United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 35

SEQ ID NO: 1459691 - DNA, 12 bp, Homo sapiens
atttatttttgt

SEQ ID NO: 1459692 - DNA, 19 bp, Homo sapiens
atttattttttacattatt

SEQ ID NO: 1459693 - DNA, 17 bp, Homo sapiens
atttattttttcttttc

SEQ ID NO: 1459694 - DNA, 22 bp, Homo sapiens
atttattttttcttttctttac

SEQ ID NO: 1459695 - DNA, 20 bp, Homo sapiens
atttcaaaaaaataaaataa

SEQ ID NO: 1459696 - DNA, 17 bp, Homo sapiens
atttcaaaaatataact

SEQ ID NO: 1459697 - DNA, 18 bp, Homo sapiens
atttcaaacttaaacaaa

SEQ ID NO: 1459698 - DNA, 16 bp, Homo sapiens
atttcaaagccctgcc

SEQ ID NO: 1459699 - DNA, 18 bp, Homo sapiens
atttcaaagccctgcctc

SEQ ID NO: 1459700 - DNA, 19 bp, Homo sapiens
atttcaaagccctgcctct

SEQ ID NO: 1459701 - DNA, 19 bp, Homo sapiens
atttcaaagttttgttgta

SEQ ID NO: 1459702 - DNA, 19 bp, Homo sapiens
atttcaagacagattgtga

SEQ ID NO: 1459703 - DNA, 20 bp, Homo sapiens
atttcaagagatttaattaa

SEQ ID NO: 1459704 - DNA, 12 bp, Homo sapiens
atttcaaggttc

SEQ ID NO: 1459705 - DNA, 11 bp, Homo sapiens
atttcaagtgc

SEQ ID NO: 1459706 - DNA, 12 bp, Homo sapiens
atttcaagtgcc

SEQ ID NO: 1459707 - DNA, 20 bp, Homo sapiens
atttcaatagctttgtagtt

SEQ ID NO: 1459708 - DNA, 17 bp, Homo sapiens
atttcaattcctggccc

SEQ ID NO: 1459709 - DNA, 20 bp, Homo sapiens
atttcacaacagatcaattt

SEQ ID NO: 1459710 - DNA, 10 bp, Homo sapiens
atttcacaag

SEQ ID NO: 1459711 - DNA, 15 bp, Homo sapiens
atttcacaagctatt

SEQ ID NO: 1459712 - DNA, 21 bp, Homo sapiens
atttcacatgagtcaaaacaa

SEQ ID NO: 1459713 - DNA, 15 bp, Homo sapiens
atttcaccagcagca

SEQ ID NO: 1459714 - DNA, 20 bp, Homo sapiens
atttcacccctccctttctc

SEQ ID NO: 1459715 - DNA, 15 bp, Homo sapiens
atttcacctgtaaac

SEQ ID NO: 1459716 - DNA, 18 bp, Homo sapiens
atttcacctgtaaacctg

SEQ ID NO: 1459717 - DNA, 15 bp, Homo sapiens
atttcacctgtgaca

SEQ ID NO: 1459718 - DNA, 18 bp, Homo sapiens
atttcactaaatgtaaaa

SEQ ID NO: 1459719 - DNA, 14 bp, Homo sapiens
atttcactattttt

SEQ ID NO: 1459720 - DNA, 22 bp, Homo sapiens
atttcactatttttatttatat

SEQ ID NO: 1459721 - DNA, 14 bp, Homo sapiens
atttcacttaataa

SEQ ID NO: 1459722 - DNA, 18 bp, Homo sapiens
atttcagaaaatgaaaaa

SEQ ID NO: 1459723 - DNA, 21 bp, Homo sapiens
atttcagaaagcctttcattt

SEQ ID NO: 1459724 - DNA, 19 bp, Homo sapiens
atttcagaagttagtttgt

SEQ ID NO: 1459725 - DNA, 15 bp, Homo sapiens
ccttccagatggtca

SEQ ID NO: 1459726 - DNA, 17 bp, Homo sapiens
ccttccagctcctgtaa

SEQ ID NO: 1459727 - DNA, 16 bp, Homo sapiens
ccttccagctgctgtc

SEQ ID NO: 1459728 - DNA, 12 bp, Homo sapiens
ccttccagggcc

SEQ ID NO: 1459729 - DNA, 13 bp, Homo sapiens
ccttccagggccc

SEQ ID NO: 1459730 - DNA, 23 bp, Homo sapiens
ccttccagggcctgagcagctgg

SEQ ID NO: 1459731 - DNA, 16 bp, Homo sapiens
ccttccaggtgggtgt

SEQ ID NO: 1459732 - DNA, 15 bp, Homo sapiens
ccttccagtggctcg

SEQ ID NO: 1459733 - DNA, 22 bp, Homo sapiens
ccttccagtggctcgctccctg

SEQ ID NO: 1459734 - DNA, 13 bp, Homo sapiens
ccttccatcttgt

SEQ ID NO: 1459735 - DNA, 20 bp, Homo sapiens
ccttccatcttgtggggcca

SEQ ID NO: 1459736 - DNA, 23 bp, Homo sapiens
ccttccatcttgtggggccagga

SEQ ID NO: 1459737 - DNA, 16 bp, Homo sapiens
ccttccatgccccagg

SEQ ID NO: 1459738 - DNA, 16 bp, Homo sapiens
ccttccatgtgccttt

SEQ ID NO: 1459739 - DNA, 13 bp, Homo sapiens
accacagctgggc

SEQ ID NO: 1459740 - DNA, 21 bp, Homo sapiens
accacaggcatctacacagcc

SEQ ID NO: 1459741 - DNA, 22 bp, Homo sapiens
accacaggcatctacacagcct

SEQ ID NO: 1459742 - DNA, 14 bp, Homo sapiens
accacagtcagtgg

SEQ ID NO: 1459743 - DNA, 17 bp, Homo sapiens
accacagtcagtggaga

SEQ ID NO: 1459744 - DNA, 19 bp, Homo sapiens
accacagtcagtggagaga

SEQ ID NO: 1459745 - DNA, 15 bp, Homo sapiens
accacagtgggtggc

SEQ ID NO: 1459746 - DNA, 16 bp, Homo sapiens
accacagtgggtggca

SEQ ID NO: 1459747 - DNA, 19 bp, Homo sapiens
accacagtgggtggcacct

SEQ ID NO: 1459748 - DNA, 21 bp, Homo sapiens
accacagtgggtggcacctcc

SEQ ID NO: 1459749 - DNA, 12 bp, Homo sapiens
accacagtgtct

SEQ ID NO: 1459750 - DNA, 23 bp, Homo sapiens
accacatagcatgcttcctttct

SEQ ID NO: 1459751 - DNA, 20 bp, Homo sapiens
accacatcctccgtccagcc

SEQ ID NO: 1459752 - DNA, 21 bp, Homo sapiens
accacatcctccgtccagccg

SEQ ID NO: 1459753 - DNA, 17 bp, Homo sapiens
accacatctttatctgt

SEQ ID NO: 1459754 - DNA, 14 bp, Homo sapiens
accacatttaatgg

SEQ ID NO: 1459755 - DNA, 21 bp, Homo sapiens
accacatttaatgggaaaaac

SEQ ID NO: 1459756 - DNA, 16 bp, Homo sapiens
accaccacgcctggct

SEQ ID NO: 1459757 - DNA, 20 bp, Homo sapiens
accaccactggccaccaggc

SEQ ID NO: 1459758 - DNA, 21 bp, Homo sapiens
accaccactggccaccaggct

SEQ ID NO: 1459759 - DNA, 13 bp, Homo sapiens
accaccagcaggc

SEQ ID NO: 1459760 - DNA, 20 bp, Homo sapiens
accaccaggagcagcagcca

SEQ ID NO: 1459761 - DNA, 20 bp, Homo sapiens
accaccccggccccctgccc

SEQ ID NO: 1459762 - DNA, 15 bp, Homo sapiens
accaccctcccctct

SEQ ID NO: 1459763 - DNA, 16 bp, Homo sapiens
accaccctcccctctc

SEQ ID NO: 1459764 - DNA, 21 bp, Homo sapiens
accaccctcccctctcttgca

SEQ ID NO: 1459765 - DNA, 23 bp, Homo sapiens
accaccctcccctctcttgcacc

SEQ ID NO: 1459766 - DNA, 21 bp, Homo sapiens
accaccctgccccccctaaga

SEQ ID NO: 1459767 - DNA, 22 bp, Homo sapiens
accaccgcctctggccgccacc

SEQ ID NO: 1459768 - DNA, 20 bp, Homo sapiens
accacctaggccactcctcc

SEQ ID NO: 1459769 - DNA, 15 bp, Homo sapiens
accacctcactcctg

SEQ ID NO: 1459770 - DNA, 16 bp, Homo sapiens
accacctcactcctgt

SEQ ID NO: 1459771 - DNA, 13 bp, Homo sapiens
accacctgcttct

SEQ ID NO: 1459772 - DNA, 15 bp, Homo sapiens
accacctgcttctga

SEQ ID NO: 1459773 - DNA, 13 bp, Homo sapiens
accaccttcccag

SEQ ID NO: 1459774 - DNA, 20 bp, Homo sapiens
accaccttcccagctctccc

SEQ ID NO: 1459775 - DNA, 15 bp, Homo sapiens
accacctttactgtg

SEQ ID NO: 1459776 - DNA, 15 bp, Homo sapiens
accacctttggctgg

SEQ ID NO: 1459777 - DNA, 19 bp, Homo sapiens
accacgactggccagggcc

SEQ ID NO: 1459778 - DNA, 14 bp, Homo sapiens
accacgcccggcta

SEQ ID NO: 1459779 - DNA, 20 bp, Homo sapiens
accacgcccgtcctgcctgt

SEQ ID NO: 1459780 - DNA, 23 bp, Homo sapiens
accacgcccgtcctgcctgtggc

SEQ ID NO: 1459781 - DNA, 18 bp, Homo sapiens
accacgcctcttgaccag

SEQ ID NO: 1459782 - DNA, 20 bp, Homo sapiens
accacgcctggctaattttt

SEQ ID NO: 1459783 - DNA, 18 bp, Homo sapiens
accacggagggagcgaca

SEQ ID NO: 1459784 - DNA, 18 bp, Homo sapiens
accacgtctgccaggccc

SEQ ID NO: 1459785 - DNA, 23 bp, Homo sapiens
accactaaaagatcgcagtttgc

SEQ ID NO: 1459786 - DNA, 18 bp, Homo sapiens
accactaaccatccccaa

SEQ ID NO: 1459787 - DNA, 13 bp, Homo sapiens
accactagaactc

SEQ ID NO: 1459788 - DNA, 20 bp, Homo sapiens
accactagaactctccatct

SEQ ID NO: 1459789 - DNA, 20 bp, Homo sapiens
accactaggaatcccagagg

SEQ ID NO: 1459790 - DNA, 12 bp, Homo sapiens
acattttaaata

SEQ ID NO: 1459791 - DNA, 19 bp, Homo sapiens
acattttccttttcaaata

SEQ ID NO: 1459792 - DNA, 13 bp, Homo sapiens
acattttctctta

SEQ ID NO: 1459793 - DNA, 12 bp, Homo sapiens
acattttgtaca

SEQ ID NO: 1459794 - DNA, 13 bp, Homo sapiens
acattttgtacat

SEQ ID NO: 1459795 - DNA, 14 bp, Homo sapiens
acattttgtatgga

SEQ ID NO: 1459796 - DNA, 16 bp, Homo sapiens
acatttttaaattctt

SEQ ID NO: 1459797 - DNA, 19 bp, Homo sapiens
acatttttaaattcttact

SEQ ID NO: 1459798 - DNA, 24 bp, Homo sapiens
acatttttaaattcttactctgga

SEQ ID NO: 1459799 - DNA, 14 bp, Homo sapiens
acatttttacaata

SEQ ID NO: 1459800 - DNA, 15 bp, Homo sapiens
acatttttacaataa

SEQ ID NO: 1459801 - DNA, 19 bp, Homo sapiens
acatttttccgtttgcttt

SEQ ID NO: 1459802 - DNA, 21 bp, Homo sapiens
acatttttccgtttgcttttg

SEQ ID NO: 1459803 - DNA, 17 bp, Homo sapiens
acattttttaagcttca

SEQ ID NO: 1459804 - DNA, 18 bp, Homo sapiens
acattttttagtctgtaa

SEQ ID NO: 1459805 - DNA, 19 bp, Homo sapiens
acattttttcttctgaaga

SEQ ID NO: 1459806 - DNA, 13 bp, Homo sapiens
acattttttgaaa

SEQ ID NO: 1459807 - DNA, 15 bp, Homo sapiens
acattttttgaaatg

SEQ ID NO: 1459808 - DNA, 18 bp, Homo sapiens
acatttttttatgctctt

SEQ ID NO: 1459809 - DNA, 18 bp, Homo sapiens
acatttttttgcatgcat

SEQ ID NO: 1459810 - DNA, 14 bp, Homo sapiens
accaaaaaatgtga

SEQ ID NO: 1459811 - DNA, 16 bp, Homo sapiens
accaaaaatagaaatt

SEQ ID NO: 1459812 - DNA, 18 bp, Homo sapiens
accaaaactgtgcagagt

SEQ ID NO: 1459813 - DNA, 13 bp, Homo sapiens
accaaaacttcca

SEQ ID NO: 1459814 - DNA, 15 bp, Homo sapiens
accaaaataataaaa

SEQ ID NO: 1459815 - DNA, 14 bp, Homo sapiens
accaaacaaggaag

SEQ ID NO: 1459816 - DNA, 14 bp, Homo sapiens
accaaacactcagt

SEQ ID NO: 1459817 - DNA, 15 bp, Homo sapiens
accaaaccagccttc

SEQ ID NO: 1459818 - DNA, 17 bp, Homo sapiens
accaaactactgaatga

SEQ ID NO: 1459819 - DNA, 18 bp, Homo sapiens
accaaactgttaaatgtg

SEQ ID NO: 1459820 - DNA, 13 bp, Homo sapiens
accaaagactgca

SEQ ID NO: 1459821 - DNA, 14 bp, Homo sapiens
accaaagactgcag

SEQ ID NO: 1459822 - DNA, 14 bp, Homo sapiens
accaaagccaccag

SEQ ID NO: 1459823 - DNA, 15 bp, Homo sapiens
accaaagcctcttca

SEQ ID NO: 1459824 - DNA, 12 bp, Homo sapiens
accaaagctgcc

SEQ ID NO: 1459825 - DNA, 18 bp, Homo sapiens
accaaagctgcccactgt

SEQ ID NO: 1459826 - DNA, 12 bp, Homo sapiens
accaaagttcta

SEQ ID NO: 1459827 - DNA, 20 bp, Homo sapiens
accaaagttctaataatttc

SEQ ID NO: 1459828 - DNA, 16 bp, Homo sapiens
accaaataaaaatatt

SEQ ID NO: 1459829 - DNA, 15 bp, Homo sapiens
accaaatattaaaga

SEQ ID NO: 1459830 - DNA, 15 bp, Homo sapiens
accaaatctggaagc

SEQ ID NO: 1459831 - DNA, 21 bp, Homo sapiens
accaacaataaatatgtatta

SEQ ID NO: 1459832 - DNA, 22 bp, Homo sapiens
accaacacccaaagcatggact

SEQ ID NO: 1459833 - DNA, 15 bp, Homo sapiens
accaacataaaacaa

SEQ ID NO: 1459834 - DNA, 16 bp, Homo sapiens
accaacataaaacaaa

SEQ ID NO: 1459835 - DNA, 14 bp, Homo sapiens
accaacatctttgc

SEQ ID NO: 1459836 - DNA, 22 bp, Homo sapiens
accaacatctttgcgaaaagat

SEQ ID NO: 1459837 - DNA, 13 bp, Homo sapiens
accaaccacagca

SEQ ID NO: 1459838 - DNA, 13 bp, Homo sapiens
accaaccaggcct

SEQ ID NO: 1459839 - DNA, 20 bp, Homo sapiens
accaacccccatctccctag

SEQ ID NO: 1459840 - DNA, 21 bp, Homo sapiens
accaacccccatctccctagc

SEQ ID NO: 1459841 - DNA, 13 bp, Homo sapiens
accaaccctgtgg

SEQ ID NO: 1459842 - DNA, 14 bp, Homo sapiens
accaaccctgtggg

SEQ ID NO: 1459843 - DNA, 19 bp, Homo sapiens
accaactatttttgaggaa

SEQ ID NO: 1459844 - DNA, 15 bp, Homo sapiens
accaactctgcactc

SEQ ID NO: 1459845 - DNA, 22 bp, Homo sapiens
accaactctgcactccatggcc

SEQ ID NO: 1459846 - DNA, 21 bp, Homo sapiens
accaactgccctaagccccca

SEQ ID NO: 1459847 - DNA, 14 bp, Homo sapiens
accaactggcttct

SEQ ID NO: 1459848 - DNA, 19 bp, Homo sapiens
accaactggcttctgtgca

SEQ ID NO: 1459849 - DNA, 23 bp, Homo sapiens
accaactgtcactcattgctgag

SEQ ID NO: 1459850 - DNA, 12 bp, Homo sapiens
accaagaactgc

SEQ ID NO: 1459851 - DNA, 15 bp, Homo sapiens
accaagaactgcatg

SEQ ID NO: 1459852 - DNA, 15 bp, Homo sapiens
accaagagagaaaga

SEQ ID NO: 1459853 - DNA, 19 bp, Homo sapiens
accaagatgcaaatgtttt

SEQ ID NO: 1459854 - DNA, 15 bp, Homo sapiens
accaagcatctttgt

SEQ ID NO: 1459855 - DNA, 16 bp, Homo sapiens
accaagccgtggcttc

SEQ ID NO: 1459856 - DNA, 17 bp, Homo sapiens
accaagccgtggcttcc

SEQ ID NO: 1459857 - DNA, 13 bp, Homo sapiens
accaagccttggc

SEQ ID NO: 1459858 - DNA, 20 bp, Homo sapiens
accaagctgtacccttgaga

SEQ ID NO: 1459859 - DNA, 18 bp, Homo sapiens
accaagcttcagagccta

SEQ ID NO: 1459860 - DNA, 22 bp, Homo sapiens
accaagcttcagagcctagcca

SEQ ID NO: 1459861 - DNA, 16 bp, Homo sapiens
accaaggaatttaaaa

SEQ ID NO: 1459862 - DNA, 20 bp, Homo sapiens
accaaggacggaaaatgctt

SEQ ID NO: 1459863 - DNA, 16 bp, Homo sapiens
accaaggcaaggcagg

SEQ ID NO: 1459864 - DNA, 18 bp, Homo sapiens
accaaggcaaggcaggtg

SEQ ID NO: 1459865 - DNA, 15 bp, Homo sapiens
accaaggcagcctcc

SEQ ID NO: 1459866 - DNA, 18 bp, Homo sapiens
accaaggcagcctccaga

SEQ ID NO: 1459867 - DNA, 22 bp, Homo sapiens
accaaggcagcctccagagcca

SEQ ID NO: 1459868 - DNA, 21 bp, Homo sapiens
accaaggggtggccgggcaca

SEQ ID NO: 1459869 - DNA, 21 bp, Homo sapiens
accaaggtacaactgtattta

SEQ ID NO: 1459870 - DNA, 20 bp, Homo sapiens
accaagtcctggctacatcc

SEQ ID NO: 1459871 - DNA, 12 bp, Homo sapiens
accaagtgaaat

SEQ ID NO: 1459872 - DNA, 13 bp, Homo sapiens
accaagtgcaata

SEQ ID NO: 1459873 - DNA, 12 bp, Homo sapiens
accaagtggctg

SEQ ID NO: 1459874 - DNA, 18 bp, Homo sapiens
accaagtgtgctaaaaat

SEQ ID NO: 1459875 - DNA, 20 bp, Homo sapiens
accaagttgtgcttttctgt

SEQ ID NO: 1459876 - DNA, 15 bp, Homo sapiens
accaataaatgtttg

SEQ ID NO: 1459877 - DNA, 15 bp, Homo sapiens
accaataaatttgta

SEQ ID NO: 1459878 - DNA, 23 bp, Homo sapiens
accaataacaaggagctcaccct

SEQ ID NO: 1459879 - DNA, 21 bp, Homo sapiens
accaataatggggcagacaca

SEQ ID NO: 1459880 - DNA, 16 bp, Homo sapiens
accaatagcccacagc

SEQ ID NO: 1459881 - DNA, 19 bp, Homo sapiens
accaatagcctgaatttga

SEQ ID NO: 1459882 - DNA, 11 bp, Homo sapiens
accaatatata

SEQ ID NO: 1459883 - DNA, 18 bp, Homo sapiens
accaatcccgtgaaagaa

SEQ ID NO: 1459884 - DNA, 22 bp, Homo sapiens
accaatgaagaagacaaagtct

SEQ ID NO: 1459885 - DNA, 14 bp, Homo sapiens
accaatgagcctta

SEQ ID NO: 1459886 - DNA, 17 bp, Homo sapiens
accaatgcctttttaga

SEQ ID NO: 1459887 - DNA, 16 bp, Homo sapiens
accaatgctgttgtaa

SEQ ID NO: 1459888 - DNA, 16 bp, Homo sapiens
accaattcaacccttt

SEQ ID NO: 1459889 - DNA, 18 bp, Homo sapiens
accaattcaccaacacag

SEQ ID NO: 1459890 - DNA, 23 bp, Homo sapiens
accaatttggtaaaaatgctgct

SEQ ID NO: 1459891 - DNA, 14 bp, Homo sapiens
accacaaaaatgaa

SEQ ID NO: 1459892 - DNA, 16 bp, Homo sapiens
accacaaaccctgctg

SEQ ID NO: 1459893 - DNA, 20 bp, Homo sapiens
accacaaagcacagtttgaa

SEQ ID NO: 1459894 - DNA, 15 bp, Homo sapiens
accacaactgacaca

SEQ ID NO: 1459895 - DNA, 13 bp, Homo sapiens
accacaagactct

SEQ ID NO: 1459896 - DNA, 16 bp, Homo sapiens
accacaagcctgagaa

SEQ ID NO: 1459897 - DNA, 17 bp, Homo sapiens
accacaatgtttcttca

SEQ ID NO: 1459898 - DNA, 21 bp, Homo sapiens
accacaatgtttcttcatttc

SEQ ID NO: 1459899 - DNA, 14 bp, Homo sapiens
accacacaaagaca

SEQ ID NO: 1459900 - DNA, 17 bp, Homo sapiens
accacaccaaccaggcc

SEQ ID NO: 1459901 - DNA, 18 bp, Homo sapiens
accacaccaaccaggcct

SEQ ID NO: 1459902 - DNA, 19 bp, Homo sapiens
accacacctggctaatttt

SEQ ID NO: 1459903 - DNA, 18 bp, Homo sapiens
accacactgaatctcccc

SEQ ID NO: 1459904 - DNA, 18 bp, Homo sapiens
accacactgggtgcgtct

SEQ ID NO: 1459905 - DNA, 23 bp, Homo sapiens
accacactgggtgcgtctccagt

SEQ ID NO: 1459906 - DNA, 17 bp, Homo sapiens
accacacttgaaacctt

SEQ ID NO: 1459907 - DNA, 15 bp, Homo sapiens
accacagacacacac

SEQ ID NO: 1459908 - DNA, 17 bp, Homo sapiens
acattgcctgttctgct

SEQ ID NO: 1459909 - DNA, 21 bp, Homo sapiens
acattgctttactgtcaaaat

SEQ ID NO: 1459910 - DNA, 19 bp, Homo sapiens
acattggcacaatgtatac

SEQ ID NO: 1459911 - DNA, 20 bp, Homo sapiens
acattggcacaatgtatact

SEQ ID NO: 1459912 - DNA, 17 bp, Homo sapiens
acattgtaaaataaagt

SEQ ID NO: 1459913 - DNA, 19 bp, Homo sapiens
acattgtacgaagagtatt

SEQ ID NO: 1459914 - DNA, 16 bp, Homo sapiens
acattgtcctgtagct

SEQ ID NO: 1459915 - DNA, 15 bp, Homo sapiens
acattgtgtctagga

SEQ ID NO: 1459916 - DNA, 23 bp, Homo sapiens
acattgtgtgaaaaaagaaaatg

SEQ ID NO: 1459917 - DNA, 16 bp, Homo sapiens
acattgttaaaataaa

SEQ ID NO: 1459918 - DNA, 15 bp, Homo sapiens
acattgttttaaaaa

SEQ ID NO: 1459919 - DNA, 12 bp, Homo sapiens
acatttaaaatt

SEQ ID NO: 1459920 - DNA, 23 bp, Homo sapiens
acatttaaattttaccctttaga

SEQ ID NO: 1459921 - DNA, 15 bp, Homo sapiens
acatttaataaaact

SEQ ID NO: 1459922 - DNA, 17 bp, Homo sapiens
acatttacaataaatat

SEQ ID NO: 1459923 - DNA, 22 bp, Homo sapiens
acatttaccctttggccccact

SEQ ID NO: 1459924 - DNA, 18 bp, Homo sapiens
acatttagaagaaagatg

SEQ ID NO: 1459925 - DNA, 13 bp, Homo sapiens
acatttagatcct

SEQ ID NO: 1459926 - DNA, 15 bp, Homo sapiens
acatttataatgttt

SEQ ID NO: 1459927 - DNA, 13 bp, Homo sapiens
acatttatgacct

SEQ ID NO: 1459928 - DNA, 19 bp, Homo sapiens
acatttatgtgaggtaatt

SEQ ID NO: 1459929 - DNA, 16 bp, Homo sapiens
acatttcatacaacag

SEQ ID NO: 1459930 - DNA, 18 bp, Homo sapiens
acatttccttacagaact

SEQ ID NO: 1459931 - DNA, 23 bp, Homo sapiens
acatttctaagtcaaacacttgt

SEQ ID NO: 1459932 - DNA, 22 bp, Homo sapiens
acatttctcctttgataaaata

SEQ ID NO: 1459933 - DNA, 20 bp, Homo sapiens
acatttctctaactcctgcc

SEQ ID NO: 1459934 - DNA, 16 bp, Homo sapiens
acatttctctccacct

SEQ ID NO: 1459935 - DNA, 12 bp, Homo sapiens
acatttctggat

SEQ ID NO: 1459936 - DNA, 14 bp, Homo sapiens
acatttctgttctc

SEQ ID NO: 1459937 - DNA, 23 bp, Homo sapiens
acatttcttagactacatttaga

SEQ ID NO: 1459938 - DNA, 12 bp, Homo sapiens
acatttgatatt

SEQ ID NO: 1459939 - DNA, 20 bp, Homo sapiens
acatttgatgcatgtctttt

SEQ ID NO: 1459940 - DNA, 22 bp, Homo sapiens
acatttgatgcatgtcttttaa

SEQ ID NO: 1459941 - DNA, 15 bp, Homo sapiens
acatttgccaagtga

SEQ ID NO: 1459942 - DNA, 21 bp, Homo sapiens
acatttgctttaatgagtgca

SEQ ID NO: 1459943 - DNA, 17 bp, Homo sapiens
acatttggccacaaaac

SEQ ID NO: 1459944 - DNA, 15 bp, Homo sapiens
acatttgggctcagg

SEQ ID NO: 1459945 - DNA, 17 bp, Homo sapiens
acatttggtaatgtttt

SEQ ID NO: 1459946 - DNA, 19 bp, Homo sapiens
acatttggtaatgttttta

SEQ ID NO: 1459947 - DNA, 22 bp, Homo sapiens
acatttggtggtactttattct

SEQ ID NO: 1459948 - DNA, 14 bp, Homo sapiens
acatttgtagttga

SEQ ID NO: 1459949 - DNA, 12 bp, Homo sapiens
acatttgtatat

SEQ ID NO: 1459950 - DNA, 18 bp, Homo sapiens
acatttgtatattgtgga

SEQ ID NO: 1459951 - DNA, 14 bp, Homo sapiens
acatttgtatttat

SEQ ID NO: 1459952 - DNA, 21 bp, Homo sapiens
acatttgtatttatgtggctg

SEQ ID NO: 1459953 - DNA, 20 bp, Homo sapiens
acatttgtattttgtgatga

SEQ ID NO: 1459954 - DNA, 14 bp, Homo sapiens
acatttgtttcccc

SEQ ID NO: 1459955 - DNA, 18 bp, Homo sapiens
acatttgtttgtattcat

SEQ ID NO: 1459956 - DNA, 20 bp, Homo sapiens
acatttgtttgtattcatgt

SEQ ID NO: 1459957 - DNA, 12 bp, Homo sapiens
gcctggactgac

SEQ ID NO: 1459958 - DNA, 14 bp, Homo sapiens
gcctggactgacca

SEQ ID NO: 1459959 - DNA, 16 bp, Homo sapiens
gcctggactgaccaca

SEQ ID NO: 1459960 - DNA, 14 bp, Homo sapiens
gcctggactgactg

SEQ ID NO: 1459961 - DNA, 19 bp, Homo sapiens
gcctggactgactgcagcc

SEQ ID NO: 1459962 - DNA, 16 bp, Homo sapiens
gcctggactttcctgc

SEQ ID NO: 1459963 - DNA, 17 bp, Homo sapiens
gcctggactttcctgca

SEQ ID NO: 1459964 - DNA, 18 bp, Homo sapiens
gcctggactttcctgcaa

SEQ ID NO: 1459965 - DNA, 20 bp, Homo sapiens
gcctggagacaaggtgctaa

SEQ ID NO: 1459966 - DNA, 21 bp, Homo sapiens
gcctggagacaaggtgctaac

SEQ ID NO: 1459967 - DNA, 14 bp, Homo sapiens
gcctggagcatgga

SEQ ID NO: 1459968 - DNA, 17 bp, Homo sapiens
gcctggagcatggacag

SEQ ID NO: 1459969 - DNA, 13 bp, Homo sapiens
gcctggagcccca

SEQ ID NO: 1459970 - DNA, 18 bp, Homo sapiens
gcctggagccccatcggc

SEQ ID NO: 1459971 - DNA, 13 bp, Homo sapiens
gcctggagctaat

SEQ ID NO: 1459972 - DNA, 20 bp, Homo sapiens
gcctggaggtctggctgagc

SEQ ID NO: 1459973 - DNA, 21 bp, Homo sapiens
gcctggaggtctggctgagcc

SEQ ID NO: 1459974 - DNA, 22 bp, Homo sapiens
gcctggaggtctggctgagccc

SEQ ID NO: 1459975 - DNA, 21 bp, Homo sapiens
gcctggatattattcttgtag

SEQ ID NO: 1459976 - DNA, 17 bp, Homo sapiens
gcctggatgagaaacag

SEQ ID NO: 1459977 - DNA, 20 bp, Homo sapiens
gcctggatgttgctgtgcac

SEQ ID NO: 1459978 - DNA, 18 bp, Homo sapiens
gcctggattcatttcctg

SEQ ID NO: 1459979 - DNA, 20 bp, Homo sapiens
gcctggattcatttcctgcc

SEQ ID NO: 1459980 - DNA, 18 bp, Homo sapiens
gcctggcaacagagcgag

SEQ ID NO: 1459981 - DNA, 16 bp, Homo sapiens
gcctggcacacatcag

SEQ ID NO: 1459982 - DNA, 15 bp, Homo sapiens
gcctggcacaggact

SEQ ID NO: 1459983 - DNA, 13 bp, Homo sapiens
gcctggcacaggg

SEQ ID NO: 1459984 - DNA, 18 bp, Homo sapiens
gcctggcacatcagaaag

SEQ ID NO: 1459985 - DNA, 20 bp, Homo sapiens
gcctggcagccgtgccttca

SEQ ID NO: 1459986 - DNA, 14 bp, Homo sapiens
gcctggccacctct

SEQ ID NO: 1459987 - DNA, 17 bp, Homo sapiens
gcctggccacgcagcca

SEQ ID NO: 1459988 - DNA, 18 bp, Homo sapiens
gcctggccacgcagccag

SEQ ID NO: 1459989 - DNA, 13 bp, Homo sapiens
gcctggccagaca

SEQ ID NO: 1459990 - DNA, 14 bp, Homo sapiens
gcctggccagacac

SEQ ID NO: 1459991 - DNA, 16 bp, Homo sapiens
gcctggccagacacag

SEQ ID NO: 1459992 - DNA, 14 bp, Homo sapiens
gcctggccaggagc

SEQ ID NO: 1459993 - DNA, 15 bp, Homo sapiens
gcctggccaggagct

SEQ ID NO: 1459994 - DNA, 23 bp, Homo sapiens
gcctggccaggcagatctgtgcc

SEQ ID NO: 1459995 - DNA, 15 bp, Homo sapiens
gcctggccaggccct

SEQ ID NO: 1459996 - DNA, 16 bp, Homo sapiens
gcctggccagtcctgg

SEQ ID NO: 1459997 - DNA, 20 bp, Homo sapiens
gcctggccagtcctggtcct

SEQ ID NO: 1459998 - DNA, 16 bp, Homo sapiens
gcctggccagtcttcc

SEQ ID NO: 1459999 - DNA, 18 bp, Homo sapiens
gcctggccagtcttcctc

SEQ ID NO: 1460000 - DNA, 14 bp, Homo sapiens
gcctggccatttcc

SEQ ID NO: 1460001 - DNA, 17 bp, Homo sapiens
gcctggcccacgccctc

SEQ ID NO: 1460002 - DNA, 14 bp, Homo sapiens
gcctggcccataga

SEQ ID NO: 1460003 - DNA, 22 bp, Homo sapiens
gcctggcccccaacctcagggc

SEQ ID NO: 1460004 - DNA, 15 bp, Homo sapiens
gcctggccggctcca

SEQ ID NO: 1460005 - DNA, 13 bp, Homo sapiens
gcctggcctccag

SEQ ID NO: 1460006 - DNA, 15 bp, Homo sapiens
gcctggcctccagct

SEQ ID NO: 1460007 - DNA, 12 bp, Homo sapiens
gcctggcctctg

SEQ ID NO: 1460008 - DNA, 14 bp, Homo sapiens
gcctggcctctggg

SEQ ID NO: 1460009 - DNA, 22 bp, Homo sapiens
gcctggcctctgggcagtgtgg

SEQ ID NO: 1460010 - DNA, 12 bp, Homo sapiens
gcctggcctgag

SEQ ID NO: 1460011 - DNA, 17 bp, Homo sapiens
gcctggcctgagctggg

SEQ ID NO: 1460012 - DNA, 14 bp, Homo sapiens
gcctggcctggctc

SEQ ID NO: 1460013 - DNA, 15 bp, Homo sapiens
gcctggcctggctcc

SEQ ID NO: 1460014 - DNA, 19 bp, Homo sapiens
gcctggcgacagagcgaga

SEQ ID NO: 1460015 - DNA, 16 bp, Homo sapiens
gcctggctcccaggac

SEQ ID NO: 1460016 - DNA, 18 bp, Homo sapiens
gcctggctcccaggacac

SEQ ID NO: 1460017 - DNA, 13 bp, Homo sapiens
gcctggctcccca

SEQ ID NO: 1460018 - DNA, 16 bp, Homo sapiens
gcctggctccgtccag

SEQ ID NO: 1460019 - DNA, 12 bp, Homo sapiens
gcctggctgtgg

SEQ ID NO: 1460020 - DNA, 14 bp, Homo sapiens
gcctggctgtggag

SEQ ID NO: 1460021 - DNA, 19 bp, Homo sapiens
gcctggctgtggaggcctg

SEQ ID NO: 1460022 - DNA, 24 bp, Homo sapiens
gcctggctgtggaggcctgatgct

SEQ ID NO: 1460023 - DNA, 14 bp, Homo sapiens
gcctggcttgctcc

SEQ ID NO: 1460024 - DNA, 15 bp, Homo sapiens
gcctgggaatgtatt

SEQ ID NO: 1460025 - DNA, 17 bp, Homo sapiens
gcctgggacccagctac

SEQ ID NO: 1460026 - DNA, 17 bp, Homo sapiens
gcctgggactcccagtg

SEQ ID NO: 1460027 - DNA, 17 bp, Homo sapiens
gcctgggacttccatgc

SEQ ID NO: 1460028 - DNA, 17 bp, Homo sapiens
gcctgggagcccagagg

SEQ ID NO: 1460029 - DNA, 12 bp, Homo sapiens
gcctgggagggt

SEQ ID NO: 1460030 - DNA, 20 bp, Homo sapiens
gcctgggagggttcccctgg

SEQ ID NO: 1460031 - DNA, 18 bp, Homo sapiens
gcctgggatgggctccca

SEQ ID NO: 1460032 - DNA, 19 bp, Homo sapiens
gcctgggcaacagagcaag

SEQ ID NO: 1460033 - DNA, 22 bp, Homo sapiens
gcctgggcaacatagtgagacc

SEQ ID NO: 1460034 - DNA, 13 bp, Homo sapiens
gcctgggcagcat

SEQ ID NO: 1460035 - DNA, 17 bp, Homo sapiens
gcctgggcagccaggct

SEQ ID NO: 1460036 - DNA, 18 bp, Homo sapiens
gcctgggcagccaggctg

SEQ ID NO: 1460037 - DNA, 13 bp, Homo sapiens
gcctgggccacac

SEQ ID NO: 1460038 - DNA, 21 bp, Homo sapiens
gcctgggccacacctgagcgc

SEQ ID NO: 1460039 - DNA, 16 bp, Homo sapiens
gcctgggccagagaag

SEQ ID NO: 1460040 - DNA, 15 bp, Homo sapiens
gcctgggccctgggc

SEQ ID NO: 1460041 - DNA, 16 bp, Homo sapiens
gcctgggccgctgcca

SEQ ID NO: 1460042 - DNA, 16 bp, Homo sapiens
gcctgggcctcatggc

SEQ ID NO: 1460043 - DNA, 14 bp, Homo sapiens
gcctgggcctgctt

SEQ ID NO: 1460044 - DNA, 22 bp, Homo sapiens
gcctgggcctgcttttccagga

SEQ ID NO: 1460045 - DNA, 15 bp, Homo sapiens
gcctgggcctgtgca

SEQ ID NO: 1460046 - DNA, 20 bp, Homo sapiens
gcctgggcctgtgcagcagc

SEQ ID NO: 1460047 - DNA, 21 bp, Homo sapiens
gcctgggcctgtgcagcagcc

SEQ ID NO: 1460048 - DNA, 12 bp, Homo sapiens
gcctgggctcac

SEQ ID NO: 1460049 - DNA, 21 bp, Homo sapiens
gcctgggctgaccccggtggc

SEQ ID NO: 1460050 - DNA, 15 bp, Homo sapiens
gcctgggctgggaaa

SEQ ID NO: 1460051 - DNA, 15 bp, Homo sapiens
gcctgggctgttggc

SEQ ID NO: 1460052 - DNA, 18 bp, Homo sapiens
gcctgggctgttggcact

SEQ ID NO: 1460053 - DNA, 20 bp, Homo sapiens
gcctggggcctccagaagct

SEQ ID NO: 1460054 - DNA, 14 bp, Homo sapiens
gcctggggctccct

SEQ ID NO: 1460055 - DNA, 16 bp, Homo sapiens
gcctggggctccctct

SEQ ID NO: 1460056 - DNA, 23 bp, Homo sapiens
gcctggggctccgaaattccaag

SEQ ID NO: 1460057 - DNA, 18 bp, Homo sapiens
aaatagtttaggagaaac

SEQ ID NO: 1460058 - DNA, 20 bp, Homo sapiens
aaatagtttgaattcagtaa

SEQ ID NO: 1460059 - DNA, 18 bp, Homo sapiens
aaatataaaattatgaga

SEQ ID NO: 1460060 - DNA, 22 bp, Homo sapiens
aaatataaacaaagattcatga

SEQ ID NO: 1460061 - DNA, 17 bp, Homo sapiens
aaatataacacattttt

SEQ ID NO: 1460062 - DNA, 12 bp, Homo sapiens
aaatataattct

SEQ ID NO: 1460063 - DNA, 16 bp, Homo sapiens
aaatatacattttcta

SEQ ID NO: 1460064 - DNA, 18 bp, Homo sapiens
aaatatagatcagttata

SEQ ID NO: 1460065 - DNA, 12 bp, Homo sapiens
aaatatataata

SEQ ID NO: 1460066 - DNA, 22 bp, Homo sapiens
aaatatatatagatatgtatat

SEQ ID NO: 1460067 - DNA, 18 bp, Homo sapiens
aaatatattacttaactg

SEQ ID NO: 1460068 - DNA, 19 bp, Homo sapiens
aaatatcagacaagcacta

SEQ ID NO: 1460069 - DNA, 20 bp, Homo sapiens
aaatatcagacaagcactat

SEQ ID NO: 1460070 - DNA, 22 bp, Homo sapiens
aaatatcagacaagcactattt

SEQ ID NO: 1460071 - DNA, 12 bp, Homo sapiens
aaatatcagtat

SEQ ID NO: 1460072 - DNA, 12 bp, Homo sapiens
aaatatcatgtt

SEQ ID NO: 1460073 - DNA, 17 bp, Homo sapiens
aaatatccacagtactc

SEQ ID NO: 1460074 - DNA, 22 bp, Homo sapiens
aaatatccatttatcttttgta

SEQ ID NO: 1460075 - DNA, 19 bp, Homo sapiens
aaatatccttgatgtacag

SEQ ID NO: 1460076 - DNA, 19 bp, Homo sapiens
aaatatcgctgatgcagac

SEQ ID NO: 1460077 - DNA, 21 bp, Homo sapiens
aaatatcgctgatgcagacac

SEQ ID NO: 1460078 - DNA, 19 bp, Homo sapiens
aaatatctagtaatatatt

SEQ ID NO: 1460079 - DNA, 17 bp, Homo sapiens
aaatatctgaaaatgta

SEQ ID NO: 1460080 - DNA, 22 bp, Homo sapiens
aaatatctgaaaatgtatgtgt

SEQ ID NO: 1460081 - DNA, 23 bp, Homo sapiens
aaatatctgaaaatgtatgtgta

SEQ ID NO: 1460082 - DNA, 13 bp, Homo sapiens
aaatatctgtatt

SEQ ID NO: 1460083 - DNA, 14 bp, Homo sapiens
aaatatctgttatt

SEQ ID NO: 1460084 - DNA, 20 bp, Homo sapiens
aaatatgaacctattttcat

SEQ ID NO: 1460085 - DNA, 23 bp, Homo sapiens
aaatatgaacctattttcatttg

SEQ ID NO: 1460086 - DNA, 13 bp, Homo sapiens
aaatatgaatgaa

SEQ ID NO: 1460087 - DNA, 22 bp, Homo sapiens
aaatatgatactctcagatttt

SEQ ID NO: 1460088 - DNA, 20 bp, Homo sapiens
aaatatgattttatttgaca

SEQ ID NO: 1460089 - DNA, 17 bp, Homo sapiens
aaatatgcaaagcactg

SEQ ID NO: 1460090 - DNA, 22 bp, Homo sapiens
aaatatgctgttatgtccagaa

SEQ ID NO: 1460091 - DNA, 13 bp, Homo sapiens
aaatatgtaatat

SEQ ID NO: 1460092 - DNA, 20 bp, Homo sapiens
aaatatgtaatttcaaaata

SEQ ID NO: 1460093 - DNA, 12 bp, Homo sapiens
aaatatgtagat

SEQ ID NO: 1460094 - DNA, 15 bp, Homo sapiens
aaatattaagcatgt

SEQ ID NO: 1460095 - DNA, 20 bp, Homo sapiens
aaatattataacttaaaaaa

SEQ ID NO: 1460096 - DNA, 15 bp, Homo sapiens
aaatattatgtgttt

SEQ ID NO: 1460097 - DNA, 20 bp, Homo sapiens
aaatattattttatgaaagg

SEQ ID NO: 1460098 - DNA, 13 bp, Homo sapiens
aaatattcactct

SEQ ID NO: 1460099 - DNA, 17 bp, Homo sapiens
aaatattcactctccat

SEQ ID NO: 1460100 - DNA, 22 bp, Homo sapiens
aaatattcactctccattagaa

SEQ ID NO: 1460101 - DNA, 14 bp, Homo sapiens
aaatattcagaaat

SEQ ID NO: 1460102 - DNA, 13 bp, Homo sapiens
aaatattctctct

SEQ ID NO: 1460103 - DNA, 15 bp, Homo sapiens
aaatattctttctca

SEQ ID NO: 1460104 - DNA, 17 bp, Homo sapiens
aaatattgttgacaact

SEQ ID NO: 1460105 - DNA, 12 bp, Homo sapiens
aaatatttaagt

SEQ ID NO: 1460106 - DNA, 14 bp, Homo sapiens
aaatatttaagtga

SEQ ID NO: 1460107 - DNA, 20 bp, Homo sapiens
aaatatttaagtgaaggaga

SEQ ID NO: 1460108 - DNA, 15 bp, Homo sapiens
aaatatttaatatca

SEQ ID NO: 1460109 - DNA, 17 bp, Homo sapiens
aaatatttaatgttgaa

SEQ ID NO: 1460110 - DNA, 15 bp, Homo sapiens
aaatatttatgaaga

SEQ ID NO: 1460111 - DNA, 16 bp, Homo sapiens
aaatatttatgaagaa

SEQ ID NO: 1460112 - DNA, 13 bp, Homo sapiens
aaatatttatttt

SEQ ID NO: 1460113 - DNA, 17 bp, Homo sapiens
aaatatttcagatatca

SEQ ID NO: 1460114 - DNA, 20 bp, Homo sapiens
aaatatttcctgacttgagt

SEQ ID NO: 1460115 - DNA, 12 bp, Homo sapiens
aaatatttcctt

SEQ ID NO: 1460116 - DNA, 14 bp, Homo sapiens
aaatatttccttaa

SEQ ID NO: 1460117 - DNA, 13 bp, Homo sapiens
aaatatttctgag

SEQ ID NO: 1460118 - DNA, 14 bp, Homo sapiens
aaatatttgtacat

SEQ ID NO: 1460119 - DNA, 20 bp, Homo sapiens
aaatattttcatacagcatt

SEQ ID NO: 1460120 - DNA, 22 bp, Homo sapiens
aaatattttccgtcacttaaat

SEQ ID NO: 1460121 - DNA, 15 bp, Homo sapiens
aaatattttctctgt

SEQ ID NO: 1460122 - DNA, 21 bp, Homo sapiens
aaatattttctctgtactttt

SEQ ID NO: 1460123 - DNA, 11 bp, Homo sapiens
aaatattttgc

SEQ ID NO: 1460124 - DNA, 15 bp, Homo sapiens
aaatattttgctaac

SEQ ID NO: 1460125 - DNA, 14 bp, Homo sapiens
aaatatttttagta

SEQ ID NO: 1460126 - DNA, 23 bp, Homo sapiens
aaatatttttggggcatcctgga

SEQ ID NO: 1460127 - DNA, 19 bp, Homo sapiens
aaatatttttttctagcta

SEQ ID NO: 1460128 - DNA, 21 bp, Homo sapiens
aaatatttttttctagctata

SEQ ID NO: 1460129 - DNA, 22 bp, Homo sapiens
aaatatttttttctagctataa

SEQ ID NO: 1460130 - DNA, 15 bp, Homo sapiens
aaatcaaagaacaga

SEQ ID NO: 1460131 - DNA, 17 bp, Homo sapiens
aaatcaaagaacagatg

SEQ ID NO: 1460132 - DNA, 19 bp, Homo sapiens
aaatcaaatatgcaaagca

SEQ ID NO: 1460133 - DNA, 13 bp, Homo sapiens
aaatcaaatgtat

SEQ ID NO: 1460134 - DNA, 14 bp, Homo sapiens
atactacctagaag

SEQ ID NO: 1460135 - DNA, 18 bp, Homo sapiens
atactactgaaacagatt

SEQ ID NO: 1460136 - DNA, 21 bp, Homo sapiens
atactactgaaacagatttca

SEQ ID NO: 1460137 - DNA, 20 bp, Homo sapiens
atactagggagccatttgag

SEQ ID NO: 1460138 - DNA, 13 bp, Homo sapiens
atactatttaaga

SEQ ID NO: 1460139 - DNA, 16 bp, Homo sapiens
atactatttaagatgt

SEQ ID NO: 1460140 - DNA, 21 bp, Homo sapiens
atactatttaagatgtgaaaa

SEQ ID NO: 1460141 - DNA, 18 bp, Homo sapiens
atactatttagattttct

SEQ ID NO: 1460142 - DNA, 23 bp, Homo sapiens
atactatttagtttttgtaattt

SEQ ID NO: 1460143 - DNA, 14 bp, Homo sapiens
atactcatgtgcaa

SEQ ID NO: 1460144 - DNA, 12 bp, Homo sapiens
atactccagaga

SEQ ID NO: 1460145 - DNA, 13 bp, Homo sapiens
atactcctgtcac

SEQ ID NO: 1460146 - DNA, 12 bp, Homo sapiens
atactccttccc

SEQ ID NO: 1460147 - DNA, 19 bp, Homo sapiens
atactccttgcttcctgat

SEQ ID NO: 1460148 - DNA, 21 bp, Homo sapiens
atactctagaacatgcacatt

SEQ ID NO: 1460149 - DNA, 20 bp, Homo sapiens
atactctcaccatttggatc

SEQ ID NO: 1460150 - DNA, 15 bp, Homo sapiens
atactctgtcagatg

SEQ ID NO: 1460151 - DNA, 21 bp, Homo sapiens
atactctgtgtaatctctgat

SEQ ID NO: 1460152 - DNA, 21 bp, Homo sapiens
atactcttaggaagagaaacc

SEQ ID NO: 1460153 - DNA, 22 bp, Homo sapiens
atactcttaggaagagaaacca

SEQ ID NO: 1460154 - DNA, 22 bp, Homo sapiens
atactgaaggaaaaacacaagc

SEQ ID NO: 1460155 - DNA, 14 bp, Homo sapiens
atactgagggacca

SEQ ID NO: 1460156 - DNA, 15 bp, Homo sapiens
atactgcatactttt

SEQ ID NO: 1460157 - DNA, 21 bp, Homo sapiens
atactgcctagaaaatgcaaa

SEQ ID NO: 1460158 - DNA, 11 bp, Homo sapiens
atactgctctg

SEQ ID NO: 1460159 - DNA, 13 bp, Homo sapiens
atactgctctgaa

SEQ ID NO: 1460160 - DNA, 13 bp, Homo sapiens
atactgcttgtca

SEQ ID NO: 1460161 - DNA, 15 bp, Homo sapiens
atactggcacagagg

SEQ ID NO: 1460162 - DNA, 15 bp, Homo sapiens
atactggcctggact

SEQ ID NO: 1460163 - DNA, 23 bp, Homo sapiens
atactgggacaccattaccaaaa

SEQ ID NO: 1460164 - DNA, 16 bp, Homo sapiens
atactgtacttaataa

SEQ ID NO: 1460165 - DNA, 16 bp, Homo sapiens
atactgtagtattctt

SEQ ID NO: 1460166 - DNA, 13 bp, Homo sapiens
atactgtattaag

SEQ ID NO: 1460167 - DNA, 15 bp, Homo sapiens
atactgtattaagag

SEQ ID NO: 1460168 - DNA, 16 bp, Homo sapiens
atactgtattaagagt

SEQ ID NO: 1460169 - DNA, 20 bp, Homo sapiens
atactgtattaagagtgaaa

SEQ ID NO: 1460170 - DNA, 23 bp, Homo sapiens
atactgtctgggattaagggcaa

SEQ ID NO: 1460171 - DNA, 18 bp, Homo sapiens
atactgtgagcttacatt

SEQ ID NO: 1460172 - DNA, 20 bp, Homo sapiens
atactgtgagcttacattga

SEQ ID NO: 1460173 - DNA, 22 bp, Homo sapiens
atactgtgtgcttgttttataa

SEQ ID NO: 1460174 - DNA, 15 bp, Homo sapiens
atactgtgtgggata

SEQ ID NO: 1460175 - DNA, 14 bp, Homo sapiens
atactgtgtgtttt

SEQ ID NO: 1460176 - DNA, 21 bp, Homo sapiens
atactgtgtgttttcccaaag

SEQ ID NO: 1460177 - DNA, 18 bp, Homo sapiens
atactgttattctttgca

SEQ ID NO: 1460178 - DNA, 20 bp, Homo sapiens
atactgttattctttgcact

SEQ ID NO: 1460179 - DNA, 21 bp, Homo sapiens
atacttaaatggaaaaaatga

SEQ ID NO: 1460180 - DNA, 12 bp, Homo sapiens
atacttaaatgt

SEQ ID NO: 1460181 - DNA, 14 bp, Homo sapiens
atacttaagcaaaa

SEQ ID NO: 1460182 - DNA, 20 bp, Homo sapiens
atacttagtggtatgtctct

SEQ ID NO: 1460183 - DNA, 21 bp, Homo sapiens
atacttagtggtatgtctctt

SEQ ID NO: 1460184 - DNA, 18 bp, Homo sapiens
atacttatttgtatatgg

SEQ ID NO: 1460185 - DNA, 20 bp, Homo sapiens
atacttattttctgttcaga

SEQ ID NO: 1460186 - DNA, 18 bp, Homo sapiens
atacttcaggtgcttttg

SEQ ID NO: 1460187 - DNA, 14 bp, Homo sapiens
atacttcctggatt

SEQ ID NO: 1460188 - DNA, 17 bp, Homo sapiens
atacttcgatgatgatg

SEQ ID NO: 1460189 - DNA, 15 bp, Homo sapiens
atacttctctcagat

SEQ ID NO: 1460190 - DNA, 20 bp, Homo sapiens
atacttcttacttgtctgta

SEQ ID NO: 1460191 - DNA, 21 bp, Homo sapiens
atacttgaagggccagagcca

SEQ ID NO: 1460192 - DNA, 20 bp, Homo sapiens
atacttgtttttgtaaagaa

SEQ ID NO: 1460193 - DNA, 14 bp, Homo sapiens
atactttacaaacc

SEQ ID NO: 1460194 - DNA, 17 bp, Homo sapiens
attgcactgctgttcct

SEQ ID NO: 1460195 - DNA, 13 bp, Homo sapiens
attgcacttttaa

SEQ ID NO: 1460196 - DNA, 17 bp, Homo sapiens
attgcagaaaggagaga

SEQ ID NO: 1460197 - DNA, 13 bp, Homo sapiens
attgcagaattgt

SEQ ID NO: 1460198 - DNA, 17 bp, Homo sapiens
attgcagacctgtcacc

SEQ ID NO: 1460199 - DNA, 22 bp, Homo sapiens
attgcagatatgggactgattc

SEQ ID NO: 1460200 - DNA, 15 bp, Homo sapiens
attgcagctcactgc

SEQ ID NO: 1460201 - DNA, 19 bp, Homo sapiens
attgcagtcatagaagaga

SEQ ID NO: 1460202 - DNA, 24 bp, Homo sapiens
attgcagttagccccagaaaatga

SEQ ID NO: 1460203 - DNA, 19 bp, Homo sapiens
attgcagttcaaatcctca

SEQ ID NO: 1460204 - DNA, 15 bp, Homo sapiens
attgcatactttgta

SEQ ID NO: 1460205 - DNA, 19 bp, Homo sapiens
attgcatcactgtatcatt

SEQ ID NO: 1460206 - DNA, 15 bp, Homo sapiens
attgcatttctgctc

SEQ ID NO: 1460207 - DNA, 15 bp, Homo sapiens
attgccacggaaaca

SEQ ID NO: 1460208 - DNA, 21 bp, Homo sapiens
attgccagctgacatcttgaa

SEQ ID NO: 1460209 - DNA, 18 bp, Homo sapiens
attgcccaggctgttctt

SEQ ID NO: 1460210 - DNA, 22 bp, Homo sapiens
attgccccatccagacctggct

SEQ ID NO: 1460211 - DNA, 23 bp, Homo sapiens
attgccccatccagacctggctc

SEQ ID NO: 1460212 - DNA, 20 bp, Homo sapiens
attgcccccatggggtcctt

SEQ ID NO: 1460213 - DNA, 22 bp, Homo sapiens
attgcctagaaatatctttctc

SEQ ID NO: 1460214 - DNA, 14 bp, Homo sapiens
attgcctcccaggc

SEQ ID NO: 1460215 - DNA, 21 bp, Homo sapiens
attgcctcctgttctgcccac

SEQ ID NO: 1460216 - DNA, 11 bp, Homo sapiens
attgcctctga

SEQ ID NO: 1460217 - DNA, 13 bp, Homo sapiens
attgcctctgaaa

SEQ ID NO: 1460218 - DNA, 16 bp, Homo sapiens
attgcctggactgacc

SEQ ID NO: 1460219 - DNA, 14 bp, Homo sapiens
attgcctgtttctg

SEQ ID NO: 1460220 - DNA, 21 bp, Homo sapiens
attgccttatttgtctgtaaa

SEQ ID NO: 1460221 - DNA, 19 bp, Homo sapiens
attgcgccattgcactcca

SEQ ID NO: 1460222 - DNA, 15 bp, Homo sapiens
attgcgtagaggcta

SEQ ID NO: 1460223 - DNA, 15 bp, Homo sapiens
attgctaaaaaataa

SEQ ID NO: 1460224 - DNA, 13 bp, Homo sapiens
attgctaattgtg

SEQ ID NO: 1460225 - DNA, 23 bp, Homo sapiens
attgctaccacagacttgcactg

SEQ ID NO: 1460226 - DNA, 14 bp, Homo sapiens
attgctagataaaa

SEQ ID NO: 1460227 - DNA, 16 bp, Homo sapiens
attgctatcttttctg

SEQ ID NO: 1460228 - DNA, 15 bp, Homo sapiens
attgctatgttacta

SEQ ID NO: 1460229 - DNA, 20 bp, Homo sapiens
attgctatgttactattttc

SEQ ID NO: 1460230 - DNA, 21 bp, Homo sapiens
attgctattttatttgtattc

SEQ ID NO: 1460231 - DNA, 13 bp, Homo sapiens
attgctcacagtt

SEQ ID NO: 1460232 - DNA, 17 bp, Homo sapiens
attgctcacagttatta

SEQ ID NO: 1460233 - DNA, 13 bp, Homo sapiens
attgctcagcccg

SEQ ID NO: 1460234 - DNA, 14 bp, Homo sapiens
attgctcagcccgc

SEQ ID NO: 1460235 - DNA, 15 bp, Homo sapiens
attgctcagcccgct

SEQ ID NO: 1460236 - DNA, 18 bp, Homo sapiens
attgctcagcccgcttgg

SEQ ID NO: 1460237 - DNA, 23 bp, Homo sapiens
attgctcagcccgcttggccacc

SEQ ID NO: 1460238 - DNA, 16 bp, Homo sapiens
attgctctatgtctgc

SEQ ID NO: 1460239 - DNA, 12 bp, Homo sapiens
attgctctggag

SEQ ID NO: 1460240 - DNA, 14 bp, Homo sapiens
attgctctggagca

SEQ ID NO: 1460241 - DNA, 13 bp, Homo sapiens
attgctgaaattt

SEQ ID NO: 1460242 - DNA, 16 bp, Homo sapiens
attgctgatgtagtat

SEQ ID NO: 1460243 - DNA, 16 bp, Homo sapiens
attgctgcatatttga

SEQ ID NO: 1460244 - DNA, 18 bp, Homo sapiens
attgctgcatatttgtgc

SEQ ID NO: 1460245 - DNA, 22 bp, Homo sapiens
attgctgccataattctaagtt

SEQ ID NO: 1460246 - DNA, 14 bp, Homo sapiens
attgctggttctat

SEQ ID NO: 1460247 - DNA, 22 bp, Homo sapiens
attgctgtaccacatctgctct

SEQ ID NO: 1460248 - DNA, 20 bp, Homo sapiens
attgctgtattttagaaaat

SEQ ID NO: 1460249 - DNA, 14 bp, Homo sapiens
attgctgtcctgga

SEQ ID NO: 1460250 - DNA, 17 bp, Homo sapiens
attgctgtgtgtcccag

SEQ ID NO: 1460251 - DNA, 18 bp, Homo sapiens
attgctgtgtgtcccagg

SEQ ID NO: 1460252 - DNA, 17 bp, Homo sapiens
attgcttaaaagacatt

SEQ ID NO: 1460253 - DNA, 16 bp, Homo sapiens
attgcttaaaatagca

SEQ ID NO: 1460254 - DNA, 17 bp, Homo sapiens
attgcttaaaatagcaa

SEQ ID NO: 1460255 - DNA, 16 bp, Homo sapiens
attgcttacattttta

SEQ ID NO: 1460256 - DNA, 21 bp, Homo sapiens
attgcttacatttttacaata

SEQ ID NO: 1460257 - DNA, 22 bp, Homo sapiens
attgcttagtaagtatttccat

SEQ ID NO: 1460258 - DNA, 14 bp, Homo sapiens
attgcttattttat

SEQ ID NO: 1460259 - DNA, 18 bp, Homo sapiens
gcctggtcctccctccca

SEQ ID NO: 1460260 - DNA, 18 bp, Homo sapiens
gcctggtgcattgctgtg

SEQ ID NO: 1460261 - DNA, 13 bp, Homo sapiens
gcctggtgggcct

SEQ ID NO: 1460262 - DNA, 18 bp, Homo sapiens
gcctgtaacaatgtaata

SEQ ID NO: 1460263 - DNA, 16 bp, Homo sapiens
gcctgtaatcccagaa

SEQ ID NO: 1460264 - DNA, 15 bp, Homo sapiens
gcctgtaatcccagc

SEQ ID NO: 1460265 - DNA, 19 bp, Homo sapiens
gcctgtaatcccagcactt

SEQ ID NO: 1460266 - DNA, 17 bp, Homo sapiens
gcctgtaatcccagcag

SEQ ID NO: 1460267 - DNA, 20 bp, Homo sapiens
gcctgtaccggtttggctgg

SEQ ID NO: 1460268 - DNA, 18 bp, Homo sapiens
gcctgtaccttgctgtgg

SEQ ID NO: 1460269 - DNA, 20 bp, Homo sapiens
gcctgtagctttcctggtcc

SEQ ID NO: 1460270 - DNA, 19 bp, Homo sapiens
gcctgtagggaactttctg

SEQ ID NO: 1460271 - DNA, 22 bp, Homo sapiens
gcctgtagtcccagctactcag

SEQ ID NO: 1460272 - DNA, 21 bp, Homo sapiens
gcctgtatcctccctggcaga

SEQ ID NO: 1460273 - DNA, 23 bp, Homo sapiens
gcctgtatcctccctggcagaca

SEQ ID NO: 1460274 - DNA, 16 bp, Homo sapiens
gcctgtatttgagaga

SEQ ID NO: 1460275 - DNA, 23 bp, Homo sapiens
gcctgtatttgagagactgccat

SEQ ID NO: 1460276 - DNA, 14 bp, Homo sapiens
gcctgtcaccagag

SEQ ID NO: 1460277 - DNA, 15 bp, Homo sapiens
gcctgtcaccagagc

SEQ ID NO: 1460278 - DNA, 16 bp, Homo sapiens
gcctgtcacgctctgg

SEQ ID NO: 1460279 - DNA, 18 bp, Homo sapiens
gcctgtccaccctgccaa

SEQ ID NO: 1460280 - DNA, 13 bp, Homo sapiens
gcctgtccagcct

SEQ ID NO: 1460281 - DNA, 14 bp, Homo sapiens
gcctgtccagcctg

SEQ ID NO: 1460282 - DNA, 17 bp, Homo sapiens
gcctgtccagcctgggc

SEQ ID NO: 1460283 - DNA, 20 bp, Homo sapiens
gcctgtcccacccccacccc

SEQ ID NO: 1460284 - DNA, 16 bp, Homo sapiens
gcctgtcccttgcctc

SEQ ID NO: 1460285 - DNA, 17 bp, Homo sapiens
gcctgtcccttgcctct

SEQ ID NO: 1460286 - DNA, 14 bp, Homo sapiens
gcctgtcgtgccag

SEQ ID NO: 1460287 - DNA, 18 bp, Homo sapiens
gcctgtctcatccccagg

SEQ ID NO: 1460288 - DNA, 22 bp, Homo sapiens
gcctgtctcatccccaggggtc

SEQ ID NO: 1460289 - DNA, 13 bp, Homo sapiens
gcctgtctccttt

SEQ ID NO: 1460290 - DNA, 21 bp, Homo sapiens
gcctgtctcctttgcaggctc

SEQ ID NO: 1460291 - DNA, 22 bp, Homo sapiens
gcctgtctcctttgcaggctca

SEQ ID NO: 1460292 - DNA, 15 bp, Homo sapiens
gcctgtctgccccag

SEQ ID NO: 1460293 - DNA, 21 bp, Homo sapiens
gcctgtctgccccagcccaga

SEQ ID NO: 1460294 - DNA, 20 bp, Homo sapiens
gcctgtctttcagcattcag

SEQ ID NO: 1460295 - DNA, 23 bp, Homo sapiens
gcctgtgaaaaagaaactgaata

SEQ ID NO: 1460296 - DNA, 22 bp, Homo sapiens
gcctgtgaagaaccctgcaggg

SEQ ID NO: 1460297 - DNA, 22 bp, Homo sapiens
gcctgtgaataaaaaccctgta

SEQ ID NO: 1460298 - DNA, 16 bp, Homo sapiens
gcctgtgagccagtct

SEQ ID NO: 1460299 - DNA, 16 bp, Homo sapiens
gcctgtgcagcagccc

SEQ ID NO: 1460300 - DNA, 17 bp, Homo sapiens
gcctgtgcagcagccca

SEQ ID NO: 1460301 - DNA, 18 bp, Homo sapiens
gcctgtgcagcagcccag

SEQ ID NO: 1460302 - DNA, 20 bp, Homo sapiens
gcctgtgcagcagcccagct

SEQ ID NO: 1460303 - DNA, 22 bp, Homo sapiens
gcctgtgcagcagcccagcttc

SEQ ID NO: 1460304 - DNA, 19 bp, Homo sapiens
gcctgtgcctcctcacccc

SEQ ID NO: 1460305 - DNA, 19 bp, Homo sapiens
gcctgtgcgtcccagctga

SEQ ID NO: 1460306 - DNA, 13 bp, Homo sapiens
gcctgtgctcctg

SEQ ID NO: 1460307 - DNA, 15 bp, Homo sapiens
gcctgtgctcctgcc

SEQ ID NO: 1460308 - DNA, 18 bp, Homo sapiens
gcctgtgctcctgcccag

SEQ ID NO: 1460309 - DNA, 19 bp, Homo sapiens
gcctgtgctcctgcccagg

SEQ ID NO: 1460310 - DNA, 21 bp, Homo sapiens
gcctgtgctgcatgcgacagc

SEQ ID NO: 1460311 - DNA, 13 bp, Homo sapiens
gcctgtgctgtga

SEQ ID NO: 1460312 - DNA, 14 bp, Homo sapiens
gcctgtgctgtgac

SEQ ID NO: 1460313 - DNA, 17 bp, Homo sapiens
gcctgtggcacagccct

SEQ ID NO: 1460314 - DNA, 20 bp, Homo sapiens
gcctgtggcacagccctgag

SEQ ID NO: 1460315 - DNA, 12 bp, Homo sapiens
gcctgtggcaga

SEQ ID NO: 1460316 - DNA, 22 bp, Homo sapiens
gcctgtggcagaaaagaggaga

SEQ ID NO: 1460317 - DNA, 22 bp, Homo sapiens
gcctgtggcatctttgccttgg

SEQ ID NO: 1460318 - DNA, 16 bp, Homo sapiens
gcctgtggcctgtgtc

SEQ ID NO: 1460319 - DNA, 15 bp, Homo sapiens
gcctgtgtccagcag

SEQ ID NO: 1460320 - DNA, 18 bp, Homo sapiens
gcctgtgtccagcagctg

SEQ ID NO: 1460321 - DNA, 21 bp, Homo sapiens
gcctgtgtccagcagctgcgg

SEQ ID NO: 1460322 - DNA, 22 bp, Homo sapiens
gcctgtgtccagcagctgcggg

SEQ ID NO: 1460323 - DNA, 14 bp, Homo sapiens
gcctgtgtccatgc

SEQ ID NO: 1460324 - DNA, 20 bp, Homo sapiens
gcctgtgtccatgcgctcag

SEQ ID NO: 1460325 - DNA, 23 bp, Homo sapiens
gcctgtgtccatgcgctcagggc

SEQ ID NO: 1460326 - DNA, 15 bp, Homo sapiens
gcctgtgtcccatga

SEQ ID NO: 1460327 - DNA, 20 bp, Homo sapiens
gcctgtgtcccatgacccac

SEQ ID NO: 1460328 - DNA, 22 bp, Homo sapiens
gcctgtgtcccatgacccaccc

SEQ ID NO: 1460329 - DNA, 23 bp, Homo sapiens
gcctgtgtcccatgacccacccc

SEQ ID NO: 1460330 - DNA, 13 bp, Homo sapiens
gcctgttccctag

SEQ ID NO: 1460331 - DNA, 16 bp, Homo sapiens
gcctgttccctagaga

SEQ ID NO: 1460332 - DNA, 11 bp, Homo sapiens
gcctgttcctt

SEQ ID NO: 1460333 - DNA, 12 bp, Homo sapiens
gcctgttctgct

SEQ ID NO: 1460334 - DNA, 13 bp, Homo sapiens
gcctgttctgctt

SEQ ID NO: 1460335 - DNA, 15 bp, Homo sapiens
gcctgttctgcttcg

SEQ ID NO: 1460336 - DNA, 17 bp, Homo sapiens
gcctgttggcaggccca

SEQ ID NO: 1460337 - DNA, 19 bp, Homo sapiens
gcctgttggcaggcccact

SEQ ID NO: 1460338 - DNA, 13 bp, Homo sapiens
gcctgttggctgc

SEQ ID NO: 1460339 - DNA, 20 bp, Homo sapiens
gcctgtttgatgtatgtgtg

SEQ ID NO: 1460340 - DNA, 21 bp, Homo sapiens
gcctgtttgatgtatgtgtga

SEQ ID NO: 1460341 - DNA, 14 bp, Homo sapiens
gcctgtttggcctc

SEQ ID NO: 1460342 - DNA, 14 bp, Homo sapiens
gccttaaaaccaaa

SEQ ID NO: 1460343 - DNA, 20 bp, Homo sapiens
gccttaaacctacctcccac

SEQ ID NO: 1460344 - DNA, 22 bp, Homo sapiens
gccttaaactctggacactcta

SEQ ID NO: 1460345 - DNA, 17 bp, Homo sapiens
gccttaacacactggcc

SEQ ID NO: 1460346 - DNA, 21 bp, Homo sapiens
gccttaacttcttaaaccatt

SEQ ID NO: 1460347 - DNA, 15 bp, Homo sapiens
gccttaagcagaaca

SEQ ID NO: 1460348 - DNA, 21 bp, Homo sapiens
gccttaagcagaacaaatgtg

SEQ ID NO: 1460349 - DNA, 23 bp, Homo sapiens
gccttaagcagaacaaatgtgtt

SEQ ID NO: 1460350 - DNA, 18 bp, Homo sapiens
gccttaagctgatcctgc

SEQ ID NO: 1460351 - DNA, 17 bp, Homo sapiens
gccttaataaatatgta

SEQ ID NO: 1460352 - DNA, 14 bp, Homo sapiens
gccttaatttcctt

SEQ ID NO: 1460353 - DNA, 17 bp, Homo sapiens
gccttaatttccttttt

SEQ ID NO: 1460354 - DNA, 15 bp, Homo sapiens
gccttacaaagggaa

SEQ ID NO: 1460355 - DNA, 23 bp, Homo sapiens
gccttacaaagggaaagcctctg

SEQ ID NO: 1460356 - DNA, 12 bp, Homo sapiens
gccttacctcct

SEQ ID NO: 1460357 - DNA, 18 bp, Homo sapiens
gccttacctcctgcccag

SEQ ID NO: 1460358 - DNA, 22 bp, Homo sapiens
gccttagggaagctggcctgag

SEQ ID NO: 1460359 - DNA, 20 bp, Homo sapiens
gccttagggtttgcagagtg

SEQ ID NO: 1460360 - DNA, 15 bp, Homo sapiens
gccttagtctcagtt

SEQ ID NO: 1460361 - DNA, 16 bp, Homo sapiens
gccttagttaccctga

SEQ ID NO: 1460362 - DNA, 23 bp, Homo sapiens
gccttatcgggctccagccatct

SEQ ID NO: 1460363 - DNA, 22 bp, Homo sapiens
gccttatgggctgaagtgttct

SEQ ID NO: 1460364 - DNA, 12 bp, Homo sapiens
gccttatgtgga

SEQ ID NO: 1460365 - DNA, 12 bp, Homo sapiens
gccttattaaag

SEQ ID NO: 1460366 - DNA, 15 bp, Homo sapiens
gccttattttgaact

SEQ ID NO: 1460367 - DNA, 21 bp, Homo sapiens
gccttcaacaacgtgagagaa

SEQ ID NO: 1460368 - DNA, 17 bp, Homo sapiens
gccttcaagaatcagaa

SEQ ID NO: 1460369 - DNA, 15 bp, Homo sapiens
gccttcaagtgccaa

SEQ ID NO: 1460370 - DNA, 17 bp, Homo sapiens
gccttcaagtgccaaac

SEQ ID NO: 1460371 - DNA, 18 bp, Homo sapiens
gcctttttcatttatcta

SEQ ID NO: 1460372 - DNA, 19 bp, Homo sapiens
gcctttttcatttatctat

SEQ ID NO: 1460373 - DNA, 21 bp, Homo sapiens
gcgaacttcacataggaaggg

SEQ ID NO: 1460374 - DNA, 15 bp, Homo sapiens
gcgaaggggccctgg

SEQ ID NO: 1460375 - DNA, 16 bp, Homo sapiens
gcgaaggggccctggt

SEQ ID NO: 1460376 - DNA, 19 bp, Homo sapiens
gcgaagtctttgccttctc

SEQ ID NO: 1460377 - DNA, 19 bp, Homo sapiens
tatttatttaaaagattca

SEQ ID NO: 1460378 - DNA, 13 bp, Homo sapiens
tatttatttaaat

SEQ ID NO: 1460379 - DNA, 14 bp, Homo sapiens
tatttatttaaatt

SEQ ID NO: 1460380 - DNA, 16 bp, Homo sapiens
tatttatttaagctta

SEQ ID NO: 1460381 - DNA, 13 bp, Homo sapiens
tatttatttatgt

SEQ ID NO: 1460382 - DNA, 14 bp, Homo sapiens
tatttatttccaga

SEQ ID NO: 1460383 - DNA, 19 bp, Homo sapiens
tatttatttccagtggtca

SEQ ID NO: 1460384 - DNA, 14 bp, Homo sapiens
tatttatttctagt

SEQ ID NO: 1460385 - DNA, 13 bp, Homo sapiens
tatttattttcag

SEQ ID NO: 1460386 - DNA, 21 bp, Homo sapiens
tatttattttcagtatactgt

SEQ ID NO: 1460387 - DNA, 14 bp, Homo sapiens
tatttcaaaatgtc

SEQ ID NO: 1460388 - DNA, 15 bp, Homo sapiens
tatttcaactaatgt

SEQ ID NO: 1460389 - DNA, 14 bp, Homo sapiens
tatttcaagacatt

SEQ ID NO: 1460390 - DNA, 12 bp, Homo sapiens
tatttcaagtgc

SEQ ID NO: 1460391 - DNA, 22 bp, Homo sapiens
tatttcaagtgcctagactgtt

SEQ ID NO: 1460392 - DNA, 18 bp, Homo sapiens
tatttcaatcttttaaat

SEQ ID NO: 1460393 - DNA, 14 bp, Homo sapiens
tatttcacagagca

SEQ ID NO: 1460394 - DNA, 23 bp, Homo sapiens
tatttcacatgagtcaaaacaaa

SEQ ID NO: 1460395 - DNA, 16 bp, Homo sapiens
tatttcaccagcagca

SEQ ID NO: 1460396 - DNA, 14 bp, Homo sapiens
tatttcagaaatac

SEQ ID NO: 1460397 - DNA, 16 bp, Homo sapiens
tatttcagacattttc

SEQ ID NO: 1460398 - DNA, 22 bp, Homo sapiens
tatttcagatatcaaaattcta

SEQ ID NO: 1460399 - DNA, 21 bp, Homo sapiens
tatttcaggcattggatattt

SEQ ID NO: 1460400 - DNA, 18 bp, Homo sapiens
tatttcagtgttacctgt

SEQ ID NO: 1460401 - DNA, 13 bp, Homo sapiens
tatttcagtgttt

SEQ ID NO: 1460402 - DNA, 20 bp, Homo sapiens
tatttcataaacaacttaat

SEQ ID NO: 1460403 - DNA, 21 bp, Homo sapiens
tatttcatgtttttgatcaaa

SEQ ID NO: 1460404 - DNA, 12 bp, Homo sapiens
tatttcatttct

SEQ ID NO: 1460405 - DNA, 18 bp, Homo sapiens
tatttccactgaacaaaa

SEQ ID NO: 1460406 - DNA, 12 bp, Homo sapiens
tatttccagtgg

SEQ ID NO: 1460407 - DNA, 21 bp, Homo sapiens
tatttccccttggacacttgg

SEQ ID NO: 1460408 - DNA, 16 bp, Homo sapiens
tatttcccttccaaag

SEQ ID NO: 1460409 - DNA, 16 bp, Homo sapiens
tatttccctttagctg

SEQ ID NO: 1460410 - DNA, 15 bp, Homo sapiens
tatttcctaaggcat

SEQ ID NO: 1460411 - DNA, 17 bp, Homo sapiens
tatttcctgacttgagt

SEQ ID NO: 1460412 - DNA, 17 bp, Homo sapiens
tatttcctttatgtgaa

SEQ ID NO: 1460413 - DNA, 21 bp, Homo sapiens
tatttcgagtgttgtgttaaa

SEQ ID NO: 1460414 - DNA, 13 bp, Homo sapiens
tatttctagaagc

SEQ ID NO: 1460415 - DNA, 14 bp, Homo sapiens
tatttctagcagag

SEQ ID NO: 1460416 - DNA, 15 bp, Homo sapiens
tatttctagcagagt

SEQ ID NO: 1460417 - DNA, 21 bp, Homo sapiens
tatttctagggaaatttttca

SEQ ID NO: 1460418 - DNA, 14 bp, Homo sapiens
tatttctatgacaa

SEQ ID NO: 1460419 - DNA, 14 bp, Homo sapiens
tatttctgaaggta

SEQ ID NO: 1460420 - DNA, 21 bp, Homo sapiens
tatttctgaaggtagcattct

SEQ ID NO: 1460421 - DNA, 15 bp, Homo sapiens
tatttctgactctta

SEQ ID NO: 1460422 - DNA, 11 bp, Homo sapiens
tatttctgaga

SEQ ID NO: 1460423 - DNA, 10 bp, Homo sapiens
tatttctgcg

SEQ ID NO: 1460424 - DNA, 17 bp, Homo sapiens
tatttctgggtcttttg

SEQ ID NO: 1460425 - DNA, 22 bp, Homo sapiens
tatttctgtggagggttgccat

SEQ ID NO: 1460426 - DNA, 14 bp, Homo sapiens
tatttctgttctta

SEQ ID NO: 1460427 - DNA, 21 bp, Homo sapiens
tatttctgttcttacaaatgt

SEQ ID NO: 1460428 - DNA, 23 bp, Homo sapiens
tatttcttaacctttgctatgta

SEQ ID NO: 1460429 - DNA, 16 bp, Homo sapiens
tatttcttatatatgt

SEQ ID NO: 1460430 - DNA, 14 bp, Homo sapiens
tatttcttgctttc

SEQ ID NO: 1460431 - DNA, 23 bp, Homo sapiens
tatttctttttaattattttaaa

SEQ ID NO: 1460432 - DNA, 15 bp, Homo sapiens
tatttctttttatag

SEQ ID NO: 1460433 - DNA, 20 bp, Homo sapiens
tatttgaaatagtatacatt

SEQ ID NO: 1460434 - DNA, 22 bp, Homo sapiens
tatttgaacatgtgccttttct

SEQ ID NO: 1460435 - DNA, 22 bp, Homo sapiens
tatttgaagcatgctctgtaag

SEQ ID NO: 1460436 - DNA, 14 bp, Homo sapiens
tatttgaaggccag

SEQ ID NO: 1460437 - DNA, 19 bp, Homo sapiens
tatttgaatgaacactatg

SEQ ID NO: 1460438 - DNA, 18 bp, Homo sapiens
tatttgaattttaaatct

SEQ ID NO: 1460439 - DNA, 13 bp, Homo sapiens
tatttgatttcta

SEQ ID NO: 1460440 - DNA, 14 bp, Homo sapiens
tatttgatttctaa

SEQ ID NO: 1460441 - DNA, 18 bp, Homo sapiens
tatttgatttctaattgt

SEQ ID NO: 1460442 - DNA, 20 bp, Homo sapiens
tatttgcagttacttgaata

SEQ ID NO: 1460443 - DNA, 15 bp, Homo sapiens
tatttgcatgttacc

SEQ ID NO: 1460444 - DNA, 17 bp, Homo sapiens
tatttgccaataaagct

SEQ ID NO: 1460445 - DNA, 20 bp, Homo sapiens
tatttgcctgtctgtttgct

SEQ ID NO: 1460446 - DNA, 19 bp, Homo sapiens
tatttgctaatgtataatg

SEQ ID NO: 1460447 - DNA, 18 bp, Homo sapiens
tatttgctgacaaccatt

SEQ ID NO: 1460448 - DNA, 12 bp, Homo sapiens
tatttggaaaga

SEQ ID NO: 1460449 - DNA, 16 bp, Homo sapiens
tatttggaaagagacc

SEQ ID NO: 1460450 - DNA, 18 bp, Homo sapiens
tatttggagctatcagtg

SEQ ID NO: 1460451 - DNA, 16 bp, Homo sapiens
tatttggagtggaggc

SEQ ID NO: 1460452 - DNA, 15 bp, Homo sapiens
tatttggtattaaac

SEQ ID NO: 1460453 - DNA, 23 bp, Homo sapiens
aatgacaacagaaaaacaatctt

SEQ ID NO: 1460454 - DNA, 22 bp, Homo sapiens
aatgacacccatgccagagagg

SEQ ID NO: 1460455 - DNA, 13 bp, Homo sapiens
aatgacagatttc

SEQ ID NO: 1460456 - DNA, 16 bp, Homo sapiens
aatgacagatttctgt

SEQ ID NO: 1460457 - DNA, 17 bp, Homo sapiens
aatgacataaaaagaag

SEQ ID NO: 1460458 - DNA, 18 bp, Homo sapiens
aatgacatcttcaaagct

SEQ ID NO: 1460459 - DNA, 22 bp, Homo sapiens
aatgacatgcactgacccttcc

SEQ ID NO: 1460460 - DNA, 19 bp, Homo sapiens
aatgaccacacctgcctct

SEQ ID NO: 1460461 - DNA, 15 bp, Homo sapiens
aatgaccattcaatt

SEQ ID NO: 1460462 - DNA, 19 bp, Homo sapiens
aatgaccattcaattagtg

SEQ ID NO: 1460463 - DNA, 15 bp, Homo sapiens
aatgaccgagccctg

SEQ ID NO: 1460464 - DNA, 19 bp, Homo sapiens
aatgaccgagccctggaga

SEQ ID NO: 1460465 - DNA, 23 bp, Homo sapiens
aatgacggtaagtgttctcatga

SEQ ID NO: 1460466 - DNA, 24 bp, Homo sapiens
aatgacggtaagtgttctcatgaa

SEQ ID NO: 1460467 - DNA, 14 bp, Homo sapiens
aatgacgtgtgtgg

SEQ ID NO: 1460468 - DNA, 16 bp, Homo sapiens
aatgacgtgtgtggct

SEQ ID NO: 1460469 - DNA, 19 bp, Homo sapiens
aatgactggggagggctgc

SEQ ID NO: 1460470 - DNA, 15 bp, Homo sapiens
aatgacttagaaact

SEQ ID NO: 1460471 - DNA, 16 bp, Homo sapiens
aatgacttagaaactg

SEQ ID NO: 1460472 - DNA, 22 bp, Homo sapiens
aatgacttatttctgctctgga

SEQ ID NO: 1460473 - DNA, 21 bp, Homo sapiens
aatgacttgtacaaacagtat

SEQ ID NO: 1460474 - DNA, 16 bp, Homo sapiens
aatgagaaaggacaga

SEQ ID NO: 1460475 - DNA, 13 bp, Homo sapiens
aatgagacatcca

SEQ ID NO: 1460476 - DNA, 14 bp, Homo sapiens
aatgagacatccag

SEQ ID NO: 1460477 - DNA, 15 bp, Homo sapiens
aatgagacatccagc

SEQ ID NO: 1460478 - DNA, 19 bp, Homo sapiens
aatgagaccctcgtggcct

SEQ ID NO: 1460479 - DNA, 17 bp, Homo sapiens
aatgagatcccgcctct

SEQ ID NO: 1460480 - DNA, 19 bp, Homo sapiens
aatgagatgttattactgt

SEQ ID NO: 1460481 - DNA, 22 bp, Homo sapiens
aatgagccatcactagaagaaa

SEQ ID NO: 1460482 - DNA, 15 bp, Homo sapiens
aatgagccatcccca

SEQ ID NO: 1460483 - DNA, 14 bp, Homo sapiens
aatgagctcctgcg

SEQ ID NO: 1460484 - DNA, 14 bp, Homo sapiens
aatgagctctgaaa

SEQ ID NO: 1460485 - DNA, 17 bp, Homo sapiens
aatgagcttgattaaat

SEQ ID NO: 1460486 - DNA, 19 bp, Homo sapiens
aatgaggaaaattcttaaa

SEQ ID NO: 1460487 - DNA, 21 bp, Homo sapiens
aatgagggaaattgctatttt

SEQ ID NO: 1460488 - DNA, 16 bp, Homo sapiens
aatgaggtctgaaatg

SEQ ID NO: 1460489 - DNA, 19 bp, Homo sapiens
aatgaggtctgaaatggag

SEQ ID NO: 1460490 - DNA, 23 bp, Homo sapiens
aatgaggtgggaggtggaagaag

SEQ ID NO: 1460491 - DNA, 18 bp, Homo sapiens
aatgagtaaaaactagaa

SEQ ID NO: 1460492 - DNA, 14 bp, Homo sapiens
aatgagtctgttgt

SEQ ID NO: 1460493 - DNA, 16 bp, Homo sapiens
aatgagtgcacctgcc

SEQ ID NO: 1460494 - DNA, 16 bp, Homo sapiens
aatgagttgtcacaga

SEQ ID NO: 1460495 - DNA, 19 bp, Homo sapiens
aatgagtttaaaaaaataa

SEQ ID NO: 1460496 - DNA, 14 bp, Homo sapiens
aatgagtttcttag

SEQ ID NO: 1460497 - DNA, 19 bp, Homo sapiens
aatgagtttcttagacttt

SEQ ID NO: 1460498 - DNA, 18 bp, Homo sapiens
aatgataagtaaatgcta

SEQ ID NO: 1460499 - DNA, 18 bp, Homo sapiens
aatgataccctgaatttg

SEQ ID NO: 1460500 - DNA, 14 bp, Homo sapiens
aatgatcaaaacat

SEQ ID NO: 1460501 - DNA, 16 bp, Homo sapiens
aatgatcataagtcta

SEQ ID NO: 1460502 - DNA, 20 bp, Homo sapiens
aatgatccccaagtgtgaac

SEQ ID NO: 1460503 - DNA, 22 bp, Homo sapiens
aatgatcctgtctctaaaaaga

SEQ ID NO: 1460504 - DNA, 22 bp, Homo sapiens
aatgatctctctgaatcctaag

SEQ ID NO: 1460505 - DNA, 15 bp, Homo sapiens
aatgatgacccacta

SEQ ID NO: 1460506 - DNA, 20 bp, Homo sapiens
aatgatgacccactaaagag

SEQ ID NO: 1460507 - DNA, 12 bp, Homo sapiens
aatgatgatgac

SEQ ID NO: 1460508 - DNA, 21 bp, Homo sapiens
aatgatgatgtggaagaactt

SEQ ID NO: 1460509 - DNA, 14 bp, Homo sapiens
aatgatggcaattt

SEQ ID NO: 1460510 - DNA, 15 bp, Homo sapiens
aatgatgtccagaag

SEQ ID NO: 1460511 - DNA, 18 bp, Homo sapiens
aatgattatattcacaga

SEQ ID NO: 1460512 - DNA, 17 bp, Homo sapiens
aatgattcaaaaagtca

SEQ ID NO: 1460513 - DNA, 19 bp, Homo sapiens
aatgattcaaattgctgct

SEQ ID NO: 1460514 - DNA, 22 bp, Homo sapiens
aatgattcaaattgctgcttgg

SEQ ID NO: 1460515 - DNA, 16 bp, Homo sapiens
aatgattggtagcaaa

SEQ ID NO: 1460516 - DNA, 14 bp, Homo sapiens
aatgcaaaaataac

SEQ ID NO: 1460517 - DNA, 18 bp, Homo sapiens
aatgcaaaattgttttca

SEQ ID NO: 1460518 - DNA, 22 bp, Homo sapiens
aatgcaaaattgttttcacttg

SEQ ID NO: 1460519 - DNA, 12 bp, Homo sapiens
aatgcaaattca

SEQ ID NO: 1460520 - DNA, 19 bp, Homo sapiens
aatgcaagagtgattgcag

SEQ ID NO: 1460521 - DNA, 22 bp, Homo sapiens
aatgcaagagtgattgcagctt

SEQ ID NO: 1460522 - DNA, 15 bp, Homo sapiens
aatgcaataactctg

SEQ ID NO: 1460523 - DNA, 24 bp, Homo sapiens
aatgcaatctccccttgatttaaa

SEQ ID NO: 1460524 - DNA, 19 bp, Homo sapiens
aatgcacatatagacacat

SEQ ID NO: 1460525 - DNA, 16 bp, Homo sapiens
aatgcaccatggagac

SEQ ID NO: 1460526 - DNA, 17 bp, Homo sapiens
aatgcagaagcaaacaa

SEQ ID NO: 1460527 - DNA, 15 bp, Homo sapiens
aatgcagaagtattc

SEQ ID NO: 1460528 - DNA, 20 bp, Homo sapiens
aatgcagattcctgggcctg

SEQ ID NO: 1460529 - DNA, 21 bp, Homo sapiens
aatgcagattcctgggcctgt

SEQ ID NO: 1460530 - DNA, 18 bp, Homo sapiens
aatgcagatttctcttta

SEQ ID NO: 1460531 - DNA, 22 bp, Homo sapiens
aatgcagggattgctgccactt

SEQ ID NO: 1460532 - DNA, 18 bp, Homo sapiens
aatgcaggtgaacttttt

SEQ ID NO: 1460533 - DNA, 13 bp, Homo sapiens
aatgcagtacaga

SEQ ID NO: 1460534 - DNA, 16 bp, Homo sapiens
aatgcagtgacacaat

SEQ ID NO: 1460535 - DNA, 20 bp, Homo sapiens
aatgcagtgacacaatctcg

SEQ ID NO: 1460536 - DNA, 20 bp, Homo sapiens
aatgcatctcatcaacttaa

SEQ ID NO: 1460537 - DNA, 18 bp, Homo sapiens
aatgcatgttaggaaaat

SEQ ID NO: 1460538 - DNA, 20 bp, Homo sapiens
aatgcatttaaactcatttg

SEQ ID NO: 1460539 - DNA, 19 bp, Homo sapiens
aatgccaagggggtgactg

SEQ ID NO: 1460540 - DNA, 22 bp, Homo sapiens
aatgccactgccttcgcttctt

SEQ ID NO: 1460541 - DNA, 19 bp, Homo sapiens
aatgccactgggacagctg

SEQ ID NO: 1460542 - DNA, 13 bp, Homo sapiens
aatgccagagcca

SEQ ID NO: 1460543 - DNA, 18 bp, Homo sapiens
aatgccagagccaacctg

SEQ ID NO: 1460544 - DNA, 23 bp, Homo sapiens
aatgccagtaacgcgtcttcctg

SEQ ID NO: 1460545 - DNA, 22 bp, Homo sapiens
aatgccatgaacaaattcttta

SEQ ID NO: 1460546 - DNA, 17 bp, Homo sapiens
aatgccatttagaatct

SEQ ID NO: 1460547 - DNA, 18 bp, Homo sapiens
aatgccatttagaatcta

SEQ ID NO: 1460548 - DNA, 19 bp, Homo sapiens
aatgccatttagaatctag

SEQ ID NO: 1460549 - DNA, 21 bp, Homo sapiens
aatgccatttcagtggcttcc

SEQ ID NO: 1460550 - DNA, 14 bp, Homo sapiens
aatgcccttcactg

SEQ ID NO: 1460551 - DNA, 12 bp, Homo sapiens
aatgcctcctcc

SEQ ID NO: 1460552 - DNA, 15 bp, Homo sapiens
aatgcctcctccctg

SEQ ID NO: 1460553 - DNA, 19 bp, Homo sapiens
aatgcctcgctcccttcaa

SEQ ID NO: 1460554 - DNA, 16 bp, Homo sapiens
aatgcctcttgtcttc

SEQ ID NO: 1460555 - DNA, 13 bp, Homo sapiens
aatgcctgctttt

SEQ ID NO: 1460556 - DNA, 20 bp, Homo sapiens
aatgcctgctttttggaaag

SEQ ID NO: 1460557 - DNA, 19 bp, Homo sapiens
aatgcggcccactttcctg

SEQ ID NO: 1460558 - DNA, 20 bp, Homo sapiens
aatgcggccgcattccctga

SEQ ID NO: 1460559 - DNA, 22 bp, Homo sapiens
aatgcggttataaaaaatggtt

SEQ ID NO: 1460560 - DNA, 13 bp, Homo sapiens
aatgctaatgtaa

SEQ ID NO: 1460561 - DNA, 18 bp, Homo sapiens
aatgctatcactgtcttt

SEQ ID NO: 1460562 - DNA, 15 bp, Homo sapiens
aatgctcattttctg

SEQ ID NO: 1460563 - DNA, 20 bp, Homo sapiens
aatgctcattttctggtttg

SEQ ID NO: 1460564 - DNA, 17 bp, Homo sapiens
aatgctcgtgtgatttc

SEQ ID NO: 1460565 - DNA, 18 bp, Homo sapiens
aatgctgaaaaaacacct

SEQ ID NO: 1460566 - DNA, 18 bp, Homo sapiens
aatgctgaactccttgtt

SEQ ID NO: 1460567 - DNA, 16 bp, Homo sapiens
aattatgtaatatatt

SEQ ID NO: 1460568 - DNA, 19 bp, Homo sapiens
aattatgtaatatattgta

SEQ ID NO: 1460569 - DNA, 15 bp, Homo sapiens
aattatgtaatgcaa

SEQ ID NO: 1460570 - DNA, 18 bp, Homo sapiens
aattatgtatgtttacat

SEQ ID NO: 1460571 - DNA, 21 bp, Homo sapiens
aattatgtatgtttacatatc

SEQ ID NO: 1460572 - DNA, 13 bp, Homo sapiens
aattatgtctctt

SEQ ID NO: 1460573 - DNA, 17 bp, Homo sapiens
aattattagcatttgtt

SEQ ID NO: 1460574 - DNA, 13 bp, Homo sapiens
aattattattctt

SEQ ID NO: 1460575 - DNA, 13 bp, Homo sapiens
aattattatttat

SEQ ID NO: 1460576 - DNA, 12 bp, Homo sapiens
aattattatttg

SEQ ID NO: 1460577 - DNA, 15 bp, Homo sapiens
aattattattttaaa

SEQ ID NO: 1460578 - DNA, 21 bp, Homo sapiens
aattattattttaaaatatat

SEQ ID NO: 1460579 - DNA, 14 bp, Homo sapiens
aattattctagtca

SEQ ID NO: 1460580 - DNA, 16 bp, Homo sapiens
aattattctgattctt

SEQ ID NO: 1460581 - DNA, 13 bp, Homo sapiens
aattattgacact

SEQ ID NO: 1460582 - DNA, 15 bp, Homo sapiens
aattattgacactga

SEQ ID NO: 1460583 - DNA, 19 bp, Homo sapiens
aattattgacactgaactt

SEQ ID NO: 1460584 - DNA, 14 bp, Homo sapiens
aattatttgcatat

SEQ ID NO: 1460585 - DNA, 11 bp, Homo sapiens
aattattttaa

SEQ ID NO: 1460586 - DNA, 18 bp, Homo sapiens
aattattttaaaatattt

SEQ ID NO: 1460587 - DNA, 19 bp, Homo sapiens
aattattttaatattttgt

SEQ ID NO: 1460588 - DNA, 19 bp, Homo sapiens
aattattttggatctatca

SEQ ID NO: 1460589 - DNA, 20 bp, Homo sapiens
aattattttggtacttttat

SEQ ID NO: 1460590 - DNA, 20 bp, Homo sapiens
aattattttgttcatacata

SEQ ID NO: 1460591 - DNA, 22 bp, Homo sapiens
aattattttgttcatacatatt

SEQ ID NO: 1460592 - DNA, 19 bp, Homo sapiens
aattatttttgtgtttcta

SEQ ID NO: 1460593 - DNA, 22 bp, Homo sapiens
aattcaaaagtattgaaagcca

SEQ ID NO: 1460594 - DNA, 22 bp, Homo sapiens
aattcaaaagttccaagagtct

SEQ ID NO: 1460595 - DNA, 20 bp, Homo sapiens
aattcaaactggggcctcca

SEQ ID NO: 1460596 - DNA, 19 bp, Homo sapiens
aattcaaagcatggacatt

SEQ ID NO: 1460597 - DNA, 14 bp, Homo sapiens
aattcaaagctcta

SEQ ID NO: 1460598 - DNA, 16 bp, Homo sapiens
aattcaacacttattt

SEQ ID NO: 1460599 - DNA, 14 bp, Homo sapiens
aattcaaccctttg

SEQ ID NO: 1460600 - DNA, 20 bp, Homo sapiens
aattcaagagctagaaaaat

SEQ ID NO: 1460601 - DNA, 17 bp, Homo sapiens
aattcaaggaatttctt

SEQ ID NO: 1460602 - DNA, 18 bp, Homo sapiens
aattcaatagtaatataa

SEQ ID NO: 1460603 - DNA, 20 bp, Homo sapiens
aattcaatagtaatataata

SEQ ID NO: 1460604 - DNA, 17 bp, Homo sapiens
aattcaatttggattta

SEQ ID NO: 1460605 - DNA, 17 bp, Homo sapiens
aattcaattttaaagac

SEQ ID NO: 1460606 - DNA, 15 bp, Homo sapiens
aattcacagcacagt

SEQ ID NO: 1460607 - DNA, 17 bp, Homo sapiens
aattcactccagtcaac

SEQ ID NO: 1460608 - DNA, 20 bp, Homo sapiens
aattcactccagtcaacaga

SEQ ID NO: 1460609 - DNA, 22 bp, Homo sapiens
aattcactccagtcaacagatt

SEQ ID NO: 1460610 - DNA, 13 bp, Homo sapiens
aattcactcccac

SEQ ID NO: 1460611 - DNA, 17 bp, Homo sapiens
aattcacttaagttttt

SEQ ID NO: 1460612 - DNA, 21 bp, Homo sapiens
aattcagacatctgaggtttt

SEQ ID NO: 1460613 - DNA, 15 bp, Homo sapiens
aattcagcaaaccat

SEQ ID NO: 1460614 - DNA, 15 bp, Homo sapiens
aattcagcactgatt

SEQ ID NO: 1460615 - DNA, 15 bp, Homo sapiens
aattcaggtttttcc

SEQ ID NO: 1460616 - DNA, 16 bp, Homo sapiens
aattcagtgccttcaa

SEQ ID NO: 1460617 - DNA, 14 bp, Homo sapiens
aattcagttttttt

SEQ ID NO: 1460618 - DNA, 14 bp, Homo sapiens
aattcataaaaaca

SEQ ID NO: 1460619 - DNA, 14 bp, Homo sapiens
aattcataaaaata

SEQ ID NO: 1460620 - DNA, 15 bp, Homo sapiens
aattcataaaaataa

SEQ ID NO: 1460621 - DNA, 16 bp, Homo sapiens
aattcataaaaataac

SEQ ID NO: 1460622 - DNA, 19 bp, Homo sapiens
aattcatagcatcctgatt

SEQ ID NO: 1460623 - DNA, 18 bp, Homo sapiens
aattcatagtaagattga

SEQ ID NO: 1460624 - DNA, 13 bp, Homo sapiens
aattcatattctg

SEQ ID NO: 1460625 - DNA, 13 bp, Homo sapiens
aattcatctattt

SEQ ID NO: 1460626 - DNA, 14 bp, Homo sapiens
aattcatgtttctt

SEQ ID NO: 1460627 - DNA, 12 bp, Homo sapiens
aattcatttcta

SEQ ID NO: 1460628 - DNA, 18 bp, Homo sapiens
aattcatttctagactca

SEQ ID NO: 1460629 - DNA, 19 bp, Homo sapiens
aattcatttctagactcaa

SEQ ID NO: 1460630 - DNA, 15 bp, Homo sapiens
aattcatttgtattg

SEQ ID NO: 1460631 - DNA, 20 bp, Homo sapiens
aattcatttgtattgcttat

SEQ ID NO: 1460632 - DNA, 18 bp, Homo sapiens
aattcatttgtggcaatt

SEQ ID NO: 1460633 - DNA, 19 bp, Homo sapiens
aattcatttgtggcaatta

SEQ ID NO: 1460634 - DNA, 13 bp, Homo sapiens
aattccaaagtct

SEQ ID NO: 1460635 - DNA, 18 bp, Homo sapiens
aattccaaagtctctaat

SEQ ID NO: 1460636 - DNA, 17 bp, Homo sapiens
aattccaattatatgag

SEQ ID NO: 1460637 - DNA, 14 bp, Homo sapiens
aattccaccaggat

SEQ ID NO: 1460638 - DNA, 14 bp, Homo sapiens
aattccactgtcaa

SEQ ID NO: 1460639 - DNA, 20 bp, Homo sapiens
aattccaggctgagccatga

SEQ ID NO: 1460640 - DNA, 16 bp, Homo sapiens
aattccatgaatgttc

SEQ ID NO: 1460641 - DNA, 16 bp, Homo sapiens
aattcccattttgcaa

SEQ ID NO: 1460642 - DNA, 20 bp, Homo sapiens
aattcccgttttgtcacttt

SEQ ID NO: 1460643 - DNA, 10 bp, Homo sapiens
aattccctat

SEQ ID NO: 1460644 - DNA, 18 bp, Homo sapiens
aattcccttgaattgtgt

SEQ ID NO: 1460645 - DNA, 20 bp, Homo sapiens
aattcctagataaaaagatg

SEQ ID NO: 1460646 - DNA, 17 bp, Homo sapiens
aattcctcctctattta

SEQ ID NO: 1460647 - DNA, 15 bp, Homo sapiens
aattcctctccaggc

SEQ ID NO: 1460648 - DNA, 13 bp, Homo sapiens
aattcctctggga

SEQ ID NO: 1460649 - DNA, 14 bp, Homo sapiens
aattcctctgggaa

SEQ ID NO: 1460650 - DNA, 16 bp, Homo sapiens
aattcctcttcattgt

SEQ ID NO: 1460651 - DNA, 21 bp, Homo sapiens
aattccttcgaaaggccttca

SEQ ID NO: 1460652 - DNA, 22 bp, Homo sapiens
aattccttctcttttttcagag

SEQ ID NO: 1460653 - DNA, 21 bp, Homo sapiens
aattccttggcatgccttcca

SEQ ID NO: 1460654 - DNA, 19 bp, Homo sapiens
aattccttttctaactctc

SEQ ID NO: 1460655 - DNA, 15 bp, Homo sapiens
aattcgaaccaggaa

SEQ ID NO: 1460656 - DNA, 23 bp, Homo sapiens
aattcgaaccaggaaatggaacc

SEQ ID NO: 1460657 - DNA, 18 bp, Homo sapiens
aattcgctgcaacctgtt

SEQ ID NO: 1460658 - DNA, 20 bp, Homo sapiens
aattcggtgtgctgccaact

SEQ ID NO: 1460659 - DNA, 20 bp, Homo sapiens
aattctaaatccgacttgaa

SEQ ID NO: 1460660 - DNA, 14 bp, Homo sapiens
aattctaacccaag

SEQ ID NO: 1460661 - DNA, 16 bp, Homo sapiens
aattctaagttattta

SEQ ID NO: 1460662 - DNA, 14 bp, Homo sapiens
aattctacagtttc

SEQ ID NO: 1460663 - DNA, 18 bp, Homo sapiens
aattctagtattttatct

SEQ ID NO: 1460664 - DNA, 19 bp, Homo sapiens
aattctcagaatctcaaat

SEQ ID NO: 1460665 - DNA, 16 bp, Homo sapiens
aattctccaggatttt

SEQ ID NO: 1460666 - DNA, 13 bp, Homo sapiens
aattctcccagcg

SEQ ID NO: 1460667 - DNA, 16 bp, Homo sapiens
aattctcccctccctc

SEQ ID NO: 1460668 - DNA, 18 bp, Homo sapiens
aattctcttcgctgtgat

SEQ ID NO: 1460669 - DNA, 20 bp, Homo sapiens
aattctgaaaactgaatgtc

SEQ ID NO: 1460670 - DNA, 15 bp, Homo sapiens
aattctgaaccagaa

SEQ ID NO: 1460671 - DNA, 13 bp, Homo sapiens
aattctgactgtc

SEQ ID NO: 1460672 - DNA, 21 bp, Homo sapiens
aattctgactgtccaggagct

SEQ ID NO: 1460673 - DNA, 23 bp, Homo sapiens
aattctgagttttgtgtttgttg

SEQ ID NO: 1460674 - DNA, 17 bp, Homo sapiens
aattctgatgtttctgt

SEQ ID NO: 1460675 - DNA, 18 bp, Homo sapiens
aattctgatgtttctgtg

SEQ ID NO: 1460676 - DNA, 15 bp, Homo sapiens
aattctgattgattt

SEQ ID NO: 1460677 - DNA, 16 bp, Homo sapiens
aattctgctacctcac

SEQ ID NO: 1460678 - DNA, 22 bp, Homo sapiens
aattctgtactgatttttgtaa

SEQ ID NO: 1460679 - DNA, 22 bp, Homo sapiens
aattctgttgttccattttatg

SEQ ID NO: 1460680 - DNA, 20 bp, Homo sapiens
aattcttaaaaaattgaaaa

SEQ ID NO: 1460681 - DNA, 23 bp, Homo sapiens
aattcttcacctaagtctctgtg

SEQ ID NO: 1460682 - DNA, 20 bp, Homo sapiens
cccggtgggacccccgtggg

SEQ ID NO: 1460683 - DNA, 18 bp, Homo sapiens
cccggttcagacccctgc

SEQ ID NO: 1460684 - DNA, 19 bp, Homo sapiens
cccgtaggcagcctctctg

SEQ ID NO: 1460685 - DNA, 22 bp, Homo sapiens
cccgtaggcagcctctctgcta

SEQ ID NO: 1460686 - DNA, 13 bp, Homo sapiens
cccgtcctgcctg

SEQ ID NO: 1460687 - DNA, 12 bp, Homo sapiens
cccgtcggagct

SEQ ID NO: 1460688 - DNA, 18 bp, Homo sapiens
cccgtcggagctgcctgc

SEQ ID NO: 1460689 - DNA, 20 bp, Homo sapiens
cccgtctggggttcagcccc

SEQ ID NO: 1460690 - DNA, 16 bp, Homo sapiens
cccgtcttcagcctag

SEQ ID NO: 1460691 - DNA, 18 bp, Homo sapiens
cccgtcttcagcctagcc

SEQ ID NO: 1460692 - DNA, 15 bp, Homo sapiens
cccgtgaagcagtgc

SEQ ID NO: 1460693 - DNA, 11 bp, Homo sapiens
cccgtgcagta

SEQ ID NO: 1460694 - DNA, 22 bp, Homo sapiens
cccgtggggcagggagctgggc

SEQ ID NO: 1460695 - DNA, 16 bp, Homo sapiens
cccgtggggtgctgcc

SEQ ID NO: 1460696 - DNA, 22 bp, Homo sapiens
cccgtggtggcggtggctgccc

SEQ ID NO: 1460697 - DNA, 18 bp, Homo sapiens
cccgtgtaaaaagcctcc

SEQ ID NO: 1460698 - DNA, 11 bp, Homo sapiens
cccgtgtgtgt

SEQ ID NO: 1460699 - DNA, 12 bp, Homo sapiens
cccgtgtgtgtg

SEQ ID NO: 1460700 - DNA, 13 bp, Homo sapiens
cccgtgtgtgtgt

SEQ ID NO: 1460701 - DNA, 19 bp, Homo sapiens
cccgtgtgtgtgtatgtgt

SEQ ID NO: 1460702 - DNA, 20 bp, Homo sapiens
cccgtgtgtgtgtatgtgtg

SEQ ID NO: 1460703 - DNA, 17 bp, Homo sapiens
cccgttctgctggcctg

SEQ ID NO: 1460704 - DNA, 19 bp, Homo sapiens
cccgttgcggggtggagtg

SEQ ID NO: 1460705 - DNA, 21 bp, Homo sapiens
cccgttgcttcccgctgcaca

SEQ ID NO: 1460706 - DNA, 14 bp, Homo sapiens
cccgtttctggtgg

SEQ ID NO: 1460707 - DNA, 15 bp, Homo sapiens
ccctaaatctgagga

SEQ ID NO: 1460708 - DNA, 17 bp, Homo sapiens
ccctaaccccttccaga

SEQ ID NO: 1460709 - DNA, 21 bp, Homo sapiens
ccctaaccccttccagatcac

SEQ ID NO: 1460710 - DNA, 14 bp, Homo sapiens
ccctaagtgcccaa

SEQ ID NO: 1460711 - DNA, 23 bp, Homo sapiens
ccctaagtggattggctttgtgc

SEQ ID NO: 1460712 - DNA, 20 bp, Homo sapiens
ccctaagtggctgccttctt

SEQ ID NO: 1460713 - DNA, 15 bp, Homo sapiens
ccctaatctatggtc

SEQ ID NO: 1460714 - DNA, 22 bp, Homo sapiens
ccctaatctatggtcgggagac

SEQ ID NO: 1460715 - DNA, 23 bp, Homo sapiens
ccctaatctttcacttgaaagat

SEQ ID NO: 1460716 - DNA, 13 bp, Homo sapiens
ccctaattctctt

SEQ ID NO: 1460717 - DNA, 19 bp, Homo sapiens
ccctaatttaacccagctc

SEQ ID NO: 1460718 - DNA, 13 bp, Homo sapiens
ccctacagagctg

SEQ ID NO: 1460719 - DNA, 13 bp, Homo sapiens
ccctacagcctgc

SEQ ID NO: 1460720 - DNA, 14 bp, Homo sapiens
ccctacagcctgca

SEQ ID NO: 1460721 - DNA, 16 bp, Homo sapiens
ccctacagcctgcaca

SEQ ID NO: 1460722 - DNA, 21 bp, Homo sapiens
ccctaccgagtctcttctcca

SEQ ID NO: 1460723 - DNA, 22 bp, Homo sapiens
ccctacctgattggtgcaaccc

SEQ ID NO: 1460724 - DNA, 22 bp, Homo sapiens
ccctacgggcgctgcagcctcc

SEQ ID NO: 1460725 - DNA, 23 bp, Homo sapiens
ccctactattcagtggcgagaaa

SEQ ID NO: 1460726 - DNA, 17 bp, Homo sapiens
ccctactgctgtgaacc

SEQ ID NO: 1460727 - DNA, 18 bp, Homo sapiens
ccctacttcttttgctct

SEQ ID NO: 1460728 - DNA, 13 bp, Homo sapiens
ccctacttgataa

SEQ ID NO: 1460729 - DNA, 15 bp, Homo sapiens
ccctactttgcttcc

SEQ ID NO: 1460730 - DNA, 16 bp, Homo sapiens
ccctagagacagtgat

SEQ ID NO: 1460731 - DNA, 19 bp, Homo sapiens
ccctagagacagtgatgcc

SEQ ID NO: 1460732 - DNA, 21 bp, Homo sapiens
ccctagagacagtgatgcctg

SEQ ID NO: 1460733 - DNA, 20 bp, Homo sapiens
ccctagaggcgagccaggca

SEQ ID NO: 1460734 - DNA, 19 bp, Homo sapiens
ccctagcagcccaccctgc

SEQ ID NO: 1460735 - DNA, 16 bp, Homo sapiens
ccctagccctggttag

SEQ ID NO: 1460736 - DNA, 18 bp, Homo sapiens
ccctagctcaccaggcct

SEQ ID NO: 1460737 - DNA, 19 bp, Homo sapiens
ccctagctttagaccctgg

SEQ ID NO: 1460738 - DNA, 20 bp, Homo sapiens
ccctaggatgctgcagcaga

SEQ ID NO: 1460739 - DNA, 17 bp, Homo sapiens
ccctaggggacacttcc

SEQ ID NO: 1460740 - DNA, 14 bp, Homo sapiens
ccctaggtgcccag

SEQ ID NO: 1460741 - DNA, 20 bp, Homo sapiens
ccctagttagcatccaggct

SEQ ID NO: 1460742 - DNA, 19 bp, Homo sapiens
ccctagttctacctcaggc

SEQ ID NO: 1460743 - DNA, 18 bp, Homo sapiens
ccctatagagagggggct

SEQ ID NO: 1460744 - DNA, 23 bp, Homo sapiens
ccctatctaaccctcccatggca

SEQ ID NO: 1460745 - DNA, 13 bp, Homo sapiens
ccctatctcctga

SEQ ID NO: 1460746 - DNA, 16 bp, Homo sapiens
ccctatctcctgacag

SEQ ID NO: 1460747 - DNA, 13 bp, Homo sapiens
ccctatgctgtgc

SEQ ID NO: 1460748 - DNA, 17 bp, Homo sapiens
ccctatgggcttccgca

SEQ ID NO: 1460749 - DNA, 15 bp, Homo sapiens
ccctatgtctcagga

SEQ ID NO: 1460750 - DNA, 17 bp, Homo sapiens
ccctatttattgacttt

SEQ ID NO: 1460751 - DNA, 16 bp, Homo sapiens
ccctatttccccaccc

SEQ ID NO: 1460752 - DNA, 15 bp, Homo sapiens
ccctcaaacctcctc

SEQ ID NO: 1460753 - DNA, 19 bp, Homo sapiens
ccctcaaagggagagaaaa

SEQ ID NO: 1460754 - DNA, 16 bp, Homo sapiens
ccctcaacctcttctg

SEQ ID NO: 1460755 - DNA, 23 bp, Homo sapiens
ccctcacactttgccatttgctt

SEQ ID NO: 1460756 - DNA, 13 bp, Homo sapiens
ccctcaccaccac

SEQ ID NO: 1460757 - DNA, 14 bp, Homo sapiens
ccctcaccaccaca

SEQ ID NO: 1460758 - DNA, 14 bp, Homo sapiens
ccctcaccatccag

SEQ ID NO: 1460759 - DNA, 16 bp, Homo sapiens
ccctcaccatccagtg

SEQ ID NO: 1460760 - DNA, 18 bp, Homo sapiens
ccctcaccatccagtggg

SEQ ID NO: 1460761 - DNA, 20 bp, Homo sapiens
ccctcacccctggttctcat

SEQ ID NO: 1460762 - DNA, 22 bp, Homo sapiens
ccctcacccctggttctcatct

SEQ ID NO: 1460763 - DNA, 10 bp, Homo sapiens
ccctcacctc

SEQ ID NO: 1460764 - DNA, 13 bp, Homo sapiens
ccctcacctctga

SEQ ID NO: 1460765 - DNA, 15 bp, Homo sapiens
ccctcacctctgagg

SEQ ID NO: 1460766 - DNA, 16 bp, Homo sapiens
ccctcacctctgagga

SEQ ID NO: 1460767 - DNA, 21 bp, Homo sapiens
ccctcaccttggcaccagaca

SEQ ID NO: 1460768 - DNA, 22 bp, Homo sapiens
ccctcagaagaaaacttttgtt

SEQ ID NO: 1460769 - DNA, 14 bp, Homo sapiens
ccctcagcacccct

SEQ ID NO: 1460770 - DNA, 15 bp, Homo sapiens
ccctcagcacccctt

SEQ ID NO: 1460771 - DNA, 17 bp, Homo sapiens
ccctcagcaccccttcc

SEQ ID NO: 1460772 - DNA, 19 bp, Homo sapiens
ccctcagcaccccttccat

SEQ ID NO: 1460773 - DNA, 12 bp, Homo sapiens
ccctcagcctcc

SEQ ID NO: 1460774 - DNA, 13 bp, Homo sapiens
ccctcagccttga

SEQ ID NO: 1460775 - DNA, 13 bp, Homo sapiens
ccctcagtgatac

SEQ ID NO: 1460776 - DNA, 19 bp, Homo sapiens
ccctcagtttccctatctc

SEQ ID NO: 1460777 - DNA, 17 bp, Homo sapiens
ccctcataagtttgttt

SEQ ID NO: 1460778 - DNA, 15 bp, Homo sapiens
ccctcataccatctg

SEQ ID NO: 1460779 - DNA, 21 bp, Homo sapiens
ccctcatggcccctctgacct

SEQ ID NO: 1460780 - DNA, 16 bp, Homo sapiens
ccctcatttctgccag

SEQ ID NO: 1460781 - DNA, 17 bp, Homo sapiens
ccctccaaacctccagc

SEQ ID NO: 1460782 - DNA, 24 bp, Homo sapiens
ccctccaaacctccagcctccctg

SEQ ID NO: 1460783 - DNA, 15 bp, Homo sapiens
ccctccacagctgca

SEQ ID NO: 1460784 - DNA, 15 bp, Homo sapiens
ccctccaccagcctg

SEQ ID NO: 1460785 - DNA, 19 bp, Homo sapiens
ccctccaccagcctgctga

SEQ ID NO: 1460786 - DNA, 14 bp, Homo sapiens
ccctccaccctgtc

SEQ ID NO: 1460787 - DNA, 16 bp, Homo sapiens
ccctccaccctgtccc

SEQ ID NO: 1460788 - DNA, 22 bp, Homo sapiens
ccctccaccctgtcccccagct

SEQ ID NO: 1460789 - DNA, 12 bp, Homo sapiens
ccctccaccttc

SEQ ID NO: 1460790 - DNA, 16 bp, Homo sapiens
ccctccacgtgtccgt

SEQ ID NO: 1460791 - DNA, 21 bp, Homo sapiens
ccctccactcagctgtcctgc

SEQ ID NO: 1460792 - DNA, 14 bp, Homo sapiens
ccctccagaccctg

SEQ ID NO: 1460793 - DNA, 18 bp, Homo sapiens
ccctccagaccctgcctg

SEQ ID NO: 1460794 - DNA, 12 bp, Homo sapiens
ccctccagcaca

SEQ ID NO: 1460795 - DNA, 13 bp, Homo sapiens
ccctccagcacac

SEQ ID NO: 1460796 - DNA, 14 bp, Homo sapiens
ccctccagctcatg

SEQ ID NO: 1460797 - DNA, 15 bp, Homo sapiens
ccctgccaccaggcc

SEQ ID NO: 1460798 - DNA, 13 bp, Homo sapiens
ccctgccactcac

SEQ ID NO: 1460799 - DNA, 14 bp, Homo sapiens
ccctgccagtgcct

SEQ ID NO: 1460800 - DNA, 13 bp, Homo sapiens
ccctgccatcttc

SEQ ID NO: 1460801 - DNA, 14 bp, Homo sapiens
ccctgcccagccca

SEQ ID NO: 1460802 - DNA, 17 bp, Homo sapiens
ccctgccccaccccatc

SEQ ID NO: 1460803 - DNA, 22 bp, Homo sapiens
ccctgccccaccccatccagcc

SEQ ID NO: 1460804 - DNA, 18 bp, Homo sapiens
ccctgcccccagccccgg

SEQ ID NO: 1460805 - DNA, 16 bp, Homo sapiens
ccctgcccccaggact

SEQ ID NO: 1460806 - DNA, 17 bp, Homo sapiens
ccctgcccccaggactg

SEQ ID NO: 1460807 - DNA, 22 bp, Homo sapiens
ccctgcccccaggactgggcca

SEQ ID NO: 1460808 - DNA, 12 bp, Homo sapiens
ccctgcccccca

SEQ ID NO: 1460809 - DNA, 22 bp, Homo sapiens
ccctgccccccaaggttctggt

SEQ ID NO: 1460810 - DNA, 17 bp, Homo sapiens
ccctgccccgggatgca

SEQ ID NO: 1460811 - DNA, 11 bp, Homo sapiens
ccctgccccta

SEQ ID NO: 1460812 - DNA, 21 bp, Homo sapiens
ccctgcccctacgggcgctgc

SEQ ID NO: 1460813 - DNA, 23 bp, Homo sapiens
ccctgcccctcccttcaaccatt

SEQ ID NO: 1460814 - DNA, 20 bp, Homo sapiens
ccctgccccttaaccccaag

SEQ ID NO: 1460815 - DNA, 15 bp, Homo sapiens
ccctgccccttgcca

SEQ ID NO: 1460816 - DNA, 14 bp, Homo sapiens
ccctgccctagctc

SEQ ID NO: 1460817 - DNA, 10 bp, Homo sapiens
ccctgccctc

SEQ ID NO: 1460818 - DNA, 15 bp, Homo sapiens
ccctgccctcccctg

SEQ ID NO: 1460819 - DNA, 13 bp, Homo sapiens
ccctgccctcgtg

SEQ ID NO: 1460820 - DNA, 13 bp, Homo sapiens
ccctgccctgcac

SEQ ID NO: 1460821 - DNA, 23 bp, Homo sapiens
ccctgcccttcctcctgatggag

SEQ ID NO: 1460822 - DNA, 20 bp, Homo sapiens
ccctgccggtgcacaggcct

SEQ ID NO: 1460823 - DNA, 14 bp, Homo sapiens
ccctgccgtttccc

SEQ ID NO: 1460824 - DNA, 15 bp, Homo sapiens
ccctgcctacacaca

SEQ ID NO: 1460825 - DNA, 12 bp, Homo sapiens
ccctgcctctgt

SEQ ID NO: 1460826 - DNA, 15 bp, Homo sapiens
ccctgcctgagccca

SEQ ID NO: 1460827 - DNA, 14 bp, Homo sapiens
ccctgcctgaggag

SEQ ID NO: 1460828 - DNA, 21 bp, Homo sapiens
ccctgcctgagggcccctctg

SEQ ID NO: 1460829 - DNA, 22 bp, Homo sapiens
ccctgcctgagggcccctctgc

SEQ ID NO: 1460830 - DNA, 23 bp, Homo sapiens
ccctgcctgagggcccctctgcc

SEQ ID NO: 1460831 - DNA, 13 bp, Homo sapiens
ccctgcctgccca

SEQ ID NO: 1460832 - DNA, 14 bp, Homo sapiens
ccctgcctgcccac

SEQ ID NO: 1460833 - DNA, 14 bp, Homo sapiens
ccctgcctggactt

SEQ ID NO: 1460834 - DNA, 13 bp, Homo sapiens
ccctgcctggccc

SEQ ID NO: 1460835 - DNA, 22 bp, Homo sapiens
ccctgccttgctgacaataaag

SEQ ID NO: 1460836 - DNA, 17 bp, Homo sapiens
ccctgcgaaggggccct

SEQ ID NO: 1460837 - DNA, 19 bp, Homo sapiens
ccctgcgaaggggccctgg

SEQ ID NO: 1460838 - DNA, 20 bp, Homo sapiens
ccctgcgaaggggccctggt

SEQ ID NO: 1460839 - DNA, 14 bp, Homo sapiens
ccctgcgcctccag

SEQ ID NO: 1460840 - DNA, 18 bp, Homo sapiens
ccctgcgcctccagaggt

SEQ ID NO: 1460841 - DNA, 21 bp, Homo sapiens
ccctgcgcctccagaggtcct

SEQ ID NO: 1460842 - DNA, 20 bp, Homo sapiens
ccctgcgttggagccactcc

SEQ ID NO: 1460843 - DNA, 21 bp, Homo sapiens
ccctgctactcctgtgctctg

SEQ ID NO: 1460844 - DNA, 18 bp, Homo sapiens
ccctgctccaccagcagc

SEQ ID NO: 1460845 - DNA, 14 bp, Homo sapiens
ccctgctcccattc

SEQ ID NO: 1460846 - DNA, 15 bp, Homo sapiens
ccctgctcctccctg

SEQ ID NO: 1460847 - DNA, 16 bp, Homo sapiens
ccctgctcctccctgg

SEQ ID NO: 1460848 - DNA, 17 bp, Homo sapiens
ccctgctcctccctggc

SEQ ID NO: 1460849 - DNA, 19 bp, Homo sapiens
ccctgctcctccctggctg

SEQ ID NO: 1460850 - DNA, 21 bp, Homo sapiens
ccctgctcctccctggctgcc

SEQ ID NO: 1460851 - DNA, 15 bp, Homo sapiens
ccctgctctctgagt

SEQ ID NO: 1460852 - DNA, 11 bp, Homo sapiens
ccctgctgaat

SEQ ID NO: 1460853 - DNA, 13 bp, Homo sapiens
ccctgctgcccag

SEQ ID NO: 1460854 - DNA, 15 bp, Homo sapiens
ccctgctgctggtgc

SEQ ID NO: 1460855 - DNA, 15 bp, Homo sapiens
ccctgctgtctctct

SEQ ID NO: 1460856 - DNA, 13 bp, Homo sapiens
ccctgctgtgcca

SEQ ID NO: 1460857 - DNA, 21 bp, Homo sapiens
ccctgctgtgccatgctgggc

SEQ ID NO: 1460858 - DNA, 15 bp, Homo sapiens
ccctgcttccaggaa

SEQ ID NO: 1460859 - DNA, 16 bp, Homo sapiens
ccctgcttcctgcttg

SEQ ID NO: 1460860 - DNA, 14 bp, Homo sapiens
ccctgcttctgctg

SEQ ID NO: 1460861 - DNA, 16 bp, Homo sapiens
ccctgctttgcatctt

SEQ ID NO: 1460862 - DNA, 22 bp, Homo sapiens
ccctgctttgggctgccctggt

SEQ ID NO: 1460863 - DNA, 21 bp, Homo sapiens
ccctggaaaacagacgggtct

SEQ ID NO: 1460864 - DNA, 22 bp, Homo sapiens
ccctggaaacccacctctctgg

SEQ ID NO: 1460865 - DNA, 19 bp, Homo sapiens
ccctggaaaccttccaccc

SEQ ID NO: 1460866 - DNA, 21 bp, Homo sapiens
ccctggaaaccttccacccag

SEQ ID NO: 1460867 - DNA, 19 bp, Homo sapiens
ccctggaaaggggagttga

SEQ ID NO: 1460868 - DNA, 21 bp, Homo sapiens
ccctggaaccgggaagggtgg

SEQ ID NO: 1460869 - DNA, 18 bp, Homo sapiens
ccctggaactcctggcct

SEQ ID NO: 1460870 - DNA, 15 bp, Homo sapiens
ccctggaagagccca

SEQ ID NO: 1460871 - DNA, 18 bp, Homo sapiens
ccctggaagagcccagtc

SEQ ID NO: 1460872 - DNA, 22 bp, Homo sapiens
ccctggaagccggcggcccaag

SEQ ID NO: 1460873 - DNA, 9 bp, Homo sapiens
ccctggaat

SEQ ID NO: 1460874 - DNA, 19 bp, Homo sapiens
ccctggaattcagcaccct

SEQ ID NO: 1460875 - DNA, 23 bp, Homo sapiens
ccctggaattcagcaccctgggt

SEQ ID NO: 1460876 - DNA, 11 bp, Homo sapiens
ccctggacaca

SEQ ID NO: 1460877 - DNA, 12 bp, Homo sapiens
ccctggacacag

SEQ ID NO: 1460878 - DNA, 13 bp, Homo sapiens
ccctggacacagc

SEQ ID NO: 1460879 - DNA, 16 bp, Homo sapiens
ccctggacacagctct

SEQ ID NO: 1460880 - DNA, 19 bp, Homo sapiens
ccctggacacagctcttca

SEQ ID NO: 1460881 - DNA, 21 bp, Homo sapiens
ccctggacacagctcttcatt

SEQ ID NO: 1460882 - DNA, 21 bp, Homo sapiens
ccctggaccaccagccccagc

SEQ ID NO: 1460883 - DNA, 17 bp, Homo sapiens
ccctggacttgcctctg

SEQ ID NO: 1460884 - DNA, 17 bp, Homo sapiens
ccctggagagccccatg

SEQ ID NO: 1460885 - DNA, 12 bp, Homo sapiens
ccctggagccag

SEQ ID NO: 1460886 - DNA, 20 bp, Homo sapiens
ccctggagccagcagggctg

SEQ ID NO: 1460887 - DNA, 12 bp, Homo sapiens
ccctggagctgt

SEQ ID NO: 1460888 - DNA, 18 bp, Homo sapiens
ccctggagctgtccttca

SEQ ID NO: 1460889 - DNA, 20 bp, Homo sapiens
ccctggagctgtccttcatt

SEQ ID NO: 1460890 - DNA, 15 bp, Homo sapiens
ccctggaggcacgca

SEQ ID NO: 1460891 - DNA, 16 bp, Homo sapiens
ccctggaggcacgcac

SEQ ID NO: 1460892 - DNA, 19 bp, Homo sapiens
ccctggaggcacgcaccac

SEQ ID NO: 1460893 - DNA, 20 bp, Homo sapiens
ccctggaggcacgcaccact

SEQ ID NO: 1460894 - DNA, 17 bp, Homo sapiens
ccctggaggtctccagg

SEQ ID NO: 1460895 - DNA, 23 bp, Homo sapiens
ccctggatgggcattgggctgac

SEQ ID NO: 1460896 - DNA, 13 bp, Homo sapiens
ccctggatgtccc

SEQ ID NO: 1460897 - DNA, 21 bp, Homo sapiens
ccctggatgtcccctgtccca

SEQ ID NO: 1460898 - DNA, 19 bp, Homo sapiens
ccctggatgtgtggggcat

SEQ ID NO: 1460899 - DNA, 11 bp, Homo sapiens
ccctggcaccc

SEQ ID NO: 1460900 - DNA, 19 bp, Homo sapiens
ccctggcacctgtgttcca

SEQ ID NO: 1460901 - DNA, 23 bp, Homo sapiens
ccctggcaggtggccaggcaggc

SEQ ID NO: 1460902 - DNA, 14 bp, Homo sapiens
ccctggcagtgctg

SEQ ID NO: 1460903 - DNA, 20 bp, Homo sapiens
ccctggccaccttgtcctgg

SEQ ID NO: 1460904 - DNA, 16 bp, Homo sapiens
ccctggccagctctga

SEQ ID NO: 1460905 - DNA, 16 bp, Homo sapiens
ccctggcccgcccctc

SEQ ID NO: 1460906 - DNA, 20 bp, Homo sapiens
ccctggcccgcccctcgctg

SEQ ID NO: 1460907 - DNA, 20 bp, Homo sapiens
ccctggcctcccctgccacc

SEQ ID NO: 1460908 - DNA, 20 bp, Homo sapiens
ccctggccttaaaaggggcc

SEQ ID NO: 1460909 - DNA, 22 bp, Homo sapiens
ccctggccttaaaaggggccca

SEQ ID NO: 1460910 - DNA, 20 bp, Homo sapiens
ccctggctacttcccttcct

SEQ ID NO: 1460911 - DNA, 21 bp, Homo sapiens
ccctggctacttcccttcctc

SEQ ID NO: 1460912 - DNA, 20 bp, Homo sapiens
gtctaggactgcagtgtgga

SEQ ID NO: 1460913 - DNA, 18 bp, Homo sapiens
gtctaggagacagagcca

SEQ ID NO: 1460914 - DNA, 21 bp, Homo sapiens
gtctaggagctgggaggaaaa

SEQ ID NO: 1460915 - DNA, 19 bp, Homo sapiens
gtctaggctggaagagcca

SEQ ID NO: 1460916 - DNA, 12 bp, Homo sapiens
gtctagggagag

SEQ ID NO: 1460917 - DNA, 18 bp, Homo sapiens
gtctaggtctcctcaggg

SEQ ID NO: 1460918 - DNA, 20 bp, Homo sapiens
gtctataatcccagcacttt

SEQ ID NO: 1460919 - DNA, 17 bp, Homo sapiens
gtctatatcataactat

SEQ ID NO: 1460920 - DNA, 18 bp, Homo sapiens
gtctatatcataactata

SEQ ID NO: 1460921 - DNA, 15 bp, Homo sapiens
gtctatgaagttgct

SEQ ID NO: 1460922 - DNA, 22 bp, Homo sapiens
gtctatgtcgagagctggccaa

SEQ ID NO: 1460923 - DNA, 18 bp, Homo sapiens
gtctattaaaattctgat

SEQ ID NO: 1460924 - DNA, 16 bp, Homo sapiens
gtctattctgagcctt

SEQ ID NO: 1460925 - DNA, 15 bp, Homo sapiens
gtctattttaaaata

SEQ ID NO: 1460926 - DNA, 20 bp, Homo sapiens
gtctcaagagggcactggtg

SEQ ID NO: 1460927 - DNA, 19 bp, Homo sapiens
gtctcaagggctagcatcc

SEQ ID NO: 1460928 - DNA, 15 bp, Homo sapiens
gtctcacagagaagc

SEQ ID NO: 1460929 - DNA, 19 bp, Homo sapiens
gtctcacagagaagctcct

SEQ ID NO: 1460930 - DNA, 21 bp, Homo sapiens
gtctcacagagaagctcctgc

SEQ ID NO: 1460931 - DNA, 23 bp, Homo sapiens
gtctcacagagaagctcctgcta

SEQ ID NO: 1460932 - DNA, 21 bp, Homo sapiens
gtctcacccattatctggaat

SEQ ID NO: 1460933 - DNA, 18 bp, Homo sapiens
gtctcaccggctctcacc

SEQ ID NO: 1460934 - DNA, 19 bp, Homo sapiens
gtctcaccggctctcacct

SEQ ID NO: 1460935 - DNA, 13 bp, Homo sapiens
gtctcactcctga

SEQ ID NO: 1460936 - DNA, 17 bp, Homo sapiens
gtctcactcctgagtgg

SEQ ID NO: 1460937 - DNA, 21 bp, Homo sapiens
gtctcactgaaacatttaaat

SEQ ID NO: 1460938 - DNA, 22 bp, Homo sapiens
gtctcacttgtgcagtgttgac

SEQ ID NO: 1460939 - DNA, 14 bp, Homo sapiens
gtctcagaagaggt

SEQ ID NO: 1460940 - DNA, 13 bp, Homo sapiens
gtctcagcctccc

SEQ ID NO: 1460941 - DNA, 15 bp, Homo sapiens
gtctcagcctcctga

SEQ ID NO: 1460942 - DNA, 13 bp, Homo sapiens
gtctcagcctctg

SEQ ID NO: 1460943 - DNA, 18 bp, Homo sapiens
gtctcagcctctgccagc

SEQ ID NO: 1460944 - DNA, 12 bp, Homo sapiens
gtctcaggcagc

SEQ ID NO: 1460945 - DNA, 13 bp, Homo sapiens
gtctcaggcagca

SEQ ID NO: 1460946 - DNA, 22 bp, Homo sapiens
gtctcaggtttgttttgtgaat

SEQ ID NO: 1460947 - DNA, 15 bp, Homo sapiens
gtctcagtttcactt

SEQ ID NO: 1460948 - DNA, 19 bp, Homo sapiens
gtctcagtttgtgtgtctt

SEQ ID NO: 1460949 - DNA, 13 bp, Homo sapiens
gtctcatccccag

SEQ ID NO: 1460950 - DNA, 14 bp, Homo sapiens
gtctcatccccagg

SEQ ID NO: 1460951 - DNA, 16 bp, Homo sapiens
gtctcatccccagggg

SEQ ID NO: 1460952 - DNA, 15 bp, Homo sapiens
gtctcatctcttcag

SEQ ID NO: 1460953 - DNA, 18 bp, Homo sapiens
gtctcatctcttcaggtt

SEQ ID NO: 1460954 - DNA, 16 bp, Homo sapiens
gtctcatgctgttgct

SEQ ID NO: 1460955 - DNA, 23 bp, Homo sapiens
gtctccaagggagggtgcagccc

SEQ ID NO: 1460956 - DNA, 14 bp, Homo sapiens
gtctccagctgcct

SEQ ID NO: 1460957 - DNA, 23 bp, Homo sapiens
gtctccagctgcctgggcccgga

SEQ ID NO: 1460958 - DNA, 14 bp, Homo sapiens
gtctccaggggcct

SEQ ID NO: 1460959 - DNA, 20 bp, Homo sapiens
gtctccaggggctgcttcct

SEQ ID NO: 1460960 - DNA, 21 bp, Homo sapiens
gtctccatgaggtactggtcc

SEQ ID NO: 1460961 - DNA, 13 bp, Homo sapiens
gtctccatgtttg

SEQ ID NO: 1460962 - DNA, 19 bp, Homo sapiens
gtctcccaggccccctgca

SEQ ID NO: 1460963 - DNA, 19 bp, Homo sapiens
gtctccctcccctctcaga

SEQ ID NO: 1460964 - DNA, 22 bp, Homo sapiens
gtctccctcccctctcagaaca

SEQ ID NO: 1460965 - DNA, 23 bp, Homo sapiens
gtctccctcccctctcagaacat

SEQ ID NO: 1460966 - DNA, 14 bp, Homo sapiens
gtctccctctcctg

SEQ ID NO: 1460967 - DNA, 15 bp, Homo sapiens
gtctccctctcctgc

SEQ ID NO: 1460968 - DNA, 17 bp, Homo sapiens
gtctccctctcctgcct

SEQ ID NO: 1460969 - DNA, 21 bp, Homo sapiens
gtctccctggtgcctctgtgc

SEQ ID NO: 1460970 - DNA, 14 bp, Homo sapiens
gtctcccttctctc

SEQ ID NO: 1460971 - DNA, 19 bp, Homo sapiens
gtctcccttggcccagaga

SEQ ID NO: 1460972 - DNA, 20 bp, Homo sapiens
gtctcctcaacccacatggg

SEQ ID NO: 1460973 - DNA, 12 bp, Homo sapiens
gtctcctcctcg

SEQ ID NO: 1460974 - DNA, 15 bp, Homo sapiens
gtctcctctccattt

SEQ ID NO: 1460975 - DNA, 23 bp, Homo sapiens
gtctcctgtcttatggtccagaa

SEQ ID NO: 1460976 - DNA, 19 bp, Homo sapiens
gtctccttactctgagccc

SEQ ID NO: 1460977 - DNA, 18 bp, Homo sapiens
gtctccttcagcacggcg

SEQ ID NO: 1460978 - DNA, 14 bp, Homo sapiens
gtctccttgcactt

SEQ ID NO: 1460979 - DNA, 15 bp, Homo sapiens
gtctccttgggccct

SEQ ID NO: 1460980 - DNA, 23 bp, Homo sapiens
gtctccttgggccctttttccct

SEQ ID NO: 1460981 - DNA, 18 bp, Homo sapiens
gtctcctttgcactgagg

SEQ ID NO: 1460982 - DNA, 13 bp, Homo sapiens
gtctcctttgctc

SEQ ID NO: 1460983 - DNA, 18 bp, Homo sapiens
gtctcctttgctcttgcc

SEQ ID NO: 1460984 - DNA, 16 bp, Homo sapiens
gtctcgaactcctggc

SEQ ID NO: 1460985 - DNA, 16 bp, Homo sapiens
gtctcgaatgtaattg

SEQ ID NO: 1460986 - DNA, 15 bp, Homo sapiens
gtctcgcagcctgaa

SEQ ID NO: 1460987 - DNA, 16 bp, Homo sapiens
gtctcgcagcctgaag

SEQ ID NO: 1460988 - DNA, 19 bp, Homo sapiens
gtctcgcagcctgaagcct

SEQ ID NO: 1460989 - DNA, 16 bp, Homo sapiens
gtctcgctttgttgcc

SEQ ID NO: 1460990 - DNA, 15 bp, Homo sapiens
gtctcggccttcaca

SEQ ID NO: 1460991 - DNA, 22 bp, Homo sapiens
gtctctaaaaagaagccacaga

SEQ ID NO: 1460992 - DNA, 20 bp, Homo sapiens
gtctctaatgtctgcagctc

SEQ ID NO: 1460993 - DNA, 12 bp, Homo sapiens
gtctctagagca

SEQ ID NO: 1460994 - DNA, 16 bp, Homo sapiens
gtctctatattatgtc

SEQ ID NO: 1460995 - DNA, 21 bp, Homo sapiens
gtctctatattatgtcttctt

SEQ ID NO: 1460996 - DNA, 17 bp, Homo sapiens
gtctctcactgttgcag

SEQ ID NO: 1460997 - DNA, 14 bp, Homo sapiens
gtctctccactgct

SEQ ID NO: 1460998 - DNA, 20 bp, Homo sapiens
gtctctccactgctctcagc

SEQ ID NO: 1460999 - DNA, 13 bp, Homo sapiens
gtctctcccaccc

SEQ ID NO: 1461000 - DNA, 21 bp, Homo sapiens
gtctctccttcctcttggctg

SEQ ID NO: 1461001 - DNA, 22 bp, Homo sapiens
gtctctctccaggtcagcctgg

SEQ ID NO: 1461002 - DNA, 23 bp, Homo sapiens
gtctctctccaggtcagcctgga

SEQ ID NO: 1461003 - DNA, 22 bp, Homo sapiens
gtctctctgccaagatccatct

SEQ ID NO: 1461004 - DNA, 12 bp, Homo sapiens
gtctctctttct

SEQ ID NO: 1461005 - DNA, 12 bp, Homo sapiens
gtctctgaaggg

SEQ ID NO: 1461006 - DNA, 15 bp, Homo sapiens
gtctctgaggggtgg

SEQ ID NO: 1461007 - DNA, 22 bp, Homo sapiens
gtctctgaggggtgggggtgcc

SEQ ID NO: 1461008 - DNA, 17 bp, Homo sapiens
gtctctgagtcctttgc

SEQ ID NO: 1461009 - DNA, 16 bp, Homo sapiens
gtctctgccatgtggc

SEQ ID NO: 1461010 - DNA, 18 bp, Homo sapiens
gtctctgccatgtggcag

SEQ ID NO: 1461011 - DNA, 19 bp, Homo sapiens
gtctctgccatgtggcaga

SEQ ID NO: 1461012 - DNA, 15 bp, Homo sapiens
gtctctgccgcctgc

SEQ ID NO: 1461013 - DNA, 15 bp, Homo sapiens
gtctctgccttaggg

SEQ ID NO: 1461014 - DNA, 13 bp, Homo sapiens
gtctctgctggcc

SEQ ID NO: 1461015 - DNA, 15 bp, Homo sapiens
gtctctgctggccca

SEQ ID NO: 1461016 - DNA, 16 bp, Homo sapiens
gtctctgctggcccag

SEQ ID NO: 1461017 - DNA, 12 bp, Homo sapiens
gtctctgggagc

SEQ ID NO: 1461018 - DNA, 15 bp, Homo sapiens
gtctctgtgagactc

SEQ ID NO: 1461019 - DNA, 20 bp, Homo sapiens
gtctctgttcagatgtgcat

SEQ ID NO: 1461020 - DNA, 21 bp, Homo sapiens
gtctctgttcagatgtgcatt

SEQ ID NO: 1461021 - DNA, 18 bp, Homo sapiens
gtctcttcggcagggagg

SEQ ID NO: 1461022 - DNA, 17 bp, Homo sapiens
gtctcttctccactgga

SEQ ID NO: 1461023 - DNA, 22 bp, Homo sapiens
gtctcttctgaataaagcaatt

SEQ ID NO: 1461024 - DNA, 21 bp, Homo sapiens
gtctcttctgggcgtctgagc

SEQ ID NO: 1461025 - DNA, 22 bp, Homo sapiens
gtctcttctgggcgtctgagct

SEQ ID NO: 1461026 - DNA, 21 bp, Homo sapiens
gtctcttcttggggcccagtg

SEQ ID NO: 1461027 - DNA, 19 bp, Homo sapiens
gtcttagaagtggaccagg

SEQ ID NO: 1461028 - DNA, 22 bp, Homo sapiens
gtcttagaagtggaccaggaca

SEQ ID NO: 1461029 - DNA, 23 bp, Homo sapiens
gtcttagaagtggaccaggacag

SEQ ID NO: 1461030 - DNA, 18 bp, Homo sapiens
gtcttatctgttcagtgt

SEQ ID NO: 1461031 - DNA, 21 bp, Homo sapiens
gtcttatcttctgcagtgagt

SEQ ID NO: 1461032 - DNA, 16 bp, Homo sapiens
gtcttatggtccagaa

SEQ ID NO: 1461033 - DNA, 14 bp, Homo sapiens
gtcttatttattat

SEQ ID NO: 1461034 - DNA, 14 bp, Homo sapiens
gtcttcaatctctg

SEQ ID NO: 1461035 - DNA, 15 bp, Homo sapiens
gtcttcaatctctgt

SEQ ID NO: 1461036 - DNA, 18 bp, Homo sapiens
gtcttcaatctctgttct

SEQ ID NO: 1461037 - DNA, 14 bp, Homo sapiens
gtcttcacactgcg

SEQ ID NO: 1461038 - DNA, 17 bp, Homo sapiens
gtcttcagacccagaga

SEQ ID NO: 1461039 - DNA, 13 bp, Homo sapiens
gtcttcagcctag

SEQ ID NO: 1461040 - DNA, 23 bp, Homo sapiens
gtcttcagcctagccgacctcag

SEQ ID NO: 1461041 - DNA, 21 bp, Homo sapiens
gtcttcagtctcacagagaag

SEQ ID NO: 1461042 - DNA, 18 bp, Homo sapiens
gtcttcatcccctcagaa

SEQ ID NO: 1461043 - DNA, 15 bp, Homo sapiens
gtcttccataatgta

SEQ ID NO: 1461044 - DNA, 12 bp, Homo sapiens
gtcttccatggg

SEQ ID NO: 1461045 - DNA, 16 bp, Homo sapiens
gtcttccctacctcag

SEQ ID NO: 1461046 - DNA, 21 bp, Homo sapiens
gtcttccctacctcaggcagg

SEQ ID NO: 1461047 - DNA, 18 bp, Homo sapiens
gtcttcctatttcagaag

SEQ ID NO: 1461048 - DNA, 15 bp, Homo sapiens
gtcttcctcttagcc

SEQ ID NO: 1461049 - DNA, 22 bp, Homo sapiens
gtcttcctcttagcctctggat

SEQ ID NO: 1461050 - DNA, 17 bp, Homo sapiens
gtcttcctgcattcacc

SEQ ID NO: 1461051 - DNA, 22 bp, Homo sapiens
gtcttcctgtgtacctctagaa

SEQ ID NO: 1461052 - DNA, 15 bp, Homo sapiens
gtcttccttctaccc

SEQ ID NO: 1461053 - DNA, 18 bp, Homo sapiens
gtcttccttctaccccaa

SEQ ID NO: 1461054 - DNA, 15 bp, Homo sapiens
gtcttctaatttcaa

SEQ ID NO: 1461055 - DNA, 14 bp, Homo sapiens
gtcttctctctggc

SEQ ID NO: 1461056 - DNA, 21 bp, Homo sapiens
gtcttctgccctaacctgaca

SEQ ID NO: 1461057 - DNA, 17 bp, Homo sapiens
gtcttctgcctgttata

SEQ ID NO: 1461058 - DNA, 18 bp, Homo sapiens
gtcttctggacaggctct

SEQ ID NO: 1461059 - DNA, 23 bp, Homo sapiens
gtcttctggacaggctctgcttc

SEQ ID NO: 1461060 - DNA, 16 bp, Homo sapiens
gtcttcttacatgcat

SEQ ID NO: 1461061 - DNA, 16 bp, Homo sapiens
gtcttgaaagtggcac

SEQ ID NO: 1461062 - DNA, 13 bp, Homo sapiens
gtcttgaaatgaa

SEQ ID NO: 1461063 - DNA, 17 bp, Homo sapiens
gtcttgaacgagcagcc

SEQ ID NO: 1461064 - DNA, 19 bp, Homo sapiens
gtcttgaatgtcttttgaa

SEQ ID NO: 1461065 - DNA, 12 bp, Homo sapiens
gtcttgaatttc

SEQ ID NO: 1461066 - DNA, 12 bp, Homo sapiens
gtcttgactcat

SEQ ID NO: 1461067 - DNA, 19 bp, Homo sapiens
gtcttgactcatggcagct

SEQ ID NO: 1461068 - DNA, 21 bp, Homo sapiens
gtcttgactctaaatgcagtt

SEQ ID NO: 1461069 - DNA, 22 bp, Homo sapiens
gtcttgactctaaatgcagttt

SEQ ID NO: 1461070 - DNA, 19 bp, Homo sapiens
gtcttgatgtgtcatctaa

SEQ ID NO: 1461071 - DNA, 19 bp, Homo sapiens
gtcttgccagccagaagcc

SEQ ID NO: 1461072 - DNA, 16 bp, Homo sapiens
gtcttgcccagcagct

SEQ ID NO: 1461073 - DNA, 22 bp, Homo sapiens
gtcttggaagctgtttggaaaa

SEQ ID NO: 1461074 - DNA, 15 bp, Homo sapiens
gtcttggacactgta

SEQ ID NO: 1461075 - DNA, 18 bp, Homo sapiens
gtcttggcggcagcagcc

SEQ ID NO: 1461076 - DNA, 23 bp, Homo sapiens
gtcttggcggcagcagccatcat

SEQ ID NO: 1461077 - DNA, 21 bp, Homo sapiens
gtcttgggcagagctggctct

SEQ ID NO: 1461078 - DNA, 22 bp, Homo sapiens
gtcttgggctactggcagctcc

SEQ ID NO: 1461079 - DNA, 17 bp, Homo sapiens
gtcttggttctaaaggt

SEQ ID NO: 1461080 - DNA, 13 bp, Homo sapiens
gtcttgtaattgt

SEQ ID NO: 1461081 - DNA, 12 bp, Homo sapiens
gtcttgtacttc

SEQ ID NO: 1461082 - DNA, 13 bp, Homo sapiens
gtcttgtacttct

SEQ ID NO: 1461083 - DNA, 16 bp, Homo sapiens
gtcttgtacttctgtg

SEQ ID NO: 1461084 - DNA, 20 bp, Homo sapiens
gtcttgttgcggatggatgg

SEQ ID NO: 1461085 - DNA, 20 bp, Homo sapiens
gtcttgttgttattgatgtt

SEQ ID NO: 1461086 - DNA, 17 bp, Homo sapiens
gtctttaggcagcagct

SEQ ID NO: 1461087 - DNA, 17 bp, Homo sapiens
gtctttagttttgattt

SEQ ID NO: 1461088 - DNA, 16 bp, Homo sapiens
gtctttcacagctcct

SEQ ID NO: 1461089 - DNA, 14 bp, Homo sapiens
gtctttcagcattc

SEQ ID NO: 1461090 - DNA, 16 bp, Homo sapiens
gtctttcagcattcag

SEQ ID NO: 1461091 - DNA, 11 bp, Homo sapiens
gtctttcagta

SEQ ID NO: 1461092 - DNA, 23 bp, Homo sapiens
gtctttctcaaagaaatattaag

SEQ ID NO: 1461093 - DNA, 18 bp, Homo sapiens
gtctttctctaaatatga

SEQ ID NO: 1461094 - DNA, 15 bp, Homo sapiens
gtctttcttcttcaa

SEQ ID NO: 1461095 - DNA, 19 bp, Homo sapiens
gtctttgcacatgtgacca

SEQ ID NO: 1461096 - DNA, 13 bp, Homo sapiens
gtctttgccttct

SEQ ID NO: 1461097 - DNA, 15 bp, Homo sapiens
gtctttgctgtactc

SEQ ID NO: 1461098 - DNA, 15 bp, Homo sapiens
gtctttggttcagct

SEQ ID NO: 1461099 - DNA, 15 bp, Homo sapiens
gtctttggttctaag

SEQ ID NO: 1461100 - DNA, 17 bp, Homo sapiens
gtctttggttctaagga

SEQ ID NO: 1461101 - DNA, 13 bp, Homo sapiens
gtctttgtgggag

SEQ ID NO: 1461102 - DNA, 16 bp, Homo sapiens
gtctttgttgtctccc

SEQ ID NO: 1461103 - DNA, 17 bp, Homo sapiens
gtcttttaatgcttcat

SEQ ID NO: 1461104 - DNA, 24 bp, Homo sapiens
gtcttttaggacccttcccttgag

SEQ ID NO: 1461105 - DNA, 23 bp, Homo sapiens
gtcttttctgtcaccaaatttgt

SEQ ID NO: 1461106 - DNA, 19 bp, Homo sapiens
gtcttttgaatattcccaa

SEQ ID NO: 1461107 - DNA, 23 bp, Homo sapiens
gtcttttgagctattcacctcag

SEQ ID NO: 1461108 - DNA, 13 bp, Homo sapiens
gtcttttgctttt

SEQ ID NO: 1461109 - DNA, 16 bp, Homo sapiens
gtcttttgcttttggc

SEQ ID NO: 1461110 - DNA, 16 bp, Homo sapiens
gtcttttgttctctga

SEQ ID NO: 1461111 - DNA, 17 bp, Homo sapiens
gtcttttttttcctttg

SEQ ID NO: 1461112 - DNA, 20 bp, Homo sapiens
gtcttttttttcctttgaac

SEQ ID NO: 1461113 - DNA, 23 bp, Homo sapiens
gtctttttttttctttttccagt

SEQ ID NO: 1461114 - DNA, 22 bp, Homo sapiens
gtgaaacaatgttgtccaacaa

SEQ ID NO: 1461115 - DNA, 15 bp, Homo sapiens
gtgaaacacagctgt

SEQ ID NO: 1461116 - DNA, 17 bp, Homo sapiens
gtgaaacccccatctct

SEQ ID NO: 1461117 - DNA, 23 bp, Homo sapiens
gtgaaacctttagggcagcttgc

SEQ ID NO: 1461118 - DNA, 21 bp, Homo sapiens
gtgaaactgaaggtcaataaa

SEQ ID NO: 1461119 - DNA, 17 bp, Homo sapiens
gtgaaagtacatttgga

SEQ ID NO: 1461120 - DNA, 15 bp, Homo sapiens
gtgaaatacatcctt

SEQ ID NO: 1461121 - DNA, 23 bp, Homo sapiens
gtgaaataccacaagcctgagaa

SEQ ID NO: 1461122 - DNA, 17 bp, Homo sapiens
gtgaaatcaaaggtgct

SEQ ID NO: 1461123 - DNA, 13 bp, Homo sapiens
gtgaaatggccac

SEQ ID NO: 1461124 - DNA, 21 bp, Homo sapiens
gtgaaatggctggggccgctg

SEQ ID NO: 1461125 - DNA, 15 bp, Homo sapiens
gtgaaattaagcatt

SEQ ID NO: 1461126 - DNA, 15 bp, Homo sapiens
gtgaaattctcagag

SEQ ID NO: 1461127 - DNA, 20 bp, Homo sapiens
gtgaaattttggtgaatgtg

SEQ ID NO: 1461128 - DNA, 14 bp, Homo sapiens
gtgaacaaggtaaa

SEQ ID NO: 1461129 - DNA, 16 bp, Homo sapiens
gtgaacacacacaagg

SEQ ID NO: 1461130 - DNA, 13 bp, Homo sapiens
gtgaacacatcag

SEQ ID NO: 1461131 - DNA, 15 bp, Homo sapiens
gtgaacacatcagct

SEQ ID NO: 1461132 - DNA, 13 bp, Homo sapiens
gtgaacactgtga

SEQ ID NO: 1461133 - DNA, 20 bp, Homo sapiens
gtgaaccaaaaatagaaatt

SEQ ID NO: 1461134 - DNA, 14 bp, Homo sapiens
gtgaacgatttaga

SEQ ID NO: 1461135 - DNA, 22 bp, Homo sapiens
gtgaacgtggggtgagggatca

SEQ ID NO: 1461136 - DNA, 15 bp, Homo sapiens
gtgaactgcaaagct

SEQ ID NO: 1461137 - DNA, 13 bp, Homo sapiens
gtgaactggaaga

SEQ ID NO: 1461138 - DNA, 21 bp, Homo sapiens
gtgaactgtgagggtaaaggc

SEQ ID NO: 1461139 - DNA, 13 bp, Homo sapiens
gtgaagacatttt

SEQ ID NO: 1461140 - DNA, 21 bp, Homo sapiens
gtgaagagaatgtattctgta

SEQ ID NO: 1461141 - DNA, 15 bp, Homo sapiens
gtgaagaggggcagc

SEQ ID NO: 1461142 - DNA, 20 bp, Homo sapiens
gtgcacctattctgtagttg

SEQ ID NO: 1461143 - DNA, 16 bp, Homo sapiens
gtgcacctgcctccac

SEQ ID NO: 1461144 - DNA, 21 bp, Homo sapiens
gtgcacctgtactcaggaggc

SEQ ID NO: 1461145 - DNA, 18 bp, Homo sapiens
gtgcacgtggagagctgg

SEQ ID NO: 1461146 - DNA, 15 bp, Homo sapiens
gtgcactccagcttc

SEQ ID NO: 1461147 - DNA, 13 bp, Homo sapiens
gtgcactctgcta

SEQ ID NO: 1461148 - DNA, 20 bp, Homo sapiens
gtgcactctgctaatcatgt

SEQ ID NO: 1461149 - DNA, 9 bp, Homo sapiens
gtgcagaat

SEQ ID NO: 1461150 - DNA, 13 bp, Homo sapiens
gtgcagaatgtaa

SEQ ID NO: 1461151 - DNA, 13 bp, Homo sapiens
gtgcagacaggcc

SEQ ID NO: 1461152 - DNA, 23 bp, Homo sapiens
gtgcagacaggccatgtgagcca

SEQ ID NO: 1461153 - DNA, 17 bp, Homo sapiens
gtgcagaggtttcttga

SEQ ID NO: 1461154 - DNA, 12 bp, Homo sapiens
gtgcagcagccc

SEQ ID NO: 1461155 - DNA, 16 bp, Homo sapiens
gtgcagcagcccagct

SEQ ID NO: 1461156 - DNA, 17 bp, Homo sapiens
gtgcaggacagctcttg

SEQ ID NO: 1461157 - DNA, 17 bp, Homo sapiens
gtgcagggacaaagagg

SEQ ID NO: 1461158 - DNA, 23 bp, Homo sapiens
gtgcagggaggaggtggcagccc

SEQ ID NO: 1461159 - DNA, 20 bp, Homo sapiens
gtgcagggagggcagttttc

SEQ ID NO: 1461160 - DNA, 20 bp, Homo sapiens
gtgcagggtgtgtactgcac

SEQ ID NO: 1461161 - DNA, 15 bp, Homo sapiens
gtgcagtactttgtg

SEQ ID NO: 1461162 - DNA, 16 bp, Homo sapiens
gtgcagtatctcaaga

SEQ ID NO: 1461163 - DNA, 19 bp, Homo sapiens
gtgcagtggcccccacaga

SEQ ID NO: 1461164 - DNA, 16 bp, Homo sapiens
gtgcagttgtgatttc

SEQ ID NO: 1461165 - DNA, 17 bp, Homo sapiens
gtgcagttgtgatttct

SEQ ID NO: 1461166 - DNA, 14 bp, Homo sapiens
gtgcatagcgtcct

SEQ ID NO: 1461167 - DNA, 21 bp, Homo sapiens
gtgcatagcgtcctgccctgc

SEQ ID NO: 1461168 - DNA, 16 bp, Homo sapiens
gtgcatatctgcctcc

SEQ ID NO: 1461169 - DNA, 14 bp, Homo sapiens
gtgcatctcagccc

SEQ ID NO: 1461170 - DNA, 15 bp, Homo sapiens
gtgcatctcagccca

SEQ ID NO: 1461171 - DNA, 14 bp, Homo sapiens
gtgcatctcctccc

SEQ ID NO: 1461172 - DNA, 22 bp, Homo sapiens
gtgcatctcctcccgcccttcc

SEQ ID NO: 1461173 - DNA, 14 bp, Homo sapiens
gtgcatctggtgta

SEQ ID NO: 1461174 - DNA, 18 bp, Homo sapiens
gtgcatgctctctgcagc

SEQ ID NO: 1461175 - DNA, 19 bp, Homo sapiens
gtgcatgctctctgcagcc

SEQ ID NO: 1461176 - DNA, 21 bp, Homo sapiens
gtgcatgctctctgcagccag

SEQ ID NO: 1461177 - DNA, 16 bp, Homo sapiens
gtgcatgctgtagctg

SEQ ID NO: 1461178 - DNA, 18 bp, Homo sapiens
gtgcatgtgaagcatgct

SEQ ID NO: 1461179 - DNA, 18 bp, Homo sapiens
gtgcatgtgtgtgtctgt

SEQ ID NO: 1461180 - DNA, 14 bp, Homo sapiens
gtgcattaaataac

SEQ ID NO: 1461181 - DNA, 16 bp, Homo sapiens
gtgcattctttggtaa

SEQ ID NO: 1461182 - DNA, 17 bp, Homo sapiens
gtgcatttcaaggaaca

SEQ ID NO: 1461183 - DNA, 20 bp, Homo sapiens
gtgcatttcacctgtgacaa

SEQ ID NO: 1461184 - DNA, 17 bp, Homo sapiens
gtgcattttcccagata

SEQ ID NO: 1461185 - DNA, 21 bp, Homo sapiens
gtgcattttctaagtgggaca

SEQ ID NO: 1461186 - DNA, 22 bp, Homo sapiens
gtgcattttctaagtgggacat

SEQ ID NO: 1461187 - DNA, 22 bp, Homo sapiens
gtgccaaacaaaaaggttctca

SEQ ID NO: 1461188 - DNA, 14 bp, Homo sapiens
gtgccaactgccag

SEQ ID NO: 1461189 - DNA, 17 bp, Homo sapiens
gtgccaagcacagtgcc

SEQ ID NO: 1461190 - DNA, 15 bp, Homo sapiens
gtgccaagggcccca

SEQ ID NO: 1461191 - DNA, 16 bp, Homo sapiens
gtgccaagggccccag

SEQ ID NO: 1461192 - DNA, 22 bp, Homo sapiens
gtgccaagtcctagctcctcct

SEQ ID NO: 1461193 - DNA, 21 bp, Homo sapiens
gtgccacccatgcagctgctc

SEQ ID NO: 1461194 - DNA, 23 bp, Homo sapiens
gtgccacccatgcagctgctccc

SEQ ID NO: 1461195 - DNA, 21 bp, Homo sapiens
gtgccacccgtaggcagcctc

SEQ ID NO: 1461196 - DNA, 22 bp, Homo sapiens
gtgccactcaccgaagccactt

SEQ ID NO: 1461197 - DNA, 16 bp, Homo sapiens
gtgccactccctgagc

SEQ ID NO: 1461198 - DNA, 17 bp, Homo sapiens
gtgccactgacttgctg

SEQ ID NO: 1461199 - DNA, 18 bp, Homo sapiens
gtgccactgacttgctgt

SEQ ID NO: 1461200 - DNA, 23 bp, Homo sapiens
gtgccactgccccccgaggctgc

SEQ ID NO: 1461201 - DNA, 18 bp, Homo sapiens
gtgccacttaatgtatgt

SEQ ID NO: 1461202 - DNA, 22 bp, Homo sapiens
gtgccacttcttaaaggcctgg

SEQ ID NO: 1461203 - DNA, 23 bp, Homo sapiens
gtgccagacattgctctcagtgc

SEQ ID NO: 1461204 - DNA, 21 bp, Homo sapiens
gtgccagaggaatcctggcag

SEQ ID NO: 1461205 - DNA, 16 bp, Homo sapiens
gtgccagaggtgggca

SEQ ID NO: 1461206 - DNA, 17 bp, Homo sapiens
gtgccagaggtgggcag

SEQ ID NO: 1461207 - DNA, 12 bp, Homo sapiens
gtgccagcagcc

SEQ ID NO: 1461208 - DNA, 13 bp, Homo sapiens
gtgccagcagcct

SEQ ID NO: 1461209 - DNA, 23 bp, Homo sapiens
gtgccagcagcctcgcacaggcc

SEQ ID NO: 1461210 - DNA, 13 bp, Homo sapiens
gtgccagccttcc

SEQ ID NO: 1461211 - DNA, 18 bp, Homo sapiens
gtgccagccttcctctgc

SEQ ID NO: 1461212 - DNA, 13 bp, Homo sapiens
gtgccaggcccgg

SEQ ID NO: 1461213 - DNA, 17 bp, Homo sapiens
gtgccaggcccggggct

SEQ ID NO: 1461214 - DNA, 19 bp, Homo sapiens
gtgccaggcccggggctgg

SEQ ID NO: 1461215 - DNA, 16 bp, Homo sapiens
gtgccagggctgcagg

SEQ ID NO: 1461216 - DNA, 15 bp, Homo sapiens
gtgccagttcctgta

SEQ ID NO: 1461217 - DNA, 22 bp, Homo sapiens
gtgccagttcctgtaacaggtg

SEQ ID NO: 1461218 - DNA, 16 bp, Homo sapiens
gtgccatgcctgctcc

SEQ ID NO: 1461219 - DNA, 24 bp, Homo sapiens
gtgccatgcctgctccctgtctgt

SEQ ID NO: 1461220 - DNA, 14 bp, Homo sapiens
gtgccatgctgggc

SEQ ID NO: 1461221 - DNA, 20 bp, Homo sapiens
gtgccattttaaaaatagaa

SEQ ID NO: 1461222 - DNA, 17 bp, Homo sapiens
gtgcccaaagtggggag

SEQ ID NO: 1461223 - DNA, 19 bp, Homo sapiens
gtgcccaaagtggggaggg

SEQ ID NO: 1461224 - DNA, 19 bp, Homo sapiens
gtgcccaagccagaggctg

SEQ ID NO: 1461225 - DNA, 16 bp, Homo sapiens
gtgcccacatttgatg

SEQ ID NO: 1461226 - DNA, 22 bp, Homo sapiens
gtgcccagaactggactcagga

SEQ ID NO: 1461227 - DNA, 12 bp, Homo sapiens
gtgcccagcagg

SEQ ID NO: 1461228 - DNA, 14 bp, Homo sapiens
gtgcccagcaggcc

SEQ ID NO: 1461229 - DNA, 22 bp, Homo sapiens
gtgcccagcaggcccagcatgc

SEQ ID NO: 1461230 - DNA, 12 bp, Homo sapiens
gtgcccaggccc

SEQ ID NO: 1461231 - DNA, 13 bp, Homo sapiens
gtgcccaggccct

SEQ ID NO: 1461232 - DNA, 17 bp, Homo sapiens
gtgcccaggcccttggc

SEQ ID NO: 1461233 - DNA, 13 bp, Homo sapiens
gtgcccagggttt

SEQ ID NO: 1461234 - DNA, 18 bp, Homo sapiens
gtgcccagtggagcctgc

SEQ ID NO: 1461235 - DNA, 20 bp, Homo sapiens
gtgcccagtggagcctgccg

SEQ ID NO: 1461236 - DNA, 12 bp, Homo sapiens
gtgccccacctg

SEQ ID NO: 1461237 - DNA, 19 bp, Homo sapiens
gtgccccactccagcctgg

SEQ ID NO: 1461238 - DNA, 20 bp, Homo sapiens
gtgccccactccagcctggg

SEQ ID NO: 1461239 - DNA, 13 bp, Homo sapiens
gtgccccagactg

SEQ ID NO: 1461240 - DNA, 15 bp, Homo sapiens
gtgccccagactgag

SEQ ID NO: 1461241 - DNA, 18 bp, Homo sapiens
gtgccccagactgagctc

SEQ ID NO: 1461242 - DNA, 22 bp, Homo sapiens
gtgccccagactgagctctcca

SEQ ID NO: 1461243 - DNA, 12 bp, Homo sapiens
gtgccccaggac

SEQ ID NO: 1461244 - DNA, 19 bp, Homo sapiens
gtgccccaggaccagctca

SEQ ID NO: 1461245 - DNA, 21 bp, Homo sapiens
gtgccccaggaccagctcagg

SEQ ID NO: 1461246 - DNA, 14 bp, Homo sapiens
gtgccccctcctct

SEQ ID NO: 1461247 - DNA, 21 bp, Homo sapiens
gtgcccctctccttcttagct

SEQ ID NO: 1461248 - DNA, 16 bp, Homo sapiens
gtgcccgcaggaactg

SEQ ID NO: 1461249 - DNA, 14 bp, Homo sapiens
gtgcccgtgtcggt

SEQ ID NO: 1461250 - DNA, 12 bp, Homo sapiens
gtgccctcacca

SEQ ID NO: 1461251 - DNA, 20 bp, Homo sapiens
gtgccctccacagccgcagc

SEQ ID NO: 1461252 - DNA, 12 bp, Homo sapiens
gtgccctctcca

SEQ ID NO: 1461253 - DNA, 18 bp, Homo sapiens
gtgccctgaaagggccct

SEQ ID NO: 1461254 - DNA, 14 bp, Homo sapiens
gtgccctgccccca

SEQ ID NO: 1461255 - DNA, 14 bp, Homo sapiens
gtgccctgcctcca

SEQ ID NO: 1461256 - DNA, 22 bp, Homo sapiens
gtgcccttgcccttggagctgc

SEQ ID NO: 1461257 - DNA, 18 bp, Homo sapiens
aatattagtgattctgat

SEQ ID NO: 1461258 - DNA, 22 bp, Homo sapiens
aatattagtgattctgatttca

SEQ ID NO: 1461259 - DNA, 15 bp, Homo sapiens
aatacagtgagctct

SEQ ID NO: 1461260 - DNA, 16 bp, Homo sapiens
aatacatagtgaaaat

SEQ ID NO: 1461261 - DNA, 17 bp, Homo sapiens
aatacatcagaaaataa

SEQ ID NO: 1461262 - DNA, 20 bp, Homo sapiens
aatacatgcaacagaagtga

SEQ ID NO: 1461263 - DNA, 13 bp, Homo sapiens
aatacatgcatct

SEQ ID NO: 1461264 - DNA, 18 bp, Homo sapiens
aatacatgccacatcaaa

SEQ ID NO: 1461265 - DNA, 17 bp, Homo sapiens
aatacattaacggtgct

SEQ ID NO: 1461266 - DNA, 23 bp, Homo sapiens
aatacattccattgttttagtaa

SEQ ID NO: 1461267 - DNA, 13 bp, Homo sapiens
aatacattctttg

SEQ ID NO: 1461268 - DNA, 17 bp, Homo sapiens
aatacattctttgctag

SEQ ID NO: 1461269 - DNA, 12 bp, Homo sapiens
aatacatttgta

SEQ ID NO: 1461270 - DNA, 17 bp, Homo sapiens
aatacatttgtaagtgt

SEQ ID NO: 1461271 - DNA, 17 bp, Homo sapiens
aatacatttgtattttg

SEQ ID NO: 1461272 - DNA, 18 bp, Homo sapiens
aatacatttgtattttgt

SEQ ID NO: 1461273 - DNA, 20 bp, Homo sapiens
aatacattttgtatattaac

SEQ ID NO: 1461274 - DNA, 15 bp, Homo sapiens
aataccaaaaattag

SEQ ID NO: 1461275 - DNA, 14 bp, Homo sapiens
aataccacaagcct

SEQ ID NO: 1461276 - DNA, 16 bp, Homo sapiens
aataccacaagcctga

SEQ ID NO: 1461277 - DNA, 23 bp, Homo sapiens
aataccactggttaaaataaagc

SEQ ID NO: 1461278 - DNA, 14 bp, Homo sapiens
aataccactgtaat

SEQ ID NO: 1461279 - DNA, 18 bp, Homo sapiens
aataccattaaaactgct

SEQ ID NO: 1461280 - DNA, 20 bp, Homo sapiens
aataccattaaaactgcttt

SEQ ID NO: 1461281 - DNA, 22 bp, Homo sapiens
aataccattttttaaggaaaca

SEQ ID NO: 1461282 - DNA, 16 bp, Homo sapiens
aataccgctcagtatt

SEQ ID NO: 1461283 - DNA, 17 bp, Homo sapiens
aatacctaattgtggat

SEQ ID NO: 1461284 - DNA, 19 bp, Homo sapiens
aatacctccattaaatggt

SEQ ID NO: 1461285 - DNA, 13 bp, Homo sapiens
aatacctctgtgt

SEQ ID NO: 1461286 - DNA, 19 bp, Homo sapiens
aatacctcttactttgctt

SEQ ID NO: 1461287 - DNA, 12 bp, Homo sapiens
aatacctgctca

SEQ ID NO: 1461288 - DNA, 19 bp, Homo sapiens
aatacggaagagcaggtga

SEQ ID NO: 1461289 - DNA, 17 bp, Homo sapiens
aatacgtgccagatata

SEQ ID NO: 1461290 - DNA, 14 bp, Homo sapiens
aatactatttaaga

SEQ ID NO: 1461291 - DNA, 20 bp, Homo sapiens
aatactatttaagatgtgaa

SEQ ID NO: 1461292 - DNA, 20 bp, Homo sapiens
aatactcaaatgagtaacat

SEQ ID NO: 1461293 - DNA, 13 bp, Homo sapiens
aatactcaccaaa

SEQ ID NO: 1461294 - DNA, 15 bp, Homo sapiens
aatactcttgaaagg

SEQ ID NO: 1461295 - DNA, 15 bp, Homo sapiens
aatactcttgaaatg

SEQ ID NO: 1461296 - DNA, 14 bp, Homo sapiens
aatactggactcag

SEQ ID NO: 1461297 - DNA, 15 bp, Homo sapiens
aatactggtctcagg

SEQ ID NO: 1461298 - DNA, 17 bp, Homo sapiens
aatactgtcaaacaata

SEQ ID NO: 1461299 - DNA, 16 bp, Homo sapiens
aatactgttctttcca

SEQ ID NO: 1461300 - DNA, 21 bp, Homo sapiens
aatacttaacacgtgaatatt

SEQ ID NO: 1461301 - DNA, 19 bp, Homo sapiens
aatacttactataatttga

SEQ ID NO: 1461302 - DNA, 18 bp, Homo sapiens
aatacttatgttgtattg

SEQ ID NO: 1461303 - DNA, 13 bp, Homo sapiens
aatacttgtaatt

SEQ ID NO: 1461304 - DNA, 15 bp, Homo sapiens
aatactttaattcat

SEQ ID NO: 1461305 - DNA, 14 bp, Homo sapiens
aatactttatttct

SEQ ID NO: 1461306 - DNA, 15 bp, Homo sapiens
aatacttttactctg

SEQ ID NO: 1461307 - DNA, 21 bp, Homo sapiens
aatacttttgtgtattctgtg

SEQ ID NO: 1461308 - DNA, 17 bp, Homo sapiens
aatacttttttctagtt

SEQ ID NO: 1461309 - DNA, 15 bp, Homo sapiens
aatagaaaatggtcc

SEQ ID NO: 1461310 - DNA, 20 bp, Homo sapiens
aatagaaattagatttgtgc

SEQ ID NO: 1461311 - DNA, 18 bp, Homo sapiens
aatagaaattttgtaaga

SEQ ID NO: 1461312 - DNA, 19 bp, Homo sapiens
aatagaacaacatatacaa

SEQ ID NO: 1461313 - DNA, 15 bp, Homo sapiens
aatagaagaacatcc

SEQ ID NO: 1461314 - DNA, 13 bp, Homo sapiens
aatagaaggtgat

SEQ ID NO: 1461315 - DNA, 15 bp, Homo sapiens
aatagaataaaggca

SEQ ID NO: 1461316 - DNA, 16 bp, Homo sapiens
aatagaataaaggcag

SEQ ID NO: 1461317 - DNA, 15 bp, Homo sapiens
aatagaatacatttt

SEQ ID NO: 1461318 - DNA, 14 bp, Homo sapiens
aatagacaaataga

SEQ ID NO: 1461319 - DNA, 19 bp, Homo sapiens
aatagacaaatagaaaatg

SEQ ID NO: 1461320 - DNA, 15 bp, Homo sapiens
aatagacagtatatt

SEQ ID NO: 1461321 - DNA, 15 bp, Homo sapiens
aatagactaaatgaa

SEQ ID NO: 1461322 - DNA, 16 bp, Homo sapiens
aatagactaaatgaaa

SEQ ID NO: 1461323 - DNA, 14 bp, Homo sapiens
aatagagaagtgtg

SEQ ID NO: 1461324 - DNA, 14 bp, Homo sapiens
aatagagactgtag

SEQ ID NO: 1461325 - DNA, 22 bp, Homo sapiens
aatagagcaaaattgatgtgtt

SEQ ID NO: 1461326 - DNA, 15 bp, Homo sapiens
aatagagtatatgca

SEQ ID NO: 1461327 - DNA, 18 bp, Homo sapiens
aatagatacagcagaggc

SEQ ID NO: 1461328 - DNA, 19 bp, Homo sapiens
aatagatatgaaagctgat

SEQ ID NO: 1461329 - DNA, 16 bp, Homo sapiens
aatagatgtgatcact

SEQ ID NO: 1461330 - DNA, 20 bp, Homo sapiens
aatagattactgatgtgata

SEQ ID NO: 1461331 - DNA, 14 bp, Homo sapiens
aatagattaggttt

SEQ ID NO: 1461332 - DNA, 16 bp, Homo sapiens
aatagattaggtttgc

SEQ ID NO: 1461333 - DNA, 13 bp, Homo sapiens
aatagcaactttt

SEQ ID NO: 1461334 - DNA, 15 bp, Homo sapiens
aatagcaacttttgt

SEQ ID NO: 1461335 - DNA, 19 bp, Homo sapiens
aatagcaacttttgtgtaa

SEQ ID NO: 1461336 - DNA, 22 bp, Homo sapiens
aatagcagagagccaaatctga

SEQ ID NO: 1461337 - DNA, 15 bp, Homo sapiens
aatagccccagactg

SEQ ID NO: 1461338 - DNA, 16 bp, Homo sapiens
aatagccccagactgg

SEQ ID NO: 1461339 - DNA, 11 bp, Homo sapiens
aatagcctaaa

SEQ ID NO: 1461340 - DNA, 15 bp, Homo sapiens
aatagcctaaatgat

SEQ ID NO: 1461341 - DNA, 16 bp, Homo sapiens
aatagcctaaatgatg

SEQ ID NO: 1461342 - DNA, 17 bp, Homo sapiens
aatagctgccttcaagg

SEQ ID NO: 1461343 - DNA, 13 bp, Homo sapiens
aatagctgtgatc

SEQ ID NO: 1461344 - DNA, 15 bp, Homo sapiens
aatagctttgtagtt

SEQ ID NO: 1461345 - DNA, 11 bp, Homo sapiens
aataggaaaac

SEQ ID NO: 1461346 - DNA, 13 bp, Homo sapiens
aataggaaacaag

SEQ ID NO: 1461347 - DNA, 19 bp, Homo sapiens
aataggaatcattcagaaa

SEQ ID NO: 1461348 - DNA, 21 bp, Homo sapiens
aataggaatcttcactagaag

SEQ ID NO: 1461349 - DNA, 17 bp, Homo sapiens
aataggagtatttttgg

SEQ ID NO: 1461350 - DNA, 16 bp, Homo sapiens
aataggcattaacaca

SEQ ID NO: 1461351 - DNA, 16 bp, Homo sapiens
aataggggatatttaa

SEQ ID NO: 1461352 - DNA, 15 bp, Homo sapiens
aatagggtagaatga

SEQ ID NO: 1461353 - DNA, 16 bp, Homo sapiens
aatagggtagaatgat

SEQ ID NO: 1461354 - DNA, 22 bp, Homo sapiens
aatagggtagaatgattaatca

SEQ ID NO: 1461355 - DNA, 22 bp, Homo sapiens
aatagtaaaagataacaagatc

SEQ ID NO: 1461356 - DNA, 13 bp, Homo sapiens
aatagtaatataa

SEQ ID NO: 1461357 - DNA, 16 bp, Homo sapiens
aatagtaatataatac

SEQ ID NO: 1461358 - DNA, 14 bp, Homo sapiens
aatagtagacattt

SEQ ID NO: 1461359 - DNA, 15 bp, Homo sapiens
aatagtatacattgt

SEQ ID NO: 1461360 - DNA, 20 bp, Homo sapiens
aatagtatacattgtcttga

SEQ ID NO: 1461361 - DNA, 22 bp, Homo sapiens
aatagtatttgagagttctaaa

SEQ ID NO: 1461362 - DNA, 19 bp, Homo sapiens
aatagtcaccttcatgatt

SEQ ID NO: 1461363 - DNA, 16 bp, Homo sapiens
aatagtcattccaaat

SEQ ID NO: 1461364 - DNA, 19 bp, Homo sapiens
aatagtctctctgcaagac

SEQ ID NO: 1461365 - DNA, 22 bp, Homo sapiens
aatagtctctctgcaagacaga

SEQ ID NO: 1461366 - DNA, 15 bp, Homo sapiens
aatagtctgtgtgaa

SEQ ID NO: 1461367 - DNA, 16 bp, Homo sapiens
aatagtgtgaaatata

SEQ ID NO: 1461368 - DNA, 19 bp, Homo sapiens
aatagttagatctttgtaa

SEQ ID NO: 1461369 - DNA, 18 bp, Homo sapiens
aatagttcagtagaatta

SEQ ID NO: 1461370 - DNA, 19 bp, Homo sapiens
aatagttcagtagaattac

SEQ ID NO: 1461371 - DNA, 16 bp, Homo sapiens
aatagttctatttcta

SEQ ID NO: 1461372 - DNA, 17 bp, Homo sapiens
aatagttctatttctat

SEQ ID NO: 1461373 - DNA, 20 bp, Homo sapiens
aatagttctatttctatctg

SEQ ID NO: 1461374 - DNA, 23 bp, Homo sapiens
aatagttctatttctatctgcaa

SEQ ID NO: 1461375 - DNA, 20 bp, Homo sapiens
aatagtttcaaatgagttta

SEQ ID NO: 1461376 - DNA, 16 bp, Homo sapiens
aatagtttgtctattt

SEQ ID NO: 1461377 - DNA, 16 bp, Homo sapiens
aataaatctttggaaa

SEQ ID NO: 1461378 - DNA, 17 bp, Homo sapiens
aataaatgaatgaataa

SEQ ID NO: 1461379 - DNA, 18 bp, Homo sapiens
aataaatgagctatgtat

SEQ ID NO: 1461380 - DNA, 16 bp, Homo sapiens
aataaatgattatatt

SEQ ID NO: 1461381 - DNA, 22 bp, Homo sapiens
aataaatgattatattcacaga

SEQ ID NO: 1461382 - DNA, 16 bp, Homo sapiens
aataaatgccctcttc

SEQ ID NO: 1461383 - DNA, 17 bp, Homo sapiens
aataaatggtatagcaa

SEQ ID NO: 1461384 - DNA, 22 bp, Homo sapiens
aataaatggtatagcaaatgtt

SEQ ID NO: 1461385 - DNA, 20 bp, Homo sapiens
aataaatgttacctaattat

SEQ ID NO: 1461386 - DNA, 22 bp, Homo sapiens
aataaatgtttgttatttacac

SEQ ID NO: 1461387 - DNA, 16 bp, Homo sapiens
aataaattattagaga

SEQ ID NO: 1461388 - DNA, 12 bp, Homo sapiens
aataaattattt

SEQ ID NO: 1461389 - DNA, 23 bp, Homo sapiens
aataaattcaaaacctgcagtta

SEQ ID NO: 1461390 - DNA, 22 bp, Homo sapiens
aataaattgatttttataaata

SEQ ID NO: 1461391 - DNA, 14 bp, Homo sapiens
caaaatgtgtattt

SEQ ID NO: 1461392 - DNA, 20 bp, Homo sapiens
caaaatgtgtatttcttata

SEQ ID NO: 1461393 - DNA, 20 bp, Homo sapiens
caaaatgttatcttctcaag

SEQ ID NO: 1461394 - DNA, 22 bp, Homo sapiens
caaaatgttatcttctcaagtt

SEQ ID NO: 1461395 - DNA, 16 bp, Homo sapiens
caaaattaagcaaatg

SEQ ID NO: 1461396 - DNA, 15 bp, Homo sapiens
caaaattcaaagcat

SEQ ID NO: 1461397 - DNA, 20 bp, Homo sapiens
caaaattcactaatcttgaa

SEQ ID NO: 1461398 - DNA, 17 bp, Homo sapiens
caaaattgacattgctt

SEQ ID NO: 1461399 - DNA, 19 bp, Homo sapiens
caaaattgacattgcttta

SEQ ID NO: 1461400 - DNA, 22 bp, Homo sapiens
caaaattgatgtgtttatttat

SEQ ID NO: 1461401 - DNA, 11 bp, Homo sapiens
caaaattgctt

SEQ ID NO: 1461402 - DNA, 14 bp, Homo sapiens
caaaattgttttca

SEQ ID NO: 1461403 - DNA, 16 bp, Homo sapiens
caaaattgttttcact

SEQ ID NO: 1461404 - DNA, 14 bp, Homo sapiens
caaaatttccagta

SEQ ID NO: 1461405 - DNA, 17 bp, Homo sapiens
caaaatttccagtacct

SEQ ID NO: 1461406 - DNA, 20 bp, Homo sapiens
caaaatttccagtacctttg

SEQ ID NO: 1461407 - DNA, 12 bp, Homo sapiens
caaaatttgaaa

SEQ ID NO: 1461408 - DNA, 14 bp, Homo sapiens
caaaatttgaaatt

SEQ ID NO: 1461409 - DNA, 12 bp, Homo sapiens
caaaatttgaga

SEQ ID NO: 1461410 - DNA, 13 bp, Homo sapiens
caaaatttgtttg

SEQ ID NO: 1461411 - DNA, 23 bp, Homo sapiens
caaaattttatagctcagtttat

SEQ ID NO: 1461412 - DNA, 18 bp, Homo sapiens
caaaattttattcctata

SEQ ID NO: 1461413 - DNA, 16 bp, Homo sapiens
caaaatttttttaatc

SEQ ID NO: 1461414 - DNA, 11 bp, Homo sapiens
caaacaaaact

SEQ ID NO: 1461415 - DNA, 14 bp, Homo sapiens
caaacaaaatttct

SEQ ID NO: 1461416 - DNA, 14 bp, Homo sapiens
caaacaaacaaaca

SEQ ID NO: 1461417 - DNA, 16 bp, Homo sapiens
caaacaaggaagccaa

SEQ ID NO: 1461418 - DNA, 12 bp, Homo sapiens
caaacaataaag

SEQ ID NO: 1461419 - DNA, 18 bp, Homo sapiens
gctcccaccccaccccct

SEQ ID NO: 1461420 - DNA, 12 bp, Homo sapiens
gctcccaccctc

SEQ ID NO: 1461421 - DNA, 21 bp, Homo sapiens
gctcccaccgcccccacccct

SEQ ID NO: 1461422 - DNA, 23 bp, Homo sapiens
gctcccaccgcccccaccccttc

SEQ ID NO: 1461423 - DNA, 13 bp, Homo sapiens
gctcccacctagt

SEQ ID NO: 1461424 - DNA, 18 bp, Homo sapiens
gctcccacctagtgcccc

SEQ ID NO: 1461425 - DNA, 21 bp, Homo sapiens
gctcccactcagaactctcca

SEQ ID NO: 1461426 - DNA, 19 bp, Homo sapiens
gctcccactccctttccaa

SEQ ID NO: 1461427 - DNA, 13 bp, Homo sapiens
gctcccaggacac

SEQ ID NO: 1461428 - DNA, 12 bp, Homo sapiens
gctcccaggcca

SEQ ID NO: 1461429 - DNA, 16 bp, Homo sapiens
gctcccaggggtctcc

SEQ ID NO: 1461430 - DNA, 19 bp, Homo sapiens
gctcccaggggtctccctg

SEQ ID NO: 1461431 - DNA, 13 bp, Homo sapiens
gctcccagggtgg

SEQ ID NO: 1461432 - DNA, 15 bp, Homo sapiens
gctcccatctcctga

SEQ ID NO: 1461433 - DNA, 13 bp, Homo sapiens
gctcccatgtgag

SEQ ID NO: 1461434 - DNA, 21 bp, Homo sapiens
gctcccatgtgagtccctgtg

SEQ ID NO: 1461435 - DNA, 21 bp, Homo sapiens
gctcccattcactcttccaga

SEQ ID NO: 1461436 - DNA, 15 bp, Homo sapiens
gctcccattcctccc

SEQ ID NO: 1461437 - DNA, 17 bp, Homo sapiens
gctcccattcctccctc

SEQ ID NO: 1461438 - DNA, 21 bp, Homo sapiens
gctccccacagcgtccctggc

SEQ ID NO: 1461439 - DNA, 21 bp, Homo sapiens
gctccccaggactcaccctca

SEQ ID NO: 1461440 - DNA, 15 bp, Homo sapiens
gctcccccaccccct

SEQ ID NO: 1461441 - DNA, 20 bp, Homo sapiens
gctcccccaccccctcccca

SEQ ID NO: 1461442 - DNA, 22 bp, Homo sapiens
gctcccccaccccctccccagg

SEQ ID NO: 1461443 - DNA, 18 bp, Homo sapiens
gctccccctctgcttctc

SEQ ID NO: 1461444 - DNA, 14 bp, Homo sapiens
gctccccgcctcca

SEQ ID NO: 1461445 - DNA, 15 bp, Homo sapiens
gctccccgcctccac

SEQ ID NO: 1461446 - DNA, 16 bp, Homo sapiens
gctcccctccacagct

SEQ ID NO: 1461447 - DNA, 17 bp, Homo sapiens
gctcccctccacagctg

SEQ ID NO: 1461448 - DNA, 20 bp, Homo sapiens
gctcccctccacagctgcag

SEQ ID NO: 1461449 - DNA, 21 bp, Homo sapiens
gctcccctcccaggggagcca

SEQ ID NO: 1461450 - DNA, 15 bp, Homo sapiens
gctcccctcggagaa

SEQ ID NO: 1461451 - DNA, 17 bp, Homo sapiens
gctcccctgctgaggca

SEQ ID NO: 1461452 - DNA, 14 bp, Homo sapiens
gctcccctggagcc

SEQ ID NO: 1461453 - DNA, 20 bp, Homo sapiens
gctcccctggagccagcagg

SEQ ID NO: 1461454 - DNA, 23 bp, Homo sapiens
gctcccctggagccagcagggct

SEQ ID NO: 1461455 - DNA, 17 bp, Homo sapiens
gctcccggggcagggca

SEQ ID NO: 1461456 - DNA, 17 bp, Homo sapiens
gctccctcccctgccct

SEQ ID NO: 1461457 - DNA, 16 bp, Homo sapiens
gctccctcctcccatc

SEQ ID NO: 1461458 - DNA, 17 bp, Homo sapiens
gctccctcctcccatct

SEQ ID NO: 1461459 - DNA, 21 bp, Homo sapiens
gctccctcctcccatctcctt

SEQ ID NO: 1461460 - DNA, 12 bp, Homo sapiens
gctccctcctgc

SEQ ID NO: 1461461 - DNA, 15 bp, Homo sapiens
gctccctcctgcaca

SEQ ID NO: 1461462 - DNA, 16 bp, Homo sapiens
gctccctcgctgtatg

SEQ ID NO: 1461463 - DNA, 17 bp, Homo sapiens
gctccctcgctgtatga

SEQ ID NO: 1461464 - DNA, 23 bp, Homo sapiens
gctccctcgtcttcagctgcatt

SEQ ID NO: 1461465 - DNA, 13 bp, Homo sapiens
gctccctctctgg

SEQ ID NO: 1461466 - DNA, 13 bp, Homo sapiens
gctccctggaagc

SEQ ID NO: 1461467 - DNA, 13 bp, Homo sapiens
gctccctggaggc

SEQ ID NO: 1461468 - DNA, 20 bp, Homo sapiens
gctccctggaggcacgcacc

SEQ ID NO: 1461469 - DNA, 13 bp, Homo sapiens
gctccctgggcag

SEQ ID NO: 1461470 - DNA, 15 bp, Homo sapiens
gctccctgggcagtg

SEQ ID NO: 1461471 - DNA, 17 bp, Homo sapiens
gctccctgtagctctgc

SEQ ID NO: 1461472 - DNA, 18 bp, Homo sapiens
gctccctgtggggcagga

SEQ ID NO: 1461473 - DNA, 22 bp, Homo sapiens
gctcccttcaagacgaggggca

SEQ ID NO: 1461474 - DNA, 15 bp, Homo sapiens
gctccgaaattccaa

SEQ ID NO: 1461475 - DNA, 15 bp, Homo sapiens
gctccgaggacccag

SEQ ID NO: 1461476 - DNA, 13 bp, Homo sapiens
gctccgcctgctg

SEQ ID NO: 1461477 - DNA, 13 bp, Homo sapiens
gctccgctgcctg

SEQ ID NO: 1461478 - DNA, 18 bp, Homo sapiens
gctccgctgcctggaaca

SEQ ID NO: 1461479 - DNA, 23 bp, Homo sapiens
gctccggaggactcaccactgcc

SEQ ID NO: 1461480 - DNA, 20 bp, Homo sapiens
gctccggtttgggctgtctt

SEQ ID NO: 1461481 - DNA, 14 bp, Homo sapiens
gctccgtctctgtc

SEQ ID NO: 1461482 - DNA, 15 bp, Homo sapiens
gctccgtgcctccac

SEQ ID NO: 1461483 - DNA, 14 bp, Homo sapiens
gctccgtggactgc

SEQ ID NO: 1461484 - DNA, 19 bp, Homo sapiens
gctccgtgttcctcggtgg

SEQ ID NO: 1461485 - DNA, 19 bp, Homo sapiens
gctcctacctgtctgctgc

SEQ ID NO: 1461486 - DNA, 20 bp, Homo sapiens
gctcctacctgtctgctgcc

SEQ ID NO: 1461487 - DNA, 19 bp, Homo sapiens
gctcctataaagggcccac

SEQ ID NO: 1461488 - DNA, 14 bp, Homo sapiens
gctcctatctgtgt

SEQ ID NO: 1461489 - DNA, 20 bp, Homo sapiens
attttctgtgcctgaatatt

SEQ ID NO: 1461490 - DNA, 18 bp, Homo sapiens
attttctgttcagattaa

SEQ ID NO: 1461491 - DNA, 12 bp, Homo sapiens
attttctttcta

SEQ ID NO: 1461492 - DNA, 13 bp, Homo sapiens
attttctttctat

SEQ ID NO: 1461493 - DNA, 22 bp, Homo sapiens
attttctttctatgtagaactg

SEQ ID NO: 1461494 - DNA, 14 bp, Homo sapiens
attttctttgtttc

SEQ ID NO: 1461495 - DNA, 19 bp, Homo sapiens
attttcttttatatctgta

SEQ ID NO: 1461496 - DNA, 21 bp, Homo sapiens
attttcttttatatctgtaaa

SEQ ID NO: 1461497 - DNA, 18 bp, Homo sapiens
attttctttttcttaaga

SEQ ID NO: 1461498 - DNA, 17 bp, Homo sapiens
attttctttttttaact

SEQ ID NO: 1461499 - DNA, 20 bp, Homo sapiens
attttctttttttaactggt

SEQ ID NO: 1461500 - DNA, 13 bp, Homo sapiens
attttgaagtgct

SEQ ID NO: 1461501 - DNA, 22 bp, Homo sapiens
attttgaagtgctgtttattaa

SEQ ID NO: 1461502 - DNA, 12 bp, Homo sapiens
attttgaatacc

SEQ ID NO: 1461503 - DNA, 14 bp, Homo sapiens
attttgaataccat

SEQ ID NO: 1461504 - DNA, 15 bp, Homo sapiens
attttgaatgtcaca

SEQ ID NO: 1461505 - DNA, 16 bp, Homo sapiens
attttgacaaagtgcc

SEQ ID NO: 1461506 - DNA, 18 bp, Homo sapiens
attttgacactatatctg

SEQ ID NO: 1461507 - DNA, 19 bp, Homo sapiens
attttgacactatatctgt

SEQ ID NO: 1461508 - DNA, 23 bp, Homo sapiens
attttgagaaactgctgcagatt

SEQ ID NO: 1461509 - DNA, 22 bp, Homo sapiens
attttgagaatgctgacacttt

SEQ ID NO: 1461510 - DNA, 21 bp, Homo sapiens
attttgagctgaaatgctgca

SEQ ID NO: 1461511 - DNA, 19 bp, Homo sapiens
attttgaggttttgtaaaa

SEQ ID NO: 1461512 - DNA, 23 bp, Homo sapiens
attttgaggttttgtaaaactgt

SEQ ID NO: 1461513 - DNA, 22 bp, Homo sapiens
attttgagtcctaggacttaaa

SEQ ID NO: 1461514 - DNA, 16 bp, Homo sapiens
attttgatatacattg

SEQ ID NO: 1461515 - DNA, 18 bp, Homo sapiens
attttgatatacattgtg

SEQ ID NO: 1461516 - DNA, 14 bp, Homo sapiens
attttgcaaaattt

SEQ ID NO: 1461517 - DNA, 18 bp, Homo sapiens
attttgcaaaatttccag

SEQ ID NO: 1461518 - DNA, 12 bp, Homo sapiens
attttgcactgt

SEQ ID NO: 1461519 - DNA, 22 bp, Homo sapiens
attttgcagaggctatgggaag

SEQ ID NO: 1461520 - DNA, 16 bp, Homo sapiens
attttgcagcagtgag

SEQ ID NO: 1461521 - DNA, 17 bp, Homo sapiens
attttgcattccagaat

SEQ ID NO: 1461522 - DNA, 19 bp, Homo sapiens
attttgcattccagaatct

SEQ ID NO: 1461523 - DNA, 22 bp, Homo sapiens
attttgcccttccatagcctaa

SEQ ID NO: 1461524 - DNA, 18 bp, Homo sapiens
attttgcctcttttctct

SEQ ID NO: 1461525 - DNA, 13 bp, Homo sapiens
attttgctaactg

SEQ ID NO: 1461526 - DNA, 15 bp, Homo sapiens
attttgctaactggg

SEQ ID NO: 1461527 - DNA, 18 bp, Homo sapiens
attttgctaactgggtta

SEQ ID NO: 1461528 - DNA, 20 bp, Homo sapiens
attttgctaactgggttaaa

SEQ ID NO: 1461529 - DNA, 17 bp, Homo sapiens
attttgctaactggtta

SEQ ID NO: 1461530 - DNA, 18 bp, Homo sapiens
attttgctaactggttaa

SEQ ID NO: 1461531 - DNA, 19 bp, Homo sapiens
attttgctaactggttaaa

SEQ ID NO: 1461532 - DNA, 15 bp, Homo sapiens
attttgctgagttgt

SEQ ID NO: 1461533 - DNA, 16 bp, Homo sapiens
attttgctgagttgtt

SEQ ID NO: 1461534 - DNA, 11 bp, Homo sapiens
attttgcttta

SEQ ID NO: 1461535 - DNA, 16 bp, Homo sapiens
attttgctttaatttt

SEQ ID NO: 1461536 - DNA, 13 bp, Homo sapiens
attttgctttggt

SEQ ID NO: 1461537 - DNA, 14 bp, Homo sapiens
attttggaaaataa

SEQ ID NO: 1461538 - DNA, 18 bp, Homo sapiens
attttggaaagatgttaa

SEQ ID NO: 1461539 - DNA, 20 bp, Homo sapiens
attttggaactatgaagact

SEQ ID NO: 1461540 - DNA, 20 bp, Homo sapiens
attttggaagttttcaggac

SEQ ID NO: 1461541 - DNA, 21 bp, Homo sapiens
attttggatctatcacctgtc

SEQ ID NO: 1461542 - DNA, 20 bp, Homo sapiens
attttggctcaccgtggatt

SEQ ID NO: 1461543 - DNA, 19 bp, Homo sapiens
attttgggttttgggtctt

SEQ ID NO: 1461544 - DNA, 21 bp, Homo sapiens
attttggtgaatgtgggtagt

SEQ ID NO: 1461545 - DNA, 17 bp, Homo sapiens
attttggttttgttccc

SEQ ID NO: 1461546 - DNA, 23 bp, Homo sapiens
attttggttttgttcccctcctc

SEQ ID NO: 1461547 - DNA, 10 bp, Homo sapiens
attttgtaaa

SEQ ID NO: 1461548 - DNA, 14 bp, Homo sapiens
attttgtaaaacaa

SEQ ID NO: 1461549 - DNA, 19 bp, Homo sapiens
attttgtaaactcaaaata

SEQ ID NO: 1461550 - DNA, 18 bp, Homo sapiens
attttgtaacgaagacac

SEQ ID NO: 1461551 - DNA, 19 bp, Homo sapiens
attttgtaacgaagacaca

SEQ ID NO: 1461552 - DNA, 17 bp, Homo sapiens
attttgtaagaaggcaa

SEQ ID NO: 1461553 - DNA, 20 bp, Homo sapiens
attttgtacatgtatgaaat

SEQ ID NO: 1461554 - DNA, 15 bp, Homo sapiens
attttgtagatgtga

SEQ ID NO: 1461555 - DNA, 17 bp, Homo sapiens
attttgtatattaactt

SEQ ID NO: 1461556 - DNA, 18 bp, Homo sapiens
attttgtatgctgaattt

SEQ ID NO: 1461557 - DNA, 12 bp, Homo sapiens
attttgtatgga

SEQ ID NO: 1461558 - DNA, 14 bp, Homo sapiens
attttgtatggagt

SEQ ID NO: 1461559 - DNA, 20 bp, Homo sapiens
attttgtatggagttaaata

SEQ ID NO: 1461560 - DNA, 24 bp, Homo sapiens
attttgtattacatctaatgcttc

SEQ ID NO: 1461561 - DNA, 18 bp, Homo sapiens
attttgtattttcaactt

SEQ ID NO: 1461562 - DNA, 17 bp, Homo sapiens
attttgtcctaatatat

SEQ ID NO: 1461563 - DNA, 12 bp, Homo sapiens
attttgtctacc

SEQ ID NO: 1461564 - DNA, 18 bp, Homo sapiens
attttgtcttaagtgttt

SEQ ID NO: 1461565 - DNA, 22 bp, Homo sapiens
attttgtcttaagtgtttctca

SEQ ID NO: 1461566 - DNA, 22 bp, Homo sapiens
attttgtgacccctttcactta

SEQ ID NO: 1461567 - DNA, 12 bp, Homo sapiens
attttgtgcatt

SEQ ID NO: 1461568 - DNA, 14 bp, Homo sapiens
attttgtgcattct

SEQ ID NO: 1461569 - DNA, 15 bp, Homo sapiens
attttgtgcattctt

SEQ ID NO: 1461570 - DNA, 19 bp, Homo sapiens
attttgtgcattctttggt

SEQ ID NO: 1461571 - DNA, 20 bp, Homo sapiens
attttgtgctcatttaagtt

SEQ ID NO: 1461572 - DNA, 14 bp, Homo sapiens
attttgtggctgtt

SEQ ID NO: 1461573 - DNA, 20 bp, Homo sapiens
attttgtggctttctttctt

SEQ ID NO: 1461574 - DNA, 15 bp, Homo sapiens
attttgtgtgagact

SEQ ID NO: 1461575 - DNA, 16 bp, Homo sapiens
attttgtgtgagactt

SEQ ID NO: 1461576 - DNA, 22 bp, Homo sapiens
attttgtgtgagacttaaaaca

SEQ ID NO: 1461577 - DNA, 19 bp, Homo sapiens
attttgtgtttattcttga

SEQ ID NO: 1461578 - DNA, 15 bp, Homo sapiens
attttgttaaagctg

SEQ ID NO: 1461579 - DNA, 21 bp, Homo sapiens
attttgttaaagctggaacat

SEQ ID NO: 1461580 - DNA, 22 bp, Homo sapiens
attttgttacataaggatgact

SEQ ID NO: 1461581 - DNA, 18 bp, Homo sapiens
attttgttatagaatact

SEQ ID NO: 1461582 - DNA, 22 bp, Homo sapiens
attttgttatagaatacttttt

SEQ ID NO: 1461583 - DNA, 12 bp, Homo sapiens
attttgttcata

SEQ ID NO: 1461584 - DNA, 14 bp, Homo sapiens
attttgttcataca

SEQ ID NO: 1461585 - DNA, 16 bp, Homo sapiens
attttgttcatacata

SEQ ID NO: 1461586 - DNA, 18 bp, Homo sapiens
attttgttcatacatatt

SEQ ID NO: 1461587 - DNA, 14 bp, Homo sapiens
attttgttctctgg

SEQ ID NO: 1461588 - DNA, 13 bp, Homo sapiens
attttgttgcctt

SEQ ID NO: 1461589 - DNA, 23 bp, Homo sapiens
attttgttgctgttttgatttgt

SEQ ID NO: 1461590 - DNA, 19 bp, Homo sapiens
attttgttgcttttgtgaa

SEQ ID NO: 1461591 - DNA, 15 bp, Homo sapiens
attttgttgttcctc

SEQ ID NO: 1461592 - DNA, 17 bp, Homo sapiens
attttgttgttcctcta

SEQ ID NO: 1461593 - DNA, 11 bp, Homo sapiens
attttgtttac

SEQ ID NO: 1461594 - DNA, 14 bp, Homo sapiens
attttgtttctgta

SEQ ID NO: 1461595 - DNA, 20 bp, Homo sapiens
attttgttttattttgaatg

SEQ ID NO: 1461596 - DNA, 19 bp, Homo sapiens
atttttaaaaaatattttc

SEQ ID NO: 1461597 - DNA, 20 bp, Homo sapiens
atttttaaaaaatattttct

SEQ ID NO: 1461598 - DNA, 17 bp, Homo sapiens
atttttaaaacccattt

SEQ ID NO: 1461599 - DNA, 18 bp, Homo sapiens
atttttaaaatatgtttt

SEQ ID NO: 1461600 - DNA, 15 bp, Homo sapiens
atttttaaaatgtca

SEQ ID NO: 1461601 - DNA, 19 bp, Homo sapiens
atttttaaagtagaagagg

SEQ ID NO: 1461602 - DNA, 20 bp, Homo sapiens
atttttaaatgcagttacaa

SEQ ID NO: 1461603 - DNA, 19 bp, Homo sapiens
atttttaaatgtaaaacat

SEQ ID NO: 1461604 - DNA, 20 bp, Homo sapiens
atttttaacacttaaatttc

SEQ ID NO: 1461605 - DNA, 19 bp, Homo sapiens
atttttttttcaatcaact

SEQ ID NO: 1461606 - DNA, 13 bp, Homo sapiens
atttttttttcca

SEQ ID NO: 1461607 - DNA, 14 bp, Homo sapiens
atttttttttctaa

SEQ ID NO: 1461608 - DNA, 15 bp, Homo sapiens
atttttttttctaag

SEQ ID NO: 1461609 - DNA, 18 bp, Homo sapiens
atttttttttctaagaga

SEQ ID NO: 1461610 - DNA, 19 bp, Homo sapiens
attttttttttaaattatt

SEQ ID NO: 1461611 - DNA, 23 bp, Homo sapiens
atttttttttttttcacaatgtg

SEQ ID NO: 1461612 - DNA, 22 bp, Homo sapiens
caaaaaaaaaaaaaagcatcta

SEQ ID NO: 1461613 - DNA, 13 bp, Homo sapiens
caaaaaaacacta

SEQ ID NO: 1461614 - DNA, 15 bp, Homo sapiens
caaaaaaagcctcca

SEQ ID NO: 1461615 - DNA, 14 bp, Homo sapiens
caaaaaaaggaaaa

SEQ ID NO: 1461616 - DNA, 16 bp, Homo sapiens
caaaaaaaggaaaaat

SEQ ID NO: 1461617 - DNA, 13 bp, Homo sapiens
caaaaaaccagga

SEQ ID NO: 1461618 - DNA, 20 bp, Homo sapiens
caaaaaactctctcccagga

SEQ ID NO: 1461619 - DNA, 13 bp, Homo sapiens
caaaaaaggaaaa

SEQ ID NO: 1461620 - DNA, 12 bp, Homo sapiens
caaaaaataaat

SEQ ID NO: 1461621 - DNA, 13 bp, Homo sapiens
caaaaaataaatt

SEQ ID NO: 1461622 - DNA, 12 bp, Homo sapiens
caaaaaatacat

SEQ ID NO: 1461623 - DNA, 16 bp, Homo sapiens
caaaaaatgttttaaa

SEQ ID NO: 1461624 - DNA, 13 bp, Homo sapiens
caaaaaattatat

SEQ ID NO: 1461625 - DNA, 14 bp, Homo sapiens
caaaaacaaaatta

SEQ ID NO: 1461626 - DNA, 14 bp, Homo sapiens
caaaaacacagcaa

SEQ ID NO: 1461627 - DNA, 14 bp, Homo sapiens
caaaaacagcctca

SEQ ID NO: 1461628 - DNA, 15 bp, Homo sapiens
caaaaacagcctcac

SEQ ID NO: 1461629 - DNA, 16 bp, Homo sapiens
caaaaacagcctcaca

SEQ ID NO: 1461630 - DNA, 23 bp, Homo sapiens
caaaaacatgtatgtgcatttca

SEQ ID NO: 1461631 - DNA, 13 bp, Homo sapiens
caaaaaccatgtt

SEQ ID NO: 1461632 - DNA, 19 bp, Homo sapiens
caaaaaccatgttgcgttc

SEQ ID NO: 1461633 - DNA, 23 bp, Homo sapiens
caaaaaccttggcataagacaga

SEQ ID NO: 1461634 - DNA, 14 bp, Homo sapiens
caaaaactatttgg

SEQ ID NO: 1461635 - DNA, 13 bp, Homo sapiens
caaaaacttgtta

SEQ ID NO: 1461636 - DNA, 21 bp, Homo sapiens
caaaaagaacaataatgagag

SEQ ID NO: 1461637 - DNA, 15 bp, Homo sapiens
caaaaagcttctgtg

SEQ ID NO: 1461638 - DNA, 18 bp, Homo sapiens
caaaaaggaccaactggc

SEQ ID NO: 1461639 - DNA, 19 bp, Homo sapiens
caaaaaggcaaatattgaa

SEQ ID NO: 1461640 - DNA, 20 bp, Homo sapiens
caaaaagggaaactattgtc

SEQ ID NO: 1461641 - DNA, 22 bp, Homo sapiens
caaaaagtaaaaattaaaaaat

SEQ ID NO: 1461642 - DNA, 14 bp, Homo sapiens
caaaaataaactag

SEQ ID NO: 1461643 - DNA, 19 bp, Homo sapiens
caaaaataaactagtttcc

SEQ ID NO: 1461644 - DNA, 16 bp, Homo sapiens
caaaaataatcatgaa

SEQ ID NO: 1461645 - DNA, 13 bp, Homo sapiens
caaaaatagaaat

SEQ ID NO: 1461646 - DNA, 22 bp, Homo sapiens
caaaaatcaaagaacagatggg

SEQ ID NO: 1461647 - DNA, 19 bp, Homo sapiens
caaaaatctcccagtgaca

SEQ ID NO: 1461648 - DNA, 20 bp, Homo sapiens
caaaaatctcccagtgacaa

SEQ ID NO: 1461649 - DNA, 15 bp, Homo sapiens
caaaaattagccggg

SEQ ID NO: 1461650 - DNA, 22 bp, Homo sapiens
caaaaatttctgtaaaacaggt

SEQ ID NO: 1461651 - DNA, 11 bp, Homo sapiens
caaaacaaaaa

SEQ ID NO: 1461652 - DNA, 13 bp, Homo sapiens
caaaacaaaacaa

SEQ ID NO: 1461653 - DNA, 16 bp, Homo sapiens
caaaacaatctctcaa

SEQ ID NO: 1461654 - DNA, 19 bp, Homo sapiens
caaaacaccaaagaattgt

SEQ ID NO: 1461655 - DNA, 22 bp, Homo sapiens
caaaacatgtctcctatcctgg

SEQ ID NO: 1461656 - DNA, 19 bp, Homo sapiens
caaaacattttgaaggaaa

SEQ ID NO: 1461657 - DNA, 17 bp, Homo sapiens
caaaaccaaaagttatt

SEQ ID NO: 1461658 - DNA, 17 bp, Homo sapiens
caaaaccctcagcactg

SEQ ID NO: 1461659 - DNA, 22 bp, Homo sapiens
caaaacctcatgacagccagag

SEQ ID NO: 1461660 - DNA, 19 bp, Homo sapiens
caaaacctgcttccttcag

SEQ ID NO: 1461661 - DNA, 20 bp, Homo sapiens
caaaacctgcttccttcagt

SEQ ID NO: 1461662 - DNA, 14 bp, Homo sapiens
caaaacctggagat

SEQ ID NO: 1461663 - DNA, 20 bp, Homo sapiens
caaaacctgtattactgaat

SEQ ID NO: 1461664 - DNA, 13 bp, Homo sapiens
caaaacctgtgcc

SEQ ID NO: 1461665 - DNA, 16 bp, Homo sapiens
caaaacctgtgccagg

SEQ ID NO: 1461666 - DNA, 11 bp, Homo sapiens
caaaaccttcc

SEQ ID NO: 1461667 - DNA, 17 bp, Homo sapiens
caaaacgggtcagtatt

SEQ ID NO: 1461668 - DNA, 13 bp, Homo sapiens
caaaacgtcttat

SEQ ID NO: 1461669 - DNA, 15 bp, Homo sapiens
caaaacgtcttattg

SEQ ID NO: 1461670 - DNA, 16 bp, Homo sapiens
caaaactcacagagct

SEQ ID NO: 1461671 - DNA, 21 bp, Homo sapiens
caaaactcatttcctatgtaa

SEQ ID NO: 1461672 - DNA, 14 bp, Homo sapiens
caaaactccgtctc

SEQ ID NO: 1461673 - DNA, 11 bp, Homo sapiens
caaaactctac

SEQ ID NO: 1461674 - DNA, 18 bp, Homo sapiens
caaaactgcactgtcaag

SEQ ID NO: 1461675 - DNA, 21 bp, Homo sapiens
caaaacttctcttgaaaagtt

SEQ ID NO: 1461676 - DNA, 19 bp, Homo sapiens
caaaactttcgttgttatt

SEQ ID NO: 1461677 - DNA, 14 bp, Homo sapiens
caaaagaataagac

SEQ ID NO: 1461678 - DNA, 13 bp, Homo sapiens
caaaagacaaaaa

SEQ ID NO: 1461679 - DNA, 13 bp, Homo sapiens
caaaagagagaat

SEQ ID NO: 1461680 - DNA, 21 bp, Homo sapiens
caaaagagggtttattttcag

SEQ ID NO: 1461681 - DNA, 19 bp, Homo sapiens
caaaagatgctcttctgtg

SEQ ID NO: 1461682 - DNA, 20 bp, Homo sapiens
caaaagatgctcttctgtgg

SEQ ID NO: 1461683 - DNA, 16 bp, Homo sapiens
caaaagattaatcttt

SEQ ID NO: 1461684 - DNA, 19 bp, Homo sapiens
caaaagattaatctttaaa

SEQ ID NO: 1461685 - DNA, 20 bp, Homo sapiens
caaaagattgctgaaatttt

SEQ ID NO: 1461686 - DNA, 22 bp, Homo sapiens
caaaagattgctgaaattttat

SEQ ID NO: 1461687 - DNA, 13 bp, Homo sapiens
caaaagatttgtt

SEQ ID NO: 1461688 - DNA, 14 bp, Homo sapiens
caaaagcaaaacat

SEQ ID NO: 1461689 - DNA, 15 bp, Homo sapiens
caaaagcaaagatgc

SEQ ID NO: 1461690 - DNA, 14 bp, Homo sapiens
caaaagcacccttg

SEQ ID NO: 1461691 - DNA, 16 bp, Homo sapiens
caaaagctgaacacat

SEQ ID NO: 1461692 - DNA, 15 bp, Homo sapiens
caaaagctttttaaa

SEQ ID NO: 1461693 - DNA, 16 bp, Homo sapiens
caaaagctttttaaaa

SEQ ID NO: 1461694 - DNA, 16 bp, Homo sapiens
caaaagggaagagttt

SEQ ID NO: 1461695 - DNA, 19 bp, Homo sapiens
caaaagggtgtatagtgtt

SEQ ID NO: 1461696 - DNA, 15 bp, Homo sapiens
caaaaggtgcctgtg

SEQ ID NO: 1461697 - DNA, 11 bp, Homo sapiens
caaaaggttta

SEQ ID NO: 1461698 - DNA, 23 bp, Homo sapiens
caaaagttccatatagacaccaa

SEQ ID NO: 1461699 - DNA, 21 bp, Homo sapiens
caaaataaaaagtgacacagc

SEQ ID NO: 1461700 - DNA, 22 bp, Homo sapiens
caaaataattttaagaaatcaa

SEQ ID NO: 1461701 - DNA, 15 bp, Homo sapiens
caaaatacacacccc

SEQ ID NO: 1461702 - DNA, 16 bp, Homo sapiens
caaaatacatttgtaa

SEQ ID NO: 1461703 - DNA, 18 bp, Homo sapiens
caaaatacatttgtaagt

SEQ ID NO: 1461704 - DNA, 14 bp, Homo sapiens
caaaataccagagc

SEQ ID NO: 1461705 - DNA, 16 bp, Homo sapiens
caaaatagacatcttt

SEQ ID NO: 1461706 - DNA, 14 bp, Homo sapiens
caaaatatttaagt

SEQ ID NO: 1461707 - DNA, 16 bp, Homo sapiens
caaaatatttaagtga

SEQ ID NO: 1461708 - DNA, 20 bp, Homo sapiens
caaaatatttaagtgaagga

SEQ ID NO: 1461709 - DNA, 18 bp, Homo sapiens
caaaatcaagcctgattc

SEQ ID NO: 1461710 - DNA, 21 bp, Homo sapiens
caaaatccaaaacttctcttg

SEQ ID NO: 1461711 - DNA, 15 bp, Homo sapiens
caaaatcctacagat

SEQ ID NO: 1461712 - DNA, 20 bp, Homo sapiens
caaaatccttgcttatgaca

SEQ ID NO: 1461713 - DNA, 16 bp, Homo sapiens
caaaatctcctggctt

SEQ ID NO: 1461714 - DNA, 21 bp, Homo sapiens
caaaatctgtccaaaggaggc

SEQ ID NO: 1461715 - DNA, 19 bp, Homo sapiens
caaaatctttgtataaata

SEQ ID NO: 1461716 - DNA, 23 bp, Homo sapiens
caaaatctttgtataaataaata

SEQ ID NO: 1461717 - DNA, 15 bp, Homo sapiens
caaaatgacaatgat

SEQ ID NO: 1461718 - DNA, 22 bp, Homo sapiens
caaaatgagagggcagtgtttc

SEQ ID NO: 1461719 - DNA, 18 bp, Homo sapiens
caaaatgatagttttcta

SEQ ID NO: 1461720 - DNA, 16 bp, Homo sapiens
caaaatggaataaaag

SEQ ID NO: 1461721 - DNA, 18 bp, Homo sapiens
caaaatggggcagaagag

SEQ ID NO: 1461722 - DNA, 15 bp, Homo sapiens
gctcctatctgtgtt

SEQ ID NO: 1461723 - DNA, 18 bp, Homo sapiens
gctcctcacccctgtagg

SEQ ID NO: 1461724 - DNA, 15 bp, Homo sapiens
gctcctcacctgtct

SEQ ID NO: 1461725 - DNA, 14 bp, Homo sapiens
gctcctcactggag

SEQ ID NO: 1461726 - DNA, 15 bp, Homo sapiens
gctcctccagggcca

SEQ ID NO: 1461727 - DNA, 18 bp, Homo sapiens
gctcctccagggccacgt

SEQ ID NO: 1461728 - DNA, 14 bp, Homo sapiens
gctcctcccggtgc

SEQ ID NO: 1461729 - DNA, 12 bp, Homo sapiens
gctcctccctgc

SEQ ID NO: 1461730 - DNA, 15 bp, Homo sapiens
gctcctccctgcccc

SEQ ID NO: 1461731 - DNA, 13 bp, Homo sapiens
gctcctccctggc

SEQ ID NO: 1461732 - DNA, 19 bp, Homo sapiens
gctcctccctggctgccct

SEQ ID NO: 1461733 - DNA, 13 bp, Homo sapiens
gctcctcctcctg

SEQ ID NO: 1461734 - DNA, 19 bp, Homo sapiens
gctcctcctcttggagctg

SEQ ID NO: 1461735 - DNA, 20 bp, Homo sapiens
gctcctcctcttggagctga

SEQ ID NO: 1461736 - DNA, 21 bp, Homo sapiens
gctcctctccccagcccagag

SEQ ID NO: 1461737 - DNA, 22 bp, Homo sapiens
gctcctctccccagcccagaga

SEQ ID NO: 1461738 - DNA, 23 bp, Homo sapiens
gctcctctccccagcccagagac

SEQ ID NO: 1461739 - DNA, 13 bp, Homo sapiens
gctcctctctttg

SEQ ID NO: 1461740 - DNA, 15 bp, Homo sapiens
gctcctctctttgtg

SEQ ID NO: 1461741 - DNA, 17 bp, Homo sapiens
gctcctcttgattcctg

SEQ ID NO: 1461742 - DNA, 23 bp, Homo sapiens
gctcctgaggggcatctgcccct

SEQ ID NO: 1461743 - DNA, 12 bp, Homo sapiens
gctcctgcactt

SEQ ID NO: 1461744 - DNA, 12 bp, Homo sapiens
gctcctgcccag

SEQ ID NO: 1461745 - DNA, 13 bp, Homo sapiens
gctcctgcccagg

SEQ ID NO: 1461746 - DNA, 19 bp, Homo sapiens
gctcctgcccaggagcagc

SEQ ID NO: 1461747 - DNA, 20 bp, Homo sapiens
gctcctgcccaggagcagct

SEQ ID NO: 1461748 - DNA, 21 bp, Homo sapiens
gctcctgccgcagacgggcac

SEQ ID NO: 1461749 - DNA, 23 bp, Homo sapiens
gctcctgccgcagacgggcacag

SEQ ID NO: 1461750 - DNA, 13 bp, Homo sapiens
gctcctgctactt

SEQ ID NO: 1461751 - DNA, 15 bp, Homo sapiens
gctcctgctacttcc

SEQ ID NO: 1461752 - DNA, 12 bp, Homo sapiens
gctcctgctgcg

SEQ ID NO: 1461753 - DNA, 12 bp, Homo sapiens
gctcctggctgc

SEQ ID NO: 1461754 - DNA, 14 bp, Homo sapiens
gctcctggctgcca

SEQ ID NO: 1461755 - DNA, 17 bp, Homo sapiens
gctcctggctgccaggc

SEQ ID NO: 1461756 - DNA, 16 bp, Homo sapiens
gctcctgggccggctg

SEQ ID NO: 1461757 - DNA, 17 bp, Homo sapiens
gctcctgtctgccagcc

SEQ ID NO: 1461758 - DNA, 18 bp, Homo sapiens
gctcctgtctgccagcca

SEQ ID NO: 1461759 - DNA, 19 bp, Homo sapiens
gctcctgtctgccagccag

SEQ ID NO: 1461760 - DNA, 21 bp, Homo sapiens
gctcctgtggcagctgcccct

SEQ ID NO: 1461761 - DNA, 15 bp, Homo sapiens
gctcctgtggcagga

SEQ ID NO: 1461762 - DNA, 17 bp, Homo sapiens
gctcctgtggcaggagg

SEQ ID NO: 1461763 - DNA, 20 bp, Homo sapiens
gctcctgtggccccaccctg

SEQ ID NO: 1461764 - DNA, 24 bp, Homo sapiens
gctccttcactgttccctctggct

SEQ ID NO: 1461765 - DNA, 17 bp, Homo sapiens
gctccttgagaggagaa

SEQ ID NO: 1461766 - DNA, 18 bp, Homo sapiens
gctccttgagtaaaaagg

SEQ ID NO: 1461767 - DNA, 22 bp, Homo sapiens
gctccttggggcagggcctggg

SEQ ID NO: 1461768 - DNA, 14 bp, Homo sapiens
gctcctttctccag

SEQ ID NO: 1461769 - DNA, 16 bp, Homo sapiens
gctccttttctctttg

SEQ ID NO: 1461770 - DNA, 20 bp, Homo sapiens
gctcgagcagtcctgcctca

SEQ ID NO: 1461771 - DNA, 13 bp, Homo sapiens
gctcgcccagcag

SEQ ID NO: 1461772 - DNA, 23 bp, Homo sapiens
gctcgcccatacccgtgacagtg

SEQ ID NO: 1461773 - DNA, 16 bp, Homo sapiens
gctcgccgtgtctcag

SEQ ID NO: 1461774 - DNA, 18 bp, Homo sapiens
gctcgccgtgtctcagcc

SEQ ID NO: 1461775 - DNA, 12 bp, Homo sapiens
gctcgcgggcag

SEQ ID NO: 1461776 - DNA, 18 bp, Homo sapiens
gctcgcgggcagcgggcc

SEQ ID NO: 1461777 - DNA, 16 bp, Homo sapiens
gctcgctccctgtagc

SEQ ID NO: 1461778 - DNA, 21 bp, Homo sapiens
gctcgctccctgtagctctgc

SEQ ID NO: 1461779 - DNA, 16 bp, Homo sapiens
gctcgctggctttctc

SEQ ID NO: 1461780 - DNA, 22 bp, Homo sapiens
gctcgggacggatagtagacag

SEQ ID NO: 1461781 - DNA, 15 bp, Homo sapiens
gctcgggccgtaggg

SEQ ID NO: 1461782 - DNA, 21 bp, Homo sapiens
gctcggggtaaaaagtggctg

SEQ ID NO: 1461783 - DNA, 18 bp, Homo sapiens
gctcggtggacccaggga

SEQ ID NO: 1461784 - DNA, 13 bp, Homo sapiens
gctcgtatcccaa

SEQ ID NO: 1461785 - DNA, 22 bp, Homo sapiens
gctcgtggactgagtgggaagc

SEQ ID NO: 1461786 - DNA, 15 bp, Homo sapiens
gctcgtggccttccc

SEQ ID NO: 1461787 - DNA, 15 bp, Homo sapiens
gctcgtgtatcctgg

SEQ ID NO: 1461788 - DNA, 18 bp, Homo sapiens
gctcgtgtatcctggggc

SEQ ID NO: 1461789 - DNA, 20 bp, Homo sapiens
gctctaaaaggtaatgtgtg

SEQ ID NO: 1461790 - DNA, 13 bp, Homo sapiens
gctctaaaatatt

SEQ ID NO: 1461791 - DNA, 22 bp, Homo sapiens
gctctaactggacatgaaggaa

SEQ ID NO: 1461792 - DNA, 15 bp, Homo sapiens
gctctaattcacagt

SEQ ID NO: 1461793 - DNA, 13 bp, Homo sapiens
gctctaccctgtc

SEQ ID NO: 1461794 - DNA, 19 bp, Homo sapiens
gctctaccctgtctgtccc

SEQ ID NO: 1461795 - DNA, 13 bp, Homo sapiens
gctctacgggggc

SEQ ID NO: 1461796 - DNA, 14 bp, Homo sapiens
gctctactgccctc

SEQ ID NO: 1461797 - DNA, 20 bp, Homo sapiens
gctctagatcataaggcttc

SEQ ID NO: 1461798 - DNA, 16 bp, Homo sapiens
gctctagattcataaa

SEQ ID NO: 1461799 - DNA, 17 bp, Homo sapiens
gctctagattcataaat

SEQ ID NO: 1461800 - DNA, 20 bp, Homo sapiens
gctctagattcataaataca

SEQ ID NO: 1461801 - DNA, 13 bp, Homo sapiens
gctctagccagga

SEQ ID NO: 1461802 - DNA, 18 bp, Homo sapiens
gctctagccaggagtctg

SEQ ID NO: 1461803 - DNA, 18 bp, Homo sapiens
gctctagctggcaggaca

SEQ ID NO: 1461804 - DNA, 14 bp, Homo sapiens
gctctaggctgccc

SEQ ID NO: 1461805 - DNA, 20 bp, Homo sapiens
gctctagggaatctggatta

SEQ ID NO: 1461806 - DNA, 21 bp, Homo sapiens
gctctagtgggacagcccaga

SEQ ID NO: 1461807 - DNA, 13 bp, Homo sapiens
gctctatgagtct

SEQ ID NO: 1461808 - DNA, 18 bp, Homo sapiens
gctctatgagtctagatg

SEQ ID NO: 1461809 - DNA, 21 bp, Homo sapiens
gctctatgagtctagatgttt

SEQ ID NO: 1461810 - DNA, 13 bp, Homo sapiens
gctctatgtctgc

SEQ ID NO: 1461811 - DNA, 15 bp, Homo sapiens
gctctattctctaaa

SEQ ID NO: 1461812 - DNA, 16 bp, Homo sapiens
gctctcaaatccctct

SEQ ID NO: 1461813 - DNA, 12 bp, Homo sapiens
gctctcagaagg

SEQ ID NO: 1461814 - DNA, 13 bp, Homo sapiens
gctctcagcaagt

SEQ ID NO: 1461815 - DNA, 19 bp, Homo sapiens
gctctcagcaagtgcccag

SEQ ID NO: 1461816 - DNA, 11 bp, Homo sapiens
gctctcagcca

SEQ ID NO: 1461817 - DNA, 17 bp, Homo sapiens
gctctcagccaacgagt

SEQ ID NO: 1461818 - DNA, 23 bp, Homo sapiens
gctctcagcctcccaaccccagg

SEQ ID NO: 1461819 - DNA, 16 bp, Homo sapiens
gctctcagcctcccac

SEQ ID NO: 1461820 - DNA, 17 bp, Homo sapiens
gctctcagcctcccaca

SEQ ID NO: 1461821 - DNA, 22 bp, Homo sapiens
gctctccaaaggggctgctggg

SEQ ID NO: 1461822 - DNA, 23 bp, Homo sapiens
gctctccaaaggggctgctgggg

SEQ ID NO: 1461823 - DNA, 15 bp, Homo sapiens
gctctccaccaccca

SEQ ID NO: 1461824 - DNA, 13 bp, Homo sapiens
gctctccacctca

SEQ ID NO: 1461825 - DNA, 15 bp, Homo sapiens
gctctccacctcagc

SEQ ID NO: 1461826 - DNA, 16 bp, Homo sapiens
gctctccacctcagcc

SEQ ID NO: 1461827 - DNA, 19 bp, Homo sapiens
gctctccacctcagccttg

SEQ ID NO: 1461828 - DNA, 14 bp, Homo sapiens
gctctccaggcccc

SEQ ID NO: 1461829 - DNA, 23 bp, Homo sapiens
gctctcccccttggatttgaact

SEQ ID NO: 1461830 - DNA, 18 bp, Homo sapiens
gctctccccggcaggcct

SEQ ID NO: 1461831 - DNA, 14 bp, Homo sapiens
gctctcccctcctg

SEQ ID NO: 1461832 - DNA, 19 bp, Homo sapiens
gctctcccctcctgctggg

SEQ ID NO: 1461833 - DNA, 11 bp, Homo sapiens
gctctccctct

SEQ ID NO: 1461834 - DNA, 17 bp, Homo sapiens
gctctccctctggccct

SEQ ID NO: 1461835 - DNA, 18 bp, Homo sapiens
gctctccctctggccctg

SEQ ID NO: 1461836 - DNA, 24 bp, Homo sapiens
gctctccctgtcacgctcatgtcc

SEQ ID NO: 1461837 - DNA, 15 bp, Homo sapiens
gctctccgagctctg

SEQ ID NO: 1461838 - DNA, 20 bp, Homo sapiens
gctctccgagctctggtgct

SEQ ID NO: 1461839 - DNA, 21 bp, Homo sapiens
atttttaacacttaaatttct

SEQ ID NO: 1461840 - DNA, 12 bp, Homo sapiens
atttttaagctg

SEQ ID NO: 1461841 - DNA, 14 bp, Homo sapiens
atttttaatcatga

SEQ ID NO: 1461842 - DNA, 12 bp, Homo sapiens
atttttaatgat

SEQ ID NO: 1461843 - DNA, 15 bp, Homo sapiens
atttttaatgggggt

SEQ ID NO: 1461844 - DNA, 23 bp, Homo sapiens
atttttaatgggggtagcagctg

SEQ ID NO: 1461845 - DNA, 16 bp, Homo sapiens
atttttaatgtatcta

SEQ ID NO: 1461846 - DNA, 20 bp, Homo sapiens
atttttaatgtatctatttg

SEQ ID NO: 1461847 - DNA, 19 bp, Homo sapiens
atttttactaatatatatt

SEQ ID NO: 1461848 - DNA, 17 bp, Homo sapiens
atttttagactatttct

SEQ ID NO: 1461849 - DNA, 19 bp, Homo sapiens
atttttagactatttcttt

SEQ ID NO: 1461850 - DNA, 13 bp, Homo sapiens
atttttataaatt

SEQ ID NO: 1461851 - DNA, 14 bp, Homo sapiens
atttttataataat

SEQ ID NO: 1461852 - DNA, 17 bp, Homo sapiens
atttttatacaaaccta

SEQ ID NO: 1461853 - DNA, 17 bp, Homo sapiens
atttttatacggaaaaa

SEQ ID NO: 1461854 - DNA, 23 bp, Homo sapiens
atttttatacggaaaaaattgta

SEQ ID NO: 1461855 - DNA, 14 bp, Homo sapiens
atttttatacttta

SEQ ID NO: 1461856 - DNA, 15 bp, Homo sapiens
atttttatactttat

SEQ ID NO: 1461857 - DNA, 18 bp, Homo sapiens
atttttatatcagcctga

SEQ ID NO: 1461858 - DNA, 17 bp, Homo sapiens
atttttatcatgaattc

SEQ ID NO: 1461859 - DNA, 12 bp, Homo sapiens
atttttatgcag

SEQ ID NO: 1461860 - DNA, 21 bp, Homo sapiens
atttttattaaagcatttcct

SEQ ID NO: 1461861 - DNA, 14 bp, Homo sapiens
atttttattaaatg

SEQ ID NO: 1461862 - DNA, 17 bp, Homo sapiens
atttttattaaatgtat

SEQ ID NO: 1461863 - DNA, 12 bp, Homo sapiens
atttttattgtt

SEQ ID NO: 1461864 - DNA, 14 bp, Homo sapiens
atttttatttatat

SEQ ID NO: 1461865 - DNA, 13 bp, Homo sapiens
atttttatttatg

SEQ ID NO: 1461866 - DNA, 20 bp, Homo sapiens
atttttatttatttttcttg

SEQ ID NO: 1461867 - DNA, 16 bp, Homo sapiens
atttttatttctgact

SEQ ID NO: 1461868 - DNA, 15 bp, Homo sapiens
atttttatttgtaaa

SEQ ID NO: 1461869 - DNA, 16 bp, Homo sapiens
atttttatttttctaa

SEQ ID NO: 1461870 - DNA, 17 bp, Homo sapiens
atttttcaaaatcgttt

SEQ ID NO: 1461871 - DNA, 14 bp, Homo sapiens
atttttcaaggcat

SEQ ID NO: 1461872 - DNA, 14 bp, Homo sapiens
atttttcaatatat

SEQ ID NO: 1461873 - DNA, 14 bp, Homo sapiens
atttttcagatgct

SEQ ID NO: 1461874 - DNA, 15 bp, Homo sapiens
atttttcagatgctt

SEQ ID NO: 1461875 - DNA, 18 bp, Homo sapiens
atttttcagatgcttctg

SEQ ID NO: 1461876 - DNA, 18 bp, Homo sapiens
atttttcatctttaagaa

SEQ ID NO: 1461877 - DNA, 15 bp, Homo sapiens
atttttccaaaataa

SEQ ID NO: 1461878 - DNA, 16 bp, Homo sapiens
atttttcccagtattt

SEQ ID NO: 1461879 - DNA, 10 bp, Homo sapiens
atttttccta

SEQ ID NO: 1461880 - DNA, 17 bp, Homo sapiens
atttttcctttgagtgc

SEQ ID NO: 1461881 - DNA, 17 bp, Homo sapiens
atttttctaaccttgaa

SEQ ID NO: 1461882 - DNA, 13 bp, Homo sapiens
atttttctataaa

SEQ ID NO: 1461883 - DNA, 16 bp, Homo sapiens
atttttctcccaagaa

SEQ ID NO: 1461884 - DNA, 21 bp, Homo sapiens
atttttctcccaagaaacctg

SEQ ID NO: 1461885 - DNA, 10 bp, Homo sapiens
atttttctct

SEQ ID NO: 1461886 - DNA, 14 bp, Homo sapiens
atttttctcttgta

SEQ ID NO: 1461887 - DNA, 15 bp, Homo sapiens
atttttctcttgtac

SEQ ID NO: 1461888 - DNA, 10 bp, Homo sapiens
atttttctgt

SEQ ID NO: 1461889 - DNA, 21 bp, Homo sapiens
atttttgaagtaaattaaaca

SEQ ID NO: 1461890 - DNA, 13 bp, Homo sapiens
atttttgacagaa

SEQ ID NO: 1461891 - DNA, 15 bp, Homo sapiens
atttttgacagaata

SEQ ID NO: 1461892 - DNA, 22 bp, Homo sapiens
atttttgacagaatatgtttca

SEQ ID NO: 1461893 - DNA, 18 bp, Homo sapiens
atttttgagcccttgttt

SEQ ID NO: 1461894 - DNA, 14 bp, Homo sapiens
atttttgagttaca

SEQ ID NO: 1461895 - DNA, 23 bp, Homo sapiens
atttttgagttacaatttggagc

SEQ ID NO: 1461896 - DNA, 21 bp, Homo sapiens
atttttgattaacaatgtatt

SEQ ID NO: 1461897 - DNA, 20 bp, Homo sapiens
atttttggagaaatgtcata

SEQ ID NO: 1461898 - DNA, 21 bp, Homo sapiens
atttttggagaaatgtcataa

SEQ ID NO: 1461899 - DNA, 24 bp, Homo sapiens
atttttggggcatcctggatgatt

SEQ ID NO: 1461900 - DNA, 15 bp, Homo sapiens
atttttggtgcaagt

SEQ ID NO: 1461901 - DNA, 21 bp, Homo sapiens
atttttgtacattacactaaa

SEQ ID NO: 1461902 - DNA, 23 bp, Homo sapiens
atttttgtacattacactaaatt

SEQ ID NO: 1461903 - DNA, 12 bp, Homo sapiens
atttttgtattt

SEQ ID NO: 1461904 - DNA, 21 bp, Homo sapiens
atttttgtcatgaactgtact

SEQ ID NO: 1461905 - DNA, 17 bp, Homo sapiens
atttttgtttcttccaa

SEQ ID NO: 1461906 - DNA, 14 bp, Homo sapiens
atttttgtttgact

SEQ ID NO: 1461907 - DNA, 21 bp, Homo sapiens
atttttgttttcattatctca

SEQ ID NO: 1461908 - DNA, 19 bp, Homo sapiens
attttttaaatgtaaaatt

SEQ ID NO: 1461909 - DNA, 12 bp, Homo sapiens
attttttaagct

SEQ ID NO: 1461910 - DNA, 16 bp, Homo sapiens
attttttaaggaaaca

SEQ ID NO: 1461911 - DNA, 17 bp, Homo sapiens
attttttaagtatttat

SEQ ID NO: 1461912 - DNA, 15 bp, Homo sapiens
attttttaattatta

SEQ ID NO: 1461913 - DNA, 20 bp, Homo sapiens
attttttaattattatttat

SEQ ID NO: 1461914 - DNA, 22 bp, Homo sapiens
attttttaatttgatgaaagct

SEQ ID NO: 1461915 - DNA, 21 bp, Homo sapiens
attttttactacataattaaa

SEQ ID NO: 1461916 - DNA, 17 bp, Homo sapiens
attttttaggtgcttta

SEQ ID NO: 1461917 - DNA, 21 bp, Homo sapiens
attttttatcatgcatgtcct

SEQ ID NO: 1461918 - DNA, 17 bp, Homo sapiens
attttttatttacattt

SEQ ID NO: 1461919 - DNA, 16 bp, Homo sapiens
attttttcccttttta

SEQ ID NO: 1461920 - DNA, 14 bp, Homo sapiens
attttttcctgttt

SEQ ID NO: 1461921 - DNA, 20 bp, Homo sapiens
attttttcgtgcactctgct

SEQ ID NO: 1461922 - DNA, 15 bp, Homo sapiens
attttttctacacag

SEQ ID NO: 1461923 - DNA, 12 bp, Homo sapiens
attttttcttcc

SEQ ID NO: 1461924 - DNA, 14 bp, Homo sapiens
attttttcttttgt

SEQ ID NO: 1461925 - DNA, 14 bp, Homo sapiens
attttttgaaatgc

SEQ ID NO: 1461926 - DNA, 15 bp, Homo sapiens
attttttgaaatgct

SEQ ID NO: 1461927 - DNA, 16 bp, Homo sapiens
attttttggcacttgc

SEQ ID NO: 1461928 - DNA, 19 bp, Homo sapiens
attttttggtggtgaaatt

SEQ ID NO: 1461929 - DNA, 14 bp, Homo sapiens
attttttgtataat

SEQ ID NO: 1461930 - DNA, 15 bp, Homo sapiens
attttttgtataatt

SEQ ID NO: 1461931 - DNA, 15 bp, Homo sapiens
atttttttaaaattt

SEQ ID NO: 1461932 - DNA, 18 bp, Homo sapiens
atttttttaagaaaaaag

SEQ ID NO: 1461933 - DNA, 18 bp, Homo sapiens
atttttttaatagtgctt

SEQ ID NO: 1461934 - DNA, 22 bp, Homo sapiens
atttttttatctatgtggaaaa

SEQ ID NO: 1461935 - DNA, 16 bp, Homo sapiens
atttttttattactga

SEQ ID NO: 1461936 - DNA, 21 bp, Homo sapiens
atttttttcactggagttaca

SEQ ID NO: 1461937 - DNA, 22 bp, Homo sapiens
atttttttcactggagttacat

SEQ ID NO: 1461938 - DNA, 12 bp, Homo sapiens
atttttttctac

SEQ ID NO: 1461939 - DNA, 18 bp, Homo sapiens
atttttttctacataatt

SEQ ID NO: 1461940 - DNA, 20 bp, Homo sapiens
atttttttctacataattgt

SEQ ID NO: 1461941 - DNA, 23 bp, Homo sapiens
atttttttctacataattgtgac

SEQ ID NO: 1461942 - DNA, 15 bp, Homo sapiens
atttttttctagcta

SEQ ID NO: 1461943 - DNA, 21 bp, Homo sapiens
atttttttctagctataacaa

SEQ ID NO: 1461944 - DNA, 18 bp, Homo sapiens
atttttttctttctttgt

SEQ ID NO: 1461945 - DNA, 13 bp, Homo sapiens
atttttttgtaat

SEQ ID NO: 1461946 - DNA, 19 bp, Homo sapiens
atttttttgtaataagcaa

SEQ ID NO: 1461947 - DNA, 22 bp, Homo sapiens
attttttttaaaatagaaattt

SEQ ID NO: 1461948 - DNA, 14 bp, Homo sapiens
attttttttaacat

SEQ ID NO: 1461949 - DNA, 18 bp, Homo sapiens
attttttttagtatttat

SEQ ID NO: 1461950 - DNA, 20 bp, Homo sapiens
attttttttatcatgtcgta

SEQ ID NO: 1461951 - DNA, 23 bp, Homo sapiens
attttttttcccatttagaatgg

SEQ ID NO: 1461952 - DNA, 14 bp, Homo sapiens
attttttttggcct

SEQ ID NO: 1461953 - DNA, 15 bp, Homo sapiens
attttttttggcctg

SEQ ID NO: 1461954 - DNA, 18 bp, Homo sapiens
attttttttgtattctta

SEQ ID NO: 1461955 - DNA, 21 bp, Homo sapiens
atttttttttaattttgatat

SEQ ID NO: 1461956 - DNA, 21 bp, Homo sapiens
agaggccgagcggtggccccg

SEQ ID NO: 1461957 - DNA, 16 bp, Homo sapiens
agaggccggggtccag

SEQ ID NO: 1461958 - DNA, 12 bp, Homo sapiens
agaggcctcagt

SEQ ID NO: 1461959 - DNA, 18 bp, Homo sapiens
agaggcctcccccagcca

SEQ ID NO: 1461960 - DNA, 22 bp, Homo sapiens
agaggcctgaggatgagctgga

SEQ ID NO: 1461961 - DNA, 21 bp, Homo sapiens
agaggcctgcctccagggctg

SEQ ID NO: 1461962 - DNA, 15 bp, Homo sapiens
agaggcctggagccc

SEQ ID NO: 1461963 - DNA, 16 bp, Homo sapiens
agaggcctggagccca

SEQ ID NO: 1461964 - DNA, 22 bp, Homo sapiens
agaggcctggcatcttctggag

SEQ ID NO: 1461965 - DNA, 20 bp, Homo sapiens
agaggcctgtttggcctctc

SEQ ID NO: 1461966 - DNA, 16 bp, Homo sapiens
agaggcgggccagcca

SEQ ID NO: 1461967 - DNA, 19 bp, Homo sapiens
agaggcgggccagccaggc

SEQ ID NO: 1461968 - DNA, 18 bp, Homo sapiens
agaggcgtactacccagc

SEQ ID NO: 1461969 - DNA, 23 bp, Homo sapiens
agaggcgtactacccagctctgt

SEQ ID NO: 1461970 - DNA, 22 bp, Homo sapiens
agaggcgttagtgggcaggtgg

SEQ ID NO: 1461971 - DNA, 19 bp, Homo sapiens
agaggctaaattactcagg

SEQ ID NO: 1461972 - DNA, 21 bp, Homo sapiens
agaggctaaattactcaggaa

SEQ ID NO: 1461973 - DNA, 16 bp, Homo sapiens
agaggctagcttctgc

SEQ ID NO: 1461974 - DNA, 19 bp, Homo sapiens
agaggctagcttctgcttt

SEQ ID NO: 1461975 - DNA, 13 bp, Homo sapiens
agaggctgaggca

SEQ ID NO: 1461976 - DNA, 14 bp, Homo sapiens
agaggctgaggcct

SEQ ID NO: 1461977 - DNA, 12 bp, Homo sapiens
agaggctgcagg

SEQ ID NO: 1461978 - DNA, 16 bp, Homo sapiens
agaggctgcccctctc

SEQ ID NO: 1461979 - DNA, 18 bp, Homo sapiens
agaggctgcccctctcac

SEQ ID NO: 1461980 - DNA, 13 bp, Homo sapiens
agaggctgcctca

SEQ ID NO: 1461981 - DNA, 15 bp, Homo sapiens
agaggctgcctcagc

SEQ ID NO: 1461982 - DNA, 14 bp, Homo sapiens
agaggctgggttca

SEQ ID NO: 1461983 - DNA, 22 bp, Homo sapiens
agaggctgttcccaccaggctg

SEQ ID NO: 1461984 - DNA, 21 bp, Homo sapiens
agaggcttctccgccagcctc

SEQ ID NO: 1461985 - DNA, 12 bp, Homo sapiens
agagggaagctg

SEQ ID NO: 1461986 - DNA, 14 bp, Homo sapiens
agagggaagctggc

SEQ ID NO: 1461987 - DNA, 15 bp, Homo sapiens
agagggaagctggct

SEQ ID NO: 1461988 - DNA, 17 bp, Homo sapiens
agagggaatggatgggg

SEQ ID NO: 1461989 - DNA, 13 bp, Homo sapiens
agagggaatgtga

SEQ ID NO: 1461990 - DNA, 14 bp, Homo sapiens
agagggaatgtgaa

SEQ ID NO: 1461991 - DNA, 15 bp, Homo sapiens
agagggaatgtgaaa

SEQ ID NO: 1461992 - DNA, 15 bp, Homo sapiens
agagggacaggcact

SEQ ID NO: 1461993 - DNA, 18 bp, Homo sapiens
agagggactcaagggaaa

SEQ ID NO: 1461994 - DNA, 13 bp, Homo sapiens
agagttaaaagca

SEQ ID NO: 1461995 - DNA, 15 bp, Homo sapiens
agagttaaaatgttt

SEQ ID NO: 1461996 - DNA, 14 bp, Homo sapiens
agagttaagaatgt

SEQ ID NO: 1461997 - DNA, 23 bp, Homo sapiens
agagttaataggagtatttttgg

SEQ ID NO: 1461998 - DNA, 17 bp, Homo sapiens
agagttacagttctgtg

SEQ ID NO: 1461999 - DNA, 17 bp, Homo sapiens
agagttacttgataagg

SEQ ID NO: 1462000 - DNA, 19 bp, Homo sapiens
agagttagtttctttggga

SEQ ID NO: 1462001 - DNA, 15 bp, Homo sapiens
agagttattgaatct

SEQ ID NO: 1462002 - DNA, 16 bp, Homo sapiens
agagttcaagcctgtg

SEQ ID NO: 1462003 - DNA, 20 bp, Homo sapiens
agagttcccttgaaactttg

SEQ ID NO: 1462004 - DNA, 12 bp, Homo sapiens
agagttcctcct

SEQ ID NO: 1462005 - DNA, 16 bp, Homo sapiens
agagttcctgcggagt

SEQ ID NO: 1462006 - DNA, 21 bp, Homo sapiens
agagttctatccccaagctgg

SEQ ID NO: 1462007 - DNA, 21 bp, Homo sapiens
agagttgctgagagggctcga

SEQ ID NO: 1462008 - DNA, 21 bp, Homo sapiens
agagttgctttgccagagcag

SEQ ID NO: 1462009 - DNA, 17 bp, Homo sapiens
agagttggctcaggcag

SEQ ID NO: 1462010 - DNA, 18 bp, Homo sapiens
agagttggctcaggcaga

SEQ ID NO: 1462011 - DNA, 16 bp, Homo sapiens
agagtttatacagtgt

SEQ ID NO: 1462012 - DNA, 16 bp, Homo sapiens
agagtttcaaaagcaa

SEQ ID NO: 1462013 - DNA, 14 bp, Homo sapiens
agagtttgtgtgta

SEQ ID NO: 1462014 - DNA, 15 bp, Homo sapiens
agagtttgtgtgtat

SEQ ID NO: 1462015 - DNA, 17 bp, Homo sapiens
agagtttgtgtgtattt

SEQ ID NO: 1462016 - DNA, 18 bp, Homo sapiens
agagtttgtgtgttgtct

SEQ ID NO: 1462017 - DNA, 16 bp, Homo sapiens
agagttttatcaactt

SEQ ID NO: 1462018 - DNA, 17 bp, Homo sapiens
agagtttttaaagcctt

SEQ ID NO: 1462019 - DNA, 18 bp, Homo sapiens
agataaaagctgaagtta

SEQ ID NO: 1462020 - DNA, 18 bp, Homo sapiens
agataaacacaggcaggt

SEQ ID NO: 1462021 - DNA, 19 bp, Homo sapiens
agataaacctagataaaga

SEQ ID NO: 1462022 - DNA, 19 bp, Homo sapiens
agataaagaccagaaattc

SEQ ID NO: 1462023 - DNA, 11 bp, Homo sapiens
agataaagatg

SEQ ID NO: 1462024 - DNA, 13 bp, Homo sapiens
agataaagccaga

SEQ ID NO: 1462025 - DNA, 21 bp, Homo sapiens
agataaagtcaaatgccaaac

SEQ ID NO: 1462026 - DNA, 17 bp, Homo sapiens
agataaatccttaacat

SEQ ID NO: 1462027 - DNA, 16 bp, Homo sapiens
agataaatgattcaaa

SEQ ID NO: 1462028 - DNA, 12 bp, Homo sapiens
agataaatgtgc

SEQ ID NO: 1462029 - DNA, 13 bp, Homo sapiens
agataactaggaa

SEQ ID NO: 1462030 - DNA, 18 bp, Homo sapiens
agataactctctttcctt

SEQ ID NO: 1462031 - DNA, 15 bp, Homo sapiens
agataagataaatga

SEQ ID NO: 1462032 - DNA, 16 bp, Homo sapiens
agataagcaagagaga

SEQ ID NO: 1462033 - DNA, 23 bp, Homo sapiens
agataagtggccttgacacatta

SEQ ID NO: 1462034 - DNA, 20 bp, Homo sapiens
agataagttggagcaggggt

SEQ ID NO: 1462035 - DNA, 20 bp, Homo sapiens
agataataactgtcttctgg

SEQ ID NO: 1462036 - DNA, 19 bp, Homo sapiens
agataatcagtgtgtctaa

SEQ ID NO: 1462037 - DNA, 14 bp, Homo sapiens
agataatgatactt

SEQ ID NO: 1462038 - DNA, 15 bp, Homo sapiens
agataattcatttgt

SEQ ID NO: 1462039 - DNA, 16 bp, Homo sapiens
agataattcatttgta

SEQ ID NO: 1462040 - DNA, 18 bp, Homo sapiens
agataatttacaagatat

SEQ ID NO: 1462041 - DNA, 22 bp, Homo sapiens
agatacaaaaccttgtgtaaga

SEQ ID NO: 1462042 - DNA, 23 bp, Homo sapiens
agatacaaaaccttgtgtaagag

SEQ ID NO: 1462043 - DNA, 14 bp, Homo sapiens
agatacaaattaat

SEQ ID NO: 1462044 - DNA, 21 bp, Homo sapiens
agatacacagctccgagctgt

SEQ ID NO: 1462045 - DNA, 21 bp, Homo sapiens
agatacatggttgtgacctga

SEQ ID NO: 1462046 - DNA, 22 bp, Homo sapiens
agataccacaaaccctgctgaa

SEQ ID NO: 1462047 - DNA, 22 bp, Homo sapiens
agatacctaaaagagatttcaa

SEQ ID NO: 1462048 - DNA, 18 bp, Homo sapiens
agataccttgaaaggaag

SEQ ID NO: 1462049 - DNA, 16 bp, Homo sapiens
agatacgggggctgtg

SEQ ID NO: 1462050 - DNA, 22 bp, Homo sapiens
agatacgggggctgtgactctg

SEQ ID NO: 1462051 - DNA, 18 bp, Homo sapiens
agatactaaggacgttgt

SEQ ID NO: 1462052 - DNA, 12 bp, Homo sapiens
agatactctcag

SEQ ID NO: 1462053 - DNA, 13 bp, Homo sapiens
agatactggaaac

SEQ ID NO: 1462054 - DNA, 20 bp, Homo sapiens
agatactgtgagcttacatt

SEQ ID NO: 1462055 - DNA, 23 bp, Homo sapiens
agatacttttaaagttttgtcag

SEQ ID NO: 1462056 - DNA, 21 bp, Homo sapiens
agatagaacacaaaacttgaa

SEQ ID NO: 1462057 - DNA, 17 bp, Homo sapiens
agatagaagaattttat

SEQ ID NO: 1462058 - DNA, 18 bp, Homo sapiens
agatagacgggttgaaag

SEQ ID NO: 1462059 - DNA, 12 bp, Homo sapiens
agatagagaaat

SEQ ID NO: 1462060 - DNA, 15 bp, Homo sapiens
agatagagaaatagt

SEQ ID NO: 1462061 - DNA, 21 bp, Homo sapiens
agatagagagtgagtacatgc

SEQ ID NO: 1462062 - DNA, 13 bp, Homo sapiens
agatagagtaaaa

SEQ ID NO: 1462063 - DNA, 14 bp, Homo sapiens
agatagatttggaa

SEQ ID NO: 1462064 - DNA, 17 bp, Homo sapiens
agatagatttggaatag

SEQ ID NO: 1462065 - DNA, 15 bp, Homo sapiens
agatagggaaaaggg

SEQ ID NO: 1462066 - DNA, 22 bp, Homo sapiens
agatagggaaaaggggctcctt

SEQ ID NO: 1462067 - DNA, 20 bp, Homo sapiens
agatagtccataatgttctg

SEQ ID NO: 1462068 - DNA, 23 bp, Homo sapiens
agatagtccataatgttctgcta

SEQ ID NO: 1462069 - DNA, 16 bp, Homo sapiens
agatagtcttcagttt

SEQ ID NO: 1462070 - DNA, 23 bp, Homo sapiens
agatagttaaaagactgcagctg

SEQ ID NO: 1462071 - DNA, 16 bp, Homo sapiens
agatagttttaattct

SEQ ID NO: 1462072 - DNA, 15 bp, Homo sapiens
agatataaattttta

SEQ ID NO: 1462073 - DNA, 16 bp, Homo sapiens
agatataacattcagt

SEQ ID NO: 1462074 - DNA, 17 bp, Homo sapiens
agatataacattcagtt

SEQ ID NO: 1462075 - DNA, 16 bp, Homo sapiens
ctgccctcccgcacct

SEQ ID NO: 1462076 - DNA, 19 bp, Homo sapiens
ctgccctcccgcaccttcc

SEQ ID NO: 1462077 - DNA, 23 bp, Homo sapiens
ctgccctcccgcaccttcctcct

SEQ ID NO: 1462078 - DNA, 18 bp, Homo sapiens
ctgccctcgtggccagcc

SEQ ID NO: 1462079 - DNA, 19 bp, Homo sapiens
ctgccctcgtggccagccc

SEQ ID NO: 1462080 - DNA, 20 bp, Homo sapiens
ctgccctcgtggccagcccg

SEQ ID NO: 1462081 - DNA, 14 bp, Homo sapiens
ctgccctctctgcg

SEQ ID NO: 1462082 - DNA, 13 bp, Homo sapiens
ctgccctctgccc

SEQ ID NO: 1462083 - DNA, 16 bp, Homo sapiens
ctgccctctgccccat

SEQ ID NO: 1462084 - DNA, 12 bp, Homo sapiens
ctgccctctgct

SEQ ID NO: 1462085 - DNA, 18 bp, Homo sapiens
ctgccctctgctctgcct

SEQ ID NO: 1462086 - DNA, 20 bp, Homo sapiens
ctgccctctgctctgcctgg

SEQ ID NO: 1462087 - DNA, 17 bp, Homo sapiens
ctgccctgcacgtcatg

SEQ ID NO: 1462088 - DNA, 12 bp, Homo sapiens
ctgccctgcatg

SEQ ID NO: 1462089 - DNA, 14 bp, Homo sapiens
ctgccctgccccac

SEQ ID NO: 1462090 - DNA, 23 bp, Homo sapiens
ctgccctgccccaccccacctca

SEQ ID NO: 1462091 - DNA, 15 bp, Homo sapiens
ctgccctgcctgccc

SEQ ID NO: 1462092 - DNA, 17 bp, Homo sapiens
ctgccctggcagcagca

SEQ ID NO: 1462093 - DNA, 12 bp, Homo sapiens
ctgccctggccc

SEQ ID NO: 1462094 - DNA, 16 bp, Homo sapiens
ctgccctggccctgag

SEQ ID NO: 1462095 - DNA, 23 bp, Homo sapiens
ctgccctggccctgaggtgtggg

SEQ ID NO: 1462096 - DNA, 12 bp, Homo sapiens
ctgccctggctg

SEQ ID NO: 1462097 - DNA, 14 bp, Homo sapiens
ctgccctggctgct

SEQ ID NO: 1462098 - DNA, 13 bp, Homo sapiens
ctgccctggctgt

SEQ ID NO: 1462099 - DNA, 11 bp, Homo sapiens
ctgccctggga

SEQ ID NO: 1462100 - DNA, 19 bp, Homo sapiens
ctgccctgggatgtccaca

SEQ ID NO: 1462101 - DNA, 24 bp, Homo sapiens
ctgccctgggatgtccacagatgc

SEQ ID NO: 1462102 - DNA, 20 bp, Homo sapiens
ctgccctgggcgagcccctc

SEQ ID NO: 1462103 - DNA, 22 bp, Homo sapiens
ctgccctgggcgagcccctcct

SEQ ID NO: 1462104 - DNA, 14 bp, Homo sapiens
ctgccctggtccag

SEQ ID NO: 1462105 - DNA, 20 bp, Homo sapiens
ctgccctggtccagggaagc

SEQ ID NO: 1462106 - DNA, 21 bp, Homo sapiens
ctgccctggtccagggaagct

SEQ ID NO: 1462107 - DNA, 20 bp, Homo sapiens
ctgccctggtgctgccacac

SEQ ID NO: 1462108 - DNA, 21 bp, Homo sapiens
ctgccctggtgctgccacact

SEQ ID NO: 1462109 - DNA, 16 bp, Homo sapiens
ctgccctgtctggaac

SEQ ID NO: 1462110 - DNA, 20 bp, Homo sapiens
ctgccctgtgatatgtctgc

SEQ ID NO: 1462111 - DNA, 13 bp, Homo sapiens
ctgccctgtgtac

SEQ ID NO: 1462112 - DNA, 19 bp, Homo sapiens
ctgccctgttgtgtataga

SEQ ID NO: 1462113 - DNA, 16 bp, Homo sapiens
ctgccctgtttctgtt

SEQ ID NO: 1462114 - DNA, 12 bp, Homo sapiens
ctgcccttccag

SEQ ID NO: 1462115 - DNA, 14 bp, Homo sapiens
ctgcccttcctcag

SEQ ID NO: 1462116 - DNA, 15 bp, Homo sapiens
ctgcccttcctcctg

SEQ ID NO: 1462117 - DNA, 15 bp, Homo sapiens
ctgcccttcctgcag

SEQ ID NO: 1462118 - DNA, 17 bp, Homo sapiens
ctgcccttctcaagact

SEQ ID NO: 1462119 - DNA, 10 bp, Homo sapiens
ctgcccttga

SEQ ID NO: 1462120 - DNA, 22 bp, Homo sapiens
ctgcccttgaaccccctccctg

SEQ ID NO: 1462121 - DNA, 13 bp, Homo sapiens
ctgcccttgggcc

SEQ ID NO: 1462122 - DNA, 20 bp, Homo sapiens
ctgcccttgggtccccccga

SEQ ID NO: 1462123 - DNA, 18 bp, Homo sapiens
ctgcccttgttgcctgca

SEQ ID NO: 1462124 - DNA, 21 bp, Homo sapiens
ctgcccttgttgcctgcaccc

SEQ ID NO: 1462125 - DNA, 22 bp, Homo sapiens
ctgcccttgttgcctgcaccct

SEQ ID NO: 1462126 - DNA, 14 bp, Homo sapiens
ctgccgaacacaca

SEQ ID NO: 1462127 - DNA, 14 bp, Homo sapiens
ctgccgacatccct

SEQ ID NO: 1462128 - DNA, 17 bp, Homo sapiens
ctgccgacctcgtcctc

SEQ ID NO: 1462129 - DNA, 19 bp, Homo sapiens
ctgccgacctcgtcctccc

SEQ ID NO: 1462130 - DNA, 19 bp, Homo sapiens
ctgccgagacagaccctct

SEQ ID NO: 1462131 - DNA, 14 bp, Homo sapiens
ctgccgcaccccag

SEQ ID NO: 1462132 - DNA, 16 bp, Homo sapiens
ctgccgcaccccagag

SEQ ID NO: 1462133 - DNA, 15 bp, Homo sapiens
ctgccgcagagctgg

SEQ ID NO: 1462134 - DNA, 16 bp, Homo sapiens
ctgccgcagagctggc

SEQ ID NO: 1462135 - DNA, 15 bp, Homo sapiens
ctgccgcccaaagag

SEQ ID NO: 1462136 - DNA, 13 bp, Homo sapiens
ctgccgcccccgc

SEQ ID NO: 1462137 - DNA, 14 bp, Homo sapiens
ctgccgcccccgcc

SEQ ID NO: 1462138 - DNA, 16 bp, Homo sapiens
ctgccgcccccgcctg

SEQ ID NO: 1462139 - DNA, 22 bp, Homo sapiens
ctgccgcctgcgtttggaggcc

SEQ ID NO: 1462140 - DNA, 13 bp, Homo sapiens
ctgccgctacctc

SEQ ID NO: 1462141 - DNA, 17 bp, Homo sapiens
ctgccgctacctccctc

SEQ ID NO: 1462142 - DNA, 18 bp, Homo sapiens
ctgccgctacctccctcc

SEQ ID NO: 1462143 - DNA, 19 bp, Homo sapiens
ctgccgctgcttccaggct

SEQ ID NO: 1462144 - DNA, 14 bp, Homo sapiens
ctgccggctctggg

SEQ ID NO: 1462145 - DNA, 18 bp, Homo sapiens
ctgccgggctgagggcct

SEQ ID NO: 1462146 - DNA, 23 bp, Homo sapiens
ctgccgggctgagggcctgctgg

SEQ ID NO: 1462147 - DNA, 15 bp, Homo sapiens
ctgccggtcccccat

SEQ ID NO: 1462148 - DNA, 16 bp, Homo sapiens
ctgccggtcgggcagc

SEQ ID NO: 1462149 - DNA, 20 bp, Homo sapiens
ctgccggtcgggcagccagc

SEQ ID NO: 1462150 - DNA, 14 bp, Homo sapiens
ctgccggtttgaaa

SEQ ID NO: 1462151 - DNA, 20 bp, Homo sapiens
ctgccgtgcatggctcctgt

SEQ ID NO: 1462152 - DNA, 21 bp, Homo sapiens
ctgccgtgcatggctcctgtc

SEQ ID NO: 1462153 - DNA, 17 bp, Homo sapiens
ctgccgtgccgcctgca

SEQ ID NO: 1462154 - DNA, 19 bp, Homo sapiens
ctgccgtgccgcctgcact

SEQ ID NO: 1462155 - DNA, 22 bp, Homo sapiens
ctgccgtgccgcctgcactcct

SEQ ID NO: 1462156 - DNA, 13 bp, Homo sapiens
ctgccgtggggcc

SEQ ID NO: 1462157 - DNA, 20 bp, Homo sapiens
ctgcctaaattaaattgggc

SEQ ID NO: 1462158 - DNA, 13 bp, Homo sapiens
ctgcctaagccct

SEQ ID NO: 1462159 - DNA, 19 bp, Homo sapiens
ctgcctaaggccctttgtg

SEQ ID NO: 1462160 - DNA, 15 bp, Homo sapiens
ctgcctaagtggctg

SEQ ID NO: 1462161 - DNA, 16 bp, Homo sapiens
ctgcctaagtggctgc

SEQ ID NO: 1462162 - DNA, 23 bp, Homo sapiens
ctgcctacagaacttcagaaaga

SEQ ID NO: 1462163 - DNA, 18 bp, Homo sapiens
ctgcctagaaaatgcaaa

SEQ ID NO: 1462164 - DNA, 14 bp, Homo sapiens
ctgcctagagtgta

SEQ ID NO: 1462165 - DNA, 15 bp, Homo sapiens
ctgcctaggagctgg

SEQ ID NO: 1462166 - DNA, 17 bp, Homo sapiens
ctgcctaggagctggct

SEQ ID NO: 1462167 - DNA, 23 bp, Homo sapiens
ctgcctaggagctggctggcagg

SEQ ID NO: 1462168 - DNA, 19 bp, Homo sapiens
ctgcctaggaggctggcca

SEQ ID NO: 1462169 - DNA, 17 bp, Homo sapiens
ctgcctaggtttttcct

SEQ ID NO: 1462170 - DNA, 17 bp, Homo sapiens
ctgcctagtgggagtta

SEQ ID NO: 1462171 - DNA, 23 bp, Homo sapiens
ctgcctcacttcctacaagagca

SEQ ID NO: 1462172 - DNA, 21 bp, Homo sapiens
ctgcctcagccagtggcacag

SEQ ID NO: 1462173 - DNA, 23 bp, Homo sapiens
ctgcctcagccagtggcacagga

SEQ ID NO: 1462174 - DNA, 12 bp, Homo sapiens
ctgcctcagcct

SEQ ID NO: 1462175 - DNA, 23 bp, Homo sapiens
ctgcctcaggaggcaggaccttc

SEQ ID NO: 1462176 - DNA, 22 bp, Homo sapiens
ctgcctcagtggctctgggtac

SEQ ID NO: 1462177 - DNA, 13 bp, Homo sapiens
ctgcctcatttag

SEQ ID NO: 1462178 - DNA, 17 bp, Homo sapiens
ctgcctccaccagcaag

SEQ ID NO: 1462179 - DNA, 20 bp, Homo sapiens
ctgcctccagggctggactg

SEQ ID NO: 1462180 - DNA, 22 bp, Homo sapiens
ctgcctccagggctggactgag

SEQ ID NO: 1462181 - DNA, 12 bp, Homo sapiens
ctgcctccatgg

SEQ ID NO: 1462182 - DNA, 14 bp, Homo sapiens
ctgcctccatggca

SEQ ID NO: 1462183 - DNA, 22 bp, Homo sapiens
ctgcctccatggcagcagccag

SEQ ID NO: 1462184 - DNA, 21 bp, Homo sapiens
ctgcctcccaaggtcctctca

SEQ ID NO: 1462185 - DNA, 23 bp, Homo sapiens
ctgcctcccaaggtcctctcagt

SEQ ID NO: 1462186 - DNA, 14 bp, Homo sapiens
ctgcctcccaggtt

SEQ ID NO: 1462187 - DNA, 14 bp, Homo sapiens
ctgcctcccctccg

SEQ ID NO: 1462188 - DNA, 18 bp, Homo sapiens
ctgcctccctctccatat

SEQ ID NO: 1462189 - DNA, 23 bp, Homo sapiens
ctgcctccctggggaccaggagc

SEQ ID NO: 1462190 - DNA, 16 bp, Homo sapiens
ctgcctcccttgtggc

SEQ ID NO: 1462191 - DNA, 15 bp, Homo sapiens
ctgcctcctgccacc

SEQ ID NO: 1462192 - DNA, 18 bp, Homo sapiens
agatataactgtcttgtt

SEQ ID NO: 1462193 - DNA, 14 bp, Homo sapiens
agatatataaataa

SEQ ID NO: 1462194 - DNA, 16 bp, Homo sapiens
agatatatacaaggtg

SEQ ID NO: 1462195 - DNA, 19 bp, Homo sapiens
agatatatgctctgcatgt

SEQ ID NO: 1462196 - DNA, 16 bp, Homo sapiens
agatatatttttcaca

SEQ ID NO: 1462197 - DNA, 21 bp, Homo sapiens
agatatcaaaattctagctgt

SEQ ID NO: 1462198 - DNA, 15 bp, Homo sapiens
agatatcagagctct

SEQ ID NO: 1462199 - DNA, 14 bp, Homo sapiens
agatatcagtgtct

SEQ ID NO: 1462200 - DNA, 16 bp, Homo sapiens
agatatcgacttgttt

SEQ ID NO: 1462201 - DNA, 15 bp, Homo sapiens
agatatctcaatgaa

SEQ ID NO: 1462202 - DNA, 15 bp, Homo sapiens
agatatctgcatgtg

SEQ ID NO: 1462203 - DNA, 19 bp, Homo sapiens
agatatcttggacaaatca

SEQ ID NO: 1462204 - DNA, 21 bp, Homo sapiens
agatatcttggacaaatcaca

SEQ ID NO: 1462205 - DNA, 22 bp, Homo sapiens
agatatcttggacaaatcacat

SEQ ID NO: 1462206 - DNA, 15 bp, Homo sapiens
agatatgaaagctga

SEQ ID NO: 1462207 - DNA, 17 bp, Homo sapiens
agatatgatatgtaaac

SEQ ID NO: 1462208 - DNA, 21 bp, Homo sapiens
agatatgtatcataaaaataa

SEQ ID NO: 1462209 - DNA, 19 bp, Homo sapiens
agatattaggggggaaagt

SEQ ID NO: 1462210 - DNA, 14 bp, Homo sapiens
agatattattgctt

SEQ ID NO: 1462211 - DNA, 19 bp, Homo sapiens
agatattgaaggagaaaat

SEQ ID NO: 1462212 - DNA, 21 bp, Homo sapiens
agatattgaaggagaaaatag

SEQ ID NO: 1462213 - DNA, 21 bp, Homo sapiens
agatattgtgaagtacatatt

SEQ ID NO: 1462214 - DNA, 23 bp, Homo sapiens
agatattgttttctgtaaataac

SEQ ID NO: 1462215 - DNA, 17 bp, Homo sapiens
agatatttatatatatt

SEQ ID NO: 1462216 - DNA, 23 bp, Homo sapiens
agatatttattgtttatttatca

SEQ ID NO: 1462217 - DNA, 12 bp, Homo sapiens
agatatttcaaa

SEQ ID NO: 1462218 - DNA, 13 bp, Homo sapiens
agatatttccaag

SEQ ID NO: 1462219 - DNA, 16 bp, Homo sapiens
agatatttccatttct

SEQ ID NO: 1462220 - DNA, 20 bp, Homo sapiens
agatatttccatttcttcct

SEQ ID NO: 1462221 - DNA, 13 bp, Homo sapiens
agatatttgcacc

SEQ ID NO: 1462222 - DNA, 18 bp, Homo sapiens
agatattttatatgtatg

SEQ ID NO: 1462223 - DNA, 19 bp, Homo sapiens
agatatttttatctttata

SEQ ID NO: 1462224 - DNA, 21 bp, Homo sapiens
agatatttttatctttatatg

SEQ ID NO: 1462225 - DNA, 16 bp, Homo sapiens
agatcaaaataaaaag

SEQ ID NO: 1462226 - DNA, 13 bp, Homo sapiens
agatcaaagatga

SEQ ID NO: 1462227 - DNA, 17 bp, Homo sapiens
agatcaaagtatgtatg

SEQ ID NO: 1462228 - DNA, 19 bp, Homo sapiens
agatcaaatagttgcatag

SEQ ID NO: 1462229 - DNA, 23 bp, Homo sapiens
agatcaattacttattttaggaa

SEQ ID NO: 1462230 - DNA, 19 bp, Homo sapiens
agatcacatcttaaattca

SEQ ID NO: 1462231 - DNA, 15 bp, Homo sapiens
agatcaccagcccgg

SEQ ID NO: 1462232 - DNA, 16 bp, Homo sapiens
agatcaccagcccggc

SEQ ID NO: 1462233 - DNA, 17 bp, Homo sapiens
agatcaccttgtattct

SEQ ID NO: 1462234 - DNA, 23 bp, Homo sapiens
agatcacgccattgtactccagc

SEQ ID NO: 1462235 - DNA, 19 bp, Homo sapiens
agatcactgccctttttga

SEQ ID NO: 1462236 - DNA, 14 bp, Homo sapiens
agatcactgtagtt

SEQ ID NO: 1462237 - DNA, 14 bp, Homo sapiens
agatcagaacattc

SEQ ID NO: 1462238 - DNA, 22 bp, Homo sapiens
agatcagaacattcagctctgg

SEQ ID NO: 1462239 - DNA, 23 bp, Homo sapiens
agatcagaacattcagctctgga

SEQ ID NO: 1462240 - DNA, 18 bp, Homo sapiens
agatcagatgctccaaga

SEQ ID NO: 1462241 - DNA, 20 bp, Homo sapiens
agatcagcaaaccggggcct

SEQ ID NO: 1462242 - DNA, 15 bp, Homo sapiens
agatcagcattcaaa

SEQ ID NO: 1462243 - DNA, 20 bp, Homo sapiens
agatcagcattcaaaatagt

SEQ ID NO: 1462244 - DNA, 16 bp, Homo sapiens
agatcataaggcttca

SEQ ID NO: 1462245 - DNA, 16 bp, Homo sapiens
agatcatatttaaaga

SEQ ID NO: 1462246 - DNA, 16 bp, Homo sapiens
agatcatttggagctc

SEQ ID NO: 1462247 - DNA, 18 bp, Homo sapiens
agatccaaaagaagcccc

SEQ ID NO: 1462248 - DNA, 23 bp, Homo sapiens
agatccaaaagaagcccccagct

SEQ ID NO: 1462249 - DNA, 17 bp, Homo sapiens
agatccacacacagagg

SEQ ID NO: 1462250 - DNA, 13 bp, Homo sapiens
agatccagcctgg

SEQ ID NO: 1462251 - DNA, 13 bp, Homo sapiens
agatccaggacta

SEQ ID NO: 1462252 - DNA, 22 bp, Homo sapiens
agatccagggacagaggcccca

SEQ ID NO: 1462253 - DNA, 9 bp, Homo sapiens
agatccagt

SEQ ID NO: 1462254 - DNA, 18 bp, Homo sapiens
agatccatttccattgct

SEQ ID NO: 1462255 - DNA, 13 bp, Homo sapiens
agatcccatctct

SEQ ID NO: 1462256 - DNA, 18 bp, Homo sapiens
agatcccatgtcacctca

SEQ ID NO: 1462257 - DNA, 19 bp, Homo sapiens
agatcccatgtcacctcag

SEQ ID NO: 1462258 - DNA, 22 bp, Homo sapiens
agatcccatgtcacctcagctg

SEQ ID NO: 1462259 - DNA, 23 bp, Homo sapiens
agatcccatgtcacctcagctga

SEQ ID NO: 1462260 - DNA, 21 bp, Homo sapiens
agatccccaaaacaggccagg

SEQ ID NO: 1462261 - DNA, 19 bp, Homo sapiens
agatccgggagactgacac

SEQ ID NO: 1462262 - DNA, 21 bp, Homo sapiens
agatcctaagggtcgaaagct

SEQ ID NO: 1462263 - DNA, 23 bp, Homo sapiens
agatcctaagggtcgaaagctct

SEQ ID NO: 1462264 - DNA, 16 bp, Homo sapiens
agatcctagatcctaa

SEQ ID NO: 1462265 - DNA, 13 bp, Homo sapiens
agatcctgaagca

SEQ ID NO: 1462266 - DNA, 23 bp, Homo sapiens
agatcctgaagcagttcagaagg

SEQ ID NO: 1462267 - DNA, 15 bp, Homo sapiens
agatcctgcacccca

SEQ ID NO: 1462268 - DNA, 21 bp, Homo sapiens
agatccttcgggtgctggaag

SEQ ID NO: 1462269 - DNA, 20 bp, Homo sapiens
agatcgacaccatcctggct

SEQ ID NO: 1462270 - DNA, 21 bp, Homo sapiens
agatcgacaccatcctggcta

SEQ ID NO: 1462271 - DNA, 13 bp, Homo sapiens
agatcgagaccat

SEQ ID NO: 1462272 - DNA, 18 bp, Homo sapiens
agatcgagaccatcctgg

SEQ ID NO: 1462273 - DNA, 22 bp, Homo sapiens
agatcgcaccactgcactccag

SEQ ID NO: 1462274 - DNA, 14 bp, Homo sapiens
agatcgcagtttgc

SEQ ID NO: 1462275 - DNA, 15 bp, Homo sapiens
agatcgcagtttgcc

SEQ ID NO: 1462276 - DNA, 17 bp, Homo sapiens
agatcgcttgagcccag

SEQ ID NO: 1462277 - DNA, 20 bp, Homo sapiens
agatcgcttgagcccaggag

SEQ ID NO: 1462278 - DNA, 15 bp, Homo sapiens
agatcgcttttctca

SEQ ID NO: 1462279 - DNA, 14 bp, Homo sapiens
agatcggaacagct

SEQ ID NO: 1462280 - DNA, 17 bp, Homo sapiens
agatcggaacagctcct

SEQ ID NO: 1462281 - DNA, 13 bp, Homo sapiens
agatcggccacag

SEQ ID NO: 1462282 - DNA, 17 bp, Homo sapiens
agatcgttagtatctaa

SEQ ID NO: 1462283 - DNA, 16 bp, Homo sapiens
agatcgttctctgcct

SEQ ID NO: 1462284 - DNA, 13 bp, Homo sapiens
agatctaaaaata

SEQ ID NO: 1462285 - DNA, 21 bp, Homo sapiens
agatctaaacagttatttctg

SEQ ID NO: 1462286 - DNA, 13 bp, Homo sapiens
agatctacacatg

SEQ ID NO: 1462287 - DNA, 19 bp, Homo sapiens
agatctatatttttgtact

SEQ ID NO: 1462288 - DNA, 13 bp, Homo sapiens
agatctcaggtcc

SEQ ID NO: 1462289 - DNA, 18 bp, Homo sapiens
agatctcctggcaaaggc

SEQ ID NO: 1462290 - DNA, 15 bp, Homo sapiens
agatctcctgtattc

SEQ ID NO: 1462291 - DNA, 13 bp, Homo sapiens
agatctgactgcc

SEQ ID NO: 1462292 - DNA, 12 bp, Homo sapiens
agatctgcaggc

SEQ ID NO: 1462293 - DNA, 14 bp, Homo sapiens
agatctgcaggctg

SEQ ID NO: 1462294 - DNA, 15 bp, Homo sapiens
agatctgcaggctgc

SEQ ID NO: 1462295 - DNA, 14 bp, Homo sapiens
agatctgcctgggc

SEQ ID NO: 1462296 - DNA, 15 bp, Homo sapiens
agatctgcctgggcc

SEQ ID NO: 1462297 - DNA, 23 bp, Homo sapiens
agatctgcctgggcctgtgcagc

SEQ ID NO: 1462298 - DNA, 13 bp, Homo sapiens
agatctggaacct

SEQ ID NO: 1462299 - DNA, 14 bp, Homo sapiens
agatctggaacctc

SEQ ID NO: 1462300 - DNA, 17 bp, Homo sapiens
agatctggaacctcagc

SEQ ID NO: 1462301 - DNA, 15 bp, Homo sapiens
agatctggtttctaa

SEQ ID NO: 1462302 - DNA, 14 bp, Homo sapiens
agatctgtcctcag

SEQ ID NO: 1462303 - DNA, 13 bp, Homo sapiens
agatctgtgcccc

SEQ ID NO: 1462304 - DNA, 14 bp, Homo sapiens
agatctgtgtggct

SEQ ID NO: 1462305 - DNA, 21 bp, Homo sapiens
agatctgtgtggctcctgggc

SEQ ID NO: 1462306 - DNA, 13 bp, Homo sapiens
agatcttaggtat

SEQ ID NO: 1462307 - DNA, 15 bp, Homo sapiens
agatcttctgaaatg

SEQ ID NO: 1462308 - DNA, 17 bp, Homo sapiens
agatcttctgaaatgaa

SEQ ID NO: 1462309 - DNA, 15 bp, Homo sapiens
ctgcctcctgcctgc

SEQ ID NO: 1462310 - DNA, 17 bp, Homo sapiens
ctgcctcctgcctgccc

SEQ ID NO: 1462311 - DNA, 16 bp, Homo sapiens
ctgcctcctggctcag

SEQ ID NO: 1462312 - DNA, 20 bp, Homo sapiens
ctgcctcctggctcaggccc

SEQ ID NO: 1462313 - DNA, 19 bp, Homo sapiens
ctgcctccttgatatttgt

SEQ ID NO: 1462314 - DNA, 21 bp, Homo sapiens
ctgcctctagtccccaaggcc

SEQ ID NO: 1462315 - DNA, 16 bp, Homo sapiens
ctgcctctccctggcc

SEQ ID NO: 1462316 - DNA, 18 bp, Homo sapiens
ctgcctctccctggccct

SEQ ID NO: 1462317 - DNA, 14 bp, Homo sapiens
ctgcctctctagga

SEQ ID NO: 1462318 - DNA, 16 bp, Homo sapiens
ctgcctctgaaaatat

SEQ ID NO: 1462319 - DNA, 17 bp, Homo sapiens
ctgcctctgaaaatatt

SEQ ID NO: 1462320 - DNA, 10 bp, Homo sapiens
ctgcctctgc

SEQ ID NO: 1462321 - DNA, 13 bp, Homo sapiens
ctgcctctgcctc

SEQ ID NO: 1462322 - DNA, 14 bp, Homo sapiens
ctgcctctgcctgc

SEQ ID NO: 1462323 - DNA, 11 bp, Homo sapiens
ctgcctctgct

SEQ ID NO: 1462324 - DNA, 12 bp, Homo sapiens
ctgcctctgctc

SEQ ID NO: 1462325 - DNA, 13 bp, Homo sapiens
ctgcctctgctcc

SEQ ID NO: 1462326 - DNA, 15 bp, Homo sapiens
ctgcctctgctccct

SEQ ID NO: 1462327 - DNA, 16 bp, Homo sapiens
ctgcctctgctccctc

SEQ ID NO: 1462328 - DNA, 12 bp, Homo sapiens
ctgcctctgtgt

SEQ ID NO: 1462329 - DNA, 13 bp, Homo sapiens
ctgcctgagcacc

SEQ ID NO: 1462330 - DNA, 13 bp, Homo sapiens
ctgcctgagccca

SEQ ID NO: 1462331 - DNA, 19 bp, Homo sapiens
ctgcctgagcccaggagct

SEQ ID NO: 1462332 - DNA, 15 bp, Homo sapiens
ctgcctgaggaggag

SEQ ID NO: 1462333 - DNA, 21 bp, Homo sapiens
ctgcctgaggaggaggacaca

SEQ ID NO: 1462334 - DNA, 15 bp, Homo sapiens
ctgcctgagggcccc

SEQ ID NO: 1462335 - DNA, 16 bp, Homo sapiens
ctgcctgagggcccct

SEQ ID NO: 1462336 - DNA, 18 bp, Homo sapiens
ctgcctgagggcccctct

SEQ ID NO: 1462337 - DNA, 22 bp, Homo sapiens
ctgcctgagggcccctctgccc

SEQ ID NO: 1462338 - DNA, 17 bp, Homo sapiens
ctgcctgcactccctgg

SEQ ID NO: 1462339 - DNA, 20 bp, Homo sapiens
ctgcctgcactccctggcct

SEQ ID NO: 1462340 - DNA, 21 bp, Homo sapiens
ctgcctgcactccctggcctt

SEQ ID NO: 1462341 - DNA, 16 bp, Homo sapiens
ctgcctgcagaggtct

SEQ ID NO: 1462342 - DNA, 17 bp, Homo sapiens
ctgcctgccaccctgcc

SEQ ID NO: 1462343 - DNA, 21 bp, Homo sapiens
ctgcctgccagctgcactgat

SEQ ID NO: 1462344 - DNA, 20 bp, Homo sapiens
ctgcctgccatgtagttggg

SEQ ID NO: 1462345 - DNA, 15 bp, Homo sapiens
ctgcctgcctcccct

SEQ ID NO: 1462346 - DNA, 12 bp, Homo sapiens
ctgcctgcctgt

SEQ ID NO: 1462347 - DNA, 14 bp, Homo sapiens
ctgcctgcctgtct

SEQ ID NO: 1462348 - DNA, 15 bp, Homo sapiens
ctgcctgcggcccag

SEQ ID NO: 1462349 - DNA, 20 bp, Homo sapiens
ctgcctggagacaaggtgct

SEQ ID NO: 1462350 - DNA, 12 bp, Homo sapiens
ctgcctggccag

SEQ ID NO: 1462351 - DNA, 13 bp, Homo sapiens
ctgcctggccagg

SEQ ID NO: 1462352 - DNA, 17 bp, Homo sapiens
ctgcctggccaggcaga

SEQ ID NO: 1462353 - DNA, 21 bp, Homo sapiens
ctgcctggccaggcagatctg

SEQ ID NO: 1462354 - DNA, 19 bp, Homo sapiens
ctgcctggcccccaacctc

SEQ ID NO: 1462355 - DNA, 16 bp, Homo sapiens
ctgcctggcctggctc

SEQ ID NO: 1462356 - DNA, 18 bp, Homo sapiens
ctgcctggcctggctccc

SEQ ID NO: 1462357 - DNA, 15 bp, Homo sapiens
ctgcctgggacactg

SEQ ID NO: 1462358 - DNA, 21 bp, Homo sapiens
ctgcctgggatgggctcccac

SEQ ID NO: 1462359 - DNA, 22 bp, Homo sapiens
ctgcctgggatgggctcccacc

SEQ ID NO: 1462360 - DNA, 22 bp, Homo sapiens
ctgcctgggcccggaagggctt

SEQ ID NO: 1462361 - DNA, 16 bp, Homo sapiens
ctgcctgggcctgtgc

SEQ ID NO: 1462362 - DNA, 23 bp, Homo sapiens
ctgcctgggctgaccccggtggc

SEQ ID NO: 1462363 - DNA, 13 bp, Homo sapiens
ctgcctggtcctc

SEQ ID NO: 1462364 - DNA, 14 bp, Homo sapiens
ctgcctggtcctcc

SEQ ID NO: 1462365 - DNA, 16 bp, Homo sapiens
ctgcctggtcctccct

SEQ ID NO: 1462366 - DNA, 20 bp, Homo sapiens
ctgcctggtcctccctccca

SEQ ID NO: 1462367 - DNA, 17 bp, Homo sapiens
ctgcctggtctgtctgg

SEQ ID NO: 1462368 - DNA, 22 bp, Homo sapiens
ctgcctggtgcattgctgtgtg

SEQ ID NO: 1462369 - DNA, 21 bp, Homo sapiens
ctgcctgtccctaccccatgg

SEQ ID NO: 1462370 - DNA, 13 bp, Homo sapiens
ctgcctgtctgcc

SEQ ID NO: 1462371 - DNA, 23 bp, Homo sapiens
ctgcctgtctgccccagcccaga

SEQ ID NO: 1462372 - DNA, 13 bp, Homo sapiens
ctgcctgtctgtc

SEQ ID NO: 1462373 - DNA, 16 bp, Homo sapiens
ctgcctgtgagccagt

SEQ ID NO: 1462374 - DNA, 18 bp, Homo sapiens
ctgcctgtgagccagtct

SEQ ID NO: 1462375 - DNA, 13 bp, Homo sapiens
ctgcctgtggagt

SEQ ID NO: 1462376 - DNA, 11 bp, Homo sapiens
ctgcctgtgtg

SEQ ID NO: 1462377 - DNA, 22 bp, Homo sapiens
ctgcctgttaggagaagctgca

SEQ ID NO: 1462378 - DNA, 17 bp, Homo sapiens
ctgcctgttataactct

SEQ ID NO: 1462379 - DNA, 20 bp, Homo sapiens
ctgcctgttggcaggcccac

SEQ ID NO: 1462380 - DNA, 21 bp, Homo sapiens
ctgcctgttggcaggcccact

SEQ ID NO: 1462381 - DNA, 17 bp, Homo sapiens
ctgccttaaacacacat

SEQ ID NO: 1462382 - DNA, 21 bp, Homo sapiens
ctgccttaatgacattcccct

SEQ ID NO: 1462383 - DNA, 22 bp, Homo sapiens
ctgccttactggtttccccagg

SEQ ID NO: 1462384 - DNA, 18 bp, Homo sapiens
ctgccttcacaaatgtca

SEQ ID NO: 1462385 - DNA, 11 bp, Homo sapiens
ctgccttccct

SEQ ID NO: 1462386 - DNA, 12 bp, Homo sapiens
ctgccttcccta

SEQ ID NO: 1462387 - DNA, 15 bp, Homo sapiens
ctgccttcgcttctt

SEQ ID NO: 1462388 - DNA, 21 bp, Homo sapiens
ctgccttcgcttcttgcctct

SEQ ID NO: 1462389 - DNA, 18 bp, Homo sapiens
ctgccttctggccttgta

SEQ ID NO: 1462390 - DNA, 23 bp, Homo sapiens
ctgccttctttccatcaactccc

SEQ ID NO: 1462391 - DNA, 22 bp, Homo sapiens
ctgccttgaagccactgaagct

SEQ ID NO: 1462392 - DNA, 15 bp, Homo sapiens
ctgccttggctcaga

SEQ ID NO: 1462393 - DNA, 23 bp, Homo sapiens
ctgccttgtccctctcactcccc

SEQ ID NO: 1462394 - DNA, 14 bp, Homo sapiens
ctgccttgtgtaca

SEQ ID NO: 1462395 - DNA, 14 bp, Homo sapiens
ctgcctttaagcca

SEQ ID NO: 1462396 - DNA, 18 bp, Homo sapiens
ctgcctttaagccaaaga

SEQ ID NO: 1462397 - DNA, 23 bp, Homo sapiens
ctgcctttctcccccgacactgc

SEQ ID NO: 1462398 - DNA, 20 bp, Homo sapiens
ctgcctttgcagttggactc

SEQ ID NO: 1462399 - DNA, 15 bp, Homo sapiens
ctgccttttctggag

SEQ ID NO: 1462400 - DNA, 18 bp, Homo sapiens
ctgcgaaggggccctggt

SEQ ID NO: 1462401 - DNA, 17 bp, Homo sapiens
ctgcgactttctgcctg

SEQ ID NO: 1462402 - DNA, 23 bp, Homo sapiens
ctgcgaggacatcaaagtggtaa

SEQ ID NO: 1462403 - DNA, 16 bp, Homo sapiens
ctgcgaggctatgagt

SEQ ID NO: 1462404 - DNA, 23 bp, Homo sapiens
ctgcgcaggtctcttctgggcgt

SEQ ID NO: 1462405 - DNA, 13 bp, Homo sapiens
ctgcgccaggcag

SEQ ID NO: 1462406 - DNA, 14 bp, Homo sapiens
ctgcgccaggcaga

SEQ ID NO: 1462407 - DNA, 16 bp, Homo sapiens
ctgcgccaggcagagc

SEQ ID NO: 1462408 - DNA, 18 bp, Homo sapiens
ctgcgcccttaccttccc

SEQ ID NO: 1462409 - DNA, 19 bp, Homo sapiens
ctgcgcccttgtgccctgc

SEQ ID NO: 1462410 - DNA, 12 bp, Homo sapiens
ctgcgcctccag

SEQ ID NO: 1462411 - DNA, 14 bp, Homo sapiens
ctgcgcctccagag

SEQ ID NO: 1462412 - DNA, 17 bp, Homo sapiens
ctgcgcctccagaggtc

SEQ ID NO: 1462413 - DNA, 13 bp, Homo sapiens
ctgcgcctgaaaa

SEQ ID NO: 1462414 - DNA, 21 bp, Homo sapiens
ctgcgctgaggcccagcccct

SEQ ID NO: 1462415 - DNA, 17 bp, Homo sapiens
ctgcgcttccctgcagt

SEQ ID NO: 1462416 - DNA, 13 bp, Homo sapiens
ctgcgcttgcttt

SEQ ID NO: 1462417 - DNA, 12 bp, Homo sapiens
ctgcggaagcca

SEQ ID NO: 1462418 - DNA, 14 bp, Homo sapiens
ctgcggaagccaaa

SEQ ID NO: 1462419 - DNA, 21 bp, Homo sapiens
ctgcggaagccaaaggcagct

SEQ ID NO: 1462420 - DNA, 17 bp, Homo sapiens
ctgcggagccggcacct

SEQ ID NO: 1462421 - DNA, 15 bp, Homo sapiens
ctgcggaggagctgc

SEQ ID NO: 1462422 - DNA, 22 bp, Homo sapiens
ctgcggagtgaagaggggcagc

SEQ ID NO: 1462423 - DNA, 17 bp, Homo sapiens
ctgcggctgtgggcgag

SEQ ID NO: 1462424 - DNA, 13 bp, Homo sapiens
ctgcgggacagag

SEQ ID NO: 1462425 - DNA, 17 bp, Homo sapiens
ctgcgggagctctgtat

SEQ ID NO: 1462426 - DNA, 17 bp, Homo sapiens
ctgcgggatggtcctgg

SEQ ID NO: 1462427 - DNA, 18 bp, Homo sapiens
ctgcgggcccagctgagt

SEQ ID NO: 1462428 - DNA, 20 bp, Homo sapiens
ctgcgggcgcgggcagccac

SEQ ID NO: 1462429 - DNA, 23 bp, Homo sapiens
ctgcgggcgcgggcagccaccca

SEQ ID NO: 1462430 - DNA, 21 bp, Homo sapiens
ctgcgggtggggcttggggct

SEQ ID NO: 1462431 - DNA, 15 bp, Homo sapiens
ctgcggtcactcagg

SEQ ID NO: 1462432 - DNA, 20 bp, Homo sapiens
ctgcggtcactcaggcctct

SEQ ID NO: 1462433 - DNA, 15 bp, Homo sapiens
ctgcgtccccactcc

SEQ ID NO: 1462434 - DNA, 21 bp, Homo sapiens
ctgcgtcctcatttcccctcc

SEQ ID NO: 1462435 - DNA, 18 bp, Homo sapiens
ctgcgtcctgacgccctg

SEQ ID NO: 1462436 - DNA, 13 bp, Homo sapiens
ctgcgtctatcct

SEQ ID NO: 1462437 - DNA, 20 bp, Homo sapiens
ctgcgtgccagtcaagaaga

SEQ ID NO: 1462438 - DNA, 22 bp, Homo sapiens
ctgcgtgccagtcaagaagaaa

SEQ ID NO: 1462439 - DNA, 18 bp, Homo sapiens
ctgcgtggcgcaggtgcc

SEQ ID NO: 1462440 - DNA, 22 bp, Homo sapiens
ctgcgtggcgcaggtgccatgc

SEQ ID NO: 1462441 - DNA, 13 bp, Homo sapiens
ctgcgtgtgtata

SEQ ID NO: 1462442 - DNA, 17 bp, Homo sapiens
ctgcgtgtgtatatttg

SEQ ID NO: 1462443 - DNA, 17 bp, Homo sapiens
ctgcgttggagccactc

SEQ ID NO: 1462444 - DNA, 19 bp, Homo sapiens
ctgcgtttattaatgcctc

SEQ ID NO: 1462445 - DNA, 20 bp, Homo sapiens
ctgcgtttggaggcccctgg

SEQ ID NO: 1462446 - DNA, 17 bp, Homo sapiens
ctgctaaccatttatat

SEQ ID NO: 1462447 - DNA, 17 bp, Homo sapiens
ctgctaaggctcctcct

SEQ ID NO: 1462448 - DNA, 19 bp, Homo sapiens
ctgctaaggctcctccttg

SEQ ID NO: 1462449 - DNA, 22 bp, Homo sapiens
ctgctaagtaggggcagtgatg

SEQ ID NO: 1462450 - DNA, 22 bp, Homo sapiens
ctgctaattctttgcaaaaatc

SEQ ID NO: 1462451 - DNA, 22 bp, Homo sapiens
ctgctacattataatgtacaga

SEQ ID NO: 1462452 - DNA, 14 bp, Homo sapiens
ctgctaccagcgcc

SEQ ID NO: 1462453 - DNA, 17 bp, Homo sapiens
ctgctacccagaaatca

SEQ ID NO: 1462454 - DNA, 15 bp, Homo sapiens
ctgctacctcactgg

SEQ ID NO: 1462455 - DNA, 18 bp, Homo sapiens
ctgctacctcactggggt

SEQ ID NO: 1462456 - DNA, 18 bp, Homo sapiens
ctgctacctctgagaaga

SEQ ID NO: 1462457 - DNA, 21 bp, Homo sapiens
ctgctacctgttcttgggcct

SEQ ID NO: 1462458 - DNA, 19 bp, Homo sapiens
ctgctactacccgagccca

SEQ ID NO: 1462459 - DNA, 21 bp, Homo sapiens
ctgctactacccgagcccagc

SEQ ID NO: 1462460 - DNA, 19 bp, Homo sapiens
ctgctactcctgtgctctg

SEQ ID NO: 1462461 - DNA, 18 bp, Homo sapiens
ctgctactctgttccttc

SEQ ID NO: 1462462 - DNA, 22 bp, Homo sapiens
ctgctactctgttccttcacat

SEQ ID NO: 1462463 - DNA, 17 bp, Homo sapiens
ctgctacttccccagct

SEQ ID NO: 1462464 - DNA, 17 bp, Homo sapiens
ctgctagactcctcagg

SEQ ID NO: 1462465 - DNA, 19 bp, Homo sapiens
ctgctagactcctcaggag

SEQ ID NO: 1462466 - DNA, 19 bp, Homo sapiens
ctgctagagacgctgatcc

SEQ ID NO: 1462467 - DNA, 13 bp, Homo sapiens
ctgctagagcaac

SEQ ID NO: 1462468 - DNA, 15 bp, Homo sapiens
ctgctagagcaaccc

SEQ ID NO: 1462469 - DNA, 14 bp, Homo sapiens
ctgctagattttaa

SEQ ID NO: 1462470 - DNA, 18 bp, Homo sapiens
ctgctagtgaaatggctg

SEQ ID NO: 1462471 - DNA, 22 bp, Homo sapiens
ctgctagtgaaatggctggggc

SEQ ID NO: 1462472 - DNA, 21 bp, Homo sapiens
ctgctatccccatctccctgc

SEQ ID NO: 1462473 - DNA, 13 bp, Homo sapiens
ctgctatgaaaat

SEQ ID NO: 1462474 - DNA, 21 bp, Homo sapiens
ctgctatgaaaatgagcatca

SEQ ID NO: 1462475 - DNA, 17 bp, Homo sapiens
ctgctatttattttcct

SEQ ID NO: 1462476 - DNA, 19 bp, Homo sapiens
ctgctatttattttcctaa

SEQ ID NO: 1462477 - DNA, 21 bp, Homo sapiens
ctgctatttattttcctaaag

SEQ ID NO: 1462478 - DNA, 20 bp, Homo sapiens
ctgctcaagaagacatggag

SEQ ID NO: 1462479 - DNA, 19 bp, Homo sapiens
ctgctcaagccgcaagctc

SEQ ID NO: 1462480 - DNA, 19 bp, Homo sapiens
ctgctcaccgcccatcagg

SEQ ID NO: 1462481 - DNA, 19 bp, Homo sapiens
ctgctcacctgtgtgccca

SEQ ID NO: 1462482 - DNA, 22 bp, Homo sapiens
ctgctcacctgtgtgcccagca

SEQ ID NO: 1462483 - DNA, 17 bp, Homo sapiens
ctgctcagaacttgctg

SEQ ID NO: 1462484 - DNA, 18 bp, Homo sapiens
ctgctcagcagccagtct

SEQ ID NO: 1462485 - DNA, 21 bp, Homo sapiens
ctgctcagcagccagtctcag

SEQ ID NO: 1462486 - DNA, 15 bp, Homo sapiens
ctgctcagccctgca

SEQ ID NO: 1462487 - DNA, 13 bp, Homo sapiens
ctgctcagcctca

SEQ ID NO: 1462488 - DNA, 17 bp, Homo sapiens
ctgctcagctctggtcc

SEQ ID NO: 1462489 - DNA, 17 bp, Homo sapiens
ctgctcaggcccatgct

SEQ ID NO: 1462490 - DNA, 21 bp, Homo sapiens
ctgctcataggacctgcatcc

SEQ ID NO: 1462491 - DNA, 15 bp, Homo sapiens
ctgctcatattgtga

SEQ ID NO: 1462492 - DNA, 13 bp, Homo sapiens
ctgctcatccact

SEQ ID NO: 1462493 - DNA, 19 bp, Homo sapiens
ctgctcatggccctcggag

SEQ ID NO: 1462494 - DNA, 22 bp, Homo sapiens
ctgctcattacagttctttcct

SEQ ID NO: 1462495 - DNA, 14 bp, Homo sapiens
ctgctccaacagaa

SEQ ID NO: 1462496 - DNA, 23 bp, Homo sapiens
ctgctccaacccccgccacctca

SEQ ID NO: 1462497 - DNA, 16 bp, Homo sapiens
ctgctccaatttcccc

SEQ ID NO: 1462498 - DNA, 11 bp, Homo sapiens
ctgctccacca

SEQ ID NO: 1462499 - DNA, 13 bp, Homo sapiens
ctgctccaccaca

SEQ ID NO: 1462500 - DNA, 16 bp, Homo sapiens
ctgctccaccacatcc

SEQ ID NO: 1462501 - DNA, 15 bp, Homo sapiens
ctgctccaccagcag

SEQ ID NO: 1462502 - DNA, 12 bp, Homo sapiens
ctgctccaccct

SEQ ID NO: 1462503 - DNA, 14 bp, Homo sapiens
ctgctccacccttg

SEQ ID NO: 1462504 - DNA, 15 bp, Homo sapiens
ctgctccacccttgg

SEQ ID NO: 1462505 - DNA, 17 bp, Homo sapiens
ctgctccacccttggcc

SEQ ID NO: 1462506 - DNA, 19 bp, Homo sapiens
ctgctccacccttggcctg

SEQ ID NO: 1462507 - DNA, 13 bp, Homo sapiens
ctgctccagacct

SEQ ID NO: 1462508 - DNA, 23 bp, Homo sapiens
ctgctccagcaactgcccttcca

SEQ ID NO: 1462509 - DNA, 18 bp, Homo sapiens
ctgctccagcagcacacc

SEQ ID NO: 1462510 - DNA, 21 bp, Homo sapiens
ctgctcccaccaccagtgaga

SEQ ID NO: 1462511 - DNA, 14 bp, Homo sapiens
ctgctcccagcagc

SEQ ID NO: 1462512 - DNA, 22 bp, Homo sapiens
ctgctcccagtgggagcttccc

SEQ ID NO: 1462513 - DNA, 15 bp, Homo sapiens
ctgctcccattcctc

SEQ ID NO: 1462514 - DNA, 17 bp, Homo sapiens
ctgctccccacccgcct

SEQ ID NO: 1462515 - DNA, 17 bp, Homo sapiens
ctgctccccaggccacc

SEQ ID NO: 1462516 - DNA, 14 bp, Homo sapiens
ctgctcccccaccc

SEQ ID NO: 1462517 - DNA, 17 bp, Homo sapiens
ctgctcccccaccccct

SEQ ID NO: 1462518 - DNA, 14 bp, Homo sapiens
ctgctcccctaacc

SEQ ID NO: 1462519 - DNA, 13 bp, Homo sapiens
ctgctccctggca

SEQ ID NO: 1462520 - DNA, 13 bp, Homo sapiens
ctgctccctgtct

SEQ ID NO: 1462521 - DNA, 17 bp, Homo sapiens
ctgctccctgtctgtgt

SEQ ID NO: 1462522 - DNA, 23 bp, Homo sapiens
ctgctccctgtctgtgtcccagc

SEQ ID NO: 1462523 - DNA, 20 bp, Homo sapiens
ctgctccctgtggcactcag

SEQ ID NO: 1462524 - DNA, 20 bp, Homo sapiens
ctgctccgtggactgcagtc

SEQ ID NO: 1462525 - DNA, 14 bp, Homo sapiens
ctgctcctcactgg

SEQ ID NO: 1462526 - DNA, 13 bp, Homo sapiens
ctgctcctcatgg

SEQ ID NO: 1462527 - DNA, 13 bp, Homo sapiens
ctgctcctccagg

SEQ ID NO: 1462528 - DNA, 17 bp, Homo sapiens
ctgctcctccagggcca

SEQ ID NO: 1462529 - DNA, 22 bp, Homo sapiens
ctgctcctccagggccacgtgc

SEQ ID NO: 1462530 - DNA, 16 bp, Homo sapiens
ctgctcctccctgccc

SEQ ID NO: 1462531 - DNA, 19 bp, Homo sapiens
ctgctcctccctgcccccc

SEQ ID NO: 1462532 - DNA, 15 bp, Homo sapiens
ctgctcctccctggc

SEQ ID NO: 1462533 - DNA, 22 bp, Homo sapiens
ctgctcctccctggctgccctg

SEQ ID NO: 1462534 - DNA, 23 bp, Homo sapiens
ctgctcctccctggctgccctgg

SEQ ID NO: 1462535 - DNA, 15 bp, Homo sapiens
ctgctcctgcttttc

SEQ ID NO: 1462536 - DNA, 18 bp, Homo sapiens
ctgctcctgcttttctgt

SEQ ID NO: 1462537 - DNA, 15 bp, Homo sapiens
ctgctcctgtggcag

SEQ ID NO: 1462538 - DNA, 19 bp, Homo sapiens
ctgctcctgtggcaggagg

SEQ ID NO: 1462539 - DNA, 15 bp, Homo sapiens
ctgctccttcactgt

SEQ ID NO: 1462540 - DNA, 20 bp, Homo sapiens
ctgctcctttaccctcttgg

SEQ ID NO: 1462541 - DNA, 21 bp, Homo sapiens
ctgctcggcttcttggacctt

SEQ ID NO: 1462542 - DNA, 19 bp, Homo sapiens
tgtgaaacagttgctgtga

SEQ ID NO: 1462543 - DNA, 16 bp, Homo sapiens
tgtgaaacggaagctc

SEQ ID NO: 1462544 - DNA, 20 bp, Homo sapiens
tgtgaaacgtcccacacttt

SEQ ID NO: 1462545 - DNA, 19 bp, Homo sapiens
tgtgaaactggcactgaat

SEQ ID NO: 1462546 - DNA, 17 bp, Homo sapiens
tgtgaaaggaacatttt

SEQ ID NO: 1462547 - DNA, 21 bp, Homo sapiens
tgtgaaagtcagatgcccaga

SEQ ID NO: 1462548 - DNA, 22 bp, Homo sapiens
tgtgaaagtcagatgcccagag

SEQ ID NO: 1462549 - DNA, 16 bp, Homo sapiens
tgtgaaattcatttgt

SEQ ID NO: 1462550 - DNA, 15 bp, Homo sapiens
tgtgaaattctcaga

SEQ ID NO: 1462551 - DNA, 18 bp, Homo sapiens
tgtgaaattctcagagtg

SEQ ID NO: 1462552 - DNA, 19 bp, Homo sapiens
tgtgaaattctcagagtgt

SEQ ID NO: 1462553 - DNA, 20 bp, Homo sapiens
tgtgaacaaaagatgctctt

SEQ ID NO: 1462554 - DNA, 13 bp, Homo sapiens
tgtgaacagcttg

SEQ ID NO: 1462555 - DNA, 16 bp, Homo sapiens
tgtgaacagcttgctg

SEQ ID NO: 1462556 - DNA, 12 bp, Homo sapiens
tgtgaacattta

SEQ ID NO: 1462557 - DNA, 20 bp, Homo sapiens
tgtgaaccctagctgtgtca

SEQ ID NO: 1462558 - DNA, 24 bp, Homo sapiens
tgtgaacctttgagctttcataga

SEQ ID NO: 1462559 - DNA, 16 bp, Homo sapiens
tgtgaactggaagaaa

SEQ ID NO: 1462560 - DNA, 13 bp, Homo sapiens
tgtgaactttcat

SEQ ID NO: 1462561 - DNA, 21 bp, Homo sapiens
tgtgaagacattttttgctat

SEQ ID NO: 1462562 - DNA, 18 bp, Homo sapiens
tgtgaagagggagaagca

SEQ ID NO: 1462563 - DNA, 22 bp, Homo sapiens
tgtgaagatgatatactatttt

SEQ ID NO: 1462564 - DNA, 19 bp, Homo sapiens
tgtgaagcatgctttgctg

SEQ ID NO: 1462565 - DNA, 23 bp, Homo sapiens
tgtgaagccatgagttccagaaa

SEQ ID NO: 1462566 - DNA, 22 bp, Homo sapiens
tgtgaagtaacccctcctggct

SEQ ID NO: 1462567 - DNA, 18 bp, Homo sapiens
tgtgaagtgaatgaaaca

SEQ ID NO: 1462568 - DNA, 14 bp, Homo sapiens
tgtgaagttcatct

SEQ ID NO: 1462569 - DNA, 16 bp, Homo sapiens
tgtgaatacattcttt

SEQ ID NO: 1462570 - DNA, 15 bp, Homo sapiens
tgtgaatcagaccct

SEQ ID NO: 1462571 - DNA, 18 bp, Homo sapiens
tgtgaatcagaccctacc

SEQ ID NO: 1462572 - DNA, 18 bp, Homo sapiens
tgtgaatccaggaggcag

SEQ ID NO: 1462573 - DNA, 22 bp, Homo sapiens
tgtgaatccaggaggcagtgga

SEQ ID NO: 1462574 - DNA, 14 bp, Homo sapiens
tgtgaatcctggca

SEQ ID NO: 1462575 - DNA, 14 bp, Homo sapiens
tgtgaatcttgaat

SEQ ID NO: 1462576 - DNA, 23 bp, Homo sapiens
tgtgaattaggctgtaactactt

SEQ ID NO: 1462577 - DNA, 17 bp, Homo sapiens
tgtgaattattgacact

SEQ ID NO: 1462578 - DNA, 19 bp, Homo sapiens
tgtgaattattgacactga

SEQ ID NO: 1462579 - DNA, 15 bp, Homo sapiens
tgtgaattgactacc

SEQ ID NO: 1462580 - DNA, 17 bp, Homo sapiens
tgtgaatttttaagctg

SEQ ID NO: 1462581 - DNA, 15 bp, Homo sapiens
tgtgaatttttattg

SEQ ID NO: 1462582 - DNA, 16 bp, Homo sapiens
tgtgaatttttattgt

SEQ ID NO: 1462583 - DNA, 18 bp, Homo sapiens
tgtgacaaaggatgaaga

SEQ ID NO: 1462584 - DNA, 14 bp, Homo sapiens
tgtgacaagaataa

SEQ ID NO: 1462585 - DNA, 15 bp, Homo sapiens
tgtgacaattctgtt

SEQ ID NO: 1462586 - DNA, 19 bp, Homo sapiens
tgtgacaattctgttttta

SEQ ID NO: 1462587 - DNA, 17 bp, Homo sapiens
tgtgacacatatgcacc

SEQ ID NO: 1462588 - DNA, 23 bp, Homo sapiens
tgtgacacctaactcttttctat

SEQ ID NO: 1462589 - DNA, 23 bp, Homo sapiens
tgtgacacctggtgcgggcctgg

SEQ ID NO: 1462590 - DNA, 16 bp, Homo sapiens
tgtgacagaatcttgt

SEQ ID NO: 1462591 - DNA, 22 bp, Homo sapiens
tgtgacagaatcttgtatttgg

SEQ ID NO: 1462592 - DNA, 18 bp, Homo sapiens
tgtgacagtttccaaatt

SEQ ID NO: 1462593 - DNA, 21 bp, Homo sapiens
tgtgacagtttccaaattgcc

SEQ ID NO: 1462594 - DNA, 12 bp, Homo sapiens
tgtgacatgccc

SEQ ID NO: 1462595 - DNA, 18 bp, Homo sapiens
tgtgacatggtgcctgag

SEQ ID NO: 1462596 - DNA, 22 bp, Homo sapiens
tgtgacatggtgcctgagaggc

SEQ ID NO: 1462597 - DNA, 14 bp, Homo sapiens
tgtgacatgtaaca

SEQ ID NO: 1462598 - DNA, 13 bp, Homo sapiens
tgtgaccaagtta

SEQ ID NO: 1462599 - DNA, 19 bp, Homo sapiens
tgtgaccaatacatttgta

SEQ ID NO: 1462600 - DNA, 16 bp, Homo sapiens
tgtgacccctttcact

SEQ ID NO: 1462601 - DNA, 17 bp, Homo sapiens
tgtgacccttgtcatct

SEQ ID NO: 1462602 - DNA, 18 bp, Homo sapiens
tgtgactaggaaaaaatt

SEQ ID NO: 1462603 - DNA, 18 bp, Homo sapiens
tgtgactataaagctgtt

SEQ ID NO: 1462604 - DNA, 21 bp, Homo sapiens
tgtgactcttactccttaggt

SEQ ID NO: 1462605 - DNA, 15 bp, Homo sapiens
tgtgactggatcttc

SEQ ID NO: 1462606 - DNA, 17 bp, Homo sapiens
tgtgacttaagaagcct

SEQ ID NO: 1462607 - DNA, 15 bp, Homo sapiens
tgtgacttcactgta

SEQ ID NO: 1462608 - DNA, 16 bp, Homo sapiens
tgtgacttcactgtat

SEQ ID NO: 1462609 - DNA, 14 bp, Homo sapiens
tgtgacttttgctt

SEQ ID NO: 1462610 - DNA, 16 bp, Homo sapiens
tgtgacttttgcttta

SEQ ID NO: 1462611 - DNA, 23 bp, Homo sapiens
tgtgacttttgctttaattccat

SEQ ID NO: 1462612 - DNA, 21 bp, Homo sapiens
tgtgagaaggtttattgttaa

SEQ ID NO: 1462613 - DNA, 22 bp, Homo sapiens
tgtgagaagtgaatgctgggac

SEQ ID NO: 1462614 - DNA, 24 bp, Homo sapiens
tgtgagaagtgaatgctgggactc

SEQ ID NO: 1462615 - DNA, 15 bp, Homo sapiens
tgtgagacccccaca

SEQ ID NO: 1462616 - DNA, 18 bp, Homo sapiens
tgtgagacccccacacct

SEQ ID NO: 1462617 - DNA, 14 bp, Homo sapiens
tgtgagagagactg

SEQ ID NO: 1462618 - DNA, 13 bp, Homo sapiens
tgtgagagcccat

SEQ ID NO: 1462619 - DNA, 14 bp, Homo sapiens
tgtgagcaagaagt

SEQ ID NO: 1462620 - DNA, 14 bp, Homo sapiens
tgtgagcagcctcc

SEQ ID NO: 1462621 - DNA, 18 bp, Homo sapiens
tgtgagcatcagagggct

SEQ ID NO: 1462622 - DNA, 16 bp, Homo sapiens
tgtgagccaccgctgc

SEQ ID NO: 1462623 - DNA, 16 bp, Homo sapiens
tgtgagctcttccctt

SEQ ID NO: 1462624 - DNA, 15 bp, Homo sapiens
tgtgagctcttccta

SEQ ID NO: 1462625 - DNA, 22 bp, Homo sapiens
tgtgagctggatagacttggga

SEQ ID NO: 1462626 - DNA, 17 bp, Homo sapiens
tgtgaggacctccctgt

SEQ ID NO: 1462627 - DNA, 22 bp, Homo sapiens
tgtgaggagagtctgaatattt

SEQ ID NO: 1462628 - DNA, 23 bp, Homo sapiens
tgtgaggattatgggtcctgcaa

SEQ ID NO: 1462629 - DNA, 18 bp, Homo sapiens
tgtgaggcaggggcggag

SEQ ID NO: 1462630 - DNA, 17 bp, Homo sapiens
tgtgaggcggcagctgg

SEQ ID NO: 1462631 - DNA, 14 bp, Homo sapiens
tgtgaggctgtcct

SEQ ID NO: 1462632 - DNA, 22 bp, Homo sapiens
tgtgagggaggggaaaagcatt

SEQ ID NO: 1462633 - DNA, 15 bp, Homo sapiens
tgtgagggtgctgac

SEQ ID NO: 1462634 - DNA, 14 bp, Homo sapiens
tgtcccatgaccca

SEQ ID NO: 1462635 - DNA, 21 bp, Homo sapiens
tgtcccatgacccacccctgt

SEQ ID NO: 1462636 - DNA, 16 bp, Homo sapiens
tgtcccatgatccctg

SEQ ID NO: 1462637 - DNA, 14 bp, Homo sapiens
tgtcccatggggaa

SEQ ID NO: 1462638 - DNA, 15 bp, Homo sapiens
tgtcccattctagat

SEQ ID NO: 1462639 - DNA, 17 bp, Homo sapiens
tgtcccattctagatcc

SEQ ID NO: 1462640 - DNA, 21 bp, Homo sapiens
tgtcccattctagatcctgca

SEQ ID NO: 1462641 - DNA, 13 bp, Homo sapiens
tgtcccatttcct

SEQ ID NO: 1462642 - DNA, 15 bp, Homo sapiens
tgtcccatttccttg

SEQ ID NO: 1462643 - DNA, 17 bp, Homo sapiens
tgtcccatttccttgga

SEQ ID NO: 1462644 - DNA, 18 bp, Homo sapiens
tgtcccatttccttggag

SEQ ID NO: 1462645 - DNA, 19 bp, Homo sapiens
tgtccccaacgtcccctcc

SEQ ID NO: 1462646 - DNA, 15 bp, Homo sapiens
tgtccccagggcccc

SEQ ID NO: 1462647 - DNA, 21 bp, Homo sapiens
tgtccccataagacaaacact

SEQ ID NO: 1462648 - DNA, 23 bp, Homo sapiens
tgtccccataagacaaacactgc

SEQ ID NO: 1462649 - DNA, 13 bp, Homo sapiens
tgtcccccaaggt

SEQ ID NO: 1462650 - DNA, 13 bp, Homo sapiens
tgtcccccagctc

SEQ ID NO: 1462651 - DNA, 13 bp, Homo sapiens
tgtcccctgagtt

SEQ ID NO: 1462652 - DNA, 18 bp, Homo sapiens
tgtcccctgccccagagg

SEQ ID NO: 1462653 - DNA, 20 bp, Homo sapiens
tgtcccctgccccagaggtc

SEQ ID NO: 1462654 - DNA, 13 bp, Homo sapiens
tgtcccctgtccc

SEQ ID NO: 1462655 - DNA, 14 bp, Homo sapiens
tgtcccctgtccca

SEQ ID NO: 1462656 - DNA, 22 bp, Homo sapiens
tgtccccttctctcatctctta

SEQ ID NO: 1462657 - DNA, 15 bp, Homo sapiens
tgtcccgccttcctc

SEQ ID NO: 1462658 - DNA, 23 bp, Homo sapiens
tgtcccgccttcctcctccacag

SEQ ID NO: 1462659 - DNA, 15 bp, Homo sapiens
tgtcccgcggtgctg

SEQ ID NO: 1462660 - DNA, 22 bp, Homo sapiens
tgtccctaccgagtctcttctc

SEQ ID NO: 1462661 - DNA, 21 bp, Homo sapiens
tgtccctcactgttgaatttt

SEQ ID NO: 1462662 - DNA, 15 bp, Homo sapiens
tgtccctccaggccc

SEQ ID NO: 1462663 - DNA, 16 bp, Homo sapiens
tgtccctctagtgcct

SEQ ID NO: 1462664 - DNA, 22 bp, Homo sapiens
tgtccctctcactccccagccc

SEQ ID NO: 1462665 - DNA, 17 bp, Homo sapiens
tgtccctctcagtgcct

SEQ ID NO: 1462666 - DNA, 19 bp, Homo sapiens
tgtccctctcagtgccttc

SEQ ID NO: 1462667 - DNA, 21 bp, Homo sapiens
tgtccctctcctatgtggcag

SEQ ID NO: 1462668 - DNA, 15 bp, Homo sapiens
tgtccctctgtggct

SEQ ID NO: 1462669 - DNA, 15 bp, Homo sapiens
tgtccctgaaaccta

SEQ ID NO: 1462670 - DNA, 13 bp, Homo sapiens
tgtccctgcaggg

SEQ ID NO: 1462671 - DNA, 16 bp, Homo sapiens
tgtccctgcagggcca

SEQ ID NO: 1462672 - DNA, 21 bp, Homo sapiens
tgtccctgcagggccatctga

SEQ ID NO: 1462673 - DNA, 18 bp, Homo sapiens
tgtccctggacacagctc

SEQ ID NO: 1462674 - DNA, 23 bp, Homo sapiens
tgtccctggacacagctcttcat

SEQ ID NO: 1462675 - DNA, 18 bp, Homo sapiens
tgtccctgtagctcagtc

SEQ ID NO: 1462676 - DNA, 13 bp, Homo sapiens
tgtccctgtcacc

SEQ ID NO: 1462677 - DNA, 13 bp, Homo sapiens
tgtccctgttaga

SEQ ID NO: 1462678 - DNA, 17 bp, Homo sapiens
tgtcccttcgagtccag

SEQ ID NO: 1462679 - DNA, 21 bp, Homo sapiens
tgtcccttcgagtccaggaca

SEQ ID NO: 1462680 - DNA, 15 bp, Homo sapiens
tgtccctttccctac

SEQ ID NO: 1462681 - DNA, 15 bp, Homo sapiens
tgtcccttttctttg

SEQ ID NO: 1462682 - DNA, 13 bp, Homo sapiens
tgtccgagaacta

SEQ ID NO: 1462683 - DNA, 19 bp, Homo sapiens
tgtccgggtgccagggctg

SEQ ID NO: 1462684 - DNA, 13 bp, Homo sapiens
tgtccgtccaccc

SEQ ID NO: 1462685 - DNA, 15 bp, Homo sapiens
tgtccgtccaccctt

SEQ ID NO: 1462686 - DNA, 23 bp, Homo sapiens
tgtccgtctctcttgcttgagga

SEQ ID NO: 1462687 - DNA, 20 bp, Homo sapiens
tgtcctaattcttctgtcct

SEQ ID NO: 1462688 - DNA, 16 bp, Homo sapiens
tgtcctaccactctaa

SEQ ID NO: 1462689 - DNA, 17 bp, Homo sapiens
tgcgccaccgcccagag

SEQ ID NO: 1462690 - DNA, 12 bp, Homo sapiens
tgcgccaggcag

SEQ ID NO: 1462691 - DNA, 14 bp, Homo sapiens
tgcgccaggcagag

SEQ ID NO: 1462692 - DNA, 16 bp, Homo sapiens
aaaactttcctcgcct

SEQ ID NO: 1462693 - DNA, 16 bp, Homo sapiens
aaaactttggaaccag

SEQ ID NO: 1462694 - DNA, 19 bp, Homo sapiens
aaaactttggcaacatctt

SEQ ID NO: 1462695 - DNA, 19 bp, Homo sapiens
aaaactttggtgcattgtt

SEQ ID NO: 1462696 - DNA, 13 bp, Homo sapiens
aaaacttttctca

SEQ ID NO: 1462697 - DNA, 14 bp, Homo sapiens
aaaagaaaattgat

SEQ ID NO: 1462698 - DNA, 14 bp, Homo sapiens
aaaagaaatatatt

SEQ ID NO: 1462699 - DNA, 19 bp, Homo sapiens
aaaagaaatcatgtccata

SEQ ID NO: 1462700 - DNA, 16 bp, Homo sapiens
aaaagaacagtaaaca

SEQ ID NO: 1462701 - DNA, 13 bp, Homo sapiens
aaaagaataagac

SEQ ID NO: 1462702 - DNA, 16 bp, Homo sapiens
aaaagaatacagaaag

SEQ ID NO: 1462703 - DNA, 14 bp, Homo sapiens
aaaagaccaagact

SEQ ID NO: 1462704 - DNA, 16 bp, Homo sapiens
aaaagaccaagacttt

SEQ ID NO: 1462705 - DNA, 19 bp, Homo sapiens
aaaagaccctgagactcca

SEQ ID NO: 1462706 - DNA, 17 bp, Homo sapiens
aaaagactgaacatgtt

SEQ ID NO: 1462707 - DNA, 14 bp, Homo sapiens
aaaagagatttcaa

SEQ ID NO: 1462708 - DNA, 18 bp, Homo sapiens
aaaagagcatatactggt

SEQ ID NO: 1462709 - DNA, 12 bp, Homo sapiens
aaaagataaaga

SEQ ID NO: 1462710 - DNA, 13 bp, Homo sapiens
aaaagataaagat

SEQ ID NO: 1462711 - DNA, 14 bp, Homo sapiens
aaaagataaagatg

SEQ ID NO: 1462712 - DNA, 20 bp, Homo sapiens
aaaagataaagatgatctac

SEQ ID NO: 1462713 - DNA, 14 bp, Homo sapiens
aaaagatcattaaa

SEQ ID NO: 1462714 - DNA, 13 bp, Homo sapiens
aaaagatcgcagt

SEQ ID NO: 1462715 - DNA, 19 bp, Homo sapiens
aaaagatgggaaactgctt

SEQ ID NO: 1462716 - DNA, 11 bp, Homo sapiens
aaaagattcat

SEQ ID NO: 1462717 - DNA, 16 bp, Homo sapiens
aaaagattctgtgtca

SEQ ID NO: 1462718 - DNA, 21 bp, Homo sapiens
aaaagattgctgaaattttat

SEQ ID NO: 1462719 - DNA, 14 bp, Homo sapiens
aaaagatttacatt

SEQ ID NO: 1462720 - DNA, 16 bp, Homo sapiens
aaaagcaaaaagcaag

SEQ ID NO: 1462721 - DNA, 14 bp, Homo sapiens
aaaagcaacttcat

SEQ ID NO: 1462722 - DNA, 14 bp, Homo sapiens
aaaagcaagactgt

SEQ ID NO: 1462723 - DNA, 18 bp, Homo sapiens
aaaagcaattctgactgt

SEQ ID NO: 1462724 - DNA, 17 bp, Homo sapiens
aaaagcacaagtacttt

SEQ ID NO: 1462725 - DNA, 22 bp, Homo sapiens
aaaagcagaattttaatgtgaa

SEQ ID NO: 1462726 - DNA, 19 bp, Homo sapiens
aaaagcagtaaatttgcta

SEQ ID NO: 1462727 - DNA, 17 bp, Homo sapiens
aaaagcatgatgggaaa

SEQ ID NO: 1462728 - DNA, 19 bp, Homo sapiens
aaaagcatgatgggaaaat

SEQ ID NO: 1462729 - DNA, 20 bp, Homo sapiens
aaaagcattgtccaaaatcc

SEQ ID NO: 1462730 - DNA, 15 bp, Homo sapiens
aaaagcatttgggca

SEQ ID NO: 1462731 - DNA, 16 bp, Homo sapiens
aaaagccaaaggtcaa

SEQ ID NO: 1462732 - DNA, 18 bp, Homo sapiens
aaaagcctccttgtgcaa

SEQ ID NO: 1462733 - DNA, 11 bp, Homo sapiens
aaaagcctgct

SEQ ID NO: 1462734 - DNA, 21 bp, Homo sapiens
aaaagcgggtaaaaaacctgg

SEQ ID NO: 1462735 - DNA, 20 bp, Homo sapiens
aaaagctacagttttgtgaa

SEQ ID NO: 1462736 - DNA, 14 bp, Homo sapiens
aaaaggaaagaaaa

SEQ ID NO: 1462737 - DNA, 23 bp, Homo sapiens
aaaaggaaatattctttctcata

SEQ ID NO: 1462738 - DNA, 17 bp, Homo sapiens
aaaaggaaatttgtttg

SEQ ID NO: 1462739 - DNA, 14 bp, Homo sapiens
aaaaggaagactag

SEQ ID NO: 1462740 - DNA, 17 bp, Homo sapiens
aaaaggaatgatatatt

SEQ ID NO: 1462741 - DNA, 16 bp, Homo sapiens
aaaaggacaatttcaa

SEQ ID NO: 1462742 - DNA, 16 bp, Homo sapiens
aaaaggacacctttta

SEQ ID NO: 1462743 - DNA, 18 bp, Homo sapiens
aaaaggacttcaggaaca

SEQ ID NO: 1462744 - DNA, 11 bp, Homo sapiens
aaaaggagaga

SEQ ID NO: 1462745 - DNA, 21 bp, Homo sapiens
aaaaggatgtataaattttta

SEQ ID NO: 1462746 - DNA, 13 bp, Homo sapiens
aaaaggatttaag

SEQ ID NO: 1462747 - DNA, 16 bp, Homo sapiens
aaaaggcaaatattga

SEQ ID NO: 1462748 - DNA, 17 bp, Homo sapiens
aaaaggcaaatattgaa

SEQ ID NO: 1462749 - DNA, 23 bp, Homo sapiens
aaaaggcaaatattgaagttgtt

SEQ ID NO: 1462750 - DNA, 14 bp, Homo sapiens
aaaaggcattgttt

SEQ ID NO: 1462751 - DNA, 15 bp, Homo sapiens
aaaaggcgcatctaa

SEQ ID NO: 1462752 - DNA, 14 bp, Homo sapiens
aaaagggagttttt

SEQ ID NO: 1462753 - DNA, 22 bp, Homo sapiens
aaaagggcggaagagttacaat

SEQ ID NO: 1462754 - DNA, 11 bp, Homo sapiens
aaaaggggccc

SEQ ID NO: 1462755 - DNA, 22 bp, Homo sapiens
aaaagggtgtatagtgttcaca

SEQ ID NO: 1462756 - DNA, 20 bp, Homo sapiens
aaaaggtgcctgtgaggcag

SEQ ID NO: 1462757 - DNA, 14 bp, Homo sapiens
aaaaggtgtccttt

SEQ ID NO: 1462758 - DNA, 19 bp, Homo sapiens
aaaaggttcactaaagcag

SEQ ID NO: 1462759 - DNA, 13 bp, Homo sapiens
aaaaggttgaata

SEQ ID NO: 1462760 - DNA, 14 bp, Homo sapiens
aaaaggttgccaaa

SEQ ID NO: 1462761 - DNA, 11 bp, Homo sapiens
aaaagtaaaca

SEQ ID NO: 1462762 - DNA, 15 bp, Homo sapiens
aaaagtaaatgtaca

SEQ ID NO: 1462763 - DNA, 12 bp, Homo sapiens
aaaagtaacttg

SEQ ID NO: 1462764 - DNA, 22 bp, Homo sapiens
aaaagtaatctttaaactggct

SEQ ID NO: 1462765 - DNA, 20 bp, Homo sapiens
aaaagtacaatgaactgctt

SEQ ID NO: 1462766 - DNA, 21 bp, Homo sapiens
aaaagtacatttaatacagca

SEQ ID NO: 1462767 - DNA, 20 bp, Homo sapiens
aaaagtagagaaatggattc

SEQ ID NO: 1462768 - DNA, 17 bp, Homo sapiens
aaaagtatattaaacaa

SEQ ID NO: 1462769 - DNA, 15 bp, Homo sapiens
aaaagtcaaaaggtg

SEQ ID NO: 1462770 - DNA, 19 bp, Homo sapiens
aaaagtgaagtgaatctga

SEQ ID NO: 1462771 - DNA, 23 bp, Homo sapiens
aaaagtgaagtgaatctgattgc

SEQ ID NO: 1462772 - DNA, 16 bp, Homo sapiens
aaaagtgagagacctc

SEQ ID NO: 1462773 - DNA, 21 bp, Homo sapiens
aaaagtgatcaataaaatgtg

SEQ ID NO: 1462774 - DNA, 23 bp, Homo sapiens
aaaagtgatcaataaaatgtgat

SEQ ID NO: 1462775 - DNA, 23 bp, Homo sapiens
aaaagtgggttttttagttgaat

SEQ ID NO: 1462776 - DNA, 19 bp, Homo sapiens
aaaagtgtgtatatatttt

SEQ ID NO: 1462777 - DNA, 20 bp, Homo sapiens
aaaagtgtgtatatattttg

SEQ ID NO: 1462778 - DNA, 21 bp, Homo sapiens
aaaagtgtgtatatattttgt

SEQ ID NO: 1462779 - DNA, 15 bp, Homo sapiens
aaaagttattaaaat

SEQ ID NO: 1462780 - DNA, 13 bp, Homo sapiens
aaaagttccaaga

SEQ ID NO: 1462781 - DNA, 19 bp, Homo sapiens
aaaagttgaaaagccaaag

SEQ ID NO: 1462782 - DNA, 12 bp, Homo sapiens
aaaagttgaaat

SEQ ID NO: 1462783 - DNA, 19 bp, Homo sapiens
aaaagttgaaatgtgtaat

SEQ ID NO: 1462784 - DNA, 20 bp, Homo sapiens
aaaagttggaaggatctgct

SEQ ID NO: 1462785 - DNA, 17 bp, Homo sapiens
aaaagtttgaggaatat

SEQ ID NO: 1462786 - DNA, 16 bp, Homo sapiens
aaaagtttgccagaag

SEQ ID NO: 1462787 - DNA, 17 bp, Homo sapiens
aaaagttttatttttct

SEQ ID NO: 1462788 - DNA, 19 bp, Homo sapiens
aaaagtttttaatttgatg

SEQ ID NO: 1462789 - DNA, 20 bp, Homo sapiens
aaaagttttttattatgcat

SEQ ID NO: 1462790 - DNA, 16 bp, Homo sapiens
aaaataaaaaagatcc

SEQ ID NO: 1462791 - DNA, 22 bp, Homo sapiens
aaaataaaaagtgacacagcag

SEQ ID NO: 1462792 - DNA, 18 bp, Homo sapiens
aaaataaaaataaattca

SEQ ID NO: 1462793 - DNA, 13 bp, Homo sapiens
aaaataaaacaca

SEQ ID NO: 1462794 - DNA, 23 bp, Homo sapiens
aaaataaaacatcacctatttaa

SEQ ID NO: 1462795 - DNA, 13 bp, Homo sapiens
aaaataaaactaa

SEQ ID NO: 1462796 - DNA, 15 bp, Homo sapiens
aaaataaaatattca

SEQ ID NO: 1462797 - DNA, 16 bp, Homo sapiens
aaaataaaatattcac

SEQ ID NO: 1462798 - DNA, 18 bp, Homo sapiens
aaaataaaatgcatttaa

SEQ ID NO: 1462799 - DNA, 12 bp, Homo sapiens
aaaataaaatgt

SEQ ID NO: 1462800 - DNA, 22 bp, Homo sapiens
aaaataaacagacaaaaacaag

SEQ ID NO: 1462801 - DNA, 12 bp, Homo sapiens
aaaataaacatc

SEQ ID NO: 1462802 - DNA, 14 bp, Homo sapiens
aaaataaagaagta

SEQ ID NO: 1462803 - DNA, 13 bp, Homo sapiens
aaaataaagttgg

SEQ ID NO: 1462804 - DNA, 12 bp, Homo sapiens
aaaataaattat

SEQ ID NO: 1462805 - DNA, 22 bp, Homo sapiens
aaaataaattttaaaaaggaat

SEQ ID NO: 1462806 - DNA, 22 bp, Homo sapiens
aaaataacaactaacttgtttg

SEQ ID NO: 1462807 - DNA, 19 bp, Homo sapiens
aaaataacatctgaaaaga

SEQ ID NO: 1462808 - DNA, 16 bp, Homo sapiens
aaacacagttacactt

SEQ ID NO: 1462809 - DNA, 18 bp, Homo sapiens
aaacaccaaagaattgta

SEQ ID NO: 1462810 - DNA, 19 bp, Homo sapiens
aaacaccaacatgttggga

SEQ ID NO: 1462811 - DNA, 15 bp, Homo sapiens
aaacaccatggagat

SEQ ID NO: 1462812 - DNA, 20 bp, Homo sapiens
aaacacccctctgtctagga

SEQ ID NO: 1462813 - DNA, 23 bp, Homo sapiens
aaacacgccttgttcctgctctt

SEQ ID NO: 1462814 - DNA, 19 bp, Homo sapiens
aaacactacacatttgaaa

SEQ ID NO: 1462815 - DNA, 21 bp, Homo sapiens
aaacactacacatttgaaaca

SEQ ID NO: 1462816 - DNA, 24 bp, Homo sapiens
aaacactcagttgttcaataataa

SEQ ID NO: 1462817 - DNA, 19 bp, Homo sapiens
aaacactgcagtttcctgg

SEQ ID NO: 1462818 - DNA, 22 bp, Homo sapiens
aaacactgcagtttcctggaaa

SEQ ID NO: 1462819 - DNA, 13 bp, Homo sapiens
aaacactgccata

SEQ ID NO: 1462820 - DNA, 21 bp, Homo sapiens
aaacactgccatattgtgtaa

SEQ ID NO: 1462821 - DNA, 23 bp, Homo sapiens
aaacactgccatattgtgtaatt

SEQ ID NO: 1462822 - DNA, 13 bp, Homo sapiens
aaacactgccatc

SEQ ID NO: 1462823 - DNA, 23 bp, Homo sapiens
aaacactgtaatcttaaaagtgt

SEQ ID NO: 1462824 - DNA, 19 bp, Homo sapiens
aaacacttatcttctggat

SEQ ID NO: 1462825 - DNA, 21 bp, Homo sapiens
aaacacttctcatcatattgt

SEQ ID NO: 1462826 - DNA, 16 bp, Homo sapiens
aaacacttgtgacttt

SEQ ID NO: 1462827 - DNA, 22 bp, Homo sapiens
aaacagaaacgagatttgccaa

SEQ ID NO: 1462828 - DNA, 16 bp, Homo sapiens
aaacagaatcttctgg

SEQ ID NO: 1462829 - DNA, 21 bp, Homo sapiens
aaacagagtggcctccctgct

SEQ ID NO: 1462830 - DNA, 22 bp, Homo sapiens
aaacagagtggcctccctgctg

SEQ ID NO: 1462831 - DNA, 22 bp, Homo sapiens
aaacagatattacagcttattt

SEQ ID NO: 1462832 - DNA, 15 bp, Homo sapiens
aaacagatttttaca

SEQ ID NO: 1462833 - DNA, 12 bp, Homo sapiens
aaacagcacacc

SEQ ID NO: 1462834 - DNA, 16 bp, Homo sapiens
aaacagcacacctgtg

SEQ ID NO: 1462835 - DNA, 14 bp, Homo sapiens
aaacagcattgctt

SEQ ID NO: 1462836 - DNA, 14 bp, Homo sapiens
aaacagccagcaag

SEQ ID NO: 1462837 - DNA, 23 bp, Homo sapiens
aaacagccgtcagccaaatgtaa

SEQ ID NO: 1462838 - DNA, 18 bp, Homo sapiens
aaacagcttcatgccttt

SEQ ID NO: 1462839 - DNA, 22 bp, Homo sapiens
aaacagcttcatgcctttgtaa

SEQ ID NO: 1462840 - DNA, 14 bp, Homo sapiens
aaacagctttcaag

SEQ ID NO: 1462841 - DNA, 11 bp, Homo sapiens
aaacaggacca

SEQ ID NO: 1462842 - DNA, 19 bp, Homo sapiens
aaacaggcaaagttttaca

SEQ ID NO: 1462843 - DNA, 21 bp, Homo sapiens
aaacaggcaaagttttacaga

SEQ ID NO: 1462844 - DNA, 23 bp, Homo sapiens
aaacaggcaaagttttacagaga

SEQ ID NO: 1462845 - DNA, 15 bp, Homo sapiens
aaacaggcccagcat

SEQ ID NO: 1462846 - DNA, 15 bp, Homo sapiens
aaacagggtctggga

SEQ ID NO: 1462847 - DNA, 21 bp, Homo sapiens
aaacaggtatatactttgaaa

SEQ ID NO: 1462848 - DNA, 21 bp, Homo sapiens
aaacaggtatttttttaaatc

SEQ ID NO: 1462849 - DNA, 23 bp, Homo sapiens
aaacaggtatttttttaaatcaa

SEQ ID NO: 1462850 - DNA, 13 bp, Homo sapiens
aaacagtacagaa

SEQ ID NO: 1462851 - DNA, 19 bp, Homo sapiens
aaacagtatattctttggt

SEQ ID NO: 1462852 - DNA, 16 bp, Homo sapiens
aaacagttctcactgg

SEQ ID NO: 1462853 - DNA, 18 bp, Homo sapiens
aaacagttgcatgtagta

SEQ ID NO: 1462854 - DNA, 24 bp, Homo sapiens
aaacagttgcatgtagtaacacta

SEQ ID NO: 1462855 - DNA, 22 bp, Homo sapiens
aaacagttgctgtgaactttca

SEQ ID NO: 1462856 - DNA, 23 bp, Homo sapiens
aaacagttgctgtgaactttcat

SEQ ID NO: 1462857 - DNA, 20 bp, Homo sapiens
aaacataaaaagcagaattt

SEQ ID NO: 1462858 - DNA, 16 bp, Homo sapiens
aaacataattgtggat

SEQ ID NO: 1462859 - DNA, 20 bp, Homo sapiens
aaacataattgtggattata

SEQ ID NO: 1462860 - DNA, 20 bp, Homo sapiens
aaacatacagaggatgcctt

SEQ ID NO: 1462861 - DNA, 16 bp, Homo sapiens
aaacatacgtgtgcat

SEQ ID NO: 1462862 - DNA, 22 bp, Homo sapiens
aaacatcacacacacagacaga

SEQ ID NO: 1462863 - DNA, 16 bp, Homo sapiens
aaacatcactccctct

SEQ ID NO: 1462864 - DNA, 16 bp, Homo sapiens
aaacatcagacctgtc

SEQ ID NO: 1462865 - DNA, 14 bp, Homo sapiens
aaacatcagctgaa

SEQ ID NO: 1462866 - DNA, 22 bp, Homo sapiens
aaacatcagttactctgaaggg

SEQ ID NO: 1462867 - DNA, 14 bp, Homo sapiens
aaacatcagtttct

SEQ ID NO: 1462868 - DNA, 20 bp, Homo sapiens
aaacatcctagggtgtttta

SEQ ID NO: 1462869 - DNA, 18 bp, Homo sapiens
aaacatccttcaagaact

SEQ ID NO: 1462870 - DNA, 15 bp, Homo sapiens
aaacatctattctct

SEQ ID NO: 1462871 - DNA, 16 bp, Homo sapiens
aaacatcttttcctga

SEQ ID NO: 1462872 - DNA, 13 bp, Homo sapiens
aaacatgacactg

SEQ ID NO: 1462873 - DNA, 15 bp, Homo sapiens
aaacatgacactgac

SEQ ID NO: 1462874 - DNA, 14 bp, Homo sapiens
aaacatgcacattt

SEQ ID NO: 1462875 - DNA, 20 bp, Homo sapiens
aaacatgcacattttgtaca

SEQ ID NO: 1462876 - DNA, 24 bp, Homo sapiens
aaacatgctaaatagttctatcag

SEQ ID NO: 1462877 - DNA, 16 bp, Homo sapiens
aaacatggtgcctata

SEQ ID NO: 1462878 - DNA, 23 bp, Homo sapiens
aaacatggtgcctatatctgaga

SEQ ID NO: 1462879 - DNA, 15 bp, Homo sapiens
aaacatgtactacag

SEQ ID NO: 1462880 - DNA, 13 bp, Homo sapiens
aaacatgtatgtg

SEQ ID NO: 1462881 - DNA, 18 bp, Homo sapiens
aaacattaaacactgtaa

SEQ ID NO: 1462882 - DNA, 22 bp, Homo sapiens
aaacattaatagcagcctttct

SEQ ID NO: 1462883 - DNA, 16 bp, Homo sapiens
aaacattaattttgtg

SEQ ID NO: 1462884 - DNA, 17 bp, Homo sapiens
aaacattcgtgagctgg

SEQ ID NO: 1462885 - DNA, 18 bp, Homo sapiens
aaacatttacaataaata

SEQ ID NO: 1462886 - DNA, 23 bp, Homo sapiens
aaacatttacaataaatattctg

SEQ ID NO: 1462887 - DNA, 15 bp, Homo sapiens
aaacatttgccaagt

SEQ ID NO: 1462888 - DNA, 17 bp, Homo sapiens
aaacatttgttcctgga

SEQ ID NO: 1462889 - DNA, 17 bp, Homo sapiens
aaacatttgtttccccc

SEQ ID NO: 1462890 - DNA, 12 bp, Homo sapiens
aaacattttctg

SEQ ID NO: 1462891 - DNA, 17 bp, Homo sapiens
aaacattttgaaggaaa

SEQ ID NO: 1462892 - DNA, 19 bp, Homo sapiens
aaacattttgtcatataag

SEQ ID NO: 1462893 - DNA, 15 bp, Homo sapiens
aaacattttttaaga

SEQ ID NO: 1462894 - DNA, 20 bp, Homo sapiens
aaacattttttagtctgtaa

SEQ ID NO: 1462895 - DNA, 17 bp, Homo sapiens
aaacattttttcttctg

SEQ ID NO: 1462896 - DNA, 11 bp, Homo sapiens
aaaccaaaaca

SEQ ID NO: 1462897 - DNA, 15 bp, Homo sapiens
aaaccaaccctgtgg

SEQ ID NO: 1462898 - DNA, 22 bp, Homo sapiens
aaaccaacctaatatattgtat

SEQ ID NO: 1462899 - DNA, 15 bp, Homo sapiens
aaaccaagcaaagga

SEQ ID NO: 1462900 - DNA, 14 bp, Homo sapiens
aaaccaatgaagaa

SEQ ID NO: 1462901 - DNA, 18 bp, Homo sapiens
aaaccaatgaagaagaca

SEQ ID NO: 1462902 - DNA, 22 bp, Homo sapiens
aaaccacaactgacacaggaaa

SEQ ID NO: 1462903 - DNA, 12 bp, Homo sapiens
aaaccacacaaa

SEQ ID NO: 1462904 - DNA, 12 bp, Homo sapiens
aaaccacagcag

SEQ ID NO: 1462905 - DNA, 15 bp, Homo sapiens
aaaccacagcagttg

SEQ ID NO: 1462906 - DNA, 12 bp, Homo sapiens
aaaccacagctg

SEQ ID NO: 1462907 - DNA, 20 bp, Homo sapiens
aaaccacagctgggcagggt

SEQ ID NO: 1462908 - DNA, 12 bp, Homo sapiens
aaaccactgaaa

SEQ ID NO: 1462909 - DNA, 22 bp, Homo sapiens
aaaccacttaaacgaagagttc

SEQ ID NO: 1462910 - DNA, 13 bp, Homo sapiens
aaaccacttctcc

SEQ ID NO: 1462911 - DNA, 23 bp, Homo sapiens
aaaccaggacactaccctgagat

SEQ ID NO: 1462912 - DNA, 17 bp, Homo sapiens
aaaccatgagaatttgc

SEQ ID NO: 1462913 - DNA, 19 bp, Homo sapiens
aaaccatttcagccaaact

SEQ ID NO: 1462914 - DNA, 13 bp, Homo sapiens
aaaccatttttgc

SEQ ID NO: 1462915 - DNA, 16 bp, Homo sapiens
aaacccacctctctgg

SEQ ID NO: 1462916 - DNA, 23 bp, Homo sapiens
aaacccaccttgttggagcctgc

SEQ ID NO: 1462917 - DNA, 13 bp, Homo sapiens
aaaccccatctct

SEQ ID NO: 1462918 - DNA, 13 bp, Homo sapiens
aaacccccatctc

SEQ ID NO: 1462919 - DNA, 19 bp, Homo sapiens
aaaccctcacaacccctga

SEQ ID NO: 1462920 - DNA, 18 bp, Homo sapiens
aaaccctcattgtgtttc

SEQ ID NO: 1462921 - DNA, 21 bp, Homo sapiens
aaaccctcccagaaacatctc

SEQ ID NO: 1462922 - DNA, 15 bp, Homo sapiens
aaaccctgctgaaca

SEQ ID NO: 1462923 - DNA, 14 bp, Homo sapiens
aaaccctgcttctg

SEQ ID NO: 1462924 - DNA, 16 bp, Homo sapiens
aaaccctggagccatc

SEQ ID NO: 1462925 - DNA, 12 bp, Homo sapiens
aaaccctgtctc

SEQ ID NO: 1462926 - DNA, 22 bp, Homo sapiens
aaacccttcagtgctacatttt

SEQ ID NO: 1462927 - DNA, 17 bp, Homo sapiens
aaaccgcaaacgtgaaa

SEQ ID NO: 1462928 - DNA, 16 bp, Homo sapiens
aaaccgcctagtttac

SEQ ID NO: 1462929 - DNA, 12 bp, Homo sapiens
aaacctcaccct

SEQ ID NO: 1462930 - DNA, 21 bp, Homo sapiens
aaacctcatgacagccagagc

SEQ ID NO: 1462931 - DNA, 22 bp, Homo sapiens
aaacctcatgacagccagagcc

SEQ ID NO: 1462932 - DNA, 18 bp, Homo sapiens
aaacctccagcctccctg

SEQ ID NO: 1462933 - DNA, 17 bp, Homo sapiens
aaacctctcctgacccc

SEQ ID NO: 1462934 - DNA, 18 bp, Homo sapiens
aaacctctcctgacccct

SEQ ID NO: 1462935 - DNA, 18 bp, Homo sapiens
aaacctgacccctgctca

SEQ ID NO: 1462936 - DNA, 13 bp, Homo sapiens
aaacctgaggcag

SEQ ID NO: 1462937 - DNA, 22 bp, Homo sapiens
aaacctgcagttaacaggatat

SEQ ID NO: 1462938 - DNA, 14 bp, Homo sapiens
aaacctgccctgcc

SEQ ID NO: 1462939 - DNA, 13 bp, Homo sapiens
aaacctgcttcct

SEQ ID NO: 1462940 - DNA, 15 bp, Homo sapiens
aaacctgcttccttc

SEQ ID NO: 1462941 - DNA, 21 bp, Homo sapiens
aaacctgggattcaggaatgt

SEQ ID NO: 1462942 - DNA, 22 bp, Homo sapiens
aaacctgtattactgaataata

SEQ ID NO: 1462943 - DNA, 13 bp, Homo sapiens
aaaccttagtttc

SEQ ID NO: 1462944 - DNA, 17 bp, Homo sapiens
aaaccttattgtacctc

SEQ ID NO: 1462945 - DNA, 12 bp, Homo sapiens
aaaccttccttc

SEQ ID NO: 1462946 - DNA, 14 bp, Homo sapiens
aaaccttccttccc

SEQ ID NO: 1462947 - DNA, 15 bp, Homo sapiens
aaaccttccttccct

SEQ ID NO: 1462948 - DNA, 16 bp, Homo sapiens
aaaccttccttccctg

SEQ ID NO: 1462949 - DNA, 14 bp, Homo sapiens
aaaccttctgcctt

SEQ ID NO: 1462950 - DNA, 16 bp, Homo sapiens
aaaccttggcataaga

SEQ ID NO: 1462951 - DNA, 16 bp, Homo sapiens
aaacctttagggcagc

SEQ ID NO: 1462952 - DNA, 18 bp, Homo sapiens
aaaccttttatttttatt

SEQ ID NO: 1462953 - DNA, 15 bp, Homo sapiens
aaacgaaggcataat

SEQ ID NO: 1462954 - DNA, 19 bp, Homo sapiens
aaacgagggctgatggagg

SEQ ID NO: 1462955 - DNA, 19 bp, Homo sapiens
aaacgagtcaatcccctca

SEQ ID NO: 1462956 - DNA, 21 bp, Homo sapiens
aaacgatgtgcaatacatttt

SEQ ID NO: 1462957 - DNA, 22 bp, Homo sapiens
aaacgatgtgcaatacattttt

SEQ ID NO: 1462958 - DNA, 16 bp, Homo sapiens
aaacgctacctctctg

SEQ ID NO: 1462959 - DNA, 23 bp, Homo sapiens
aaacggattagggcatttgagaa

SEQ ID NO: 1462960 - DNA, 17 bp, Homo sapiens
aaacgggaacatgcccc

SEQ ID NO: 1462961 - DNA, 16 bp, Homo sapiens
aaacgtcccacacttt

SEQ ID NO: 1462962 - DNA, 18 bp, Homo sapiens
aaacgtcccacactttga

SEQ ID NO: 1462963 - DNA, 21 bp, Homo sapiens
aaacgtcccacactttgaagc

SEQ ID NO: 1462964 - DNA, 23 bp, Homo sapiens
aaacgtcctctttagtttttggt

SEQ ID NO: 1462965 - DNA, 18 bp, Homo sapiens
aaacgtcttattgtggta

SEQ ID NO: 1462966 - DNA, 21 bp, Homo sapiens
aaacgtggtcaccttcgagta

SEQ ID NO: 1462967 - DNA, 16 bp, Homo sapiens
aaacgtggttacatta

SEQ ID NO: 1462968 - DNA, 17 bp, Homo sapiens
aaactaaaaaaaaaaag

SEQ ID NO: 1462969 - DNA, 16 bp, Homo sapiens
aaactaaaattcaaca

SEQ ID NO: 1462970 - DNA, 22 bp, Homo sapiens
aaactaaaattcaacaaatgat

SEQ ID NO: 1462971 - DNA, 15 bp, Homo sapiens
aaactaacagataag

SEQ ID NO: 1462972 - DNA, 21 bp, Homo sapiens
aaactaaccagcattccctac

SEQ ID NO: 1462973 - DNA, 15 bp, Homo sapiens
aaactaagagaaact

SEQ ID NO: 1462974 - DNA, 18 bp, Homo sapiens
aaactaagagaaactgtg

SEQ ID NO: 1462975 - DNA, 19 bp, Homo sapiens
aaactaagagaaactgtgt

SEQ ID NO: 1462976 - DNA, 14 bp, Homo sapiens
aaactaagctcttt

SEQ ID NO: 1462977 - DNA, 17 bp, Homo sapiens
aaactaaggatttttca

SEQ ID NO: 1462978 - DNA, 11 bp, Homo sapiens
aaactaatcca

SEQ ID NO: 1462979 - DNA, 13 bp, Homo sapiens
aaactaatcttaa

SEQ ID NO: 1462980 - DNA, 23 bp, Homo sapiens
aaactaatcttaaccctgtgctg

SEQ ID NO: 1462981 - DNA, 13 bp, Homo sapiens
aaactaattgttt

SEQ ID NO: 1462982 - DNA, 17 bp, Homo sapiens
aaactacagaataatgt

SEQ ID NO: 1462983 - DNA, 15 bp, Homo sapiens
aaactacagatcttt

SEQ ID NO: 1462984 - DNA, 21 bp, Homo sapiens
aaactactgaatgaagcagta

SEQ ID NO: 1462985 - DNA, 17 bp, Homo sapiens
aaactaggcaatgtact

SEQ ID NO: 1462986 - DNA, 14 bp, Homo sapiens
aaactagtttccag

SEQ ID NO: 1462987 - DNA, 15 bp, Homo sapiens
aaactagtttccagt

SEQ ID NO: 1462988 - DNA, 16 bp, Homo sapiens
aaactagtttccagtg

SEQ ID NO: 1462989 - DNA, 13 bp, Homo sapiens
aaactataaactt

SEQ ID NO: 1462990 - DNA, 15 bp, Homo sapiens
aaactataaacttaa

SEQ ID NO: 1462991 - DNA, 20 bp, Homo sapiens
aaactatcaactacaaatta

SEQ ID NO: 1462992 - DNA, 16 bp, Homo sapiens
aaactatcttggtgaa

SEQ ID NO: 1462993 - DNA, 18 bp, Homo sapiens
aaactatggttcccaata

SEQ ID NO: 1462994 - DNA, 21 bp, Homo sapiens
aaactatggttcccaataaaa

SEQ ID NO: 1462995 - DNA, 22 bp, Homo sapiens
aaactattagagtatttccctt

SEQ ID NO: 1462996 - DNA, 20 bp, Homo sapiens
aaactattggaaagtactcc

SEQ ID NO: 1462997 - DNA, 11 bp, Homo sapiens
aaactatttat

SEQ ID NO: 1462998 - DNA, 19 bp, Homo sapiens
aaactatttatatcacaca

SEQ ID NO: 1462999 - DNA, 21 bp, Homo sapiens
aaactcaaaatatttgtacat

SEQ ID NO: 1463000 - DNA, 17 bp, Homo sapiens
aaactcaaccagagtca

SEQ ID NO: 1463001 - DNA, 16 bp, Homo sapiens
aaactcaccatgtaaa

SEQ ID NO: 1463002 - DNA, 20 bp, Homo sapiens
aaactcactgctcaagaaga

SEQ ID NO: 1463003 - DNA, 23 bp, Homo sapiens
aaactcaggatggtcatcttgga

SEQ ID NO: 1463004 - DNA, 15 bp, Homo sapiens
aaactcatttataaa

SEQ ID NO: 1463005 - DNA, 14 bp, Homo sapiens
aaactcatttatct

SEQ ID NO: 1463006 - DNA, 17 bp, Homo sapiens
aaactccacatctgcct

SEQ ID NO: 1463007 - DNA, 19 bp, Homo sapiens
aaactccgtcttagaagtg

SEQ ID NO: 1463008 - DNA, 17 bp, Homo sapiens
aaactctctcccaggac

SEQ ID NO: 1463009 - DNA, 16 bp, Homo sapiens
aaactctgaaggagag

SEQ ID NO: 1463010 - DNA, 18 bp, Homo sapiens
aaactctgaatttatctt

SEQ ID NO: 1463011 - DNA, 19 bp, Homo sapiens
aaactcttcagttaattct

SEQ ID NO: 1463012 - DNA, 20 bp, Homo sapiens
aaactcttttttaaaaatta

SEQ ID NO: 1463013 - DNA, 20 bp, Homo sapiens
aaactgaaagcacatgaata

SEQ ID NO: 1463014 - DNA, 21 bp, Homo sapiens
aaactgaagcagcctctcccc

SEQ ID NO: 1463015 - DNA, 16 bp, Homo sapiens
aaactgaaggtcaata

SEQ ID NO: 1463016 - DNA, 14 bp, Homo sapiens
aaactgaatttgtt

SEQ ID NO: 1463017 - DNA, 15 bp, Homo sapiens
aaactgaatttgttc

SEQ ID NO: 1463018 - DNA, 20 bp, Homo sapiens
aaactgactttttcccccca

SEQ ID NO: 1463019 - DNA, 22 bp, Homo sapiens
aaactgagcctcacttgccctc

SEQ ID NO: 1463020 - DNA, 19 bp, Homo sapiens
aaactgaggaattttcttt

SEQ ID NO: 1463021 - DNA, 16 bp, Homo sapiens
aaactgatcaaaaata

SEQ ID NO: 1463022 - DNA, 18 bp, Homo sapiens
aaactgatcaaaaataaa

SEQ ID NO: 1463023 - DNA, 21 bp, Homo sapiens
aaactgatcaaaaataaacta

SEQ ID NO: 1463024 - DNA, 21 bp, Homo sapiens
aaactgatggaccgggtgggc

SEQ ID NO: 1463025 - DNA, 12 bp, Homo sapiens
aaactgatgtac

SEQ ID NO: 1463026 - DNA, 22 bp, Homo sapiens
aaactgcaaatgtccccttgat

SEQ ID NO: 1463027 - DNA, 15 bp, Homo sapiens
aaactgcactgtcaa

SEQ ID NO: 1463028 - DNA, 17 bp, Homo sapiens
aaactgcattagaaatt

SEQ ID NO: 1463029 - DNA, 14 bp, Homo sapiens
aaactgccagcaac

SEQ ID NO: 1463030 - DNA, 16 bp, Homo sapiens
aaactgctgcagatta

SEQ ID NO: 1463031 - DNA, 15 bp, Homo sapiens
aaactgctgcatact

SEQ ID NO: 1463032 - DNA, 22 bp, Homo sapiens
aaactgcttttttttttccagc

SEQ ID NO: 1463033 - DNA, 23 bp, Homo sapiens
aaactgcttttttttttccagca

SEQ ID NO: 1463034 - DNA, 14 bp, Homo sapiens
aaactggaaatact

SEQ ID NO: 1463035 - DNA, 19 bp, Homo sapiens
aaactggaacggtgaaggt

SEQ ID NO: 1463036 - DNA, 13 bp, Homo sapiens
aaactggcatctg

SEQ ID NO: 1463037 - DNA, 14 bp, Homo sapiens
aaagcctcttcaaa

SEQ ID NO: 1463038 - DNA, 13 bp, Homo sapiens
aaagcctgcaatt

SEQ ID NO: 1463039 - DNA, 20 bp, Homo sapiens
aaagccttaaaaatatcctt

SEQ ID NO: 1463040 - DNA, 15 bp, Homo sapiens
aaagccttagggaag

SEQ ID NO: 1463041 - DNA, 19 bp, Homo sapiens
aaagccttagggaagctgg

SEQ ID NO: 1463042 - DNA, 21 bp, Homo sapiens
aaagccttagggcaggaaaga

SEQ ID NO: 1463043 - DNA, 15 bp, Homo sapiens
aaagccttctggatc

SEQ ID NO: 1463044 - DNA, 16 bp, Homo sapiens
aaagccttctggatcc

SEQ ID NO: 1463045 - DNA, 13 bp, Homo sapiens
aaagcctttcatt

SEQ ID NO: 1463046 - DNA, 16 bp, Homo sapiens
aaagcctttgtatctt

SEQ ID NO: 1463047 - DNA, 21 bp, Homo sapiens
aaagcggggcttcatctgcaa

SEQ ID NO: 1463048 - DNA, 14 bp, Homo sapiens
aaagcggggggagg

SEQ ID NO: 1463049 - DNA, 18 bp, Homo sapiens
aaagcgggttataatgaa

SEQ ID NO: 1463050 - DNA, 14 bp, Homo sapiens
aaagctaaattttg

SEQ ID NO: 1463051 - DNA, 14 bp, Homo sapiens
aaagctcaaatgaa

SEQ ID NO: 1463052 - DNA, 13 bp, Homo sapiens
aaagctcaagatg

SEQ ID NO: 1463053 - DNA, 20 bp, Homo sapiens
aaagctcaagatgacagctc

SEQ ID NO: 1463054 - DNA, 21 bp, Homo sapiens
aaagctcaagatgacagctct

SEQ ID NO: 1463055 - DNA, 12 bp, Homo sapiens
aaagctcaggag

SEQ ID NO: 1463056 - DNA, 17 bp, Homo sapiens
aaagctcttctttttta

SEQ ID NO: 1463057 - DNA, 19 bp, Homo sapiens
aaagctgattactgtcaat

SEQ ID NO: 1463058 - DNA, 22 bp, Homo sapiens
aaagctgattactgtcaataaa

SEQ ID NO: 1463059 - DNA, 17 bp, Homo sapiens
aaagctgccatttccct

SEQ ID NO: 1463060 - DNA, 16 bp, Homo sapiens
aaagctggaacatttg

SEQ ID NO: 1463061 - DNA, 18 bp, Homo sapiens
aaagctggaacatttgat

SEQ ID NO: 1463062 - DNA, 23 bp, Homo sapiens
aaagctggaacatttgatatttt

SEQ ID NO: 1463063 - DNA, 20 bp, Homo sapiens
aaagctgttattcttgttat

SEQ ID NO: 1463064 - DNA, 21 bp, Homo sapiens
aaagctgttattcttgttata

SEQ ID NO: 1463065 - DNA, 14 bp, Homo sapiens
aaagctgttccttg

SEQ ID NO: 1463066 - DNA, 13 bp, Homo sapiens
aaagcttattaaa

SEQ ID NO: 1463067 - DNA, 13 bp, Homo sapiens
aaagcttctaaag

SEQ ID NO: 1463068 - DNA, 23 bp, Homo sapiens
aaagcttgtggccccttttactt

SEQ ID NO: 1463069 - DNA, 12 bp, Homo sapiens
aaagctttcctg

SEQ ID NO: 1463070 - DNA, 14 bp, Homo sapiens
aaagctttcctgcc

SEQ ID NO: 1463071 - DNA, 22 bp, Homo sapiens
aaagctttcctgccccaggcct

SEQ ID NO: 1463072 - DNA, 16 bp, Homo sapiens
aaagctttgctacaaa

SEQ ID NO: 1463073 - DNA, 21 bp, Homo sapiens
aaagctttgcttatggtaata

SEQ ID NO: 1463074 - DNA, 20 bp, Homo sapiens
aaagctttggctgagacctg

SEQ ID NO: 1463075 - DNA, 17 bp, Homo sapiens
aaagctttttaaaattt

SEQ ID NO: 1463076 - DNA, 14 bp, Homo sapiens
aaaggaaaaataac

SEQ ID NO: 1463077 - DNA, 16 bp, Homo sapiens
aaaggaaaagttaaac

SEQ ID NO: 1463078 - DNA, 14 bp, Homo sapiens
aaaggaaaccaagt

SEQ ID NO: 1463079 - DNA, 17 bp, Homo sapiens
aaaggaaatctcacccc

SEQ ID NO: 1463080 - DNA, 23 bp, Homo sapiens
aaaggaaatctcaccccatccca

SEQ ID NO: 1463081 - DNA, 14 bp, Homo sapiens
aaaggaacactgac

SEQ ID NO: 1463082 - DNA, 13 bp, Homo sapiens
aaaggaacaggct

SEQ ID NO: 1463083 - DNA, 17 bp, Homo sapiens
aaaggaagcattgtaaa

SEQ ID NO: 1463084 - DNA, 20 bp, Homo sapiens
aaaggaagcattgtaaaata

SEQ ID NO: 1463085 - DNA, 23 bp, Homo sapiens
aaaggaattttgtaaagtttcta

SEQ ID NO: 1463086 - DNA, 16 bp, Homo sapiens
aaaggacaatttcaaa

SEQ ID NO: 1463087 - DNA, 15 bp, Homo sapiens
aaaggacccacccat

SEQ ID NO: 1463088 - DNA, 21 bp, Homo sapiens
aaaggacccttgagtaagtga

SEQ ID NO: 1463089 - DNA, 22 bp, Homo sapiens
aaaggacccttgagtaagtgaa

SEQ ID NO: 1463090 - DNA, 14 bp, Homo sapiens
aaaggagaaaaaaa

SEQ ID NO: 1463091 - DNA, 12 bp, Homo sapiens
aaaggagagaag

SEQ ID NO: 1463092 - DNA, 21 bp, Homo sapiens
aaaggagccttttgctctctg

SEQ ID NO: 1463093 - DNA, 22 bp, Homo sapiens
aaaggagctcgaaggatattgt

SEQ ID NO: 1463094 - DNA, 15 bp, Homo sapiens
aaaggagctttctca

SEQ ID NO: 1463095 - DNA, 21 bp, Homo sapiens
aaaggagctttctcaatgtct

SEQ ID NO: 1463096 - DNA, 18 bp, Homo sapiens
aaaggatctgtgattggc

SEQ ID NO: 1463097 - DNA, 20 bp, Homo sapiens
aaaggatctgtgattggctg

SEQ ID NO: 1463098 - DNA, 15 bp, Homo sapiens
aaaggatgaagaaca

SEQ ID NO: 1463099 - DNA, 19 bp, Homo sapiens
aaaggatgtaaacagtgcc

SEQ ID NO: 1463100 - DNA, 17 bp, Homo sapiens
aaaggatgtataaattt

SEQ ID NO: 1463101 - DNA, 19 bp, Homo sapiens
aaaggatttaagcaaaggc

SEQ ID NO: 1463102 - DNA, 14 bp, Homo sapiens
aaaggatttctaga

SEQ ID NO: 1463103 - DNA, 19 bp, Homo sapiens
aaaggattttaccaaagca

SEQ ID NO: 1463104 - DNA, 16 bp, Homo sapiens
aaaggcaaacatttga

SEQ ID NO: 1463105 - DNA, 22 bp, Homo sapiens
aaaggcaagcttgaggccaaga

SEQ ID NO: 1463106 - DNA, 23 bp, Homo sapiens
aaaggcagctaagatagaaagct

SEQ ID NO: 1463107 - DNA, 13 bp, Homo sapiens
aaaggcagctgcc

SEQ ID NO: 1463108 - DNA, 17 bp, Homo sapiens
aaaggcagctgcctctg

SEQ ID NO: 1463109 - DNA, 18 bp, Homo sapiens
aaaggcagctgcctctgc

SEQ ID NO: 1463110 - DNA, 19 bp, Homo sapiens
aaaggcagctgcctctgct

SEQ ID NO: 1463111 - DNA, 14 bp, Homo sapiens
aaaggcagttttct

SEQ ID NO: 1463112 - DNA, 16 bp, Homo sapiens
aaaggcagttttctaa

SEQ ID NO: 1463113 - DNA, 16 bp, Homo sapiens
aaaggcattctctgaa

SEQ ID NO: 1463114 - DNA, 18 bp, Homo sapiens
aaaggcattctctgaaga

SEQ ID NO: 1463115 - DNA, 17 bp, Homo sapiens
aaaggccgccgtgacct

SEQ ID NO: 1463116 - DNA, 18 bp, Homo sapiens
aaaggccgccgtgaccta

SEQ ID NO: 1463117 - DNA, 12 bp, Homo sapiens
aaaggcctggaa

SEQ ID NO: 1463118 - DNA, 20 bp, Homo sapiens
aaaggcctggaaccagggag

SEQ ID NO: 1463119 - DNA, 21 bp, Homo sapiens
aaaggccttcagacacatgct

SEQ ID NO: 1463120 - DNA, 21 bp, Homo sapiens
aaaggcgcagtgcttctctac

SEQ ID NO: 1463121 - DNA, 19 bp, Homo sapiens
aaaggctaagaatagtggg

SEQ ID NO: 1463122 - DNA, 19 bp, Homo sapiens
aaaggctcagtctcaggag

SEQ ID NO: 1463123 - DNA, 14 bp, Homo sapiens
aaaggctcatttaa

SEQ ID NO: 1463124 - DNA, 15 bp, Homo sapiens
aaaggctcatttaaa

SEQ ID NO: 1463125 - DNA, 19 bp, Homo sapiens
aaaggctcatttaaaacag

SEQ ID NO: 1463126 - DNA, 22 bp, Homo sapiens
aaaggctccctcgccctgtgag

SEQ ID NO: 1463127 - DNA, 16 bp, Homo sapiens
aaaggctgaaaagaag

SEQ ID NO: 1463128 - DNA, 13 bp, Homo sapiens
aaaggctgtggta

SEQ ID NO: 1463129 - DNA, 19 bp, Homo sapiens
aaaggctgttaaatacagg

SEQ ID NO: 1463130 - DNA, 14 bp, Homo sapiens
aaaggcttggctgg

SEQ ID NO: 1463131 - DNA, 13 bp, Homo sapiens
aaagggaaattga

SEQ ID NO: 1463132 - DNA, 13 bp, Homo sapiens
aaagggaactaga

SEQ ID NO: 1463133 - DNA, 14 bp, Homo sapiens
aaagggaactagat

SEQ ID NO: 1463134 - DNA, 11 bp, Homo sapiens
aaagggaagta

SEQ ID NO: 1463135 - DNA, 24 bp, Homo sapiens
aaagggaagtaacagacacacgat

SEQ ID NO: 1463136 - DNA, 21 bp, Homo sapiens
aaagggagaaggaagggcaga

SEQ ID NO: 1463137 - DNA, 13 bp, Homo sapiens
aaagggagcccct

SEQ ID NO: 1463138 - DNA, 14 bp, Homo sapiens
aaagggagtttttg

SEQ ID NO: 1463139 - DNA, 20 bp, Homo sapiens
aaagggatggcaagatgtgg

SEQ ID NO: 1463140 - DNA, 14 bp, Homo sapiens
aaagggattgctga

SEQ ID NO: 1463141 - DNA, 20 bp, Homo sapiens
aaagggcactcccaaccctg

SEQ ID NO: 1463142 - DNA, 23 bp, Homo sapiens
aaagggcagccctccacttctgg

SEQ ID NO: 1463143 - DNA, 15 bp, Homo sapiens
aaagggccagaaaaa

SEQ ID NO: 1463144 - DNA, 23 bp, Homo sapiens
aaagggcccacagtgacttttgc

SEQ ID NO: 1463145 - DNA, 20 bp, Homo sapiens
aaagggccctttcatcttga

SEQ ID NO: 1463146 - DNA, 17 bp, Homo sapiens
aaagggctatggcaagg

SEQ ID NO: 1463147 - DNA, 14 bp, Homo sapiens
aaaggggagagcct

SEQ ID NO: 1463148 - DNA, 19 bp, Homo sapiens
aaaggggcgagcacccacg

SEQ ID NO: 1463149 - DNA, 13 bp, Homo sapiens
aaagggggctgca

SEQ ID NO: 1463150 - DNA, 13 bp, Homo sapiens
aaaggggggaggg

SEQ ID NO: 1463151 - DNA, 23 bp, Homo sapiens
aaaggggtcggctgaccatgctc

SEQ ID NO: 1463152 - DNA, 15 bp, Homo sapiens
aaaggggtgctttta

SEQ ID NO: 1463153 - DNA, 17 bp, Homo sapiens
aaagggtgaaaattatt

SEQ ID NO: 1463154 - DNA, 19 bp, Homo sapiens
aaagggtgaagctatttat

SEQ ID NO: 1463155 - DNA, 14 bp, Homo sapiens
aaagggtgtatagt

SEQ ID NO: 1463156 - DNA, 18 bp, Homo sapiens
aaagggtgtatagtgttc

SEQ ID NO: 1463157 - DNA, 19 bp, Homo sapiens
aaagggtgtatagtgttca

SEQ ID NO: 1463158 - DNA, 16 bp, Homo sapiens
aaaggtaatgtgtgga

SEQ ID NO: 1463159 - DNA, 16 bp, Homo sapiens
aaaggtaccaaacaag

SEQ ID NO: 1463160 - DNA, 14 bp, Homo sapiens
aaaggtaggtcaga

SEQ ID NO: 1463161 - DNA, 15 bp, Homo sapiens
aaaggtatattgtga

SEQ ID NO: 1463162 - DNA, 19 bp, Homo sapiens
aaaggtattccttgttctt

SEQ ID NO: 1463163 - DNA, 14 bp, Homo sapiens
aaaggtcagcccgt

SEQ ID NO: 1463164 - DNA, 20 bp, Homo sapiens
aaaggtccacaggtctagac

SEQ ID NO: 1463165 - DNA, 21 bp, Homo sapiens
aaaggtccacaggtctagact

SEQ ID NO: 1463166 - DNA, 21 bp, Homo sapiens
aaaggtgcctgtgaggcaggg

SEQ ID NO: 1463167 - DNA, 16 bp, Homo sapiens
aaaggtggtaaattca

SEQ ID NO: 1463168 - DNA, 17 bp, Homo sapiens
aaaggtggtaaattcag

SEQ ID NO: 1463169 - DNA, 14 bp, Homo sapiens
aaaggtgtatttaa

SEQ ID NO: 1463170 - DNA, 19 bp, Homo sapiens
aaaggttagagaataaatt

SEQ ID NO: 1463171 - DNA, 14 bp, Homo sapiens
aaaggttcttcatc

SEQ ID NO: 1463172 - DNA, 22 bp, Homo sapiens
aaaggttcttcatccctttcca

SEQ ID NO: 1463173 - DNA, 17 bp, Homo sapiens
aaaggttgaataatata

SEQ ID NO: 1463174 - DNA, 19 bp, Homo sapiens
aaaggttgaataatatatg

SEQ ID NO: 1463175 - DNA, 21 bp, Homo sapiens
aaaggttgccaaattgctgca

SEQ ID NO: 1463176 - DNA, 21 bp, Homo sapiens
aaaggtttggaaggagcagaa

SEQ ID NO: 1463177 - DNA, 14 bp, Homo sapiens
aaaggttttcctct

SEQ ID NO: 1463178 - DNA, 22 bp, Homo sapiens
aaagtacattctggggaaacaa

SEQ ID NO: 1463179 - DNA, 14 bp, Homo sapiens
aaagtacattgtaa

SEQ ID NO: 1463180 - DNA, 12 bp, Homo sapiens
aaagtacattta

SEQ ID NO: 1463181 - DNA, 14 bp, Homo sapiens
aaagtacatttaat

SEQ ID NO: 1463182 - DNA, 19 bp, Homo sapiens
aaagtacattttttgaaat

SEQ ID NO: 1463183 - DNA, 14 bp, Homo sapiens
aaagtactctttaa

SEQ ID NO: 1463184 - DNA, 16 bp, Homo sapiens
aaagtactctttaaca

SEQ ID NO: 1463185 - DNA, 18 bp, Homo sapiens
aaagtactttaaaaagga

SEQ ID NO: 1463186 - DNA, 15 bp, Homo sapiens
aaagtagacaaatgg

SEQ ID NO: 1463187 - DNA, 18 bp, Homo sapiens
aaagtagggatgcggatc

SEQ ID NO: 1463188 - DNA, 14 bp, Homo sapiens
aaagtatatattta

SEQ ID NO: 1463189 - DNA, 14 bp, Homo sapiens
aaagtatgcattat

SEQ ID NO: 1463190 - DNA, 16 bp, Homo sapiens
aaagtatgtattattt

SEQ ID NO: 1463191 - DNA, 14 bp, Homo sapiens
aaagtattatcatt

SEQ ID NO: 1463192 - DNA, 14 bp, Homo sapiens
aaagtattctcttt

SEQ ID NO: 1463193 - DNA, 18 bp, Homo sapiens
aaagtattgaaagccaac

SEQ ID NO: 1463194 - DNA, 21 bp, Homo sapiens
aaagtcaaatgccaaacacta

SEQ ID NO: 1463195 - DNA, 17 bp, Homo sapiens
aaagtcacccaaacact

SEQ ID NO: 1463196 - DNA, 19 bp, Homo sapiens
aaagtcacccaaacacttc

SEQ ID NO: 1463197 - DNA, 21 bp, Homo sapiens
aaagtctaagcaagatgtttt

SEQ ID NO: 1463198 - DNA, 13 bp, Homo sapiens
aaagtctatgctt

SEQ ID NO: 1463199 - DNA, 12 bp, Homo sapiens
aaagtctatttt

SEQ ID NO: 1463200 - DNA, 14 bp, Homo sapiens
aaagtgaacacaca

SEQ ID NO: 1463201 - DNA, 13 bp, Homo sapiens
aaagtgacatttg

SEQ ID NO: 1463202 - DNA, 14 bp, Homo sapiens
aaagtgaccctgtt

SEQ ID NO: 1463203 - DNA, 15 bp, Homo sapiens
aaagtgatgaactgg

SEQ ID NO: 1463204 - DNA, 15 bp, Homo sapiens
aaagtgattaaacgt

SEQ ID NO: 1463205 - DNA, 21 bp, Homo sapiens
aaagtgattatctctttgatc

SEQ ID NO: 1463206 - DNA, 14 bp, Homo sapiens
aaagtgcaagtcca

SEQ ID NO: 1463207 - DNA, 20 bp, Homo sapiens
aaagtgcctgacacactaac

SEQ ID NO: 1463208 - DNA, 19 bp, Homo sapiens
aaagtgcgtgtgtgtatgt

SEQ ID NO: 1463209 - DNA, 12 bp, Homo sapiens
aaagtgctggga

SEQ ID NO: 1463210 - DNA, 21 bp, Homo sapiens
aaagtgcttaaggtttgtttt

SEQ ID NO: 1463211 - DNA, 17 bp, Homo sapiens
aaagtggcaagaccaaa

SEQ ID NO: 1463212 - DNA, 17 bp, Homo sapiens
aaagtggccatgccacc

SEQ ID NO: 1463213 - DNA, 18 bp, Homo sapiens
aaagtggctgcggtgttt

SEQ ID NO: 1463214 - DNA, 21 bp, Homo sapiens
aaagtgggttttttagttgaa

SEQ ID NO: 1463215 - DNA, 16 bp, Homo sapiens
aaagtggtaaatactg

SEQ ID NO: 1463216 - DNA, 17 bp, Homo sapiens
aaagtggtaaatactgt

SEQ ID NO: 1463217 - DNA, 19 bp, Homo sapiens
aaagtggtaaatactgtga

SEQ ID NO: 1463218 - DNA, 14 bp, Homo sapiens
aaagtggtctctgc

SEQ ID NO: 1463219 - DNA, 20 bp, Homo sapiens
aaagtgtatatttattcata

SEQ ID NO: 1463220 - DNA, 10 bp, Homo sapiens
aaagtgtatt

SEQ ID NO: 1463221 - DNA, 22 bp, Homo sapiens
aaagtgtcttttgacattttat

SEQ ID NO: 1463222 - DNA, 21 bp, Homo sapiens
aaagtgtgaaataaatttttt

SEQ ID NO: 1463223 - DNA, 18 bp, Homo sapiens
aaagtgtgagcaaactaa

SEQ ID NO: 1463224 - DNA, 18 bp, Homo sapiens
aaagtgtgtatatatttt

SEQ ID NO: 1463225 - DNA, 20 bp, Homo sapiens
aaagtgtgtatatattttgt

SEQ ID NO: 1463226 - DNA, 11 bp, Homo sapiens
aaagtgttact

SEQ ID NO: 1463227 - DNA, 20 bp, Homo sapiens
aaagtgttgctgtggctcca

SEQ ID NO: 1463228 - DNA, 16 bp, Homo sapiens
aaagtgttgtgttcct

SEQ ID NO: 1463229 - DNA, 17 bp, Homo sapiens
aaagtgttgtgttcctg

SEQ ID NO: 1463230 - DNA, 22 bp, Homo sapiens
aaagtgttgtgttcctggctga

SEQ ID NO: 1463231 - DNA, 15 bp, Homo sapiens
aaagttaaactaaaa

SEQ ID NO: 1463232 - DNA, 16 bp, Homo sapiens
aaagttaacagatttt

SEQ ID NO: 1463233 - DNA, 14 bp, Homo sapiens
aaagttactgtaaa

SEQ ID NO: 1463234 - DNA, 16 bp, Homo sapiens
aaagttactgtaaatg

SEQ ID NO: 1463235 - DNA, 19 bp, Homo sapiens
aaagttactgtaaatgcct

SEQ ID NO: 1463236 - DNA, 21 bp, Homo sapiens
aaagttagtatcttttgatat

SEQ ID NO: 1463237 - DNA, 20 bp, Homo sapiens
aaagttagtattaaaatcta

SEQ ID NO: 1463238 - DNA, 22 bp, Homo sapiens
aaagttagtattaaaatctaca

SEQ ID NO: 1463239 - DNA, 22 bp, Homo sapiens
aaagttatgtatttaaagttgt

SEQ ID NO: 1463240 - DNA, 16 bp, Homo sapiens
aaagttattaaaattg

SEQ ID NO: 1463241 - DNA, 20 bp, Homo sapiens
aaagttcaatactcttgaaa

SEQ ID NO: 1463242 - DNA, 12 bp, Homo sapiens
aaagttcaggga

SEQ ID NO: 1463243 - DNA, 22 bp, Homo sapiens
aaagttcatagggtctcttcag

SEQ ID NO: 1463244 - DNA, 15 bp, Homo sapiens
aaagttcatatctgg

SEQ ID NO: 1463245 - DNA, 23 bp, Homo sapiens
aaagttcatatctggagcctgat

SEQ ID NO: 1463246 - DNA, 20 bp, Homo sapiens
aaagttccaagagtctaaag

SEQ ID NO: 1463247 - DNA, 21 bp, Homo sapiens
aaagttcccactccttcagga

SEQ ID NO: 1463248 - DNA, 14 bp, Homo sapiens
aaagttctcagaac

SEQ ID NO: 1463249 - DNA, 18 bp, Homo sapiens
aaagttcttattttagta

SEQ ID NO: 1463250 - DNA, 18 bp, Homo sapiens
aaagttgaaaagccaaag

SEQ ID NO: 1463251 - DNA, 12 bp, Homo sapiens
aaagttgcagat

SEQ ID NO: 1463252 - DNA, 19 bp, Homo sapiens
aaagttggttcacttcaaa

SEQ ID NO: 1463253 - DNA, 13 bp, Homo sapiens
aaagttgtaaaat

SEQ ID NO: 1463254 - DNA, 16 bp, Homo sapiens
aaagtttacattgtcc

SEQ ID NO: 1463255 - DNA, 14 bp, Homo sapiens
aaagtttccatatg

SEQ ID NO: 1463256 - DNA, 14 bp, Homo sapiens
aaagtttctatttt

SEQ ID NO: 1463257 - DNA, 13 bp, Homo sapiens
aaagtttctcaga

SEQ ID NO: 1463258 - DNA, 13 bp, Homo sapiens
aaagttttacaat

SEQ ID NO: 1463259 - DNA, 13 bp, Homo sapiens
aaagttttacaga

SEQ ID NO: 1463260 - DNA, 14 bp, Homo sapiens
aaagttttacagag

SEQ ID NO: 1463261 - DNA, 15 bp, Homo sapiens
aaagttttacagaga

SEQ ID NO: 1463262 - DNA, 13 bp, Homo sapiens
aaagttttgcaaa

SEQ ID NO: 1463263 - DNA, 16 bp, Homo sapiens
aaagttttgcaaaggg

SEQ ID NO: 1463264 - DNA, 15 bp, Homo sapiens
aaagttttgtcagaa

SEQ ID NO: 1463265 - DNA, 17 bp, Homo sapiens
aaagtttttaatttgat

SEQ ID NO: 1463266 - DNA, 14 bp, Homo sapiens
aaagtttttgtttg

SEQ ID NO: 1463267 - DNA, 17 bp, Homo sapiens
aaataaaaaaagatttt

SEQ ID NO: 1463268 - DNA, 20 bp, Homo sapiens
aaatgcagtcctgaggagag

SEQ ID NO: 1463269 - DNA, 11 bp, Homo sapiens
aaatgcatatt

SEQ ID NO: 1463270 - DNA, 15 bp, Homo sapiens
aaatgcatattgtat

SEQ ID NO: 1463271 - DNA, 12 bp, Homo sapiens
aaatgcatattt

SEQ ID NO: 1463272 - DNA, 20 bp, Homo sapiens
aaatgcatccattcctcagg

SEQ ID NO: 1463273 - DNA, 13 bp, Homo sapiens
aaatgcatggagg

SEQ ID NO: 1463274 - DNA, 15 bp, Homo sapiens
aaatgcattattgac

SEQ ID NO: 1463275 - DNA, 23 bp, Homo sapiens
aaatgccaagggggtgactggaa

SEQ ID NO: 1463276 - DNA, 13 bp, Homo sapiens
aaatgccagagcc

SEQ ID NO: 1463277 - DNA, 16 bp, Homo sapiens
aaatgccagagccaac

SEQ ID NO: 1463278 - DNA, 18 bp, Homo sapiens
aaatgccatagaaatgta

SEQ ID NO: 1463279 - DNA, 19 bp, Homo sapiens
aaatgccatagtttgtgaa

SEQ ID NO: 1463280 - DNA, 16 bp, Homo sapiens
aaatgccttgtataaa

SEQ ID NO: 1463281 - DNA, 15 bp, Homo sapiens
aaatgctagaaaaat

SEQ ID NO: 1463282 - DNA, 18 bp, Homo sapiens
aaatgctcattttctggt

SEQ ID NO: 1463283 - DNA, 19 bp, Homo sapiens
aaatgctcgtgtgatttcc

SEQ ID NO: 1463284 - DNA, 19 bp, Homo sapiens
aaatgctgacaaaaatatt

SEQ ID NO: 1463285 - DNA, 14 bp, Homo sapiens
aaatgctgcatttt

SEQ ID NO: 1463286 - DNA, 14 bp, Homo sapiens
aaatgctgcctgcc

SEQ ID NO: 1463287 - DNA, 16 bp, Homo sapiens
aaatgctgcctgcctg

SEQ ID NO: 1463288 - DNA, 13 bp, Homo sapiens
aaatgctgctctc

SEQ ID NO: 1463289 - DNA, 18 bp, Homo sapiens
aaatgctgctctcagcct

SEQ ID NO: 1463290 - DNA, 18 bp, Homo sapiens
aaatgctgtagaagtgag

SEQ ID NO: 1463291 - DNA, 16 bp, Homo sapiens
aaatgcttcatttgta

SEQ ID NO: 1463292 - DNA, 19 bp, Homo sapiens
aaatgctttgtgtgattga

SEQ ID NO: 1463293 - DNA, 18 bp, Homo sapiens
aaatggaaaggtcctgct

SEQ ID NO: 1463294 - DNA, 18 bp, Homo sapiens
aaatggaaatttaaatga

SEQ ID NO: 1463295 - DNA, 17 bp, Homo sapiens
aaatggaatcaggtaga

SEQ ID NO: 1463296 - DNA, 15 bp, Homo sapiens
aaatggagaagctct

SEQ ID NO: 1463297 - DNA, 22 bp, Homo sapiens
aaatggaggtccttctgctgga

SEQ ID NO: 1463298 - DNA, 19 bp, Homo sapiens
aaatggatattattagaaa

SEQ ID NO: 1463299 - DNA, 19 bp, Homo sapiens
aaatggattaattactaat

SEQ ID NO: 1463300 - DNA, 14 bp, Homo sapiens
aaatggattcagta

SEQ ID NO: 1463301 - DNA, 20 bp, Homo sapiens
aaatggccagttttctggta

SEQ ID NO: 1463302 - DNA, 13 bp, Homo sapiens
aaatggccatttg

SEQ ID NO: 1463303 - DNA, 19 bp, Homo sapiens
aaatggccatttgcttttt

SEQ ID NO: 1463304 - DNA, 23 bp, Homo sapiens
aaatggccatttgctttttcacc

SEQ ID NO: 1463305 - DNA, 14 bp, Homo sapiens
aaatggcgtctgct

SEQ ID NO: 1463306 - DNA, 17 bp, Homo sapiens
aaatggcgtctgctctg

SEQ ID NO: 1463307 - DNA, 20 bp, Homo sapiens
aaatggctaataaactgtat

SEQ ID NO: 1463308 - DNA, 18 bp, Homo sapiens
aaatggctcaagtagaaa

SEQ ID NO: 1463309 - DNA, 19 bp, Homo sapiens
aaatggctggggccgctgg

SEQ ID NO: 1463310 - DNA, 22 bp, Homo sapiens
aaatggctggggccgctggggt

SEQ ID NO: 1463311 - DNA, 19 bp, Homo sapiens
aaatggctgtaatcatttg

SEQ ID NO: 1463312 - DNA, 22 bp, Homo sapiens
aaatggcttcagaattaaaact

SEQ ID NO: 1463313 - DNA, 16 bp, Homo sapiens
aaatgggaaaaaactt

SEQ ID NO: 1463314 - DNA, 21 bp, Homo sapiens
aaatgggaaaaaacttaaaaa

SEQ ID NO: 1463315 - DNA, 18 bp, Homo sapiens
aaatgggaattctcaggt

SEQ ID NO: 1463316 - DNA, 16 bp, Homo sapiens
aaatgggactgatgtc

SEQ ID NO: 1463317 - DNA, 21 bp, Homo sapiens
aaatggggccagatccagcct

SEQ ID NO: 1463318 - DNA, 22 bp, Homo sapiens
aaatggggccagatccagcctg

SEQ ID NO: 1463319 - DNA, 13 bp, Homo sapiens
aaatggtataaaa

SEQ ID NO: 1463320 - DNA, 19 bp, Homo sapiens
aaatggtcccaattaagaa

SEQ ID NO: 1463321 - DNA, 16 bp, Homo sapiens
aaatggtcgcccagga

SEQ ID NO: 1463322 - DNA, 14 bp, Homo sapiens
aaatggtgtacata

SEQ ID NO: 1463323 - DNA, 14 bp, Homo sapiens
aaatggtgtttttt

SEQ ID NO: 1463324 - DNA, 23 bp, Homo sapiens
aaatggttcagaattaaactttt

SEQ ID NO: 1463325 - DNA, 19 bp, Homo sapiens
aaatggttgatggaaaata

SEQ ID NO: 1463326 - DNA, 20 bp, Homo sapiens
aaatggttgatggaaaataa

SEQ ID NO: 1463327 - DNA, 23 bp, Homo sapiens
aaatggttgatggaaaataaaca

SEQ ID NO: 1463328 - DNA, 22 bp, Homo sapiens
aaatgtaaagatatttttatct

SEQ ID NO: 1463329 - DNA, 11 bp, Homo sapiens
aaatgtaaatc

SEQ ID NO: 1463330 - DNA, 11 bp, Homo sapiens
aaatgtaacat

SEQ ID NO: 1463331 - DNA, 16 bp, Homo sapiens
aaatgtaacatcataa

SEQ ID NO: 1463332 - DNA, 17 bp, Homo sapiens
aaatgtaacttttgtaa

SEQ ID NO: 1463333 - DNA, 22 bp, Homo sapiens
aaatgtaagatcgttctctgcc

SEQ ID NO: 1463334 - DNA, 20 bp, Homo sapiens
aaatgtaagattatagattc

SEQ ID NO: 1463335 - DNA, 14 bp, Homo sapiens
aaatgtaagcaaag

SEQ ID NO: 1463336 - DNA, 18 bp, Homo sapiens
aaatgtaatataatgtat

SEQ ID NO: 1463337 - DNA, 17 bp, Homo sapiens
aaatgtaatttaaatga

SEQ ID NO: 1463338 - DNA, 19 bp, Homo sapiens
aaatgtaatttaaatgaaa

SEQ ID NO: 1463339 - DNA, 14 bp, Homo sapiens
aaatgtacatgtat

SEQ ID NO: 1463340 - DNA, 17 bp, Homo sapiens
aaatgtacatgtattaa

SEQ ID NO: 1463341 - DNA, 20 bp, Homo sapiens
aaatgtacccctctcagtct

SEQ ID NO: 1463342 - DNA, 16 bp, Homo sapiens
aaatgtacctgatgta

SEQ ID NO: 1463343 - DNA, 15 bp, Homo sapiens
aaatgtactggtaat

SEQ ID NO: 1463344 - DNA, 21 bp, Homo sapiens
aaatgtactggtaattgtaca

SEQ ID NO: 1463345 - DNA, 17 bp, Homo sapiens
aaatgtagacagatatt

SEQ ID NO: 1463346 - DNA, 18 bp, Homo sapiens
aaatgtagcgacagcatt

SEQ ID NO: 1463347 - DNA, 21 bp, Homo sapiens
aaatgtaggcatcatgcatgt

SEQ ID NO: 1463348 - DNA, 20 bp, Homo sapiens
aaatgtaggcttagtttgtg

SEQ ID NO: 1463349 - DNA, 17 bp, Homo sapiens
aaatgtaggtcctcaga

SEQ ID NO: 1463350 - DNA, 16 bp, Homo sapiens
aaatgtataaatatac

SEQ ID NO: 1463351 - DNA, 19 bp, Homo sapiens
aaatgtataaatatacagt

SEQ ID NO: 1463352 - DNA, 17 bp, Homo sapiens
aaatgtatatatgtata

SEQ ID NO: 1463353 - DNA, 21 bp, Homo sapiens
aaatgtatcctgataaacatt

SEQ ID NO: 1463354 - DNA, 23 bp, Homo sapiens
aaatgtatcctgataaacattaa

SEQ ID NO: 1463355 - DNA, 22 bp, Homo sapiens
aaatgtcagatacaatgtattt

SEQ ID NO: 1463356 - DNA, 14 bp, Homo sapiens
aaatgtcataaatt

SEQ ID NO: 1463357 - DNA, 23 bp, Homo sapiens
aaatgtctattttcttgaggaaa

SEQ ID NO: 1463358 - DNA, 12 bp, Homo sapiens
aaatgtctgctg

SEQ ID NO: 1463359 - DNA, 14 bp, Homo sapiens
aaatgtctgtaaat

SEQ ID NO: 1463360 - DNA, 20 bp, Homo sapiens
aaatgtctgtaaatatgttt

SEQ ID NO: 1463361 - DNA, 10 bp, Homo sapiens
aaatgtgaat

SEQ ID NO: 1463362 - DNA, 17 bp, Homo sapiens
aaatgtgaatcgcagct

SEQ ID NO: 1463363 - DNA, 13 bp, Homo sapiens
aaatgtgaatttt

SEQ ID NO: 1463364 - DNA, 15 bp, Homo sapiens
aaatgtgaattttta

SEQ ID NO: 1463365 - DNA, 20 bp, Homo sapiens
aaatgtgaatttttattgtt

SEQ ID NO: 1463366 - DNA, 21 bp, Homo sapiens
aaatgtgaatttttattgttg

SEQ ID NO: 1463367 - DNA, 17 bp, Homo sapiens
aaatgtgagctataatg

SEQ ID NO: 1463368 - DNA, 15 bp, Homo sapiens
aaatgtgatcaactg

SEQ ID NO: 1463369 - DNA, 18 bp, Homo sapiens
aaatgtgatgttctaagg

SEQ ID NO: 1463370 - DNA, 13 bp, Homo sapiens
aaatgtgattttt

SEQ ID NO: 1463371 - DNA, 16 bp, Homo sapiens
aaatgtgatttttctg

SEQ ID NO: 1463372 - DNA, 17 bp, Homo sapiens
aaatgtgatttttctga

SEQ ID NO: 1463373 - DNA, 20 bp, Homo sapiens
aaatgtgggattatgggtca

SEQ ID NO: 1463374 - DNA, 12 bp, Homo sapiens
aaatgtgtacat

SEQ ID NO: 1463375 - DNA, 21 bp, Homo sapiens
aaatgtgtcctatctatcttc

SEQ ID NO: 1463376 - DNA, 13 bp, Homo sapiens
aaatgtgtttttc

SEQ ID NO: 1463377 - DNA, 16 bp, Homo sapiens
aaatgtgtttttctat

SEQ ID NO: 1463378 - DNA, 17 bp, Homo sapiens
aaatgtgtttttctata

SEQ ID NO: 1463379 - DNA, 21 bp, Homo sapiens
aaatgtgtttttctatatagt

SEQ ID NO: 1463380 - DNA, 16 bp, Homo sapiens
aaatgttacacattaa

SEQ ID NO: 1463381 - DNA, 23 bp, Homo sapiens
aaatgttacacattaaacaggat

SEQ ID NO: 1463382 - DNA, 14 bp, Homo sapiens
aaatgttacctctg

SEQ ID NO: 1463383 - DNA, 23 bp, Homo sapiens
aaattgttgtccggtttacttta

SEQ ID NO: 1463384 - DNA, 23 bp, Homo sapiens
aaattgtttatgtgttatgaaca

SEQ ID NO: 1463385 - DNA, 20 bp, Homo sapiens
aaattgttttgagctttcca

SEQ ID NO: 1463386 - DNA, 19 bp, Homo sapiens
aaatttaaaatgttactta

SEQ ID NO: 1463387 - DNA, 13 bp, Homo sapiens
aaatttaaaatta

SEQ ID NO: 1463388 - DNA, 16 bp, Homo sapiens
aaatttaactgcatat

SEQ ID NO: 1463389 - DNA, 17 bp, Homo sapiens
aaatttaactgcatata

SEQ ID NO: 1463390 - DNA, 23 bp, Homo sapiens
aaatttaagtatcttttttcaaa

SEQ ID NO: 1463391 - DNA, 21 bp, Homo sapiens
aaatttaataccagatacctt

SEQ ID NO: 1463392 - DNA, 16 bp, Homo sapiens
aaatttaatatactgc

SEQ ID NO: 1463393 - DNA, 17 bp, Homo sapiens
aaatttaatgctgcctt

SEQ ID NO: 1463394 - DNA, 17 bp, Homo sapiens
aaatttacatttaatac

SEQ ID NO: 1463395 - DNA, 14 bp, Homo sapiens
aaatttatgcattt

SEQ ID NO: 1463396 - DNA, 15 bp, Homo sapiens
aaatttatgcatttc

SEQ ID NO: 1463397 - DNA, 18 bp, Homo sapiens
aaatttatgcatttcatt

SEQ ID NO: 1463398 - DNA, 23 bp, Homo sapiens
aaatttatgcatttcattcaaat

SEQ ID NO: 1463399 - DNA, 18 bp, Homo sapiens
aaatttattttataagaa

SEQ ID NO: 1463400 - DNA, 14 bp, Homo sapiens
aaatttcaaatgca

SEQ ID NO: 1463401 - DNA, 22 bp, Homo sapiens
aaatttcattgtgttgatttct

SEQ ID NO: 1463402 - DNA, 22 bp, Homo sapiens
aaatttcctgtttgaaatatca

SEQ ID NO: 1463403 - DNA, 23 bp, Homo sapiens
aaatttcgttgtccaatttgtaa

SEQ ID NO: 1463404 - DNA, 15 bp, Homo sapiens
aaatttctcattagt

SEQ ID NO: 1463405 - DNA, 15 bp, Homo sapiens
aaatttcttatgtga

SEQ ID NO: 1463406 - DNA, 17 bp, Homo sapiens
aaatttcttatgtgaca

SEQ ID NO: 1463407 - DNA, 23 bp, Homo sapiens
aaatttcttggcaaattttaaaa

SEQ ID NO: 1463408 - DNA, 16 bp, Homo sapiens
aaatttgactaatttt

SEQ ID NO: 1463409 - DNA, 18 bp, Homo sapiens
aaatttgactaattttac

SEQ ID NO: 1463410 - DNA, 20 bp, Homo sapiens
aaatttgactaattttacat

SEQ ID NO: 1463411 - DNA, 16 bp, Homo sapiens
aaatttgacttttctg

SEQ ID NO: 1463412 - DNA, 17 bp, Homo sapiens
aaatttgagaatacata

SEQ ID NO: 1463413 - DNA, 20 bp, Homo sapiens
aaatttgatggactaattat

SEQ ID NO: 1463414 - DNA, 17 bp, Homo sapiens
aaatttggcattgatct

SEQ ID NO: 1463415 - DNA, 13 bp, Homo sapiens
aaatttggcctta

SEQ ID NO: 1463416 - DNA, 16 bp, Homo sapiens
aaatttggttctaata

SEQ ID NO: 1463417 - DNA, 13 bp, Homo sapiens
aaatttgtaactt

SEQ ID NO: 1463418 - DNA, 20 bp, Homo sapiens
aaatttgtacaggactgtaa

SEQ ID NO: 1463419 - DNA, 13 bp, Homo sapiens
aaatttgttcttt

SEQ ID NO: 1463420 - DNA, 22 bp, Homo sapiens
aaatttgttctttgtttagcct

SEQ ID NO: 1463421 - DNA, 15 bp, Homo sapiens
aaatttgttgtttgt

SEQ ID NO: 1463422 - DNA, 16 bp, Homo sapiens
aaatttgttgtttgtt

SEQ ID NO: 1463423 - DNA, 18 bp, Homo sapiens
aaatttgtttgaaatctt

SEQ ID NO: 1463424 - DNA, 14 bp, Homo sapiens
aaatttgtttgtat

SEQ ID NO: 1463425 - DNA, 12 bp, Homo sapiens
aaattttaaaaa

SEQ ID NO: 1463426 - DNA, 22 bp, Homo sapiens
aaattttaggcaagttttccct

SEQ ID NO: 1463427 - DNA, 21 bp, Homo sapiens
aaattttataaaattaagcaa

SEQ ID NO: 1463428 - DNA, 12 bp, Homo sapiens
aaattttatatg

SEQ ID NO: 1463429 - DNA, 13 bp, Homo sapiens
aaattttatgtca

SEQ ID NO: 1463430 - DNA, 20 bp, Homo sapiens
aaattttatgtcatagaaat

SEQ ID NO: 1463431 - DNA, 13 bp, Homo sapiens
aaattttattcct

SEQ ID NO: 1463432 - DNA, 20 bp, Homo sapiens
aaattttcatgaatgtgctg

SEQ ID NO: 1463433 - DNA, 13 bp, Homo sapiens
aaattttctcctt

SEQ ID NO: 1463434 - DNA, 11 bp, Homo sapiens
aaattttgtaa

SEQ ID NO: 1463435 - DNA, 16 bp, Homo sapiens
aaattttgtaaaacaa

SEQ ID NO: 1463436 - DNA, 23 bp, Homo sapiens
aaattttgtgacccctttcactt

SEQ ID NO: 1463437 - DNA, 15 bp, Homo sapiens
aaatttttatttttc

SEQ ID NO: 1463438 - DNA, 16 bp, Homo sapiens
aaatttttatttttga

SEQ ID NO: 1463439 - DNA, 22 bp, Homo sapiens
aaatttttgagttacaatttgg

SEQ ID NO: 1463440 - DNA, 14 bp, Homo sapiens
aaatttttgcaaat

SEQ ID NO: 1463441 - DNA, 13 bp, Homo sapiens
aaattttttggca

SEQ ID NO: 1463442 - DNA, 20 bp, Homo sapiens
aaattttttttggtcaaatt

SEQ ID NO: 1463443 - DNA, 13 bp, Homo sapiens
aacaaaaaataca

SEQ ID NO: 1463444 - DNA, 19 bp, Homo sapiens
aacaaaaacagaatttgag

SEQ ID NO: 1463445 - DNA, 16 bp, Homo sapiens
aacaaaaaccagcagg

SEQ ID NO: 1463446 - DNA, 14 bp, Homo sapiens
aacaaaaccagctg

SEQ ID NO: 1463447 - DNA, 20 bp, Homo sapiens
aacaaaagggtgtatagtgt

SEQ ID NO: 1463448 - DNA, 21 bp, Homo sapiens
aacaaaatcaagcctgattca

SEQ ID NO: 1463449 - DNA, 18 bp, Homo sapiens
aacaaaattagccgggca

SEQ ID NO: 1463450 - DNA, 13 bp, Homo sapiens
aacaaaatttcta

SEQ ID NO: 1463451 - DNA, 14 bp, Homo sapiens
aacaaacaaaactt

SEQ ID NO: 1463452 - DNA, 10 bp, Homo sapiens
aacaaaccat

SEQ ID NO: 1463453 - DNA, 14 bp, Homo sapiens
aacaaactcttcag

SEQ ID NO: 1463454 - DNA, 14 bp, Homo sapiens
aacaaagattgaga

SEQ ID NO: 1463455 - DNA, 17 bp, Homo sapiens
aacaaagcagctttaaa

SEQ ID NO: 1463456 - DNA, 18 bp, Homo sapiens
aacaaagcagctttaaaa

SEQ ID NO: 1463457 - DNA, 22 bp, Homo sapiens
aacaaatatacattttctaaat

SEQ ID NO: 1463458 - DNA, 13 bp, Homo sapiens
aacaaatatgcaa

SEQ ID NO: 1463459 - DNA, 16 bp, Homo sapiens
aacaaatcataatgta

SEQ ID NO: 1463460 - DNA, 23 bp, Homo sapiens
aacaaatgatttccacaaacaga

SEQ ID NO: 1463461 - DNA, 18 bp, Homo sapiens
aacaaattcatattctgt

SEQ ID NO: 1463462 - DNA, 12 bp, Homo sapiens
aacaaattcttt

SEQ ID NO: 1463463 - DNA, 14 bp, Homo sapiens
aacaaattctttag

SEQ ID NO: 1463464 - DNA, 19 bp, Homo sapiens
aacaaattctttagtactc

SEQ ID NO: 1463465 - DNA, 22 bp, Homo sapiens
aacaaattctttagtactcaat

SEQ ID NO: 1463466 - DNA, 13 bp, Homo sapiens
aacaacaataata

SEQ ID NO: 1463467 - DNA, 24 bp, Homo sapiens
aacaacatgtgagcatggtcacaa

SEQ ID NO: 1463468 - DNA, 14 bp, Homo sapiens
aacaacatgttcta

SEQ ID NO: 1463469 - DNA, 18 bp, Homo sapiens
aacaacctcaactgccta

SEQ ID NO: 1463470 - DNA, 19 bp, Homo sapiens
aacaaccttttacattgtg

SEQ ID NO: 1463471 - DNA, 19 bp, Homo sapiens
aacaacgtgtatagtgcct

SEQ ID NO: 1463472 - DNA, 14 bp, Homo sapiens
aacaactatttact

SEQ ID NO: 1463473 - DNA, 13 bp, Homo sapiens
aacaactctattt

SEQ ID NO: 1463474 - DNA, 22 bp, Homo sapiens
aacaacttaatgttctgaataa

SEQ ID NO: 1463475 - DNA, 15 bp, Homo sapiens
aacaacttggcattt

SEQ ID NO: 1463476 - DNA, 18 bp, Homo sapiens
aacaacttggcatttcta

SEQ ID NO: 1463477 - DNA, 15 bp, Homo sapiens
aacaactttcacttc

SEQ ID NO: 1463478 - DNA, 14 bp, Homo sapiens
aacaagacagcctt

SEQ ID NO: 1463479 - DNA, 18 bp, Homo sapiens
aacaagaccgccccaggg

SEQ ID NO: 1463480 - DNA, 19 bp, Homo sapiens
aacaagactgccaggtggt

SEQ ID NO: 1463481 - DNA, 21 bp, Homo sapiens
aacaagagcaaaactccgtct

SEQ ID NO: 1463482 - DNA, 19 bp, Homo sapiens
aacaagatctttcaggaaa

SEQ ID NO: 1463483 - DNA, 20 bp, Homo sapiens
aacaagatttccttgtgcaa

SEQ ID NO: 1463484 - DNA, 13 bp, Homo sapiens
aacaagcatgcag

SEQ ID NO: 1463485 - DNA, 16 bp, Homo sapiens
aacaaggaagccaaag

SEQ ID NO: 1463486 - DNA, 20 bp, Homo sapiens
aacaaggaatgcctgtgcca

SEQ ID NO: 1463487 - DNA, 22 bp, Homo sapiens
aacaaggagctcaccctgcccg

SEQ ID NO: 1463488 - DNA, 24 bp, Homo sapiens
aacaaggagctcaccctgcccgct

SEQ ID NO: 1463489 - DNA, 20 bp, Homo sapiens
aacaagtcacagctgcagct

SEQ ID NO: 1463490 - DNA, 17 bp, Homo sapiens
aacaagtcatttttgta

SEQ ID NO: 1463491 - DNA, 17 bp, Homo sapiens
aacaagttgttaaaaca

SEQ ID NO: 1463492 - DNA, 23 bp, Homo sapiens
aacaagttgttaaaacatttaat

SEQ ID NO: 1463493 - DNA, 15 bp, Homo sapiens
aacaataaagggaga

SEQ ID NO: 1463494 - DNA, 17 bp, Homo sapiens
aacaataaatgaatgaa

SEQ ID NO: 1463495 - DNA, 15 bp, Homo sapiens
aacaataaatgtgca

SEQ ID NO: 1463496 - DNA, 12 bp, Homo sapiens
aacaataataaa

SEQ ID NO: 1463497 - DNA, 13 bp, Homo sapiens
aacaataataaag

SEQ ID NO: 1463498 - DNA, 16 bp, Homo sapiens
aacagcagaggttctt

SEQ ID NO: 1463499 - DNA, 13 bp, Homo sapiens
aacagcagctcat

SEQ ID NO: 1463500 - DNA, 20 bp, Homo sapiens
aacagcagtctccttcagca

SEQ ID NO: 1463501 - DNA, 12 bp, Homo sapiens
aacagcagtgat

SEQ ID NO: 1463502 - DNA, 22 bp, Homo sapiens
aacagcatgaataaaacactca

SEQ ID NO: 1463503 - DNA, 18 bp, Homo sapiens
aacagcatgtctactgct

SEQ ID NO: 1463504 - DNA, 12 bp, Homo sapiens
aacagccagcaa

SEQ ID NO: 1463505 - DNA, 19 bp, Homo sapiens
aacagccctcctctgcact

SEQ ID NO: 1463506 - DNA, 15 bp, Homo sapiens
aacagcctgcctgtc

SEQ ID NO: 1463507 - DNA, 21 bp, Homo sapiens
aacagcgggagacctgtgcta

SEQ ID NO: 1463508 - DNA, 17 bp, Homo sapiens
aacagctgcattagaaa

SEQ ID NO: 1463509 - DNA, 18 bp, Homo sapiens
aacagctgtcacaacttg

SEQ ID NO: 1463510 - DNA, 11 bp, Homo sapiens
aacagctgtgt

SEQ ID NO: 1463511 - DNA, 12 bp, Homo sapiens
aacagcttccct

SEQ ID NO: 1463512 - DNA, 15 bp, Homo sapiens
aacagcttgccaggg

SEQ ID NO: 1463513 - DNA, 14 bp, Homo sapiens
aacagcttgctgtc

SEQ ID NO: 1463514 - DNA, 12 bp, Homo sapiens
aacaggaatcct

SEQ ID NO: 1463515 - DNA, 14 bp, Homo sapiens
aacaggaatctcag

SEQ ID NO: 1463516 - DNA, 20 bp, Homo sapiens
aacaggaattttattttgct

SEQ ID NO: 1463517 - DNA, 16 bp, Homo sapiens
aacaggacctctgctt

SEQ ID NO: 1463518 - DNA, 20 bp, Homo sapiens
aacaggcaaagttttacaga

SEQ ID NO: 1463519 - DNA, 13 bp, Homo sapiens
aacaggcccagca

SEQ ID NO: 1463520 - DNA, 15 bp, Homo sapiens
aacaggcctctccat

SEQ ID NO: 1463521 - DNA, 18 bp, Homo sapiens
aacaggctactctcctcg

SEQ ID NO: 1463522 - DNA, 20 bp, Homo sapiens
aacaggctcaatattcctga

SEQ ID NO: 1463523 - DNA, 21 bp, Homo sapiens
aacaggctgttctgcactgaa

SEQ ID NO: 1463524 - DNA, 23 bp, Homo sapiens
aacaggctgttctgcactgaaaa

SEQ ID NO: 1463525 - DNA, 12 bp, Homo sapiens
aacaggcttgga

SEQ ID NO: 1463526 - DNA, 19 bp, Homo sapiens
aacaggcttggagggaagg

SEQ ID NO: 1463527 - DNA, 23 bp, Homo sapiens
aacagggacttgtttagagagcc

SEQ ID NO: 1463528 - DNA, 19 bp, Homo sapiens
aacagggagaagtagctag

SEQ ID NO: 1463529 - DNA, 21 bp, Homo sapiens
aacagggattgattttaaaat

SEQ ID NO: 1463530 - DNA, 16 bp, Homo sapiens
aacagggccacataga

SEQ ID NO: 1463531 - DNA, 20 bp, Homo sapiens
aacagggccacatagatgct

SEQ ID NO: 1463532 - DNA, 15 bp, Homo sapiens
aacaggggaggaaaa

SEQ ID NO: 1463533 - DNA, 23 bp, Homo sapiens
aacaggtagtattacaccaccgg

SEQ ID NO: 1463534 - DNA, 13 bp, Homo sapiens
aacaggtctcctc

SEQ ID NO: 1463535 - DNA, 18 bp, Homo sapiens
aacaggtctcctcttaaa

SEQ ID NO: 1463536 - DNA, 16 bp, Homo sapiens
aacaggttttataatt

SEQ ID NO: 1463537 - DNA, 16 bp, Homo sapiens
aacagtaaaccactga

SEQ ID NO: 1463538 - DNA, 17 bp, Homo sapiens
aacagtaaaccactgaa

SEQ ID NO: 1463539 - DNA, 19 bp, Homo sapiens
aacagtaaaccactgaaaa

SEQ ID NO: 1463540 - DNA, 20 bp, Homo sapiens
aacagtacagaaggcaaagt

SEQ ID NO: 1463541 - DNA, 20 bp, Homo sapiens
aacagtatgtgggatattga

SEQ ID NO: 1463542 - DNA, 13 bp, Homo sapiens
aacagtccttgct

SEQ ID NO: 1463543 - DNA, 14 bp, Homo sapiens
aacagtccttgctt

SEQ ID NO: 1463544 - DNA, 13 bp, Homo sapiens
aacagtctcagga

SEQ ID NO: 1463545 - DNA, 21 bp, Homo sapiens
aacagtgagcctgaattttgt

SEQ ID NO: 1463546 - DNA, 13 bp, Homo sapiens
aacagtgcctgct

SEQ ID NO: 1463547 - DNA, 14 bp, Homo sapiens
aacagtgcctgctg

SEQ ID NO: 1463548 - DNA, 15 bp, Homo sapiens
aacagtgcctgctga

SEQ ID NO: 1463549 - DNA, 15 bp, Homo sapiens
aacagtggaatataa

SEQ ID NO: 1463550 - DNA, 11 bp, Homo sapiens
aacagtggctg

SEQ ID NO: 1463551 - DNA, 22 bp, Homo sapiens
aacagtgtggtttgggaaagat

SEQ ID NO: 1463552 - DNA, 15 bp, Homo sapiens
aacagtgtttcccat

SEQ ID NO: 1463553 - DNA, 17 bp, Homo sapiens
aacagttaactttcaga

SEQ ID NO: 1463554 - DNA, 18 bp, Homo sapiens
aacagttaactttcagaa

SEQ ID NO: 1463555 - DNA, 20 bp, Homo sapiens
aacagttaactttcagaaga

SEQ ID NO: 1463556 - DNA, 21 bp, Homo sapiens
aacagttaattagttaacagt

SEQ ID NO: 1463557 - DNA, 13 bp, Homo sapiens
aacagttcaaaga

SEQ ID NO: 1463558 - DNA, 14 bp, Homo sapiens
aacagttcaaagaa

SEQ ID NO: 1463559 - DNA, 15 bp, Homo sapiens
aacagttcaaagaag

SEQ ID NO: 1463560 - DNA, 17 bp, Homo sapiens
aacagttcaaagaagtc

SEQ ID NO: 1463561 - DNA, 13 bp, Homo sapiens
aacagttctgagc

SEQ ID NO: 1463562 - DNA, 18 bp, Homo sapiens
aacagttctgagctgtaa

SEQ ID NO: 1463563 - DNA, 21 bp, Homo sapiens
aacagttctgagctgtaattt

SEQ ID NO: 1463564 - DNA, 15 bp, Homo sapiens
aacagttgatttccc

SEQ ID NO: 1463565 - DNA, 17 bp, Homo sapiens
aacagttggtgatttta

SEQ ID NO: 1463566 - DNA, 13 bp, Homo sapiens
aacagttgtattt

SEQ ID NO: 1463567 - DNA, 16 bp, Homo sapiens
aacagtttcttgcttg

SEQ ID NO: 1463568 - DNA, 23 bp, Homo sapiens
aacagtttcttgcttggaagcca

SEQ ID NO: 1463569 - DNA, 12 bp, Homo sapiens
aacagttttgtg

SEQ ID NO: 1463570 - DNA, 23 bp, Homo sapiens
aacataaaaagcagaattttaat

SEQ ID NO: 1463571 - DNA, 16 bp, Homo sapiens
aacataaaacaaaacc

SEQ ID NO: 1463572 - DNA, 21 bp, Homo sapiens
aacataaaacaaaaccaagcc

SEQ ID NO: 1463573 - DNA, 14 bp, Homo sapiens
aacataaaatacaa

SEQ ID NO: 1463574 - DNA, 14 bp, Homo sapiens
aacataaaatctgt

SEQ ID NO: 1463575 - DNA, 19 bp, Homo sapiens
aacataaagcaaatagaca

SEQ ID NO: 1463576 - DNA, 21 bp, Homo sapiens
aacataaagttgtattgcatg

SEQ ID NO: 1463577 - DNA, 16 bp, Homo sapiens
aacataatctagttta

SEQ ID NO: 1463578 - DNA, 22 bp, Homo sapiens
aacataatcttctgccttctca

SEQ ID NO: 1463579 - DNA, 18 bp, Homo sapiens
aacataattcttgtatat

SEQ ID NO: 1463580 - DNA, 17 bp, Homo sapiens
aacatacaagaaaatgt

SEQ ID NO: 1463581 - DNA, 18 bp, Homo sapiens
aacatacagaggatgcct

SEQ ID NO: 1463582 - DNA, 21 bp, Homo sapiens
aacatagtgagacccctgtct

SEQ ID NO: 1463583 - DNA, 13 bp, Homo sapiens
aacatataatgtt

SEQ ID NO: 1463584 - DNA, 19 bp, Homo sapiens
aacatatatttattgagta

SEQ ID NO: 1463585 - DNA, 14 bp, Homo sapiens
aacatatctaaagt

SEQ ID NO: 1463586 - DNA, 17 bp, Homo sapiens
aacatatctaaagtcat

SEQ ID NO: 1463587 - DNA, 22 bp, Homo sapiens
aacatattcatgaaatgtggaa

SEQ ID NO: 1463588 - DNA, 14 bp, Homo sapiens
aacatattgttgaa

SEQ ID NO: 1463589 - DNA, 18 bp, Homo sapiens
aacatatttttatacttt

SEQ ID NO: 1463590 - DNA, 13 bp, Homo sapiens
aacatcacagccc

SEQ ID NO: 1463591 - DNA, 17 bp, Homo sapiens
aacatcagacctgtctt

SEQ ID NO: 1463592 - DNA, 22 bp, Homo sapiens
aacatcagggtgtggcattttg

SEQ ID NO: 1463593 - DNA, 19 bp, Homo sapiens
aacatcagttactctgaag

SEQ ID NO: 1463594 - DNA, 20 bp, Homo sapiens
aacatcataattacattcct

SEQ ID NO: 1463595 - DNA, 21 bp, Homo sapiens
aacatcatcaggaagcctgtg

SEQ ID NO: 1463596 - DNA, 17 bp, Homo sapiens
aacatccaaccttccca

SEQ ID NO: 1463597 - DNA, 13 bp, Homo sapiens
aacatctctgaat

SEQ ID NO: 1463598 - DNA, 14 bp, Homo sapiens
aacatctctgcagt

SEQ ID NO: 1463599 - DNA, 15 bp, Homo sapiens
aacatctctgcagtt

SEQ ID NO: 1463600 - DNA, 21 bp, Homo sapiens
aacatctctggcccagaaagc

SEQ ID NO: 1463601 - DNA, 12 bp, Homo sapiens
aacatctgaaaa

SEQ ID NO: 1463602 - DNA, 16 bp, Homo sapiens
aacatctgaaaagaaa

SEQ ID NO: 1463603 - DNA, 22 bp, Homo sapiens
aacatctgaaaagaaatgctaa

SEQ ID NO: 1463604 - DNA, 16 bp, Homo sapiens
aacatctgaaagccac

SEQ ID NO: 1463605 - DNA, 21 bp, Homo sapiens
aacatcttggctgttctagac

SEQ ID NO: 1463606 - DNA, 18 bp, Homo sapiens
aacatctttaaggggagg

SEQ ID NO: 1463607 - DNA, 15 bp, Homo sapiens
aacatctttgcgaaa

SEQ ID NO: 1463608 - DNA, 22 bp, Homo sapiens
aacatcttttcctgatggctgg

SEQ ID NO: 1463609 - DNA, 15 bp, Homo sapiens
aacatcttttcttgc

SEQ ID NO: 1463610 - DNA, 21 bp, Homo sapiens
aacatgaaaatttttgagtta

SEQ ID NO: 1463611 - DNA, 20 bp, Homo sapiens
aacatgaacacccttagaaa

SEQ ID NO: 1463612 - DNA, 14 bp, Homo sapiens
aacatgacactgac

SEQ ID NO: 1463613 - DNA, 22 bp, Homo sapiens
aacctgtgatctagtccttgtc

SEQ ID NO: 1463614 - DNA, 14 bp, Homo sapiens
aacctgtgccaggc

SEQ ID NO: 1463615 - DNA, 16 bp, Homo sapiens
aacctgtgtgcatctg

SEQ ID NO: 1463616 - DNA, 21 bp, Homo sapiens
aacctgttacactgggctggg

SEQ ID NO: 1463617 - DNA, 18 bp, Homo sapiens
aacctgttcttagagtgt

SEQ ID NO: 1463618 - DNA, 19 bp, Homo sapiens
aacctgttcttagagtgta

SEQ ID NO: 1463619 - DNA, 22 bp, Homo sapiens
aacctgttcttagagtgtagct

SEQ ID NO: 1463620 - DNA, 18 bp, Homo sapiens
aacctgtttttttttcat

SEQ ID NO: 1463621 - DNA, 13 bp, Homo sapiens
aaccttaagatac

SEQ ID NO: 1463622 - DNA, 19 bp, Homo sapiens
aaccttcacatctgtcacg

SEQ ID NO: 1463623 - DNA, 15 bp, Homo sapiens
aaccttccacccagt

SEQ ID NO: 1463624 - DNA, 13 bp, Homo sapiens
aaccttccatctc

SEQ ID NO: 1463625 - DNA, 20 bp, Homo sapiens
aaccttgaaaaaaaacagtg

SEQ ID NO: 1463626 - DNA, 16 bp, Homo sapiens
aaccttgaatgctgcc

SEQ ID NO: 1463627 - DNA, 22 bp, Homo sapiens
aaccttggaccactcctgtccc

SEQ ID NO: 1463628 - DNA, 14 bp, Homo sapiens
aaccttgtgtaaga

SEQ ID NO: 1463629 - DNA, 23 bp, Homo sapiens
aaccttgttttggacagtttacc

SEQ ID NO: 1463630 - DNA, 20 bp, Homo sapiens
aacctttaaagtaaaggcct

SEQ ID NO: 1463631 - DNA, 17 bp, Homo sapiens
aacctttgctatgtaag

SEQ ID NO: 1463632 - DNA, 23 bp, Homo sapiens
aacgaaactccatctcaaaacaa

SEQ ID NO: 1463633 - DNA, 23 bp, Homo sapiens
aacgaagagttcccttgaaactt

SEQ ID NO: 1463634 - DNA, 12 bp, Homo sapiens
aacgaataaagg

SEQ ID NO: 1463635 - DNA, 19 bp, Homo sapiens
aacgaccaaactcagttcg

SEQ ID NO: 1463636 - DNA, 20 bp, Homo sapiens
aacgagatttgccaaaaact

SEQ ID NO: 1463637 - DNA, 15 bp, Homo sapiens
aacgagcactggcca

SEQ ID NO: 1463638 - DNA, 16 bp, Homo sapiens
aacgagcactggccag

SEQ ID NO: 1463639 - DNA, 16 bp, Homo sapiens
aacgagcagcccaggg

SEQ ID NO: 1463640 - DNA, 23 bp, Homo sapiens
aacgatacaaatttggccttaag

SEQ ID NO: 1463641 - DNA, 20 bp, Homo sapiens
aacgatgtgcaatacatttt

SEQ ID NO: 1463642 - DNA, 12 bp, Homo sapiens
aacgcacaggaa

SEQ ID NO: 1463643 - DNA, 13 bp, Homo sapiens
aacgcattgccac

SEQ ID NO: 1463644 - DNA, 15 bp, Homo sapiens
aacgccagtctccca

SEQ ID NO: 1463645 - DNA, 16 bp, Homo sapiens
aacgcccctccaaacc

SEQ ID NO: 1463646 - DNA, 23 bp, Homo sapiens
aacgcccctccaaacctccagcc

SEQ ID NO: 1463647 - DNA, 18 bp, Homo sapiens
aacgcccctgtggccaac

SEQ ID NO: 1463648 - DNA, 13 bp, Homo sapiens
aacgcctccccct

SEQ ID NO: 1463649 - DNA, 20 bp, Homo sapiens
aacgctcttagctttctcag

SEQ ID NO: 1463650 - DNA, 14 bp, Homo sapiens
aacggaccaaagca

SEQ ID NO: 1463651 - DNA, 16 bp, Homo sapiens
aacggaggaagcccac

SEQ ID NO: 1463652 - DNA, 22 bp, Homo sapiens
aacggaggcctgcgaccctggg

SEQ ID NO: 1463653 - DNA, 17 bp, Homo sapiens
aacgggctgccctgcca

SEQ ID NO: 1463654 - DNA, 16 bp, Homo sapiens
aacggggctcttctca

SEQ ID NO: 1463655 - DNA, 15 bp, Homo sapiens
aacggggtccttcaa

SEQ ID NO: 1463656 - DNA, 14 bp, Homo sapiens
aacgggtcagtatt

SEQ ID NO: 1463657 - DNA, 17 bp, Homo sapiens
aacggtaaatttctgtg

SEQ ID NO: 1463658 - DNA, 20 bp, Homo sapiens
aacggtgctaaaaatgaaaa

SEQ ID NO: 1463659 - DNA, 23 bp, Homo sapiens
aacggtttttttctttggctgca

SEQ ID NO: 1463660 - DNA, 14 bp, Homo sapiens
aacgtcatctcagg

SEQ ID NO: 1463661 - DNA, 16 bp, Homo sapiens
aacgtcccacactttg

SEQ ID NO: 1463662 - DNA, 22 bp, Homo sapiens
aacgtcccacactttgaagcaa

SEQ ID NO: 1463663 - DNA, 13 bp, Homo sapiens
aacgtgaaattct

SEQ ID NO: 1463664 - DNA, 15 bp, Homo sapiens
aacgtgatgatcagc

SEQ ID NO: 1463665 - DNA, 15 bp, Homo sapiens
aacgtgatgtgccac

SEQ ID NO: 1463666 - DNA, 17 bp, Homo sapiens
aacgtgatgtgccacta

SEQ ID NO: 1463667 - DNA, 15 bp, Homo sapiens
aacgtgcaaagccaa

SEQ ID NO: 1463668 - DNA, 18 bp, Homo sapiens
aacgtgcaaagccaaggc

SEQ ID NO: 1463669 - DNA, 13 bp, Homo sapiens
aacgtggtcacct

SEQ ID NO: 1463670 - DNA, 16 bp, Homo sapiens
aacgtgttcaatattt

SEQ ID NO: 1463671 - DNA, 14 bp, Homo sapiens
aacgttgctcccca

SEQ ID NO: 1463672 - DNA, 11 bp, Homo sapiens
aacgttttctt

SEQ ID NO: 1463673 - DNA, 17 bp, Homo sapiens
aacgttttcttctttcc

SEQ ID NO: 1463674 - DNA, 17 bp, Homo sapiens
aactaaactcatttata

SEQ ID NO: 1463675 - DNA, 22 bp, Homo sapiens
aactaaaggacttgatgtacat

SEQ ID NO: 1463676 - DNA, 21 bp, Homo sapiens
aactaaatgtgcaatagaagg

SEQ ID NO: 1463677 - DNA, 16 bp, Homo sapiens
aactaaattttaaagc

SEQ ID NO: 1463678 - DNA, 14 bp, Homo sapiens
aactaagagaaact

SEQ ID NO: 1463679 - DNA, 17 bp, Homo sapiens
aactaagagaaactgtg

SEQ ID NO: 1463680 - DNA, 16 bp, Homo sapiens
aactaaggtgaagaat

SEQ ID NO: 1463681 - DNA, 22 bp, Homo sapiens
aactaatacgtgccagatataa

SEQ ID NO: 1463682 - DNA, 13 bp, Homo sapiens
aactaatttgtgg

SEQ ID NO: 1463683 - DNA, 15 bp, Homo sapiens
aactaatttttgtat

SEQ ID NO: 1463684 - DNA, 12 bp, Homo sapiens
aactacaaagta

SEQ ID NO: 1463685 - DNA, 16 bp, Homo sapiens
aactacaaagtaaaat

SEQ ID NO: 1463686 - DNA, 22 bp, Homo sapiens
aactacaaccaagctctctgca

SEQ ID NO: 1463687 - DNA, 14 bp, Homo sapiens
aactacataaaaat

SEQ ID NO: 1463688 - DNA, 15 bp, Homo sapiens
aactacattttgcaa

SEQ ID NO: 1463689 - DNA, 12 bp, Homo sapiens
aactacctcctc

SEQ ID NO: 1463690 - DNA, 16 bp, Homo sapiens
aactacctcctcactt

SEQ ID NO: 1463691 - DNA, 14 bp, Homo sapiens
aactactaagaata

SEQ ID NO: 1463692 - DNA, 18 bp, Homo sapiens
aactactaagaataaata

SEQ ID NO: 1463693 - DNA, 20 bp, Homo sapiens
aactactactggtgatgcct

SEQ ID NO: 1463694 - DNA, 12 bp, Homo sapiens
aactactgaata

SEQ ID NO: 1463695 - DNA, 17 bp, Homo sapiens
aactactgacagggagc

SEQ ID NO: 1463696 - DNA, 12 bp, Homo sapiens
aactactgtact

SEQ ID NO: 1463697 - DNA, 13 bp, Homo sapiens
aactactgtactt

SEQ ID NO: 1463698 - DNA, 16 bp, Homo sapiens
aactactgtactttgc

SEQ ID NO: 1463699 - DNA, 17 bp, Homo sapiens
aactactttataactaa

SEQ ID NO: 1463700 - DNA, 16 bp, Homo sapiens
aactagaaagaaggac

SEQ ID NO: 1463701 - DNA, 16 bp, Homo sapiens
aactagaaatctgcca

SEQ ID NO: 1463702 - DNA, 14 bp, Homo sapiens
aactagaattagta

SEQ ID NO: 1463703 - DNA, 20 bp, Homo sapiens
aactagaattagtatgtctg

SEQ ID NO: 1463704 - DNA, 19 bp, Homo sapiens
aactagaatttattcaatt

SEQ ID NO: 1463705 - DNA, 23 bp, Homo sapiens
aactagccagacaaaatttgaga

SEQ ID NO: 1463706 - DNA, 13 bp, Homo sapiens
aactagcccctgg

SEQ ID NO: 1463707 - DNA, 22 bp, Homo sapiens
aactataaagttttatttgaat

SEQ ID NO: 1463708 - DNA, 15 bp, Homo sapiens
aactataaggtgcct

SEQ ID NO: 1463709 - DNA, 17 bp, Homo sapiens
aactataaggtgcctca

SEQ ID NO: 1463710 - DNA, 19 bp, Homo sapiens
aactataaggtgcctcagt

SEQ ID NO: 1463711 - DNA, 23 bp, Homo sapiens
aactataaggtgcctcagttttc

SEQ ID NO: 1463712 - DNA, 23 bp, Homo sapiens
aactatagcttgcagaactgtag

SEQ ID NO: 1463713 - DNA, 23 bp, Homo sapiens
aactatgcatggtgccccaggac

SEQ ID NO: 1463714 - DNA, 23 bp, Homo sapiens
aactatgcctatgtagtgtcttt

SEQ ID NO: 1463715 - DNA, 16 bp, Homo sapiens
aactatgggttatttt

SEQ ID NO: 1463716 - DNA, 22 bp, Homo sapiens
aactatgttcctaacaaaatga

SEQ ID NO: 1463717 - DNA, 18 bp, Homo sapiens
aactattatgattattta

SEQ ID NO: 1463718 - DNA, 23 bp, Homo sapiens
aactattcaggagagtagaacag

SEQ ID NO: 1463719 - DNA, 19 bp, Homo sapiens
aactattgcctctggacgt

SEQ ID NO: 1463720 - DNA, 20 bp, Homo sapiens
aactattgggtgaatatggt

SEQ ID NO: 1463721 - DNA, 22 bp, Homo sapiens
aactattgggtgaatatggtgg

SEQ ID NO: 1463722 - DNA, 14 bp, Homo sapiens
aactatttactttt

SEQ ID NO: 1463723 - DNA, 22 bp, Homo sapiens
aactatttatatcacacaatat

SEQ ID NO: 1463724 - DNA, 18 bp, Homo sapiens
aactatttcttatatatg

SEQ ID NO: 1463725 - DNA, 13 bp, Homo sapiens
aactatttttgta

SEQ ID NO: 1463726 - DNA, 13 bp, Homo sapiens
aactcaaaagttg

SEQ ID NO: 1463727 - DNA, 16 bp, Homo sapiens
aactcaaaatatttgt

SEQ ID NO: 1463728 - DNA, 20 bp, Homo sapiens
aacttggtcagagccactct

SEQ ID NO: 1463729 - DNA, 15 bp, Homo sapiens
aacttgtaaatgctg

SEQ ID NO: 1463730 - DNA, 14 bp, Homo sapiens
aacttgtatactta

SEQ ID NO: 1463731 - DNA, 13 bp, Homo sapiens
aacttgtatattc

SEQ ID NO: 1463732 - DNA, 15 bp, Homo sapiens
aacttgtatattcca

SEQ ID NO: 1463733 - DNA, 21 bp, Homo sapiens
aacttgtcctatgtcaatttg

SEQ ID NO: 1463734 - DNA, 19 bp, Homo sapiens
aacttgtctaaataagttt

SEQ ID NO: 1463735 - DNA, 21 bp, Homo sapiens
aacttgtctgggaattgtgtg

SEQ ID NO: 1463736 - DNA, 20 bp, Homo sapiens
aacttgtctttttctggact

SEQ ID NO: 1463737 - DNA, 19 bp, Homo sapiens
aacttgtgagcatcagagg

SEQ ID NO: 1463738 - DNA, 20 bp, Homo sapiens
aacttgtgtactgataaaat

SEQ ID NO: 1463739 - DNA, 16 bp, Homo sapiens
aacttgtttgctgtga

SEQ ID NO: 1463740 - DNA, 14 bp, Homo sapiens
aactttaatgtttt

SEQ ID NO: 1463741 - DNA, 20 bp, Homo sapiens
aactttaattctctttcaaa

SEQ ID NO: 1463742 - DNA, 15 bp, Homo sapiens
aactttataaagata

SEQ ID NO: 1463743 - DNA, 23 bp, Homo sapiens
aactttatacccagaaagttatt

SEQ ID NO: 1463744 - DNA, 17 bp, Homo sapiens
aactttcacttcttcct

SEQ ID NO: 1463745 - DNA, 16 bp, Homo sapiens
aactttcactttgaaa

SEQ ID NO: 1463746 - DNA, 12 bp, Homo sapiens
aactttcatacc

SEQ ID NO: 1463747 - DNA, 14 bp, Homo sapiens
aactttcctcgcct

SEQ ID NO: 1463748 - DNA, 16 bp, Homo sapiens
aactttcgttgttatt

SEQ ID NO: 1463749 - DNA, 14 bp, Homo sapiens
aactttctggtccc

SEQ ID NO: 1463750 - DNA, 19 bp, Homo sapiens
aactttgcagcataccaat

SEQ ID NO: 1463751 - DNA, 16 bp, Homo sapiens
aactttggaggcaaat

SEQ ID NO: 1463752 - DNA, 12 bp, Homo sapiens
aactttgggaaa

SEQ ID NO: 1463753 - DNA, 22 bp, Homo sapiens
aactttgggaaaacatgttaat

SEQ ID NO: 1463754 - DNA, 14 bp, Homo sapiens
aacttttaaagaaa

SEQ ID NO: 1463755 - DNA, 11 bp, Homo sapiens
aacttttaatt

SEQ ID NO: 1463756 - DNA, 17 bp, Homo sapiens
aacttttcaatgacatt

SEQ ID NO: 1463757 - DNA, 16 bp, Homo sapiens
aacttttctaacagaa

SEQ ID NO: 1463758 - DNA, 13 bp, Homo sapiens
aacttttctaaga

SEQ ID NO: 1463759 - DNA, 19 bp, Homo sapiens
aacttttctaagaaaagca

SEQ ID NO: 1463760 - DNA, 14 bp, Homo sapiens
aacttttgtaaata

SEQ ID NO: 1463761 - DNA, 11 bp, Homo sapiens
aacttttgtac

SEQ ID NO: 1463762 - DNA, 13 bp, Homo sapiens
aacttttgtgaat

SEQ ID NO: 1463763 - DNA, 15 bp, Homo sapiens
aactttttgttctgg

SEQ ID NO: 1463764 - DNA, 13 bp, Homo sapiens
aacttttttccac

SEQ ID NO: 1463765 - DNA, 18 bp, Homo sapiens
aacttttttggtgtgtgt

SEQ ID NO: 1463766 - DNA, 16 bp, Homo sapiens
aacttttttgtggcaa

SEQ ID NO: 1463767 - DNA, 15 bp, Homo sapiens
aacttttttgtgtat

SEQ ID NO: 1463768 - DNA, 19 bp, Homo sapiens
aacttttttttctctcttt

SEQ ID NO: 1463769 - DNA, 16 bp, Homo sapiens
aacttttttttgagaa

SEQ ID NO: 1463770 - DNA, 17 bp, Homo sapiens
aacttttttttgagaat

SEQ ID NO: 1463771 - DNA, 18 bp, Homo sapiens
aagaaaaaaaaaaaagcc

SEQ ID NO: 1463772 - DNA, 17 bp, Homo sapiens
aagaaaaaaaagaaagc

SEQ ID NO: 1463773 - DNA, 15 bp, Homo sapiens
aagaaaaaaatacta

SEQ ID NO: 1463774 - DNA, 14 bp, Homo sapiens
aagaaaaacatgtc

SEQ ID NO: 1463775 - DNA, 19 bp, Homo sapiens
aagaaaaacatgtcatgta

SEQ ID NO: 1463776 - DNA, 13 bp, Homo sapiens
aagaaaaagtaca

SEQ ID NO: 1463777 - DNA, 13 bp, Homo sapiens
aagaaaaatattt

SEQ ID NO: 1463778 - DNA, 22 bp, Homo sapiens
aagaaaacaaaaccaaaagtta

SEQ ID NO: 1463779 - DNA, 14 bp, Homo sapiens
aagaaaacaacttc

SEQ ID NO: 1463780 - DNA, 13 bp, Homo sapiens
aagaaaacatcta

SEQ ID NO: 1463781 - DNA, 17 bp, Homo sapiens
aagaaaagaattacaga

SEQ ID NO: 1463782 - DNA, 15 bp, Homo sapiens
aagaaaagacatttt

SEQ ID NO: 1463783 - DNA, 11 bp, Homo sapiens
aagaaaagata

SEQ ID NO: 1463784 - DNA, 17 bp, Homo sapiens
aagaaaagcctgaacta

SEQ ID NO: 1463785 - DNA, 13 bp, Homo sapiens
aagaaaaggacaa

SEQ ID NO: 1463786 - DNA, 15 bp, Homo sapiens
aagaaaaggacaaat

SEQ ID NO: 1463787 - DNA, 17 bp, Homo sapiens
aagaaaaggatttaagc

SEQ ID NO: 1463788 - DNA, 19 bp, Homo sapiens
aagaaaaggatttaagcaa

SEQ ID NO: 1463789 - DNA, 15 bp, Homo sapiens
aagaaaagtgcatat

SEQ ID NO: 1463790 - DNA, 20 bp, Homo sapiens
aagaaaagtgcatatttatc

SEQ ID NO: 1463791 - DNA, 22 bp, Homo sapiens
aagaaaagtgcatatttatcca

SEQ ID NO: 1463792 - DNA, 20 bp, Homo sapiens
aagaaaatacttaaatgtta

SEQ ID NO: 1463793 - DNA, 12 bp, Homo sapiens
aagaaaatagat

SEQ ID NO: 1463794 - DNA, 18 bp, Homo sapiens
aagaaaatggctaataaa

SEQ ID NO: 1463795 - DNA, 14 bp, Homo sapiens
aagaaaatgttacg

SEQ ID NO: 1463796 - DNA, 22 bp, Homo sapiens
aagaaaatgttacggcatcaca

SEQ ID NO: 1463797 - DNA, 13 bp, Homo sapiens
aagaaacatttcc

SEQ ID NO: 1463798 - DNA, 19 bp, Homo sapiens
aagaaaccttgctctcctc

SEQ ID NO: 1463799 - DNA, 17 bp, Homo sapiens
aagaaactatacatcat

SEQ ID NO: 1463800 - DNA, 14 bp, Homo sapiens
aagaaactgaatga

SEQ ID NO: 1463801 - DNA, 19 bp, Homo sapiens
aagaaactgaggaattttc

SEQ ID NO: 1463802 - DNA, 20 bp, Homo sapiens
aagaaactgaggaattttct

SEQ ID NO: 1463803 - DNA, 14 bp, Homo sapiens
aagaaactttgttt

SEQ ID NO: 1463804 - DNA, 16 bp, Homo sapiens
aagaaacttttttatt

SEQ ID NO: 1463805 - DNA, 20 bp, Homo sapiens
aagaaagactatctaaatgt

SEQ ID NO: 1463806 - DNA, 17 bp, Homo sapiens
aagaaagatttgttact

SEQ ID NO: 1463807 - DNA, 17 bp, Homo sapiens
aagaaagcctaaaattg

SEQ ID NO: 1463808 - DNA, 22 bp, Homo sapiens
aagaaagcttcaaactgcatga

SEQ ID NO: 1463809 - DNA, 16 bp, Homo sapiens
aagaaaggaaaagaaa

SEQ ID NO: 1463810 - DNA, 20 bp, Homo sapiens
aagaaaggctgttaaataca

SEQ ID NO: 1463811 - DNA, 15 bp, Homo sapiens
aagaaatagttctgt

SEQ ID NO: 1463812 - DNA, 23 bp, Homo sapiens
aagaaatcatgtccatacacttt

SEQ ID NO: 1463813 - DNA, 20 bp, Homo sapiens
aagaaatctcctaacaaaag

SEQ ID NO: 1463814 - DNA, 15 bp, Homo sapiens
aagaaatctggccca

SEQ ID NO: 1463815 - DNA, 20 bp, Homo sapiens
aagaaatctggcccagggtg

SEQ ID NO: 1463816 - DNA, 12 bp, Homo sapiens
aagaaatgatgt

SEQ ID NO: 1463817 - DNA, 13 bp, Homo sapiens
aagaaatgatgtt

SEQ ID NO: 1463818 - DNA, 21 bp, Homo sapiens
aagaaatgattcaaattgctg

SEQ ID NO: 1463819 - DNA, 23 bp, Homo sapiens
aagaaatgattcaaattgctgct

SEQ ID NO: 1463820 - DNA, 19 bp, Homo sapiens
aagaaatgctaatgtaatc

SEQ ID NO: 1463821 - DNA, 18 bp, Homo sapiens
aagaaatggcgtctgctc

SEQ ID NO: 1463822 - DNA, 19 bp, Homo sapiens
aagaaatgggtttcttgcc

SEQ ID NO: 1463823 - DNA, 16 bp, Homo sapiens
aagaaattaacaataa

SEQ ID NO: 1463824 - DNA, 14 bp, Homo sapiens
aagaaattcagaac

SEQ ID NO: 1463825 - DNA, 22 bp, Homo sapiens
aagaaattccatacttctctca

SEQ ID NO: 1463826 - DNA, 15 bp, Homo sapiens
aagaaatttgcagtt

SEQ ID NO: 1463827 - DNA, 18 bp, Homo sapiens
aagaacaacaaagacatg

SEQ ID NO: 1463828 - DNA, 19 bp, Homo sapiens
aagaacaagctcatctatt

SEQ ID NO: 1463829 - DNA, 15 bp, Homo sapiens
aagaacacagcatgt

SEQ ID NO: 1463830 - DNA, 19 bp, Homo sapiens
aagaacaccctatattttg

SEQ ID NO: 1463831 - DNA, 20 bp, Homo sapiens
aagaacacttttaataaact

SEQ ID NO: 1463832 - DNA, 14 bp, Homo sapiens
aagaacagaaaaca

SEQ ID NO: 1463833 - DNA, 12 bp, Homo sapiens
aagaacaggcct

SEQ ID NO: 1463834 - DNA, 14 bp, Homo sapiens
aagaaccatctttg

SEQ ID NO: 1463835 - DNA, 19 bp, Homo sapiens
aagaaccctatttaaaact

SEQ ID NO: 1463836 - DNA, 18 bp, Homo sapiens
aagaaccctgcagggccc

SEQ ID NO: 1463837 - DNA, 17 bp, Homo sapiens
aagaacctaacatttat

SEQ ID NO: 1463838 - DNA, 23 bp, Homo sapiens
aagaacctacagactccatctct

SEQ ID NO: 1463839 - DNA, 17 bp, Homo sapiens
aagaacggggctcttct

SEQ ID NO: 1463840 - DNA, 16 bp, Homo sapiens
aagaactccttatttt

SEQ ID NO: 1463841 - DNA, 20 bp, Homo sapiens
aagaactccttattttgtat

SEQ ID NO: 1463842 - DNA, 17 bp, Homo sapiens
aagaactctaaccagtg

SEQ ID NO: 1463843 - DNA, 14 bp, Homo sapiens
aagaactctctgga

SEQ ID NO: 1463844 - DNA, 20 bp, Homo sapiens
aagagcttgctccagattct

SEQ ID NO: 1463845 - DNA, 22 bp, Homo sapiens
aagagcttgctccagattctga

SEQ ID NO: 1463846 - DNA, 13 bp, Homo sapiens
aagaggaacagtg

SEQ ID NO: 1463847 - DNA, 18 bp, Homo sapiens
aagaggaacagtgtggtt

SEQ ID NO: 1463848 - DNA, 16 bp, Homo sapiens
aagaggaagaaattca

SEQ ID NO: 1463849 - DNA, 18 bp, Homo sapiens
aagaggaagaaattcagg

SEQ ID NO: 1463850 - DNA, 19 bp, Homo sapiens
aagaggaagaaattcaggt

SEQ ID NO: 1463851 - DNA, 14 bp, Homo sapiens
aagaggaagagaga

SEQ ID NO: 1463852 - DNA, 22 bp, Homo sapiens
aagaggaatctgtttctctgct

SEQ ID NO: 1463853 - DNA, 16 bp, Homo sapiens
aagaggagaccctgga

SEQ ID NO: 1463854 - DNA, 22 bp, Homo sapiens
aagaggaggggaagaggcctgt

SEQ ID NO: 1463855 - DNA, 16 bp, Homo sapiens
aagaggatgagcagag

SEQ ID NO: 1463856 - DNA, 15 bp, Homo sapiens
aagaggcaccaggaa

SEQ ID NO: 1463857 - DNA, 18 bp, Homo sapiens
aagaggcaccaggaagcc

SEQ ID NO: 1463858 - DNA, 23 bp, Homo sapiens
aagaggccacttagggaaagatg

SEQ ID NO: 1463859 - DNA, 23 bp, Homo sapiens
aagaggcccactagagggcccat

SEQ ID NO: 1463860 - DNA, 14 bp, Homo sapiens
aagaggcgggccag

SEQ ID NO: 1463861 - DNA, 13 bp, Homo sapiens
aagaggctgactt

SEQ ID NO: 1463862 - DNA, 18 bp, Homo sapiens
aagaggctgaggcctgga

SEQ ID NO: 1463863 - DNA, 21 bp, Homo sapiens
aagaggctgcccctctcacca

SEQ ID NO: 1463864 - DNA, 22 bp, Homo sapiens
aagaggctgcccctctcaccaa

SEQ ID NO: 1463865 - DNA, 11 bp, Homo sapiens
aagagggacag

SEQ ID NO: 1463866 - DNA, 14 bp, Homo sapiens
aagagggacaggct

SEQ ID NO: 1463867 - DNA, 14 bp, Homo sapiens
aagagggcccagcc

SEQ ID NO: 1463868 - DNA, 19 bp, Homo sapiens
aagaggggaccagaagcca

SEQ ID NO: 1463869 - DNA, 21 bp, Homo sapiens
aagaggggaggggcctaggga

SEQ ID NO: 1463870 - DNA, 11 bp, Homo sapiens
aagaggggcag

SEQ ID NO: 1463871 - DNA, 15 bp, Homo sapiens
aagaggggctgggct

SEQ ID NO: 1463872 - DNA, 22 bp, Homo sapiens
aagagggttttaggtagaaaaa

SEQ ID NO: 1463873 - DNA, 23 bp, Homo sapiens
aagagggttttaggtagaaaaac

SEQ ID NO: 1463874 - DNA, 23 bp, Homo sapiens
aagaggtactgtaatgggtaatt

SEQ ID NO: 1463875 - DNA, 13 bp, Homo sapiens
aagaggtctgagc

SEQ ID NO: 1463876 - DNA, 20 bp, Homo sapiens
aagaggtgaagtttatattt

SEQ ID NO: 1463877 - DNA, 13 bp, Homo sapiens
aagaggtgttatt

SEQ ID NO: 1463878 - DNA, 14 bp, Homo sapiens
aagaggttacttta

SEQ ID NO: 1463879 - DNA, 19 bp, Homo sapiens
aagagtagttgatgttgca

SEQ ID NO: 1463880 - DNA, 17 bp, Homo sapiens
aagagtatccttccttc

SEQ ID NO: 1463881 - DNA, 12 bp, Homo sapiens
aagagtattttt

SEQ ID NO: 1463882 - DNA, 15 bp, Homo sapiens
aagagtatttttaac

SEQ ID NO: 1463883 - DNA, 19 bp, Homo sapiens
aagagtatttttgacagaa

SEQ ID NO: 1463884 - DNA, 20 bp, Homo sapiens
aagagtccaggtaaatggta

SEQ ID NO: 1463885 - DNA, 13 bp, Homo sapiens
aagagtctaaaga

SEQ ID NO: 1463886 - DNA, 14 bp, Homo sapiens
aagagtctaaagat

SEQ ID NO: 1463887 - DNA, 20 bp, Homo sapiens
aagagtctagattcaaaggt

SEQ ID NO: 1463888 - DNA, 14 bp, Homo sapiens
aagagtcttccaat

SEQ ID NO: 1463889 - DNA, 16 bp, Homo sapiens
aagagtctttcttctt

SEQ ID NO: 1463890 - DNA, 22 bp, Homo sapiens
aagagtgaaataccattattat

SEQ ID NO: 1463891 - DNA, 19 bp, Homo sapiens
aagagtgagctctggtgga

SEQ ID NO: 1463892 - DNA, 23 bp, Homo sapiens
aagagtgatagtcttttgctttt

SEQ ID NO: 1463893 - DNA, 13 bp, Homo sapiens
aagagtgattgca

SEQ ID NO: 1463894 - DNA, 20 bp, Homo sapiens
aagagtgattgcagctttat

SEQ ID NO: 1463895 - DNA, 14 bp, Homo sapiens
aagagtgcattttc

SEQ ID NO: 1463896 - DNA, 16 bp, Homo sapiens
aagagtggaggaggag

SEQ ID NO: 1463897 - DNA, 18 bp, Homo sapiens
aagagtgtcactgagctg

SEQ ID NO: 1463898 - DNA, 21 bp, Homo sapiens
aagagttacaataaagtttac

SEQ ID NO: 1463899 - DNA, 20 bp, Homo sapiens
aagagttcccttgaaacttt

SEQ ID NO: 1463900 - DNA, 21 bp, Homo sapiens
aagagtttcagtttgttggaa

SEQ ID NO: 1463901 - DNA, 14 bp, Homo sapiens
aagataaaagaatg

SEQ ID NO: 1463902 - DNA, 18 bp, Homo sapiens
aagataaagaccagaaat

SEQ ID NO: 1463903 - DNA, 14 bp, Homo sapiens
aagataaagatgat

SEQ ID NO: 1463904 - DNA, 14 bp, Homo sapiens
aagataaatgtgct

SEQ ID NO: 1463905 - DNA, 19 bp, Homo sapiens
aagataacaagatctttca

SEQ ID NO: 1463906 - DNA, 18 bp, Homo sapiens
aagataacccttattcca

SEQ ID NO: 1463907 - DNA, 19 bp, Homo sapiens
aagataacttactgtatat

SEQ ID NO: 1463908 - DNA, 16 bp, Homo sapiens
aagataataatatatg

SEQ ID NO: 1463909 - DNA, 20 bp, Homo sapiens
aagatacaaattaattttac

SEQ ID NO: 1463910 - DNA, 14 bp, Homo sapiens
aagatacagacatt

SEQ ID NO: 1463911 - DNA, 22 bp, Homo sapiens
aagatacagacattcaatgaat

SEQ ID NO: 1463912 - DNA, 21 bp, Homo sapiens
aagatacctttttttttcttt

SEQ ID NO: 1463913 - DNA, 20 bp, Homo sapiens
aagatactcacatgagttct

SEQ ID NO: 1463914 - DNA, 13 bp, Homo sapiens
aagatagaaagct

SEQ ID NO: 1463915 - DNA, 17 bp, Homo sapiens
aagatagaaagctggac

SEQ ID NO: 1463916 - DNA, 19 bp, Homo sapiens
aagatagagtaaaaagaaa

SEQ ID NO: 1463917 - DNA, 17 bp, Homo sapiens
aagatagcgcatatatt

SEQ ID NO: 1463918 - DNA, 15 bp, Homo sapiens
aagatagtgtaactt

SEQ ID NO: 1463919 - DNA, 21 bp, Homo sapiens
aagatatacttgtttttgtaa

SEQ ID NO: 1463920 - DNA, 18 bp, Homo sapiens
aagatatcagagctctta

SEQ ID NO: 1463921 - DNA, 20 bp, Homo sapiens
aagatatccatctttttctt

SEQ ID NO: 1463922 - DNA, 13 bp, Homo sapiens
aagatattcaggt

SEQ ID NO: 1463923 - DNA, 13 bp, Homo sapiens
aagatattcctga

SEQ ID NO: 1463924 - DNA, 14 bp, Homo sapiens
aagatattgaagga

SEQ ID NO: 1463925 - DNA, 15 bp, Homo sapiens
aagatattgtacata

SEQ ID NO: 1463926 - DNA, 16 bp, Homo sapiens
aagatattgtacataa

SEQ ID NO: 1463927 - DNA, 17 bp, Homo sapiens
aagatattgtacataaa

SEQ ID NO: 1463928 - DNA, 22 bp, Homo sapiens
aagatatttttgaagtaaatta

SEQ ID NO: 1463929 - DNA, 20 bp, Homo sapiens
aagatcaaaaggttaataaa

SEQ ID NO: 1463930 - DNA, 21 bp, Homo sapiens
aagatcacttgttgttttact

SEQ ID NO: 1463931 - DNA, 14 bp, Homo sapiens
aagatccagaaata

SEQ ID NO: 1463932 - DNA, 19 bp, Homo sapiens
aagatccagaaatacttaa

SEQ ID NO: 1463933 - DNA, 23 bp, Homo sapiens
aagatccgagtgtgatttgaatt

SEQ ID NO: 1463934 - DNA, 22 bp, Homo sapiens
aagatctctagagtttagtcct

SEQ ID NO: 1463935 - DNA, 17 bp, Homo sapiens
aagatctgtcctcagcc

SEQ ID NO: 1463936 - DNA, 20 bp, Homo sapiens
aagatctgtcctcagccttg

SEQ ID NO: 1463937 - DNA, 14 bp, Homo sapiens
aagatcttagattc

SEQ ID NO: 1463938 - DNA, 18 bp, Homo sapiens
aagatcttgagagctgct

SEQ ID NO: 1463939 - DNA, 13 bp, Homo sapiens
aagatgaaaatat

SEQ ID NO: 1463940 - DNA, 17 bp, Homo sapiens
aagatgagagaactgga

SEQ ID NO: 1463941 - DNA, 20 bp, Homo sapiens
aagatgagattggcatggct

SEQ ID NO: 1463942 - DNA, 21 bp, Homo sapiens
aagatgagattggcatggctt

SEQ ID NO: 1463943 - DNA, 12 bp, Homo sapiens
aagatgagttgg

SEQ ID NO: 1463944 - DNA, 13 bp, Homo sapiens
aagatgatcattt

SEQ ID NO: 1463945 - DNA, 22 bp, Homo sapiens
aagatgattttttaaggagctg

SEQ ID NO: 1463946 - DNA, 23 bp, Homo sapiens
aagatgattttttaaggagctgg

SEQ ID NO: 1463947 - DNA, 15 bp, Homo sapiens
aagatgcaaggacca

SEQ ID NO: 1463948 - DNA, 12 bp, Homo sapiens
aagatgcatttt

SEQ ID NO: 1463949 - DNA, 21 bp, Homo sapiens
aagatgccagcttctctctcc

SEQ ID NO: 1463950 - DNA, 23 bp, Homo sapiens
aagatgctccagcaacacagcct

SEQ ID NO: 1463951 - DNA, 15 bp, Homo sapiens
aagatgctcttctgt

SEQ ID NO: 1463952 - DNA, 14 bp, Homo sapiens
aagatgctgggttg

SEQ ID NO: 1463953 - DNA, 16 bp, Homo sapiens
aagatgctgggttggt

SEQ ID NO: 1463954 - DNA, 13 bp, Homo sapiens
aagatgctgtaaa

SEQ ID NO: 1463955 - DNA, 18 bp, Homo sapiens
aagatgctgtaaataggt

SEQ ID NO: 1463956 - DNA, 18 bp, Homo sapiens
aagatgctgtcggcacca

SEQ ID NO: 1463957 - DNA, 16 bp, Homo sapiens
aagatggactctgaaa

SEQ ID NO: 1463958 - DNA, 22 bp, Homo sapiens
aagatggactctgaaaaacatt

SEQ ID NO: 1463959 - DNA, 12 bp, Homo sapiens
aagcactgagca

SEQ ID NO: 1463960 - DNA, 22 bp, Homo sapiens
aagcactgctcacgtctctgcc

SEQ ID NO: 1463961 - DNA, 21 bp, Homo sapiens
aagcactttaatggcctggag

SEQ ID NO: 1463962 - DNA, 15 bp, Homo sapiens
aagcactttgcactt

SEQ ID NO: 1463963 - DNA, 16 bp, Homo sapiens
aagcactttgcactta

SEQ ID NO: 1463964 - DNA, 19 bp, Homo sapiens
aagcagaaaataaaggaag

SEQ ID NO: 1463965 - DNA, 15 bp, Homo sapiens
aagcagaacaaatgt

SEQ ID NO: 1463966 - DNA, 17 bp, Homo sapiens
aagcagaacaaatgtgt

SEQ ID NO: 1463967 - DNA, 20 bp, Homo sapiens
aagcagaacaaatgtgtttt

SEQ ID NO: 1463968 - DNA, 16 bp, Homo sapiens
aagcagagaggtggag

SEQ ID NO: 1463969 - DNA, 18 bp, Homo sapiens
aagcagaggaccagggcc

SEQ ID NO: 1463970 - DNA, 18 bp, Homo sapiens
aagcagagtgcacagctg

SEQ ID NO: 1463971 - DNA, 21 bp, Homo sapiens
aagcagagtgcacagctgtcc

SEQ ID NO: 1463972 - DNA, 21 bp, Homo sapiens
aagcagagtggactgcattta

SEQ ID NO: 1463973 - DNA, 17 bp, Homo sapiens
aagcagatggaatgctg

SEQ ID NO: 1463974 - DNA, 12 bp, Homo sapiens
aagcagcaacag

SEQ ID NO: 1463975 - DNA, 14 bp, Homo sapiens
aagcagcaacagcc

SEQ ID NO: 1463976 - DNA, 20 bp, Homo sapiens
aagcagcatggaaaaatggt

SEQ ID NO: 1463977 - DNA, 19 bp, Homo sapiens
aagcagcgaccgccccctc

SEQ ID NO: 1463978 - DNA, 19 bp, Homo sapiens
aagcagctaaatgtaactt

SEQ ID NO: 1463979 - DNA, 22 bp, Homo sapiens
aagcagctgattcagcagtgcc

SEQ ID NO: 1463980 - DNA, 16 bp, Homo sapiens
aagcagcttattgttt

SEQ ID NO: 1463981 - DNA, 17 bp, Homo sapiens
aagcagctttaaacaaa

SEQ ID NO: 1463982 - DNA, 16 bp, Homo sapiens
aagcaggagcagctgt

SEQ ID NO: 1463983 - DNA, 15 bp, Homo sapiens
aagcaggaggccctt

SEQ ID NO: 1463984 - DNA, 17 bp, Homo sapiens
aagcaggaggcccttgt

SEQ ID NO: 1463985 - DNA, 18 bp, Homo sapiens
aagcaggaggcccttgtc

SEQ ID NO: 1463986 - DNA, 21 bp, Homo sapiens
aagcaggcttgcccagtacat

SEQ ID NO: 1463987 - DNA, 18 bp, Homo sapiens
aagcagggaaagctccac

SEQ ID NO: 1463988 - DNA, 22 bp, Homo sapiens
aagcaggttgaggggctcctgg

SEQ ID NO: 1463989 - DNA, 16 bp, Homo sapiens
aagcaggtttgttttc

SEQ ID NO: 1463990 - DNA, 13 bp, Homo sapiens
aagcagtaactga

SEQ ID NO: 1463991 - DNA, 18 bp, Homo sapiens
aagcagtcgtgcctgtgt

SEQ ID NO: 1463992 - DNA, 14 bp, Homo sapiens
aagcagtgcctcga

SEQ ID NO: 1463993 - DNA, 15 bp, Homo sapiens
aagcagtgccttcca

SEQ ID NO: 1463994 - DNA, 20 bp, Homo sapiens
aagcagtgccttccataatt

SEQ ID NO: 1463995 - DNA, 21 bp, Homo sapiens
aagcagtgtgagcagggctga

SEQ ID NO: 1463996 - DNA, 22 bp, Homo sapiens
aagcataaaaacattttaaaaa

SEQ ID NO: 1463997 - DNA, 12 bp, Homo sapiens
aagcataaaaga

SEQ ID NO: 1463998 - DNA, 16 bp, Homo sapiens
aagcataaaagatcac

SEQ ID NO: 1463999 - DNA, 14 bp, Homo sapiens
aagcataaagctca

SEQ ID NO: 1464000 - DNA, 17 bp, Homo sapiens
aagcatatgcagccaac

SEQ ID NO: 1464001 - DNA, 19 bp, Homo sapiens
aagcatatgcagccaacca

SEQ ID NO: 1464002 - DNA, 19 bp, Homo sapiens
aagcatatgggttagatgt

SEQ ID NO: 1464003 - DNA, 14 bp, Homo sapiens
aagcatattttgct

SEQ ID NO: 1464004 - DNA, 15 bp, Homo sapiens
aagcatcacctcagg

SEQ ID NO: 1464005 - DNA, 16 bp, Homo sapiens
aagcatcacctcaggc

SEQ ID NO: 1464006 - DNA, 22 bp, Homo sapiens
aagcatcagagatggtaatcta

SEQ ID NO: 1464007 - DNA, 22 bp, Homo sapiens
aagcatcattatttgcagagac

SEQ ID NO: 1464008 - DNA, 13 bp, Homo sapiens
aagcatccctcac

SEQ ID NO: 1464009 - DNA, 18 bp, Homo sapiens
aagcatctgatagaatga

SEQ ID NO: 1464010 - DNA, 13 bp, Homo sapiens
aagcatgaaaaag

SEQ ID NO: 1464011 - DNA, 13 bp, Homo sapiens
aagcatgaaatgt

SEQ ID NO: 1464012 - DNA, 18 bp, Homo sapiens
aagcatgacagaaaatat

SEQ ID NO: 1464013 - DNA, 17 bp, Homo sapiens
aagcatgatgggaaaat

SEQ ID NO: 1464014 - DNA, 20 bp, Homo sapiens
aagcatgatgggaaaatatt

SEQ ID NO: 1464015 - DNA, 14 bp, Homo sapiens
aagcatggacattt

SEQ ID NO: 1464016 - DNA, 16 bp, Homo sapiens
aagcatgtaggagaat

SEQ ID NO: 1464017 - DNA, 17 bp, Homo sapiens
aagcatgtctcaatagt

SEQ ID NO: 1464018 - DNA, 14 bp, Homo sapiens
aagcatgtctctct

SEQ ID NO: 1464019 - DNA, 19 bp, Homo sapiens
aagcatgtctctctgccaa

SEQ ID NO: 1464020 - DNA, 13 bp, Homo sapiens
aagcatgtggcat

SEQ ID NO: 1464021 - DNA, 14 bp, Homo sapiens
aagcatgttttgca

SEQ ID NO: 1464022 - DNA, 15 bp, Homo sapiens
aagcatgttttgcat

SEQ ID NO: 1464023 - DNA, 13 bp, Homo sapiens
aagcattctttaa

SEQ ID NO: 1464024 - DNA, 17 bp, Homo sapiens
aagcattgcctggactg

SEQ ID NO: 1464025 - DNA, 20 bp, Homo sapiens
aagcattgcctggactgacc

SEQ ID NO: 1464026 - DNA, 14 bp, Homo sapiens
aagcattgtaaaat

SEQ ID NO: 1464027 - DNA, 21 bp, Homo sapiens
aagcatttcaaagccctgcct

SEQ ID NO: 1464028 - DNA, 16 bp, Homo sapiens
aagcatttcatgaaaa

SEQ ID NO: 1464029 - DNA, 20 bp, Homo sapiens
aagcatttggtgcctatttg

SEQ ID NO: 1464030 - DNA, 16 bp, Homo sapiens
aagcattttgaaacaa

SEQ ID NO: 1464031 - DNA, 18 bp, Homo sapiens
aagcatttttcaatatat

SEQ ID NO: 1464032 - DNA, 18 bp, Homo sapiens
aagccaaacattcttatt

SEQ ID NO: 1464033 - DNA, 17 bp, Homo sapiens
aagccaaagaaacaagc

SEQ ID NO: 1464034 - DNA, 15 bp, Homo sapiens
aagccaaaggcagct

SEQ ID NO: 1464035 - DNA, 17 bp, Homo sapiens
aagccaacagtcaaaac

SEQ ID NO: 1464036 - DNA, 16 bp, Homo sapiens
aagccaaccagccttt

SEQ ID NO: 1464037 - DNA, 16 bp, Homo sapiens
aagccaacgacaaagc

SEQ ID NO: 1464038 - DNA, 17 bp, Homo sapiens
aagccaaggcagcgacc

SEQ ID NO: 1464039 - DNA, 21 bp, Homo sapiens
aagccaaggcagcgaccccag

SEQ ID NO: 1464040 - DNA, 19 bp, Homo sapiens
aagccaagggaacctgtgt

SEQ ID NO: 1464041 - DNA, 20 bp, Homo sapiens
aagccaatcccctccttggg

SEQ ID NO: 1464042 - DNA, 19 bp, Homo sapiens
aagccaatctacaatctct

SEQ ID NO: 1464043 - DNA, 18 bp, Homo sapiens
aagccacaagtcttccag

SEQ ID NO: 1464044 - DNA, 19 bp, Homo sapiens
aagccaccctaccatgaat

SEQ ID NO: 1464045 - DNA, 17 bp, Homo sapiens
aagccactggaaggagc

SEQ ID NO: 1464046 - DNA, 19 bp, Homo sapiens
aagccactggaaggagcac

SEQ ID NO: 1464047 - DNA, 18 bp, Homo sapiens
aagccacttgaaatgtta

SEQ ID NO: 1464048 - DNA, 15 bp, Homo sapiens
aagccagaaccagat

SEQ ID NO: 1464049 - DNA, 15 bp, Homo sapiens
aagccagagcctggg

SEQ ID NO: 1464050 - DNA, 14 bp, Homo sapiens
aagccagaggagaa

SEQ ID NO: 1464051 - DNA, 23 bp, Homo sapiens
aagccagagtttttaaagccttc

SEQ ID NO: 1464052 - DNA, 10 bp, Homo sapiens
aagccagcca

SEQ ID NO: 1464053 - DNA, 13 bp, Homo sapiens
aagccagccacag

SEQ ID NO: 1464054 - DNA, 14 bp, Homo sapiens
aagccagccacaga

SEQ ID NO: 1464055 - DNA, 21 bp, Homo sapiens
aagccagccccctccagctca

SEQ ID NO: 1464056 - DNA, 22 bp, Homo sapiens
aagccagccccctccagctcat

SEQ ID NO: 1464057 - DNA, 15 bp, Homo sapiens
aagccagctgcccta

SEQ ID NO: 1464058 - DNA, 16 bp, Homo sapiens
aagccagctgccctat

SEQ ID NO: 1464059 - DNA, 22 bp, Homo sapiens
aagccagctgccctatgggcct

SEQ ID NO: 1464060 - DNA, 14 bp, Homo sapiens
aagccagctttccc

SEQ ID NO: 1464061 - DNA, 24 bp, Homo sapiens
aagccaggaatttcccaggaccct

SEQ ID NO: 1464062 - DNA, 22 bp, Homo sapiens
aagccaggtacaggagaggcag

SEQ ID NO: 1464063 - DNA, 16 bp, Homo sapiens
aagccagtgtccttcg

SEQ ID NO: 1464064 - DNA, 20 bp, Homo sapiens
aagccagtttgggtaaaata

SEQ ID NO: 1464065 - DNA, 13 bp, Homo sapiens
aagccatcacttc

SEQ ID NO: 1464066 - DNA, 14 bp, Homo sapiens
aagccatcacttct

SEQ ID NO: 1464067 - DNA, 20 bp, Homo sapiens
aagccatcttgagtggtcat

SEQ ID NO: 1464068 - DNA, 15 bp, Homo sapiens
aagccatctttcttt

SEQ ID NO: 1464069 - DNA, 22 bp, Homo sapiens
aagcccattttcaactgctttg

SEQ ID NO: 1464070 - DNA, 16 bp, Homo sapiens
aagccccacatgtcca

SEQ ID NO: 1464071 - DNA, 16 bp, Homo sapiens
aagccccagggcctgg

SEQ ID NO: 1464072 - DNA, 17 bp, Homo sapiens
aagccccagggcctggg

SEQ ID NO: 1464073 - DNA, 21 bp, Homo sapiens
aagcccccagctaagaacctg

SEQ ID NO: 1464074 - DNA, 18 bp, Homo sapiens
aaggacccacccatcttc

SEQ ID NO: 1464075 - DNA, 21 bp, Homo sapiens
aaggacccggaggggcctggc

SEQ ID NO: 1464076 - DNA, 22 bp, Homo sapiens
aaggacccggaggggcctggca

SEQ ID NO: 1464077 - DNA, 14 bp, Homo sapiens
aaggaccctgtgag

SEQ ID NO: 1464078 - DNA, 19 bp, Homo sapiens
aaggaccgtggccctgccc

SEQ ID NO: 1464079 - DNA, 15 bp, Homo sapiens
aaggacctaaaaatt

SEQ ID NO: 1464080 - DNA, 19 bp, Homo sapiens
aaggaccttaagacagagt

SEQ ID NO: 1464081 - DNA, 21 bp, Homo sapiens
aaggacggccttcaactgaaa

SEQ ID NO: 1464082 - DNA, 17 bp, Homo sapiens
aaggactaacataaaat

SEQ ID NO: 1464083 - DNA, 21 bp, Homo sapiens
aaggactaacataaaatctgt

SEQ ID NO: 1464084 - DNA, 16 bp, Homo sapiens
aaggactataagaata

SEQ ID NO: 1464085 - DNA, 22 bp, Homo sapiens
aaggactggtgcgaccccccac

SEQ ID NO: 1464086 - DNA, 19 bp, Homo sapiens
aaggagaaacagagacagg

SEQ ID NO: 1464087 - DNA, 23 bp, Homo sapiens
aaggagaagcacagctcctgcca

SEQ ID NO: 1464088 - DNA, 15 bp, Homo sapiens
aaggagaaggaagga

SEQ ID NO: 1464089 - DNA, 18 bp, Homo sapiens
aaggagaatcatgtttct

SEQ ID NO: 1464090 - DNA, 14 bp, Homo sapiens
aaggagactgtgtt

SEQ ID NO: 1464091 - DNA, 14 bp, Homo sapiens
aaggagagcaagaa

SEQ ID NO: 1464092 - DNA, 13 bp, Homo sapiens
aaggagagcctgc

SEQ ID NO: 1464093 - DNA, 17 bp, Homo sapiens
aaggagagttcaagcct

SEQ ID NO: 1464094 - DNA, 15 bp, Homo sapiens
aaggagcacatacta

SEQ ID NO: 1464095 - DNA, 18 bp, Homo sapiens
aaggagcacatactacct

SEQ ID NO: 1464096 - DNA, 20 bp, Homo sapiens
aaggagcacatactacctag

SEQ ID NO: 1464097 - DNA, 16 bp, Homo sapiens
aaggagcccagccaga

SEQ ID NO: 1464098 - DNA, 17 bp, Homo sapiens
aaggagccttttgctct

SEQ ID NO: 1464099 - DNA, 20 bp, Homo sapiens
aaggagccttttgctctctg

SEQ ID NO: 1464100 - DNA, 13 bp, Homo sapiens
aaggagctcaccc

SEQ ID NO: 1464101 - DNA, 19 bp, Homo sapiens
aaggagctgatttccaggc

SEQ ID NO: 1464102 - DNA, 20 bp, Homo sapiens
aaggagctgatttccaggcc

SEQ ID NO: 1464103 - DNA, 19 bp, Homo sapiens
aaggaggaatagtgcttgc

SEQ ID NO: 1464104 - DNA, 16 bp, Homo sapiens
aaggaggcatgcctct

SEQ ID NO: 1464105 - DNA, 20 bp, Homo sapiens
aaggaggcatgcctctgata

SEQ ID NO: 1464106 - DNA, 19 bp, Homo sapiens
aaggaggccaaccagcccg

SEQ ID NO: 1464107 - DNA, 20 bp, Homo sapiens
aaggaggccctgttccctgg

SEQ ID NO: 1464108 - DNA, 14 bp, Homo sapiens
aaggagggcagagc

SEQ ID NO: 1464109 - DNA, 16 bp, Homo sapiens
aaggagggcagagcca

SEQ ID NO: 1464110 - DNA, 17 bp, Homo sapiens
aaggaggggctgtaaaa

SEQ ID NO: 1464111 - DNA, 21 bp, Homo sapiens
aaggagggtggatcacctgag

SEQ ID NO: 1464112 - DNA, 16 bp, Homo sapiens
aaggagtacaaaacaa

SEQ ID NO: 1464113 - DNA, 20 bp, Homo sapiens
aaggagtcagacattttaag

SEQ ID NO: 1464114 - DNA, 22 bp, Homo sapiens
aaggagtttattacaatgtatc

SEQ ID NO: 1464115 - DNA, 19 bp, Homo sapiens
aaggataaagccacttctg

SEQ ID NO: 1464116 - DNA, 15 bp, Homo sapiens
aaggataaatcataa

SEQ ID NO: 1464117 - DNA, 19 bp, Homo sapiens
aaggataatgaaataatca

SEQ ID NO: 1464118 - DNA, 20 bp, Homo sapiens
aaggataatgaaataatcag

SEQ ID NO: 1464119 - DNA, 17 bp, Homo sapiens
aaggataccttcttatt

SEQ ID NO: 1464120 - DNA, 20 bp, Homo sapiens
aaggatagatgctggcccag

SEQ ID NO: 1464121 - DNA, 14 bp, Homo sapiens
aaggatatgattaa

SEQ ID NO: 1464122 - DNA, 19 bp, Homo sapiens
aaggatatttaagaaaata

SEQ ID NO: 1464123 - DNA, 20 bp, Homo sapiens
aaggatccaggaatatgaca

SEQ ID NO: 1464124 - DNA, 17 bp, Homo sapiens
aaggatccggaaagaag

SEQ ID NO: 1464125 - DNA, 20 bp, Homo sapiens
aaggatctctcaggagcaca

SEQ ID NO: 1464126 - DNA, 12 bp, Homo sapiens
aaggatctgctg

SEQ ID NO: 1464127 - DNA, 16 bp, Homo sapiens
aaggatctgctgaggc

SEQ ID NO: 1464128 - DNA, 20 bp, Homo sapiens
aaggatctgctgaggcccag

SEQ ID NO: 1464129 - DNA, 18 bp, Homo sapiens
aaggatctgtgattggct

SEQ ID NO: 1464130 - DNA, 13 bp, Homo sapiens
aaggatgaaagct

SEQ ID NO: 1464131 - DNA, 19 bp, Homo sapiens
aaggatgacttttttatac

SEQ ID NO: 1464132 - DNA, 12 bp, Homo sapiens
aaggatggatgg

SEQ ID NO: 1464133 - DNA, 16 bp, Homo sapiens
aaggatggatggcacc

SEQ ID NO: 1464134 - DNA, 20 bp, Homo sapiens
aaggatggatggcaccctgg

SEQ ID NO: 1464135 - DNA, 15 bp, Homo sapiens
aaggatgtacatttc

SEQ ID NO: 1464136 - DNA, 16 bp, Homo sapiens
aaggatgtacatttcc

SEQ ID NO: 1464137 - DNA, 15 bp, Homo sapiens
aaggatgttggtgtt

SEQ ID NO: 1464138 - DNA, 19 bp, Homo sapiens
aaggatgttttgtcccatt

SEQ ID NO: 1464139 - DNA, 22 bp, Homo sapiens
aaggatgttttgtcccatttcc

SEQ ID NO: 1464140 - DNA, 19 bp, Homo sapiens
aaggattttaccaaagcat

SEQ ID NO: 1464141 - DNA, 20 bp, Homo sapiens
aaggattttaccaaagcatc

SEQ ID NO: 1464142 - DNA, 18 bp, Homo sapiens
aaggatttttcaagagat

SEQ ID NO: 1464143 - DNA, 20 bp, Homo sapiens
aaggcaaagcacgaaatgtt

SEQ ID NO: 1464144 - DNA, 17 bp, Homo sapiens
aaggcaaagtttacaga

SEQ ID NO: 1464145 - DNA, 16 bp, Homo sapiens
aaggcaaatattgaag

SEQ ID NO: 1464146 - DNA, 15 bp, Homo sapiens
aaggcaagcttgagg

SEQ ID NO: 1464147 - DNA, 17 bp, Homo sapiens
aaggcaatattaaccta

SEQ ID NO: 1464148 - DNA, 13 bp, Homo sapiens
aaggcaatggaaa

SEQ ID NO: 1464149 - DNA, 20 bp, Homo sapiens
aaggcaattttagtgtatta

SEQ ID NO: 1464150 - DNA, 22 bp, Homo sapiens
aaggcacacagagattctggat

SEQ ID NO: 1464151 - DNA, 19 bp, Homo sapiens
aaggcacagtgggagctga

SEQ ID NO: 1464152 - DNA, 23 bp, Homo sapiens
aaggcacccgccctttccttgcc

SEQ ID NO: 1464153 - DNA, 19 bp, Homo sapiens
aaggcactctagattccat

SEQ ID NO: 1464154 - DNA, 21 bp, Homo sapiens
aaggcactctgttatttagac

SEQ ID NO: 1464155 - DNA, 12 bp, Homo sapiens
aaggcagacaca

SEQ ID NO: 1464156 - DNA, 21 bp, Homo sapiens
aaggcagacccagtatgaaat

SEQ ID NO: 1464157 - DNA, 15 bp, Homo sapiens
aaggcagagaaatct

SEQ ID NO: 1464158 - DNA, 14 bp, Homo sapiens
aaggcagaggcctg

SEQ ID NO: 1464159 - DNA, 19 bp, Homo sapiens
aaggcagaggcctgggctg

SEQ ID NO: 1464160 - DNA, 21 bp, Homo sapiens
aaggcagccctcacctctgag

SEQ ID NO: 1464161 - DNA, 11 bp, Homo sapiens
aaggcagcctc

SEQ ID NO: 1464162 - DNA, 19 bp, Homo sapiens
aaggcagcctccagagcca

SEQ ID NO: 1464163 - DNA, 22 bp, Homo sapiens
aaggcagcctccagagccagcc

SEQ ID NO: 1464164 - DNA, 17 bp, Homo sapiens
aaggcagcctgaacact

SEQ ID NO: 1464165 - DNA, 22 bp, Homo sapiens
aaggcagctaagatagaaagct

SEQ ID NO: 1464166 - DNA, 12 bp, Homo sapiens
aaggcagctgcc

SEQ ID NO: 1464167 - DNA, 13 bp, Homo sapiens
aaggcagctgcct

SEQ ID NO: 1464168 - DNA, 14 bp, Homo sapiens
aaggcagctgcctc

SEQ ID NO: 1464169 - DNA, 19 bp, Homo sapiens
aaggcagctgcctctgctc

SEQ ID NO: 1464170 - DNA, 22 bp, Homo sapiens
aaggcagctgcctctgctccct

SEQ ID NO: 1464171 - DNA, 23 bp, Homo sapiens
aaggcagctgcctctgctccctc

SEQ ID NO: 1464172 - DNA, 12 bp, Homo sapiens
aaggcaggagcc

SEQ ID NO: 1464173 - DNA, 22 bp, Homo sapiens
aaggcaggtgcctccaggtgtg

SEQ ID NO: 1464174 - DNA, 18 bp, Homo sapiens
aaggcagtagttttcaaa

SEQ ID NO: 1464175 - DNA, 19 bp, Homo sapiens
aaggcagtagttttcaaaa

SEQ ID NO: 1464176 - DNA, 20 bp, Homo sapiens
aaggcagtagttttcaaaac

SEQ ID NO: 1464177 - DNA, 16 bp, Homo sapiens
aaggcagtggcagggg

SEQ ID NO: 1464178 - DNA, 21 bp, Homo sapiens
aaggcagtggcaggggagcag

SEQ ID NO: 1464179 - DNA, 15 bp, Homo sapiens
aaggcagtttgcaaa

SEQ ID NO: 1464180 - DNA, 19 bp, Homo sapiens
aaggcagtttgcaaaaaat

SEQ ID NO: 1464181 - DNA, 20 bp, Homo sapiens
aaggcatccttgtcttttga

SEQ ID NO: 1464182 - DNA, 22 bp, Homo sapiens
aaggcatcgtcatgcacagtat

SEQ ID NO: 1464183 - DNA, 17 bp, Homo sapiens
aaggcatctatctgtgc

SEQ ID NO: 1464184 - DNA, 18 bp, Homo sapiens
aaggcatctatctgtgct

SEQ ID NO: 1464185 - DNA, 12 bp, Homo sapiens
aaggcatgagaa

SEQ ID NO: 1464186 - DNA, 17 bp, Homo sapiens
aaggcatttggctgctg

SEQ ID NO: 1464187 - DNA, 16 bp, Homo sapiens
aaggccaaaatcaaga

SEQ ID NO: 1464188 - DNA, 22 bp, Homo sapiens
aagggcttctgcaccctccacc

SEQ ID NO: 1464189 - DNA, 23 bp, Homo sapiens
aagggcttctgcaccctccaccc

SEQ ID NO: 1464190 - DNA, 18 bp, Homo sapiens
aagggctttgagggtgga

SEQ ID NO: 1464191 - DNA, 13 bp, Homo sapiens
aaggggaaaaatg

SEQ ID NO: 1464192 - DNA, 16 bp, Homo sapiens
aaggggagaagggaat

SEQ ID NO: 1464193 - DNA, 18 bp, Homo sapiens
aaggggagagcctgctgg

SEQ ID NO: 1464194 - DNA, 19 bp, Homo sapiens
aaggggagagcctgctggc

SEQ ID NO: 1464195 - DNA, 13 bp, Homo sapiens
aaggggagcccac

SEQ ID NO: 1464196 - DNA, 21 bp, Homo sapiens
aaggggaggcacactttctgg

SEQ ID NO: 1464197 - DNA, 13 bp, Homo sapiens
aaggggagttgag

SEQ ID NO: 1464198 - DNA, 17 bp, Homo sapiens
aaggggcacaccactgc

SEQ ID NO: 1464199 - DNA, 21 bp, Homo sapiens
aaggggcacaccactgccctg

SEQ ID NO: 1464200 - DNA, 14 bp, Homo sapiens
aaggggcagcagga

SEQ ID NO: 1464201 - DNA, 15 bp, Homo sapiens
aaggggcagcaggag

SEQ ID NO: 1464202 - DNA, 18 bp, Homo sapiens
aaggggcaggattctgca

SEQ ID NO: 1464203 - DNA, 15 bp, Homo sapiens
aaggggcatttcaca

SEQ ID NO: 1464204 - DNA, 16 bp, Homo sapiens
aaggggcccaagcccc

SEQ ID NO: 1464205 - DNA, 13 bp, Homo sapiens
aaggggccctggt

SEQ ID NO: 1464206 - DNA, 21 bp, Homo sapiens
aaggggctgctggggcatgtg

SEQ ID NO: 1464207 - DNA, 23 bp, Homo sapiens
aaggggctgttcttccaggaggc

SEQ ID NO: 1464208 - DNA, 21 bp, Homo sapiens
aagggggacgtttctggaact

SEQ ID NO: 1464209 - DNA, 22 bp, Homo sapiens
aagggggccgccaccctcccct

SEQ ID NO: 1464210 - DNA, 22 bp, Homo sapiens
aagggggctctgccccaggccc

SEQ ID NO: 1464211 - DNA, 21 bp, Homo sapiens
aaggggggttgcagtggagag

SEQ ID NO: 1464212 - DNA, 18 bp, Homo sapiens
aagggggtcaaaggaaga

SEQ ID NO: 1464213 - DNA, 12 bp, Homo sapiens
aagggggtccca

SEQ ID NO: 1464214 - DNA, 15 bp, Homo sapiens
aagggggtctctgtt

SEQ ID NO: 1464215 - DNA, 13 bp, Homo sapiens
aagggggtgactg

SEQ ID NO: 1464216 - DNA, 16 bp, Homo sapiens
aagggggtgactggaa

SEQ ID NO: 1464217 - DNA, 22 bp, Homo sapiens
aaggggtgggtcagaacatgtt

SEQ ID NO: 1464218 - DNA, 23 bp, Homo sapiens
aaggggtgggtcagaacatgtta

SEQ ID NO: 1464219 - DNA, 18 bp, Homo sapiens
aagggtcgaaagctctag

SEQ ID NO: 1464220 - DNA, 22 bp, Homo sapiens
aagggtcgaaagctctagaatc

SEQ ID NO: 1464221 - DNA, 19 bp, Homo sapiens
aagggtgatgggaaagcat

SEQ ID NO: 1464222 - DNA, 20 bp, Homo sapiens
aagggtggatgacagggcag

SEQ ID NO: 1464223 - DNA, 21 bp, Homo sapiens
aagggtggatgacagggcaga

SEQ ID NO: 1464224 - DNA, 16 bp, Homo sapiens
aagggtggcctgttcc

SEQ ID NO: 1464225 - DNA, 21 bp, Homo sapiens
aagggtggcctgttccctaga

SEQ ID NO: 1464226 - DNA, 22 bp, Homo sapiens
aagggtggcctgttccctagag

SEQ ID NO: 1464227 - DNA, 22 bp, Homo sapiens
aagggtgtaggggccacctcct

SEQ ID NO: 1464228 - DNA, 15 bp, Homo sapiens
aagggtgtatagtgt

SEQ ID NO: 1464229 - DNA, 15 bp, Homo sapiens
aagggttaaggcctg

SEQ ID NO: 1464230 - DNA, 16 bp, Homo sapiens
aagggttaaggcctga

SEQ ID NO: 1464231 - DNA, 17 bp, Homo sapiens
aagggttgaaggcagtc

SEQ ID NO: 1464232 - DNA, 14 bp, Homo sapiens
aagggtttcgactg

SEQ ID NO: 1464233 - DNA, 20 bp, Homo sapiens
aagggtttcgactggtccag

SEQ ID NO: 1464234 - DNA, 20 bp, Homo sapiens
aagggtttgtaatactttac

SEQ ID NO: 1464235 - DNA, 13 bp, Homo sapiens
aagggttttcttt

SEQ ID NO: 1464236 - DNA, 12 bp, Homo sapiens
aaggtaaaattg

SEQ ID NO: 1464237 - DNA, 16 bp, Homo sapiens
aaggtaaaattgaaag

SEQ ID NO: 1464238 - DNA, 12 bp, Homo sapiens
aaggtaatccta

SEQ ID NO: 1464239 - DNA, 14 bp, Homo sapiens
aaggtaattgtttt

SEQ ID NO: 1464240 - DNA, 18 bp, Homo sapiens
aaggtaccaaacaaggaa

SEQ ID NO: 1464241 - DNA, 19 bp, Homo sapiens
aaggtaccgatttctgcta

SEQ ID NO: 1464242 - DNA, 18 bp, Homo sapiens
aaggtagcccagcactgt

SEQ ID NO: 1464243 - DNA, 20 bp, Homo sapiens
aaggtagcttacctgacaca

SEQ ID NO: 1464244 - DNA, 23 bp, Homo sapiens
aaggtatatcattctaaagatag

SEQ ID NO: 1464245 - DNA, 19 bp, Homo sapiens
aaggtatcagttgcaataa

SEQ ID NO: 1464246 - DNA, 20 bp, Homo sapiens
aaggtatcagttgcaataat

SEQ ID NO: 1464247 - DNA, 22 bp, Homo sapiens
aaggtattccttgttcttccct

SEQ ID NO: 1464248 - DNA, 18 bp, Homo sapiens
aaggtattccttttgtgt

SEQ ID NO: 1464249 - DNA, 19 bp, Homo sapiens
aaggtatttaaagtatttt

SEQ ID NO: 1464250 - DNA, 19 bp, Homo sapiens
aaggtattttgaataccat

SEQ ID NO: 1464251 - DNA, 18 bp, Homo sapiens
aaggtattttgtagatgt

SEQ ID NO: 1464252 - DNA, 15 bp, Homo sapiens
aaggtcaaacaggct

SEQ ID NO: 1464253 - DNA, 22 bp, Homo sapiens
aaggtcatcaaacatttgccaa

SEQ ID NO: 1464254 - DNA, 23 bp, Homo sapiens
aaggtctcatgctgttgctgcta

SEQ ID NO: 1464255 - DNA, 22 bp, Homo sapiens
aaggtctccaagggagggtgca

SEQ ID NO: 1464256 - DNA, 19 bp, Homo sapiens
aaggtctccttactctgag

SEQ ID NO: 1464257 - DNA, 16 bp, Homo sapiens
aaggtctgttttgagt

SEQ ID NO: 1464258 - DNA, 19 bp, Homo sapiens
aaggtctttcagtactttt

SEQ ID NO: 1464259 - DNA, 12 bp, Homo sapiens
aaggtctttgca

SEQ ID NO: 1464260 - DNA, 13 bp, Homo sapiens
aaggtctttggtt

SEQ ID NO: 1464261 - DNA, 21 bp, Homo sapiens
aaggtgacacattacaaagcc

SEQ ID NO: 1464262 - DNA, 20 bp, Homo sapiens
aaggtgagtttgagctgcct

SEQ ID NO: 1464263 - DNA, 14 bp, Homo sapiens
aaggtgatttcaga

SEQ ID NO: 1464264 - DNA, 20 bp, Homo sapiens
aaggtgccgtgagcaggctt

SEQ ID NO: 1464265 - DNA, 21 bp, Homo sapiens
aaggtgcctcagttttccttc

SEQ ID NO: 1464266 - DNA, 11 bp, Homo sapiens
aaggtgcctgt

SEQ ID NO: 1464267 - DNA, 13 bp, Homo sapiens
aaggtgctaacat

SEQ ID NO: 1464268 - DNA, 19 bp, Homo sapiens
aaggtgctctctttctgtc

SEQ ID NO: 1464269 - DNA, 18 bp, Homo sapiens
aaggtgctgacggccagg

SEQ ID NO: 1464270 - DNA, 12 bp, Homo sapiens
aaggtggaataa

SEQ ID NO: 1464271 - DNA, 13 bp, Homo sapiens
aaggtggagggaa

SEQ ID NO: 1464272 - DNA, 14 bp, Homo sapiens
aaggtggattttgt

SEQ ID NO: 1464273 - DNA, 16 bp, Homo sapiens
aaggtggggccctgcc

SEQ ID NO: 1464274 - DNA, 22 bp, Homo sapiens
aaggtgggtccaggaaggcagc

SEQ ID NO: 1464275 - DNA, 24 bp, Homo sapiens
aaggtgggtccaggaaggcagctg

SEQ ID NO: 1464276 - DNA, 19 bp, Homo sapiens
aaggtggtaaattcagaca

SEQ ID NO: 1464277 - DNA, 21 bp, Homo sapiens
aaggtgtatttaaactatctt

SEQ ID NO: 1464278 - DNA, 15 bp, Homo sapiens
aaggtgtccctgcct

SEQ ID NO: 1464279 - DNA, 13 bp, Homo sapiens
aaggtgtgcaaag

SEQ ID NO: 1464280 - DNA, 20 bp, Homo sapiens
aaggttaatgttcatcatcc

SEQ ID NO: 1464281 - DNA, 21 bp, Homo sapiens
aaggttactgggagtgtgggc

SEQ ID NO: 1464282 - DNA, 23 bp, Homo sapiens
aaggttactgggagtgtgggctg

SEQ ID NO: 1464283 - DNA, 15 bp, Homo sapiens
aaggttatcagtgct

SEQ ID NO: 1464284 - DNA, 18 bp, Homo sapiens
aaggttccaactgtatat

SEQ ID NO: 1464285 - DNA, 22 bp, Homo sapiens
aaggttccaatcagatctttat

SEQ ID NO: 1464286 - DNA, 19 bp, Homo sapiens
aaggttcttcatccctttc

SEQ ID NO: 1464287 - DNA, 16 bp, Homo sapiens
aaggttgccaaattgc

SEQ ID NO: 1464288 - DNA, 16 bp, Homo sapiens
aaggttgtatgtaaat

SEQ ID NO: 1464289 - DNA, 20 bp, Homo sapiens
aaggtttaaagagtctagat

SEQ ID NO: 1464290 - DNA, 21 bp, Homo sapiens
aaggtttattgttaatacaag

SEQ ID NO: 1464291 - DNA, 12 bp, Homo sapiens
aaggtttgcaaa

SEQ ID NO: 1464292 - DNA, 19 bp, Homo sapiens
aaggtttggaaggagcaga

SEQ ID NO: 1464293 - DNA, 17 bp, Homo sapiens
aaggtttgtatattgtc

SEQ ID NO: 1464294 - DNA, 20 bp, Homo sapiens
aaggttttataaggctgatg

SEQ ID NO: 1464295 - DNA, 20 bp, Homo sapiens
aaggttttcctcttctattt

SEQ ID NO: 1464296 - DNA, 18 bp, Homo sapiens
aagtaaaaattaaaaaat

SEQ ID NO: 1464297 - DNA, 14 bp, Homo sapiens
aagtaaaaccacag

SEQ ID NO: 1464298 - DNA, 18 bp, Homo sapiens
aagtaaaaccacagcagt

SEQ ID NO: 1464299 - DNA, 19 bp, Homo sapiens
aagtaaaagatcaggttat

SEQ ID NO: 1464300 - DNA, 15 bp, Homo sapiens
aagtaaaatgaacat

SEQ ID NO: 1464301 - DNA, 18 bp, Homo sapiens
aagtaaaatgaacatttt

SEQ ID NO: 1464302 - DNA, 23 bp, Homo sapiens
aagtgggatttggggcctcaaga

SEQ ID NO: 1464303 - DNA, 21 bp, Homo sapiens
aagtgggccaggacaggcccg

SEQ ID NO: 1464304 - DNA, 13 bp, Homo sapiens
aagtgggcccacc

SEQ ID NO: 1464305 - DNA, 19 bp, Homo sapiens
aagtgggcccacccggtgg

SEQ ID NO: 1464306 - DNA, 22 bp, Homo sapiens
aagtggggcctccttgtccagg

SEQ ID NO: 1464307 - DNA, 13 bp, Homo sapiens
aagtggggctcgc

SEQ ID NO: 1464308 - DNA, 15 bp, Homo sapiens
aagtggggctcgcca

SEQ ID NO: 1464309 - DNA, 16 bp, Homo sapiens
aagtggggtgttcttc

SEQ ID NO: 1464310 - DNA, 21 bp, Homo sapiens
aagtgggttttttagttgaat

SEQ ID NO: 1464311 - DNA, 21 bp, Homo sapiens
aagtggtacaatctggctcac

SEQ ID NO: 1464312 - DNA, 14 bp, Homo sapiens
aagtggtctctgct

SEQ ID NO: 1464313 - DNA, 17 bp, Homo sapiens
aagtggtctctgctggg

SEQ ID NO: 1464314 - DNA, 16 bp, Homo sapiens
aagtggtgtttattgc

SEQ ID NO: 1464315 - DNA, 17 bp, Homo sapiens
aagtggtgtttattgca

SEQ ID NO: 1464316 - DNA, 12 bp, Homo sapiens
aagtgtaaaaaa

SEQ ID NO: 1464317 - DNA, 15 bp, Homo sapiens
aagtgtaaaaaatgt

SEQ ID NO: 1464318 - DNA, 12 bp, Homo sapiens
aagtgtaaatga

SEQ ID NO: 1464319 - DNA, 15 bp, Homo sapiens
aagtgtaacagctga

SEQ ID NO: 1464320 - DNA, 21 bp, Homo sapiens
aagtgtataatataaaaaatt

SEQ ID NO: 1464321 - DNA, 19 bp, Homo sapiens
aagtgtatatttattcata

SEQ ID NO: 1464322 - DNA, 19 bp, Homo sapiens
aagtgtatggtaggggctt

SEQ ID NO: 1464323 - DNA, 13 bp, Homo sapiens
aagtgtatttgga

SEQ ID NO: 1464324 - DNA, 19 bp, Homo sapiens
aagtgtctcaaaggagctt

SEQ ID NO: 1464325 - DNA, 23 bp, Homo sapiens
aagtgtctggcccgcaatactgt

SEQ ID NO: 1464326 - DNA, 17 bp, Homo sapiens
aagtgtcttttgacatt

SEQ ID NO: 1464327 - DNA, 18 bp, Homo sapiens
aagtgtgagctcttccct

SEQ ID NO: 1464328 - DNA, 21 bp, Homo sapiens
aagtgtgagtaagagctggtg

SEQ ID NO: 1464329 - DNA, 17 bp, Homo sapiens
aagtgtgggtctgtgtg

SEQ ID NO: 1464330 - DNA, 20 bp, Homo sapiens
aagtgtgtaattatgtaaat

SEQ ID NO: 1464331 - DNA, 21 bp, Homo sapiens
aagtgtgtaattatgtaaata

SEQ ID NO: 1464332 - DNA, 17 bp, Homo sapiens
aagtgtgtatatatttt

SEQ ID NO: 1464333 - DNA, 19 bp, Homo sapiens
aagtgtgtatatattttgt

SEQ ID NO: 1464334 - DNA, 21 bp, Homo sapiens
aagtgtgtatatattttgtgt

SEQ ID NO: 1464335 - DNA, 16 bp, Homo sapiens
aagtgtgtgtagtttt

SEQ ID NO: 1464336 - DNA, 11 bp, Homo sapiens
aagtgttactt

SEQ ID NO: 1464337 - DNA, 20 bp, Homo sapiens
aagtgttctcatgaagcagg

SEQ ID NO: 1464338 - DNA, 21 bp, Homo sapiens
aagtgttctcatgaagcagga

SEQ ID NO: 1464339 - DNA, 19 bp, Homo sapiens
aagtgttcttaggtttact

SEQ ID NO: 1464340 - DNA, 18 bp, Homo sapiens
aagtgttgaagggaggtg

SEQ ID NO: 1464341 - DNA, 16 bp, Homo sapiens
aagtgttgatcaacca

SEQ ID NO: 1464342 - DNA, 18 bp, Homo sapiens
aagtgttgtaaatattta

SEQ ID NO: 1464343 - DNA, 22 bp, Homo sapiens
aagtgttgtaaatatttatgta

SEQ ID NO: 1464344 - DNA, 15 bp, Homo sapiens
aagtgttgtgttcct

SEQ ID NO: 1464345 - DNA, 16 bp, Homo sapiens
aagtgttgtgttcctg

SEQ ID NO: 1464346 - DNA, 23 bp, Homo sapiens
aagtgtttaacttgtcaaaaaac

SEQ ID NO: 1464347 - DNA, 14 bp, Homo sapiens
aagtgtttctcaaa

SEQ ID NO: 1464348 - DNA, 18 bp, Homo sapiens
aagtgtttctcaaaagag

SEQ ID NO: 1464349 - DNA, 23 bp, Homo sapiens
aagtgtttctcaaaagaggttac

SEQ ID NO: 1464350 - DNA, 14 bp, Homo sapiens
aagttaaataaatc

SEQ ID NO: 1464351 - DNA, 14 bp, Homo sapiens
aagttaaatatgta

SEQ ID NO: 1464352 - DNA, 13 bp, Homo sapiens
aagttaacagaga

SEQ ID NO: 1464353 - DNA, 19 bp, Homo sapiens
aagttacacagaaatgctg

SEQ ID NO: 1464354 - DNA, 23 bp, Homo sapiens
aagttacacagaaatgctgctgg

SEQ ID NO: 1464355 - DNA, 22 bp, Homo sapiens
aagttacctgttatatatctct

SEQ ID NO: 1464356 - DNA, 15 bp, Homo sapiens
aagttactgaatgca

SEQ ID NO: 1464357 - DNA, 13 bp, Homo sapiens
aagttactgtaaa

SEQ ID NO: 1464358 - DNA, 14 bp, Homo sapiens
aagttactgtaaat

SEQ ID NO: 1464359 - DNA, 20 bp, Homo sapiens
aagttactgtaaatgccttg

SEQ ID NO: 1464360 - DNA, 19 bp, Homo sapiens
aagttactttgtcagaggc

SEQ ID NO: 1464361 - DNA, 22 bp, Homo sapiens
aagttagaactagccaaaccag

SEQ ID NO: 1464362 - DNA, 21 bp, Homo sapiens
aagttagagattttacaaaat

SEQ ID NO: 1464363 - DNA, 17 bp, Homo sapiens
aagttagggggttctta

SEQ ID NO: 1464364 - DNA, 20 bp, Homo sapiens
aagttagtatcttttgatat

SEQ ID NO: 1464365 - DNA, 18 bp, Homo sapiens
aagttagtattaaaatct

SEQ ID NO: 1464366 - DNA, 23 bp, Homo sapiens
aagttagtttgtatatattatta

SEQ ID NO: 1464367 - DNA, 18 bp, Homo sapiens
aagttataaatcaatgtc

SEQ ID NO: 1464368 - DNA, 18 bp, Homo sapiens
aagttatggcagtgatgc

SEQ ID NO: 1464369 - DNA, 16 bp, Homo sapiens
aagttatgtgtatgtg

SEQ ID NO: 1464370 - DNA, 15 bp, Homo sapiens
aagttattaacttta

SEQ ID NO: 1464371 - DNA, 19 bp, Homo sapiens
aagttattcaaatttgtac

SEQ ID NO: 1464372 - DNA, 21 bp, Homo sapiens
aagttattcaaatttgtacag

SEQ ID NO: 1464373 - DNA, 19 bp, Homo sapiens
aagttattgataagttcat

SEQ ID NO: 1464374 - DNA, 22 bp, Homo sapiens
aagttattgataagttcataca

SEQ ID NO: 1464375 - DNA, 21 bp, Homo sapiens
aagttatttactcctcctgct

SEQ ID NO: 1464376 - DNA, 13 bp, Homo sapiens
aagttatttactt

SEQ ID NO: 1464377 - DNA, 14 bp, Homo sapiens
aagttatttacttt

SEQ ID NO: 1464378 - DNA, 19 bp, Homo sapiens
aagttatttcttgtttgtt

SEQ ID NO: 1464379 - DNA, 18 bp, Homo sapiens
aagttattttctacagtg

SEQ ID NO: 1464380 - DNA, 15 bp, Homo sapiens
aagttatttttgtac

SEQ ID NO: 1464381 - DNA, 23 bp, Homo sapiens
aagttcaaattcttctgaactca

SEQ ID NO: 1464382 - DNA, 19 bp, Homo sapiens
aagttcaatctgtttttca

SEQ ID NO: 1464383 - DNA, 14 bp, Homo sapiens
aagttcatagggtc

SEQ ID NO: 1464384 - DNA, 22 bp, Homo sapiens
aagttcatattccatatttatt

SEQ ID NO: 1464385 - DNA, 20 bp, Homo sapiens
aagttcatgtttgtaaatta

SEQ ID NO: 1464386 - DNA, 20 bp, Homo sapiens
aagttcattgcaattaaact

SEQ ID NO: 1464387 - DNA, 16 bp, Homo sapiens
aagttccaagagtcta

SEQ ID NO: 1464388 - DNA, 17 bp, Homo sapiens
aagttccaagagtctaa

SEQ ID NO: 1464389 - DNA, 21 bp, Homo sapiens
aagttccaagagtctaaagat

SEQ ID NO: 1464390 - DNA, 19 bp, Homo sapiens
aagttccagtgttctctct

SEQ ID NO: 1464391 - DNA, 19 bp, Homo sapiens
aagttccatatagacacca

SEQ ID NO: 1464392 - DNA, 20 bp, Homo sapiens
aagttccccatccctgtcat

SEQ ID NO: 1464393 - DNA, 21 bp, Homo sapiens
aagttccccatccctgtcatt

SEQ ID NO: 1464394 - DNA, 16 bp, Homo sapiens
aagttctaagttcatg

SEQ ID NO: 1464395 - DNA, 22 bp, Homo sapiens
aagttctattttactgtcttga

SEQ ID NO: 1464396 - DNA, 18 bp, Homo sapiens
aagttctccagcttcagc

SEQ ID NO: 1464397 - DNA, 15 bp, Homo sapiens
aagttctgagtgttt

SEQ ID NO: 1464398 - DNA, 19 bp, Homo sapiens
aagttcttatgaggagggg

SEQ ID NO: 1464399 - DNA, 20 bp, Homo sapiens
aagttcttatgaggagggga

SEQ ID NO: 1464400 - DNA, 16 bp, Homo sapiens
aagttgaaaagccaaa

SEQ ID NO: 1464401 - DNA, 17 bp, Homo sapiens
aagttgaaaagccaaag

SEQ ID NO: 1464402 - DNA, 17 bp, Homo sapiens
aagttgaagctaagatt

SEQ ID NO: 1464403 - DNA, 14 bp, Homo sapiens
aagttgatgcaatc

SEQ ID NO: 1464404 - DNA, 22 bp, Homo sapiens
aagttgcagatgttagatattt

SEQ ID NO: 1464405 - DNA, 22 bp, Homo sapiens
aagttgcagtgagctgatatca

SEQ ID NO: 1464406 - DNA, 20 bp, Homo sapiens
aagttgcgacggagagaaaa

SEQ ID NO: 1464407 - DNA, 22 bp, Homo sapiens
aagttgcgacggagagaaaaaa

SEQ ID NO: 1464408 - DNA, 23 bp, Homo sapiens
aagttgcgacggagagaaaaaag

SEQ ID NO: 1464409 - DNA, 23 bp, Homo sapiens
aagttgctgtttattttttttgg

SEQ ID NO: 1464410 - DNA, 17 bp, Homo sapiens
aagttggaaaggaaaaa

SEQ ID NO: 1464411 - DNA, 23 bp, Homo sapiens
aagttggaaccgtgtccagcaca

SEQ ID NO: 1464412 - DNA, 11 bp, Homo sapiens
aagttggaagg

SEQ ID NO: 1464413 - DNA, 14 bp, Homo sapiens
aagttggaaggatc

SEQ ID NO: 1464414 - DNA, 11 bp, Homo sapiens
aagttggttta

SEQ ID NO: 1464415 - DNA, 22 bp, Homo sapiens
aatactcttgaaatgtagaatt

SEQ ID NO: 1464416 - DNA, 22 bp, Homo sapiens
aatactgcctagaaaatgcaaa

SEQ ID NO: 1464417 - DNA, 22 bp, Homo sapiens
aatactgctctgaatattttgt

SEQ ID NO: 1464418 - DNA, 15 bp, Homo sapiens
aatactggactcagg

SEQ ID NO: 1464419 - DNA, 19 bp, Homo sapiens
aatactggactcaggaact

SEQ ID NO: 1464420 - DNA, 20 bp, Homo sapiens
aatactggactcaggaactt

SEQ ID NO: 1464421 - DNA, 21 bp, Homo sapiens
aatactggactcaggaacttt

SEQ ID NO: 1464422 - DNA, 18 bp, Homo sapiens
aatactgggttcttagtt

SEQ ID NO: 1464423 - DNA, 11 bp, Homo sapiens
aatactggtct

SEQ ID NO: 1464424 - DNA, 15 bp, Homo sapiens
aatactgtgaaatac

SEQ ID NO: 1464425 - DNA, 19 bp, Homo sapiens
aatactgttattctttgca

SEQ ID NO: 1464426 - DNA, 22 bp, Homo sapiens
aatactgttattctttgcactt

SEQ ID NO: 1464427 - DNA, 18 bp, Homo sapiens
aatacttaaaaatagtct

SEQ ID NO: 1464428 - DNA, 14 bp, Homo sapiens
aatacttaaatgtt

SEQ ID NO: 1464429 - DNA, 18 bp, Homo sapiens
aatacttaaatgttatgt

SEQ ID NO: 1464430 - DNA, 21 bp, Homo sapiens
aatacttctcaaacctgttta

SEQ ID NO: 1464431 - DNA, 22 bp, Homo sapiens
aatacttctcaaacctgtttaa

SEQ ID NO: 1464432 - DNA, 23 bp, Homo sapiens
aatacttctcaaacctgtttaaa

SEQ ID NO: 1464433 - DNA, 16 bp, Homo sapiens
aatacttgactcattt

SEQ ID NO: 1464434 - DNA, 19 bp, Homo sapiens
aatacttttgtgtattctg

SEQ ID NO: 1464435 - DNA, 15 bp, Homo sapiens
aatacttttttctag

SEQ ID NO: 1464436 - DNA, 12 bp, Homo sapiens
aatagaaaaagt

SEQ ID NO: 1464437 - DNA, 13 bp, Homo sapiens
aatagaaaatggt

SEQ ID NO: 1464438 - DNA, 14 bp, Homo sapiens
aatagaaataaatt

SEQ ID NO: 1464439 - DNA, 19 bp, Homo sapiens
aatagaaataaattcctaa

SEQ ID NO: 1464440 - DNA, 16 bp, Homo sapiens
aatagaaattttgtaa

SEQ ID NO: 1464441 - DNA, 13 bp, Homo sapiens
aatagaacacagt

SEQ ID NO: 1464442 - DNA, 14 bp, Homo sapiens
aatagaaggtgatg

SEQ ID NO: 1464443 - DNA, 13 bp, Homo sapiens
aatagaataattc

SEQ ID NO: 1464444 - DNA, 17 bp, Homo sapiens
aatagaataattctttt

SEQ ID NO: 1464445 - DNA, 17 bp, Homo sapiens
aatagaatataattatc

SEQ ID NO: 1464446 - DNA, 17 bp, Homo sapiens
aatagacaaaaagtata

SEQ ID NO: 1464447 - DNA, 18 bp, Homo sapiens
aatagacaaaaagtatat

SEQ ID NO: 1464448 - DNA, 19 bp, Homo sapiens
aatagacagtaaaatacta

SEQ ID NO: 1464449 - DNA, 15 bp, Homo sapiens
aatagagactgtaga

SEQ ID NO: 1464450 - DNA, 18 bp, Homo sapiens
aatagagactgtagattg

SEQ ID NO: 1464451 - DNA, 13 bp, Homo sapiens
aatagagctgcca

SEQ ID NO: 1464452 - DNA, 15 bp, Homo sapiens
aatagagctgccact

SEQ ID NO: 1464453 - DNA, 18 bp, Homo sapiens
aatagagctgccactggg

SEQ ID NO: 1464454 - DNA, 13 bp, Homo sapiens
aatagaggagctg

SEQ ID NO: 1464455 - DNA, 16 bp, Homo sapiens
aatagagtatatgcac

SEQ ID NO: 1464456 - DNA, 17 bp, Homo sapiens
aatagagtatatgcact

SEQ ID NO: 1464457 - DNA, 23 bp, Homo sapiens
aatagagtgtagtttacagaaaa

SEQ ID NO: 1464458 - DNA, 19 bp, Homo sapiens
aatagagttgggacaattg

SEQ ID NO: 1464459 - DNA, 11 bp, Homo sapiens
aatagattctc

SEQ ID NO: 1464460 - DNA, 12 bp, Homo sapiens
aatagattctct

SEQ ID NO: 1464461 - DNA, 16 bp, Homo sapiens
aatagcagagagccaa

SEQ ID NO: 1464462 - DNA, 17 bp, Homo sapiens
aatagcagagagccaaa

SEQ ID NO: 1464463 - DNA, 19 bp, Homo sapiens
aatagcatgacaggctgtt

SEQ ID NO: 1464464 - DNA, 12 bp, Homo sapiens
aatagccagaga

SEQ ID NO: 1464465 - DNA, 14 bp, Homo sapiens
aatagccccagact

SEQ ID NO: 1464466 - DNA, 14 bp, Homo sapiens
aatagcctgaattt

SEQ ID NO: 1464467 - DNA, 15 bp, Homo sapiens
aatagctgaaaaggg

SEQ ID NO: 1464468 - DNA, 15 bp, Homo sapiens
aatagctgtagtttt

SEQ ID NO: 1464469 - DNA, 13 bp, Homo sapiens
aatagctgtcata

SEQ ID NO: 1464470 - DNA, 19 bp, Homo sapiens
aatagctgtcataaaatga

SEQ ID NO: 1464471 - DNA, 23 bp, Homo sapiens
aatagctgtgatcagtgattttc

SEQ ID NO: 1464472 - DNA, 13 bp, Homo sapiens
aatagcttctgtg

SEQ ID NO: 1464473 - DNA, 23 bp, Homo sapiens
aataggaatcattcagaaatgtt

SEQ ID NO: 1464474 - DNA, 16 bp, Homo sapiens
aataggagtatttttg

SEQ ID NO: 1464475 - DNA, 16 bp, Homo sapiens
aataggatttttagaa

SEQ ID NO: 1464476 - DNA, 14 bp, Homo sapiens
aataggcaggaagc

SEQ ID NO: 1464477 - DNA, 14 bp, Homo sapiens
aataggcctattta

SEQ ID NO: 1464478 - DNA, 20 bp, Homo sapiens
aataggctattaaaaaagtc

SEQ ID NO: 1464479 - DNA, 18 bp, Homo sapiens
aatagggagacagggtag

SEQ ID NO: 1464480 - DNA, 23 bp, Homo sapiens
aatagggtagaatgattaatcaa

SEQ ID NO: 1464481 - DNA, 14 bp, Homo sapiens
aataggtatataga

SEQ ID NO: 1464482 - DNA, 14 bp, Homo sapiens
aataggtcagataa

SEQ ID NO: 1464483 - DNA, 22 bp, Homo sapiens
aataggtgggggaaaatgaatt

SEQ ID NO: 1464484 - DNA, 16 bp, Homo sapiens
aataggttcagatttt

SEQ ID NO: 1464485 - DNA, 15 bp, Homo sapiens
aatagtaaacattaa

SEQ ID NO: 1464486 - DNA, 12 bp, Homo sapiens
aatagtaactct

SEQ ID NO: 1464487 - DNA, 15 bp, Homo sapiens
aatagtatagaagtc

SEQ ID NO: 1464488 - DNA, 15 bp, Homo sapiens
aatagtatttgagag

SEQ ID NO: 1464489 - DNA, 15 bp, Homo sapiens
aatagtcagaaaaca

SEQ ID NO: 1464490 - DNA, 24 bp, Homo sapiens
aatagtctctctgcaagacagaaa

SEQ ID NO: 1464491 - DNA, 13 bp, Homo sapiens
aatagtctgtgtg

SEQ ID NO: 1464492 - DNA, 21 bp, Homo sapiens
aatagtgccgcaataaacata

SEQ ID NO: 1464493 - DNA, 15 bp, Homo sapiens
aatagtgtaagaact

SEQ ID NO: 1464494 - DNA, 18 bp, Homo sapiens
aatagtgtaagaactgta

SEQ ID NO: 1464495 - DNA, 20 bp, Homo sapiens
aatagtgtcatataaactca

SEQ ID NO: 1464496 - DNA, 15 bp, Homo sapiens
aatagttagccctca

SEQ ID NO: 1464497 - DNA, 22 bp, Homo sapiens
aatagttcagtagaattaccat

SEQ ID NO: 1464498 - DNA, 11 bp, Homo sapiens
aatagttctgt

SEQ ID NO: 1464499 - DNA, 12 bp, Homo sapiens
aatagttgaatt

SEQ ID NO: 1464500 - DNA, 14 bp, Homo sapiens
aatagtttgtctat

SEQ ID NO: 1464501 - DNA, 19 bp, Homo sapiens
aatagtttgtctattttaa

SEQ ID NO: 1464502 - DNA, 14 bp, Homo sapiens
aatagttttttact

SEQ ID NO: 1464503 - DNA, 14 bp, Homo sapiens
aatataaacaaaga

SEQ ID NO: 1464504 - DNA, 22 bp, Homo sapiens
aatataaacaaagattcatgat

SEQ ID NO: 1464505 - DNA, 16 bp, Homo sapiens
aatataaagtattcaa

SEQ ID NO: 1464506 - DNA, 14 bp, Homo sapiens
aatataacacattt

SEQ ID NO: 1464507 - DNA, 22 bp, Homo sapiens
aatataactatgtggctgaaaa

SEQ ID NO: 1464508 - DNA, 21 bp, Homo sapiens
aatataacttaaaaatgtaaa

SEQ ID NO: 1464509 - DNA, 14 bp, Homo sapiens
aatataagcataaa

SEQ ID NO: 1464510 - DNA, 17 bp, Homo sapiens
aatataagcataaaaga

SEQ ID NO: 1464511 - DNA, 19 bp, Homo sapiens
aatataaggaaagcaataa

SEQ ID NO: 1464512 - DNA, 17 bp, Homo sapiens
aatataatgtattttct

SEQ ID NO: 1464513 - DNA, 11 bp, Homo sapiens
aatataattat

SEQ ID NO: 1464514 - DNA, 23 bp, Homo sapiens
aatataattttggtaattttgat

SEQ ID NO: 1464515 - DNA, 20 bp, Homo sapiens
aatatacatgtttatgtaaa

SEQ ID NO: 1464516 - DNA, 19 bp, Homo sapiens
aatatacattcaaacttaa

SEQ ID NO: 1464517 - DNA, 18 bp, Homo sapiens
aatatacattttctaaat

SEQ ID NO: 1464518 - DNA, 20 bp, Homo sapiens
aatatacattttctaaataa

SEQ ID NO: 1464519 - DNA, 17 bp, Homo sapiens
aatatactatatttatg

SEQ ID NO: 1464520 - DNA, 14 bp, Homo sapiens
aatatagaaacacg

SEQ ID NO: 1464521 - DNA, 23 bp, Homo sapiens
aatatagagacaggacagaatgt

SEQ ID NO: 1464522 - DNA, 22 bp, Homo sapiens
aatatagatgtaatttttcaaa

SEQ ID NO: 1464523 - DNA, 18 bp, Homo sapiens
aatataggtcctgtgtta

SEQ ID NO: 1464524 - DNA, 20 bp, Homo sapiens
aatatagttattattgctgt

SEQ ID NO: 1464525 - DNA, 21 bp, Homo sapiens
aatatagttattattgctgtt

SEQ ID NO: 1464526 - DNA, 22 bp, Homo sapiens
aatatagttgaacaagatttcc

SEQ ID NO: 1464527 - DNA, 23 bp, Homo sapiens
aatatagttgaacaagatttccc

SEQ ID NO: 1464528 - DNA, 18 bp, Homo sapiens
aatatataaaaagaaaag

SEQ ID NO: 1464529 - DNA, 14 bp, Homo sapiens
aatatataatttat

SEQ ID NO: 1464530 - DNA, 13 bp, Homo sapiens
aattcttctgaac

SEQ ID NO: 1464531 - DNA, 18 bp, Homo sapiens
aattcttctgaactcaaa

SEQ ID NO: 1464532 - DNA, 22 bp, Homo sapiens
aattcttctgcaacatttgaca

SEQ ID NO: 1464533 - DNA, 18 bp, Homo sapiens
aattcttgtaatttttat

SEQ ID NO: 1464534 - DNA, 16 bp, Homo sapiens
aattcttgtatattat

SEQ ID NO: 1464535 - DNA, 16 bp, Homo sapiens
aattctttagtactca

SEQ ID NO: 1464536 - DNA, 16 bp, Homo sapiens
aattctttctgtctcc

SEQ ID NO: 1464537 - DNA, 18 bp, Homo sapiens
aattctttgacctgttgg

SEQ ID NO: 1464538 - DNA, 22 bp, Homo sapiens
aattctttgacctgttgggagt

SEQ ID NO: 1464539 - DNA, 17 bp, Homo sapiens
aattctttgttctgttt

SEQ ID NO: 1464540 - DNA, 15 bp, Homo sapiens
aattcttttctgagg

SEQ ID NO: 1464541 - DNA, 13 bp, Homo sapiens
aattgaaaaaaat

SEQ ID NO: 1464542 - DNA, 14 bp, Homo sapiens
aattgaaaagtaca

SEQ ID NO: 1464543 - DNA, 18 bp, Homo sapiens
aattgaaaagtgttctgt

SEQ ID NO: 1464544 - DNA, 20 bp, Homo sapiens
aattgaaaagtgttctgtgc

SEQ ID NO: 1464545 - DNA, 16 bp, Homo sapiens
aattgaaactgagtat

SEQ ID NO: 1464546 - DNA, 22 bp, Homo sapiens
aattgaaaggcattctctgaag

SEQ ID NO: 1464547 - DNA, 20 bp, Homo sapiens
aattgaaggttgtatgtaaa

SEQ ID NO: 1464548 - DNA, 18 bp, Homo sapiens
aattgaagtaaacttttt

SEQ ID NO: 1464549 - DNA, 20 bp, Homo sapiens
aattgaagtttcaagtttta

SEQ ID NO: 1464550 - DNA, 21 bp, Homo sapiens
aattgacataggcaataataa

SEQ ID NO: 1464551 - DNA, 11 bp, Homo sapiens
aattgactacc

SEQ ID NO: 1464552 - DNA, 14 bp, Homo sapiens
aattgactgtcact

SEQ ID NO: 1464553 - DNA, 21 bp, Homo sapiens
aattgaggtttggaagagtga

SEQ ID NO: 1464554 - DNA, 22 bp, Homo sapiens
aattgaggtttggaagagtgaa

SEQ ID NO: 1464555 - DNA, 22 bp, Homo sapiens
aattgagtagctgcatgctgtt

SEQ ID NO: 1464556 - DNA, 18 bp, Homo sapiens
aattgagttgcacttatt

SEQ ID NO: 1464557 - DNA, 19 bp, Homo sapiens
aattgatacttcaggtgct

SEQ ID NO: 1464558 - DNA, 16 bp, Homo sapiens
aattgatgtatatgtt

SEQ ID NO: 1464559 - DNA, 20 bp, Homo sapiens
aattgatgtatatgtttata

SEQ ID NO: 1464560 - DNA, 22 bp, Homo sapiens
aattgattattctgattccact

SEQ ID NO: 1464561 - DNA, 23 bp, Homo sapiens
aattgattattctgattccactt

SEQ ID NO: 1464562 - DNA, 20 bp, Homo sapiens
aattgatttttataaatact

SEQ ID NO: 1464563 - DNA, 22 bp, Homo sapiens
aattgatttttctcttcatttt

SEQ ID NO: 1464564 - DNA, 14 bp, Homo sapiens
aattgcaatatata

SEQ ID NO: 1464565 - DNA, 15 bp, Homo sapiens
aattgcactgctgtt

SEQ ID NO: 1464566 - DNA, 17 bp, Homo sapiens
aattgcagaattcaaaa

SEQ ID NO: 1464567 - DNA, 13 bp, Homo sapiens
aattgcagtcatt

SEQ ID NO: 1464568 - DNA, 14 bp, Homo sapiens
aattgcagtcattt

SEQ ID NO: 1464569 - DNA, 12 bp, Homo sapiens
aattgccagctg

SEQ ID NO: 1464570 - DNA, 19 bp, Homo sapiens
aattgcctacaataaaaag

SEQ ID NO: 1464571 - DNA, 14 bp, Homo sapiens
aattgcctttctgt

SEQ ID NO: 1464572 - DNA, 19 bp, Homo sapiens
aattgcctttctgtgttta

SEQ ID NO: 1464573 - DNA, 19 bp, Homo sapiens
aattgctatgttactattt

SEQ ID NO: 1464574 - DNA, 22 bp, Homo sapiens
aattgctattttatttgtattc

SEQ ID NO: 1464575 - DNA, 14 bp, Homo sapiens
aattgctcaagttc

SEQ ID NO: 1464576 - DNA, 17 bp, Homo sapiens
aattgctcacagttatt

SEQ ID NO: 1464577 - DNA, 21 bp, Homo sapiens
aattgctcacagttattacat

SEQ ID NO: 1464578 - DNA, 22 bp, Homo sapiens
aattgctcacagttattacata

SEQ ID NO: 1464579 - DNA, 19 bp, Homo sapiens
aattgcttaaaagacattt

SEQ ID NO: 1464580 - DNA, 19 bp, Homo sapiens
aattgcttaccaaaggata

SEQ ID NO: 1464581 - DNA, 14 bp, Homo sapiens
aattgcttctaaaa

SEQ ID NO: 1464582 - DNA, 18 bp, Homo sapiens
aattgcttctaaaacaat

SEQ ID NO: 1464583 - DNA, 19 bp, Homo sapiens
aattgcttctaaaacaata

SEQ ID NO: 1464584 - DNA, 18 bp, Homo sapiens
aattgctttgccaaaata

SEQ ID NO: 1464585 - DNA, 20 bp, Homo sapiens
aattgctttgccaaaatacc

SEQ ID NO: 1464586 - DNA, 19 bp, Homo sapiens
aattggaatcttcacctca

SEQ ID NO: 1464587 - DNA, 20 bp, Homo sapiens
aattggaatcttcacctcag

SEQ ID NO: 1464588 - DNA, 22 bp, Homo sapiens
aattggagttggagtagaatgt

SEQ ID NO: 1464589 - DNA, 23 bp, Homo sapiens
aattggatacagtacggatttgt

SEQ ID NO: 1464590 - DNA, 14 bp, Homo sapiens
aattggattatttt

SEQ ID NO: 1464591 - DNA, 11 bp, Homo sapiens
aattggatttc

SEQ ID NO: 1464592 - DNA, 21 bp, Homo sapiens
aattggcagccctatttcagt

SEQ ID NO: 1464593 - DNA, 21 bp, Homo sapiens
aattgggagcttgggaatgga

SEQ ID NO: 1464594 - DNA, 19 bp, Homo sapiens
aattgggcttcaatcactg

SEQ ID NO: 1464595 - DNA, 16 bp, Homo sapiens
aattggggaggagggg

SEQ ID NO: 1464596 - DNA, 15 bp, Homo sapiens
aattggtaaaaacag

SEQ ID NO: 1464597 - DNA, 17 bp, Homo sapiens
aattggtaaaaacagca

SEQ ID NO: 1464598 - DNA, 19 bp, Homo sapiens
aattggtacttttaaaaac

SEQ ID NO: 1464599 - DNA, 18 bp, Homo sapiens
aattggtatcaagaaagt

SEQ ID NO: 1464600 - DNA, 13 bp, Homo sapiens
aattgtaatctga

SEQ ID NO: 1464601 - DNA, 12 bp, Homo sapiens
aattgtacaaaa

SEQ ID NO: 1464602 - DNA, 15 bp, Homo sapiens
aattgtacaataaat

SEQ ID NO: 1464603 - DNA, 18 bp, Homo sapiens
aattgtagttctgtgtac

SEQ ID NO: 1464604 - DNA, 21 bp, Homo sapiens
aattgtagttctgtgtacttt

SEQ ID NO: 1464605 - DNA, 11 bp, Homo sapiens
aattgtataag

SEQ ID NO: 1464606 - DNA, 16 bp, Homo sapiens
aattgtataagtcaag

SEQ ID NO: 1464607 - DNA, 18 bp, Homo sapiens
aattgtataagtcaagca

SEQ ID NO: 1464608 - DNA, 21 bp, Homo sapiens
aattgtataagtcaagcacat

SEQ ID NO: 1464609 - DNA, 21 bp, Homo sapiens
aattgtatacattttgttata

SEQ ID NO: 1464610 - DNA, 22 bp, Homo sapiens
aattgtatacattttgttatag

SEQ ID NO: 1464611 - DNA, 22 bp, Homo sapiens
aattgtatctcatactgtctgg

SEQ ID NO: 1464612 - DNA, 18 bp, Homo sapiens
aattgtatggtgataaaa

SEQ ID NO: 1464613 - DNA, 16 bp, Homo sapiens
aattgtattgaaaaca

SEQ ID NO: 1464614 - DNA, 19 bp, Homo sapiens
aattgtcattatttttgtt

SEQ ID NO: 1464615 - DNA, 12 bp, Homo sapiens
aattgtctcttc

SEQ ID NO: 1464616 - DNA, 21 bp, Homo sapiens
aattgtcttttttttcctttg

SEQ ID NO: 1464617 - DNA, 14 bp, Homo sapiens
aattgtgatgtgtc

SEQ ID NO: 1464618 - DNA, 18 bp, Homo sapiens
aattgtgattagacagaa

SEQ ID NO: 1464619 - DNA, 14 bp, Homo sapiens
aattgtgctgccat

SEQ ID NO: 1464620 - DNA, 13 bp, Homo sapiens
aattgtggattaa

SEQ ID NO: 1464621 - DNA, 17 bp, Homo sapiens
aattgtggattataaaa

SEQ ID NO: 1464622 - DNA, 21 bp, Homo sapiens
aattgtgtaaaaaatggaaaa

SEQ ID NO: 1464623 - DNA, 14 bp, Homo sapiens
aattgtgtatatgt

SEQ ID NO: 1464624 - DNA, 19 bp, Homo sapiens
aattgtgtatatgttggtt

SEQ ID NO: 1464625 - DNA, 23 bp, Homo sapiens
aattgtgtattgatgcaatataa

SEQ ID NO: 1464626 - DNA, 20 bp, Homo sapiens
aattgtgttttaattgtaaa

SEQ ID NO: 1464627 - DNA, 17 bp, Homo sapiens
aattgttacaagtgttc

SEQ ID NO: 1464628 - DNA, 23 bp, Homo sapiens
aattgttacaagtgttcttaggt

SEQ ID NO: 1464629 - DNA, 15 bp, Homo sapiens
aattgtttaagtgtt

SEQ ID NO: 1464630 - DNA, 14 bp, Homo sapiens
aattgtttagattt

SEQ ID NO: 1464631 - DNA, 21 bp, Homo sapiens
aattgtttatgtgttatgaac

SEQ ID NO: 1464632 - DNA, 17 bp, Homo sapiens
aattgtttggcttcctc

SEQ ID NO: 1464633 - DNA, 19 bp, Homo sapiens
aattgtttggcttcctcct

SEQ ID NO: 1464634 - DNA, 21 bp, Homo sapiens
aattgtttggcttcctcctga

SEQ ID NO: 1464635 - DNA, 14 bp, Homo sapiens
aattgttttcactt

SEQ ID NO: 1464636 - DNA, 15 bp, Homo sapiens
aattgttttggaata

SEQ ID NO: 1464637 - DNA, 19 bp, Homo sapiens
aattgttttttaaagcaag

SEQ ID NO: 1464638 - DNA, 18 bp, Homo sapiens
aattgttttttaatttaa

SEQ ID NO: 1464639 - DNA, 18 bp, Homo sapiens
aatttaaaaaataaataa

SEQ ID NO: 1464640 - DNA, 16 bp, Homo sapiens
aatttaaaattaagta

SEQ ID NO: 1464641 - DNA, 18 bp, Homo sapiens
aatttaaagggtgtactt

SEQ ID NO: 1464642 - DNA, 21 bp, Homo sapiens
aatttaaagggtgtacttata

SEQ ID NO: 1464643 - DNA, 18 bp, Homo sapiens
aatttaaataaagttact

SEQ ID NO: 1464644 - DNA, 17 bp, Homo sapiens
acaaaagcaaagatgca

SEQ ID NO: 1464645 - DNA, 15 bp, Homo sapiens
acaaaagctttttaa

SEQ ID NO: 1464646 - DNA, 13 bp, Homo sapiens
acaaaagggtgta

SEQ ID NO: 1464647 - DNA, 13 bp, Homo sapiens
acaaaataaattg

SEQ ID NO: 1464648 - DNA, 14 bp, Homo sapiens
acaaaatatttaag

SEQ ID NO: 1464649 - DNA, 12 bp, Homo sapiens
acaaaatgccaa

SEQ ID NO: 1464650 - DNA, 20 bp, Homo sapiens
acaaaattaagcaaatgtta

SEQ ID NO: 1464651 - DNA, 13 bp, Homo sapiens
acaaaattcaaag

SEQ ID NO: 1464652 - DNA, 13 bp, Homo sapiens
acaaaatttgaga

SEQ ID NO: 1464653 - DNA, 15 bp, Homo sapiens
acaaaattttatttt

SEQ ID NO: 1464654 - DNA, 23 bp, Homo sapiens
acaaaattttgtttaaaactcag

SEQ ID NO: 1464655 - DNA, 10 bp, Homo sapiens
acaaacaaaa

SEQ ID NO: 1464656 - DNA, 15 bp, Homo sapiens
acaaacaaaaaatta

SEQ ID NO: 1464657 - DNA, 13 bp, Homo sapiens
acaaacaaaactt

SEQ ID NO: 1464658 - DNA, 15 bp, Homo sapiens
acaaacaaacaaact

SEQ ID NO: 1464659 - DNA, 14 bp, Homo sapiens
acaaacacacctct

SEQ ID NO: 1464660 - DNA, 15 bp, Homo sapiens
acaaacacctcccag

SEQ ID NO: 1464661 - DNA, 11 bp, Homo sapiens
acaaacactgc

SEQ ID NO: 1464662 - DNA, 22 bp, Homo sapiens
acaaacactgcagtttcctgga

SEQ ID NO: 1464663 - DNA, 13 bp, Homo sapiens
acaaacactgcca

SEQ ID NO: 1464664 - DNA, 22 bp, Homo sapiens
acaaacactgccatattgtgta

SEQ ID NO: 1464665 - DNA, 20 bp, Homo sapiens
acaaacagggctgccttctg

SEQ ID NO: 1464666 - DNA, 14 bp, Homo sapiens
acaaacataagtgc

SEQ ID NO: 1464667 - DNA, 17 bp, Homo sapiens
acaaaccaacatctttg

SEQ ID NO: 1464668 - DNA, 15 bp, Homo sapiens
acaaaccacaactga

SEQ ID NO: 1464669 - DNA, 16 bp, Homo sapiens
acaaaccacaactgac

SEQ ID NO: 1464670 - DNA, 21 bp, Homo sapiens
acaaaccacaactgacacagg

SEQ ID NO: 1464671 - DNA, 14 bp, Homo sapiens
acaaaccatgcaaa

SEQ ID NO: 1464672 - DNA, 23 bp, Homo sapiens
acaaaccctgctgaacacagtgt

SEQ ID NO: 1464673 - DNA, 20 bp, Homo sapiens
acaaaccgaaaatggacatt

SEQ ID NO: 1464674 - DNA, 14 bp, Homo sapiens
acaaacctaaaaat

SEQ ID NO: 1464675 - DNA, 18 bp, Homo sapiens
acaaacctaccaaaatgg

SEQ ID NO: 1464676 - DNA, 16 bp, Homo sapiens
acaaacctcactgaga

SEQ ID NO: 1464677 - DNA, 21 bp, Homo sapiens
acaaacggagcccctgaaagc

SEQ ID NO: 1464678 - DNA, 15 bp, Homo sapiens
acaaacgtccccagc

SEQ ID NO: 1464679 - DNA, 16 bp, Homo sapiens
acaaactacatgtaat

SEQ ID NO: 1464680 - DNA, 17 bp, Homo sapiens
acaaactacctctggac

SEQ ID NO: 1464681 - DNA, 22 bp, Homo sapiens
acaaactatttcttatatatgt

SEQ ID NO: 1464682 - DNA, 19 bp, Homo sapiens
acaaactcatcctctttta

SEQ ID NO: 1464683 - DNA, 22 bp, Homo sapiens
acaaactcatcctcttttaatg

SEQ ID NO: 1464684 - DNA, 16 bp, Homo sapiens
acaaactctcaccatg

SEQ ID NO: 1464685 - DNA, 20 bp, Homo sapiens
acaaactcttcagttaattc

SEQ ID NO: 1464686 - DNA, 11 bp, Homo sapiens
acaaactgcaa

SEQ ID NO: 1464687 - DNA, 16 bp, Homo sapiens
acaaactgcaatagag

SEQ ID NO: 1464688 - DNA, 15 bp, Homo sapiens
acaaactgtgaaaat

SEQ ID NO: 1464689 - DNA, 20 bp, Homo sapiens
acaaagaacctaacatttat

SEQ ID NO: 1464690 - DNA, 22 bp, Homo sapiens
acaaagacaaattctgtttctt

SEQ ID NO: 1464691 - DNA, 15 bp, Homo sapiens
acaaagacattgatt

SEQ ID NO: 1464692 - DNA, 20 bp, Homo sapiens
acaaagagaaaaagaaatgc

SEQ ID NO: 1464693 - DNA, 23 bp, Homo sapiens
acaaagatgtttgtcagatatga

SEQ ID NO: 1464694 - DNA, 16 bp, Homo sapiens
acaaagcacagtttga

SEQ ID NO: 1464695 - DNA, 18 bp, Homo sapiens
acaaagcacagtttgaac

SEQ ID NO: 1464696 - DNA, 17 bp, Homo sapiens
acaaagcagctttaaaa

SEQ ID NO: 1464697 - DNA, 17 bp, Homo sapiens
acaaagccaacagtcaa

SEQ ID NO: 1464698 - DNA, 15 bp, Homo sapiens
acaaagccagaggag

SEQ ID NO: 1464699 - DNA, 20 bp, Homo sapiens
acaaagcgagatcccatctc

SEQ ID NO: 1464700 - DNA, 22 bp, Homo sapiens
acaaagctcaagatgacagctc

SEQ ID NO: 1464701 - DNA, 14 bp, Homo sapiens
acaaagctttgcta

SEQ ID NO: 1464702 - DNA, 16 bp, Homo sapiens
acaaaggatgaagaac

SEQ ID NO: 1464703 - DNA, 18 bp, Homo sapiens
acaaagggaaagcctctg

SEQ ID NO: 1464704 - DNA, 19 bp, Homo sapiens
acaaagggaaagcctctgg

SEQ ID NO: 1464705 - DNA, 11 bp, Homo sapiens
acaaagtgcct

SEQ ID NO: 1464706 - DNA, 20 bp, Homo sapiens
acaaagtttacattgtcctg

SEQ ID NO: 1464707 - DNA, 19 bp, Homo sapiens
acaaagtttcagagtatat

SEQ ID NO: 1464708 - DNA, 22 bp, Homo sapiens
acaaagtttcagagtatattgt

SEQ ID NO: 1464709 - DNA, 11 bp, Homo sapiens
acaaataaacc

SEQ ID NO: 1464710 - DNA, 13 bp, Homo sapiens
acaaataaacctg

SEQ ID NO: 1464711 - DNA, 17 bp, Homo sapiens
acaaataaacctgaggc

SEQ ID NO: 1464712 - DNA, 16 bp, Homo sapiens
acaaataacaatgtgc

SEQ ID NO: 1464713 - DNA, 12 bp, Homo sapiens
acaaataatcac

SEQ ID NO: 1464714 - DNA, 23 bp, Homo sapiens
acaaatactcttaggaagagaaa

SEQ ID NO: 1464715 - DNA, 22 bp, Homo sapiens
acaaatatagttgaacaagatt

SEQ ID NO: 1464716 - DNA, 19 bp, Homo sapiens
acaaatatgcaaaaggttc

SEQ ID NO: 1464717 - DNA, 16 bp, Homo sapiens
acaaatcagaagtcat

SEQ ID NO: 1464718 - DNA, 20 bp, Homo sapiens
acaaatcagaagtcatcttg

SEQ ID NO: 1464719 - DNA, 19 bp, Homo sapiens
acaaatctgcaaagcatgt

SEQ ID NO: 1464720 - DNA, 13 bp, Homo sapiens
acaaatgggactg

SEQ ID NO: 1464721 - DNA, 22 bp, Homo sapiens
acaaatgggactgatgtcatct

SEQ ID NO: 1464722 - DNA, 17 bp, Homo sapiens
acaaatggtgaatggat

SEQ ID NO: 1464723 - DNA, 20 bp, Homo sapiens
acaaatggtgaatggatttc

SEQ ID NO: 1464724 - DNA, 17 bp, Homo sapiens
acaaatgtaagcaaagg

SEQ ID NO: 1464725 - DNA, 16 bp, Homo sapiens
acaaatgtcattgtct

SEQ ID NO: 1464726 - DNA, 23 bp, Homo sapiens
acaaatgttcatatttattgatt

SEQ ID NO: 1464727 - DNA, 16 bp, Homo sapiens
acaaattaactagata

SEQ ID NO: 1464728 - DNA, 22 bp, Homo sapiens
acaaattaactagatacagaat

SEQ ID NO: 1464729 - DNA, 23 bp, Homo sapiens
acaaattaactagatacagaata

SEQ ID NO: 1464730 - DNA, 15 bp, Homo sapiens
acaaattagaggaga

SEQ ID NO: 1464731 - DNA, 15 bp, Homo sapiens
acaaattataatgta

SEQ ID NO: 1464732 - DNA, 17 bp, Homo sapiens
acaaattataatgtatt

SEQ ID NO: 1464733 - DNA, 22 bp, Homo sapiens
acaaattcaagagctagaaaaa

SEQ ID NO: 1464734 - DNA, 12 bp, Homo sapiens
acaaattctgtt

SEQ ID NO: 1464735 - DNA, 15 bp, Homo sapiens
acaaattctgtttct

SEQ ID NO: 1464736 - DNA, 16 bp, Homo sapiens
acaaattctgtttctt

SEQ ID NO: 1464737 - DNA, 19 bp, Homo sapiens
acaaattctttagtactca

SEQ ID NO: 1464738 - DNA, 20 bp, Homo sapiens
acaaattctttagtactcaa

SEQ ID NO: 1464739 - DNA, 20 bp, Homo sapiens
acaaattgcttactttggaa

SEQ ID NO: 1464740 - DNA, 16 bp, Homo sapiens
acaaatttatgcattt

SEQ ID NO: 1464741 - DNA, 18 bp, Homo sapiens
acaaatttatgcatttca

SEQ ID NO: 1464742 - DNA, 22 bp, Homo sapiens
acaaatttatgcatttcattca

SEQ ID NO: 1464743 - DNA, 19 bp, Homo sapiens
acaaatttggccttaagaa

SEQ ID NO: 1464744 - DNA, 23 bp, Homo sapiens
acaaatttggccttaagaactgt

SEQ ID NO: 1464745 - DNA, 16 bp, Homo sapiens
acaaatttttatttct

SEQ ID NO: 1464746 - DNA, 21 bp, Homo sapiens
acaaatttttatttctaaaat

SEQ ID NO: 1464747 - DNA, 12 bp, Homo sapiens
acaacaaaagaa

SEQ ID NO: 1464748 - DNA, 13 bp, Homo sapiens
acaacaataataa

SEQ ID NO: 1464749 - DNA, 15 bp, Homo sapiens
acaacactacttccc

SEQ ID NO: 1464750 - DNA, 20 bp, Homo sapiens
acaacactcatcacacttca

SEQ ID NO: 1464751 - DNA, 13 bp, Homo sapiens
acaacagaagtca

SEQ ID NO: 1464752 - DNA, 14 bp, Homo sapiens
acaacagcagtctc

SEQ ID NO: 1464753 - DNA, 15 bp, Homo sapiens
acaacagctgaagca

SEQ ID NO: 1464754 - DNA, 17 bp, Homo sapiens
acaacaggttttcacca

SEQ ID NO: 1464755 - DNA, 17 bp, Homo sapiens
acaacattatgatctaa

SEQ ID NO: 1464756 - DNA, 18 bp, Homo sapiens
acaacattatgatctaat

SEQ ID NO: 1464757 - DNA, 23 bp, Homo sapiens
acaacattatgatctaataaact

SEQ ID NO: 1464758 - DNA, 12 bp, Homo sapiens
acaacatttatg

SEQ ID NO: 1464759 - DNA, 21 bp, Homo sapiens
acacagacattttgtgtgaga

SEQ ID NO: 1464760 - DNA, 14 bp, Homo sapiens
acacagactatttt

SEQ ID NO: 1464761 - DNA, 17 bp, Homo sapiens
acacagatacacacaca

SEQ ID NO: 1464762 - DNA, 19 bp, Homo sapiens
acacagcacaccagccgct

SEQ ID NO: 1464763 - DNA, 18 bp, Homo sapiens
acacagcagtgtcccctg

SEQ ID NO: 1464764 - DNA, 21 bp, Homo sapiens
acacagccaaggggatattta

SEQ ID NO: 1464765 - DNA, 23 bp, Homo sapiens
acacagcctatatcaaacatgca

SEQ ID NO: 1464766 - DNA, 14 bp, Homo sapiens
acacagcctggact

SEQ ID NO: 1464767 - DNA, 13 bp, Homo sapiens
acacagcctgggc

SEQ ID NO: 1464768 - DNA, 18 bp, Homo sapiens
acacagcctgggccccag

SEQ ID NO: 1464769 - DNA, 15 bp, Homo sapiens
acacagctcttcatt

SEQ ID NO: 1464770 - DNA, 14 bp, Homo sapiens
acacagctgagcac

SEQ ID NO: 1464771 - DNA, 13 bp, Homo sapiens
acacagctgccct

SEQ ID NO: 1464772 - DNA, 14 bp, Homo sapiens
acacagctgcccta

SEQ ID NO: 1464773 - DNA, 16 bp, Homo sapiens
acacagctgccctagc

SEQ ID NO: 1464774 - DNA, 11 bp, Homo sapiens
acacagctgtt

SEQ ID NO: 1464775 - DNA, 16 bp, Homo sapiens
acacaggcaactgagg

SEQ ID NO: 1464776 - DNA, 11 bp, Homo sapiens
acacagggcac

SEQ ID NO: 1464777 - DNA, 13 bp, Homo sapiens
acacagggcactg

SEQ ID NO: 1464778 - DNA, 14 bp, Homo sapiens
acacagggctcttt

SEQ ID NO: 1464779 - DNA, 24 bp, Homo sapiens
acacagtaaaaacttgtactatgt

SEQ ID NO: 1464780 - DNA, 14 bp, Homo sapiens
acacagtactttat

SEQ ID NO: 1464781 - DNA, 15 bp, Homo sapiens
acacagtgacttcct

SEQ ID NO: 1464782 - DNA, 19 bp, Homo sapiens
acacagtgccttcaataaa

SEQ ID NO: 1464783 - DNA, 20 bp, Homo sapiens
acacagtgtctgttcagcaa

SEQ ID NO: 1464784 - DNA, 14 bp, Homo sapiens
acacagttatcaaa

SEQ ID NO: 1464785 - DNA, 15 bp, Homo sapiens
acacagttcctggga

SEQ ID NO: 1464786 - DNA, 22 bp, Homo sapiens
acacagttgctgtcataagaat

SEQ ID NO: 1464787 - DNA, 13 bp, Homo sapiens
acacataaatctg

SEQ ID NO: 1464788 - DNA, 20 bp, Homo sapiens
acacataaatctgtctgatt

SEQ ID NO: 1464789 - DNA, 18 bp, Homo sapiens
acacatacgtgcacaggg

SEQ ID NO: 1464790 - DNA, 22 bp, Homo sapiens
acacatagcaggggcaccttcc

SEQ ID NO: 1464791 - DNA, 19 bp, Homo sapiens
acacatagttaaaaaagaa

SEQ ID NO: 1464792 - DNA, 16 bp, Homo sapiens
acacatatatattaca

SEQ ID NO: 1464793 - DNA, 12 bp, Homo sapiens
acacatatgaac

SEQ ID NO: 1464794 - DNA, 19 bp, Homo sapiens
acacatatgaacacagaca

SEQ ID NO: 1464795 - DNA, 17 bp, Homo sapiens
acacatcccggcctctt

SEQ ID NO: 1464796 - DNA, 16 bp, Homo sapiens
acacatcgcactgtgg

SEQ ID NO: 1464797 - DNA, 20 bp, Homo sapiens
acacatctattgcagagact

SEQ ID NO: 1464798 - DNA, 15 bp, Homo sapiens
acacatctggccctg

SEQ ID NO: 1464799 - DNA, 16 bp, Homo sapiens
acacatctggccctga

SEQ ID NO: 1464800 - DNA, 19 bp, Homo sapiens
acacatctgggtgccctga

SEQ ID NO: 1464801 - DNA, 20 bp, Homo sapiens
acacatctgggtgccctgaa

SEQ ID NO: 1464802 - DNA, 22 bp, Homo sapiens
acacatctgggtgccctgaaag

SEQ ID NO: 1464803 - DNA, 15 bp, Homo sapiens
acacatcttcaacag

SEQ ID NO: 1464804 - DNA, 17 bp, Homo sapiens
acacatgctatgttctg

SEQ ID NO: 1464805 - DNA, 15 bp, Homo sapiens
acacatgttgccttg

SEQ ID NO: 1464806 - DNA, 15 bp, Homo sapiens
acacattaatgataa

SEQ ID NO: 1464807 - DNA, 23 bp, Homo sapiens
acacattatcgggagcagtgtct

SEQ ID NO: 1464808 - DNA, 11 bp, Homo sapiens
acacattttaa

SEQ ID NO: 1464809 - DNA, 15 bp, Homo sapiens
acaccaaagaattgt

SEQ ID NO: 1464810 - DNA, 14 bp, Homo sapiens
acaccaaagttcta

SEQ ID NO: 1464811 - DNA, 15 bp, Homo sapiens
acaccaaccaggcct

SEQ ID NO: 1464812 - DNA, 18 bp, Homo sapiens
acaccaacccctgaccta

SEQ ID NO: 1464813 - DNA, 23 bp, Homo sapiens
acaccaatattaacacgctgcct

SEQ ID NO: 1464814 - DNA, 23 bp, Homo sapiens
acaccaatttggtaaaaatgctg

SEQ ID NO: 1464815 - DNA, 17 bp, Homo sapiens
acaccacagacacacac

SEQ ID NO: 1464816 - DNA, 16 bp, Homo sapiens
acaccactgccctgcc

SEQ ID NO: 1464817 - DNA, 18 bp, Homo sapiens
acaccactgccctgcctg

SEQ ID NO: 1464818 - DNA, 19 bp, Homo sapiens
acaccactgccctgcctgc

SEQ ID NO: 1464819 - DNA, 21 bp, Homo sapiens
acaccactgccctgcctgccc

SEQ ID NO: 1464820 - DNA, 12 bp, Homo sapiens
acaccagagctg

SEQ ID NO: 1464821 - DNA, 17 bp, Homo sapiens
acaccagcagcactgga

SEQ ID NO: 1464822 - DNA, 12 bp, Homo sapiens
acaccaggactt

SEQ ID NO: 1464823 - DNA, 12 bp, Homo sapiens
acaccaggccgt

SEQ ID NO: 1464824 - DNA, 21 bp, Homo sapiens
acaccaggccgtcctcccggg

SEQ ID NO: 1464825 - DNA, 16 bp, Homo sapiens
acaccatcctgagcca

SEQ ID NO: 1464826 - DNA, 18 bp, Homo sapiens
acaccatcctgagccagg

SEQ ID NO: 1464827 - DNA, 15 bp, Homo sapiens
acaccatgtgcaata

SEQ ID NO: 1464828 - DNA, 23 bp, Homo sapiens
acaccatgtttgagctcagaccc

SEQ ID NO: 1464829 - DNA, 16 bp, Homo sapiens
acaccattaccaaaat

SEQ ID NO: 1464830 - DNA, 20 bp, Homo sapiens
acaccattaccaaaataata

SEQ ID NO: 1464831 - DNA, 18 bp, Homo sapiens
acaccattctcctgcctc

SEQ ID NO: 1464832 - DNA, 20 bp, Homo sapiens
acacccaaagcatggactaa

SEQ ID NO: 1464833 - DNA, 15 bp, Homo sapiens
acacccaagcctgat

SEQ ID NO: 1464834 - DNA, 18 bp, Homo sapiens
acacccagcggccccccg

SEQ ID NO: 1464835 - DNA, 14 bp, Homo sapiens
acacccatgccaga

SEQ ID NO: 1464836 - DNA, 18 bp, Homo sapiens
acacccatgccagagagg

SEQ ID NO: 1464837 - DNA, 12 bp, Homo sapiens
acaccccctccc

SEQ ID NO: 1464838 - DNA, 17 bp, Homo sapiens
acaccccgcctgcctcc

SEQ ID NO: 1464839 - DNA, 16 bp, Homo sapiens
acacccctcccctgcc

SEQ ID NO: 1464840 - DNA, 14 bp, Homo sapiens
acacccctctgtct

SEQ ID NO: 1464841 - DNA, 14 bp, Homo sapiens
acaccctaccttcc

SEQ ID NO: 1464842 - DNA, 18 bp, Homo sapiens
acaccctaccttccccag

SEQ ID NO: 1464843 - DNA, 17 bp, Homo sapiens
acaccctcaacctcttc

SEQ ID NO: 1464844 - DNA, 13 bp, Homo sapiens
acaccctggatgc

SEQ ID NO: 1464845 - DNA, 14 bp, Homo sapiens
acaccctggcctga

SEQ ID NO: 1464846 - DNA, 13 bp, Homo sapiens
acaccgctggtcc

SEQ ID NO: 1464847 - DNA, 16 bp, Homo sapiens
acaccgggcctggaga

SEQ ID NO: 1464848 - DNA, 17 bp, Homo sapiens
acaccgtcccagggctc

SEQ ID NO: 1464849 - DNA, 16 bp, Homo sapiens
acaccgtttagaaaaa

SEQ ID NO: 1464850 - DNA, 23 bp, Homo sapiens
acacctaactcttttctattttg

SEQ ID NO: 1464851 - DNA, 18 bp, Homo sapiens
acacctcagttcccttgg

SEQ ID NO: 1464852 - DNA, 21 bp, Homo sapiens
acacctcagttcccttggcct

SEQ ID NO: 1464853 - DNA, 23 bp, Homo sapiens
acacctcagttcccttggcctca

SEQ ID NO: 1464854 - DNA, 19 bp, Homo sapiens
acacctcccaggagacagt

SEQ ID NO: 1464855 - DNA, 13 bp, Homo sapiens
acacctccccctt

SEQ ID NO: 1464856 - DNA, 16 bp, Homo sapiens
acacctccctgaacca

SEQ ID NO: 1464857 - DNA, 22 bp, Homo sapiens
acacctcgcccttcagcccacc

SEQ ID NO: 1464858 - DNA, 20 bp, Homo sapiens
acacctgagcgctgtggact

SEQ ID NO: 1464859 - DNA, 23 bp, Homo sapiens
acacctgagcgctgtggactgtc

SEQ ID NO: 1464860 - DNA, 14 bp, Homo sapiens
acacctgcacctcc

SEQ ID NO: 1464861 - DNA, 11 bp, Homo sapiens
acacctgcctg

SEQ ID NO: 1464862 - DNA, 19 bp, Homo sapiens
acacctgcggggccaccca

SEQ ID NO: 1464863 - DNA, 22 bp, Homo sapiens
acacctggccgcctccaggagc

SEQ ID NO: 1464864 - DNA, 17 bp, Homo sapiens
acacctgggcttaagaa

SEQ ID NO: 1464865 - DNA, 18 bp, Homo sapiens
acacctgtcttgaataag

SEQ ID NO: 1464866 - DNA, 15 bp, Homo sapiens
acacctgtgcctcct

SEQ ID NO: 1464867 - DNA, 16 bp, Homo sapiens
acacctgttcacagaa

SEQ ID NO: 1464868 - DNA, 16 bp, Homo sapiens
acaccttccagggccc

SEQ ID NO: 1464869 - DNA, 21 bp, Homo sapiens
acaccttctgagtattctcat

SEQ ID NO: 1464870 - DNA, 20 bp, Homo sapiens
acaccttggacatcctcctc

SEQ ID NO: 1464871 - DNA, 22 bp, Homo sapiens
acaccttggacatcctcctccc

SEQ ID NO: 1464872 - DNA, 19 bp, Homo sapiens
acaccttggggtccctcca

SEQ ID NO: 1464873 - DNA, 15 bp, Homo sapiens
acacgaaagaaatgt

SEQ ID NO: 1464874 - DNA, 21 bp, Homo sapiens
acagagtggtctttctggaga

SEQ ID NO: 1464875 - DNA, 13 bp, Homo sapiens
acagataaagatt

SEQ ID NO: 1464876 - DNA, 13 bp, Homo sapiens
acagataagcaag

SEQ ID NO: 1464877 - DNA, 15 bp, Homo sapiens
acagataagcaagag

SEQ ID NO: 1464878 - DNA, 18 bp, Homo sapiens
acagataagcaagagaga

SEQ ID NO: 1464879 - DNA, 19 bp, Homo sapiens
acagataagcaagagagat

SEQ ID NO: 1464880 - DNA, 20 bp, Homo sapiens
acagataagcaagagagatg

SEQ ID NO: 1464881 - DNA, 13 bp, Homo sapiens
acagataccataa

SEQ ID NO: 1464882 - DNA, 22 bp, Homo sapiens
acagatactggaagttttgcat

SEQ ID NO: 1464883 - DNA, 22 bp, Homo sapiens
acagatactgtgagcttacatt

SEQ ID NO: 1464884 - DNA, 14 bp, Homo sapiens
acagatataaatgg

SEQ ID NO: 1464885 - DNA, 20 bp, Homo sapiens
acagatatttccatttcttc

SEQ ID NO: 1464886 - DNA, 20 bp, Homo sapiens
acagatctcagggctcggga

SEQ ID NO: 1464887 - DNA, 17 bp, Homo sapiens
acagatctcctggcaaa

SEQ ID NO: 1464888 - DNA, 21 bp, Homo sapiens
acagatctggaacctcagcct

SEQ ID NO: 1464889 - DNA, 16 bp, Homo sapiens
acagatgcaatgtgct

SEQ ID NO: 1464890 - DNA, 17 bp, Homo sapiens
acagatgcaatgtgcta

SEQ ID NO: 1464891 - DNA, 17 bp, Homo sapiens
acagatgccatggcctg

SEQ ID NO: 1464892 - DNA, 13 bp, Homo sapiens
acagatgccccag

SEQ ID NO: 1464893 - DNA, 12 bp, Homo sapiens
acagatgcctcc

SEQ ID NO: 1464894 - DNA, 19 bp, Homo sapiens
acagatgccttttttgtag

SEQ ID NO: 1464895 - DNA, 22 bp, Homo sapiens
acagatggcactttgaaggggc

SEQ ID NO: 1464896 - DNA, 16 bp, Homo sapiens
acagatgggcaaatta

SEQ ID NO: 1464897 - DNA, 20 bp, Homo sapiens
acagatggggtctgtgactg

SEQ ID NO: 1464898 - DNA, 20 bp, Homo sapiens
acagatgtgggccaccatgt

SEQ ID NO: 1464899 - DNA, 22 bp, Homo sapiens
acagatgtttttaattctagta

SEQ ID NO: 1464900 - DNA, 23 bp, Homo sapiens
acagatgtttttaattctagtat

SEQ ID NO: 1464901 - DNA, 20 bp, Homo sapiens
acagattaggtttgtcccag

SEQ ID NO: 1464902 - DNA, 18 bp, Homo sapiens
acagattatgttcctgct

SEQ ID NO: 1464903 - DNA, 20 bp, Homo sapiens
acagattatgttcctgctgt

SEQ ID NO: 1464904 - DNA, 18 bp, Homo sapiens
acagattcagaatgagaa

SEQ ID NO: 1464905 - DNA, 17 bp, Homo sapiens
acagattcaggccagcc

SEQ ID NO: 1464906 - DNA, 19 bp, Homo sapiens
acagattcaggccagccca

SEQ ID NO: 1464907 - DNA, 20 bp, Homo sapiens
acagattcaggccagcccag

SEQ ID NO: 1464908 - DNA, 20 bp, Homo sapiens
acagattctttcagttcttt

SEQ ID NO: 1464909 - DNA, 15 bp, Homo sapiens
acagattgcctcctt

SEQ ID NO: 1464910 - DNA, 19 bp, Homo sapiens
acagattgcctgtttctga

SEQ ID NO: 1464911 - DNA, 20 bp, Homo sapiens
acagatttaatacagtttat

SEQ ID NO: 1464912 - DNA, 17 bp, Homo sapiens
acagatttcatacctca

SEQ ID NO: 1464913 - DNA, 19 bp, Homo sapiens
acagatttctcactatata

SEQ ID NO: 1464914 - DNA, 14 bp, Homo sapiens
acagattttatttg

SEQ ID NO: 1464915 - DNA, 16 bp, Homo sapiens
acagatttttacaaat

SEQ ID NO: 1464916 - DNA, 19 bp, Homo sapiens
acagcaacaggaatctcag

SEQ ID NO: 1464917 - DNA, 23 bp, Homo sapiens
acagcaacaggaatctcagagac

SEQ ID NO: 1464918 - DNA, 14 bp, Homo sapiens
acagcacaagggca

SEQ ID NO: 1464919 - DNA, 18 bp, Homo sapiens
acagcacaccagccgctg

SEQ ID NO: 1464920 - DNA, 15 bp, Homo sapiens
acagcacacctgtgt

SEQ ID NO: 1464921 - DNA, 16 bp, Homo sapiens
acagcacacctgtgtc

SEQ ID NO: 1464922 - DNA, 12 bp, Homo sapiens
acagcactactc

SEQ ID NO: 1464923 - DNA, 23 bp, Homo sapiens
acagcactctctaaatcttcctt

SEQ ID NO: 1464924 - DNA, 23 bp, Homo sapiens
acagcactttggttttgctgaga

SEQ ID NO: 1464925 - DNA, 19 bp, Homo sapiens
acagcacttttcctcttct

SEQ ID NO: 1464926 - DNA, 17 bp, Homo sapiens
acagcagctcaggcaca

SEQ ID NO: 1464927 - DNA, 12 bp, Homo sapiens
acagcagctcat

SEQ ID NO: 1464928 - DNA, 21 bp, Homo sapiens
acagcagctggtgccccacct

SEQ ID NO: 1464929 - DNA, 22 bp, Homo sapiens
acagcagctggtgccccacctg

SEQ ID NO: 1464930 - DNA, 22 bp, Homo sapiens
acagcagggtagtctggtttct

SEQ ID NO: 1464931 - DNA, 18 bp, Homo sapiens
acagcaggtcctccatcc

SEQ ID NO: 1464932 - DNA, 14 bp, Homo sapiens
acagcagtctcctt

SEQ ID NO: 1464933 - DNA, 20 bp, Homo sapiens
acagcagtctccttcagcac

SEQ ID NO: 1464934 - DNA, 21 bp, Homo sapiens
acagcagtctccttcagcacg

SEQ ID NO: 1464935 - DNA, 17 bp, Homo sapiens
acagcagtgtcatcaga

SEQ ID NO: 1464936 - DNA, 17 bp, Homo sapiens
acagcagtgtcccctgc

SEQ ID NO: 1464937 - DNA, 19 bp, Homo sapiens
acagcagtgtcccctgccc

SEQ ID NO: 1464938 - DNA, 15 bp, Homo sapiens
acagcataacaaggt

SEQ ID NO: 1464939 - DNA, 22 bp, Homo sapiens
acagcataacaaggtccaagat

SEQ ID NO: 1464940 - DNA, 13 bp, Homo sapiens
acagcatcagggt

SEQ ID NO: 1464941 - DNA, 14 bp, Homo sapiens
acagcatgtgccaa

SEQ ID NO: 1464942 - DNA, 19 bp, Homo sapiens
acagcattcttgtcacaat

SEQ ID NO: 1464943 - DNA, 23 bp, Homo sapiens
acagcattcttgtcacaataaat

SEQ ID NO: 1464944 - DNA, 11 bp, Homo sapiens
acagcattgtc

SEQ ID NO: 1464945 - DNA, 13 bp, Homo sapiens
acagcattgtctt

SEQ ID NO: 1464946 - DNA, 17 bp, Homo sapiens
acagcattgtctttgct

SEQ ID NO: 1464947 - DNA, 14 bp, Homo sapiens
acagcattttaagg

SEQ ID NO: 1464948 - DNA, 20 bp, Homo sapiens
acagcattttaaggttctca

SEQ ID NO: 1464949 - DNA, 22 bp, Homo sapiens
acagcattttaaggttctcaga

SEQ ID NO: 1464950 - DNA, 14 bp, Homo sapiens
acagccaaatttaa

SEQ ID NO: 1464951 - DNA, 17 bp, Homo sapiens
acagccaacgagacaca

SEQ ID NO: 1464952 - DNA, 18 bp, Homo sapiens
acagccaacgagacacat

SEQ ID NO: 1464953 - DNA, 20 bp, Homo sapiens
acagccaactagcccctggg

SEQ ID NO: 1464954 - DNA, 23 bp, Homo sapiens
acagccaaggggatatttactgc

SEQ ID NO: 1464955 - DNA, 23 bp, Homo sapiens
acagccacccgtggggtgctgcc

SEQ ID NO: 1464956 - DNA, 13 bp, Homo sapiens
acagccagactgg

SEQ ID NO: 1464957 - DNA, 16 bp, Homo sapiens
acagccagactggcac

SEQ ID NO: 1464958 - DNA, 16 bp, Homo sapiens
acagccagacttgctt

SEQ ID NO: 1464959 - DNA, 13 bp, Homo sapiens
acagccagcacct

SEQ ID NO: 1464960 - DNA, 16 bp, Homo sapiens
acagccatgcccgcat

SEQ ID NO: 1464961 - DNA, 18 bp, Homo sapiens
acagccatgcgtggccac

SEQ ID NO: 1464962 - DNA, 17 bp, Homo sapiens
acagcccagccacggac

SEQ ID NO: 1464963 - DNA, 15 bp, Homo sapiens
acagccccagggttg

SEQ ID NO: 1464964 - DNA, 17 bp, Homo sapiens
acagcccctcaaagact

SEQ ID NO: 1464965 - DNA, 20 bp, Homo sapiens
acagcccgctctctggctgt

SEQ ID NO: 1464966 - DNA, 19 bp, Homo sapiens
acagccctgagtgtcccaa

SEQ ID NO: 1464967 - DNA, 21 bp, Homo sapiens
acagccctgagtgtcccaagc

SEQ ID NO: 1464968 - DNA, 23 bp, Homo sapiens
acagcccttatgcggttaatttt

SEQ ID NO: 1464969 - DNA, 13 bp, Homo sapiens
acagccgcagcct

SEQ ID NO: 1464970 - DNA, 20 bp, Homo sapiens
acagccgcagcctccctctg

SEQ ID NO: 1464971 - DNA, 20 bp, Homo sapiens
acagccgctcctgtctgcca

SEQ ID NO: 1464972 - DNA, 24 bp, Homo sapiens
acagccgctcctgtctgccagcca

SEQ ID NO: 1464973 - DNA, 19 bp, Homo sapiens
acagccgtcagccaaatgt

SEQ ID NO: 1464974 - DNA, 22 bp, Homo sapiens
acagccgtcccgcgttcaagac

SEQ ID NO: 1464975 - DNA, 15 bp, Homo sapiens
acagcctctacagcc

SEQ ID NO: 1464976 - DNA, 18 bp, Homo sapiens
acagcctctacagccgtc

SEQ ID NO: 1464977 - DNA, 12 bp, Homo sapiens
acagcctggact

SEQ ID NO: 1464978 - DNA, 14 bp, Homo sapiens
acagcctggcacag

SEQ ID NO: 1464979 - DNA, 21 bp, Homo sapiens
acagcctgtggcggtgcctgg

SEQ ID NO: 1464980 - DNA, 21 bp, Homo sapiens
acagcctttcgttctgctgac

SEQ ID NO: 1464981 - DNA, 16 bp, Homo sapiens
acagcctttgcccaaa

SEQ ID NO: 1464982 - DNA, 17 bp, Homo sapiens
acagcgagactccgtct

SEQ ID NO: 1464983 - DNA, 17 bp, Homo sapiens
acagcgagggcagctgc

SEQ ID NO: 1464984 - DNA, 15 bp, Homo sapiens
acagcggaggtgtgg

SEQ ID NO: 1464985 - DNA, 20 bp, Homo sapiens
acagcgggagacctgtgcta

SEQ ID NO: 1464986 - DNA, 17 bp, Homo sapiens
acagcgtccctggcgca

SEQ ID NO: 1464987 - DNA, 23 bp, Homo sapiens
acagcgtctgctcataggacctg

SEQ ID NO: 1464988 - DNA, 18 bp, Homo sapiens
acagggagaattgaaact

SEQ ID NO: 1464989 - DNA, 21 bp, Homo sapiens
acagggagccggcggcctctc

SEQ ID NO: 1464990 - DNA, 23 bp, Homo sapiens
acagggagccggcggcctctcga

SEQ ID NO: 1464991 - DNA, 18 bp, Homo sapiens
acagggataaggcctgtg

SEQ ID NO: 1464992 - DNA, 15 bp, Homo sapiens
acagggcaccagagg

SEQ ID NO: 1464993 - DNA, 12 bp, Homo sapiens
acagggcccgca

SEQ ID NO: 1464994 - DNA, 23 bp, Homo sapiens
acagggcggtaccttgtgcccag

SEQ ID NO: 1464995 - DNA, 15 bp, Homo sapiens
acagggctgggagaa

SEQ ID NO: 1464996 - DNA, 14 bp, Homo sapiens
acaggggaggaaaa

SEQ ID NO: 1464997 - DNA, 20 bp, Homo sapiens
acaggggaggaaaaaagaac

SEQ ID NO: 1464998 - DNA, 14 bp, Homo sapiens
acaggggcaggcct

SEQ ID NO: 1464999 - DNA, 15 bp, Homo sapiens
acaggggcaggcctg

SEQ ID NO: 1465000 - DNA, 23 bp, Homo sapiens
acaggggccccagatctgcctgg

SEQ ID NO: 1465001 - DNA, 17 bp, Homo sapiens
acaggggtagtttgttt

SEQ ID NO: 1465002 - DNA, 15 bp, Homo sapiens
acagggtacctcaag

SEQ ID NO: 1465003 - DNA, 21 bp, Homo sapiens
acagggtccccgagtgcctag

SEQ ID NO: 1465004 - DNA, 15 bp, Homo sapiens
acagggtctgggaca

SEQ ID NO: 1465005 - DNA, 14 bp, Homo sapiens
acagggtgggcctc

SEQ ID NO: 1465006 - DNA, 23 bp, Homo sapiens
acagggtgtggtatgagggggtg

SEQ ID NO: 1465007 - DNA, 22 bp, Homo sapiens
acaggtaaaacagggccacata

SEQ ID NO: 1465008 - DNA, 16 bp, Homo sapiens
acaggtatttttttaa

SEQ ID NO: 1465009 - DNA, 21 bp, Homo sapiens
acaggtatttttttaaatcaa

SEQ ID NO: 1465010 - DNA, 21 bp, Homo sapiens
acaggtcatcagatgcctgct

SEQ ID NO: 1465011 - DNA, 13 bp, Homo sapiens
acaggtcctgatt

SEQ ID NO: 1465012 - DNA, 19 bp, Homo sapiens
acaggtctcctcttaaaaa

SEQ ID NO: 1465013 - DNA, 18 bp, Homo sapiens
acaggtgctaatttgttt

SEQ ID NO: 1465014 - DNA, 18 bp, Homo sapiens
acaggtgtttatatctcc

SEQ ID NO: 1465015 - DNA, 20 bp, Homo sapiens
acaggttcttaaaaaggaac

SEQ ID NO: 1465016 - DNA, 22 bp, Homo sapiens
acaggtttggggagggggaaga

SEQ ID NO: 1465017 - DNA, 14 bp, Homo sapiens
acaggttttataat

SEQ ID NO: 1465018 - DNA, 20 bp, Homo sapiens
acagtaaaagccttattcta

SEQ ID NO: 1465019 - DNA, 16 bp, Homo sapiens
acagtaaaccactgaa

SEQ ID NO: 1465020 - DNA, 15 bp, Homo sapiens
acagtaactttatgt

SEQ ID NO: 1465021 - DNA, 14 bp, Homo sapiens
acagtaagttccta

SEQ ID NO: 1465022 - DNA, 20 bp, Homo sapiens
acagtaatacattccattgt

SEQ ID NO: 1465023 - DNA, 16 bp, Homo sapiens
acagtacaataatgta

SEQ ID NO: 1465024 - DNA, 20 bp, Homo sapiens
acagtacaataatgtactca

SEQ ID NO: 1465025 - DNA, 15 bp, Homo sapiens
acagtacacacaaaa

SEQ ID NO: 1465026 - DNA, 16 bp, Homo sapiens
acagtacacaccagaa

SEQ ID NO: 1465027 - DNA, 15 bp, Homo sapiens
acagtacccaaactg

SEQ ID NO: 1465028 - DNA, 18 bp, Homo sapiens
acagtacctgattgtatt

SEQ ID NO: 1465029 - DNA, 18 bp, Homo sapiens
acagtaccttgttgcaga

SEQ ID NO: 1465030 - DNA, 19 bp, Homo sapiens
acagtaccttgttgcagat

SEQ ID NO: 1465031 - DNA, 18 bp, Homo sapiens
acagtactcactttttcc

SEQ ID NO: 1465032 - DNA, 17 bp, Homo sapiens
acagtactttattgtac

SEQ ID NO: 1465033 - DNA, 13 bp, Homo sapiens
acagtagagaggg

SEQ ID NO: 1465034 - DNA, 19 bp, Homo sapiens
acagtagccttattcacct

SEQ ID NO: 1465035 - DNA, 22 bp, Homo sapiens
acagtaggaattggaaataatt

SEQ ID NO: 1465036 - DNA, 15 bp, Homo sapiens
acagtagtgtcatca

SEQ ID NO: 1465037 - DNA, 21 bp, Homo sapiens
acagtatcccacatccaactc

SEQ ID NO: 1465038 - DNA, 19 bp, Homo sapiens
acagtatgagaagaaaaat

SEQ ID NO: 1465039 - DNA, 14 bp, Homo sapiens
acagtatgatgaaa

SEQ ID NO: 1465040 - DNA, 19 bp, Homo sapiens
acagtatgatgaaaataat

SEQ ID NO: 1465041 - DNA, 23 bp, Homo sapiens
acagtatgtgggatattgaatgt

SEQ ID NO: 1465042 - DNA, 12 bp, Homo sapiens
acagtattatgc

SEQ ID NO: 1465043 - DNA, 23 bp, Homo sapiens
acagtatttctggtgtatatttt

SEQ ID NO: 1465044 - DNA, 16 bp, Homo sapiens
acagtcaaaacagaga

SEQ ID NO: 1465045 - DNA, 13 bp, Homo sapiens
acagtcactggat

SEQ ID NO: 1465046 - DNA, 21 bp, Homo sapiens
acagtcagaaggacggcagga

SEQ ID NO: 1465047 - DNA, 15 bp, Homo sapiens
acagtcattctagga

SEQ ID NO: 1465048 - DNA, 21 bp, Homo sapiens
acagtcctgggagaacctcag

SEQ ID NO: 1465049 - DNA, 22 bp, Homo sapiens
acagtcctttcccaccattcct

SEQ ID NO: 1465050 - DNA, 17 bp, Homo sapiens
acagtctcaggaaatca

SEQ ID NO: 1465051 - DNA, 19 bp, Homo sapiens
acagtctcattacagattt

SEQ ID NO: 1465052 - DNA, 12 bp, Homo sapiens
acagtctgttat

SEQ ID NO: 1465053 - DNA, 13 bp, Homo sapiens
acagtgaagtgcc

SEQ ID NO: 1465054 - DNA, 16 bp, Homo sapiens
acagtgaagttttact

SEQ ID NO: 1465055 - DNA, 23 bp, Homo sapiens
acagtgaagttttactgtctatt

SEQ ID NO: 1465056 - DNA, 13 bp, Homo sapiens
acagtgaatgtgt

SEQ ID NO: 1465057 - DNA, 13 bp, Homo sapiens
acagtgaattgtc

SEQ ID NO: 1465058 - DNA, 22 bp, Homo sapiens
acagtgacactggaccaggtcc

SEQ ID NO: 1465059 - DNA, 17 bp, Homo sapiens
acagtgacttctgagat

SEQ ID NO: 1465060 - DNA, 14 bp, Homo sapiens
acagtgagcctgaa

SEQ ID NO: 1465061 - DNA, 14 bp, Homo sapiens
acagtgatctccat

SEQ ID NO: 1465062 - DNA, 15 bp, Homo sapiens
acagtgatctccata

SEQ ID NO: 1465063 - DNA, 15 bp, Homo sapiens
acagtgatgattgaa

SEQ ID NO: 1465064 - DNA, 15 bp, Homo sapiens
acagtgcagacaggc

SEQ ID NO: 1465065 - DNA, 15 bp, Homo sapiens
acagtgcatctcagc

SEQ ID NO: 1465066 - DNA, 12 bp, Homo sapiens
acagtgccaccc

SEQ ID NO: 1465067 - DNA, 13 bp, Homo sapiens
acagtgcccaaga

SEQ ID NO: 1465068 - DNA, 18 bp, Homo sapiens
acagtgcccaagagtggg

SEQ ID NO: 1465069 - DNA, 15 bp, Homo sapiens
acagtgccctgagac

SEQ ID NO: 1465070 - DNA, 23 bp, Homo sapiens
acagtgcctcttccagtgaacat

SEQ ID NO: 1465071 - DNA, 21 bp, Homo sapiens
acagtgcctgggaatgtatta

SEQ ID NO: 1465072 - DNA, 17 bp, Homo sapiens
acagtgccttcaataaa

SEQ ID NO: 1465073 - DNA, 12 bp, Homo sapiens
acagtgccttct

SEQ ID NO: 1465074 - DNA, 19 bp, Homo sapiens
acagtgctctaggctgccc

SEQ ID NO: 1465075 - DNA, 17 bp, Homo sapiens
acagtgctcttttctcc

SEQ ID NO: 1465076 - DNA, 11 bp, Homo sapiens
acagtgctggg

SEQ ID NO: 1465077 - DNA, 18 bp, Homo sapiens
acagtgcttcagcctgag

SEQ ID NO: 1465078 - DNA, 18 bp, Homo sapiens
acagtggatcacaaagtg

SEQ ID NO: 1465079 - DNA, 18 bp, Homo sapiens
acagtggcacaaaaaaat

SEQ ID NO: 1465080 - DNA, 16 bp, Homo sapiens
acagtggctcacgcct

SEQ ID NO: 1465081 - DNA, 15 bp, Homo sapiens
acagtgggagccagg

SEQ ID NO: 1465082 - DNA, 20 bp, Homo sapiens
acagtgggagctgagctgga

SEQ ID NO: 1465083 - DNA, 24 bp, Homo sapiens
acagtgggcaggaggccccaggct

SEQ ID NO: 1465084 - DNA, 11 bp, Homo sapiens
acagtgggcct

SEQ ID NO: 1465085 - DNA, 16 bp, Homo sapiens
acagtgggtggcacct

SEQ ID NO: 1465086 - DNA, 17 bp, Homo sapiens
acagtgggtggcacctc

SEQ ID NO: 1465087 - DNA, 21 bp, Homo sapiens
acagtggtggcaacattcatt

SEQ ID NO: 1465088 - DNA, 21 bp, Homo sapiens
acagtgtaatccaggggtgta

SEQ ID NO: 1465089 - DNA, 17 bp, Homo sapiens
acagtgtcactggtcag

SEQ ID NO: 1465090 - DNA, 15 bp, Homo sapiens
acagtgtcccccagg

SEQ ID NO: 1465091 - DNA, 24 bp, Homo sapiens
acagtgtctgtatcggagacagtg

SEQ ID NO: 1465092 - DNA, 19 bp, Homo sapiens
acagtgtgcctggttaata

SEQ ID NO: 1465093 - DNA, 19 bp, Homo sapiens
acagtgttagtgctggtca

SEQ ID NO: 1465094 - DNA, 20 bp, Homo sapiens
acagtgttattttctttgaa

SEQ ID NO: 1465095 - DNA, 21 bp, Homo sapiens
acagtgttgaaaatgttcaga

SEQ ID NO: 1465096 - DNA, 9 bp, Homo sapiens
acagtgttt

SEQ ID NO: 1465097 - DNA, 22 bp, Homo sapiens
acagtgtttcccataattttct

SEQ ID NO: 1465098 - DNA, 15 bp, Homo sapiens
acagtgttttatccg

SEQ ID NO: 1465099 - DNA, 13 bp, Homo sapiens
acagttaactttc

SEQ ID NO: 1465100 - DNA, 23 bp, Homo sapiens
acagttagcaaactttgtatgtc

SEQ ID NO: 1465101 - DNA, 17 bp, Homo sapiens
acagttagcagggatgt

SEQ ID NO: 1465102 - DNA, 22 bp, Homo sapiens
acagttagggttgagttacttc

SEQ ID NO: 1465103 - DNA, 14 bp, Homo sapiens
acatggacttgtat

SEQ ID NO: 1465104 - DNA, 17 bp, Homo sapiens
acatggacttgtatatt

SEQ ID NO: 1465105 - DNA, 17 bp, Homo sapiens
acatggaggttctaagg

SEQ ID NO: 1465106 - DNA, 16 bp, Homo sapiens
acatggcagtgtttta

SEQ ID NO: 1465107 - DNA, 14 bp, Homo sapiens
acatggccagtgtg

SEQ ID NO: 1465108 - DNA, 15 bp, Homo sapiens
acatggccagtgtga

SEQ ID NO: 1465109 - DNA, 17 bp, Homo sapiens
acatggccatagaggcc

SEQ ID NO: 1465110 - DNA, 20 bp, Homo sapiens
acatggccatagaggcccag

SEQ ID NO: 1465111 - DNA, 21 bp, Homo sapiens
acatggcccctccccctgcca

SEQ ID NO: 1465112 - DNA, 15 bp, Homo sapiens
acatggctggcctgg

SEQ ID NO: 1465113 - DNA, 16 bp, Homo sapiens
acatggcttaatctta

SEQ ID NO: 1465114 - DNA, 21 bp, Homo sapiens
acatgggagcttattgctaat

SEQ ID NO: 1465115 - DNA, 13 bp, Homo sapiens
acatgggagttta

SEQ ID NO: 1465116 - DNA, 18 bp, Homo sapiens
acatgggccagtttatat

SEQ ID NO: 1465117 - DNA, 21 bp, Homo sapiens
acatggtgaaacctcatctct

SEQ ID NO: 1465118 - DNA, 22 bp, Homo sapiens
acatggtgcctatatctgagag

SEQ ID NO: 1465119 - DNA, 23 bp, Homo sapiens
acatggtgcctatatctgagaga

SEQ ID NO: 1465120 - DNA, 20 bp, Homo sapiens
acatggtgcctgagaggcag

SEQ ID NO: 1465121 - DNA, 14 bp, Homo sapiens
acatggtgtggggg

SEQ ID NO: 1465122 - DNA, 21 bp, Homo sapiens
acatggtttaaatatgaatga

SEQ ID NO: 1465123 - DNA, 15 bp, Homo sapiens
acatggtttgactct

SEQ ID NO: 1465124 - DNA, 15 bp, Homo sapiens
acatgtaagaaaatg

SEQ ID NO: 1465125 - DNA, 23 bp, Homo sapiens
acatgtaagtgtggttttgtaat

SEQ ID NO: 1465126 - DNA, 23 bp, Homo sapiens
acatgtaataaaaagtatatgtt

SEQ ID NO: 1465127 - DNA, 19 bp, Homo sapiens
acatgtaataaattcaaaa

SEQ ID NO: 1465128 - DNA, 17 bp, Homo sapiens
acatgtaattaagtact

SEQ ID NO: 1465129 - DNA, 14 bp, Homo sapiens
acatgtactacagc

SEQ ID NO: 1465130 - DNA, 17 bp, Homo sapiens
acatgtactacagctat

SEQ ID NO: 1465131 - DNA, 22 bp, Homo sapiens
acatgtactacagctatatttg

SEQ ID NO: 1465132 - DNA, 16 bp, Homo sapiens
acatgtactccagagg

SEQ ID NO: 1465133 - DNA, 22 bp, Homo sapiens
acatgtattaaattacatttgt

SEQ ID NO: 1465134 - DNA, 23 bp, Homo sapiens
acatgtcatgtaggttgtctaaa

SEQ ID NO: 1465135 - DNA, 20 bp, Homo sapiens
acatgtccagcaccttgtgc

SEQ ID NO: 1465136 - DNA, 23 bp, Homo sapiens
acatgtccagcaccttgtgcctg

SEQ ID NO: 1465137 - DNA, 15 bp, Homo sapiens
acatgtccctacacc

SEQ ID NO: 1465138 - DNA, 17 bp, Homo sapiens
acatgtctgttctacat

SEQ ID NO: 1465139 - DNA, 14 bp, Homo sapiens
acatgtcttgtaca

SEQ ID NO: 1465140 - DNA, 16 bp, Homo sapiens
acatgtcttgtacatg

SEQ ID NO: 1465141 - DNA, 22 bp, Homo sapiens
acatgtcttgtacatgtgtagc

SEQ ID NO: 1465142 - DNA, 14 bp, Homo sapiens
acatgtgacacata

SEQ ID NO: 1465143 - DNA, 18 bp, Homo sapiens
acatgtgaggaggaaaag

SEQ ID NO: 1465144 - DNA, 20 bp, Homo sapiens
acatgtgaggaggaaaagga

SEQ ID NO: 1465145 - DNA, 15 bp, Homo sapiens
acatgtgatacattt

SEQ ID NO: 1465146 - DNA, 17 bp, Homo sapiens
acatgtgccaccaacat

SEQ ID NO: 1465147 - DNA, 17 bp, Homo sapiens
acatgtgccttttctga

SEQ ID NO: 1465148 - DNA, 18 bp, Homo sapiens
acatgtgccttttctgaa

SEQ ID NO: 1465149 - DNA, 20 bp, Homo sapiens
acatgtggggacagggctgg

SEQ ID NO: 1465150 - DNA, 16 bp, Homo sapiens
acatgtggggccaggt

SEQ ID NO: 1465151 - DNA, 18 bp, Homo sapiens
acatgtggggccaggtca

SEQ ID NO: 1465152 - DNA, 20 bp, Homo sapiens
acatgtgggtggagaaggga

SEQ ID NO: 1465153 - DNA, 23 bp, Homo sapiens
acatgtggtgggacagggaccca

SEQ ID NO: 1465154 - DNA, 14 bp, Homo sapiens
acatgtgtaaaggt

SEQ ID NO: 1465155 - DNA, 11 bp, Homo sapiens
acatgtgtaca

SEQ ID NO: 1465156 - DNA, 14 bp, Homo sapiens
acatgtgtacatat

SEQ ID NO: 1465157 - DNA, 15 bp, Homo sapiens
acatgtgtacatata

SEQ ID NO: 1465158 - DNA, 18 bp, Homo sapiens
acatgtgtagggaaagtt

SEQ ID NO: 1465159 - DNA, 22 bp, Homo sapiens
acatgtgtatttatacccccag

SEQ ID NO: 1465160 - DNA, 23 bp, Homo sapiens
acatgttaagataacttactgta

SEQ ID NO: 1465161 - DNA, 16 bp, Homo sapiens
acatgttattcaatgt

SEQ ID NO: 1465162 - DNA, 22 bp, Homo sapiens
acatgttctaggtttcagcaac

SEQ ID NO: 1465163 - DNA, 16 bp, Homo sapiens
acatgttctttgtacc

SEQ ID NO: 1465164 - DNA, 13 bp, Homo sapiens
acatgttgccttg

SEQ ID NO: 1465165 - DNA, 20 bp, Homo sapiens
acatgttgggaaacttggct

SEQ ID NO: 1465166 - DNA, 17 bp, Homo sapiens
acatgtttaaatagcct

SEQ ID NO: 1465167 - DNA, 13 bp, Homo sapiens
acatgtttttcta

SEQ ID NO: 1465168 - DNA, 22 bp, Homo sapiens
acattaaaaatgaccactcttt

SEQ ID NO: 1465169 - DNA, 22 bp, Homo sapiens
acattaaaacaatattgtttct

SEQ ID NO: 1465170 - DNA, 16 bp, Homo sapiens
acattaacggtgctaa

SEQ ID NO: 1465171 - DNA, 17 bp, Homo sapiens
acattaacggtgctaaa

SEQ ID NO: 1465172 - DNA, 17 bp, Homo sapiens
acattaatatttaccaa

SEQ ID NO: 1465173 - DNA, 18 bp, Homo sapiens
acattaatatttaccaaa

SEQ ID NO: 1465174 - DNA, 15 bp, Homo sapiens
acattaatctcaaag

SEQ ID NO: 1465175 - DNA, 21 bp, Homo sapiens
acattaatgtcctcttgctgt

SEQ ID NO: 1465176 - DNA, 15 bp, Homo sapiens
acattaatgttaatt

SEQ ID NO: 1465177 - DNA, 21 bp, Homo sapiens
acattaatgttaattcagcac

SEQ ID NO: 1465178 - DNA, 22 bp, Homo sapiens
acattaatgttaattcagcact

SEQ ID NO: 1465179 - DNA, 18 bp, Homo sapiens
acattaattttgtgcatt

SEQ ID NO: 1465180 - DNA, 22 bp, Homo sapiens
acattaattttgtgcattcttt

SEQ ID NO: 1465181 - DNA, 14 bp, Homo sapiens
acattacactaaat

SEQ ID NO: 1465182 - DNA, 19 bp, Homo sapiens
acattactctgcctctgta

SEQ ID NO: 1465183 - DNA, 14 bp, Homo sapiens
acattactttttat

SEQ ID NO: 1465184 - DNA, 14 bp, Homo sapiens
acattagagaacat

SEQ ID NO: 1465185 - DNA, 19 bp, Homo sapiens
acattagattttattttac

SEQ ID NO: 1465186 - DNA, 18 bp, Homo sapiens
acattagcagtttgcttt

SEQ ID NO: 1465187 - DNA, 13 bp, Homo sapiens
acattagttgcac

SEQ ID NO: 1465188 - DNA, 14 bp, Homo sapiens
acattagttgcact

SEQ ID NO: 1465189 - DNA, 14 bp, Homo sapiens
acattataacaact

SEQ ID NO: 1465190 - DNA, 21 bp, Homo sapiens
acattataacaactatttact

SEQ ID NO: 1465191 - DNA, 16 bp, Homo sapiens
acattataatgtacag

SEQ ID NO: 1465192 - DNA, 18 bp, Homo sapiens
acattatcgggagcagtg

SEQ ID NO: 1465193 - DNA, 21 bp, Homo sapiens
acattatcgggagcagtgtct

SEQ ID NO: 1465194 - DNA, 22 bp, Homo sapiens
acattatcgggagcagtgtctt

SEQ ID NO: 1465195 - DNA, 13 bp, Homo sapiens
acattatcttagt

SEQ ID NO: 1465196 - DNA, 21 bp, Homo sapiens
acattatcttcatatgtcacc

SEQ ID NO: 1465197 - DNA, 19 bp, Homo sapiens
acattatgtggttttagat

SEQ ID NO: 1465198 - DNA, 14 bp, Homo sapiens
acattatttatatg

SEQ ID NO: 1465199 - DNA, 18 bp, Homo sapiens
acattatttatatgggga

SEQ ID NO: 1465200 - DNA, 13 bp, Homo sapiens
acattatttgcat

SEQ ID NO: 1465201 - DNA, 17 bp, Homo sapiens
acattcaatgaattata

SEQ ID NO: 1465202 - DNA, 18 bp, Homo sapiens
acattcagactaaaaata

SEQ ID NO: 1465203 - DNA, 20 bp, Homo sapiens
acattcagactaaaaataca

SEQ ID NO: 1465204 - DNA, 13 bp, Homo sapiens
acattcagctctg

SEQ ID NO: 1465205 - DNA, 16 bp, Homo sapiens
acattccacagctgcc

SEQ ID NO: 1465206 - DNA, 23 bp, Homo sapiens
acattccacagctgccctggctg

SEQ ID NO: 1465207 - DNA, 21 bp, Homo sapiens
acattccacatctgtttcaaa

SEQ ID NO: 1465208 - DNA, 16 bp, Homo sapiens
acattcccagcccagc

SEQ ID NO: 1465209 - DNA, 15 bp, Homo sapiens
acattccgaagaggg

SEQ ID NO: 1465210 - DNA, 19 bp, Homo sapiens
acattcctcagctgccaag

SEQ ID NO: 1465211 - DNA, 20 bp, Homo sapiens
acattcctcatgaatgtaaa

SEQ ID NO: 1465212 - DNA, 13 bp, Homo sapiens
acattcctggccc

SEQ ID NO: 1465213 - DNA, 14 bp, Homo sapiens
acattcgatctcat

SEQ ID NO: 1465214 - DNA, 23 bp, Homo sapiens
acattcgatctcattcagtatta

SEQ ID NO: 1465215 - DNA, 16 bp, Homo sapiens
acattcgggaccaata

SEQ ID NO: 1465216 - DNA, 18 bp, Homo sapiens
acattcgtgagctgggga

SEQ ID NO: 1465217 - DNA, 19 bp, Homo sapiens
accacattttatatttatt

SEQ ID NO: 1465218 - DNA, 15 bp, Homo sapiens
accaccactggccac

SEQ ID NO: 1465219 - DNA, 16 bp, Homo sapiens
accaccactggccacc

SEQ ID NO: 1465220 - DNA, 22 bp, Homo sapiens
accaccactggccaccaggctg

SEQ ID NO: 1465221 - DNA, 23 bp, Homo sapiens
accaccactggccaccaggctgg

SEQ ID NO: 1465222 - DNA, 24 bp, Homo sapiens
accaccactggccaccaggctggc

SEQ ID NO: 1465223 - DNA, 16 bp, Homo sapiens
accaccagcaggcagg

SEQ ID NO: 1465224 - DNA, 16 bp, Homo sapiens
accaccagccccagca

SEQ ID NO: 1465225 - DNA, 17 bp, Homo sapiens
accaccagccccagcaa

SEQ ID NO: 1465226 - DNA, 15 bp, Homo sapiens
accaccaggagcagc

SEQ ID NO: 1465227 - DNA, 16 bp, Homo sapiens
accaccaggagcagca

SEQ ID NO: 1465228 - DNA, 19 bp, Homo sapiens
accaccaggagcagcagcc

SEQ ID NO: 1465229 - DNA, 22 bp, Homo sapiens
accaccaggagcagcagccagc

SEQ ID NO: 1465230 - DNA, 13 bp, Homo sapiens
accacccacccca

SEQ ID NO: 1465231 - DNA, 18 bp, Homo sapiens
accaccccgcctgccctc

SEQ ID NO: 1465232 - DNA, 22 bp, Homo sapiens
accaccccgcctgccctcatgg

SEQ ID NO: 1465233 - DNA, 18 bp, Homo sapiens
accaccccggccccctgc

SEQ ID NO: 1465234 - DNA, 21 bp, Homo sapiens
accaccctagtcccttcccct

SEQ ID NO: 1465235 - DNA, 17 bp, Homo sapiens
accaccctcccctctct

SEQ ID NO: 1465236 - DNA, 23 bp, Homo sapiens
accaccgcctctggccgccaccc

SEQ ID NO: 1465237 - DNA, 18 bp, Homo sapiens
accacctaggccactcct

SEQ ID NO: 1465238 - DNA, 14 bp, Homo sapiens
accaccttcccagc

SEQ ID NO: 1465239 - DNA, 16 bp, Homo sapiens
accacctttactgtgc

SEQ ID NO: 1465240 - DNA, 17 bp, Homo sapiens
accaccttttattacat

SEQ ID NO: 1465241 - DNA, 13 bp, Homo sapiens
accacgactggcc

SEQ ID NO: 1465242 - DNA, 16 bp, Homo sapiens
accacgactggccagg

SEQ ID NO: 1465243 - DNA, 17 bp, Homo sapiens
accacgatgtggccctg

SEQ ID NO: 1465244 - DNA, 18 bp, Homo sapiens
accacgcccgtcctgcct

SEQ ID NO: 1465245 - DNA, 13 bp, Homo sapiens
accacgcctggct

SEQ ID NO: 1465246 - DNA, 14 bp, Homo sapiens
accacgtctgccag

SEQ ID NO: 1465247 - DNA, 19 bp, Homo sapiens
accacgtctgccaggccca

SEQ ID NO: 1465248 - DNA, 15 bp, Homo sapiens
accacgtctggctcc

SEQ ID NO: 1465249 - DNA, 17 bp, Homo sapiens
accacgtctggctccct

SEQ ID NO: 1465250 - DNA, 19 bp, Homo sapiens
accacgtctggctccctgc

SEQ ID NO: 1465251 - DNA, 22 bp, Homo sapiens
accacgtctggctccctgcccc

SEQ ID NO: 1465252 - DNA, 15 bp, Homo sapiens
accactaaccatccc

SEQ ID NO: 1465253 - DNA, 17 bp, Homo sapiens
accactacatgcagccc

SEQ ID NO: 1465254 - DNA, 17 bp, Homo sapiens
accactaggactctgag

SEQ ID NO: 1465255 - DNA, 16 bp, Homo sapiens
accactcaagcaacaa

SEQ ID NO: 1465256 - DNA, 22 bp, Homo sapiens
accactcctgtccctgtagctc

SEQ ID NO: 1465257 - DNA, 14 bp, Homo sapiens
accactcgtgcatc

SEQ ID NO: 1465258 - DNA, 17 bp, Homo sapiens
accactcgtgcatccct

SEQ ID NO: 1465259 - DNA, 21 bp, Homo sapiens
accactcgtgcatccctgaga

SEQ ID NO: 1465260 - DNA, 11 bp, Homo sapiens
accactctaat

SEQ ID NO: 1465261 - DNA, 15 bp, Homo sapiens
accactgaaaaaata

SEQ ID NO: 1465262 - DNA, 10 bp, Homo sapiens
accactgaat

SEQ ID NO: 1465263 - DNA, 17 bp, Homo sapiens
accactgcactccagcc

SEQ ID NO: 1465264 - DNA, 19 bp, Homo sapiens
accactgcactccagcctg

SEQ ID NO: 1465265 - DNA, 21 bp, Homo sapiens
accactgccccctgctgccat

SEQ ID NO: 1465266 - DNA, 15 bp, Homo sapiens
accactgccctgcct

SEQ ID NO: 1465267 - DNA, 18 bp, Homo sapiens
accactgccctgcctgcc

SEQ ID NO: 1465268 - DNA, 20 bp, Homo sapiens
accactgccctgcctgccca

SEQ ID NO: 1465269 - DNA, 16 bp, Homo sapiens
accactgcctgactgc

SEQ ID NO: 1465270 - DNA, 17 bp, Homo sapiens
accactgcttcccactg

SEQ ID NO: 1465271 - DNA, 19 bp, Homo sapiens
accactgcttcccactggg

SEQ ID NO: 1465272 - DNA, 14 bp, Homo sapiens
accactggccacca

SEQ ID NO: 1465273 - DNA, 16 bp, Homo sapiens
accactggccaccagg

SEQ ID NO: 1465274 - DNA, 18 bp, Homo sapiens
accactggccaccaggct

SEQ ID NO: 1465275 - DNA, 22 bp, Homo sapiens
accactggtacttcctttctcc

SEQ ID NO: 1465276 - DNA, 16 bp, Homo sapiens
accactggtctgtagg

SEQ ID NO: 1465277 - DNA, 22 bp, Homo sapiens
accactggttaaaataaagcct

SEQ ID NO: 1465278 - DNA, 19 bp, Homo sapiens
accactgtaaaatgaaatt

SEQ ID NO: 1465279 - DNA, 19 bp, Homo sapiens
accactgtctgtccctgaa

SEQ ID NO: 1465280 - DNA, 17 bp, Homo sapiens
accacttcattcttgaa

SEQ ID NO: 1465281 - DNA, 23 bp, Homo sapiens
accacttccaggggaacctgcca

SEQ ID NO: 1465282 - DNA, 14 bp, Homo sapiens
accacttcctgagg

SEQ ID NO: 1465283 - DNA, 16 bp, Homo sapiens
accacttgaatttatt

SEQ ID NO: 1465284 - DNA, 14 bp, Homo sapiens
accacttgagccta

SEQ ID NO: 1465285 - DNA, 23 bp, Homo sapiens
accactttccactccctgcttag

SEQ ID NO: 1465286 - DNA, 20 bp, Homo sapiens
accactttcttattctgtat

SEQ ID NO: 1465287 - DNA, 17 bp, Homo sapiens
accagaaaagcccaagt

SEQ ID NO: 1465288 - DNA, 15 bp, Homo sapiens
accagaaacacccct

SEQ ID NO: 1465289 - DNA, 17 bp, Homo sapiens
accagaaacacccctct

SEQ ID NO: 1465290 - DNA, 14 bp, Homo sapiens
accagaaagctcta

SEQ ID NO: 1465291 - DNA, 22 bp, Homo sapiens
accagaaatatcgctgatgcag

SEQ ID NO: 1465292 - DNA, 18 bp, Homo sapiens
accagaagatgtgaaatt

SEQ ID NO: 1465293 - DNA, 20 bp, Homo sapiens
accagaagctgttgggagaa

SEQ ID NO: 1465294 - DNA, 15 bp, Homo sapiens
accagaccatgggcc

SEQ ID NO: 1465295 - DNA, 22 bp, Homo sapiens
accagacctggaagaacaggcc

SEQ ID NO: 1465296 - DNA, 19 bp, Homo sapiens
accagacggttcaccagcc

SEQ ID NO: 1465297 - DNA, 22 bp, Homo sapiens
accagactagatggacctgcct

SEQ ID NO: 1465298 - DNA, 16 bp, Homo sapiens
accagactcttgcctg

SEQ ID NO: 1465299 - DNA, 23 bp, Homo sapiens
accagagacccaacagcagtgat

SEQ ID NO: 1465300 - DNA, 20 bp, Homo sapiens
accagagagagcaaggaagc

SEQ ID NO: 1465301 - DNA, 20 bp, Homo sapiens
accagagcatttccaacacc

SEQ ID NO: 1465302 - DNA, 21 bp, Homo sapiens
accagagccagatgcaggaca

SEQ ID NO: 1465303 - DNA, 12 bp, Homo sapiens
accagagcccat

SEQ ID NO: 1465304 - DNA, 17 bp, Homo sapiens
accagagccccacacgg

SEQ ID NO: 1465305 - DNA, 20 bp, Homo sapiens
accagagccccacacggagg

SEQ ID NO: 1465306 - DNA, 18 bp, Homo sapiens
accagagccttcaagtgc

SEQ ID NO: 1465307 - DNA, 14 bp, Homo sapiens
accagaggagcctt

SEQ ID NO: 1465308 - DNA, 15 bp, Homo sapiens
accagaggagccttt

SEQ ID NO: 1465309 - DNA, 17 bp, Homo sapiens
accagaggagccttttt

SEQ ID NO: 1465310 - DNA, 11 bp, Homo sapiens
accagaggccg

SEQ ID NO: 1465311 - DNA, 16 bp, Homo sapiens
accagagggcatgctg

SEQ ID NO: 1465312 - DNA, 16 bp, Homo sapiens
accagaggtgcttctg

SEQ ID NO: 1465313 - DNA, 20 bp, Homo sapiens
accagataagaatgctggtt

SEQ ID NO: 1465314 - DNA, 22 bp, Homo sapiens
accagataccttatcttacaat

SEQ ID NO: 1465315 - DNA, 21 bp, Homo sapiens
accagatctttctcttccctg

SEQ ID NO: 1465316 - DNA, 20 bp, Homo sapiens
accagatgacacataaatct

SEQ ID NO: 1465317 - DNA, 21 bp, Homo sapiens
accagatgcgtcccaagatgt

SEQ ID NO: 1465318 - DNA, 15 bp, Homo sapiens
accagatgtccgtct

SEQ ID NO: 1465319 - DNA, 22 bp, Homo sapiens
accagatgtccgtctctcttgc

SEQ ID NO: 1465320 - DNA, 21 bp, Homo sapiens
accagattctgcctatgtaaa

SEQ ID NO: 1465321 - DNA, 14 bp, Homo sapiens
accagcaacatctc

SEQ ID NO: 1465322 - DNA, 17 bp, Homo sapiens
accagcaatatatctga

SEQ ID NO: 1465323 - DNA, 13 bp, Homo sapiens
accagcactcagc

SEQ ID NO: 1465324 - DNA, 14 bp, Homo sapiens
accagcactcagcc

SEQ ID NO: 1465325 - DNA, 22 bp, Homo sapiens
accagcagacagagccaggaga

SEQ ID NO: 1465326 - DNA, 13 bp, Homo sapiens
accagcagcactg

SEQ ID NO: 1465327 - DNA, 22 bp, Homo sapiens
accagcaggaggttctgggcct

SEQ ID NO: 1465328 - DNA, 12 bp, Homo sapiens
accagcaggtgt

SEQ ID NO: 1465329 - DNA, 18 bp, Homo sapiens
accagcatcacctgcctg

SEQ ID NO: 1465330 - DNA, 19 bp, Homo sapiens
accagccacagtacatatg

SEQ ID NO: 1465331 - DNA, 21 bp, Homo sapiens
acccacgtattcattcagtga

SEQ ID NO: 1465332 - DNA, 22 bp, Homo sapiens
acccacgtgagagaatctgcct

SEQ ID NO: 1465333 - DNA, 20 bp, Homo sapiens
acccacgtgtaactgtcagc

SEQ ID NO: 1465334 - DNA, 14 bp, Homo sapiens
acccactaaagagt

SEQ ID NO: 1465335 - DNA, 18 bp, Homo sapiens
acccactacccttctcct

SEQ ID NO: 1465336 - DNA, 21 bp, Homo sapiens
acccactacccttctcctttc

SEQ ID NO: 1465337 - DNA, 14 bp, Homo sapiens
acccactcaccagg

SEQ ID NO: 1465338 - DNA, 15 bp, Homo sapiens
acccactcggtccca

SEQ ID NO: 1465339 - DNA, 22 bp, Homo sapiens
acccactgacccaactgatcct

SEQ ID NO: 1465340 - DNA, 23 bp, Homo sapiens
acccactgacccaactgatcctg

SEQ ID NO: 1465341 - DNA, 13 bp, Homo sapiens
acccactttgtaa

SEQ ID NO: 1465342 - DNA, 18 bp, Homo sapiens
acccagaatgagacatcc

SEQ ID NO: 1465343 - DNA, 23 bp, Homo sapiens
acccagaatggagcctgctctcc

SEQ ID NO: 1465344 - DNA, 20 bp, Homo sapiens
acccagaatggtcatttcag

SEQ ID NO: 1465345 - DNA, 15 bp, Homo sapiens
acccagacagctccc

SEQ ID NO: 1465346 - DNA, 22 bp, Homo sapiens
acccagacagctccctctgcct

SEQ ID NO: 1465347 - DNA, 11 bp, Homo sapiens
acccagactgt

SEQ ID NO: 1465348 - DNA, 12 bp, Homo sapiens
acccagactgtc

SEQ ID NO: 1465349 - DNA, 17 bp, Homo sapiens
acccagattgtgtacat

SEQ ID NO: 1465350 - DNA, 21 bp, Homo sapiens
acccagcaggaagccaggctg

SEQ ID NO: 1465351 - DNA, 18 bp, Homo sapiens
acccagcatctcccagca

SEQ ID NO: 1465352 - DNA, 20 bp, Homo sapiens
acccagcatctcccagcaag

SEQ ID NO: 1465353 - DNA, 19 bp, Homo sapiens
acccagccacgactgccat

SEQ ID NO: 1465354 - DNA, 17 bp, Homo sapiens
acccagccccttgagaa

SEQ ID NO: 1465355 - DNA, 11 bp, Homo sapiens
acccagcctga

SEQ ID NO: 1465356 - DNA, 14 bp, Homo sapiens
acccagctactctg

SEQ ID NO: 1465357 - DNA, 19 bp, Homo sapiens
acccagctactctgtccag

SEQ ID NO: 1465358 - DNA, 22 bp, Homo sapiens
acccagctatggttctctcgca

SEQ ID NO: 1465359 - DNA, 22 bp, Homo sapiens
acccagctccttttgtccccag

SEQ ID NO: 1465360 - DNA, 12 bp, Homo sapiens
acccagctctgt

SEQ ID NO: 1465361 - DNA, 15 bp, Homo sapiens
acccagctgatgggg

SEQ ID NO: 1465362 - DNA, 16 bp, Homo sapiens
acccaggaccatcctg

SEQ ID NO: 1465363 - DNA, 21 bp, Homo sapiens
acccaggaggtggaggttgca

SEQ ID NO: 1465364 - DNA, 23 bp, Homo sapiens
acccaggaggtggaggttgcagt

SEQ ID NO: 1465365 - DNA, 19 bp, Homo sapiens
acccaggatatctgaaaat

SEQ ID NO: 1465366 - DNA, 21 bp, Homo sapiens
acccaggatatctgaaaatat

SEQ ID NO: 1465367 - DNA, 12 bp, Homo sapiens
acccaggccctc

SEQ ID NO: 1465368 - DNA, 17 bp, Homo sapiens
acccaggccctccatgg

SEQ ID NO: 1465369 - DNA, 22 bp, Homo sapiens
acccaggccgcagctcttgccc

SEQ ID NO: 1465370 - DNA, 23 bp, Homo sapiens
acccaggccgcagctcttgccct

SEQ ID NO: 1465371 - DNA, 19 bp, Homo sapiens
acccaggcctccctgcaga

SEQ ID NO: 1465372 - DNA, 24 bp, Homo sapiens
acccaggcctccctgcagactcca

SEQ ID NO: 1465373 - DNA, 15 bp, Homo sapiens
acccaggctgcactg

SEQ ID NO: 1465374 - DNA, 20 bp, Homo sapiens
acccaggctgcactgcagtg

SEQ ID NO: 1465375 - DNA, 18 bp, Homo sapiens
acccaggctggagtgcag

SEQ ID NO: 1465376 - DNA, 20 bp, Homo sapiens
acccaggctggagtgcagtg

SEQ ID NO: 1465377 - DNA, 15 bp, Homo sapiens
acccagggctctgca

SEQ ID NO: 1465378 - DNA, 18 bp, Homo sapiens
acccagggctctgcagca

SEQ ID NO: 1465379 - DNA, 21 bp, Homo sapiens
acccagggctctgcagcacct

SEQ ID NO: 1465380 - DNA, 19 bp, Homo sapiens
acccaggtggagggcacag

SEQ ID NO: 1465381 - DNA, 22 bp, Homo sapiens
acccaggtggagggcacagccc

SEQ ID NO: 1465382 - DNA, 20 bp, Homo sapiens
acccaggtgtgcctgtgctc

SEQ ID NO: 1465383 - DNA, 15 bp, Homo sapiens
acccagtccatgctc

SEQ ID NO: 1465384 - DNA, 14 bp, Homo sapiens
acccagtccccacc

SEQ ID NO: 1465385 - DNA, 17 bp, Homo sapiens
acccagtccccacccgc

SEQ ID NO: 1465386 - DNA, 17 bp, Homo sapiens
acccagtccccgtgccc

SEQ ID NO: 1465387 - DNA, 13 bp, Homo sapiens
acccagtctcctc

SEQ ID NO: 1465388 - DNA, 15 bp, Homo sapiens
acccagtctcctctc

SEQ ID NO: 1465389 - DNA, 17 bp, Homo sapiens
acccagtctcctctcca

SEQ ID NO: 1465390 - DNA, 16 bp, Homo sapiens
acccagtctgttcccc

SEQ ID NO: 1465391 - DNA, 15 bp, Homo sapiens
acccagtgcccccac

SEQ ID NO: 1465392 - DNA, 14 bp, Homo sapiens
acccagtgctgcca

SEQ ID NO: 1465393 - DNA, 15 bp, Homo sapiens
acccagtgctgccat

SEQ ID NO: 1465394 - DNA, 18 bp, Homo sapiens
acccagtgctgccatgcc

SEQ ID NO: 1465395 - DNA, 23 bp, Homo sapiens
acccagtgctgccatgccactgc

SEQ ID NO: 1465396 - DNA, 12 bp, Homo sapiens
acccagtggctg

SEQ ID NO: 1465397 - DNA, 15 bp, Homo sapiens
acccataaacagcac

SEQ ID NO: 1465398 - DNA, 14 bp, Homo sapiens
acccatacaatgta

SEQ ID NO: 1465399 - DNA, 18 bp, Homo sapiens
acccatacaatgtatgta

SEQ ID NO: 1465400 - DNA, 23 bp, Homo sapiens
acccatacaatgtatgtacaata

SEQ ID NO: 1465401 - DNA, 18 bp, Homo sapiens
acccatagatcttctgaa

SEQ ID NO: 1465402 - DNA, 22 bp, Homo sapiens
acccatagatcttctgaaatga

SEQ ID NO: 1465403 - DNA, 23 bp, Homo sapiens
acccatgactttatatggatgat

SEQ ID NO: 1465404 - DNA, 18 bp, Homo sapiens
acccatgcaagcagagga

SEQ ID NO: 1465405 - DNA, 23 bp, Homo sapiens
acccatgcacactcatgcacaca

SEQ ID NO: 1465406 - DNA, 16 bp, Homo sapiens
acccatgcacagtaca

SEQ ID NO: 1465407 - DNA, 16 bp, Homo sapiens
acccatgcagctgctc

SEQ ID NO: 1465408 - DNA, 18 bp, Homo sapiens
acccatgcagctgctccc

SEQ ID NO: 1465409 - DNA, 16 bp, Homo sapiens
acccatgtgttaaaat

SEQ ID NO: 1465410 - DNA, 21 bp, Homo sapiens
acccattaaggggaagaatga

SEQ ID NO: 1465411 - DNA, 21 bp, Homo sapiens
acccattcagagactgtccct

SEQ ID NO: 1465412 - DNA, 17 bp, Homo sapiens
acccattccagtacagt

SEQ ID NO: 1465413 - DNA, 22 bp, Homo sapiens
acccattcgtggtgatcaatta

SEQ ID NO: 1465414 - DNA, 21 bp, Homo sapiens
acccattctgttttcccccag

SEQ ID NO: 1465415 - DNA, 20 bp, Homo sapiens
acccatttaaatttttttcc

SEQ ID NO: 1465416 - DNA, 14 bp, Homo sapiens
acccatttacaaat

SEQ ID NO: 1465417 - DNA, 19 bp, Homo sapiens
acccatttacaaataagag

SEQ ID NO: 1465418 - DNA, 21 bp, Homo sapiens
acccattttttaaaaaagcaa

SEQ ID NO: 1465419 - DNA, 18 bp, Homo sapiens
accccaaacaccttccag

SEQ ID NO: 1465420 - DNA, 23 bp, Homo sapiens
accccaaacaccttccagctcct

SEQ ID NO: 1465421 - DNA, 18 bp, Homo sapiens
accccaaagactctggag

SEQ ID NO: 1465422 - DNA, 15 bp, Homo sapiens
accccaaagctttcc

SEQ ID NO: 1465423 - DNA, 20 bp, Homo sapiens
accccaaaggaacactgaca

SEQ ID NO: 1465424 - DNA, 14 bp, Homo sapiens
accccaactctccc

SEQ ID NO: 1465425 - DNA, 16 bp, Homo sapiens
accccaactctcccca

SEQ ID NO: 1465426 - DNA, 18 bp, Homo sapiens
accccaagagaactcgcg

SEQ ID NO: 1465427 - DNA, 21 bp, Homo sapiens
accccaagccagcccggccgc

SEQ ID NO: 1465428 - DNA, 17 bp, Homo sapiens
accccacaccaggccgt

SEQ ID NO: 1465429 - DNA, 22 bp, Homo sapiens
accccaccacgatgtggccctg

SEQ ID NO: 1465430 - DNA, 16 bp, Homo sapiens
accccaccccaccccc

SEQ ID NO: 1465431 - DNA, 21 bp, Homo sapiens
accccacccccttcagtgccc

SEQ ID NO: 1465432 - DNA, 22 bp, Homo sapiens
accccacccccttcagtgccca

SEQ ID NO: 1465433 - DNA, 14 bp, Homo sapiens
accccaccctcagc

SEQ ID NO: 1465434 - DNA, 15 bp, Homo sapiens
accccaccctcagca

SEQ ID NO: 1465435 - DNA, 13 bp, Homo sapiens
accccacccttcc

SEQ ID NO: 1465436 - DNA, 16 bp, Homo sapiens
accccacgccttatcc

SEQ ID NO: 1465437 - DNA, 18 bp, Homo sapiens
accccactccagccctgt

SEQ ID NO: 1465438 - DNA, 19 bp, Homo sapiens
accccactccagccctgtc

SEQ ID NO: 1465439 - DNA, 20 bp, Homo sapiens
accccactccagccctgtcc

SEQ ID NO: 1465440 - DNA, 13 bp, Homo sapiens
accccacttcaga

SEQ ID NO: 1465441 - DNA, 16 bp, Homo sapiens
accccagcattccagc

SEQ ID NO: 1465442 - DNA, 17 bp, Homo sapiens
accccagcattccagct

SEQ ID NO: 1465443 - DNA, 12 bp, Homo sapiens
accccagccagg

SEQ ID NO: 1465444 - DNA, 14 bp, Homo sapiens
accccagccaggct

SEQ ID NO: 1465445 - DNA, 21 bp, Homo sapiens
accctgctgaacacagtgtct

SEQ ID NO: 1465446 - DNA, 16 bp, Homo sapiens
accctggagccatccc

SEQ ID NO: 1465447 - DNA, 21 bp, Homo sapiens
accctggaggccccaaccctg

SEQ ID NO: 1465448 - DNA, 16 bp, Homo sapiens
accctggatcagtcct

SEQ ID NO: 1465449 - DNA, 22 bp, Homo sapiens
accctggcagggacctgagagc

SEQ ID NO: 1465450 - DNA, 19 bp, Homo sapiens
accctggccgccccctgcc

SEQ ID NO: 1465451 - DNA, 11 bp, Homo sapiens
accctggcctg

SEQ ID NO: 1465452 - DNA, 23 bp, Homo sapiens
accctggcctggtccctggtcct

SEQ ID NO: 1465453 - DNA, 20 bp, Homo sapiens
accctgggccctgggctgga

SEQ ID NO: 1465454 - DNA, 14 bp, Homo sapiens
accctgggcctgga

SEQ ID NO: 1465455 - DNA, 15 bp, Homo sapiens
accctgggcctggag

SEQ ID NO: 1465456 - DNA, 13 bp, Homo sapiens
accctgggctcca

SEQ ID NO: 1465457 - DNA, 23 bp, Homo sapiens
accctgggctccacacagcagtg

SEQ ID NO: 1465458 - DNA, 17 bp, Homo sapiens
accctgggctggggagg

SEQ ID NO: 1465459 - DNA, 13 bp, Homo sapiens
accctggggcctg

SEQ ID NO: 1465460 - DNA, 19 bp, Homo sapiens
accctggggcctggacctg

SEQ ID NO: 1465461 - DNA, 22 bp, Homo sapiens
accctggggcctggacctgcct

SEQ ID NO: 1465462 - DNA, 14 bp, Homo sapiens
accctgggggcaca

SEQ ID NO: 1465463 - DNA, 16 bp, Homo sapiens
accctgggggcacagg

SEQ ID NO: 1465464 - DNA, 18 bp, Homo sapiens
accctgggggcacaggag

SEQ ID NO: 1465465 - DNA, 20 bp, Homo sapiens
accctgggtgtccccgctgc

SEQ ID NO: 1465466 - DNA, 21 bp, Homo sapiens
accctggtccagtcgggagga

SEQ ID NO: 1465467 - DNA, 16 bp, Homo sapiens
accctggtcctgactt

SEQ ID NO: 1465468 - DNA, 15 bp, Homo sapiens
accctggtgggccaa

SEQ ID NO: 1465469 - DNA, 14 bp, Homo sapiens
accctggtgggctg

SEQ ID NO: 1465470 - DNA, 20 bp, Homo sapiens
accctgtcaagttaacaagg

SEQ ID NO: 1465471 - DNA, 22 bp, Homo sapiens
accctgtcaagttaacaaggaa

SEQ ID NO: 1465472 - DNA, 18 bp, Homo sapiens
accctgtccggcccagtg

SEQ ID NO: 1465473 - DNA, 19 bp, Homo sapiens
accctgtccggcccagtgc

SEQ ID NO: 1465474 - DNA, 11 bp, Homo sapiens
accctgtcctc

SEQ ID NO: 1465475 - DNA, 17 bp, Homo sapiens
accctgtgcaggagcta

SEQ ID NO: 1465476 - DNA, 15 bp, Homo sapiens
accctgtgctggtgt

SEQ ID NO: 1465477 - DNA, 22 bp, Homo sapiens
accctgtgggcttatgtctctg

SEQ ID NO: 1465478 - DNA, 22 bp, Homo sapiens
acccttaccccttagcctccct

SEQ ID NO: 1465479 - DNA, 22 bp, Homo sapiens
acccttactggcttacctcctc

SEQ ID NO: 1465480 - DNA, 21 bp, Homo sapiens
acccttcacataccctccccc

SEQ ID NO: 1465481 - DNA, 20 bp, Homo sapiens
acccttcagtgctacatttt

SEQ ID NO: 1465482 - DNA, 21 bp, Homo sapiens
acccttcatcttcctgtgtcc

SEQ ID NO: 1465483 - DNA, 13 bp, Homo sapiens
acccttccctctt

SEQ ID NO: 1465484 - DNA, 13 bp, Homo sapiens
acccttccctgct

SEQ ID NO: 1465485 - DNA, 19 bp, Homo sapiens
acccttcccttgagccctc

SEQ ID NO: 1465486 - DNA, 15 bp, Homo sapiens
acccttcctgctgct

SEQ ID NO: 1465487 - DNA, 17 bp, Homo sapiens
acccttctcctttcctt

SEQ ID NO: 1465488 - DNA, 21 bp, Homo sapiens
acccttctcctttccttccca

SEQ ID NO: 1465489 - DNA, 22 bp, Homo sapiens
acccttctcctttccttcccag

SEQ ID NO: 1465490 - DNA, 12 bp, Homo sapiens
acccttctcgga

SEQ ID NO: 1465491 - DNA, 21 bp, Homo sapiens
acccttgcatccattgttgtg

SEQ ID NO: 1465492 - DNA, 14 bp, Homo sapiens
acccttgctttcct

SEQ ID NO: 1465493 - DNA, 15 bp, Homo sapiens
acccttgctttcctg

SEQ ID NO: 1465494 - DNA, 16 bp, Homo sapiens
acccttgggccagaag

SEQ ID NO: 1465495 - DNA, 17 bp, Homo sapiens
acccttgtgcttggtgg

SEQ ID NO: 1465496 - DNA, 19 bp, Homo sapiens
accctttaagatatccatc

SEQ ID NO: 1465497 - DNA, 22 bp, Homo sapiens
accctttccttccttccctggc

SEQ ID NO: 1465498 - DNA, 19 bp, Homo sapiens
accctttcgctggctttcc

SEQ ID NO: 1465499 - DNA, 22 bp, Homo sapiens
accctttctgttgccagtcagc

SEQ ID NO: 1465500 - DNA, 21 bp, Homo sapiens
accctttcttgacaaaaccta

SEQ ID NO: 1465501 - DNA, 22 bp, Homo sapiens
accctttgctgtgaggctgtcc

SEQ ID NO: 1465502 - DNA, 16 bp, Homo sapiens
accctttggccccact

SEQ ID NO: 1465503 - DNA, 23 bp, Homo sapiens
accctttggttatttcagccccc

SEQ ID NO: 1465504 - DNA, 23 bp, Homo sapiens
acccttttaagtttaaaatgtgt

SEQ ID NO: 1465505 - DNA, 15 bp, Homo sapiens
accgaaaatggacat

SEQ ID NO: 1465506 - DNA, 15 bp, Homo sapiens
accgaaatctgtatt

SEQ ID NO: 1465507 - DNA, 15 bp, Homo sapiens
accgactaccccagt

SEQ ID NO: 1465508 - DNA, 22 bp, Homo sapiens
accgagagcttggactacacaa

SEQ ID NO: 1465509 - DNA, 15 bp, Homo sapiens
accgagcaaagatca

SEQ ID NO: 1465510 - DNA, 17 bp, Homo sapiens
accgagcaaagatcaaa

SEQ ID NO: 1465511 - DNA, 19 bp, Homo sapiens
accgagcaaagatcaaaat

SEQ ID NO: 1465512 - DNA, 18 bp, Homo sapiens
accgagcccagcagatct

SEQ ID NO: 1465513 - DNA, 13 bp, Homo sapiens
accgagccctgga

SEQ ID NO: 1465514 - DNA, 18 bp, Homo sapiens
accgagtctcttctccac

SEQ ID NO: 1465515 - DNA, 20 bp, Homo sapiens
accgagtctcttctccactg

SEQ ID NO: 1465516 - DNA, 15 bp, Homo sapiens
accgatttctgctaa

SEQ ID NO: 1465517 - DNA, 18 bp, Homo sapiens
accgatttctgctaagtt

SEQ ID NO: 1465518 - DNA, 12 bp, Homo sapiens
accgcacagctc

SEQ ID NO: 1465519 - DNA, 18 bp, Homo sapiens
accgcacagctcaggagg

SEQ ID NO: 1465520 - DNA, 21 bp, Homo sapiens
accgcaggggactgtctcaga

SEQ ID NO: 1465521 - DNA, 17 bp, Homo sapiens
accgccacgtcccagca

SEQ ID NO: 1465522 - DNA, 12 bp, Homo sapiens
accgccagcagc

SEQ ID NO: 1465523 - DNA, 14 bp, Homo sapiens
accgccagcagcgc

SEQ ID NO: 1465524 - DNA, 23 bp, Homo sapiens
accgccagcagcgcgcaggcctg

SEQ ID NO: 1465525 - DNA, 11 bp, Homo sapiens
accgcccatca

SEQ ID NO: 1465526 - DNA, 16 bp, Homo sapiens
accgcctcgtgccagc

SEQ ID NO: 1465527 - DNA, 17 bp, Homo sapiens
accgcctcgtgccagca

SEQ ID NO: 1465528 - DNA, 19 bp, Homo sapiens
accgcctcgtgccagcagc

SEQ ID NO: 1465529 - DNA, 21 bp, Homo sapiens
accgcctcgtgccagcagcct

SEQ ID NO: 1465530 - DNA, 23 bp, Homo sapiens
accgcctcgtgccagcagcctcg

SEQ ID NO: 1465531 - DNA, 14 bp, Homo sapiens
accgcggccaggca

SEQ ID NO: 1465532 - DNA, 14 bp, Homo sapiens
accgctcagtattt

SEQ ID NO: 1465533 - DNA, 14 bp, Homo sapiens
accgctgccagcac

SEQ ID NO: 1465534 - DNA, 19 bp, Homo sapiens
accgctgcctaagtggctg

SEQ ID NO: 1465535 - DNA, 20 bp, Homo sapiens
accgctggtccctgccctcc

SEQ ID NO: 1465536 - DNA, 17 bp, Homo sapiens
accgcttcacccctgca

SEQ ID NO: 1465537 - DNA, 19 bp, Homo sapiens
accgcttcacccctgcact

SEQ ID NO: 1465538 - DNA, 17 bp, Homo sapiens
accgcttctgccttttc

SEQ ID NO: 1465539 - DNA, 15 bp, Homo sapiens
accggaaggaggcca

SEQ ID NO: 1465540 - DNA, 22 bp, Homo sapiens
accggaaggaggccaaccagcc

SEQ ID NO: 1465541 - DNA, 19 bp, Homo sapiens
accggacttgtcacacgga

SEQ ID NO: 1465542 - DNA, 15 bp, Homo sapiens
accggacttttctgc

SEQ ID NO: 1465543 - DNA, 12 bp, Homo sapiens
accggcagaaaa

SEQ ID NO: 1465544 - DNA, 14 bp, Homo sapiens
accggccaggccgc

SEQ ID NO: 1465545 - DNA, 14 bp, Homo sapiens
accggcgctgcagg

SEQ ID NO: 1465546 - DNA, 15 bp, Homo sapiens
accggcgctgcaggt

SEQ ID NO: 1465547 - DNA, 19 bp, Homo sapiens
accgggacagacctggaca

SEQ ID NO: 1465548 - DNA, 22 bp, Homo sapiens
accgggccagtatctatatatg

SEQ ID NO: 1465549 - DNA, 18 bp, Homo sapiens
accggggaccgggacccg

SEQ ID NO: 1465550 - DNA, 21 bp, Homo sapiens
accgggtcttgattcagtcac

SEQ ID NO: 1465551 - DNA, 23 bp, Homo sapiens
accgggtcttgattcagtcacat

SEQ ID NO: 1465552 - DNA, 20 bp, Homo sapiens
accgggtgggcctggcctga

SEQ ID NO: 1465553 - DNA, 22 bp, Homo sapiens
accgggtgggcctggcctgagc

SEQ ID NO: 1465554 - DNA, 18 bp, Homo sapiens
accggtccagctggcctg

SEQ ID NO: 1465555 - DNA, 22 bp, Homo sapiens
accgtacagtttctgcttggga

SEQ ID NO: 1465556 - DNA, 13 bp, Homo sapiens
accgtagcctccg

SEQ ID NO: 1465557 - DNA, 17 bp, Homo sapiens
accgtcacactcttcag

SEQ ID NO: 1465558 - DNA, 14 bp, Homo sapiens
accgtccaggcccc

SEQ ID NO: 1465559 - DNA, 11 bp, Homo sapiens
acctgcagtgc

SEQ ID NO: 1465560 - DNA, 21 bp, Homo sapiens
acctgcagtgccagctccctc

SEQ ID NO: 1465561 - DNA, 21 bp, Homo sapiens
acctgcatccgtagttccctg

SEQ ID NO: 1465562 - DNA, 19 bp, Homo sapiens
acctgcatccttcctgggg

SEQ ID NO: 1465563 - DNA, 23 bp, Homo sapiens
acctgccacaaaccaccaggact

SEQ ID NO: 1465564 - DNA, 16 bp, Homo sapiens
acctgccatgccagga

SEQ ID NO: 1465565 - DNA, 15 bp, Homo sapiens
acctgccccctggtg

SEQ ID NO: 1465566 - DNA, 23 bp, Homo sapiens
acctgccccgcccagctgcacct

SEQ ID NO: 1465567 - DNA, 14 bp, Homo sapiens
acctgccctcaagg

SEQ ID NO: 1465568 - DNA, 15 bp, Homo sapiens
acctgccctcaaggg

SEQ ID NO: 1465569 - DNA, 21 bp, Homo sapiens
acctgccctctatttattagc

SEQ ID NO: 1465570 - DNA, 16 bp, Homo sapiens
acctgccctgcctgag

SEQ ID NO: 1465571 - DNA, 12 bp, Homo sapiens
acctgccgacct

SEQ ID NO: 1465572 - DNA, 18 bp, Homo sapiens
acctgccgacctcgtcct

SEQ ID NO: 1465573 - DNA, 20 bp, Homo sapiens
acctgccgacctcgtcctcc

SEQ ID NO: 1465574 - DNA, 16 bp, Homo sapiens
acctgcctccaccagc

SEQ ID NO: 1465575 - DNA, 11 bp, Homo sapiens
acctgcctctc

SEQ ID NO: 1465576 - DNA, 15 bp, Homo sapiens
acctgcctctcacac

SEQ ID NO: 1465577 - DNA, 19 bp, Homo sapiens
acctgcctctcacacacat

SEQ ID NO: 1465578 - DNA, 22 bp, Homo sapiens
acctgcctctcacacacataga

SEQ ID NO: 1465579 - DNA, 16 bp, Homo sapiens
acctgctcacgtcaaa

SEQ ID NO: 1465580 - DNA, 16 bp, Homo sapiens
acctgctcagccctgc

SEQ ID NO: 1465581 - DNA, 13 bp, Homo sapiens
acctgctccagaa

SEQ ID NO: 1465582 - DNA, 17 bp, Homo sapiens
acctgctccagaagatg

SEQ ID NO: 1465583 - DNA, 13 bp, Homo sapiens
acctgctctccgg

SEQ ID NO: 1465584 - DNA, 13 bp, Homo sapiens
acctgctcttccc

SEQ ID NO: 1465585 - DNA, 16 bp, Homo sapiens
acctgctcttcccagc

SEQ ID NO: 1465586 - DNA, 22 bp, Homo sapiens
acctgctgagagacccaaggag

SEQ ID NO: 1465587 - DNA, 19 bp, Homo sapiens
acctgctgagggaccagcc

SEQ ID NO: 1465588 - DNA, 20 bp, Homo sapiens
acctgctgagggaccagcca

SEQ ID NO: 1465589 - DNA, 23 bp, Homo sapiens
acctgctgagggaccagccaaga

SEQ ID NO: 1465590 - DNA, 17 bp, Homo sapiens
acctgctgccccagctg

SEQ ID NO: 1465591 - DNA, 16 bp, Homo sapiens
acctgctgcgtcccca

SEQ ID NO: 1465592 - DNA, 21 bp, Homo sapiens
acctgctgtgatacgatgctt

SEQ ID NO: 1465593 - DNA, 14 bp, Homo sapiens
acctgcttccttca

SEQ ID NO: 1465594 - DNA, 16 bp, Homo sapiens
acctgcttctgaactc

SEQ ID NO: 1465595 - DNA, 21 bp, Homo sapiens
acctgcttctgaactcaagct

SEQ ID NO: 1465596 - DNA, 15 bp, Homo sapiens
acctggaaatgatgt

SEQ ID NO: 1465597 - DNA, 15 bp, Homo sapiens
acctggaaccagagc

SEQ ID NO: 1465598 - DNA, 18 bp, Homo sapiens
acctggaacttggggagt

SEQ ID NO: 1465599 - DNA, 20 bp, Homo sapiens
acctggaagaacaggcctct

SEQ ID NO: 1465600 - DNA, 22 bp, Homo sapiens
acctggacttaagcatctggct

SEQ ID NO: 1465601 - DNA, 19 bp, Homo sapiens
acctggaggggcaccaggt

SEQ ID NO: 1465602 - DNA, 15 bp, Homo sapiens
acctggcaaaggacc

SEQ ID NO: 1465603 - DNA, 14 bp, Homo sapiens
acctggcagctctg

SEQ ID NO: 1465604 - DNA, 18 bp, Homo sapiens
acctggccacctgaggtg

SEQ ID NO: 1465605 - DNA, 21 bp, Homo sapiens
acctggccacctgaggtgggc

SEQ ID NO: 1465606 - DNA, 21 bp, Homo sapiens
acctggccccatgtctctcag

SEQ ID NO: 1465607 - DNA, 15 bp, Homo sapiens
acctggccctgcttc

SEQ ID NO: 1465608 - DNA, 18 bp, Homo sapiens
acctggccctgcttcctg

SEQ ID NO: 1465609 - DNA, 19 bp, Homo sapiens
acctggccctgcttcctgc

SEQ ID NO: 1465610 - DNA, 17 bp, Homo sapiens
acctggccgctaagttg

SEQ ID NO: 1465611 - DNA, 17 bp, Homo sapiens
acctggcgtgctcagac

SEQ ID NO: 1465612 - DNA, 15 bp, Homo sapiens
acctggctctcagag

SEQ ID NO: 1465613 - DNA, 13 bp, Homo sapiens
acctggctgaggt

SEQ ID NO: 1465614 - DNA, 17 bp, Homo sapiens
acctggcttatttaata

SEQ ID NO: 1465615 - DNA, 17 bp, Homo sapiens
acctggcttttacttta

SEQ ID NO: 1465616 - DNA, 23 bp, Homo sapiens
acctgggaaaggacccacccatc

SEQ ID NO: 1465617 - DNA, 24 bp, Homo sapiens
acctgggaaaggacccacccatct

SEQ ID NO: 1465618 - DNA, 18 bp, Homo sapiens
acctgggattcaggaatg

SEQ ID NO: 1465619 - DNA, 15 bp, Homo sapiens
acctgggatttgaga

SEQ ID NO: 1465620 - DNA, 23 bp, Homo sapiens
acctgggcactccgcgccgatgc

SEQ ID NO: 1465621 - DNA, 19 bp, Homo sapiens
acctgggcatttggtgaga

SEQ ID NO: 1465622 - DNA, 15 bp, Homo sapiens
acctgggctcagcct

SEQ ID NO: 1465623 - DNA, 20 bp, Homo sapiens
acctgggtatcccctgcctc

SEQ ID NO: 1465624 - DNA, 15 bp, Homo sapiens
acctgggtccttttc

SEQ ID NO: 1465625 - DNA, 23 bp, Homo sapiens
acctgggttagggtgtgtgttca

SEQ ID NO: 1465626 - DNA, 17 bp, Homo sapiens
acctgggttccctttcc

SEQ ID NO: 1465627 - DNA, 14 bp, Homo sapiens
acctggtacctgga

SEQ ID NO: 1465628 - DNA, 15 bp, Homo sapiens
acctggtgcgggcct

SEQ ID NO: 1465629 - DNA, 18 bp, Homo sapiens
acctggtgcgggcctggc

SEQ ID NO: 1465630 - DNA, 19 bp, Homo sapiens
acctggtgcgggcctggcc

SEQ ID NO: 1465631 - DNA, 20 bp, Homo sapiens
acctggtgcgggcctggccc

SEQ ID NO: 1465632 - DNA, 21 bp, Homo sapiens
acctggtgcgggcctggccct

SEQ ID NO: 1465633 - DNA, 21 bp, Homo sapiens
acctggtttacttctttagca

SEQ ID NO: 1465634 - DNA, 17 bp, Homo sapiens
acctgtaacttttgtaa

SEQ ID NO: 1465635 - DNA, 19 bp, Homo sapiens
acctgtaatcccagctact

SEQ ID NO: 1465636 - DNA, 14 bp, Homo sapiens
acctgtacattctt

SEQ ID NO: 1465637 - DNA, 19 bp, Homo sapiens
acctgtagtcccagctact

SEQ ID NO: 1465638 - DNA, 16 bp, Homo sapiens
acctgtagtgagaaac

SEQ ID NO: 1465639 - DNA, 23 bp, Homo sapiens
acctgtatgtcaataaacaacag

SEQ ID NO: 1465640 - DNA, 20 bp, Homo sapiens
acctgtccccaccctccact

SEQ ID NO: 1465641 - DNA, 17 bp, Homo sapiens
acctgtccctccaggcc

SEQ ID NO: 1465642 - DNA, 12 bp, Homo sapiens
acctgtcgccca

SEQ ID NO: 1465643 - DNA, 16 bp, Homo sapiens
acctgtcgcccagtgc

SEQ ID NO: 1465644 - DNA, 13 bp, Homo sapiens
acctgtctcacca

SEQ ID NO: 1465645 - DNA, 18 bp, Homo sapiens
acctgtctcacctggact

SEQ ID NO: 1465646 - DNA, 14 bp, Homo sapiens
acctgtctcagcct

SEQ ID NO: 1465647 - DNA, 17 bp, Homo sapiens
acctgtcttccaaggag

SEQ ID NO: 1465648 - DNA, 16 bp, Homo sapiens
acctgtgactcctgtt

SEQ ID NO: 1465649 - DNA, 15 bp, Homo sapiens
acctgtgagcatcct

SEQ ID NO: 1465650 - DNA, 21 bp, Homo sapiens
acctgtgccctcaccaccaca

SEQ ID NO: 1465651 - DNA, 10 bp, Homo sapiens
acctgtggat

SEQ ID NO: 1465652 - DNA, 11 bp, Homo sapiens
acctgtgtcca

SEQ ID NO: 1465653 - DNA, 20 bp, Homo sapiens
acctgtgtccaagaactcta

SEQ ID NO: 1465654 - DNA, 20 bp, Homo sapiens
acctgtgtgcccagcacctg

SEQ ID NO: 1465655 - DNA, 15 bp, Homo sapiens
acctgtgttccagcc

SEQ ID NO: 1465656 - DNA, 21 bp, Homo sapiens
acctgttacactgggctgggt

SEQ ID NO: 1465657 - DNA, 19 bp, Homo sapiens
acctgttagctccctgtgg

SEQ ID NO: 1465658 - DNA, 16 bp, Homo sapiens
acctgttatttatcaa

SEQ ID NO: 1465659 - DNA, 18 bp, Homo sapiens
acctgttcagtgtcccgg

SEQ ID NO: 1465660 - DNA, 18 bp, Homo sapiens
acctgttcttagagtgta

SEQ ID NO: 1465661 - DNA, 20 bp, Homo sapiens
acctgttcttagagtgtagc

SEQ ID NO: 1465662 - DNA, 22 bp, Homo sapiens
acctgttcttagagtgtagctg

SEQ ID NO: 1465663 - DNA, 19 bp, Homo sapiens
acctgtttttaagctgttt

SEQ ID NO: 1465664 - DNA, 17 bp, Homo sapiens
acctgtttttttttcat

SEQ ID NO: 1465665 - DNA, 18 bp, Homo sapiens
acctgtttttttttcatt

SEQ ID NO: 1465666 - DNA, 16 bp, Homo sapiens
accttaaaattgatat

SEQ ID NO: 1465667 - DNA, 20 bp, Homo sapiens
accttaaagctgaatttata

SEQ ID NO: 1465668 - DNA, 22 bp, Homo sapiens
accttaagtaagcaacagcata

SEQ ID NO: 1465669 - DNA, 18 bp, Homo sapiens
accttagaaatcattgta

SEQ ID NO: 1465670 - DNA, 22 bp, Homo sapiens
accttagctggcattacagctg

SEQ ID NO: 1465671 - DNA, 15 bp, Homo sapiens
accttaggccttcct

SEQ ID NO: 1465672 - DNA, 21 bp, Homo sapiens
accttaggccttcctctctcc

SEQ ID NO: 1465673 - DNA, 18 bp, Homo sapiens
acgaggggtgtcttgggc

SEQ ID NO: 1465674 - DNA, 20 bp, Homo sapiens
acgaggggtgtcttgggcag

SEQ ID NO: 1465675 - DNA, 21 bp, Homo sapiens
acgaggggtgtcttgggcaga

SEQ ID NO: 1465676 - DNA, 13 bp, Homo sapiens
acgagtcacctgc

SEQ ID NO: 1465677 - DNA, 18 bp, Homo sapiens
acgagtcacctgcaagcc

SEQ ID NO: 1465678 - DNA, 16 bp, Homo sapiens
acgatcccctccccca

SEQ ID NO: 1465679 - DNA, 17 bp, Homo sapiens
acgatcccctcccccaa

SEQ ID NO: 1465680 - DNA, 14 bp, Homo sapiens
acgatgtggccctg

SEQ ID NO: 1465681 - DNA, 19 bp, Homo sapiens
acgatgtggccctggcctg

SEQ ID NO: 1465682 - DNA, 16 bp, Homo sapiens
acgattatacttgaga

SEQ ID NO: 1465683 - DNA, 18 bp, Homo sapiens
acgatttagaaagaagcc

SEQ ID NO: 1465684 - DNA, 19 bp, Homo sapiens
acgcacataccttcatgtg

SEQ ID NO: 1465685 - DNA, 23 bp, Homo sapiens
acgcaccactgcttcccactggg

SEQ ID NO: 1465686 - DNA, 11 bp, Homo sapiens
acgcacgcaca

SEQ ID NO: 1465687 - DNA, 13 bp, Homo sapiens
acgcacgcacaca

SEQ ID NO: 1465688 - DNA, 17 bp, Homo sapiens
acgcactgggccacgga

SEQ ID NO: 1465689 - DNA, 21 bp, Homo sapiens
acgcacttgcctgttggctgc

SEQ ID NO: 1465690 - DNA, 23 bp, Homo sapiens
acgcacttgcctgttggctgctg

SEQ ID NO: 1465691 - DNA, 19 bp, Homo sapiens
acgcagaagaaagggtgga

SEQ ID NO: 1465692 - DNA, 13 bp, Homo sapiens
acgcagccaggac

SEQ ID NO: 1465693 - DNA, 14 bp, Homo sapiens
acgcagccaggaca

SEQ ID NO: 1465694 - DNA, 23 bp, Homo sapiens
acgcagccggagggaggcactag

SEQ ID NO: 1465695 - DNA, 12 bp, Homo sapiens
acgcaggaatgg

SEQ ID NO: 1465696 - DNA, 14 bp, Homo sapiens
acgcaggaccagtt

SEQ ID NO: 1465697 - DNA, 16 bp, Homo sapiens
acgcaggctgagtcca

SEQ ID NO: 1465698 - DNA, 12 bp, Homo sapiens
acgcagggccat

SEQ ID NO: 1465699 - DNA, 14 bp, Homo sapiens
acgcaggtgctgcg

SEQ ID NO: 1465700 - DNA, 21 bp, Homo sapiens
acgcagtccgcccaggtcccc

SEQ ID NO: 1465701 - DNA, 21 bp, Homo sapiens
acgcatgcagtgttggggatg

SEQ ID NO: 1465702 - DNA, 14 bp, Homo sapiens
acgccacagcccag

SEQ ID NO: 1465703 - DNA, 20 bp, Homo sapiens
acgccactgcactccagcct

SEQ ID NO: 1465704 - DNA, 23 bp, Homo sapiens
acgccactgcactccagcctggg

SEQ ID NO: 1465705 - DNA, 18 bp, Homo sapiens
acgccattgtactccagc

SEQ ID NO: 1465706 - DNA, 20 bp, Homo sapiens
acgcccacccaaccccaagc

SEQ ID NO: 1465707 - DNA, 12 bp, Homo sapiens
acgcccagctcc

SEQ ID NO: 1465708 - DNA, 15 bp, Homo sapiens
acgcccagctccgcc

SEQ ID NO: 1465709 - DNA, 20 bp, Homo sapiens
acgccccgtgtctggatgca

SEQ ID NO: 1465710 - DNA, 12 bp, Homo sapiens
acgcccctccaa

SEQ ID NO: 1465711 - DNA, 16 bp, Homo sapiens
acgcccctccaaacct

SEQ ID NO: 1465712 - DNA, 19 bp, Homo sapiens
acgcccctccaaacctcca

SEQ ID NO: 1465713 - DNA, 20 bp, Homo sapiens
acgcccctccaaacctccag

SEQ ID NO: 1465714 - DNA, 21 bp, Homo sapiens
acgcccctccaaacctccagc

SEQ ID NO: 1465715 - DNA, 16 bp, Homo sapiens
acgcccctcccaagcg

SEQ ID NO: 1465716 - DNA, 15 bp, Homo sapiens
acgcccctgtggcca

SEQ ID NO: 1465717 - DNA, 18 bp, Homo sapiens
acgcccgtcctgcctgtg

SEQ ID NO: 1465718 - DNA, 20 bp, Homo sapiens
acgcccgtcctgcctgtggc

SEQ ID NO: 1465719 - DNA, 14 bp, Homo sapiens
acgccctatttcta

SEQ ID NO: 1465720 - DNA, 12 bp, Homo sapiens
acgccgagtgca

SEQ ID NO: 1465721 - DNA, 16 bp, Homo sapiens
acgccgccttggcctt

SEQ ID NO: 1465722 - DNA, 20 bp, Homo sapiens
acgccgccttggccttgcag

SEQ ID NO: 1465723 - DNA, 20 bp, Homo sapiens
acgccgtaattctttctgtc

SEQ ID NO: 1465724 - DNA, 16 bp, Homo sapiens
acgcctatgatcccag

SEQ ID NO: 1465725 - DNA, 17 bp, Homo sapiens
acgcctatgatcccagc

SEQ ID NO: 1465726 - DNA, 18 bp, Homo sapiens
acgcctatgatcccagca

SEQ ID NO: 1465727 - DNA, 23 bp, Homo sapiens
acgcctcttctgtccctgttaga

SEQ ID NO: 1465728 - DNA, 15 bp, Homo sapiens
acgcctgaggcaatt

SEQ ID NO: 1465729 - DNA, 18 bp, Homo sapiens
acgcctgcaggctggaga

SEQ ID NO: 1465730 - DNA, 22 bp, Homo sapiens
acgcctgcaggctggagactgg

SEQ ID NO: 1465731 - DNA, 23 bp, Homo sapiens
acgcctgccatcttctccccgag

SEQ ID NO: 1465732 - DNA, 12 bp, Homo sapiens
acgcctgccttt

SEQ ID NO: 1465733 - DNA, 16 bp, Homo sapiens
acgcctgtaatcccag

SEQ ID NO: 1465734 - DNA, 18 bp, Homo sapiens
acgcctgtaatcccagca

SEQ ID NO: 1465735 - DNA, 19 bp, Homo sapiens
acgcctgtaatcccagcag

SEQ ID NO: 1465736 - DNA, 14 bp, Homo sapiens
acgccttcccctca

SEQ ID NO: 1465737 - DNA, 20 bp, Homo sapiens
acgcgtatctaggctttggt

SEQ ID NO: 1465738 - DNA, 15 bp, Homo sapiens
acgcgtcttcctgag

SEQ ID NO: 1465739 - DNA, 21 bp, Homo sapiens
acgctaaagagcccttgcctc

SEQ ID NO: 1465740 - DNA, 19 bp, Homo sapiens
acgctactataaagagaag

SEQ ID NO: 1465741 - DNA, 22 bp, Homo sapiens
acgctcatgtcctgtcctggtc

SEQ ID NO: 1465742 - DNA, 14 bp, Homo sapiens
acgctccagctgcc

SEQ ID NO: 1465743 - DNA, 16 bp, Homo sapiens
acgctccagctgcccc

SEQ ID NO: 1465744 - DNA, 17 bp, Homo sapiens
acgctccagctgccccg

SEQ ID NO: 1465745 - DNA, 15 bp, Homo sapiens
acgctccctggaagc

SEQ ID NO: 1465746 - DNA, 13 bp, Homo sapiens
acgctccgctgcc

SEQ ID NO: 1465747 - DNA, 22 bp, Homo sapiens
acgctcctttgtgtgtgtgtca

SEQ ID NO: 1465748 - DNA, 16 bp, Homo sapiens
acgctctggtgcagtc

SEQ ID NO: 1465749 - DNA, 12 bp, Homo sapiens
acgctcttagct

SEQ ID NO: 1465750 - DNA, 23 bp, Homo sapiens
acgctgaactgacaatgaaggga

SEQ ID NO: 1465751 - DNA, 13 bp, Homo sapiens
acgctgcctggtc

SEQ ID NO: 1465752 - DNA, 19 bp, Homo sapiens
acgctgcctggtctgtctg

SEQ ID NO: 1465753 - DNA, 21 bp, Homo sapiens
acgctgctgcaggacattaat

SEQ ID NO: 1465754 - DNA, 14 bp, Homo sapiens
acgctgctgtcaca

SEQ ID NO: 1465755 - DNA, 22 bp, Homo sapiens
acgcttgtagaactcactctgg

SEQ ID NO: 1465756 - DNA, 23 bp, Homo sapiens
acgcttgtagaactcactctggg

SEQ ID NO: 1465757 - DNA, 15 bp, Homo sapiens
acgcttgtgacagtg

SEQ ID NO: 1465758 - DNA, 13 bp, Homo sapiens
acggaaaatgctt

SEQ ID NO: 1465759 - DNA, 15 bp, Homo sapiens
acggaaagtgctgtc

SEQ ID NO: 1465760 - DNA, 17 bp, Homo sapiens
acggaacgttggacttt

SEQ ID NO: 1465761 - DNA, 20 bp, Homo sapiens
acggaagccccctcttcctc

SEQ ID NO: 1465762 - DNA, 13 bp, Homo sapiens
acggagagaaaaa

SEQ ID NO: 1465763 - DNA, 22 bp, Homo sapiens
acggagagtgcttgggtggtgg

SEQ ID NO: 1465764 - DNA, 20 bp, Homo sapiens
acggagcccctgaaagcctc

SEQ ID NO: 1465765 - DNA, 18 bp, Homo sapiens
acggaggggagtagagaa

SEQ ID NO: 1465766 - DNA, 15 bp, Homo sapiens
acggagtggccgggc

SEQ ID NO: 1465767 - DNA, 20 bp, Homo sapiens
acggatccatgtagcaggac

SEQ ID NO: 1465768 - DNA, 14 bp, Homo sapiens
acggatctgctggg

SEQ ID NO: 1465769 - DNA, 22 bp, Homo sapiens
acggattagggcatttgagaaa

SEQ ID NO: 1465770 - DNA, 23 bp, Homo sapiens
acggattagggcatttgagaaat

SEQ ID NO: 1465771 - DNA, 17 bp, Homo sapiens
acggcaacgtagcctgg

SEQ ID NO: 1465772 - DNA, 12 bp, Homo sapiens
acggcacgcact

SEQ ID NO: 1465773 - DNA, 17 bp, Homo sapiens
acggcacgcacttgcct

SEQ ID NO: 1465774 - DNA, 19 bp, Homo sapiens
acggcacgcacttgcctgt

SEQ ID NO: 1465775 - DNA, 17 bp, Homo sapiens
acggcaggctcactgcc

SEQ ID NO: 1465776 - DNA, 22 bp, Homo sapiens
acggcaggctcactgccaggcc

SEQ ID NO: 1465777 - DNA, 22 bp, Homo sapiens
acggcatcacacttatatttta

SEQ ID NO: 1465778 - DNA, 15 bp, Homo sapiens
acggccaagaatgta

SEQ ID NO: 1465779 - DNA, 10 bp, Homo sapiens
acggccaccc

SEQ ID NO: 1465780 - DNA, 17 bp, Homo sapiens
acggccagggagaagct

SEQ ID NO: 1465781 - DNA, 18 bp, Homo sapiens
acggccctgcagccagct

SEQ ID NO: 1465782 - DNA, 15 bp, Homo sapiens
acggcctgatgctcc

SEQ ID NO: 1465783 - DNA, 18 bp, Homo sapiens
acggcctgatgctccctc

SEQ ID NO: 1465784 - DNA, 15 bp, Homo sapiens
acggcggccaggcac

SEQ ID NO: 1465785 - DNA, 18 bp, Homo sapiens
acggcgggatcctccaca

SEQ ID NO: 1465786 - DNA, 23 bp, Homo sapiens
acggcgtggtgtgtccctggaca

SEQ ID NO: 1465787 - DNA, 18 bp, Homo sapiens
acggctgcgcactgtgtc

SEQ ID NO: 1465788 - DNA, 18 bp, Homo sapiens
actactgacatgtggggc

SEQ ID NO: 1465789 - DNA, 18 bp, Homo sapiens
actactgagggaaatagc

SEQ ID NO: 1465790 - DNA, 19 bp, Homo sapiens
actactgagggaaatagcc

SEQ ID NO: 1465791 - DNA, 17 bp, Homo sapiens
actactgccttgtactt

SEQ ID NO: 1465792 - DNA, 20 bp, Homo sapiens
actactgctaccacaactat

SEQ ID NO: 1465793 - DNA, 14 bp, Homo sapiens
actactggtgatgc

SEQ ID NO: 1465794 - DNA, 18 bp, Homo sapiens
actactggtgatgcctaa

SEQ ID NO: 1465795 - DNA, 20 bp, Homo sapiens
actactgttcagcttttatt

SEQ ID NO: 1465796 - DNA, 23 bp, Homo sapiens
actacttcttttttcaaaagaaa

SEQ ID NO: 1465797 - DNA, 14 bp, Homo sapiens
actacttgaccatt

SEQ ID NO: 1465798 - DNA, 19 bp, Homo sapiens
actactttgttaggatttt

SEQ ID NO: 1465799 - DNA, 14 bp, Homo sapiens
actactttttatac

SEQ ID NO: 1465800 - DNA, 17 bp, Homo sapiens
actactttttatactcc

SEQ ID NO: 1465801 - DNA, 13 bp, Homo sapiens
actagaactctcc

SEQ ID NO: 1465802 - DNA, 15 bp, Homo sapiens
actagaactctccat

SEQ ID NO: 1465803 - DNA, 13 bp, Homo sapiens
actagaagaaaag

SEQ ID NO: 1465804 - DNA, 13 bp, Homo sapiens
actagaagatgaa

SEQ ID NO: 1465805 - DNA, 18 bp, Homo sapiens
actagaaggcttctctcc

SEQ ID NO: 1465806 - DNA, 20 bp, Homo sapiens
actagaattagtatgtctgt

SEQ ID NO: 1465807 - DNA, 19 bp, Homo sapiens
actagaattctagtgctgc

SEQ ID NO: 1465808 - DNA, 22 bp, Homo sapiens
actagaattctagtgctgctga

SEQ ID NO: 1465809 - DNA, 18 bp, Homo sapiens
actagacaccaaagttct

SEQ ID NO: 1465810 - DNA, 20 bp, Homo sapiens
actagacaccaaagttctaa

SEQ ID NO: 1465811 - DNA, 21 bp, Homo sapiens
actagaggaaaccagtttggt

SEQ ID NO: 1465812 - DNA, 15 bp, Homo sapiens
actagaggcagggag

SEQ ID NO: 1465813 - DNA, 16 bp, Homo sapiens
actagaggccagggca

SEQ ID NO: 1465814 - DNA, 18 bp, Homo sapiens
actagaggccagggcagc

SEQ ID NO: 1465815 - DNA, 15 bp, Homo sapiens
actagagtctgaaca

SEQ ID NO: 1465816 - DNA, 20 bp, Homo sapiens
actagagtctgaacagctgt

SEQ ID NO: 1465817 - DNA, 19 bp, Homo sapiens
actagataacatacttctt

SEQ ID NO: 1465818 - DNA, 19 bp, Homo sapiens
actagatactcgtgtgtgg

SEQ ID NO: 1465819 - DNA, 13 bp, Homo sapiens
actagatgtagta

SEQ ID NO: 1465820 - DNA, 17 bp, Homo sapiens
actagatgtagtatttt

SEQ ID NO: 1465821 - DNA, 17 bp, Homo sapiens
actagattccacaggga

SEQ ID NO: 1465822 - DNA, 14 bp, Homo sapiens
actagatttgtcct

SEQ ID NO: 1465823 - DNA, 15 bp, Homo sapiens
actagatttgtcctt

SEQ ID NO: 1465824 - DNA, 16 bp, Homo sapiens
actagatttgtccttt

SEQ ID NO: 1465825 - DNA, 12 bp, Homo sapiens
actagccaaggc

SEQ ID NO: 1465826 - DNA, 14 bp, Homo sapiens
actagccagacaaa

SEQ ID NO: 1465827 - DNA, 22 bp, Homo sapiens
actagccagacactctgctctg

SEQ ID NO: 1465828 - DNA, 13 bp, Homo sapiens
actagcctggcca

SEQ ID NO: 1465829 - DNA, 15 bp, Homo sapiens
actagcctgtgatta

SEQ ID NO: 1465830 - DNA, 15 bp, Homo sapiens
actaggaatcccaga

SEQ ID NO: 1465831 - DNA, 14 bp, Homo sapiens
actaggactcagaa

SEQ ID NO: 1465832 - DNA, 16 bp, Homo sapiens
actaggactctgaggc

SEQ ID NO: 1465833 - DNA, 17 bp, Homo sapiens
actaggcatacactgta

SEQ ID NO: 1465834 - DNA, 18 bp, Homo sapiens
actagggattcaggctgc

SEQ ID NO: 1465835 - DNA, 19 bp, Homo sapiens
actagggattcaggctgct

SEQ ID NO: 1465836 - DNA, 21 bp, Homo sapiens
actagggattcaggctgcttg

SEQ ID NO: 1465837 - DNA, 21 bp, Homo sapiens
actagggtgagggttttctgt

SEQ ID NO: 1465838 - DNA, 13 bp, Homo sapiens
actaggtgtcccc

SEQ ID NO: 1465839 - DNA, 16 bp, Homo sapiens
actaggtgtccccaac

SEQ ID NO: 1465840 - DNA, 15 bp, Homo sapiens
actaggtttttgctt

SEQ ID NO: 1465841 - DNA, 14 bp, Homo sapiens
actagtgacagctt

SEQ ID NO: 1465842 - DNA, 19 bp, Homo sapiens
actagtgaccccttccctg

SEQ ID NO: 1465843 - DNA, 18 bp, Homo sapiens
actagtgagtcagcacct

SEQ ID NO: 1465844 - DNA, 19 bp, Homo sapiens
actagtgagtcagcacctt

SEQ ID NO: 1465845 - DNA, 15 bp, Homo sapiens
actagttacacatct

SEQ ID NO: 1465846 - DNA, 22 bp, Homo sapiens
actagttacacatcttcaacag

SEQ ID NO: 1465847 - DNA, 17 bp, Homo sapiens
actagtttccagtggat

SEQ ID NO: 1465848 - DNA, 17 bp, Homo sapiens
actagtttgattattat

SEQ ID NO: 1465849 - DNA, 19 bp, Homo sapiens
actagtttgattattatgt

SEQ ID NO: 1465850 - DNA, 20 bp, Homo sapiens
actagtttgattattatgtt

SEQ ID NO: 1465851 - DNA, 18 bp, Homo sapiens
actataaagctgttattc

SEQ ID NO: 1465852 - DNA, 22 bp, Homo sapiens
actataagtagttggtttgtat

SEQ ID NO: 1465853 - DNA, 12 bp, Homo sapiens
actataatgtaa

SEQ ID NO: 1465854 - DNA, 16 bp, Homo sapiens
actatacctgcttcag

SEQ ID NO: 1465855 - DNA, 20 bp, Homo sapiens
actataggcatgcgccacca

SEQ ID NO: 1465856 - DNA, 20 bp, Homo sapiens
actatatatataaatgtata

SEQ ID NO: 1465857 - DNA, 16 bp, Homo sapiens
actatatatatttcta

SEQ ID NO: 1465858 - DNA, 14 bp, Homo sapiens
actatatctgtata

SEQ ID NO: 1465859 - DNA, 17 bp, Homo sapiens
actatatctgtatataa

SEQ ID NO: 1465860 - DNA, 18 bp, Homo sapiens
actatattgattgtcctt

SEQ ID NO: 1465861 - DNA, 22 bp, Homo sapiens
actatatttgggcctgctccag

SEQ ID NO: 1465862 - DNA, 14 bp, Homo sapiens
actatcaaactgaa

SEQ ID NO: 1465863 - DNA, 15 bp, Homo sapiens
actatcacacatgaa

SEQ ID NO: 1465864 - DNA, 18 bp, Homo sapiens
actatcacacatgaataa

SEQ ID NO: 1465865 - DNA, 17 bp, Homo sapiens
actatcctgattccaaa

SEQ ID NO: 1465866 - DNA, 19 bp, Homo sapiens
actatcctgattccaaata

SEQ ID NO: 1465867 - DNA, 15 bp, Homo sapiens
actatcctgtaaata

SEQ ID NO: 1465868 - DNA, 15 bp, Homo sapiens
actatcggttcaagt

SEQ ID NO: 1465869 - DNA, 19 bp, Homo sapiens
actatctgaagatttccat

SEQ ID NO: 1465870 - DNA, 21 bp, Homo sapiens
actatctgaagatttccattt

SEQ ID NO: 1465871 - DNA, 17 bp, Homo sapiens
actatctgtctggtggc

SEQ ID NO: 1465872 - DNA, 16 bp, Homo sapiens
actatcttggtgaatt

SEQ ID NO: 1465873 - DNA, 16 bp, Homo sapiens
actatctttctgataa

SEQ ID NO: 1465874 - DNA, 15 bp, Homo sapiens
actatctttttgaaa

SEQ ID NO: 1465875 - DNA, 11 bp, Homo sapiens
actatgaaata

SEQ ID NO: 1465876 - DNA, 15 bp, Homo sapiens
actatgacactgagc

SEQ ID NO: 1465877 - DNA, 22 bp, Homo sapiens
actatgacataaaaacaacttt

SEQ ID NO: 1465878 - DNA, 16 bp, Homo sapiens
actatgatctcaggag

SEQ ID NO: 1465879 - DNA, 17 bp, Homo sapiens
actatgatctcaggagc

SEQ ID NO: 1465880 - DNA, 17 bp, Homo sapiens
actatgcacaacagagt

SEQ ID NO: 1465881 - DNA, 16 bp, Homo sapiens
actatgcacaatttaa

SEQ ID NO: 1465882 - DNA, 21 bp, Homo sapiens
actatgcatggtgccccagga

SEQ ID NO: 1465883 - DNA, 16 bp, Homo sapiens
actatgggatgtatat

SEQ ID NO: 1465884 - DNA, 15 bp, Homo sapiens
actatggtatttgag

SEQ ID NO: 1465885 - DNA, 17 bp, Homo sapiens
actatggtgctgccttg

SEQ ID NO: 1465886 - DNA, 22 bp, Homo sapiens
actatggtgctgccttgcttct

SEQ ID NO: 1465887 - DNA, 17 bp, Homo sapiens
actatggttcccaataa

SEQ ID NO: 1465888 - DNA, 19 bp, Homo sapiens
actatggttcccaataaaa

SEQ ID NO: 1465889 - DNA, 22 bp, Homo sapiens
actatggttcccaataaaagtg

SEQ ID NO: 1465890 - DNA, 23 bp, Homo sapiens
actatggttcccaataaaagtga

SEQ ID NO: 1465891 - DNA, 14 bp, Homo sapiens
actatgtaatttat

SEQ ID NO: 1465892 - DNA, 15 bp, Homo sapiens
actatgtctgaacat

SEQ ID NO: 1465893 - DNA, 19 bp, Homo sapiens
actatgtctgaacatagaa

SEQ ID NO: 1465894 - DNA, 21 bp, Homo sapiens
actattaagaggcagaaaatt

SEQ ID NO: 1465895 - DNA, 20 bp, Homo sapiens
actattaagcagtaaaaact

SEQ ID NO: 1465896 - DNA, 13 bp, Homo sapiens
actattaatcttt

SEQ ID NO: 1465897 - DNA, 22 bp, Homo sapiens
actattagagtatttcccttcc

SEQ ID NO: 1465898 - DNA, 12 bp, Homo sapiens
actattattgtt

SEQ ID NO: 1465899 - DNA, 21 bp, Homo sapiens
actattcaaacagtctcagga

SEQ ID NO: 1465900 - DNA, 14 bp, Homo sapiens
actattcctaggag

SEQ ID NO: 1465901 - DNA, 17 bp, Homo sapiens
actattctgtatctttc

SEQ ID NO: 1465902 - DNA, 14 bp, Homo sapiens
actattgagaagat

SEQ ID NO: 1465903 - DNA, 16 bp, Homo sapiens
actattggaaagtact

SEQ ID NO: 1465904 - DNA, 13 bp, Homo sapiens
actattggcccta

SEQ ID NO: 1465905 - DNA, 15 bp, Homo sapiens
actattgtaatcatt

SEQ ID NO: 1465906 - DNA, 16 bp, Homo sapiens
actatttaagatgtga

SEQ ID NO: 1465907 - DNA, 21 bp, Homo sapiens
actatttaagatgtgaaaatt

SEQ ID NO: 1465908 - DNA, 21 bp, Homo sapiens
actatttatatcacacaatat

SEQ ID NO: 1465909 - DNA, 21 bp, Homo sapiens
actatttattaaaaacatgac

SEQ ID NO: 1465910 - DNA, 13 bp, Homo sapiens
actatttccttta

SEQ ID NO: 1465911 - DNA, 22 bp, Homo sapiens
actatttctacacagtgggaac

SEQ ID NO: 1465912 - DNA, 13 bp, Homo sapiens
actatttcttcag

SEQ ID NO: 1465913 - DNA, 15 bp, Homo sapiens
actattttaaatatc

SEQ ID NO: 1465914 - DNA, 15 bp, Homo sapiens
actattttattctaa

SEQ ID NO: 1465915 - DNA, 13 bp, Homo sapiens
actattttcaaag

SEQ ID NO: 1465916 - DNA, 15 bp, Homo sapiens
actattttcaaagaa

SEQ ID NO: 1465917 - DNA, 14 bp, Homo sapiens
actatttttcctca

SEQ ID NO: 1465918 - DNA, 12 bp, Homo sapiens
actatttttgta

SEQ ID NO: 1465919 - DNA, 13 bp, Homo sapiens
actcaaaacctgg

SEQ ID NO: 1465920 - DNA, 17 bp, Homo sapiens
actcaaaacctggagat

SEQ ID NO: 1465921 - DNA, 17 bp, Homo sapiens
actcaaaatctgtcata

SEQ ID NO: 1465922 - DNA, 16 bp, Homo sapiens
actcaaaccatatttt

SEQ ID NO: 1465923 - DNA, 15 bp, Homo sapiens
actcaaacggaggaa

SEQ ID NO: 1465924 - DNA, 20 bp, Homo sapiens
actcaaacggaggaagccca

SEQ ID NO: 1465925 - DNA, 22 bp, Homo sapiens
actcaaacggaggaagcccaca

SEQ ID NO: 1465926 - DNA, 19 bp, Homo sapiens
actcaaatacacatttgct

SEQ ID NO: 1465927 - DNA, 14 bp, Homo sapiens
actcaaatgagtaa

SEQ ID NO: 1465928 - DNA, 22 bp, Homo sapiens
actcaaatggggccagatccag

SEQ ID NO: 1465929 - DNA, 23 bp, Homo sapiens
actcaaatggggccagatccagc

SEQ ID NO: 1465930 - DNA, 19 bp, Homo sapiens
actcaaattaatctttctt

SEQ ID NO: 1465931 - DNA, 14 bp, Homo sapiens
actcaaattttggc

SEQ ID NO: 1465932 - DNA, 23 bp, Homo sapiens
actcaacagagaggaccaacatc

SEQ ID NO: 1465933 - DNA, 17 bp, Homo sapiens
actcaacatgttactga

SEQ ID NO: 1465934 - DNA, 19 bp, Homo sapiens
actcaacccattgttgtca

SEQ ID NO: 1465935 - DNA, 14 bp, Homo sapiens
actcaactaatttt

SEQ ID NO: 1465936 - DNA, 16 bp, Homo sapiens
actcaagaccaggctg

SEQ ID NO: 1465937 - DNA, 19 bp, Homo sapiens
actcaagaggaatctgttt

SEQ ID NO: 1465938 - DNA, 20 bp, Homo sapiens
actcaagagttcagtgctca

SEQ ID NO: 1465939 - DNA, 13 bp, Homo sapiens
actcaagctgcgt

SEQ ID NO: 1465940 - DNA, 17 bp, Homo sapiens
actcaaggactttgcag

SEQ ID NO: 1465941 - DNA, 21 bp, Homo sapiens
actcaaggataccttcttatt

SEQ ID NO: 1465942 - DNA, 19 bp, Homo sapiens
actcaagggaaaggcaagc

SEQ ID NO: 1465943 - DNA, 20 bp, Homo sapiens
actcaagggaaaggcaagct

SEQ ID NO: 1465944 - DNA, 14 bp, Homo sapiens
actcaatgagctct

SEQ ID NO: 1465945 - DNA, 22 bp, Homo sapiens
actcaatgtttctggacattct

SEQ ID NO: 1465946 - DNA, 23 bp, Homo sapiens
actcaatgtttctggacattctc

SEQ ID NO: 1465947 - DNA, 16 bp, Homo sapiens
actcacaatttaaaat

SEQ ID NO: 1465948 - DNA, 13 bp, Homo sapiens
actcacactggcc

SEQ ID NO: 1465949 - DNA, 19 bp, Homo sapiens
actcacagacctggagccc

SEQ ID NO: 1465950 - DNA, 23 bp, Homo sapiens
actcacagacctggagcccctgg

SEQ ID NO: 1465951 - DNA, 13 bp, Homo sapiens
actcacatagcca

SEQ ID NO: 1465952 - DNA, 21 bp, Homo sapiens
actcacatagccaactctccc

SEQ ID NO: 1465953 - DNA, 17 bp, Homo sapiens
actcacattagagaaca

SEQ ID NO: 1465954 - DNA, 15 bp, Homo sapiens
actcaccaaaatata

SEQ ID NO: 1465955 - DNA, 16 bp, Homo sapiens
actcaccaacttgcca

SEQ ID NO: 1465956 - DNA, 18 bp, Homo sapiens
actcaccaacttgccaca

SEQ ID NO: 1465957 - DNA, 13 bp, Homo sapiens
actcaccactgcc

SEQ ID NO: 1465958 - DNA, 21 bp, Homo sapiens
actcaccagccccactgccag

SEQ ID NO: 1465959 - DNA, 15 bp, Homo sapiens
actcaccagggtccg

SEQ ID NO: 1465960 - DNA, 23 bp, Homo sapiens
actcaccagggtccgcaccagct

SEQ ID NO: 1465961 - DNA, 15 bp, Homo sapiens
actcaccatgtaaaa

SEQ ID NO: 1465962 - DNA, 12 bp, Homo sapiens
actcacccaagc

SEQ ID NO: 1465963 - DNA, 15 bp, Homo sapiens
actcacccctagccc

SEQ ID NO: 1465964 - DNA, 19 bp, Homo sapiens
actcacccctagccctggt

SEQ ID NO: 1465965 - DNA, 13 bp, Homo sapiens
actcacctctgcc

SEQ ID NO: 1465966 - DNA, 17 bp, Homo sapiens
actcactaggcccccac

SEQ ID NO: 1465967 - DNA, 21 bp, Homo sapiens
actcactaggcccccacttgc

SEQ ID NO: 1465968 - DNA, 13 bp, Homo sapiens
actcactcattcc

SEQ ID NO: 1465969 - DNA, 14 bp, Homo sapiens
actcactccagccc

SEQ ID NO: 1465970 - DNA, 15 bp, Homo sapiens
actcactccagccca

SEQ ID NO: 1465971 - DNA, 16 bp, Homo sapiens
actcactccagcccaa

SEQ ID NO: 1465972 - DNA, 15 bp, Homo sapiens
actcactctgggctg

SEQ ID NO: 1465973 - DNA, 20 bp, Homo sapiens
actcactgcctaggaggctg

SEQ ID NO: 1465974 - DNA, 22 bp, Homo sapiens
actcactggggcctacagcttt

SEQ ID NO: 1465975 - DNA, 18 bp, Homo sapiens
actcagaaactccatgat

SEQ ID NO: 1465976 - DNA, 19 bp, Homo sapiens
actcagaactctccaggga

SEQ ID NO: 1465977 - DNA, 14 bp, Homo sapiens
actcagaagcctga

SEQ ID NO: 1465978 - DNA, 18 bp, Homo sapiens
actcagaagcctgaggct

SEQ ID NO: 1465979 - DNA, 23 bp, Homo sapiens
actcagaatataacatgtaaaat

SEQ ID NO: 1465980 - DNA, 17 bp, Homo sapiens
actcagaattattttta

SEQ ID NO: 1465981 - DNA, 15 bp, Homo sapiens
actcagagcagagca

SEQ ID NO: 1465982 - DNA, 20 bp, Homo sapiens
actcagagctctctctacag

SEQ ID NO: 1465983 - DNA, 21 bp, Homo sapiens
actcagagctctctctacaga

SEQ ID NO: 1465984 - DNA, 14 bp, Homo sapiens
actcagatccaggg

SEQ ID NO: 1465985 - DNA, 16 bp, Homo sapiens
actcagatccagggac

SEQ ID NO: 1465986 - DNA, 19 bp, Homo sapiens
actcagatctgatcaagag

SEQ ID NO: 1465987 - DNA, 18 bp, Homo sapiens
actcagatttaagcctta

SEQ ID NO: 1465988 - DNA, 21 bp, Homo sapiens
actcagatttaagccttacaa

SEQ ID NO: 1465989 - DNA, 19 bp, Homo sapiens
actcagcagccctcctcac

SEQ ID NO: 1465990 - DNA, 22 bp, Homo sapiens
actcagcagccctcctcacccc

SEQ ID NO: 1465991 - DNA, 23 bp, Homo sapiens
actcagcagccctcctcaccccg

SEQ ID NO: 1465992 - DNA, 13 bp, Homo sapiens
actcagcagttga

SEQ ID NO: 1465993 - DNA, 16 bp, Homo sapiens
actcagcagttgacat

SEQ ID NO: 1465994 - DNA, 11 bp, Homo sapiens
actcagcccag

SEQ ID NO: 1465995 - DNA, 14 bp, Homo sapiens
actcagcccagctg

SEQ ID NO: 1465996 - DNA, 14 bp, Homo sapiens
actcagccctgagg

SEQ ID NO: 1465997 - DNA, 14 bp, Homo sapiens
actcagccctgggc

SEQ ID NO: 1465998 - DNA, 15 bp, Homo sapiens
actcagccctgggcc

SEQ ID NO: 1465999 - DNA, 22 bp, Homo sapiens
actcagccctgggccccaccac

SEQ ID NO: 1466000 - DNA, 20 bp, Homo sapiens
actcagcctcattcagcatg

SEQ ID NO: 1466001 - DNA, 23 bp, Homo sapiens
actcagccttcagacagagagga

SEQ ID NO: 1466002 - DNA, 19 bp, Homo sapiens
actcagctgtcctgcagca

SEQ ID NO: 1466003 - DNA, 20 bp, Homo sapiens
actcagctttctttaaagtt

SEQ ID NO: 1466004 - DNA, 12 bp, Homo sapiens
actcaggaggct

SEQ ID NO: 1466005 - DNA, 13 bp, Homo sapiens
actcaggaggctg

SEQ ID NO: 1466006 - DNA, 14 bp, Homo sapiens
actcaggaggctga

SEQ ID NO: 1466007 - DNA, 18 bp, Homo sapiens
actcaggaggctgagaca

SEQ ID NO: 1466008 - DNA, 20 bp, Homo sapiens
actcaggaggctgagacagg

SEQ ID NO: 1466009 - DNA, 17 bp, Homo sapiens
actcaggagtctgccac

SEQ ID NO: 1466010 - DNA, 18 bp, Homo sapiens
actcaggagtctgccact

SEQ ID NO: 1466011 - DNA, 16 bp, Homo sapiens
actcaggatgcccagg

SEQ ID NO: 1466012 - DNA, 17 bp, Homo sapiens
actcaggatgcccaggg

SEQ ID NO: 1466013 - DNA, 14 bp, Homo sapiens
actcaggcctctgc

SEQ ID NO: 1466014 - DNA, 15 bp, Homo sapiens
actcaggcctctgca

SEQ ID NO: 1466015 - DNA, 16 bp, Homo sapiens
actcaggcctctgcag

SEQ ID NO: 1466016 - DNA, 19 bp, Homo sapiens
actcaggcctctgcagaag

SEQ ID NO: 1466017 - DNA, 15 bp, Homo sapiens
actcaggctttcact

SEQ ID NO: 1466018 - DNA, 13 bp, Homo sapiens
actctcggggccc

SEQ ID NO: 1466019 - DNA, 14 bp, Homo sapiens
actctcggggccct

SEQ ID NO: 1466020 - DNA, 23 bp, Homo sapiens
actctcggggcccttggggcctg

SEQ ID NO: 1466021 - DNA, 20 bp, Homo sapiens
actctctccaccctatatgt

SEQ ID NO: 1466022 - DNA, 21 bp, Homo sapiens
actctctccaccctatatgta

SEQ ID NO: 1466023 - DNA, 12 bp, Homo sapiens
actctctcccag

SEQ ID NO: 1466024 - DNA, 14 bp, Homo sapiens
actctctcccagga

SEQ ID NO: 1466025 - DNA, 16 bp, Homo sapiens
actctctccctggtct

SEQ ID NO: 1466026 - DNA, 21 bp, Homo sapiens
actctctccctggtctctgcc

SEQ ID NO: 1466027 - DNA, 14 bp, Homo sapiens
actctctgctctag

SEQ ID NO: 1466028 - DNA, 19 bp, Homo sapiens
actctctgctctagccagg

SEQ ID NO: 1466029 - DNA, 13 bp, Homo sapiens
actctctgctggc

SEQ ID NO: 1466030 - DNA, 22 bp, Homo sapiens
actctctggaagcccctgggcc

SEQ ID NO: 1466031 - DNA, 21 bp, Homo sapiens
actctctgggactctcctcct

SEQ ID NO: 1466032 - DNA, 23 bp, Homo sapiens
actctctgttttagtgtttatgt

SEQ ID NO: 1466033 - DNA, 21 bp, Homo sapiens
actctctttccttgagctgtt

SEQ ID NO: 1466034 - DNA, 22 bp, Homo sapiens
actctgaaaagcaattgccctg

SEQ ID NO: 1466035 - DNA, 23 bp, Homo sapiens
actctgaaaagcaattgccctgt

SEQ ID NO: 1466036 - DNA, 15 bp, Homo sapiens
actctgaagctaatt

SEQ ID NO: 1466037 - DNA, 20 bp, Homo sapiens
actctgaagggcatcatgca

SEQ ID NO: 1466038 - DNA, 13 bp, Homo sapiens
actctgactcatc

SEQ ID NO: 1466039 - DNA, 13 bp, Homo sapiens
actctgagcccag

SEQ ID NO: 1466040 - DNA, 14 bp, Homo sapiens
actctgagcccagg

SEQ ID NO: 1466041 - DNA, 23 bp, Homo sapiens
actctgaggctctttctgggcca

SEQ ID NO: 1466042 - DNA, 11 bp, Homo sapiens
actctgcacat

SEQ ID NO: 1466043 - DNA, 17 bp, Homo sapiens
actctgcacatgtcttg

SEQ ID NO: 1466044 - DNA, 19 bp, Homo sapiens
actctgcacatgtcttgta

SEQ ID NO: 1466045 - DNA, 15 bp, Homo sapiens
actctgcactactcc

SEQ ID NO: 1466046 - DNA, 11 bp, Homo sapiens
actctgcactc

SEQ ID NO: 1466047 - DNA, 13 bp, Homo sapiens
actctgcactcca

SEQ ID NO: 1466048 - DNA, 14 bp, Homo sapiens
actctgcactccat

SEQ ID NO: 1466049 - DNA, 19 bp, Homo sapiens
actctgcactccatggcca

SEQ ID NO: 1466050 - DNA, 20 bp, Homo sapiens
actctgcactccatggccac

SEQ ID NO: 1466051 - DNA, 21 bp, Homo sapiens
actctgcactccatggccacc

SEQ ID NO: 1466052 - DNA, 16 bp, Homo sapiens
actctgcattctagta

SEQ ID NO: 1466053 - DNA, 14 bp, Homo sapiens
actctgccccaatc

SEQ ID NO: 1466054 - DNA, 21 bp, Homo sapiens
actctgcccccatttccccga

SEQ ID NO: 1466055 - DNA, 18 bp, Homo sapiens
actctgccctactcactc

SEQ ID NO: 1466056 - DNA, 14 bp, Homo sapiens
actctgccctctgc

SEQ ID NO: 1466057 - DNA, 22 bp, Homo sapiens
actctgctagactcctcaggag

SEQ ID NO: 1466058 - DNA, 14 bp, Homo sapiens
actctgcttctctg

SEQ ID NO: 1466059 - DNA, 15 bp, Homo sapiens
actctgcttctctga

SEQ ID NO: 1466060 - DNA, 17 bp, Homo sapiens
actctgcttctctgact

SEQ ID NO: 1466061 - DNA, 18 bp, Homo sapiens
actctgcttctctgactt

SEQ ID NO: 1466062 - DNA, 22 bp, Homo sapiens
actctgcttctctgacttctgc

SEQ ID NO: 1466063 - DNA, 13 bp, Homo sapiens
actctggccctgg

SEQ ID NO: 1466064 - DNA, 15 bp, Homo sapiens
actctggccctggcc

SEQ ID NO: 1466065 - DNA, 13 bp, Homo sapiens
actctgggaaata

SEQ ID NO: 1466066 - DNA, 14 bp, Homo sapiens
actctgggcaggga

SEQ ID NO: 1466067 - DNA, 23 bp, Homo sapiens
actctgggtggaagtgcccagcc

SEQ ID NO: 1466068 - DNA, 20 bp, Homo sapiens
actctggtgagtcaccactt

SEQ ID NO: 1466069 - DNA, 17 bp, Homo sapiens
actctggtgcctccaga

SEQ ID NO: 1466070 - DNA, 19 bp, Homo sapiens
actctggtggcacaggagt

SEQ ID NO: 1466071 - DNA, 18 bp, Homo sapiens
actctgtaatagttcagt

SEQ ID NO: 1466072 - DNA, 12 bp, Homo sapiens
actctgtaattg

SEQ ID NO: 1466073 - DNA, 14 bp, Homo sapiens
actctgtataagtt

SEQ ID NO: 1466074 - DNA, 16 bp, Homo sapiens
actctgtcagatggga

SEQ ID NO: 1466075 - DNA, 16 bp, Homo sapiens
actctgtccaggccac

SEQ ID NO: 1466076 - DNA, 16 bp, Homo sapiens
actctgtcttaaatga

SEQ ID NO: 1466077 - DNA, 21 bp, Homo sapiens
actctgtgcaggtgctgcctt

SEQ ID NO: 1466078 - DNA, 16 bp, Homo sapiens
actctgtggggccttg

SEQ ID NO: 1466079 - DNA, 15 bp, Homo sapiens
actctgttcccccac

SEQ ID NO: 1466080 - DNA, 22 bp, Homo sapiens
actctgttcccccaccctccat

SEQ ID NO: 1466081 - DNA, 23 bp, Homo sapiens
actctgttcccccaccctccatg

SEQ ID NO: 1466082 - DNA, 20 bp, Homo sapiens
actctgttccttcacatcct

SEQ ID NO: 1466083 - DNA, 22 bp, Homo sapiens
actctgttccttcacatcctgt

SEQ ID NO: 1466084 - DNA, 20 bp, Homo sapiens
actctgttgcaagtgcaata

SEQ ID NO: 1466085 - DNA, 14 bp, Homo sapiens
actcttaatcaaat

SEQ ID NO: 1466086 - DNA, 18 bp, Homo sapiens
actcttacagagccttga

SEQ ID NO: 1466087 - DNA, 17 bp, Homo sapiens
actcttaggaagagaaa

SEQ ID NO: 1466088 - DNA, 20 bp, Homo sapiens
actcttaggaagagaaacca

SEQ ID NO: 1466089 - DNA, 15 bp, Homo sapiens
actcttagttttttt

SEQ ID NO: 1466090 - DNA, 11 bp, Homo sapiens
actcttcagaa

SEQ ID NO: 1466091 - DNA, 22 bp, Homo sapiens
actcttcagtgactcctgctgg

SEQ ID NO: 1466092 - DNA, 21 bp, Homo sapiens
actcttcagttaattcttaga

SEQ ID NO: 1466093 - DNA, 17 bp, Homo sapiens
actcttccagaatccca

SEQ ID NO: 1466094 - DNA, 23 bp, Homo sapiens
actcttccctgaacttcctgctt

SEQ ID NO: 1466095 - DNA, 20 bp, Homo sapiens
actcttcgaagccttgccta

SEQ ID NO: 1466096 - DNA, 14 bp, Homo sapiens
actcttgaaatgta

SEQ ID NO: 1466097 - DNA, 15 bp, Homo sapiens
actcttgaaatgtag

SEQ ID NO: 1466098 - DNA, 19 bp, Homo sapiens
actcttgaagtccaggact

SEQ ID NO: 1466099 - DNA, 15 bp, Homo sapiens
actcttgactcttgc

SEQ ID NO: 1466100 - DNA, 18 bp, Homo sapiens
actcttgagagctcaggc

SEQ ID NO: 1466101 - DNA, 18 bp, Homo sapiens
actcttggctattgaaga

SEQ ID NO: 1466102 - DNA, 21 bp, Homo sapiens
actcttgtgaattattctgat

SEQ ID NO: 1466103 - DNA, 20 bp, Homo sapiens
actcttgtttgctttgaaaa

SEQ ID NO: 1466104 - DNA, 18 bp, Homo sapiens
actctttatgatctggcc

SEQ ID NO: 1466105 - DNA, 22 bp, Homo sapiens
actctttatttctagcagagtg

SEQ ID NO: 1466106 - DNA, 13 bp, Homo sapiens
actctttcaaaaa

SEQ ID NO: 1466107 - DNA, 23 bp, Homo sapiens
actctttcggtaggtggaagcta

SEQ ID NO: 1466108 - DNA, 23 bp, Homo sapiens
actctttctattgttaaacaaat

SEQ ID NO: 1466109 - DNA, 13 bp, Homo sapiens
actctttgaatcg

SEQ ID NO: 1466110 - DNA, 21 bp, Homo sapiens
actctttgggtccattcagat

SEQ ID NO: 1466111 - DNA, 24 bp, Homo sapiens
actctttgggtccattcagatgaa

SEQ ID NO: 1466112 - DNA, 13 bp, Homo sapiens
actctttgtaaga

SEQ ID NO: 1466113 - DNA, 15 bp, Homo sapiens
actcttttctatttt

SEQ ID NO: 1466114 - DNA, 16 bp, Homo sapiens
actcttttctattttg

SEQ ID NO: 1466115 - DNA, 21 bp, Homo sapiens
actcttttggacaaaggaatc

SEQ ID NO: 1466116 - DNA, 21 bp, Homo sapiens
actcttttttaaaaattactt

SEQ ID NO: 1466117 - DNA, 15 bp, Homo sapiens
actctttttttgagt

SEQ ID NO: 1466118 - DNA, 23 bp, Homo sapiens
actctttttttgagtgacagctt

SEQ ID NO: 1466119 - DNA, 21 bp, Homo sapiens
actgaaaaaaaaaaagaagaa

SEQ ID NO: 1466120 - DNA, 22 bp, Homo sapiens
actgaaaaaaaaaaagaagaag

SEQ ID NO: 1466121 - DNA, 24 bp, Homo sapiens
actgaaaaaaaaaaagaagaagaa

SEQ ID NO: 1466122 - DNA, 15 bp, Homo sapiens
actgaaaaaatatat

SEQ ID NO: 1466123 - DNA, 22 bp, Homo sapiens
actgaaaacatttcaaagctga

SEQ ID NO: 1466124 - DNA, 16 bp, Homo sapiens
actgaaaagaaggaaa

SEQ ID NO: 1466125 - DNA, 19 bp, Homo sapiens
actgaaaagaaggaaagat

SEQ ID NO: 1466126 - DNA, 20 bp, Homo sapiens
actgaaaaggttcttcatcc

SEQ ID NO: 1466127 - DNA, 13 bp, Homo sapiens
actgaaacagatt

SEQ ID NO: 1466128 - DNA, 13 bp, Homo sapiens
actgaaacttccc

SEQ ID NO: 1466129 - DNA, 20 bp, Homo sapiens
actgaaagaagaaaacagta

SEQ ID NO: 1466130 - DNA, 23 bp, Homo sapiens
actgaaagttttgtaaaagaaat

SEQ ID NO: 1466131 - DNA, 17 bp, Homo sapiens
actgaaatgaccaagac

SEQ ID NO: 1466132 - DNA, 13 bp, Homo sapiens
actgaaattgttt

SEQ ID NO: 1466133 - DNA, 12 bp, Homo sapiens
actgaacaaaac

SEQ ID NO: 1466134 - DNA, 20 bp, Homo sapiens
actgaacacatgtgtatgat

SEQ ID NO: 1466135 - DNA, 20 bp, Homo sapiens
actgaacaccattgaaggct

SEQ ID NO: 1466136 - DNA, 16 bp, Homo sapiens
actgaacatgtttaca

SEQ ID NO: 1466137 - DNA, 19 bp, Homo sapiens
actgaacattagttgcact

SEQ ID NO: 1466138 - DNA, 13 bp, Homo sapiens
actgaaccactgc

SEQ ID NO: 1466139 - DNA, 14 bp, Homo sapiens
actgaaccactgct

SEQ ID NO: 1466140 - DNA, 20 bp, Homo sapiens
actgaaccactgcttctctt

SEQ ID NO: 1466141 - DNA, 18 bp, Homo sapiens
actgaaccggctttacca

SEQ ID NO: 1466142 - DNA, 21 bp, Homo sapiens
actgaactattttaaataaaa

SEQ ID NO: 1466143 - DNA, 22 bp, Homo sapiens
actgaactattttaaataaaat

SEQ ID NO: 1466144 - DNA, 22 bp, Homo sapiens
actgaagaagtcactgaacaaa

SEQ ID NO: 1466145 - DNA, 14 bp, Homo sapiens
actgaagcacagca

SEQ ID NO: 1466146 - DNA, 14 bp, Homo sapiens
actgaagcagcctc

SEQ ID NO: 1466147 - DNA, 16 bp, Homo sapiens
actgaagcctgcagga

SEQ ID NO: 1466148 - DNA, 22 bp, Homo sapiens
actgaaggaaaaacacaagcaa

SEQ ID NO: 1466149 - DNA, 19 bp, Homo sapiens
actgaaggaaaagcaagaa

SEQ ID NO: 1466150 - DNA, 20 bp, Homo sapiens
actgaaggaaaagcaagaaa

SEQ ID NO: 1466151 - DNA, 11 bp, Homo sapiens
actgaaggaga

SEQ ID NO: 1466152 - DNA, 21 bp, Homo sapiens
actgaaggagaaggtgcccca

SEQ ID NO: 1466153 - DNA, 16 bp, Homo sapiens
actgaaggcatatgca

SEQ ID NO: 1466154 - DNA, 17 bp, Homo sapiens
actgaaggtaaaattga

SEQ ID NO: 1466155 - DNA, 19 bp, Homo sapiens
actgaagtagtgtgcagtt

SEQ ID NO: 1466156 - DNA, 13 bp, Homo sapiens
actgaagtgctta

SEQ ID NO: 1466157 - DNA, 21 bp, Homo sapiens
actgaagtggctggtagaaaa

SEQ ID NO: 1466158 - DNA, 21 bp, Homo sapiens
actgaagttaacagagacaga

SEQ ID NO: 1466159 - DNA, 18 bp, Homo sapiens
actgaatatttatatttc

SEQ ID NO: 1466160 - DNA, 22 bp, Homo sapiens
actgaatatttatatttcacta

SEQ ID NO: 1466161 - DNA, 19 bp, Homo sapiens
actgaatctcccctcctca

SEQ ID NO: 1466162 - DNA, 19 bp, Homo sapiens
actgaatgaatccattgga

SEQ ID NO: 1466163 - DNA, 19 bp, Homo sapiens
actgaattggcttccagat

SEQ ID NO: 1466164 - DNA, 14 bp, Homo sapiens
actgaattgtatca

SEQ ID NO: 1466165 - DNA, 21 bp, Homo sapiens
actgaattgtatcaatttgtt

SEQ ID NO: 1466166 - DNA, 17 bp, Homo sapiens
actgaattgtccccagt

SEQ ID NO: 1466167 - DNA, 14 bp, Homo sapiens
actgaatttaacta

SEQ ID NO: 1466168 - DNA, 18 bp, Homo sapiens
actgaatttgttcttaaa

SEQ ID NO: 1466169 - DNA, 20 bp, Homo sapiens
actgaattttgggacttcta

SEQ ID NO: 1466170 - DNA, 18 bp, Homo sapiens
actgaatttttttgtaat

SEQ ID NO: 1466171 - DNA, 18 bp, Homo sapiens
actgacaaacgtccccag

SEQ ID NO: 1466172 - DNA, 18 bp, Homo sapiens
actgacaagccatcttga

SEQ ID NO: 1466173 - DNA, 21 bp, Homo sapiens
actgacacaggaaaccaacac

SEQ ID NO: 1466174 - DNA, 21 bp, Homo sapiens
actgacaccctggtcctgact

SEQ ID NO: 1466175 - DNA, 22 bp, Homo sapiens
actgacaccctggtcctgactt

SEQ ID NO: 1466176 - DNA, 20 bp, Homo sapiens
actgacagggagcagccccc

SEQ ID NO: 1466177 - DNA, 23 bp, Homo sapiens
actgaccaaagactgcagaaccc

SEQ ID NO: 1466178 - DNA, 14 bp, Homo sapiens
actgaccagaacta

SEQ ID NO: 1466179 - DNA, 12 bp, Homo sapiens
actgacccaact

SEQ ID NO: 1466180 - DNA, 13 bp, Homo sapiens
actgacccaggac

SEQ ID NO: 1466181 - DNA, 14 bp, Homo sapiens
actgaccccctccc

SEQ ID NO: 1466182 - DNA, 17 bp, Homo sapiens
actgaccccctcccctg

SEQ ID NO: 1466183 - DNA, 18 bp, Homo sapiens
actgaccccctcccctga

SEQ ID NO: 1466184 - DNA, 12 bp, Homo sapiens
actgacccttcc

SEQ ID NO: 1466185 - DNA, 14 bp, Homo sapiens
actgacctacctca

SEQ ID NO: 1466186 - DNA, 22 bp, Homo sapiens
actgacctgaccccattcctga

SEQ ID NO: 1466187 - DNA, 22 bp, Homo sapiens
actgacctgtcatgcccccctc

SEQ ID NO: 1466188 - DNA, 20 bp, Homo sapiens
actgaccttggagagacaca

SEQ ID NO: 1466189 - DNA, 15 bp, Homo sapiens
actgacgtttctggg

SEQ ID NO: 1466190 - DNA, 20 bp, Homo sapiens
actgactattcttgatgtaa

SEQ ID NO: 1466191 - DNA, 17 bp, Homo sapiens
actgactgcagccccct

SEQ ID NO: 1466192 - DNA, 21 bp, Homo sapiens
actgacttaatgctcttcaaa

SEQ ID NO: 1466193 - DNA, 21 bp, Homo sapiens
actgacttcagtgggactcgg

SEQ ID NO: 1466194 - DNA, 15 bp, Homo sapiens
actgacttgctgtgt

SEQ ID NO: 1466195 - DNA, 16 bp, Homo sapiens
actgactttttccccc

SEQ ID NO: 1466196 - DNA, 20 bp, Homo sapiens
actgagaatgtaagaactac

SEQ ID NO: 1466197 - DNA, 14 bp, Homo sapiens
actgagagaaagat

SEQ ID NO: 1466198 - DNA, 19 bp, Homo sapiens
actgagatcactgactctg

SEQ ID NO: 1466199 - DNA, 21 bp, Homo sapiens
actgagcaagaccctgtctct

SEQ ID NO: 1466200 - DNA, 22 bp, Homo sapiens
actgagcaagatcttgtctcca

SEQ ID NO: 1466201 - DNA, 21 bp, Homo sapiens
actgagcaccctctggattct

SEQ ID NO: 1466202 - DNA, 20 bp, Homo sapiens
actgagcatcactagtgaca

SEQ ID NO: 1466203 - DNA, 22 bp, Homo sapiens
actgagcccccccaacactgtg

SEQ ID NO: 1466204 - DNA, 12 bp, Homo sapiens
actgagcctggc

SEQ ID NO: 1466205 - DNA, 19 bp, Homo sapiens
actgagcctgttcattctg

SEQ ID NO: 1466206 - DNA, 15 bp, Homo sapiens
actgagctctccagg

SEQ ID NO: 1466207 - DNA, 20 bp, Homo sapiens
actgagctctccaggccagg

SEQ ID NO: 1466208 - DNA, 13 bp, Homo sapiens
actgaggacaggc

SEQ ID NO: 1466209 - DNA, 22 bp, Homo sapiens
actgaggagaagctgatccagt

SEQ ID NO: 1466210 - DNA, 20 bp, Homo sapiens
actgaggagacagaaagcct

SEQ ID NO: 1466211 - DNA, 21 bp, Homo sapiens
actgaggagacagaaagcctc

SEQ ID NO: 1466212 - DNA, 22 bp, Homo sapiens
actgaggagatgaccagggatg

SEQ ID NO: 1466213 - DNA, 23 bp, Homo sapiens
actgaggagatgaccagggatgc

SEQ ID NO: 1466214 - DNA, 12 bp, Homo sapiens
actgaggcctgc

SEQ ID NO: 1466215 - DNA, 14 bp, Homo sapiens
actgaggcctgctt

SEQ ID NO: 1466216 - DNA, 22 bp, Homo sapiens
actgaggccttgtgtgtcaggc

SEQ ID NO: 1466217 - DNA, 16 bp, Homo sapiens
actgagggcagtgccc

SEQ ID NO: 1466218 - DNA, 12 bp, Homo sapiens
actgagggccag

SEQ ID NO: 1466219 - DNA, 14 bp, Homo sapiens
actgaggtataaag

SEQ ID NO: 1466220 - DNA, 14 bp, Homo sapiens
actgagtataatca

SEQ ID NO: 1466221 - DNA, 17 bp, Homo sapiens
actgagtcccctccagg

SEQ ID NO: 1466222 - DNA, 20 bp, Homo sapiens
actgagtcccctccaggaag

SEQ ID NO: 1466223 - DNA, 14 bp, Homo sapiens
actgagtgggaagc

SEQ ID NO: 1466224 - DNA, 15 bp, Homo sapiens
actgagtgggaagcc

SEQ ID NO: 1466225 - DNA, 15 bp, Homo sapiens
actgagttacattgt

SEQ ID NO: 1466226 - DNA, 16 bp, Homo sapiens
actgataaacctaata

SEQ ID NO: 1466227 - DNA, 15 bp, Homo sapiens
actgataaagaaaga

SEQ ID NO: 1466228 - DNA, 21 bp, Homo sapiens
actgataacaaccttttacat

SEQ ID NO: 1466229 - DNA, 21 bp, Homo sapiens
actgataacttggggaggcaa

SEQ ID NO: 1466230 - DNA, 18 bp, Homo sapiens
actgatagcttacactga

SEQ ID NO: 1466231 - DNA, 17 bp, Homo sapiens
actgatatattttacaa

SEQ ID NO: 1466232 - DNA, 15 bp, Homo sapiens
actgatcaaaaataa

SEQ ID NO: 1466233 - DNA, 17 bp, Homo sapiens
actgatcaaaaataaac

SEQ ID NO: 1466234 - DNA, 18 bp, Homo sapiens
actgatcaaaaataaact

SEQ ID NO: 1466235 - DNA, 19 bp, Homo sapiens
actgatcaaaaataaacta

SEQ ID NO: 1466236 - DNA, 20 bp, Homo sapiens
actgatcctgctccagcagc

SEQ ID NO: 1466237 - DNA, 19 bp, Homo sapiens
actgatgagtttcactgta

SEQ ID NO: 1466238 - DNA, 22 bp, Homo sapiens
actgatgagtttcactgtactg

SEQ ID NO: 1466239 - DNA, 14 bp, Homo sapiens
actgatgctgcccc

SEQ ID NO: 1466240 - DNA, 16 bp, Homo sapiens
actgatggaaaatacc

SEQ ID NO: 1466241 - DNA, 20 bp, Homo sapiens
actgatggaccgggtgggcc

SEQ ID NO: 1466242 - DNA, 17 bp, Homo sapiens
actgatggaggctgcag

SEQ ID NO: 1466243 - DNA, 19 bp, Homo sapiens
actgatggaggctgcagcg

SEQ ID NO: 1466244 - DNA, 22 bp, Homo sapiens
actgatggctaatgtactgcat

SEQ ID NO: 1466245 - DNA, 22 bp, Homo sapiens
actgatggctcaagacaaggct

SEQ ID NO: 1466246 - DNA, 22 bp, Homo sapiens
actggctgtctgcctgtatttt

SEQ ID NO: 1466247 - DNA, 15 bp, Homo sapiens
actggcttcagcaag

SEQ ID NO: 1466248 - DNA, 16 bp, Homo sapiens
actggcttccccactc

SEQ ID NO: 1466249 - DNA, 19 bp, Homo sapiens
actggcttctgcttgtcat

SEQ ID NO: 1466250 - DNA, 16 bp, Homo sapiens
actggcttgtacattt

SEQ ID NO: 1466251 - DNA, 18 bp, Homo sapiens
actggcttgtacattttt

SEQ ID NO: 1466252 - DNA, 18 bp, Homo sapiens
actgggagtgtgggctgc

SEQ ID NO: 1466253 - DNA, 22 bp, Homo sapiens
actgggagtgtgggctgccctt

SEQ ID NO: 1466254 - DNA, 23 bp, Homo sapiens
actgggattaagaaaccttgctc

SEQ ID NO: 1466255 - DNA, 22 bp, Homo sapiens
actgggcagcaaggctgctgcc

SEQ ID NO: 1466256 - DNA, 16 bp, Homo sapiens
actgggcatttcaatc

SEQ ID NO: 1466257 - DNA, 17 bp, Homo sapiens
actgggccagccctgca

SEQ ID NO: 1466258 - DNA, 19 bp, Homo sapiens
actgggccagccctgcagc

SEQ ID NO: 1466259 - DNA, 21 bp, Homo sapiens
actgggccagccctgcagccc

SEQ ID NO: 1466260 - DNA, 15 bp, Homo sapiens
actgggcccaggcag

SEQ ID NO: 1466261 - DNA, 17 bp, Homo sapiens
actgggccctgagtctg

SEQ ID NO: 1466262 - DNA, 12 bp, Homo sapiens
actgggcctgga

SEQ ID NO: 1466263 - DNA, 18 bp, Homo sapiens
actgggcctggagccctg

SEQ ID NO: 1466264 - DNA, 13 bp, Homo sapiens
actgggctgggcc

SEQ ID NO: 1466265 - DNA, 23 bp, Homo sapiens
actggggactttatttatttcta

SEQ ID NO: 1466266 - DNA, 13 bp, Homo sapiens
actggggagcccg

SEQ ID NO: 1466267 - DNA, 12 bp, Homo sapiens
actggggcactt

SEQ ID NO: 1466268 - DNA, 12 bp, Homo sapiens
actggggcctcc

SEQ ID NO: 1466269 - DNA, 16 bp, Homo sapiens
actggggcctccagaa

SEQ ID NO: 1466270 - DNA, 17 bp, Homo sapiens
actggggcctccagaac

SEQ ID NO: 1466271 - DNA, 18 bp, Homo sapiens
actggggtcctggggcct

SEQ ID NO: 1466272 - DNA, 21 bp, Homo sapiens
actggggttcaagcccaggct

SEQ ID NO: 1466273 - DNA, 22 bp, Homo sapiens
actgggtaatttataaagaaaa

SEQ ID NO: 1466274 - DNA, 18 bp, Homo sapiens
actgggtacaagagatgg

SEQ ID NO: 1466275 - DNA, 15 bp, Homo sapiens
actgggtctcactcc

SEQ ID NO: 1466276 - DNA, 16 bp, Homo sapiens
actgggtctcactcct

SEQ ID NO: 1466277 - DNA, 16 bp, Homo sapiens
actgggtctgacctgg

SEQ ID NO: 1466278 - DNA, 19 bp, Homo sapiens
actgggtctgacctggtgg

SEQ ID NO: 1466279 - DNA, 20 bp, Homo sapiens
actgggtctgacctggtggg

SEQ ID NO: 1466280 - DNA, 16 bp, Homo sapiens
actgggtgcgtctcca

SEQ ID NO: 1466281 - DNA, 18 bp, Homo sapiens
actgggtggtggcctggt

SEQ ID NO: 1466282 - DNA, 14 bp, Homo sapiens
actgggttaaatat

SEQ ID NO: 1466283 - DNA, 16 bp, Homo sapiens
actgggttaaatattt

SEQ ID NO: 1466284 - DNA, 20 bp, Homo sapiens
actgggttaaatattttgct

SEQ ID NO: 1466285 - DNA, 14 bp, Homo sapiens
actgggttcttgtt

SEQ ID NO: 1466286 - DNA, 16 bp, Homo sapiens
actgggttctttggaa

SEQ ID NO: 1466287 - DNA, 13 bp, Homo sapiens
actgggttgactt

SEQ ID NO: 1466288 - DNA, 20 bp, Homo sapiens
actgggttgactttcaggta

SEQ ID NO: 1466289 - DNA, 16 bp, Homo sapiens
actgggtttggacccc

SEQ ID NO: 1466290 - DNA, 23 bp, Homo sapiens
actggtaaaaagatccagggatg

SEQ ID NO: 1466291 - DNA, 24 bp, Homo sapiens
actggtaaaaagatccagggatgg

SEQ ID NO: 1466292 - DNA, 20 bp, Homo sapiens
actggtaaagcctcatttga

SEQ ID NO: 1466293 - DNA, 20 bp, Homo sapiens
actggtaagcgatttgaaac

SEQ ID NO: 1466294 - DNA, 17 bp, Homo sapiens
actggtaattgtacaat

SEQ ID NO: 1466295 - DNA, 16 bp, Homo sapiens
actggtcattaatgtg

SEQ ID NO: 1466296 - DNA, 22 bp, Homo sapiens
actggtccaaaagattgctgaa

SEQ ID NO: 1466297 - DNA, 19 bp, Homo sapiens
actggtccagctctgacat

SEQ ID NO: 1466298 - DNA, 13 bp, Homo sapiens
actggtcccttcc

SEQ ID NO: 1466299 - DNA, 16 bp, Homo sapiens
actggtctaatgtttg

SEQ ID NO: 1466300 - DNA, 20 bp, Homo sapiens
actggtctcgaactcctggc

SEQ ID NO: 1466301 - DNA, 21 bp, Homo sapiens
actggtggcccgacagcctgg

SEQ ID NO: 1466302 - DNA, 22 bp, Homo sapiens
actggtggcccgacagcctggc

SEQ ID NO: 1466303 - DNA, 12 bp, Homo sapiens
actggtgggcca

SEQ ID NO: 1466304 - DNA, 17 bp, Homo sapiens
actggtggtttttgctc

SEQ ID NO: 1466305 - DNA, 14 bp, Homo sapiens
actggtgtccagct

SEQ ID NO: 1466306 - DNA, 22 bp, Homo sapiens
actggttaaaaaacaaatgttc

SEQ ID NO: 1466307 - DNA, 20 bp, Homo sapiens
actggttatagttgatatgt

SEQ ID NO: 1466308 - DNA, 20 bp, Homo sapiens
actggttgttgccaaacagc

SEQ ID NO: 1466309 - DNA, 21 bp, Homo sapiens
actggtttccccagggaagga

SEQ ID NO: 1466310 - DNA, 23 bp, Homo sapiens
actggtttccccagggaaggaaa

SEQ ID NO: 1466311 - DNA, 22 bp, Homo sapiens
actggtttctcagaatccaaag

SEQ ID NO: 1466312 - DNA, 13 bp, Homo sapiens
actgtaaaatgca

SEQ ID NO: 1466313 - DNA, 19 bp, Homo sapiens
actgtaaaatgcaaaaaat

SEQ ID NO: 1466314 - DNA, 20 bp, Homo sapiens
actgtaaagatttgttgaca

SEQ ID NO: 1466315 - DNA, 15 bp, Homo sapiens
actgtaaataaaatg

SEQ ID NO: 1466316 - DNA, 17 bp, Homo sapiens
actgtaaataaaatgtg

SEQ ID NO: 1466317 - DNA, 18 bp, Homo sapiens
actgtaaataaaatgtgt

SEQ ID NO: 1466318 - DNA, 23 bp, Homo sapiens
actgtaaataaaatgtgtacagt

SEQ ID NO: 1466319 - DNA, 17 bp, Homo sapiens
actgtaaatatgaatct

SEQ ID NO: 1466320 - DNA, 23 bp, Homo sapiens
actgtaaatatgtttgtgcctta

SEQ ID NO: 1466321 - DNA, 10 bp, Homo sapiens
actgtaaatt

SEQ ID NO: 1466322 - DNA, 14 bp, Homo sapiens
actgtaacctgatt

SEQ ID NO: 1466323 - DNA, 14 bp, Homo sapiens
actgtaactgtcag

SEQ ID NO: 1466324 - DNA, 22 bp, Homo sapiens
actgtaagtttattttttctac

SEQ ID NO: 1466325 - DNA, 14 bp, Homo sapiens
actgtaatcttaaa

SEQ ID NO: 1466326 - DNA, 15 bp, Homo sapiens
actgtaatcttaaaa

SEQ ID NO: 1466327 - DNA, 18 bp, Homo sapiens
actgtaatcttaaaagtg

SEQ ID NO: 1466328 - DNA, 21 bp, Homo sapiens
actgtaatgaggaaaaaatgg

SEQ ID NO: 1466329 - DNA, 16 bp, Homo sapiens
actgtaattatttgaa

SEQ ID NO: 1466330 - DNA, 18 bp, Homo sapiens
actgtaattatttgaatg

SEQ ID NO: 1466331 - DNA, 20 bp, Homo sapiens
actgtaattatttgaatgac

SEQ ID NO: 1466332 - DNA, 20 bp, Homo sapiens
actgtaattgacagagtaaa

SEQ ID NO: 1466333 - DNA, 13 bp, Homo sapiens
actgtacaaagta

SEQ ID NO: 1466334 - DNA, 14 bp, Homo sapiens
actgtacaaagtag

SEQ ID NO: 1466335 - DNA, 16 bp, Homo sapiens
actgtacaaagtagaa

SEQ ID NO: 1466336 - DNA, 16 bp, Homo sapiens
actgtacatttaaaat

SEQ ID NO: 1466337 - DNA, 16 bp, Homo sapiens
actgtacccaaatgga

SEQ ID NO: 1466338 - DNA, 14 bp, Homo sapiens
actgtactcctccc

SEQ ID NO: 1466339 - DNA, 20 bp, Homo sapiens
actgtactcctcccaggcgc

SEQ ID NO: 1466340 - DNA, 11 bp, Homo sapiens
actgtactgtg

SEQ ID NO: 1466341 - DNA, 13 bp, Homo sapiens
actgtacttcact

SEQ ID NO: 1466342 - DNA, 17 bp, Homo sapiens
actgtactttgccattt

SEQ ID NO: 1466343 - DNA, 19 bp, Homo sapiens
actgtactttgccattttt

SEQ ID NO: 1466344 - DNA, 19 bp, Homo sapiens
actgtagaatgatttcatg

SEQ ID NO: 1466345 - DNA, 15 bp, Homo sapiens
actgtagatatgtat

SEQ ID NO: 1466346 - DNA, 20 bp, Homo sapiens
actgtagatatgtattcttt

SEQ ID NO: 1466347 - DNA, 20 bp, Homo sapiens
actgtagattgcttctgtag

SEQ ID NO: 1466348 - DNA, 15 bp, Homo sapiens
actgtagtctcagga

SEQ ID NO: 1466349 - DNA, 17 bp, Homo sapiens
actgtagttctaagact

SEQ ID NO: 1466350 - DNA, 17 bp, Homo sapiens
actgtatataaacatat

SEQ ID NO: 1466351 - DNA, 18 bp, Homo sapiens
actgtatataaacatatt

SEQ ID NO: 1466352 - DNA, 20 bp, Homo sapiens
actgtatataaacatatttt

SEQ ID NO: 1466353 - DNA, 14 bp, Homo sapiens
actgtatatgtatt

SEQ ID NO: 1466354 - DNA, 22 bp, Homo sapiens
actgtatcaaatctgtatatgt

SEQ ID NO: 1466355 - DNA, 14 bp, Homo sapiens
actgtatcattttc

SEQ ID NO: 1466356 - DNA, 15 bp, Homo sapiens
actgtatcattttct

SEQ ID NO: 1466357 - DNA, 22 bp, Homo sapiens
actgtatctaaaaaataactgt

SEQ ID NO: 1466358 - DNA, 22 bp, Homo sapiens
actgtatctctaatacagtgtg

SEQ ID NO: 1466359 - DNA, 14 bp, Homo sapiens
actgtatctgtgta

SEQ ID NO: 1466360 - DNA, 15 bp, Homo sapiens
actgtatctgtgtag

SEQ ID NO: 1466361 - DNA, 12 bp, Homo sapiens
actgtatttgaa

SEQ ID NO: 1466362 - DNA, 15 bp, Homo sapiens
actgtcaaaataatt

SEQ ID NO: 1466363 - DNA, 13 bp, Homo sapiens
actgtcaataaac

SEQ ID NO: 1466364 - DNA, 14 bp, Homo sapiens
actgtcaataaaca

SEQ ID NO: 1466365 - DNA, 22 bp, Homo sapiens
actgtcactgccgacatccctc

SEQ ID NO: 1466366 - DNA, 16 bp, Homo sapiens
actgtcagccgggccc

SEQ ID NO: 1466367 - DNA, 22 bp, Homo sapiens
actgtcagctcccctcggagaa

SEQ ID NO: 1466368 - DNA, 14 bp, Homo sapiens
actgtcagctgagc

SEQ ID NO: 1466369 - DNA, 21 bp, Homo sapiens
actgtcagctgagcttgagct

SEQ ID NO: 1466370 - DNA, 22 bp, Homo sapiens
actgtcaggaagaaatcacaga

SEQ ID NO: 1466371 - DNA, 14 bp, Homo sapiens
actgtcagtggggc

SEQ ID NO: 1466372 - DNA, 23 bp, Homo sapiens
actgtcagttctctgggaagtgg

SEQ ID NO: 1466373 - DNA, 22 bp, Homo sapiens
actgtcatcctcaaagaaagtg

SEQ ID NO: 1466374 - DNA, 14 bp, Homo sapiens
actgtcatgtggct

SEQ ID NO: 1466375 - DNA, 17 bp, Homo sapiens
actgtcattgcccctcc

SEQ ID NO: 1466376 - DNA, 19 bp, Homo sapiens
actgtcccacaaaatattt

SEQ ID NO: 1466377 - DNA, 12 bp, Homo sapiens
actgtcctgggc

SEQ ID NO: 1466378 - DNA, 19 bp, Homo sapiens
actgtcctgggcctgcaga

SEQ ID NO: 1466379 - DNA, 22 bp, Homo sapiens
actgtcctgggcgccctggaag

SEQ ID NO: 1466380 - DNA, 17 bp, Homo sapiens
actgtccttccctgcca

SEQ ID NO: 1466381 - DNA, 21 bp, Homo sapiens
actgtcctttccttggcttta

SEQ ID NO: 1466382 - DNA, 17 bp, Homo sapiens
actgtctaagcagtttt

SEQ ID NO: 1466383 - DNA, 18 bp, Homo sapiens
actgtctaagcagttttg

SEQ ID NO: 1466384 - DNA, 13 bp, Homo sapiens
actgtctatggat

SEQ ID NO: 1466385 - DNA, 16 bp, Homo sapiens
actgtctatggatttg

SEQ ID NO: 1466386 - DNA, 19 bp, Homo sapiens
actgtctcaagagggcact

SEQ ID NO: 1466387 - DNA, 20 bp, Homo sapiens
actgtctcaagagggcactg

SEQ ID NO: 1466388 - DNA, 21 bp, Homo sapiens
actgtctcaagagggcactgg

SEQ ID NO: 1466389 - DNA, 18 bp, Homo sapiens
actgtctcagtttcactt

SEQ ID NO: 1466390 - DNA, 21 bp, Homo sapiens
actgtctgaatattctagaac

SEQ ID NO: 1466391 - DNA, 13 bp, Homo sapiens
actgtcttcctca

SEQ ID NO: 1466392 - DNA, 18 bp, Homo sapiens
actgtcttcctcaaaata

SEQ ID NO: 1466393 - DNA, 20 bp, Homo sapiens
actgtcttcctcaaaataaa

SEQ ID NO: 1466394 - DNA, 16 bp, Homo sapiens
actgtcttgtgttttc

SEQ ID NO: 1466395 - DNA, 22 bp, Homo sapiens
actgtctttataacccatattt

SEQ ID NO: 1466396 - DNA, 14 bp, Homo sapiens
actgtctttcctat

SEQ ID NO: 1466397 - DNA, 17 bp, Homo sapiens
actgtgaaaatagtgta

SEQ ID NO: 1466398 - DNA, 12 bp, Homo sapiens
actgtgaaatac

SEQ ID NO: 1466399 - DNA, 20 bp, Homo sapiens
actgtgaaataccacaagcc

SEQ ID NO: 1466400 - DNA, 21 bp, Homo sapiens
actgtgaaataccacaagcct

SEQ ID NO: 1466401 - DNA, 18 bp, Homo sapiens
actgtgaacagcttgctg

SEQ ID NO: 1466402 - DNA, 19 bp, Homo sapiens
actgtgaaccaacccccat

SEQ ID NO: 1466403 - DNA, 20 bp, Homo sapiens
actgtgaagacccagcagga

SEQ ID NO: 1466404 - DNA, 13 bp, Homo sapiens
actgtgaagagaa

SEQ ID NO: 1466405 - DNA, 20 bp, Homo sapiens
actgtgaagagaatgtattc

SEQ ID NO: 1466406 - DNA, 21 bp, Homo sapiens
actgtgaagagaatgtattct

SEQ ID NO: 1466407 - DNA, 12 bp, Homo sapiens
actgtgaagagc

SEQ ID NO: 1466408 - DNA, 16 bp, Homo sapiens
actgtgaaggaccctt

SEQ ID NO: 1466409 - DNA, 22 bp, Homo sapiens
actgtgaagtttacattgtaaa

SEQ ID NO: 1466410 - DNA, 17 bp, Homo sapiens
actgtgaatcctggcaa

SEQ ID NO: 1466411 - DNA, 20 bp, Homo sapiens
actgtgatgccacacagagt

SEQ ID NO: 1466412 - DNA, 17 bp, Homo sapiens
actgtgatttatttgga

SEQ ID NO: 1466413 - DNA, 23 bp, Homo sapiens
actgtgatttatttggagtggag

SEQ ID NO: 1466414 - DNA, 12 bp, Homo sapiens
actgtgatttct

SEQ ID NO: 1466415 - DNA, 13 bp, Homo sapiens
actgtgcactata

SEQ ID NO: 1466416 - DNA, 21 bp, Homo sapiens
actgtgcatcaaccaggaaga

SEQ ID NO: 1466417 - DNA, 18 bp, Homo sapiens
actgtgccaactactact

SEQ ID NO: 1466418 - DNA, 20 bp, Homo sapiens
actgtgccactgacttgctg

SEQ ID NO: 1466419 - DNA, 13 bp, Homo sapiens
actgtgccctggt

SEQ ID NO: 1466420 - DNA, 15 bp, Homo sapiens
actgtgcctcagaga

SEQ ID NO: 1466421 - DNA, 15 bp, Homo sapiens
actgtgcctcaggcc

SEQ ID NO: 1466422 - DNA, 22 bp, Homo sapiens
actgtgcgtcttggtgtaattt

SEQ ID NO: 1466423 - DNA, 14 bp, Homo sapiens
actgtgctcagcca

SEQ ID NO: 1466424 - DNA, 16 bp, Homo sapiens
actgtgctgtgcagct

SEQ ID NO: 1466425 - DNA, 22 bp, Homo sapiens
actgtggagactttctgttact

SEQ ID NO: 1466426 - DNA, 15 bp, Homo sapiens
actgtggcacacgcc

SEQ ID NO: 1466427 - DNA, 19 bp, Homo sapiens
actgtggccacagccccct

SEQ ID NO: 1466428 - DNA, 17 bp, Homo sapiens
actgtggccagtaaaat

SEQ ID NO: 1466429 - DNA, 19 bp, Homo sapiens
actgtggccccctccgtga

SEQ ID NO: 1466430 - DNA, 16 bp, Homo sapiens
actgtggcgttctgct

SEQ ID NO: 1466431 - DNA, 22 bp, Homo sapiens
actgtggggaaccaattgcttt

SEQ ID NO: 1466432 - DNA, 17 bp, Homo sapiens
actgtggtagctccagc

SEQ ID NO: 1466433 - DNA, 19 bp, Homo sapiens
actgtggtaggggcaggga

SEQ ID NO: 1466434 - DNA, 18 bp, Homo sapiens
actgtggtttcagatgtg

SEQ ID NO: 1466435 - DNA, 19 bp, Homo sapiens
actgtggtttcagatgtgc

SEQ ID NO: 1466436 - DNA, 22 bp, Homo sapiens
actgtggtttcagatgtgcaat

SEQ ID NO: 1466437 - DNA, 13 bp, Homo sapiens
actgtgtaattag

SEQ ID NO: 1466438 - DNA, 12 bp, Homo sapiens
actgtgtacata

SEQ ID NO: 1466439 - DNA, 18 bp, Homo sapiens
actgtgtacataactgaa

SEQ ID NO: 1466440 - DNA, 14 bp, Homo sapiens
actgtgtactgttc

SEQ ID NO: 1466441 - DNA, 13 bp, Homo sapiens
actgtgtcctggt

SEQ ID NO: 1466442 - DNA, 22 bp, Homo sapiens
actgtgtctggcgttctcaaga

SEQ ID NO: 1466443 - DNA, 23 bp, Homo sapiens
actgtgtctggcgttctcaagaa

SEQ ID NO: 1466444 - DNA, 16 bp, Homo sapiens
actgtgtgctgactga

SEQ ID NO: 1466445 - DNA, 18 bp, Homo sapiens
actgtgtgctgactgaac

SEQ ID NO: 1466446 - DNA, 19 bp, Homo sapiens
actgtgtttcgcattaagc

SEQ ID NO: 1466447 - DNA, 22 bp, Homo sapiens
actgtgtttcgcattaagcaca

SEQ ID NO: 1466448 - DNA, 13 bp, Homo sapiens
actgtgtttgcat

SEQ ID NO: 1466449 - DNA, 18 bp, Homo sapiens
actgtgtttgcattgtct

SEQ ID NO: 1466450 - DNA, 16 bp, Homo sapiens
actgttaatacacagt

SEQ ID NO: 1466451 - DNA, 17 bp, Homo sapiens
actgttacaagaggcca

SEQ ID NO: 1466452 - DNA, 14 bp, Homo sapiens
actgttactccaca

SEQ ID NO: 1466453 - DNA, 16 bp, Homo sapiens
actgttactgggccct

SEQ ID NO: 1466454 - DNA, 18 bp, Homo sapiens
actgttactgggccctga

SEQ ID NO: 1466455 - DNA, 15 bp, Homo sapiens
actgttactttggca

SEQ ID NO: 1466456 - DNA, 15 bp, Homo sapiens
actgttagaatgtaa

SEQ ID NO: 1466457 - DNA, 16 bp, Homo sapiens
actgttattctttgca

SEQ ID NO: 1466458 - DNA, 21 bp, Homo sapiens
actgttctaaagctctgacat

SEQ ID NO: 1466459 - DNA, 19 bp, Homo sapiens
actgttctcctgaatattt

SEQ ID NO: 1466460 - DNA, 22 bp, Homo sapiens
actgttctctttaaaatatttg

SEQ ID NO: 1466461 - DNA, 13 bp, Homo sapiens
actgttgaactta

SEQ ID NO: 1466462 - DNA, 19 bp, Homo sapiens
actgttgaacttagaacta

SEQ ID NO: 1466463 - DNA, 17 bp, Homo sapiens
actgttgagccccagtg

SEQ ID NO: 1466464 - DNA, 12 bp, Homo sapiens
actgttgagtta

SEQ ID NO: 1466465 - DNA, 12 bp, Homo sapiens
actgttgcattt

SEQ ID NO: 1466466 - DNA, 15 bp, Homo sapiens
actgttgcatttact

SEQ ID NO: 1466467 - DNA, 17 bp, Homo sapiens
actgttgcatttacttt

SEQ ID NO: 1466468 - DNA, 21 bp, Homo sapiens
actgttgcatttacttttaat

SEQ ID NO: 1466469 - DNA, 12 bp, Homo sapiens
actgttgctcaa

SEQ ID NO: 1466470 - DNA, 12 bp, Homo sapiens
actgttggaatg

SEQ ID NO: 1466471 - DNA, 13 bp, Homo sapiens
actgttggagccc

SEQ ID NO: 1466472 - DNA, 14 bp, Homo sapiens
actgttgtaagaat

SEQ ID NO: 1466473 - DNA, 15 bp, Homo sapiens
actgttgtaagaatt

SEQ ID NO: 1466474 - DNA, 19 bp, Homo sapiens
actgttgtagaagacaaaa

SEQ ID NO: 1466475 - DNA, 21 bp, Homo sapiens
acttgactccatttcatcatt

SEQ ID NO: 1466476 - DNA, 17 bp, Homo sapiens
acttgacttttaaggct

SEQ ID NO: 1466477 - DNA, 19 bp, Homo sapiens
acttgagatgtatgaaggc

SEQ ID NO: 1466478 - DNA, 20 bp, Homo sapiens
acttgagcaccgtcatggct

SEQ ID NO: 1466479 - DNA, 21 bp, Homo sapiens
acttgagcgtgaatctgtatc

SEQ ID NO: 1466480 - DNA, 21 bp, Homo sapiens
acttgagtaaaatactctttt

SEQ ID NO: 1466481 - DNA, 20 bp, Homo sapiens
acttgagtgttcctttttaa

SEQ ID NO: 1466482 - DNA, 22 bp, Homo sapiens
acttgagtgttcctttttaaat

SEQ ID NO: 1466483 - DNA, 23 bp, Homo sapiens
acttgagttggagtactatattt

SEQ ID NO: 1466484 - DNA, 15 bp, Homo sapiens
acttgataatattag

SEQ ID NO: 1466485 - DNA, 23 bp, Homo sapiens
acttgataatattagtgattctg

SEQ ID NO: 1466486 - DNA, 17 bp, Homo sapiens
acttgatcacatgcttg

SEQ ID NO: 1466487 - DNA, 20 bp, Homo sapiens
acttgatgcagttttaatac

SEQ ID NO: 1466488 - DNA, 22 bp, Homo sapiens
acttgatgttccacctgccaca

SEQ ID NO: 1466489 - DNA, 14 bp, Homo sapiens
acttgatgttcctt

SEQ ID NO: 1466490 - DNA, 14 bp, Homo sapiens
acttgattgagaaa

SEQ ID NO: 1466491 - DNA, 15 bp, Homo sapiens
acttgcactcttcta

SEQ ID NO: 1466492 - DNA, 13 bp, Homo sapiens
acttgcactgaag

SEQ ID NO: 1466493 - DNA, 14 bp, Homo sapiens
acttgcatcactta

SEQ ID NO: 1466494 - DNA, 19 bp, Homo sapiens
acttgcattgaatatatta

SEQ ID NO: 1466495 - DNA, 16 bp, Homo sapiens
acttgccatgcaggaa

SEQ ID NO: 1466496 - DNA, 14 bp, Homo sapiens
acttgcctttgaag

SEQ ID NO: 1466497 - DNA, 18 bp, Homo sapiens
acttgcgtcctgcagagg

SEQ ID NO: 1466498 - DNA, 20 bp, Homo sapiens
acttgcgtcctgcagaggac

SEQ ID NO: 1466499 - DNA, 22 bp, Homo sapiens
acttgctaaagcactttgcact

SEQ ID NO: 1466500 - DNA, 14 bp, Homo sapiens
acttgctaccctga

SEQ ID NO: 1466501 - DNA, 20 bp, Homo sapiens
acttgctagtgatacactgt

SEQ ID NO: 1466502 - DNA, 23 bp, Homo sapiens
acttgctgcctgaagaacagtaa

SEQ ID NO: 1466503 - DNA, 14 bp, Homo sapiens
acttgctgctgcct

SEQ ID NO: 1466504 - DNA, 17 bp, Homo sapiens
acttgctggtcctggct

SEQ ID NO: 1466505 - DNA, 13 bp, Homo sapiens
acttgctgtccag

SEQ ID NO: 1466506 - DNA, 20 bp, Homo sapiens
acttgctgtgtgaccctggg

SEQ ID NO: 1466507 - DNA, 18 bp, Homo sapiens
acttgcttaaatttctta

SEQ ID NO: 1466508 - DNA, 23 bp, Homo sapiens
acttgcttaaatttcttatgtga

SEQ ID NO: 1466509 - DNA, 16 bp, Homo sapiens
acttgcttatttgaca

SEQ ID NO: 1466510 - DNA, 16 bp, Homo sapiens
acttgcttctctagct

SEQ ID NO: 1466511 - DNA, 22 bp, Homo sapiens
acttggaaaaatccagaaagaa

SEQ ID NO: 1466512 - DNA, 23 bp, Homo sapiens
acttggaacctcattgctaccac

SEQ ID NO: 1466513 - DNA, 19 bp, Homo sapiens
acttggagccaagggttca

SEQ ID NO: 1466514 - DNA, 14 bp, Homo sapiens
acttggagctgtcc

SEQ ID NO: 1466515 - DNA, 13 bp, Homo sapiens
acttggattctct

SEQ ID NO: 1466516 - DNA, 15 bp, Homo sapiens
acttggatttcattt

SEQ ID NO: 1466517 - DNA, 13 bp, Homo sapiens
acttggcacttaa

SEQ ID NO: 1466518 - DNA, 15 bp, Homo sapiens
acttggcatacaaaa

SEQ ID NO: 1466519 - DNA, 17 bp, Homo sapiens
acttggcatacaaaata

SEQ ID NO: 1466520 - DNA, 20 bp, Homo sapiens
acttggctcgaatctctgtg

SEQ ID NO: 1466521 - DNA, 20 bp, Homo sapiens
acttgggagacctgtaatca

SEQ ID NO: 1466522 - DNA, 23 bp, Homo sapiens
acttggggagttaagacctggca

SEQ ID NO: 1466523 - DNA, 20 bp, Homo sapiens
acttgggggttcaggcccgg

SEQ ID NO: 1466524 - DNA, 16 bp, Homo sapiens
acttggtttcctattt

SEQ ID NO: 1466525 - DNA, 23 bp, Homo sapiens
acttggtttcctatttcccctta

SEQ ID NO: 1466526 - DNA, 22 bp, Homo sapiens
acttggtttgttatatcaggga

SEQ ID NO: 1466527 - DNA, 21 bp, Homo sapiens
acttgtaaaaagggggctgca

SEQ ID NO: 1466528 - DNA, 14 bp, Homo sapiens
acttgtacaaaata

SEQ ID NO: 1466529 - DNA, 20 bp, Homo sapiens
acttgtacaaaataaacaaa

SEQ ID NO: 1466530 - DNA, 19 bp, Homo sapiens
acttgtacaaacagtattt

SEQ ID NO: 1466531 - DNA, 18 bp, Homo sapiens
acttgtactatgttaata

SEQ ID NO: 1466532 - DNA, 14 bp, Homo sapiens
acttgtatattcca

SEQ ID NO: 1466533 - DNA, 20 bp, Homo sapiens
acttgtatattccaccattc

SEQ ID NO: 1466534 - DNA, 14 bp, Homo sapiens
acttgtatatttgt

SEQ ID NO: 1466535 - DNA, 22 bp, Homo sapiens
acttgtattgactttatgttgt

SEQ ID NO: 1466536 - DNA, 16 bp, Homo sapiens
acttgtcaaagaaggt

SEQ ID NO: 1466537 - DNA, 14 bp, Homo sapiens
acttgtcacgaatt

SEQ ID NO: 1466538 - DNA, 13 bp, Homo sapiens
acttgtcatgtga

SEQ ID NO: 1466539 - DNA, 15 bp, Homo sapiens
acttgtcctatgtca

SEQ ID NO: 1466540 - DNA, 19 bp, Homo sapiens
acttgtctaaataagtttg

SEQ ID NO: 1466541 - DNA, 22 bp, Homo sapiens
acttgtctaaataagtttgcaa

SEQ ID NO: 1466542 - DNA, 17 bp, Homo sapiens
acttgtctgaggcctca

SEQ ID NO: 1466543 - DNA, 20 bp, Homo sapiens
acttgtctgaggcctcatcc

SEQ ID NO: 1466544 - DNA, 12 bp, Homo sapiens
acttgtctgtca

SEQ ID NO: 1466545 - DNA, 20 bp, Homo sapiens
acttgtctgtcaaatgtttc

SEQ ID NO: 1466546 - DNA, 22 bp, Homo sapiens
acttgtctgtcaaatgtttcct

SEQ ID NO: 1466547 - DNA, 17 bp, Homo sapiens
acttgtgacttttgctt

SEQ ID NO: 1466548 - DNA, 19 bp, Homo sapiens
acttgtgacttttgcttta

SEQ ID NO: 1466549 - DNA, 20 bp, Homo sapiens
acttgtgattatttattatt

SEQ ID NO: 1466550 - DNA, 17 bp, Homo sapiens
acttgtgattggctgca

SEQ ID NO: 1466551 - DNA, 19 bp, Homo sapiens
acttgtgattggctgcagg

SEQ ID NO: 1466552 - DNA, 22 bp, Homo sapiens
acttgtgctgatcgtgctaaat

SEQ ID NO: 1466553 - DNA, 13 bp, Homo sapiens
acttgtgtatatt

SEQ ID NO: 1466554 - DNA, 22 bp, Homo sapiens
acttgtgtatattttaatgaat

SEQ ID NO: 1466555 - DNA, 14 bp, Homo sapiens
acttgtgtctctgt

SEQ ID NO: 1466556 - DNA, 16 bp, Homo sapiens
acttgtgtctctgtgc

SEQ ID NO: 1466557 - DNA, 23 bp, Homo sapiens
acttgtgtgtgggctgtgagtgt

SEQ ID NO: 1466558 - DNA, 14 bp, Homo sapiens
acttgttggtgtgg

SEQ ID NO: 1466559 - DNA, 19 bp, Homo sapiens
acttgttgtatctgctgga

SEQ ID NO: 1466560 - DNA, 20 bp, Homo sapiens
acttgttgtatctgctggat

SEQ ID NO: 1466561 - DNA, 15 bp, Homo sapiens
acttgtttagagagc

SEQ ID NO: 1466562 - DNA, 12 bp, Homo sapiens
acttgtttctat

SEQ ID NO: 1466563 - DNA, 19 bp, Homo sapiens
acttgtttctctgttgtaa

SEQ ID NO: 1466564 - DNA, 18 bp, Homo sapiens
acttgttttggatggctt

SEQ ID NO: 1466565 - DNA, 19 bp, Homo sapiens
acttgttttggatggcttg

SEQ ID NO: 1466566 - DNA, 15 bp, Homo sapiens
acttgtttttgtaaa

SEQ ID NO: 1466567 - DNA, 16 bp, Homo sapiens
acttgtttttgtaaag

SEQ ID NO: 1466568 - DNA, 15 bp, Homo sapiens
actttaaaaaggaaa

SEQ ID NO: 1466569 - DNA, 16 bp, Homo sapiens
actttaaaataaaaaa

SEQ ID NO: 1466570 - DNA, 18 bp, Homo sapiens
actttaaatcttttcttc

SEQ ID NO: 1466571 - DNA, 16 bp, Homo sapiens
actttaaatttaaagt

SEQ ID NO: 1466572 - DNA, 21 bp, Homo sapiens
actttaacttagttttgcata

SEQ ID NO: 1466573 - DNA, 17 bp, Homo sapiens
actttaacttttgaaaa

SEQ ID NO: 1466574 - DNA, 15 bp, Homo sapiens
actttaatggcctgg

SEQ ID NO: 1466575 - DNA, 22 bp, Homo sapiens
actttacaaaccattacctgta

SEQ ID NO: 1466576 - DNA, 16 bp, Homo sapiens
actttacacaagaatc

SEQ ID NO: 1466577 - DNA, 14 bp, Homo sapiens
actttacaggaggt

SEQ ID NO: 1466578 - DNA, 13 bp, Homo sapiens
actttacccacct

SEQ ID NO: 1466579 - DNA, 19 bp, Homo sapiens
actttacctgcaggctcca

SEQ ID NO: 1466580 - DNA, 15 bp, Homo sapiens
actttacgcccatct

SEQ ID NO: 1466581 - DNA, 11 bp, Homo sapiens
actttactgta

SEQ ID NO: 1466582 - DNA, 19 bp, Homo sapiens
actttacttgtggtgtgac

SEQ ID NO: 1466583 - DNA, 21 bp, Homo sapiens
actttaggtttgttcccttga

SEQ ID NO: 1466584 - DNA, 20 bp, Homo sapiens
actttagttagcatgcgcgc

SEQ ID NO: 1466585 - DNA, 16 bp, Homo sapiens
actttataactaacat

SEQ ID NO: 1466586 - DNA, 20 bp, Homo sapiens
actttatacccagaaagtta

SEQ ID NO: 1466587 - DNA, 14 bp, Homo sapiens
actttatcacatta

SEQ ID NO: 1466588 - DNA, 21 bp, Homo sapiens
actttatcacattatttgcat

SEQ ID NO: 1466589 - DNA, 19 bp, Homo sapiens
acttttgtgtattctgtgg

SEQ ID NO: 1466590 - DNA, 18 bp, Homo sapiens
actttttaaatgtaaaga

SEQ ID NO: 1466591 - DNA, 12 bp, Homo sapiens
actttttataaa

SEQ ID NO: 1466592 - DNA, 17 bp, Homo sapiens
actttttctgagctttt

SEQ ID NO: 1466593 - DNA, 12 bp, Homo sapiens
actttttctgat

SEQ ID NO: 1466594 - DNA, 21 bp, Homo sapiens
actttttgcaccttattttct

SEQ ID NO: 1466595 - DNA, 17 bp, Homo sapiens
acttttttaaatataaa

SEQ ID NO: 1466596 - DNA, 18 bp, Homo sapiens
acttttttaaatattttc

SEQ ID NO: 1466597 - DNA, 14 bp, Homo sapiens
acttttttcttaag

SEQ ID NO: 1466598 - DNA, 20 bp, Homo sapiens
acttttttgtggcaattagt

SEQ ID NO: 1466599 - DNA, 12 bp, Homo sapiens
acttttttgtgt

SEQ ID NO: 1466600 - DNA, 17 bp, Homo sapiens
acttttttgtgtatgta

SEQ ID NO: 1466601 - DNA, 19 bp, Homo sapiens
acttttttgtgtatgtact

SEQ ID NO: 1466602 - DNA, 17 bp, Homo sapiens
actttttttgtatgtgt

SEQ ID NO: 1466603 - DNA, 19 bp, Homo sapiens
acttttttttctctctttt

SEQ ID NO: 1466604 - DNA, 20 bp, Homo sapiens
actttttttttatactgcac

SEQ ID NO: 1466605 - DNA, 21 bp, Homo sapiens
agaaaaaaaaccttgtaaaaa

SEQ ID NO: 1466606 - DNA, 20 bp, Homo sapiens
agaaaaaaaataacacagag

SEQ ID NO: 1466607 - DNA, 17 bp, Homo sapiens
agaaaaaaagggagaat

SEQ ID NO: 1466608 - DNA, 13 bp, Homo sapiens
agaaaaaagcaag

SEQ ID NO: 1466609 - DNA, 11 bp, Homo sapiens
agaaaaacatg

SEQ ID NO: 1466610 - DNA, 11 bp, Homo sapiens
agaaaaagaat

SEQ ID NO: 1466611 - DNA, 21 bp, Homo sapiens
agaaaaaggctgaaaagaagg

SEQ ID NO: 1466612 - DNA, 15 bp, Homo sapiens
agaaaaagggctgcc

SEQ ID NO: 1466613 - DNA, 15 bp, Homo sapiens
agaaaaagtaaaaga

SEQ ID NO: 1466614 - DNA, 16 bp, Homo sapiens
agaaaaagtacaatga

SEQ ID NO: 1466615 - DNA, 18 bp, Homo sapiens
agaaaaataaaatttcct

SEQ ID NO: 1466616 - DNA, 14 bp, Homo sapiens
agaaaaatcatgtt

SEQ ID NO: 1466617 - DNA, 21 bp, Homo sapiens
agaaaaatcatgtttgctctc

SEQ ID NO: 1466618 - DNA, 12 bp, Homo sapiens
agaaaaatcttg

SEQ ID NO: 1466619 - DNA, 23 bp, Homo sapiens
agaaaaatcttgtgctagaatac

SEQ ID NO: 1466620 - DNA, 13 bp, Homo sapiens
agaaaaatgttct

SEQ ID NO: 1466621 - DNA, 13 bp, Homo sapiens
agaaaacaaaatt

SEQ ID NO: 1466622 - DNA, 22 bp, Homo sapiens
agaaaacaaagttctattttat

SEQ ID NO: 1466623 - DNA, 18 bp, Homo sapiens
agaaaacaacttggcatt

SEQ ID NO: 1466624 - DNA, 21 bp, Homo sapiens
agaaaacaacttggcatttct

SEQ ID NO: 1466625 - DNA, 23 bp, Homo sapiens
agaaaacaacttggcatttctat

SEQ ID NO: 1466626 - DNA, 22 bp, Homo sapiens
agaaaacaagatgagattggca

SEQ ID NO: 1466627 - DNA, 16 bp, Homo sapiens
agaaaacaagcaagtt

SEQ ID NO: 1466628 - DNA, 17 bp, Homo sapiens
agaaaacacttgtaagt

SEQ ID NO: 1466629 - DNA, 20 bp, Homo sapiens
agaaaacccttgggccagaa

SEQ ID NO: 1466630 - DNA, 16 bp, Homo sapiens
agaaaacccttttcta

SEQ ID NO: 1466631 - DNA, 14 bp, Homo sapiens
agaaaacctccagt

SEQ ID NO: 1466632 - DNA, 20 bp, Homo sapiens
agaaaactaggcaatgtact

SEQ ID NO: 1466633 - DNA, 14 bp, Homo sapiens
agaaaactgtgatt

SEQ ID NO: 1466634 - DNA, 14 bp, Homo sapiens
agaaaacttctttt

SEQ ID NO: 1466635 - DNA, 14 bp, Homo sapiens
agaaaagacatttt

SEQ ID NO: 1466636 - DNA, 18 bp, Homo sapiens
agaaaagaccctgagact

SEQ ID NO: 1466637 - DNA, 13 bp, Homo sapiens
agaaaagagaaac

SEQ ID NO: 1466638 - DNA, 18 bp, Homo sapiens
agaaaagaggagaccctg

SEQ ID NO: 1466639 - DNA, 18 bp, Homo sapiens
agaaaagcaatactgttt

SEQ ID NO: 1466640 - DNA, 15 bp, Homo sapiens
agaaaagcacctgcc

SEQ ID NO: 1466641 - DNA, 21 bp, Homo sapiens
agaaaagcagacgcagcagct

SEQ ID NO: 1466642 - DNA, 21 bp, Homo sapiens
agaaaagcagtcccattcata

SEQ ID NO: 1466643 - DNA, 15 bp, Homo sapiens
agaaaagcattttca

SEQ ID NO: 1466644 - DNA, 23 bp, Homo sapiens
agaaaagcattttcagtcttgta

SEQ ID NO: 1466645 - DNA, 19 bp, Homo sapiens
agaaaagctgccatttccc

SEQ ID NO: 1466646 - DNA, 21 bp, Homo sapiens
agaaaaggagtcaagaacaat

SEQ ID NO: 1466647 - DNA, 21 bp, Homo sapiens
agaaaaggctggagagagatt

SEQ ID NO: 1466648 - DNA, 13 bp, Homo sapiens
agaaaaggtcttg

SEQ ID NO: 1466649 - DNA, 21 bp, Homo sapiens
agaaaaggtgataaaatcata

SEQ ID NO: 1466650 - DNA, 19 bp, Homo sapiens
agaaaagtgaattgaagtt

SEQ ID NO: 1466651 - DNA, 16 bp, Homo sapiens
agaaaatagataattt

SEQ ID NO: 1466652 - DNA, 18 bp, Homo sapiens
agaaaatatattctttca

SEQ ID NO: 1466653 - DNA, 19 bp, Homo sapiens
agaaaatatattctttcaa

SEQ ID NO: 1466654 - DNA, 23 bp, Homo sapiens
agaaaatatttaatatcaaaaga

SEQ ID NO: 1466655 - DNA, 13 bp, Homo sapiens
agaaaatcatcaa

SEQ ID NO: 1466656 - DNA, 15 bp, Homo sapiens
agaaaatccttcagc

SEQ ID NO: 1466657 - DNA, 19 bp, Homo sapiens
agaaaatgacttatttctg

SEQ ID NO: 1466658 - DNA, 19 bp, Homo sapiens
agaaaatgagaaaggacag

SEQ ID NO: 1466659 - DNA, 22 bp, Homo sapiens
agaaaatgcctcaattcacata

SEQ ID NO: 1466660 - DNA, 21 bp, Homo sapiens
agaaaatggctaataaactgt

SEQ ID NO: 1466661 - DNA, 19 bp, Homo sapiens
agaaaatgtaaaggaggga

SEQ ID NO: 1466662 - DNA, 20 bp, Homo sapiens
agaaaatgtaaaggagggag

SEQ ID NO: 1466663 - DNA, 11 bp, Homo sapiens
agaaaatgtag

SEQ ID NO: 1466664 - DNA, 21 bp, Homo sapiens
agaaaattggaactctactca

SEQ ID NO: 1466665 - DNA, 18 bp, Homo sapiens
agaaaattttgtaaaaca

SEQ ID NO: 1466666 - DNA, 22 bp, Homo sapiens
agaaaattttgtattaatttct

SEQ ID NO: 1466667 - DNA, 17 bp, Homo sapiens
agaaacaaaaagagctt

SEQ ID NO: 1466668 - DNA, 13 bp, Homo sapiens
agaaacaaacatc

SEQ ID NO: 1466669 - DNA, 17 bp, Homo sapiens
agaaacaaagatgttat

SEQ ID NO: 1466670 - DNA, 15 bp, Homo sapiens
agaaacaacagggga

SEQ ID NO: 1466671 - DNA, 19 bp, Homo sapiens
agaaacacagggttttgta

SEQ ID NO: 1466672 - DNA, 13 bp, Homo sapiens
agaaacacataac

SEQ ID NO: 1466673 - DNA, 20 bp, Homo sapiens
agaaacacataattaacact

SEQ ID NO: 1466674 - DNA, 13 bp, Homo sapiens
agaaacacattct

SEQ ID NO: 1466675 - DNA, 19 bp, Homo sapiens
agaaacacccctctgtcta

SEQ ID NO: 1466676 - DNA, 16 bp, Homo sapiens
agaaacactgaaaaga

SEQ ID NO: 1466677 - DNA, 13 bp, Homo sapiens
agaaacactgcct

SEQ ID NO: 1466678 - DNA, 15 bp, Homo sapiens
agaaacagagacagg

SEQ ID NO: 1466679 - DNA, 20 bp, Homo sapiens
agaaacagagtggcctccct

SEQ ID NO: 1466680 - DNA, 13 bp, Homo sapiens
agaaacagctcag

SEQ ID NO: 1466681 - DNA, 17 bp, Homo sapiens
agaaacagctcagccag

SEQ ID NO: 1466682 - DNA, 15 bp, Homo sapiens
agaaacagctttcaa

SEQ ID NO: 1466683 - DNA, 16 bp, Homo sapiens
agaaacagctttcaag

SEQ ID NO: 1466684 - DNA, 22 bp, Homo sapiens
agaaacagttggtaacttttgt

SEQ ID NO: 1466685 - DNA, 13 bp, Homo sapiens
agaaacagtttct

SEQ ID NO: 1466686 - DNA, 11 bp, Homo sapiens
agaaacatctc

SEQ ID NO: 1466687 - DNA, 11 bp, Homo sapiens
agaaacatgaa

SEQ ID NO: 1466688 - DNA, 12 bp, Homo sapiens
agaaacatgaca

SEQ ID NO: 1466689 - DNA, 13 bp, Homo sapiens
agaaacatgacac

SEQ ID NO: 1466690 - DNA, 15 bp, Homo sapiens
agaaacatgacactg

SEQ ID NO: 1466691 - DNA, 15 bp, Homo sapiens
agaaaccttgctctc

SEQ ID NO: 1466692 - DNA, 19 bp, Homo sapiens
agaaaccttgctctcctca

SEQ ID NO: 1466693 - DNA, 15 bp, Homo sapiens
agaaaccttttattt

SEQ ID NO: 1466694 - DNA, 18 bp, Homo sapiens
agaaacgtgttaaaggtt

SEQ ID NO: 1466695 - DNA, 18 bp, Homo sapiens
agaaactataaagtttta

SEQ ID NO: 1466696 - DNA, 16 bp, Homo sapiens
agaaactcctgtttct

SEQ ID NO: 1466697 - DNA, 14 bp, Homo sapiens
agaaactccttttg

SEQ ID NO: 1466698 - DNA, 20 bp, Homo sapiens
agaaactccttttgctgtct

SEQ ID NO: 1466699 - DNA, 13 bp, Homo sapiens
agaaactgaggaa

SEQ ID NO: 1466700 - DNA, 13 bp, Homo sapiens
agaaacttaaaca

SEQ ID NO: 1466701 - DNA, 18 bp, Homo sapiens
agaaacttaaatgttatt

SEQ ID NO: 1466702 - DNA, 16 bp, Homo sapiens
agaaacttaagcaaag

SEQ ID NO: 1466703 - DNA, 18 bp, Homo sapiens
agaaacttaagcaaaggg

SEQ ID NO: 1466704 - DNA, 22 bp, Homo sapiens
agaaatttttatttttctaagg

SEQ ID NO: 1466705 - DNA, 19 bp, Homo sapiens
agaaatttttatttttgaa

SEQ ID NO: 1466706 - DNA, 21 bp, Homo sapiens
agaaatttttcagatgcttct

SEQ ID NO: 1466707 - DNA, 23 bp, Homo sapiens
agaaatttttcagatgcttctgg

SEQ ID NO: 1466708 - DNA, 14 bp, Homo sapiens
agaacaaaggacag

SEQ ID NO: 1466709 - DNA, 17 bp, Homo sapiens
agaacaaatgtgttttt

SEQ ID NO: 1466710 - DNA, 16 bp, Homo sapiens
agaacaacaaagacat

SEQ ID NO: 1466711 - DNA, 19 bp, Homo sapiens
agaacaaggtagtttttac

SEQ ID NO: 1466712 - DNA, 19 bp, Homo sapiens
agaacaagtcacagctgca

SEQ ID NO: 1466713 - DNA, 18 bp, Homo sapiens
agaacaagtgcctcctgg

SEQ ID NO: 1466714 - DNA, 19 bp, Homo sapiens
agaacaagtgcctcctgga

SEQ ID NO: 1466715 - DNA, 21 bp, Homo sapiens
agaacaagttgttaaaacatt

SEQ ID NO: 1466716 - DNA, 20 bp, Homo sapiens
agaacacaagggatataaaa

SEQ ID NO: 1466717 - DNA, 12 bp, Homo sapiens
agaacacacaga

SEQ ID NO: 1466718 - DNA, 18 bp, Homo sapiens
agaacacacagactttct

SEQ ID NO: 1466719 - DNA, 19 bp, Homo sapiens
agaacacacagactttctg

SEQ ID NO: 1466720 - DNA, 13 bp, Homo sapiens
agaacacagcatg

SEQ ID NO: 1466721 - DNA, 18 bp, Homo sapiens
agaacacagcatgtgcca

SEQ ID NO: 1466722 - DNA, 21 bp, Homo sapiens
agaacacagcatgtgccaaga

SEQ ID NO: 1466723 - DNA, 22 bp, Homo sapiens
agaacaccccgctctggcagta

SEQ ID NO: 1466724 - DNA, 18 bp, Homo sapiens
agaacacggctcacgctt

SEQ ID NO: 1466725 - DNA, 11 bp, Homo sapiens
agaacactaat

SEQ ID NO: 1466726 - DNA, 19 bp, Homo sapiens
agaacactaattcataatc

SEQ ID NO: 1466727 - DNA, 11 bp, Homo sapiens
agaacactggt

SEQ ID NO: 1466728 - DNA, 16 bp, Homo sapiens
agaacagatcttttac

SEQ ID NO: 1466729 - DNA, 23 bp, Homo sapiens
agaacagcagggtagtctggttt

SEQ ID NO: 1466730 - DNA, 18 bp, Homo sapiens
agaacagccctcggcctc

SEQ ID NO: 1466731 - DNA, 19 bp, Homo sapiens
agaacagccgctcctgtct

SEQ ID NO: 1466732 - DNA, 23 bp, Homo sapiens
agaacagccgctcctgtctgcca

SEQ ID NO: 1466733 - DNA, 18 bp, Homo sapiens
agaacaggacctctgctt

SEQ ID NO: 1466734 - DNA, 13 bp, Homo sapiens
agaacagtaaaca

SEQ ID NO: 1466735 - DNA, 13 bp, Homo sapiens
agaacatacactg

SEQ ID NO: 1466736 - DNA, 18 bp, Homo sapiens
agaacatacactgtgaac

SEQ ID NO: 1466737 - DNA, 22 bp, Homo sapiens
agaacatagtttaagttgatta

SEQ ID NO: 1466738 - DNA, 15 bp, Homo sapiens
agaacatcattagaa

SEQ ID NO: 1466739 - DNA, 16 bp, Homo sapiens
agaacatggacttgta

SEQ ID NO: 1466740 - DNA, 13 bp, Homo sapiens
agaacatgttaag

SEQ ID NO: 1466741 - DNA, 22 bp, Homo sapiens
agaaccaaagcaaccacaaatg

SEQ ID NO: 1466742 - DNA, 16 bp, Homo sapiens
agaaccaaatacctca

SEQ ID NO: 1466743 - DNA, 15 bp, Homo sapiens
agaaccaagcttcag

SEQ ID NO: 1466744 - DNA, 16 bp, Homo sapiens
agaaccaagcttcaga

SEQ ID NO: 1466745 - DNA, 17 bp, Homo sapiens
agaaccaagcttcagag

SEQ ID NO: 1466746 - DNA, 19 bp, Homo sapiens
agaaccaagcttcagagcc

SEQ ID NO: 1466747 - DNA, 20 bp, Homo sapiens
agaaccacacttgaaacctt

SEQ ID NO: 1466748 - DNA, 23 bp, Homo sapiens
agaaccaccccggccccctgccc

SEQ ID NO: 1466749 - DNA, 19 bp, Homo sapiens
agaaccagagggcatgctg

SEQ ID NO: 1466750 - DNA, 23 bp, Homo sapiens
agaaccagagggcatgctgaatg

SEQ ID NO: 1466751 - DNA, 19 bp, Homo sapiens
agaaccagccgtattttac

SEQ ID NO: 1466752 - DNA, 21 bp, Homo sapiens
agaaccagccgtattttacat

SEQ ID NO: 1466753 - DNA, 22 bp, Homo sapiens
agaaccagccgtattttacatg

SEQ ID NO: 1466754 - DNA, 16 bp, Homo sapiens
agaaccagtcccccca

SEQ ID NO: 1466755 - DNA, 19 bp, Homo sapiens
agaaccagtccccccaccc

SEQ ID NO: 1466756 - DNA, 17 bp, Homo sapiens
agaacccaagtgcctca

SEQ ID NO: 1466757 - DNA, 22 bp, Homo sapiens
agaacccacataaaagccccag

SEQ ID NO: 1466758 - DNA, 14 bp, Homo sapiens
agaacccccaggtg

SEQ ID NO: 1466759 - DNA, 19 bp, Homo sapiens
agaacccccaggtggcctg

SEQ ID NO: 1466760 - DNA, 16 bp, Homo sapiens
agaaccgagcaaagat

SEQ ID NO: 1466761 - DNA, 18 bp, Homo sapiens
agaaccgagcaaagatca

SEQ ID NO: 1466762 - DNA, 22 bp, Homo sapiens
agaaccgagcaaagatcaaaat

SEQ ID NO: 1466763 - DNA, 14 bp, Homo sapiens
agaacctaactttt

SEQ ID NO: 1466764 - DNA, 20 bp, Homo sapiens
agaacctacagactccatct

SEQ ID NO: 1466765 - DNA, 21 bp, Homo sapiens
agaacctcaggcttccttggc

SEQ ID NO: 1466766 - DNA, 14 bp, Homo sapiens
agaaccttgcctga

SEQ ID NO: 1466767 - DNA, 14 bp, Homo sapiens
agaacctttctgtg

SEQ ID NO: 1466768 - DNA, 15 bp, Homo sapiens
agaacgccagtctcc

SEQ ID NO: 1466769 - DNA, 18 bp, Homo sapiens
agaacgccagtctcccag

SEQ ID NO: 1466770 - DNA, 20 bp, Homo sapiens
agaacgccagtctcccaggc

SEQ ID NO: 1466771 - DNA, 21 bp, Homo sapiens
agaacggggctcttctcattt

SEQ ID NO: 1466772 - DNA, 22 bp, Homo sapiens
agaacgtattggtccagcttgc

SEQ ID NO: 1466773 - DNA, 16 bp, Homo sapiens
agaacgtgcatccttg

SEQ ID NO: 1466774 - DNA, 18 bp, Homo sapiens
agaactaaactcatttat

SEQ ID NO: 1466775 - DNA, 18 bp, Homo sapiens
agaactacaaacaaaatt

SEQ ID NO: 1466776 - DNA, 19 bp, Homo sapiens
agaactagccaaaccagga

SEQ ID NO: 1466777 - DNA, 15 bp, Homo sapiens
agaactatgctaatt

SEQ ID NO: 1466778 - DNA, 15 bp, Homo sapiens
agaactccaggccct

SEQ ID NO: 1466779 - DNA, 22 bp, Homo sapiens
agaactcctgtgtgtggaaggc

SEQ ID NO: 1466780 - DNA, 21 bp, Homo sapiens
agaactccttattttgtatta

SEQ ID NO: 1466781 - DNA, 18 bp, Homo sapiens
agaactcgcgctcagtaa

SEQ ID NO: 1466782 - DNA, 21 bp, Homo sapiens
agaactcgcgctcagtaaacg

SEQ ID NO: 1466783 - DNA, 17 bp, Homo sapiens
agaactctaaccagtgt

SEQ ID NO: 1466784 - DNA, 19 bp, Homo sapiens
agaactctagagagcctta

SEQ ID NO: 1466785 - DNA, 14 bp, Homo sapiens
agaactctccaggg

SEQ ID NO: 1466786 - DNA, 17 bp, Homo sapiens
agaactctctccctggt

SEQ ID NO: 1466787 - DNA, 18 bp, Homo sapiens
agaactctctccctggtc

SEQ ID NO: 1466788 - DNA, 13 bp, Homo sapiens
agaactctctgga

SEQ ID NO: 1466789 - DNA, 21 bp, Homo sapiens
agaactgaaccggctttacca

SEQ ID NO: 1466790 - DNA, 17 bp, Homo sapiens
agaactgaattttggga

SEQ ID NO: 1466791 - DNA, 12 bp, Homo sapiens
agaactgcaggc

SEQ ID NO: 1466792 - DNA, 16 bp, Homo sapiens
agaactgcaggccctg

SEQ ID NO: 1466793 - DNA, 20 bp, Homo sapiens
agaactgcaggccctggcct

SEQ ID NO: 1466794 - DNA, 17 bp, Homo sapiens
agaactgcatggaccta

SEQ ID NO: 1466795 - DNA, 21 bp, Homo sapiens
agaactgcttctaagatgcca

SEQ ID NO: 1466796 - DNA, 17 bp, Homo sapiens
agaactggactcaggat

SEQ ID NO: 1466797 - DNA, 23 bp, Homo sapiens
agaactgggatttgaacccccgc

SEQ ID NO: 1466798 - DNA, 13 bp, Homo sapiens
agaactgtacatt

SEQ ID NO: 1466799 - DNA, 22 bp, Homo sapiens
agaactgtacattgtgagctct

SEQ ID NO: 1466800 - DNA, 20 bp, Homo sapiens
agaactgtgataaaaagagg

SEQ ID NO: 1466801 - DNA, 16 bp, Homo sapiens
agaactgtgccacaat

SEQ ID NO: 1466802 - DNA, 18 bp, Homo sapiens
agaactgttcatttccac

SEQ ID NO: 1466803 - DNA, 16 bp, Homo sapiens
agaactgttggctgct

SEQ ID NO: 1466804 - DNA, 14 bp, Homo sapiens
agaacttcacagtg

SEQ ID NO: 1466805 - DNA, 14 bp, Homo sapiens
agaacttcagaaag

SEQ ID NO: 1466806 - DNA, 15 bp, Homo sapiens
agaacttcagaaaga

SEQ ID NO: 1466807 - DNA, 16 bp, Homo sapiens
agaacttcagaaagac

SEQ ID NO: 1466808 - DNA, 17 bp, Homo sapiens
agaactttaaagctcag

SEQ ID NO: 1466809 - DNA, 20 bp, Homo sapiens
agaactttaaagctcaggag

SEQ ID NO: 1466810 - DNA, 20 bp, Homo sapiens
agaactttattaagtaaaat

SEQ ID NO: 1466811 - DNA, 20 bp, Homo sapiens
agaactttggaggcaaatct

SEQ ID NO: 1466812 - DNA, 13 bp, Homo sapiens
agaagaaaaatgg

SEQ ID NO: 1466813 - DNA, 12 bp, Homo sapiens
agaagaaagatg

SEQ ID NO: 1466814 - DNA, 11 bp, Homo sapiens
agaagaaagca

SEQ ID NO: 1466815 - DNA, 12 bp, Homo sapiens
agaagaaagcaa

SEQ ID NO: 1466816 - DNA, 13 bp, Homo sapiens
agaagaaagcaaa

SEQ ID NO: 1466817 - DNA, 15 bp, Homo sapiens
agaagaaagtgtaga

SEQ ID NO: 1466818 - DNA, 21 bp, Homo sapiens
agaatgaaagctgttccttgg

SEQ ID NO: 1466819 - DNA, 17 bp, Homo sapiens
agaatgaaatgtatgtg

SEQ ID NO: 1466820 - DNA, 12 bp, Homo sapiens
agaatgaagacc

SEQ ID NO: 1466821 - DNA, 18 bp, Homo sapiens
agaatgaaggtttttgta

SEQ ID NO: 1466822 - DNA, 19 bp, Homo sapiens
agaatgaatttatctttac

SEQ ID NO: 1466823 - DNA, 18 bp, Homo sapiens
agaatgagagcgacacag

SEQ ID NO: 1466824 - DNA, 19 bp, Homo sapiens
agaatgagagcgacacaga

SEQ ID NO: 1466825 - DNA, 22 bp, Homo sapiens
agaatgagggaaattgctattt

SEQ ID NO: 1466826 - DNA, 22 bp, Homo sapiens
agaatgagtccttgatttcaaa

SEQ ID NO: 1466827 - DNA, 15 bp, Homo sapiens
agaatgagtgggaat

SEQ ID NO: 1466828 - DNA, 15 bp, Homo sapiens
agaatgagtttctta

SEQ ID NO: 1466829 - DNA, 15 bp, Homo sapiens
agaatgatctattgc

SEQ ID NO: 1466830 - DNA, 16 bp, Homo sapiens
agaatgatgttttaaa

SEQ ID NO: 1466831 - DNA, 22 bp, Homo sapiens
agaatgatgttttaaaaaaatt

SEQ ID NO: 1466832 - DNA, 13 bp, Homo sapiens
agaatgattaatc

SEQ ID NO: 1466833 - DNA, 14 bp, Homo sapiens
agaatgattaatca

SEQ ID NO: 1466834 - DNA, 15 bp, Homo sapiens
agaatgcaaccaagt

SEQ ID NO: 1466835 - DNA, 20 bp, Homo sapiens
agaatgcaaccaagtcacac

SEQ ID NO: 1466836 - DNA, 20 bp, Homo sapiens
agaatgcagacttttcagac

SEQ ID NO: 1466837 - DNA, 23 bp, Homo sapiens
agaatgcagattcctgggcctgt

SEQ ID NO: 1466838 - DNA, 17 bp, Homo sapiens
agaatgcagtacagaat

SEQ ID NO: 1466839 - DNA, 17 bp, Homo sapiens
agaatgcatctcatcaa

SEQ ID NO: 1466840 - DNA, 16 bp, Homo sapiens
agaatgccggttaaat

SEQ ID NO: 1466841 - DNA, 20 bp, Homo sapiens
agaatgctgaactccttgtt

SEQ ID NO: 1466842 - DNA, 15 bp, Homo sapiens
agaatggaagcctga

SEQ ID NO: 1466843 - DNA, 16 bp, Homo sapiens
agaatggaagcctgaa

SEQ ID NO: 1466844 - DNA, 15 bp, Homo sapiens
agaatggaggcaggg

SEQ ID NO: 1466845 - DNA, 17 bp, Homo sapiens
agaatggagggcaacat

SEQ ID NO: 1466846 - DNA, 19 bp, Homo sapiens
agaatggatcacaagatgg

SEQ ID NO: 1466847 - DNA, 22 bp, Homo sapiens
agaatggcccagtcctctccca

SEQ ID NO: 1466848 - DNA, 15 bp, Homo sapiens
agaatggctgggtca

SEQ ID NO: 1466849 - DNA, 16 bp, Homo sapiens
agaatggctttcaata

SEQ ID NO: 1466850 - DNA, 23 bp, Homo sapiens
agaatggctttcaataccctttt

SEQ ID NO: 1466851 - DNA, 17 bp, Homo sapiens
agaatgggaatatttta

SEQ ID NO: 1466852 - DNA, 19 bp, Homo sapiens
agaatggtgattttaaatg

SEQ ID NO: 1466853 - DNA, 16 bp, Homo sapiens
agaatggtgctgttta

SEQ ID NO: 1466854 - DNA, 15 bp, Homo sapiens
agaatggtggagtgt

SEQ ID NO: 1466855 - DNA, 12 bp, Homo sapiens
agaatgtaaagt

SEQ ID NO: 1466856 - DNA, 19 bp, Homo sapiens
agaatgtaaggtatatcat

SEQ ID NO: 1466857 - DNA, 18 bp, Homo sapiens
agaatgtagtttgaggaa

SEQ ID NO: 1466858 - DNA, 14 bp, Homo sapiens
agaatgtattctgt

SEQ ID NO: 1466859 - DNA, 16 bp, Homo sapiens
agaatgtattctgtat

SEQ ID NO: 1466860 - DNA, 19 bp, Homo sapiens
agaatgtcagtatgtggaa

SEQ ID NO: 1466861 - DNA, 14 bp, Homo sapiens
agaatgtggatttg

SEQ ID NO: 1466862 - DNA, 21 bp, Homo sapiens
agaatgtggatttgattcatt

SEQ ID NO: 1466863 - DNA, 21 bp, Homo sapiens
agaatgtgtgtgtgtggcagg

SEQ ID NO: 1466864 - DNA, 21 bp, Homo sapiens
agaatgtgttcttttctcctt

SEQ ID NO: 1466865 - DNA, 22 bp, Homo sapiens
agaatgttcctactcacacttc

SEQ ID NO: 1466866 - DNA, 17 bp, Homo sapiens
agaatgttgtacttgaa

SEQ ID NO: 1466867 - DNA, 15 bp, Homo sapiens
agaatgttgtattca

SEQ ID NO: 1466868 - DNA, 19 bp, Homo sapiens
agaatgttgtattcagtga

SEQ ID NO: 1466869 - DNA, 23 bp, Homo sapiens
agaatgtttggcactctctaacg

SEQ ID NO: 1466870 - DNA, 18 bp, Homo sapiens
agaatgttttactgtgaa

SEQ ID NO: 1466871 - DNA, 20 bp, Homo sapiens
agaattaaacttttaattca

SEQ ID NO: 1466872 - DNA, 22 bp, Homo sapiens
agaattaactataacaatcact

SEQ ID NO: 1466873 - DNA, 22 bp, Homo sapiens
agaattaagcagaacactgcag

SEQ ID NO: 1466874 - DNA, 21 bp, Homo sapiens
agaattaagccctaaggtcct

SEQ ID NO: 1466875 - DNA, 15 bp, Homo sapiens
agaattaccattaat

SEQ ID NO: 1466876 - DNA, 19 bp, Homo sapiens
agaattacccctatacctg

SEQ ID NO: 1466877 - DNA, 20 bp, Homo sapiens
agaattagatttctatagga

SEQ ID NO: 1466878 - DNA, 17 bp, Homo sapiens
agaattagtgccagaat

SEQ ID NO: 1466879 - DNA, 14 bp, Homo sapiens
agaattatctaatt

SEQ ID NO: 1466880 - DNA, 21 bp, Homo sapiens
agaattatgtaatatattgta

SEQ ID NO: 1466881 - DNA, 19 bp, Homo sapiens
agaattatttttaaaaaga

SEQ ID NO: 1466882 - DNA, 23 bp, Homo sapiens
agaattatttttaaaaagaaatc

SEQ ID NO: 1466883 - DNA, 21 bp, Homo sapiens
agaattatttttgtgtttcta

SEQ ID NO: 1466884 - DNA, 15 bp, Homo sapiens
agaattcccttgaat

SEQ ID NO: 1466885 - DNA, 21 bp, Homo sapiens
agaattccttcgaaaggcctt

SEQ ID NO: 1466886 - DNA, 18 bp, Homo sapiens
agaattcggtgtgctgcc

SEQ ID NO: 1466887 - DNA, 17 bp, Homo sapiens
agaattctagaaataaa

SEQ ID NO: 1466888 - DNA, 18 bp, Homo sapiens
agaattctagtgctgctg

SEQ ID NO: 1466889 - DNA, 23 bp, Homo sapiens
agaattctagtgctgctgaagat

SEQ ID NO: 1466890 - DNA, 18 bp, Homo sapiens
agaattgaacccaggagg

SEQ ID NO: 1466891 - DNA, 21 bp, Homo sapiens
agaattgactgaagcacagca

SEQ ID NO: 1466892 - DNA, 17 bp, Homo sapiens
agaattgagtaatggtg

SEQ ID NO: 1466893 - DNA, 23 bp, Homo sapiens
agaattgcttgagcttgggaagt

SEQ ID NO: 1466894 - DNA, 21 bp, Homo sapiens
agaattggagagtaaaaactg

SEQ ID NO: 1466895 - DNA, 16 bp, Homo sapiens
agaattggtaaaaaca

SEQ ID NO: 1466896 - DNA, 21 bp, Homo sapiens
agaatttatcacacttctgtg

SEQ ID NO: 1466897 - DNA, 21 bp, Homo sapiens
agaatttattcaattcctctg

SEQ ID NO: 1466898 - DNA, 16 bp, Homo sapiens
agaatttctgctaaat

SEQ ID NO: 1466899 - DNA, 21 bp, Homo sapiens
agaatttcttggtaagaagcc

SEQ ID NO: 1466900 - DNA, 14 bp, Homo sapiens
agaatttgaattat

SEQ ID NO: 1466901 - DNA, 12 bp, Homo sapiens
agaatttgagaa

SEQ ID NO: 1466902 - DNA, 20 bp, Homo sapiens
agaatttgagaaccttggac

SEQ ID NO: 1466903 - DNA, 18 bp, Homo sapiens
agaattttaaattataac

SEQ ID NO: 1466904 - DNA, 13 bp, Homo sapiens
agaattttaatgt

SEQ ID NO: 1466905 - DNA, 16 bp, Homo sapiens
agaattttaatgtgaa

SEQ ID NO: 1466906 - DNA, 23 bp, Homo sapiens
agaattttaatgtgaagacattt

SEQ ID NO: 1466907 - DNA, 19 bp, Homo sapiens
agaattttatatcattgga

SEQ ID NO: 1466908 - DNA, 15 bp, Homo sapiens
agaattttcatcccg

SEQ ID NO: 1466909 - DNA, 18 bp, Homo sapiens
agaattttgagtattcca

SEQ ID NO: 1466910 - DNA, 12 bp, Homo sapiens
agaattttgtat

SEQ ID NO: 1466911 - DNA, 12 bp, Homo sapiens
agacaaaaacaa

SEQ ID NO: 1466912 - DNA, 17 bp, Homo sapiens
agacaaaaacagcctca

SEQ ID NO: 1466913 - DNA, 18 bp, Homo sapiens
agacaaaaagacaaacat

SEQ ID NO: 1466914 - DNA, 14 bp, Homo sapiens
agacaaaaagtata

SEQ ID NO: 1466915 - DNA, 14 bp, Homo sapiens
agacaaaaatcaaa

SEQ ID NO: 1466916 - DNA, 15 bp, Homo sapiens
agacaaaatttgaga

SEQ ID NO: 1466917 - DNA, 15 bp, Homo sapiens
agacaaagatttctt

SEQ ID NO: 1466918 - DNA, 16 bp, Homo sapiens
agacaaagatttcttc

SEQ ID NO: 1466919 - DNA, 14 bp, Homo sapiens
agacaaaggaggaa

SEQ ID NO: 1466920 - DNA, 19 bp, Homo sapiens
agacaaaggaggaatttac

SEQ ID NO: 1466921 - DNA, 14 bp, Homo sapiens
agacaaatggagga

SEQ ID NO: 1466922 - DNA, 14 bp, Homo sapiens
agacaaatgggact

SEQ ID NO: 1466923 - DNA, 16 bp, Homo sapiens
agacaaatgggactga

SEQ ID NO: 1466924 - DNA, 19 bp, Homo sapiens
agacaaatgggactgatgt

SEQ ID NO: 1466925 - DNA, 13 bp, Homo sapiens
agacaacaaaaga

SEQ ID NO: 1466926 - DNA, 16 bp, Homo sapiens
agacaacaaaagaaat

SEQ ID NO: 1466927 - DNA, 13 bp, Homo sapiens
agacaacagaagt

SEQ ID NO: 1466928 - DNA, 18 bp, Homo sapiens
agacaactagatttgtcc

SEQ ID NO: 1466929 - DNA, 20 bp, Homo sapiens
agacaagaaaggcagacaca

SEQ ID NO: 1466930 - DNA, 15 bp, Homo sapiens
agacaagaagcaaat

SEQ ID NO: 1466931 - DNA, 17 bp, Homo sapiens
agacaagagatctacac

SEQ ID NO: 1466932 - DNA, 20 bp, Homo sapiens
agacattttgtgtgagactt

SEQ ID NO: 1466933 - DNA, 13 bp, Homo sapiens
agacatttttatt

SEQ ID NO: 1466934 - DNA, 22 bp, Homo sapiens
agacatttttccgtttgctttt

SEQ ID NO: 1466935 - DNA, 15 bp, Homo sapiens
agacattttttgcta

SEQ ID NO: 1466936 - DNA, 22 bp, Homo sapiens
agaccaaatctcagttgtttgc

SEQ ID NO: 1466937 - DNA, 16 bp, Homo sapiens
agaccaataaatttgt

SEQ ID NO: 1466938 - DNA, 13 bp, Homo sapiens
agaccacagacgg

SEQ ID NO: 1466939 - DNA, 14 bp, Homo sapiens
agaccaccccgcct

SEQ ID NO: 1466940 - DNA, 19 bp, Homo sapiens
agaccacgcccgtcctgcc

SEQ ID NO: 1466941 - DNA, 19 bp, Homo sapiens
agaccagaattcccttgaa

SEQ ID NO: 1466942 - DNA, 23 bp, Homo sapiens
agaccagaattcccttgaattgt

SEQ ID NO: 1466943 - DNA, 15 bp, Homo sapiens
agaccagcagacaga

SEQ ID NO: 1466944 - DNA, 16 bp, Homo sapiens
agaccagcagacagag

SEQ ID NO: 1466945 - DNA, 21 bp, Homo sapiens
agaccagcagacagagccagg

SEQ ID NO: 1466946 - DNA, 11 bp, Homo sapiens
agaccagctca

SEQ ID NO: 1466947 - DNA, 14 bp, Homo sapiens
agaccagctcagag

SEQ ID NO: 1466948 - DNA, 13 bp, Homo sapiens
agaccaggaaagg

SEQ ID NO: 1466949 - DNA, 13 bp, Homo sapiens
agaccaggctgca

SEQ ID NO: 1466950 - DNA, 15 bp, Homo sapiens
agaccaggctgcagc

SEQ ID NO: 1466951 - DNA, 16 bp, Homo sapiens
agaccaggctgtgtcc

SEQ ID NO: 1466952 - DNA, 15 bp, Homo sapiens
agaccagggagcctt

SEQ ID NO: 1466953 - DNA, 12 bp, Homo sapiens
agaccagggctc

SEQ ID NO: 1466954 - DNA, 22 bp, Homo sapiens
agaccagttgaataaaagtgca

SEQ ID NO: 1466955 - DNA, 13 bp, Homo sapiens
agaccagttggga

SEQ ID NO: 1466956 - DNA, 19 bp, Homo sapiens
agaccagttgggagcactg

SEQ ID NO: 1466957 - DNA, 21 bp, Homo sapiens
agaccagttgggagcactgga

SEQ ID NO: 1466958 - DNA, 23 bp, Homo sapiens
agaccagttgggagcactggagt

SEQ ID NO: 1466959 - DNA, 13 bp, Homo sapiens
agaccataatgtt

SEQ ID NO: 1466960 - DNA, 16 bp, Homo sapiens
agaccatattacctgg

SEQ ID NO: 1466961 - DNA, 19 bp, Homo sapiens
agaccatattacctggatt

SEQ ID NO: 1466962 - DNA, 21 bp, Homo sapiens
agaccatcctggccaacatga

SEQ ID NO: 1466963 - DNA, 21 bp, Homo sapiens
agaccatcctggcccctccag

SEQ ID NO: 1466964 - DNA, 21 bp, Homo sapiens
agaccatgaagtaaattatgt

SEQ ID NO: 1466965 - DNA, 13 bp, Homo sapiens
agaccatgccaga

SEQ ID NO: 1466966 - DNA, 17 bp, Homo sapiens
agaccatgtcttatctt

SEQ ID NO: 1466967 - DNA, 21 bp, Homo sapiens
agacccaacagcaaaggaact

SEQ ID NO: 1466968 - DNA, 23 bp, Homo sapiens
agacccagagaaggacggtgcca

SEQ ID NO: 1466969 - DNA, 13 bp, Homo sapiens
agacccagatctc

SEQ ID NO: 1466970 - DNA, 15 bp, Homo sapiens
agacccagccgccgc

SEQ ID NO: 1466971 - DNA, 17 bp, Homo sapiens
agaccccacgctgacca

SEQ ID NO: 1466972 - DNA, 13 bp, Homo sapiens
agacccccactct

SEQ ID NO: 1466973 - DNA, 16 bp, Homo sapiens
agacccccatccagcc

SEQ ID NO: 1466974 - DNA, 19 bp, Homo sapiens
agacccccatccagcctcc

SEQ ID NO: 1466975 - DNA, 22 bp, Homo sapiens
agacccccatccagcctccagg

SEQ ID NO: 1466976 - DNA, 23 bp, Homo sapiens
agacccccccatttcccgcacat

SEQ ID NO: 1466977 - DNA, 18 bp, Homo sapiens
agaccccgcacccggctc

SEQ ID NO: 1466978 - DNA, 19 bp, Homo sapiens
agaccccgggtctccttgg

SEQ ID NO: 1466979 - DNA, 13 bp, Homo sapiens
agacccctgtctt

SEQ ID NO: 1466980 - DNA, 15 bp, Homo sapiens
agacccgggaaggaa

SEQ ID NO: 1466981 - DNA, 12 bp, Homo sapiens
agaccctcgggc

SEQ ID NO: 1466982 - DNA, 19 bp, Homo sapiens
agaccctcgggccccatcc

SEQ ID NO: 1466983 - DNA, 19 bp, Homo sapiens
agaccctcttgcccatcct

SEQ ID NO: 1466984 - DNA, 16 bp, Homo sapiens
agaccctctttcttgt

SEQ ID NO: 1466985 - DNA, 22 bp, Homo sapiens
agaccctctttcttgtttgtca

SEQ ID NO: 1466986 - DNA, 13 bp, Homo sapiens
agaccctgagact

SEQ ID NO: 1466987 - DNA, 18 bp, Homo sapiens
agaccctgagactccaga

SEQ ID NO: 1466988 - DNA, 11 bp, Homo sapiens
agaccctgcct

SEQ ID NO: 1466989 - DNA, 15 bp, Homo sapiens
agaccctgcctgagc

SEQ ID NO: 1466990 - DNA, 22 bp, Homo sapiens
agaccctggaattcagcaccct

SEQ ID NO: 1466991 - DNA, 22 bp, Homo sapiens
agaccctgggtgggctctgtgc

SEQ ID NO: 1466992 - DNA, 20 bp, Homo sapiens
agaccctgtgtcctccacca

SEQ ID NO: 1466993 - DNA, 15 bp, Homo sapiens
agacccttttctcag

SEQ ID NO: 1466994 - DNA, 17 bp, Homo sapiens
agaccgcttcacccctg

SEQ ID NO: 1466995 - DNA, 20 bp, Homo sapiens
agaccgcttcacccctgcac

SEQ ID NO: 1466996 - DNA, 18 bp, Homo sapiens
agaccgtcgggggctgag

SEQ ID NO: 1466997 - DNA, 14 bp, Homo sapiens
agacctaagccctg

SEQ ID NO: 1466998 - DNA, 12 bp, Homo sapiens
agacctcagcct

SEQ ID NO: 1466999 - DNA, 20 bp, Homo sapiens
agacctcagtgccttcctgt

SEQ ID NO: 1467000 - DNA, 20 bp, Homo sapiens
agacctcatctgtggagctg

SEQ ID NO: 1467001 - DNA, 19 bp, Homo sapiens
agacctcatgcccagctct

SEQ ID NO: 1467002 - DNA, 23 bp, Homo sapiens
agacctcatgcccagctctctga

SEQ ID NO: 1467003 - DNA, 13 bp, Homo sapiens
agacctctgccta

SEQ ID NO: 1467004 - DNA, 17 bp, Homo sapiens
agacctcttccctctgg

SEQ ID NO: 1467005 - DNA, 22 bp, Homo sapiens
agacctcttccctctgggcctg

SEQ ID NO: 1467006 - DNA, 15 bp, Homo sapiens
agacctgaattcttt

SEQ ID NO: 1467007 - DNA, 19 bp, Homo sapiens
agacctgacaccgtccctc

SEQ ID NO: 1467008 - DNA, 22 bp, Homo sapiens
agacctgacaccgtccctcagt

SEQ ID NO: 1467009 - DNA, 23 bp, Homo sapiens
agacctgacaccgtccctcagtg

SEQ ID NO: 1467010 - DNA, 14 bp, Homo sapiens
agacctgagtattt

SEQ ID NO: 1467011 - DNA, 15 bp, Homo sapiens
agacctgagtatttt

SEQ ID NO: 1467012 - DNA, 22 bp, Homo sapiens
agacctgagtattttttataat

SEQ ID NO: 1467013 - DNA, 14 bp, Homo sapiens
agacctgatcctgg

SEQ ID NO: 1467014 - DNA, 19 bp, Homo sapiens
agacctgatcctggaggcc

SEQ ID NO: 1467015 - DNA, 13 bp, Homo sapiens
agacctgcctgtg

SEQ ID NO: 1467016 - DNA, 15 bp, Homo sapiens
agacctggaaccaga

SEQ ID NO: 1467017 - DNA, 16 bp, Homo sapiens
agacctggagcccctg

SEQ ID NO: 1467018 - DNA, 22 bp, Homo sapiens
agacctggagcccctgggtggg

SEQ ID NO: 1467019 - DNA, 15 bp, Homo sapiens
agacctggcagctct

SEQ ID NO: 1467020 - DNA, 17 bp, Homo sapiens
agacctgggatttgaga

SEQ ID NO: 1467021 - DNA, 18 bp, Homo sapiens
agacctgggatttgagat

SEQ ID NO: 1467022 - DNA, 15 bp, Homo sapiens
agacctgtcttccaa

SEQ ID NO: 1467023 - DNA, 19 bp, Homo sapiens
agacctgtgctagttttac

SEQ ID NO: 1467024 - DNA, 15 bp, Homo sapiens
agacctgtgtgaact

SEQ ID NO: 1467025 - DNA, 18 bp, Homo sapiens
agacctttattcacccct

SEQ ID NO: 1467026 - DNA, 20 bp, Homo sapiens
agacctttattcacccctgc

SEQ ID NO: 1467027 - DNA, 20 bp, Homo sapiens
agacctttgaggatatcaaa

SEQ ID NO: 1467028 - DNA, 21 bp, Homo sapiens
agacgaggggcagggaaggac

SEQ ID NO: 1467029 - DNA, 12 bp, Homo sapiens
agacgcagtccg

SEQ ID NO: 1467030 - DNA, 14 bp, Homo sapiens
agacgccttactgg

SEQ ID NO: 1467031 - DNA, 15 bp, Homo sapiens
agacgctgctgtcac

SEQ ID NO: 1467032 - DNA, 23 bp, Homo sapiens
agacggaagtaaattatgatgtc

SEQ ID NO: 1467033 - DNA, 13 bp, Homo sapiens
agacggaggaggg

SEQ ID NO: 1467034 - DNA, 18 bp, Homo sapiens
agacggaggaggggaagg

SEQ ID NO: 1467035 - DNA, 16 bp, Homo sapiens
agacggaggggagtag

SEQ ID NO: 1467036 - DNA, 18 bp, Homo sapiens
agacggagtctctcactg

SEQ ID NO: 1467037 - DNA, 16 bp, Homo sapiens
agacggcggccaggca

SEQ ID NO: 1467038 - DNA, 21 bp, Homo sapiens
agacggcggccaggcacaggg

SEQ ID NO: 1467039 - DNA, 17 bp, Homo sapiens
agacgggcacagacacg

SEQ ID NO: 1467040 - DNA, 15 bp, Homo sapiens
agacgggttgaaaga

SEQ ID NO: 1467041 - DNA, 20 bp, Homo sapiens
agacgggttgaaagacatca

SEQ ID NO: 1467042 - DNA, 21 bp, Homo sapiens
agacgggttgaaagacatcaa

SEQ ID NO: 1467043 - DNA, 16 bp, Homo sapiens
agacggtgttttgcca

SEQ ID NO: 1467044 - DNA, 22 bp, Homo sapiens
agacgtgcagcgcccctctgca

SEQ ID NO: 1467045 - DNA, 18 bp, Homo sapiens
agacgtttggactgattt

SEQ ID NO: 1467046 - DNA, 22 bp, Homo sapiens
agactagaattctagtgctgct

SEQ ID NO: 1467047 - DNA, 20 bp, Homo sapiens
agagaggcgttagtgggcag

SEQ ID NO: 1467048 - DNA, 16 bp, Homo sapiens
agagaggctgcctcag

SEQ ID NO: 1467049 - DNA, 16 bp, Homo sapiens
agagagggactcaagg

SEQ ID NO: 1467050 - DNA, 14 bp, Homo sapiens
agagagggcccagc

SEQ ID NO: 1467051 - DNA, 19 bp, Homo sapiens
agagaggggaaagtgtgag

SEQ ID NO: 1467052 - DNA, 17 bp, Homo sapiens
agagaggggcctgcagg

SEQ ID NO: 1467053 - DNA, 15 bp, Homo sapiens
agagagggggctctc

SEQ ID NO: 1467054 - DNA, 19 bp, Homo sapiens
agagagtgagcatgagctc

SEQ ID NO: 1467055 - DNA, 17 bp, Homo sapiens
agagagtggctcctccc

SEQ ID NO: 1467056 - DNA, 16 bp, Homo sapiens
agagagtggggcctgc

SEQ ID NO: 1467057 - DNA, 20 bp, Homo sapiens
agagagttagcatgtatgaa

SEQ ID NO: 1467058 - DNA, 14 bp, Homo sapiens
agagataattgctt

SEQ ID NO: 1467059 - DNA, 21 bp, Homo sapiens
agagataggaaactgaagcat

SEQ ID NO: 1467060 - DNA, 15 bp, Homo sapiens
agagatccctgcaga

SEQ ID NO: 1467061 - DNA, 20 bp, Homo sapiens
agagatccctgcagaaccca

SEQ ID NO: 1467062 - DNA, 18 bp, Homo sapiens
agagatctacacatgttg

SEQ ID NO: 1467063 - DNA, 19 bp, Homo sapiens
agagatctacacatgttgc

SEQ ID NO: 1467064 - DNA, 12 bp, Homo sapiens
agagatctgtgt

SEQ ID NO: 1467065 - DNA, 17 bp, Homo sapiens
agagatctgtgtggctc

SEQ ID NO: 1467066 - DNA, 16 bp, Homo sapiens
agagatgcctccaccg

SEQ ID NO: 1467067 - DNA, 21 bp, Homo sapiens
agagatgcctccaccgctgcc

SEQ ID NO: 1467068 - DNA, 14 bp, Homo sapiens
agagatgggatgct

SEQ ID NO: 1467069 - DNA, 13 bp, Homo sapiens
agagatgtgtcca

SEQ ID NO: 1467070 - DNA, 14 bp, Homo sapiens
agagatgtttacag

SEQ ID NO: 1467071 - DNA, 16 bp, Homo sapiens
agagatgtttacagta

SEQ ID NO: 1467072 - DNA, 20 bp, Homo sapiens
agagattctgtgatctttta

SEQ ID NO: 1467073 - DNA, 13 bp, Homo sapiens
agagatttaatta

SEQ ID NO: 1467074 - DNA, 18 bp, Homo sapiens
agagatttcaacaagaat

SEQ ID NO: 1467075 - DNA, 21 bp, Homo sapiens
agagatttcctccatggtgga

SEQ ID NO: 1467076 - DNA, 14 bp, Homo sapiens
agagatttggggct

SEQ ID NO: 1467077 - DNA, 21 bp, Homo sapiens
agagatttggggctaaagact

SEQ ID NO: 1467078 - DNA, 22 bp, Homo sapiens
agagatttggggctaaagactg

SEQ ID NO: 1467079 - DNA, 17 bp, Homo sapiens
agagatttgtctaattg

SEQ ID NO: 1467080 - DNA, 20 bp, Homo sapiens
agagcaaaagcctcagaaag

SEQ ID NO: 1467081 - DNA, 15 bp, Homo sapiens
agagcaaaatgctct

SEQ ID NO: 1467082 - DNA, 22 bp, Homo sapiens
agagcaaaatgctcttgtccct

SEQ ID NO: 1467083 - DNA, 15 bp, Homo sapiens
agagcaaagcgccca

SEQ ID NO: 1467084 - DNA, 21 bp, Homo sapiens
agagcaaagcgcccacccagg

SEQ ID NO: 1467085 - DNA, 19 bp, Homo sapiens
agagcaaatgcaaaaataa

SEQ ID NO: 1467086 - DNA, 22 bp, Homo sapiens
agagcaaatgcaaaaataacca

SEQ ID NO: 1467087 - DNA, 15 bp, Homo sapiens
agagcaacccctgta

SEQ ID NO: 1467088 - DNA, 21 bp, Homo sapiens
agagcaacccctgtacccagc

SEQ ID NO: 1467089 - DNA, 21 bp, Homo sapiens
agagcaagaaggaaagatttg

SEQ ID NO: 1467090 - DNA, 18 bp, Homo sapiens
agagcaagaccccatctc

SEQ ID NO: 1467091 - DNA, 14 bp, Homo sapiens
agagcaagactctg

SEQ ID NO: 1467092 - DNA, 21 bp, Homo sapiens
agagcaaggaaggtaaaaagt

SEQ ID NO: 1467093 - DNA, 14 bp, Homo sapiens
agagcaagtctgga

SEQ ID NO: 1467094 - DNA, 20 bp, Homo sapiens
agagcaattccaggctgagc

SEQ ID NO: 1467095 - DNA, 22 bp, Homo sapiens
agagcaattccaggctgagcca

SEQ ID NO: 1467096 - DNA, 14 bp, Homo sapiens
agagcacactgtag

SEQ ID NO: 1467097 - DNA, 15 bp, Homo sapiens
agagcaccccctgct

SEQ ID NO: 1467098 - DNA, 22 bp, Homo sapiens
agagcaccccctgctccaccag

SEQ ID NO: 1467099 - DNA, 14 bp, Homo sapiens
agagcacgcctgcc

SEQ ID NO: 1467100 - DNA, 14 bp, Homo sapiens
agagcagaaattct

SEQ ID NO: 1467101 - DNA, 20 bp, Homo sapiens
agagcagaaattctgttttt

SEQ ID NO: 1467102 - DNA, 14 bp, Homo sapiens
agagcagaggcagc

SEQ ID NO: 1467103 - DNA, 12 bp, Homo sapiens
agagcagaggtc

SEQ ID NO: 1467104 - DNA, 20 bp, Homo sapiens
agagcagatttctatggtac

SEQ ID NO: 1467105 - DNA, 12 bp, Homo sapiens
agagcagcagca

SEQ ID NO: 1467106 - DNA, 14 bp, Homo sapiens
agagcagcaggtgc

SEQ ID NO: 1467107 - DNA, 12 bp, Homo sapiens
agagcagcctga

SEQ ID NO: 1467108 - DNA, 19 bp, Homo sapiens
agagcagcctgatggccaa

SEQ ID NO: 1467109 - DNA, 12 bp, Homo sapiens
agagcagcctgt

SEQ ID NO: 1467110 - DNA, 16 bp, Homo sapiens
agagcagcctgtggca

SEQ ID NO: 1467111 - DNA, 17 bp, Homo sapiens
agagcagcctgtggcat

SEQ ID NO: 1467112 - DNA, 19 bp, Homo sapiens
agagcagcctgtggcatct

SEQ ID NO: 1467113 - DNA, 18 bp, Homo sapiens
agagcagctaactccgag

SEQ ID NO: 1467114 - DNA, 22 bp, Homo sapiens
agagcaggaaggacaggaagct

SEQ ID NO: 1467115 - DNA, 13 bp, Homo sapiens
agagcaggactcc

SEQ ID NO: 1467116 - DNA, 15 bp, Homo sapiens
agagcaggactccag

SEQ ID NO: 1467117 - DNA, 12 bp, Homo sapiens
agagcaggcaca

SEQ ID NO: 1467118 - DNA, 20 bp, Homo sapiens
agagcaggcacatggaggag

SEQ ID NO: 1467119 - DNA, 18 bp, Homo sapiens
agagcaggccagcccgga

SEQ ID NO: 1467120 - DNA, 22 bp, Homo sapiens
agagcaggtgactgtgctgtgc

SEQ ID NO: 1467121 - DNA, 21 bp, Homo sapiens
agagcagttggccaagcagaa

SEQ ID NO: 1467122 - DNA, 19 bp, Homo sapiens
agagcatcgtgacccttca

SEQ ID NO: 1467123 - DNA, 21 bp, Homo sapiens
agagcatcgtgacccttcagg

SEQ ID NO: 1467124 - DNA, 19 bp, Homo sapiens
agagcattgaattggagag

SEQ ID NO: 1467125 - DNA, 13 bp, Homo sapiens
agagccaacctgg

SEQ ID NO: 1467126 - DNA, 21 bp, Homo sapiens
agagccaacctggacttcctg

SEQ ID NO: 1467127 - DNA, 23 bp, Homo sapiens
agagccaacctggacttcctgtc

SEQ ID NO: 1467128 - DNA, 20 bp, Homo sapiens
agagccaagacggaggaggg

SEQ ID NO: 1467129 - DNA, 15 bp, Homo sapiens
agagccaagcactgc

SEQ ID NO: 1467130 - DNA, 23 bp, Homo sapiens
agagccacaggccccttttgtgg

SEQ ID NO: 1467131 - DNA, 10 bp, Homo sapiens
agagccacct

SEQ ID NO: 1467132 - DNA, 12 bp, Homo sapiens
agagccacctgc

SEQ ID NO: 1467133 - DNA, 23 bp, Homo sapiens
agagccactttcaagctgcactg

SEQ ID NO: 1467134 - DNA, 16 bp, Homo sapiens
agagccagatgcctcc

SEQ ID NO: 1467135 - DNA, 17 bp, Homo sapiens
agagccagatgcctccc

SEQ ID NO: 1467136 - DNA, 14 bp, Homo sapiens
agagccagccctcc

SEQ ID NO: 1467137 - DNA, 17 bp, Homo sapiens
agagccagccctccctg

SEQ ID NO: 1467138 - DNA, 19 bp, Homo sapiens
agagccagcctggctctgc

SEQ ID NO: 1467139 - DNA, 15 bp, Homo sapiens
agagccagcctggga

SEQ ID NO: 1467140 - DNA, 17 bp, Homo sapiens
agagccagcctgggact

SEQ ID NO: 1467141 - DNA, 18 bp, Homo sapiens
agagccagcctgggactc

SEQ ID NO: 1467142 - DNA, 15 bp, Homo sapiens
agagccagcggctcc

SEQ ID NO: 1467143 - DNA, 18 bp, Homo sapiens
agagccagcggctccaac

SEQ ID NO: 1467144 - DNA, 12 bp, Homo sapiens
agagccaggaga

SEQ ID NO: 1467145 - DNA, 19 bp, Homo sapiens
agagccaggagaagctcag

SEQ ID NO: 1467146 - DNA, 19 bp, Homo sapiens
agagccatgggcctgggcc

SEQ ID NO: 1467147 - DNA, 20 bp, Homo sapiens
agagccatgggcctgggcct

SEQ ID NO: 1467148 - DNA, 22 bp, Homo sapiens
agagccatgggcctgggcctgc

SEQ ID NO: 1467149 - DNA, 18 bp, Homo sapiens
agagcccagctcttgctc

SEQ ID NO: 1467150 - DNA, 22 bp, Homo sapiens
agagcccagctcttgctctctt

SEQ ID NO: 1467151 - DNA, 21 bp, Homo sapiens
agagcccatgctcaaccactg

SEQ ID NO: 1467152 - DNA, 15 bp, Homo sapiens
agagccccacacgga

SEQ ID NO: 1467153 - DNA, 17 bp, Homo sapiens
agagccccacacggagg

SEQ ID NO: 1467154 - DNA, 13 bp, Homo sapiens
agagcccccagcc

SEQ ID NO: 1467155 - DNA, 14 bp, Homo sapiens
agagcccccagccc

SEQ ID NO: 1467156 - DNA, 15 bp, Homo sapiens
agagcccccagccct

SEQ ID NO: 1467157 - DNA, 19 bp, Homo sapiens
agagcccccagccctggga

SEQ ID NO: 1467158 - DNA, 18 bp, Homo sapiens
agagcccgcgtgctggag

SEQ ID NO: 1467159 - DNA, 20 bp, Homo sapiens
agagcccgcgtgctggagaa

SEQ ID NO: 1467160 - DNA, 18 bp, Homo sapiens
agagcccgtcgcgctgga

SEQ ID NO: 1467161 - DNA, 22 bp, Homo sapiens
agagcccgtcgcgctggacagc

SEQ ID NO: 1467162 - DNA, 15 bp, Homo sapiens
agagtaaaaactgaa

SEQ ID NO: 1467163 - DNA, 15 bp, Homo sapiens
agagtaagcagtgtt

SEQ ID NO: 1467164 - DNA, 14 bp, Homo sapiens
agagtaatgggttt

SEQ ID NO: 1467165 - DNA, 17 bp, Homo sapiens
agagtaatgggtttcat

SEQ ID NO: 1467166 - DNA, 18 bp, Homo sapiens
agagtagaggtataattg

SEQ ID NO: 1467167 - DNA, 13 bp, Homo sapiens
agagtagccgaga

SEQ ID NO: 1467168 - DNA, 19 bp, Homo sapiens
agagtagccgagagcctgc

SEQ ID NO: 1467169 - DNA, 22 bp, Homo sapiens
agagtagccgagagcctgctcc

SEQ ID NO: 1467170 - DNA, 23 bp, Homo sapiens
agagtagccgagagcctgctccc

SEQ ID NO: 1467171 - DNA, 14 bp, Homo sapiens
agagtagtttttca

SEQ ID NO: 1467172 - DNA, 17 bp, Homo sapiens
agagtatccttccttca

SEQ ID NO: 1467173 - DNA, 12 bp, Homo sapiens
agagtatttccc

SEQ ID NO: 1467174 - DNA, 20 bp, Homo sapiens
agagtatttcccttccaaag

SEQ ID NO: 1467175 - DNA, 22 bp, Homo sapiens
agagtatttttaacacttaaat

SEQ ID NO: 1467176 - DNA, 15 bp, Homo sapiens
agagtatttttgaca

SEQ ID NO: 1467177 - DNA, 17 bp, Homo sapiens
agagtatttttgacaga

SEQ ID NO: 1467178 - DNA, 15 bp, Homo sapiens
agagtcaaggcctgc

SEQ ID NO: 1467179 - DNA, 16 bp, Homo sapiens
agagtcaaggcctgct

SEQ ID NO: 1467180 - DNA, 18 bp, Homo sapiens
agagtcagctctctgccc

SEQ ID NO: 1467181 - DNA, 20 bp, Homo sapiens
agagtcagctctctgccctg

SEQ ID NO: 1467182 - DNA, 21 bp, Homo sapiens
agagtcagctctctgccctgt

SEQ ID NO: 1467183 - DNA, 19 bp, Homo sapiens
agagtcatctccatcagct

SEQ ID NO: 1467184 - DNA, 14 bp, Homo sapiens
agagtcattgtaat

SEQ ID NO: 1467185 - DNA, 21 bp, Homo sapiens
agagtccaggaggccctggtc

SEQ ID NO: 1467186 - DNA, 21 bp, Homo sapiens
agagtcccagagcaggaggcc

SEQ ID NO: 1467187 - DNA, 19 bp, Homo sapiens
agagtccggatttctaaca

SEQ ID NO: 1467188 - DNA, 17 bp, Homo sapiens
agagtcctcattataaa

SEQ ID NO: 1467189 - DNA, 13 bp, Homo sapiens
agagtctagattc

SEQ ID NO: 1467190 - DNA, 21 bp, Homo sapiens
agagtctagattcaaaggttc

SEQ ID NO: 1467191 - DNA, 13 bp, Homo sapiens
agagtctgagccc

SEQ ID NO: 1467192 - DNA, 15 bp, Homo sapiens
agagtctgagccccc

SEQ ID NO: 1467193 - DNA, 15 bp, Homo sapiens
agagtcttgctctgt

SEQ ID NO: 1467194 - DNA, 16 bp, Homo sapiens
agagtgaaagggctat

SEQ ID NO: 1467195 - DNA, 17 bp, Homo sapiens
agagtgaaagggctatg

SEQ ID NO: 1467196 - DNA, 15 bp, Homo sapiens
agagtgaagaatctt

SEQ ID NO: 1467197 - DNA, 14 bp, Homo sapiens
agagtgaagggaag

SEQ ID NO: 1467198 - DNA, 15 bp, Homo sapiens
agagtgagctctggt

SEQ ID NO: 1467199 - DNA, 16 bp, Homo sapiens
agagtgattgcagctt

SEQ ID NO: 1467200 - DNA, 17 bp, Homo sapiens
agagtggaaactcagcc

SEQ ID NO: 1467201 - DNA, 18 bp, Homo sapiens
agagtggaaactcagccg

SEQ ID NO: 1467202 - DNA, 15 bp, Homo sapiens
agagtggactgcatt

SEQ ID NO: 1467203 - DNA, 17 bp, Homo sapiens
agagtggactgcattta

SEQ ID NO: 1467204 - DNA, 23 bp, Homo sapiens
agagtggaggaggaggaggagcc

SEQ ID NO: 1467205 - DNA, 18 bp, Homo sapiens
agagtggagtctgagtct

SEQ ID NO: 1467206 - DNA, 12 bp, Homo sapiens
agagtggcctcc

SEQ ID NO: 1467207 - DNA, 15 bp, Homo sapiens
agagtggcctccctg

SEQ ID NO: 1467208 - DNA, 22 bp, Homo sapiens
agagtggcctccctgctgtgcc

SEQ ID NO: 1467209 - DNA, 11 bp, Homo sapiens
agagtggcctg

SEQ ID NO: 1467210 - DNA, 12 bp, Homo sapiens
agagtggcctgg

SEQ ID NO: 1467211 - DNA, 13 bp, Homo sapiens
agagtggcctggc

SEQ ID NO: 1467212 - DNA, 15 bp, Homo sapiens
agagtggcctggcca

SEQ ID NO: 1467213 - DNA, 22 bp, Homo sapiens
agagtggcctggccaggagctc

SEQ ID NO: 1467214 - DNA, 14 bp, Homo sapiens
agagtggctcctcc

SEQ ID NO: 1467215 - DNA, 14 bp, Homo sapiens
agagtgggccccgg

SEQ ID NO: 1467216 - DNA, 20 bp, Homo sapiens
agagtgggccccgggctgga

SEQ ID NO: 1467217 - DNA, 19 bp, Homo sapiens
agagtggggtaggttggga

SEQ ID NO: 1467218 - DNA, 20 bp, Homo sapiens
agagtgggtcttggaccagg

SEQ ID NO: 1467219 - DNA, 22 bp, Homo sapiens
agagtgggtcttggaccagggc

SEQ ID NO: 1467220 - DNA, 15 bp, Homo sapiens
agagtggtatttgca

SEQ ID NO: 1467221 - DNA, 11 bp, Homo sapiens
agagtgtagct

SEQ ID NO: 1467222 - DNA, 12 bp, Homo sapiens
agagtgtagctg

SEQ ID NO: 1467223 - DNA, 14 bp, Homo sapiens
agagtgtagctgta

SEQ ID NO: 1467224 - DNA, 21 bp, Homo sapiens
agagtgtagctgtaagggcag

SEQ ID NO: 1467225 - DNA, 23 bp, Homo sapiens
agagtgtagctgtaagggcagtg

SEQ ID NO: 1467226 - DNA, 21 bp, Homo sapiens
agagttaaaatgtttactgta

SEQ ID NO: 1467227 - DNA, 22 bp, Homo sapiens
agagttaaaatgtttactgtaa

SEQ ID NO: 1467228 - DNA, 22 bp, Homo sapiens
agagttaacaatgatatatgga

SEQ ID NO: 1467229 - DNA, 13 bp, Homo sapiens
agagttaagaatg

SEQ ID NO: 1467230 - DNA, 22 bp, Homo sapiens
agagttacaataaagtttacaa

SEQ ID NO: 1467231 - DNA, 11 bp, Homo sapiens
agagttacagt

SEQ ID NO: 1467232 - DNA, 15 bp, Homo sapiens
agagttacagttctg

SEQ ID NO: 1467233 - DNA, 16 bp, Homo sapiens
agagttacagttctgt

SEQ ID NO: 1467234 - DNA, 13 bp, Homo sapiens
agagttacttgat

SEQ ID NO: 1467235 - DNA, 14 bp, Homo sapiens
agagttacttgata

SEQ ID NO: 1467236 - DNA, 15 bp, Homo sapiens
agagttccctgcaac

SEQ ID NO: 1467237 - DNA, 16 bp, Homo sapiens
agagttccttctcact

SEQ ID NO: 1467238 - DNA, 17 bp, Homo sapiens
agagttccttctcactt

SEQ ID NO: 1467239 - DNA, 22 bp, Homo sapiens
agagttcggtctgacagtcctt

SEQ ID NO: 1467240 - DNA, 13 bp, Homo sapiens
agagttcttcttt

SEQ ID NO: 1467241 - DNA, 17 bp, Homo sapiens
agagttcttctttcttt

SEQ ID NO: 1467242 - DNA, 19 bp, Homo sapiens
agagttgctttgccagagc

SEQ ID NO: 1467243 - DNA, 19 bp, Homo sapiens
agagttgggtgtctcctta

SEQ ID NO: 1467244 - DNA, 15 bp, Homo sapiens
agagtttcaaaagca

SEQ ID NO: 1467245 - DNA, 22 bp, Homo sapiens
agagtttcttgtaagccatcag

SEQ ID NO: 1467246 - DNA, 13 bp, Homo sapiens
agagtttgtgtgt

SEQ ID NO: 1467247 - DNA, 16 bp, Homo sapiens
agagtttgtgtgtatt

SEQ ID NO: 1467248 - DNA, 18 bp, Homo sapiens
agagtttgtgtgtatttg

SEQ ID NO: 1467249 - DNA, 20 bp, Homo sapiens
agagttttgtcattcagagt

SEQ ID NO: 1467250 - DNA, 13 bp, Homo sapiens
agagttttgtctt

SEQ ID NO: 1467251 - DNA, 12 bp, Homo sapiens
agataaaaagat

SEQ ID NO: 1467252 - DNA, 20 bp, Homo sapiens
agataaaacagaatcttctg

SEQ ID NO: 1467253 - DNA, 18 bp, Homo sapiens
agataaaacgatctaaag

SEQ ID NO: 1467254 - DNA, 14 bp, Homo sapiens
agataaaagcaatt

SEQ ID NO: 1467255 - DNA, 15 bp, Homo sapiens
agataaaagcaattc

SEQ ID NO: 1467256 - DNA, 22 bp, Homo sapiens
agataaaagcaattctgactgt

SEQ ID NO: 1467257 - DNA, 14 bp, Homo sapiens
agataaacacaggc

SEQ ID NO: 1467258 - DNA, 13 bp, Homo sapiens
agataaactcaga

SEQ ID NO: 1467259 - DNA, 18 bp, Homo sapiens
agataaagaccagaaatt

SEQ ID NO: 1467260 - DNA, 14 bp, Homo sapiens
agataaagatttct

SEQ ID NO: 1467261 - DNA, 16 bp, Homo sapiens
agataaatccttaaca

SEQ ID NO: 1467262 - DNA, 19 bp, Homo sapiens
agataaatccttaacattt

SEQ ID NO: 1467263 - DNA, 12 bp, Homo sapiens
agataaatgaaa

SEQ ID NO: 1467264 - DNA, 21 bp, Homo sapiens
agataacaagatctttcagga

SEQ ID NO: 1467265 - DNA, 17 bp, Homo sapiens
agataactctctttcct

SEQ ID NO: 1467266 - DNA, 16 bp, Homo sapiens
agataactgctttgca

SEQ ID NO: 1467267 - DNA, 23 bp, Homo sapiens
agataacttactgtatatgtatt

SEQ ID NO: 1467268 - DNA, 13 bp, Homo sapiens
agataagaaaagc

SEQ ID NO: 1467269 - DNA, 15 bp, Homo sapiens
agataagaaaagcct

SEQ ID NO: 1467270 - DNA, 13 bp, Homo sapiens
agataaggtttta

SEQ ID NO: 1467271 - DNA, 15 bp, Homo sapiens
agataagtggccttg

SEQ ID NO: 1467272 - DNA, 17 bp, Homo sapiens
agataagttggagcagg

SEQ ID NO: 1467273 - DNA, 15 bp, Homo sapiens
agataatatctgtga

SEQ ID NO: 1467274 - DNA, 16 bp, Homo sapiens
agataatatctgtgag

SEQ ID NO: 1467275 - DNA, 15 bp, Homo sapiens
agataatatgagaat

SEQ ID NO: 1467276 - DNA, 14 bp, Homo sapiens
agataatattgttt

SEQ ID NO: 1467277 - DNA, 17 bp, Homo sapiens
agataatattgtttggt

SEQ ID NO: 1467278 - DNA, 23 bp, Homo sapiens
agatggattctccactcagttgc

SEQ ID NO: 1467279 - DNA, 22 bp, Homo sapiens
agatggcaagagggtgacagct

SEQ ID NO: 1467280 - DNA, 17 bp, Homo sapiens
agatggcccccagctgg

SEQ ID NO: 1467281 - DNA, 13 bp, Homo sapiens
agatggctgctgc

SEQ ID NO: 1467282 - DNA, 19 bp, Homo sapiens
agatggctgctgcctgctc

SEQ ID NO: 1467283 - DNA, 14 bp, Homo sapiens
agatggctttcagg

SEQ ID NO: 1467284 - DNA, 18 bp, Homo sapiens
agatgggaatgaggtggg

SEQ ID NO: 1467285 - DNA, 13 bp, Homo sapiens
agatgggacagca

SEQ ID NO: 1467286 - DNA, 16 bp, Homo sapiens
agatgggcatcttttg

SEQ ID NO: 1467287 - DNA, 18 bp, Homo sapiens
agatgggcatcttttgta

SEQ ID NO: 1467288 - DNA, 22 bp, Homo sapiens
agatgggcatcttttgtattaa

SEQ ID NO: 1467289 - DNA, 18 bp, Homo sapiens
agatgggcttgttttctt

SEQ ID NO: 1467290 - DNA, 16 bp, Homo sapiens
agatgggggcagggct

SEQ ID NO: 1467291 - DNA, 17 bp, Homo sapiens
agatgggggcagggctg

SEQ ID NO: 1467292 - DNA, 19 bp, Homo sapiens
agatggggtctgtgactgg

SEQ ID NO: 1467293 - DNA, 18 bp, Homo sapiens
agatgggtattaaacttg

SEQ ID NO: 1467294 - DNA, 19 bp, Homo sapiens
agatggtatatttggtact

SEQ ID NO: 1467295 - DNA, 14 bp, Homo sapiens
agatggtatgaaat

SEQ ID NO: 1467296 - DNA, 17 bp, Homo sapiens
agatggtccatttgttc

SEQ ID NO: 1467297 - DNA, 21 bp, Homo sapiens
agatggtccatttgttcctgc

SEQ ID NO: 1467298 - DNA, 22 bp, Homo sapiens
agatggtccgtgcccaggccct

SEQ ID NO: 1467299 - DNA, 14 bp, Homo sapiens
agatggtggcagta

SEQ ID NO: 1467300 - DNA, 21 bp, Homo sapiens
agatggttaaaaaggccaaag

SEQ ID NO: 1467301 - DNA, 22 bp, Homo sapiens
agatggttaaaaaggccaaaga

SEQ ID NO: 1467302 - DNA, 15 bp, Homo sapiens
agatggttaaacatt

SEQ ID NO: 1467303 - DNA, 17 bp, Homo sapiens
agatggttaaacatttt

SEQ ID NO: 1467304 - DNA, 17 bp, Homo sapiens
agatggtttccacattt

SEQ ID NO: 1467305 - DNA, 18 bp, Homo sapiens
agatggtttgagcctgag

SEQ ID NO: 1467306 - DNA, 13 bp, Homo sapiens
agatgtaaaaaga

SEQ ID NO: 1467307 - DNA, 17 bp, Homo sapiens
agatgtacttctctgtg

SEQ ID NO: 1467308 - DNA, 14 bp, Homo sapiens
agatgtagtatttt

SEQ ID NO: 1467309 - DNA, 17 bp, Homo sapiens
agatgtatccttccaat

SEQ ID NO: 1467310 - DNA, 20 bp, Homo sapiens
agatgtcagccgagccgggc

SEQ ID NO: 1467311 - DNA, 16 bp, Homo sapiens
agatgtccgtctctct

SEQ ID NO: 1467312 - DNA, 17 bp, Homo sapiens
agatgtccgtctctctt

SEQ ID NO: 1467313 - DNA, 21 bp, Homo sapiens
agatgtctcaaaaatccttat

SEQ ID NO: 1467314 - DNA, 17 bp, Homo sapiens
agatgtcttctgcctgt

SEQ ID NO: 1467315 - DNA, 13 bp, Homo sapiens
agatgtcttggaa

SEQ ID NO: 1467316 - DNA, 14 bp, Homo sapiens
agatgtcttggaac

SEQ ID NO: 1467317 - DNA, 18 bp, Homo sapiens
agatgtcttggaacattg

SEQ ID NO: 1467318 - DNA, 16 bp, Homo sapiens
agatgtgaattattga

SEQ ID NO: 1467319 - DNA, 20 bp, Homo sapiens
agatgtgaattattgacact

SEQ ID NO: 1467320 - DNA, 21 bp, Homo sapiens
agatgtgaattattgacactg

SEQ ID NO: 1467321 - DNA, 18 bp, Homo sapiens
agatgtgcaaatgcaagc

SEQ ID NO: 1467322 - DNA, 13 bp, Homo sapiens
agatgtgcaataa

SEQ ID NO: 1467323 - DNA, 16 bp, Homo sapiens
agatgtggatttggca

SEQ ID NO: 1467324 - DNA, 21 bp, Homo sapiens
agatgtggccttccatttata

SEQ ID NO: 1467325 - DNA, 19 bp, Homo sapiens
agatgtgtggactgtggca

SEQ ID NO: 1467326 - DNA, 11 bp, Homo sapiens
agatgtgttct

SEQ ID NO: 1467327 - DNA, 19 bp, Homo sapiens
agatgtgttgctatcctga

SEQ ID NO: 1467328 - DNA, 15 bp, Homo sapiens
agatgttagatattt

SEQ ID NO: 1467329 - DNA, 15 bp, Homo sapiens
agatgttcaaatatt

SEQ ID NO: 1467330 - DNA, 19 bp, Homo sapiens
agatgttccagtgaggaac

SEQ ID NO: 1467331 - DNA, 16 bp, Homo sapiens
agatgttgatttttac

SEQ ID NO: 1467332 - DNA, 18 bp, Homo sapiens
agatgttgccatgtgttt

SEQ ID NO: 1467333 - DNA, 15 bp, Homo sapiens
agatgttgcttttga

SEQ ID NO: 1467334 - DNA, 16 bp, Homo sapiens
agatgttgcttttgaa

SEQ ID NO: 1467335 - DNA, 23 bp, Homo sapiens
agatgttgcttttgaaaagttga

SEQ ID NO: 1467336 - DNA, 20 bp, Homo sapiens
agatgtttattcttctagag

SEQ ID NO: 1467337 - DNA, 21 bp, Homo sapiens
agatgtttattcttctagagt

SEQ ID NO: 1467338 - DNA, 15 bp, Homo sapiens
agatgtttatttcag

SEQ ID NO: 1467339 - DNA, 14 bp, Homo sapiens
agatgtttccagac

SEQ ID NO: 1467340 - DNA, 17 bp, Homo sapiens
agatgtttggaaaccac

SEQ ID NO: 1467341 - DNA, 18 bp, Homo sapiens
agatgtttggaaaccaca

SEQ ID NO: 1467342 - DNA, 22 bp, Homo sapiens
agatgttttaccgtaataatta

SEQ ID NO: 1467343 - DNA, 15 bp, Homo sapiens
agatgttttgtataa

SEQ ID NO: 1467344 - DNA, 19 bp, Homo sapiens
agatgttttgtataaaatc

SEQ ID NO: 1467345 - DNA, 21 bp, Homo sapiens
agatgttttgtataaaatctg

SEQ ID NO: 1467346 - DNA, 22 bp, Homo sapiens
agatgttttgtataaaatctga

SEQ ID NO: 1467347 - DNA, 18 bp, Homo sapiens
agatgtttttaattctag

SEQ ID NO: 1467348 - DNA, 16 bp, Homo sapiens
agattaaaggaaggaa

SEQ ID NO: 1467349 - DNA, 18 bp, Homo sapiens
agattaaaggaaggaaaa

SEQ ID NO: 1467350 - DNA, 17 bp, Homo sapiens
agattaagatctgtgtt

SEQ ID NO: 1467351 - DNA, 19 bp, Homo sapiens
agattaagatctgtgtttt

SEQ ID NO: 1467352 - DNA, 15 bp, Homo sapiens
agattaatggcactg

SEQ ID NO: 1467353 - DNA, 20 bp, Homo sapiens
agattacaaatcagaagtca

SEQ ID NO: 1467354 - DNA, 18 bp, Homo sapiens
agattactttgctgcctt

SEQ ID NO: 1467355 - DNA, 21 bp, Homo sapiens
agattagaatggctaccccat

SEQ ID NO: 1467356 - DNA, 14 bp, Homo sapiens
agattaggtagact

SEQ ID NO: 1467357 - DNA, 13 bp, Homo sapiens
agattataataaa

SEQ ID NO: 1467358 - DNA, 14 bp, Homo sapiens
agattataatatgt

SEQ ID NO: 1467359 - DNA, 13 bp, Homo sapiens
agattataattgt

SEQ ID NO: 1467360 - DNA, 17 bp, Homo sapiens
agattatagattctaaa

SEQ ID NO: 1467361 - DNA, 23 bp, Homo sapiens
agattatagattctaaagattct

SEQ ID NO: 1467362 - DNA, 14 bp, Homo sapiens
agattatgatgcat

SEQ ID NO: 1467363 - DNA, 18 bp, Homo sapiens
agattatgttcctgctgt

SEQ ID NO: 1467364 - DNA, 20 bp, Homo sapiens
agattatgttcctgctgtat

SEQ ID NO: 1467365 - DNA, 15 bp, Homo sapiens
agattattataaact

SEQ ID NO: 1467366 - DNA, 23 bp, Homo sapiens
agattattataaactataaactt

SEQ ID NO: 1467367 - DNA, 11 bp, Homo sapiens
agattcaaagc

SEQ ID NO: 1467368 - DNA, 17 bp, Homo sapiens
agattcaaaggttctag

SEQ ID NO: 1467369 - DNA, 18 bp, Homo sapiens
agattcaaaggttctagg

SEQ ID NO: 1467370 - DNA, 21 bp, Homo sapiens
agattcaaaggttctaggttt

SEQ ID NO: 1467371 - DNA, 20 bp, Homo sapiens
agattcagaatgagaatgga

SEQ ID NO: 1467372 - DNA, 16 bp, Homo sapiens
agattcaggccagccc

SEQ ID NO: 1467373 - DNA, 20 bp, Homo sapiens
agattcaggccagcccagcc

SEQ ID NO: 1467374 - DNA, 21 bp, Homo sapiens
agattcaggccagcccagcca

SEQ ID NO: 1467375 - DNA, 12 bp, Homo sapiens
agattcataaat

SEQ ID NO: 1467376 - DNA, 18 bp, Homo sapiens
agattcataaatacaaaa

SEQ ID NO: 1467377 - DNA, 13 bp, Homo sapiens
agattcatattta

SEQ ID NO: 1467378 - DNA, 19 bp, Homo sapiens
agattccagagagtggctc

SEQ ID NO: 1467379 - DNA, 22 bp, Homo sapiens
agattccagagagtggctcctc

SEQ ID NO: 1467380 - DNA, 23 bp, Homo sapiens
agattccattggtccaagattcc

SEQ ID NO: 1467381 - DNA, 16 bp, Homo sapiens
agattcgctgtcccct

SEQ ID NO: 1467382 - DNA, 20 bp, Homo sapiens
agattcgctgtcccctcagc

SEQ ID NO: 1467383 - DNA, 21 bp, Homo sapiens
agattcgctgtcccctcagcg

SEQ ID NO: 1467384 - DNA, 16 bp, Homo sapiens
agattcgctttccatg

SEQ ID NO: 1467385 - DNA, 13 bp, Homo sapiens
agattctaaagat

SEQ ID NO: 1467386 - DNA, 17 bp, Homo sapiens
agattctaaagattcta

SEQ ID NO: 1467387 - DNA, 21 bp, Homo sapiens
agattctaaagattctatagt

SEQ ID NO: 1467388 - DNA, 11 bp, Homo sapiens
agattctagat

SEQ ID NO: 1467389 - DNA, 12 bp, Homo sapiens
agattctagatc

SEQ ID NO: 1467390 - DNA, 14 bp, Homo sapiens
agattctagatgat

SEQ ID NO: 1467391 - DNA, 15 bp, Homo sapiens
agattctctgcccag

SEQ ID NO: 1467392 - DNA, 18 bp, Homo sapiens
agattctgcctatgtaaa

SEQ ID NO: 1467393 - DNA, 23 bp, Homo sapiens
agcacccacgtgagagaatctgc

SEQ ID NO: 1467394 - DNA, 13 bp, Homo sapiens
agcaccccctgct

SEQ ID NO: 1467395 - DNA, 20 bp, Homo sapiens
agcaccccctgctccaccag

SEQ ID NO: 1467396 - DNA, 22 bp, Homo sapiens
agcaccccctgctccaccagca

SEQ ID NO: 1467397 - DNA, 12 bp, Homo sapiens
agcaccccttcc

SEQ ID NO: 1467398 - DNA, 13 bp, Homo sapiens
agcaccccttcca

SEQ ID NO: 1467399 - DNA, 15 bp, Homo sapiens
agcaccctcgagaag

SEQ ID NO: 1467400 - DNA, 12 bp, Homo sapiens
agcaccctgggt

SEQ ID NO: 1467401 - DNA, 22 bp, Homo sapiens
agcacccttctcggagacccat

SEQ ID NO: 1467402 - DNA, 18 bp, Homo sapiens
agcacccttgcccggctg

SEQ ID NO: 1467403 - DNA, 14 bp, Homo sapiens
agcaccgaggggcc

SEQ ID NO: 1467404 - DNA, 22 bp, Homo sapiens
agcaccgtgtcaagctgctctg

SEQ ID NO: 1467405 - DNA, 16 bp, Homo sapiens
agcacctccaaccaaa

SEQ ID NO: 1467406 - DNA, 17 bp, Homo sapiens
agcacctccaaccaaat

SEQ ID NO: 1467407 - DNA, 15 bp, Homo sapiens
agcacctccaggcct

SEQ ID NO: 1467408 - DNA, 16 bp, Homo sapiens
agcacctccaggcctg

SEQ ID NO: 1467409 - DNA, 21 bp, Homo sapiens
agcacctgaaccccatgggct

SEQ ID NO: 1467410 - DNA, 13 bp, Homo sapiens
agcacctgccaga

SEQ ID NO: 1467411 - DNA, 20 bp, Homo sapiens
agcacctgccgacctcgtcc

SEQ ID NO: 1467412 - DNA, 15 bp, Homo sapiens
agcaccttggcccag

SEQ ID NO: 1467413 - DNA, 19 bp, Homo sapiens
agcaccttggcccaggagc

SEQ ID NO: 1467414 - DNA, 16 bp, Homo sapiens
agcaccttgtgcctgg

SEQ ID NO: 1467415 - DNA, 17 bp, Homo sapiens
agcaccttgtgcctggg

SEQ ID NO: 1467416 - DNA, 23 bp, Homo sapiens
agcacctttgagccttggcccac

SEQ ID NO: 1467417 - DNA, 13 bp, Homo sapiens
agcacgcctgcca

SEQ ID NO: 1467418 - DNA, 16 bp, Homo sapiens
agcacgcctgccatct

SEQ ID NO: 1467419 - DNA, 19 bp, Homo sapiens
agcacggtgactctgtcca

SEQ ID NO: 1467420 - DNA, 13 bp, Homo sapiens
agcactaaagcag

SEQ ID NO: 1467421 - DNA, 20 bp, Homo sapiens
agcactagaaattgggcagt

SEQ ID NO: 1467422 - DNA, 16 bp, Homo sapiens
agcactagtaaaggag

SEQ ID NO: 1467423 - DNA, 15 bp, Homo sapiens
agcactagtttgatt

SEQ ID NO: 1467424 - DNA, 16 bp, Homo sapiens
agcactagtttgatta

SEQ ID NO: 1467425 - DNA, 23 bp, Homo sapiens
agcactagtttgattattatgtt

SEQ ID NO: 1467426 - DNA, 13 bp, Homo sapiens
agcactattttat

SEQ ID NO: 1467427 - DNA, 20 bp, Homo sapiens
agcactattttatatttaaa

SEQ ID NO: 1467428 - DNA, 12 bp, Homo sapiens
agcactcagcct

SEQ ID NO: 1467429 - DNA, 20 bp, Homo sapiens
agcactccccagagctgtgc

SEQ ID NO: 1467430 - DNA, 21 bp, Homo sapiens
agcactccccagagctgtgcc

SEQ ID NO: 1467431 - DNA, 21 bp, Homo sapiens
agcactcctcggtactcccat

SEQ ID NO: 1467432 - DNA, 16 bp, Homo sapiens
agcactcctgcttaat

SEQ ID NO: 1467433 - DNA, 16 bp, Homo sapiens
agcactcgagaccatc

SEQ ID NO: 1467434 - DNA, 18 bp, Homo sapiens
agcactcgagaccatcct

SEQ ID NO: 1467435 - DNA, 20 bp, Homo sapiens
agcactcgagaccatcctgg

SEQ ID NO: 1467436 - DNA, 22 bp, Homo sapiens
agcactctctaaatcttccttg

SEQ ID NO: 1467437 - DNA, 10 bp, Homo sapiens
agcactgaaa

SEQ ID NO: 1467438 - DNA, 13 bp, Homo sapiens
agcactgacagat

SEQ ID NO: 1467439 - DNA, 12 bp, Homo sapiens
agcactgacctg

SEQ ID NO: 1467440 - DNA, 20 bp, Homo sapiens
agcactgacctgtcatgccc

SEQ ID NO: 1467441 - DNA, 19 bp, Homo sapiens
agcactgacttctaagtaa

SEQ ID NO: 1467442 - DNA, 11 bp, Homo sapiens
agcactgagga

SEQ ID NO: 1467443 - DNA, 21 bp, Homo sapiens
agcactgaggaagaacggggc

SEQ ID NO: 1467444 - DNA, 18 bp, Homo sapiens
agcactgatttcacaaca

SEQ ID NO: 1467445 - DNA, 22 bp, Homo sapiens
agcactgctcacgtctctgccg

SEQ ID NO: 1467446 - DNA, 19 bp, Homo sapiens
agcactggaaccacctgga

SEQ ID NO: 1467447 - DNA, 13 bp, Homo sapiens
agcactggccaga

SEQ ID NO: 1467448 - DNA, 20 bp, Homo sapiens
agcactggtgtgaactcacc

SEQ ID NO: 1467449 - DNA, 15 bp, Homo sapiens
agcactgtaaacttc

SEQ ID NO: 1467450 - DNA, 12 bp, Homo sapiens
agcactgtccct

SEQ ID NO: 1467451 - DNA, 15 bp, Homo sapiens
agcactgtgaagacc

SEQ ID NO: 1467452 - DNA, 18 bp, Homo sapiens
agcactgtgaagacccag

SEQ ID NO: 1467453 - DNA, 18 bp, Homo sapiens
agcacttacgtaaaacat

SEQ ID NO: 1467454 - DNA, 15 bp, Homo sapiens
agcacttcccaggat

SEQ ID NO: 1467455 - DNA, 22 bp, Homo sapiens
agcacttgcaaccgtctgttat

SEQ ID NO: 1467456 - DNA, 18 bp, Homo sapiens
agcacttgcgtcctgcag

SEQ ID NO: 1467457 - DNA, 22 bp, Homo sapiens
agcacttgcgtcctgcagagga

SEQ ID NO: 1467458 - DNA, 13 bp, Homo sapiens
agcacttgtatat

SEQ ID NO: 1467459 - DNA, 16 bp, Homo sapiens
agcactttgggaggcc

SEQ ID NO: 1467460 - DNA, 20 bp, Homo sapiens
agcactttgggaggccaagg

SEQ ID NO: 1467461 - DNA, 21 bp, Homo sapiens
agcactttgggaggctgaggc

SEQ ID NO: 1467462 - DNA, 13 bp, Homo sapiens
agcacttttcaaa

SEQ ID NO: 1467463 - DNA, 13 bp, Homo sapiens
agcagaaagaaga

SEQ ID NO: 1467464 - DNA, 18 bp, Homo sapiens
agcagaaaggcacgtcca

SEQ ID NO: 1467465 - DNA, 16 bp, Homo sapiens
agcagaaattctgttt

SEQ ID NO: 1467466 - DNA, 14 bp, Homo sapiens
agcagaacaaatgt

SEQ ID NO: 1467467 - DNA, 12 bp, Homo sapiens
agcagaacactg

SEQ ID NO: 1467468 - DNA, 20 bp, Homo sapiens
agcagaacctgcacacagga

SEQ ID NO: 1467469 - DNA, 14 bp, Homo sapiens
agcagaactgaacc

SEQ ID NO: 1467470 - DNA, 13 bp, Homo sapiens
agcagaagacaaa

SEQ ID NO: 1467471 - DNA, 23 bp, Homo sapiens
agcagaagggggtggtgtctcca

SEQ ID NO: 1467472 - DNA, 15 bp, Homo sapiens
agcagaagtctggct

SEQ ID NO: 1467473 - DNA, 16 bp, Homo sapiens
agcagaagtctggctt

SEQ ID NO: 1467474 - DNA, 13 bp, Homo sapiens
agcagaatactgg

SEQ ID NO: 1467475 - DNA, 17 bp, Homo sapiens
agcagaatggaggcagg

SEQ ID NO: 1467476 - DNA, 14 bp, Homo sapiens
agcagacagagcca

SEQ ID NO: 1467477 - DNA, 15 bp, Homo sapiens
agcagacagagccag

SEQ ID NO: 1467478 - DNA, 17 bp, Homo sapiens
agcagacagagccagga

SEQ ID NO: 1467479 - DNA, 18 bp, Homo sapiens
agcagacagagccaggag

SEQ ID NO: 1467480 - DNA, 22 bp, Homo sapiens
agcagaccaccccgcctgccct

SEQ ID NO: 1467481 - DNA, 17 bp, Homo sapiens
agcagacccagcttaga

SEQ ID NO: 1467482 - DNA, 16 bp, Homo sapiens
agcagacgcagcagct

SEQ ID NO: 1467483 - DNA, 20 bp, Homo sapiens
agcagacgcagcagctggga

SEQ ID NO: 1467484 - DNA, 18 bp, Homo sapiens
agcagactggtttgcagt

SEQ ID NO: 1467485 - DNA, 21 bp, Homo sapiens
agcagagaattctcttatcca

SEQ ID NO: 1467486 - DNA, 13 bp, Homo sapiens
agcagagagccaa

SEQ ID NO: 1467487 - DNA, 17 bp, Homo sapiens
agcagagagccaaatct

SEQ ID NO: 1467488 - DNA, 15 bp, Homo sapiens
agcagagatgtactg

SEQ ID NO: 1467489 - DNA, 19 bp, Homo sapiens
agcagagcaaaatgctctt

SEQ ID NO: 1467490 - DNA, 20 bp, Homo sapiens
agcagagcaaaatgctcttg

SEQ ID NO: 1467491 - DNA, 22 bp, Homo sapiens
agcagagcggggtcccctctgt

SEQ ID NO: 1467492 - DNA, 21 bp, Homo sapiens
agcagagctctcccctcctgc

SEQ ID NO: 1467493 - DNA, 13 bp, Homo sapiens
agcagaggaccag

SEQ ID NO: 1467494 - DNA, 14 bp, Homo sapiens
agcagaggaccagg

SEQ ID NO: 1467495 - DNA, 13 bp, Homo sapiens
agcagagggcagg

SEQ ID NO: 1467496 - DNA, 18 bp, Homo sapiens
agcagagggggagtagcc

SEQ ID NO: 1467497 - DNA, 13 bp, Homo sapiens
agcagaggtctcc

SEQ ID NO: 1467498 - DNA, 18 bp, Homo sapiens
agcagagtgaggatgtgt

SEQ ID NO: 1467499 - DNA, 20 bp, Homo sapiens
agcagagtgaggatgtgttt

SEQ ID NO: 1467500 - DNA, 14 bp, Homo sapiens
agcagagttaaatc

SEQ ID NO: 1467501 - DNA, 16 bp, Homo sapiens
agcagatcccagctca

SEQ ID NO: 1467502 - DNA, 14 bp, Homo sapiens
agcagatggacagc

SEQ ID NO: 1467503 - DNA, 13 bp, Homo sapiens
agcagcaacagcc

SEQ ID NO: 1467504 - DNA, 14 bp, Homo sapiens
agcagcacacctca

SEQ ID NO: 1467505 - DNA, 15 bp, Homo sapiens
agcagcacacctcag

SEQ ID NO: 1467506 - DNA, 19 bp, Homo sapiens
agcagcacacctcagcccc

SEQ ID NO: 1467507 - DNA, 18 bp, Homo sapiens
agcagcaccaaccacagc

SEQ ID NO: 1467508 - DNA, 15 bp, Homo sapiens
agcagcactggaacc

SEQ ID NO: 1467509 - DNA, 13 bp, Homo sapiens
agcattactcttt

SEQ ID NO: 1467510 - DNA, 13 bp, Homo sapiens
agcattactttat

SEQ ID NO: 1467511 - DNA, 17 bp, Homo sapiens
agcattattcttcagaa

SEQ ID NO: 1467512 - DNA, 16 bp, Homo sapiens
agcattccagcccctc

SEQ ID NO: 1467513 - DNA, 19 bp, Homo sapiens
agcattccagcccctctgg

SEQ ID NO: 1467514 - DNA, 19 bp, Homo sapiens
agcattccagctctgcccc

SEQ ID NO: 1467515 - DNA, 17 bp, Homo sapiens
agcattctccccagtgt

SEQ ID NO: 1467516 - DNA, 17 bp, Homo sapiens
agcattctggaggggag

SEQ ID NO: 1467517 - DNA, 19 bp, Homo sapiens
agcattcttgtcacaataa

SEQ ID NO: 1467518 - DNA, 24 bp, Homo sapiens
agcattctttggagttaaaatgca

SEQ ID NO: 1467519 - DNA, 12 bp, Homo sapiens
agcattgcactt

SEQ ID NO: 1467520 - DNA, 14 bp, Homo sapiens
agcattgcctggac

SEQ ID NO: 1467521 - DNA, 15 bp, Homo sapiens
agcattgcctggact

SEQ ID NO: 1467522 - DNA, 11 bp, Homo sapiens
agcattgcttt

SEQ ID NO: 1467523 - DNA, 17 bp, Homo sapiens
agcattgtaaatgtgct

SEQ ID NO: 1467524 - DNA, 18 bp, Homo sapiens
agcattgtcttaattttt

SEQ ID NO: 1467525 - DNA, 21 bp, Homo sapiens
agcattgtctttgctgtactc

SEQ ID NO: 1467526 - DNA, 20 bp, Homo sapiens
agcatttaatggcagctagt

SEQ ID NO: 1467527 - DNA, 16 bp, Homo sapiens
agcatttagctggcca

SEQ ID NO: 1467528 - DNA, 20 bp, Homo sapiens
agcatttcaaagccctgcct

SEQ ID NO: 1467529 - DNA, 21 bp, Homo sapiens
agcatttcaaagccctgcctc

SEQ ID NO: 1467530 - DNA, 18 bp, Homo sapiens
agcatttccaacaccaca

SEQ ID NO: 1467531 - DNA, 19 bp, Homo sapiens
agcatttccaacaccacag

SEQ ID NO: 1467532 - DNA, 20 bp, Homo sapiens
agcatttcttttctggccaa

SEQ ID NO: 1467533 - DNA, 18 bp, Homo sapiens
agcatttgctttcctctg

SEQ ID NO: 1467534 - DNA, 14 bp, Homo sapiens
agcatttggtgcct

SEQ ID NO: 1467535 - DNA, 19 bp, Homo sapiens
agcatttggtgcctatttg

SEQ ID NO: 1467536 - DNA, 11 bp, Homo sapiens
agcatttgtat

SEQ ID NO: 1467537 - DNA, 12 bp, Homo sapiens
agcatttgtata

SEQ ID NO: 1467538 - DNA, 15 bp, Homo sapiens
agcatttttataaac

SEQ ID NO: 1467539 - DNA, 12 bp, Homo sapiens
agcatttttcaa

SEQ ID NO: 1467540 - DNA, 17 bp, Homo sapiens
agccaaacattcttatt

SEQ ID NO: 1467541 - DNA, 19 bp, Homo sapiens
agccaaaccaacaccccat

SEQ ID NO: 1467542 - DNA, 15 bp, Homo sapiens
agccaaacccactct

SEQ ID NO: 1467543 - DNA, 15 bp, Homo sapiens
agccaaaccctgtct

SEQ ID NO: 1467544 - DNA, 15 bp, Homo sapiens
agccaaactgtagat

SEQ ID NO: 1467545 - DNA, 14 bp, Homo sapiens
agccaaactgtctt

SEQ ID NO: 1467546 - DNA, 13 bp, Homo sapiens
agccaaagaaaaa

SEQ ID NO: 1467547 - DNA, 16 bp, Homo sapiens
agccaaagaaacaagc

SEQ ID NO: 1467548 - DNA, 18 bp, Homo sapiens
agccaaagaaacaagctg

SEQ ID NO: 1467549 - DNA, 13 bp, Homo sapiens
agccaaagccagg

SEQ ID NO: 1467550 - DNA, 19 bp, Homo sapiens
agccaaaggcatccaggcc

SEQ ID NO: 1467551 - DNA, 21 bp, Homo sapiens
agccaaaggtcaaacaggctg

SEQ ID NO: 1467552 - DNA, 17 bp, Homo sapiens
agccaaagttttcaaac

SEQ ID NO: 1467553 - DNA, 22 bp, Homo sapiens
agccaaatgcagggaggggagg

SEQ ID NO: 1467554 - DNA, 23 bp, Homo sapiens
agccaaatgcagggaggggaggc

SEQ ID NO: 1467555 - DNA, 18 bp, Homo sapiens
agccaacaactctgcctt

SEQ ID NO: 1467556 - DNA, 19 bp, Homo sapiens
agccaacaactctgccttt

SEQ ID NO: 1467557 - DNA, 20 bp, Homo sapiens
agccaacaactctgccttta

SEQ ID NO: 1467558 - DNA, 15 bp, Homo sapiens
agccaacaagaccgc

SEQ ID NO: 1467559 - DNA, 21 bp, Homo sapiens
agccaacaagaccgccccagg

SEQ ID NO: 1467560 - DNA, 21 bp, Homo sapiens
agccaacagtcaaaacagaga

SEQ ID NO: 1467561 - DNA, 16 bp, Homo sapiens
agccaacctaagcaag

SEQ ID NO: 1467562 - DNA, 20 bp, Homo sapiens
agccaacctggacttcctgt

SEQ ID NO: 1467563 - DNA, 22 bp, Homo sapiens
agccaacctggacttcctgtca

SEQ ID NO: 1467564 - DNA, 16 bp, Homo sapiens
agccaactagcccctg

SEQ ID NO: 1467565 - DNA, 19 bp, Homo sapiens
agccaactctcccaaaggg

SEQ ID NO: 1467566 - DNA, 23 bp, Homo sapiens
agccaactgtttccctgctgaat

SEQ ID NO: 1467567 - DNA, 19 bp, Homo sapiens
agccaagattgcgccattg

SEQ ID NO: 1467568 - DNA, 15 bp, Homo sapiens
agccaagcactgctc

SEQ ID NO: 1467569 - DNA, 16 bp, Homo sapiens
agccaagcactgctca

SEQ ID NO: 1467570 - DNA, 15 bp, Homo sapiens
agccaagcgctcatg

SEQ ID NO: 1467571 - DNA, 19 bp, Homo sapiens
agccaagcttcaaccctca

SEQ ID NO: 1467572 - DNA, 15 bp, Homo sapiens
agccaagctttaaat

SEQ ID NO: 1467573 - DNA, 19 bp, Homo sapiens
agccaagctttaaattatg

SEQ ID NO: 1467574 - DNA, 14 bp, Homo sapiens
agccaaggcagcga

SEQ ID NO: 1467575 - DNA, 22 bp, Homo sapiens
agccaaggcagcgaccccagga

SEQ ID NO: 1467576 - DNA, 20 bp, Homo sapiens
agccaaggccgccagcgtgt

SEQ ID NO: 1467577 - DNA, 16 bp, Homo sapiens
agccaagggaacctgt

SEQ ID NO: 1467578 - DNA, 20 bp, Homo sapiens
agccaagggaacctgtgtcc

SEQ ID NO: 1467579 - DNA, 17 bp, Homo sapiens
agccaaggggatattta

SEQ ID NO: 1467580 - DNA, 22 bp, Homo sapiens
agccaaggtgggctgagccctg

SEQ ID NO: 1467581 - DNA, 22 bp, Homo sapiens
agccaaggttttataaggctga

SEQ ID NO: 1467582 - DNA, 13 bp, Homo sapiens
agccaagtgcagg

SEQ ID NO: 1467583 - DNA, 16 bp, Homo sapiens
agccaagtggggtgct

SEQ ID NO: 1467584 - DNA, 16 bp, Homo sapiens
agccaagtggtccagc

SEQ ID NO: 1467585 - DNA, 19 bp, Homo sapiens
agccaagttccaaaataaa

SEQ ID NO: 1467586 - DNA, 23 bp, Homo sapiens
agccaatccctcaccttctgagt

SEQ ID NO: 1467587 - DNA, 22 bp, Homo sapiens
agccaatctacaatctcttttt

SEQ ID NO: 1467588 - DNA, 19 bp, Homo sapiens
agccaatgaacagctcctc

SEQ ID NO: 1467589 - DNA, 12 bp, Homo sapiens
agccaatgttat

SEQ ID NO: 1467590 - DNA, 15 bp, Homo sapiens
agccacaagctgcac

SEQ ID NO: 1467591 - DNA, 22 bp, Homo sapiens
agccacaagctgcactgtgaac

SEQ ID NO: 1467592 - DNA, 18 bp, Homo sapiens
agccacaagtcttccaga

SEQ ID NO: 1467593 - DNA, 21 bp, Homo sapiens
agccacaattatataaatcat

SEQ ID NO: 1467594 - DNA, 18 bp, Homo sapiens
agccacactgggcctgga

SEQ ID NO: 1467595 - DNA, 13 bp, Homo sapiens
agccacagaccac

SEQ ID NO: 1467596 - DNA, 17 bp, Homo sapiens
agccacagaccacctgc

SEQ ID NO: 1467597 - DNA, 16 bp, Homo sapiens
agccacagacccctgg

SEQ ID NO: 1467598 - DNA, 15 bp, Homo sapiens
agccacagtacatat

SEQ ID NO: 1467599 - DNA, 15 bp, Homo sapiens
agccacatgccccag

SEQ ID NO: 1467600 - DNA, 19 bp, Homo sapiens
agccacatgccccaggctc

SEQ ID NO: 1467601 - DNA, 17 bp, Homo sapiens
agccaccacgtccagct

SEQ ID NO: 1467602 - DNA, 18 bp, Homo sapiens
agccacccaagcctgctg

SEQ ID NO: 1467603 - DNA, 21 bp, Homo sapiens
agccacccaagcctgctggct

SEQ ID NO: 1467604 - DNA, 14 bp, Homo sapiens
agccaccccgggct

SEQ ID NO: 1467605 - DNA, 20 bp, Homo sapiens
agccaccccgggctctctgc

SEQ ID NO: 1467606 - DNA, 20 bp, Homo sapiens
agccaccgaagccgcctgtg

SEQ ID NO: 1467607 - DNA, 14 bp, Homo sapiens
agccaccgctgcca

SEQ ID NO: 1467608 - DNA, 16 bp, Homo sapiens
agccaccgctgccagc

SEQ ID NO: 1467609 - DNA, 17 bp, Homo sapiens
agccacctcccacccca

SEQ ID NO: 1467610 - DNA, 18 bp, Homo sapiens
agccacctcccaccccac

SEQ ID NO: 1467611 - DNA, 21 bp, Homo sapiens
agccacctcccaccccactcc

SEQ ID NO: 1467612 - DNA, 14 bp, Homo sapiens
agccacgcagggcc

SEQ ID NO: 1467613 - DNA, 19 bp, Homo sapiens
agccacggacgctggctcc

SEQ ID NO: 1467614 - DNA, 19 bp, Homo sapiens
agccacggggactcagccc

SEQ ID NO: 1467615 - DNA, 15 bp, Homo sapiens
agccacgtgaatggc

SEQ ID NO: 1467616 - DNA, 18 bp, Homo sapiens
agccacgttccttactgc

SEQ ID NO: 1467617 - DNA, 20 bp, Homo sapiens
agccacgttccttactgcag

SEQ ID NO: 1467618 - DNA, 23 bp, Homo sapiens
agccacgttccttactgcagaat

SEQ ID NO: 1467619 - DNA, 17 bp, Homo sapiens
agccactcctgtcccgc

SEQ ID NO: 1467620 - DNA, 19 bp, Homo sapiens
agccactcctgtcccgcct

SEQ ID NO: 1467621 - DNA, 22 bp, Homo sapiens
agccactcctgtcccgccttcc

SEQ ID NO: 1467622 - DNA, 23 bp, Homo sapiens
agccactcctgtcccgccttcct

SEQ ID NO: 1467623 - DNA, 15 bp, Homo sapiens
agccctttggagaac

SEQ ID NO: 1467624 - DNA, 22 bp, Homo sapiens
agccctttgggaggctgaggcg

SEQ ID NO: 1467625 - DNA, 13 bp, Homo sapiens
agccgacctcagc

SEQ ID NO: 1467626 - DNA, 12 bp, Homo sapiens
agccgactctgg

SEQ ID NO: 1467627 - DNA, 18 bp, Homo sapiens
agccgactctggccctgg

SEQ ID NO: 1467628 - DNA, 15 bp, Homo sapiens
agccgagagcctgct

SEQ ID NO: 1467629 - DNA, 21 bp, Homo sapiens
agccgagagcctgctccccca

SEQ ID NO: 1467630 - DNA, 21 bp, Homo sapiens
agccgagattgcgccactgca

SEQ ID NO: 1467631 - DNA, 15 bp, Homo sapiens
agccgagcgtagtga

SEQ ID NO: 1467632 - DNA, 13 bp, Homo sapiens
agccgaggcctgg

SEQ ID NO: 1467633 - DNA, 14 bp, Homo sapiens
agccgaggcctggc

SEQ ID NO: 1467634 - DNA, 15 bp, Homo sapiens
agccgaggcctggcc

SEQ ID NO: 1467635 - DNA, 16 bp, Homo sapiens
agccgaggcctggcca

SEQ ID NO: 1467636 - DNA, 17 bp, Homo sapiens
agccgaggcctggccaa

SEQ ID NO: 1467637 - DNA, 20 bp, Homo sapiens
agccgagggcgtcagagaga

SEQ ID NO: 1467638 - DNA, 12 bp, Homo sapiens
agccgaggggag

SEQ ID NO: 1467639 - DNA, 14 bp, Homo sapiens
agccgaggggagag

SEQ ID NO: 1467640 - DNA, 14 bp, Homo sapiens
agccgcaagctctc

SEQ ID NO: 1467641 - DNA, 18 bp, Homo sapiens
agccgcaagctctcagca

SEQ ID NO: 1467642 - DNA, 20 bp, Homo sapiens
agccgcaagctctcagcaag

SEQ ID NO: 1467643 - DNA, 14 bp, Homo sapiens
agccgcaccctgca

SEQ ID NO: 1467644 - DNA, 14 bp, Homo sapiens
agccgcagcctccc

SEQ ID NO: 1467645 - DNA, 21 bp, Homo sapiens
agccgcatcttctccatctgg

SEQ ID NO: 1467646 - DNA, 22 bp, Homo sapiens
agccgccactcctatccccagg

SEQ ID NO: 1467647 - DNA, 15 bp, Homo sapiens
agccgccagctggga

SEQ ID NO: 1467648 - DNA, 21 bp, Homo sapiens
agccgccattgccaccaggag

SEQ ID NO: 1467649 - DNA, 23 bp, Homo sapiens
agccgcccacttcccgtttcctc

SEQ ID NO: 1467650 - DNA, 19 bp, Homo sapiens
agccgcctgaaagccacaa

SEQ ID NO: 1467651 - DNA, 21 bp, Homo sapiens
agccgcgggcgctcgctcagg

SEQ ID NO: 1467652 - DNA, 18 bp, Homo sapiens
agccgctaggagagactg

SEQ ID NO: 1467653 - DNA, 19 bp, Homo sapiens
agccgctaggagagactga

SEQ ID NO: 1467654 - DNA, 14 bp, Homo sapiens
agccgctcctgtct

SEQ ID NO: 1467655 - DNA, 19 bp, Homo sapiens
agccgctcctgtctgccag

SEQ ID NO: 1467656 - DNA, 19 bp, Homo sapiens
agccgctgcagggctccca

SEQ ID NO: 1467657 - DNA, 20 bp, Homo sapiens
agccggacacggcttcactg

SEQ ID NO: 1467658 - DNA, 21 bp, Homo sapiens
agccggacacggcttcactga

SEQ ID NO: 1467659 - DNA, 17 bp, Homo sapiens
agccggacagctgccca

SEQ ID NO: 1467660 - DNA, 18 bp, Homo sapiens
agccggacagctgcccag

SEQ ID NO: 1467661 - DNA, 23 bp, Homo sapiens
agccggacagctgcccagacaca

SEQ ID NO: 1467662 - DNA, 16 bp, Homo sapiens
agccggcacagggtct

SEQ ID NO: 1467663 - DNA, 22 bp, Homo sapiens
agccggcacctacatccccagg

SEQ ID NO: 1467664 - DNA, 19 bp, Homo sapiens
agccggcctctctggcctc

SEQ ID NO: 1467665 - DNA, 13 bp, Homo sapiens
agccggcggccca

SEQ ID NO: 1467666 - DNA, 15 bp, Homo sapiens
agccggcggcctctc

SEQ ID NO: 1467667 - DNA, 16 bp, Homo sapiens
agccggcggcctctcg

SEQ ID NO: 1467668 - DNA, 14 bp, Homo sapiens
agccgggcccctgg

SEQ ID NO: 1467669 - DNA, 17 bp, Homo sapiens
agccgggcccctgggct

SEQ ID NO: 1467670 - DNA, 16 bp, Homo sapiens
agccgggcctcccacc

SEQ ID NO: 1467671 - DNA, 13 bp, Homo sapiens
agccggggcctta

SEQ ID NO: 1467672 - DNA, 22 bp, Homo sapiens
agccggtgcctggcgcccctgc

SEQ ID NO: 1467673 - DNA, 15 bp, Homo sapiens
agccggtggtgcccg

SEQ ID NO: 1467674 - DNA, 18 bp, Homo sapiens
agccgtattttacatgaa

SEQ ID NO: 1467675 - DNA, 14 bp, Homo sapiens
agccgtccatggca

SEQ ID NO: 1467676 - DNA, 17 bp, Homo sapiens
agccgtccatggcacca

SEQ ID NO: 1467677 - DNA, 22 bp, Homo sapiens
agccgtccatggcaccagcccc

SEQ ID NO: 1467678 - DNA, 20 bp, Homo sapiens
agccgtctgactccagagtc

SEQ ID NO: 1467679 - DNA, 20 bp, Homo sapiens
agccgtgatgctcaggcttg

SEQ ID NO: 1467680 - DNA, 15 bp, Homo sapiens
agccgtgccttcagc

SEQ ID NO: 1467681 - DNA, 16 bp, Homo sapiens
agccgtgccttcagct

SEQ ID NO: 1467682 - DNA, 17 bp, Homo sapiens
agccgtgccttcagctc

SEQ ID NO: 1467683 - DNA, 13 bp, Homo sapiens
agccgtggcttcc

SEQ ID NO: 1467684 - DNA, 12 bp, Homo sapiens
agcctaaagatt

SEQ ID NO: 1467685 - DNA, 21 bp, Homo sapiens
agcctaagatatacttgtttt

SEQ ID NO: 1467686 - DNA, 12 bp, Homo sapiens
agcctaatcaca

SEQ ID NO: 1467687 - DNA, 23 bp, Homo sapiens
agcctaatgaaagggaaagtcag

SEQ ID NO: 1467688 - DNA, 14 bp, Homo sapiens
agcctacctgtatg

SEQ ID NO: 1467689 - DNA, 14 bp, Homo sapiens
agcctactctcctt

SEQ ID NO: 1467690 - DNA, 19 bp, Homo sapiens
agcctagacaacctttctg

SEQ ID NO: 1467691 - DNA, 18 bp, Homo sapiens
agcctagccgacctcagc

SEQ ID NO: 1467692 - DNA, 19 bp, Homo sapiens
agcctagccgacctcagcc

SEQ ID NO: 1467693 - DNA, 21 bp, Homo sapiens
agcctagccgacctcagcctt

SEQ ID NO: 1467694 - DNA, 19 bp, Homo sapiens
agcctagcggagcccagcc

SEQ ID NO: 1467695 - DNA, 12 bp, Homo sapiens
agcctaggccgc

SEQ ID NO: 1467696 - DNA, 20 bp, Homo sapiens
agcctagttcatccaatcct

SEQ ID NO: 1467697 - DNA, 20 bp, Homo sapiens
agcctatatatatagtcaaa

SEQ ID NO: 1467698 - DNA, 16 bp, Homo sapiens
agcctatatcaaacat

SEQ ID NO: 1467699 - DNA, 22 bp, Homo sapiens
agcctatatcagtcgttttagt

SEQ ID NO: 1467700 - DNA, 22 bp, Homo sapiens
agcctcaaggttttaggttcta

SEQ ID NO: 1467701 - DNA, 21 bp, Homo sapiens
agcctcaagtcttatttcctc

SEQ ID NO: 1467702 - DNA, 22 bp, Homo sapiens
agcctcacttgaatgtgtcact

SEQ ID NO: 1467703 - DNA, 18 bp, Homo sapiens
agcctcagaaagggattg

SEQ ID NO: 1467704 - DNA, 14 bp, Homo sapiens
agcctcagaagaaa

SEQ ID NO: 1467705 - DNA, 23 bp, Homo sapiens
agcctcagaaggccccagagaga

SEQ ID NO: 1467706 - DNA, 15 bp, Homo sapiens
agcctcagtgccact

SEQ ID NO: 1467707 - DNA, 18 bp, Homo sapiens
agcctcagtgccacttga

SEQ ID NO: 1467708 - DNA, 23 bp, Homo sapiens
agcctcagtgccacttgacattc

SEQ ID NO: 1467709 - DNA, 17 bp, Homo sapiens
agcctcatccgaggcag

SEQ ID NO: 1467710 - DNA, 18 bp, Homo sapiens
agcctcatccgaggcagg

SEQ ID NO: 1467711 - DNA, 13 bp, Homo sapiens
agcctcatcctga

SEQ ID NO: 1467712 - DNA, 22 bp, Homo sapiens
agcctcatgccaaccctgggct

SEQ ID NO: 1467713 - DNA, 17 bp, Homo sapiens
agcctcatgttctgtgg

SEQ ID NO: 1467714 - DNA, 13 bp, Homo sapiens
agcctccaagggt

SEQ ID NO: 1467715 - DNA, 22 bp, Homo sapiens
agcctccaatgcattggcctct

SEQ ID NO: 1467716 - DNA, 15 bp, Homo sapiens
agcctccacagcgag

SEQ ID NO: 1467717 - DNA, 20 bp, Homo sapiens
agcctccactgcctctggaa

SEQ ID NO: 1467718 - DNA, 14 bp, Homo sapiens
agcctccagagcca

SEQ ID NO: 1467719 - DNA, 22 bp, Homo sapiens
agcctccagagccagcctggga

SEQ ID NO: 1467720 - DNA, 23 bp, Homo sapiens
agcctccagagccagcctgggac

SEQ ID NO: 1467721 - DNA, 12 bp, Homo sapiens
agcctccagggc

SEQ ID NO: 1467722 - DNA, 13 bp, Homo sapiens
agcctcccaaagt

SEQ ID NO: 1467723 - DNA, 11 bp, Homo sapiens
agcctcccaca

SEQ ID NO: 1467724 - DNA, 17 bp, Homo sapiens
agcctcccaccagagcc

SEQ ID NO: 1467725 - DNA, 13 bp, Homo sapiens
agcctcccacccc

SEQ ID NO: 1467726 - DNA, 15 bp, Homo sapiens
agcctcccccaaagc

SEQ ID NO: 1467727 - DNA, 18 bp, Homo sapiens
agcctcccccgccagccc

SEQ ID NO: 1467728 - DNA, 13 bp, Homo sapiens
agcctccctgaag

SEQ ID NO: 1467729 - DNA, 15 bp, Homo sapiens
agcctccctgaagcc

SEQ ID NO: 1467730 - DNA, 19 bp, Homo sapiens
agcctccctgtctccagct

SEQ ID NO: 1467731 - DNA, 22 bp, Homo sapiens
agcctccctgtctccagctgcc

SEQ ID NO: 1467732 - DNA, 24 bp, Homo sapiens
agcctccctgtctccagctgcctg

SEQ ID NO: 1467733 - DNA, 21 bp, Homo sapiens
agcctcccttccatgccccag

SEQ ID NO: 1467734 - DNA, 22 bp, Homo sapiens
agcctcccttccatgccccagg

SEQ ID NO: 1467735 - DNA, 16 bp, Homo sapiens
agcctccgagagggag

SEQ ID NO: 1467736 - DNA, 18 bp, Homo sapiens
agcctccgagagggagag

SEQ ID NO: 1467737 - DNA, 16 bp, Homo sapiens
agcggggtcccctctg

SEQ ID NO: 1467738 - DNA, 17 bp, Homo sapiens
agcggtccctgtccctc

SEQ ID NO: 1467739 - DNA, 14 bp, Homo sapiens
agcggtttggggag

SEQ ID NO: 1467740 - DNA, 22 bp, Homo sapiens
agcggtttggggagcagagaca

SEQ ID NO: 1467741 - DNA, 15 bp, Homo sapiens
agcgtcaagacattt

SEQ ID NO: 1467742 - DNA, 17 bp, Homo sapiens
agcgtcactccagtgct

SEQ ID NO: 1467743 - DNA, 20 bp, Homo sapiens
agcgtcactccagtgctcag

SEQ ID NO: 1467744 - DNA, 18 bp, Homo sapiens
agcgtccctagcagtgaa

SEQ ID NO: 1467745 - DNA, 11 bp, Homo sapiens
agcgtcctgcc

SEQ ID NO: 1467746 - DNA, 12 bp, Homo sapiens
agcgtcctgccc

SEQ ID NO: 1467747 - DNA, 16 bp, Homo sapiens
agcgtccttccccctg

SEQ ID NO: 1467748 - DNA, 21 bp, Homo sapiens
agcgtctgctcataggacctg

SEQ ID NO: 1467749 - DNA, 22 bp, Homo sapiens
agcgtctgctcataggacctgc

SEQ ID NO: 1467750 - DNA, 14 bp, Homo sapiens
agcgtggactctgc

SEQ ID NO: 1467751 - DNA, 21 bp, Homo sapiens
agcgtggcgcagtggccctga

SEQ ID NO: 1467752 - DNA, 13 bp, Homo sapiens
agcgtggcttaga

SEQ ID NO: 1467753 - DNA, 15 bp, Homo sapiens
agcgttcctggcctt

SEQ ID NO: 1467754 - DNA, 15 bp, Homo sapiens
agcgttctctgtcct

SEQ ID NO: 1467755 - DNA, 16 bp, Homo sapiens
agcgttctggactctg

SEQ ID NO: 1467756 - DNA, 14 bp, Homo sapiens
agctaaaaatgaac

SEQ ID NO: 1467757 - DNA, 15 bp, Homo sapiens
agctaaaaatgaacc

SEQ ID NO: 1467758 - DNA, 18 bp, Homo sapiens
agctaaaccaaggactga

SEQ ID NO: 1467759 - DNA, 18 bp, Homo sapiens
agctaaactccttcctgg

SEQ ID NO: 1467760 - DNA, 23 bp, Homo sapiens
agctaaactccttcctggcctga

SEQ ID NO: 1467761 - DNA, 15 bp, Homo sapiens
agctaaagtaacaga

SEQ ID NO: 1467762 - DNA, 18 bp, Homo sapiens
agctaaagtaacagagca

SEQ ID NO: 1467763 - DNA, 13 bp, Homo sapiens
agctaaatccttt

SEQ ID NO: 1467764 - DNA, 12 bp, Homo sapiens
agctaaatgctt

SEQ ID NO: 1467765 - DNA, 13 bp, Homo sapiens
agctaaatgcttc

SEQ ID NO: 1467766 - DNA, 11 bp, Homo sapiens
agctaaattac

SEQ ID NO: 1467767 - DNA, 18 bp, Homo sapiens
agctaaattacaattgtc

SEQ ID NO: 1467768 - DNA, 17 bp, Homo sapiens
agctaactccgagagca

SEQ ID NO: 1467769 - DNA, 17 bp, Homo sapiens
agctaagaacctggaac

SEQ ID NO: 1467770 - DNA, 18 bp, Homo sapiens
agctaagatagaaagctg

SEQ ID NO: 1467771 - DNA, 23 bp, Homo sapiens
agctaagatagaaagctggactg

SEQ ID NO: 1467772 - DNA, 16 bp, Homo sapiens
agctaaggacatttcc

SEQ ID NO: 1467773 - DNA, 19 bp, Homo sapiens
agctaaggacatttcccag

SEQ ID NO: 1467774 - DNA, 13 bp, Homo sapiens
agctaaggctcta

SEQ ID NO: 1467775 - DNA, 20 bp, Homo sapiens
agctaaggctctatgagtct

SEQ ID NO: 1467776 - DNA, 16 bp, Homo sapiens
agctaataaaccagat

SEQ ID NO: 1467777 - DNA, 12 bp, Homo sapiens
agctaataaatc

SEQ ID NO: 1467778 - DNA, 19 bp, Homo sapiens
agctaataaatctcttctt

SEQ ID NO: 1467779 - DNA, 16 bp, Homo sapiens
agctaatctgaccgtt

SEQ ID NO: 1467780 - DNA, 23 bp, Homo sapiens
agctaatctgtagggctggacct

SEQ ID NO: 1467781 - DNA, 24 bp, Homo sapiens
agctaatgtgcagggatattgcct

SEQ ID NO: 1467782 - DNA, 19 bp, Homo sapiens
agctaattctttgacctgt

SEQ ID NO: 1467783 - DNA, 17 bp, Homo sapiens
agctacaaccctaccct

SEQ ID NO: 1467784 - DNA, 22 bp, Homo sapiens
agctacaggaagcaccccatgc

SEQ ID NO: 1467785 - DNA, 18 bp, Homo sapiens
agctacatgttctttgta

SEQ ID NO: 1467786 - DNA, 21 bp, Homo sapiens
agctacatgttctttgtacct

SEQ ID NO: 1467787 - DNA, 20 bp, Homo sapiens
agctacattcctcagctgcc

SEQ ID NO: 1467788 - DNA, 14 bp, Homo sapiens
agctaccctcagcc

SEQ ID NO: 1467789 - DNA, 20 bp, Homo sapiens
agctaccctttttctccagc

SEQ ID NO: 1467790 - DNA, 22 bp, Homo sapiens
agctacctgctcagccctgcac

SEQ ID NO: 1467791 - DNA, 13 bp, Homo sapiens
agctactaatgat

SEQ ID NO: 1467792 - DNA, 21 bp, Homo sapiens
agctactcaagaggctgaggc

SEQ ID NO: 1467793 - DNA, 22 bp, Homo sapiens
agctactcaagaggctgaggca

SEQ ID NO: 1467794 - DNA, 15 bp, Homo sapiens
agctactcagaagcc

SEQ ID NO: 1467795 - DNA, 20 bp, Homo sapiens
agctactcagaagcctgagg

SEQ ID NO: 1467796 - DNA, 17 bp, Homo sapiens
agctactcaggaggctg

SEQ ID NO: 1467797 - DNA, 16 bp, Homo sapiens
agctactcagtggggc

SEQ ID NO: 1467798 - DNA, 22 bp, Homo sapiens
agctactctccccacgagggct

SEQ ID NO: 1467799 - DNA, 23 bp, Homo sapiens
agctactctccccacgagggctg

SEQ ID NO: 1467800 - DNA, 12 bp, Homo sapiens
agctactctgtc

SEQ ID NO: 1467801 - DNA, 14 bp, Homo sapiens
agctactctgtcca

SEQ ID NO: 1467802 - DNA, 16 bp, Homo sapiens
agctactctgtccagg

SEQ ID NO: 1467803 - DNA, 18 bp, Homo sapiens
agctactctgtccaggcc

SEQ ID NO: 1467804 - DNA, 23 bp, Homo sapiens
agctactctgtccaggccactgt

SEQ ID NO: 1467805 - DNA, 15 bp, Homo sapiens
agctactgagacttg

SEQ ID NO: 1467806 - DNA, 18 bp, Homo sapiens
agctactgatgaaatctg

SEQ ID NO: 1467807 - DNA, 14 bp, Homo sapiens
agctactggggagg

SEQ ID NO: 1467808 - DNA, 21 bp, Homo sapiens
agctactggggaggctgaggc

SEQ ID NO: 1467809 - DNA, 16 bp, Homo sapiens
agctacttcctcctcc

SEQ ID NO: 1467810 - DNA, 21 bp, Homo sapiens
agctacttgggaggctgaggc

SEQ ID NO: 1467811 - DNA, 14 bp, Homo sapiens
agctacttggtttg

SEQ ID NO: 1467812 - DNA, 19 bp, Homo sapiens
agctagaaaaataaaatgt

SEQ ID NO: 1467813 - DNA, 15 bp, Homo sapiens
agctagaaatatgat

SEQ ID NO: 1467814 - DNA, 15 bp, Homo sapiens
agctagaagtgggcc

SEQ ID NO: 1467815 - DNA, 16 bp, Homo sapiens
agctagacacatgaag

SEQ ID NO: 1467816 - DNA, 20 bp, Homo sapiens
agctagatacgaaatcagtt

SEQ ID NO: 1467817 - DNA, 16 bp, Homo sapiens
agctagatgcccctgc

SEQ ID NO: 1467818 - DNA, 16 bp, Homo sapiens
agctagcgctgccgca

SEQ ID NO: 1467819 - DNA, 21 bp, Homo sapiens
agctagcgctgccgcacccca

SEQ ID NO: 1467820 - DNA, 15 bp, Homo sapiens
agctagctgccactt

SEQ ID NO: 1467821 - DNA, 21 bp, Homo sapiens
agctaggaagagcaggactcc

SEQ ID NO: 1467822 - DNA, 15 bp, Homo sapiens
agctaggactgagga

SEQ ID NO: 1467823 - DNA, 16 bp, Homo sapiens
agctaggccccagagg

SEQ ID NO: 1467824 - DNA, 18 bp, Homo sapiens
agctaggccccagaggcc

SEQ ID NO: 1467825 - DNA, 15 bp, Homo sapiens
agctagtagcaatgt

SEQ ID NO: 1467826 - DNA, 19 bp, Homo sapiens
agctagtagcaatgtgcct

SEQ ID NO: 1467827 - DNA, 17 bp, Homo sapiens
agctagtttgctttttg

SEQ ID NO: 1467828 - DNA, 22 bp, Homo sapiens
agctagttttattcttggtttt

SEQ ID NO: 1467829 - DNA, 13 bp, Homo sapiens
agctataggaaat

SEQ ID NO: 1467830 - DNA, 11 bp, Homo sapiens
agctatataag

SEQ ID NO: 1467831 - DNA, 13 bp, Homo sapiens
agctatcagtgct

SEQ ID NO: 1467832 - DNA, 17 bp, Homo sapiens
agctatctctcagtgaa

SEQ ID NO: 1467833 - DNA, 20 bp, Homo sapiens
agctatgatttttttttcca

SEQ ID NO: 1467834 - DNA, 16 bp, Homo sapiens
agctatggcccagaaa

SEQ ID NO: 1467835 - DNA, 21 bp, Homo sapiens
agctatggcccagaaacaaca

SEQ ID NO: 1467836 - DNA, 19 bp, Homo sapiens
agctattcagtaataactc

SEQ ID NO: 1467837 - DNA, 19 bp, Homo sapiens
agctattctcatgcctcag

SEQ ID NO: 1467838 - DNA, 23 bp, Homo sapiens
agctattggaatttttttttcct

SEQ ID NO: 1467839 - DNA, 15 bp, Homo sapiens
agctatttaaagcat

SEQ ID NO: 1467840 - DNA, 23 bp, Homo sapiens
agctatttaatatctggcactgt

SEQ ID NO: 1467841 - DNA, 17 bp, Homo sapiens
agctatttatgggcccc

SEQ ID NO: 1467842 - DNA, 16 bp, Homo sapiens
agctatttgttaaaat

SEQ ID NO: 1467843 - DNA, 13 bp, Homo sapiens
agctattttgtga

SEQ ID NO: 1467844 - DNA, 18 bp, Homo sapiens
agctcaaatctctgttac

SEQ ID NO: 1467845 - DNA, 12 bp, Homo sapiens
agctcaaatgaa

SEQ ID NO: 1467846 - DNA, 23 bp, Homo sapiens
agctcaaatgaaatgtatgcatt

SEQ ID NO: 1467847 - DNA, 23 bp, Homo sapiens
agctcaactcacagcttctccaa

SEQ ID NO: 1467848 - DNA, 24 bp, Homo sapiens
agctcaactcacagcttctccaag

SEQ ID NO: 1467849 - DNA, 18 bp, Homo sapiens
agctcaagatgacagctc

SEQ ID NO: 1467850 - DNA, 14 bp, Homo sapiens
agctcaatggactg

SEQ ID NO: 1467851 - DNA, 21 bp, Homo sapiens
agctcacaccctaccttcccc

SEQ ID NO: 1467852 - DNA, 15 bp, Homo sapiens
agctggtttcctcat

SEQ ID NO: 1467853 - DNA, 14 bp, Homo sapiens
agctgtaagcaagt

SEQ ID NO: 1467854 - DNA, 13 bp, Homo sapiens
agctgtaagggca

SEQ ID NO: 1467855 - DNA, 15 bp, Homo sapiens
agctgtaagggcagt

SEQ ID NO: 1467856 - DNA, 19 bp, Homo sapiens
agctgtaagggcagtgccc

SEQ ID NO: 1467857 - DNA, 20 bp, Homo sapiens
agctgtaatttcgccttaaa

SEQ ID NO: 1467858 - DNA, 16 bp, Homo sapiens
agctgtacgaaaaaga

SEQ ID NO: 1467859 - DNA, 13 bp, Homo sapiens
agctgtactcaga

SEQ ID NO: 1467860 - DNA, 16 bp, Homo sapiens
agctgtactcagagca

SEQ ID NO: 1467861 - DNA, 21 bp, Homo sapiens
agctgtactcagagcagagca

SEQ ID NO: 1467862 - DNA, 20 bp, Homo sapiens
agctgtacttcttgaatata

SEQ ID NO: 1467863 - DNA, 15 bp, Homo sapiens
agctgtagaaatgta

SEQ ID NO: 1467864 - DNA, 14 bp, Homo sapiens
agctgtagccatgg

SEQ ID NO: 1467865 - DNA, 21 bp, Homo sapiens
agctgtagccatggctcaggc

SEQ ID NO: 1467866 - DNA, 13 bp, Homo sapiens
agctgtaggagag

SEQ ID NO: 1467867 - DNA, 19 bp, Homo sapiens
agctgtagttttccctgca

SEQ ID NO: 1467868 - DNA, 23 bp, Homo sapiens
agctgtataattaattgtcatta

SEQ ID NO: 1467869 - DNA, 15 bp, Homo sapiens
agctgtatgatttgt

SEQ ID NO: 1467870 - DNA, 20 bp, Homo sapiens
agctgtatgatttgttttga

SEQ ID NO: 1467871 - DNA, 16 bp, Homo sapiens
agctgtattgtctgaa

SEQ ID NO: 1467872 - DNA, 15 bp, Homo sapiens
agctgtcacaacttg

SEQ ID NO: 1467873 - DNA, 18 bp, Homo sapiens
agctgtcacaacttgtgt

SEQ ID NO: 1467874 - DNA, 18 bp, Homo sapiens
agctgtcagatgtcacat

SEQ ID NO: 1467875 - DNA, 15 bp, Homo sapiens
agctgtcccatgggg

SEQ ID NO: 1467876 - DNA, 17 bp, Homo sapiens
agctgtcccctctgtca

SEQ ID NO: 1467877 - DNA, 12 bp, Homo sapiens
agctgtccctgc

SEQ ID NO: 1467878 - DNA, 13 bp, Homo sapiens
agctgtccctgca

SEQ ID NO: 1467879 - DNA, 15 bp, Homo sapiens
agctgtccctgcagg

SEQ ID NO: 1467880 - DNA, 20 bp, Homo sapiens
agctgtccctgcagggccat

SEQ ID NO: 1467881 - DNA, 22 bp, Homo sapiens
agctgtccctgtcaccaagctc

SEQ ID NO: 1467882 - DNA, 21 bp, Homo sapiens
agctgtcctctcagaactcct

SEQ ID NO: 1467883 - DNA, 21 bp, Homo sapiens
agctgtcgctgcctccatggc

SEQ ID NO: 1467884 - DNA, 11 bp, Homo sapiens
agctgtctgct

SEQ ID NO: 1467885 - DNA, 17 bp, Homo sapiens
agctgtctgctcagaca

SEQ ID NO: 1467886 - DNA, 14 bp, Homo sapiens
agctgtcttcacat

SEQ ID NO: 1467887 - DNA, 14 bp, Homo sapiens
agctgtgccagcag

SEQ ID NO: 1467888 - DNA, 17 bp, Homo sapiens
agctgtgccagcagggg

SEQ ID NO: 1467889 - DNA, 18 bp, Homo sapiens
agctgtggcagagttaca

SEQ ID NO: 1467890 - DNA, 22 bp, Homo sapiens
agctgtggcagagttacagttc

SEQ ID NO: 1467891 - DNA, 16 bp, Homo sapiens
agctgtggctccctcc

SEQ ID NO: 1467892 - DNA, 20 bp, Homo sapiens
agctgtggctccctcctcct

SEQ ID NO: 1467893 - DNA, 15 bp, Homo sapiens
agctgtggctggagg

SEQ ID NO: 1467894 - DNA, 21 bp, Homo sapiens
agctgtggctggaggagctgg

SEQ ID NO: 1467895 - DNA, 20 bp, Homo sapiens
agctgtggggaacacagcta

SEQ ID NO: 1467896 - DNA, 22 bp, Homo sapiens
agctgtggggaacacagctaca

SEQ ID NO: 1467897 - DNA, 15 bp, Homo sapiens
agctgtgtccttgca

SEQ ID NO: 1467898 - DNA, 18 bp, Homo sapiens
agctgtgtccttgcacct

SEQ ID NO: 1467899 - DNA, 21 bp, Homo sapiens
agctgtgtccttgcacctgca

SEQ ID NO: 1467900 - DNA, 13 bp, Homo sapiens
agctgtgtctgcc

SEQ ID NO: 1467901 - DNA, 16 bp, Homo sapiens
agctgttaccattcac

SEQ ID NO: 1467902 - DNA, 17 bp, Homo sapiens
agctgttaccattcaca

SEQ ID NO: 1467903 - DNA, 19 bp, Homo sapiens
agctgttaccattcacaat

SEQ ID NO: 1467904 - DNA, 12 bp, Homo sapiens
agctgttattct

SEQ ID NO: 1467905 - DNA, 13 bp, Homo sapiens
agctgttattctt

SEQ ID NO: 1467906 - DNA, 17 bp, Homo sapiens
agctgttattcttgtta

SEQ ID NO: 1467907 - DNA, 18 bp, Homo sapiens
agctgttcctgttcagta

SEQ ID NO: 1467908 - DNA, 15 bp, Homo sapiens
agctgttgagctgtt

SEQ ID NO: 1467909 - DNA, 16 bp, Homo sapiens
agctgttgagctgttt

SEQ ID NO: 1467910 - DNA, 17 bp, Homo sapiens
agctgttgagctgtttt

SEQ ID NO: 1467911 - DNA, 19 bp, Homo sapiens
agctgttgggagaaagcaa

SEQ ID NO: 1467912 - DNA, 19 bp, Homo sapiens
agctgttgtgagctttgaa

SEQ ID NO: 1467913 - DNA, 20 bp, Homo sapiens
agctgttgtgagctttgaag

SEQ ID NO: 1467914 - DNA, 21 bp, Homo sapiens
agctgttgtgagctttgaagt

SEQ ID NO: 1467915 - DNA, 17 bp, Homo sapiens
agctgtttatggcctca

SEQ ID NO: 1467916 - DNA, 18 bp, Homo sapiens
agctgtttatggcctcag

SEQ ID NO: 1467917 - DNA, 22 bp, Homo sapiens
agctgtttatttattcactgta

SEQ ID NO: 1467918 - DNA, 14 bp, Homo sapiens
agctgtttcaaagt

SEQ ID NO: 1467919 - DNA, 14 bp, Homo sapiens
agctgtttccatag

SEQ ID NO: 1467920 - DNA, 12 bp, Homo sapiens
agctgtttctca

SEQ ID NO: 1467921 - DNA, 17 bp, Homo sapiens
agctgtttctcatgaag

SEQ ID NO: 1467922 - DNA, 14 bp, Homo sapiens
agctgttttcttct

SEQ ID NO: 1467923 - DNA, 17 bp, Homo sapiens
agcttacaagccagctg

SEQ ID NO: 1467924 - DNA, 14 bp, Homo sapiens
agcttacaggaagc

SEQ ID NO: 1467925 - DNA, 21 bp, Homo sapiens
agcttacattgaaaacagata

SEQ ID NO: 1467926 - DNA, 17 bp, Homo sapiens
agcttacattttcctga

SEQ ID NO: 1467927 - DNA, 20 bp, Homo sapiens
agcttaccagaagcttccat

SEQ ID NO: 1467928 - DNA, 22 bp, Homo sapiens
agcttaccagaagcttccatag

SEQ ID NO: 1467929 - DNA, 20 bp, Homo sapiens
agcttacccaagctgtggca

SEQ ID NO: 1467930 - DNA, 15 bp, Homo sapiens
agcttagaaactgga

SEQ ID NO: 1467931 - DNA, 15 bp, Homo sapiens
agcttagacctcagc

SEQ ID NO: 1467932 - DNA, 17 bp, Homo sapiens
agcttagacctcagcct

SEQ ID NO: 1467933 - DNA, 18 bp, Homo sapiens
agcttagacctcagcctg

SEQ ID NO: 1467934 - DNA, 19 bp, Homo sapiens
agcttagacctcagcctgt

SEQ ID NO: 1467935 - DNA, 20 bp, Homo sapiens
agcttagagtatacctccta

SEQ ID NO: 1467936 - DNA, 23 bp, Homo sapiens
agcttataagagggcatatacag

SEQ ID NO: 1467937 - DNA, 21 bp, Homo sapiens
agcttatagaataaaagctat

SEQ ID NO: 1467938 - DNA, 11 bp, Homo sapiens
agcttatctct

SEQ ID NO: 1467939 - DNA, 17 bp, Homo sapiens
agcttatctcttttata

SEQ ID NO: 1467940 - DNA, 22 bp, Homo sapiens
agcttattcatctgtttttctt

SEQ ID NO: 1467941 - DNA, 14 bp, Homo sapiens
agcttattggccac

SEQ ID NO: 1467942 - DNA, 15 bp, Homo sapiens
agcttattggccact

SEQ ID NO: 1467943 - DNA, 17 bp, Homo sapiens
agcttattggccactgg

SEQ ID NO: 1467944 - DNA, 21 bp, Homo sapiens
agcttattgtgtgcgctgcct

SEQ ID NO: 1467945 - DNA, 22 bp, Homo sapiens
agcttattgtttctctgaaagt

SEQ ID NO: 1467946 - DNA, 16 bp, Homo sapiens
agcttatttctaacta

SEQ ID NO: 1467947 - DNA, 19 bp, Homo sapiens
agcttcaaccctcagcctt

SEQ ID NO: 1467948 - DNA, 15 bp, Homo sapiens
agcttcaatataaga

SEQ ID NO: 1467949 - DNA, 15 bp, Homo sapiens
agcttcagagcctag

SEQ ID NO: 1467950 - DNA, 17 bp, Homo sapiens
agcttcagagcctagcc

SEQ ID NO: 1467951 - DNA, 20 bp, Homo sapiens
agcttcagagcctagccacc

SEQ ID NO: 1467952 - DNA, 17 bp, Homo sapiens
agcttcagccaggagct

SEQ ID NO: 1467953 - DNA, 20 bp, Homo sapiens
agcttcagctcaactcacag

SEQ ID NO: 1467954 - DNA, 15 bp, Homo sapiens
agcttcagttgcttg

SEQ ID NO: 1467955 - DNA, 16 bp, Homo sapiens
agcttcagttgcttgt

SEQ ID NO: 1467956 - DNA, 15 bp, Homo sapiens
agcttcatgcctttg

SEQ ID NO: 1467957 - DNA, 17 bp, Homo sapiens
agcttcatgcctttgta

SEQ ID NO: 1467958 - DNA, 18 bp, Homo sapiens
agcttcatgcctttgtaa

SEQ ID NO: 1467959 - DNA, 22 bp, Homo sapiens
agcttcatgcctttgtaagtta

SEQ ID NO: 1467960 - DNA, 19 bp, Homo sapiens
agcttccaaagcctagaca

SEQ ID NO: 1467961 - DNA, 19 bp, Homo sapiens
agcttccacaaaattagaa

SEQ ID NO: 1467962 - DNA, 19 bp, Homo sapiens
agcttcccacacctgcctg

SEQ ID NO: 1467963 - DNA, 20 bp, Homo sapiens
agcttccgctttgaaagaag

SEQ ID NO: 1467964 - DNA, 19 bp, Homo sapiens
agcttcctcacacccctgt

SEQ ID NO: 1467965 - DNA, 20 bp, Homo sapiens
agcttcctcacacccctgtc

SEQ ID NO: 1467966 - DNA, 24 bp, Homo sapiens
agcttcctcacacccctgtcccac

SEQ ID NO: 1467967 - DNA, 15 bp, Homo sapiens
aggacttccctgtgt

SEQ ID NO: 1467968 - DNA, 21 bp, Homo sapiens
aggacttcctgtccagctcca

SEQ ID NO: 1467969 - DNA, 14 bp, Homo sapiens
aggacttctgcctg

SEQ ID NO: 1467970 - DNA, 16 bp, Homo sapiens
aggacttggtctgatt

SEQ ID NO: 1467971 - DNA, 13 bp, Homo sapiens
aggacttgtgtct

SEQ ID NO: 1467972 - DNA, 15 bp, Homo sapiens
aggactttgtacatt

SEQ ID NO: 1467973 - DNA, 19 bp, Homo sapiens
aggagaaatgcaataactc

SEQ ID NO: 1467974 - DNA, 17 bp, Homo sapiens
aggagaagcacagctcc

SEQ ID NO: 1467975 - DNA, 18 bp, Homo sapiens
aggagaagcacagctcct

SEQ ID NO: 1467976 - DNA, 12 bp, Homo sapiens
aggagaagccag

SEQ ID NO: 1467977 - DNA, 13 bp, Homo sapiens
aggagaagctgca

SEQ ID NO: 1467978 - DNA, 17 bp, Homo sapiens
aggagaagctgcatcca

SEQ ID NO: 1467979 - DNA, 16 bp, Homo sapiens
aggagaaggaaggaga

SEQ ID NO: 1467980 - DNA, 18 bp, Homo sapiens
aggagaagggctggggcc

SEQ ID NO: 1467981 - DNA, 21 bp, Homo sapiens
aggagaagggggctctgcccc

SEQ ID NO: 1467982 - DNA, 19 bp, Homo sapiens
aggagaagtattcctgttg

SEQ ID NO: 1467983 - DNA, 18 bp, Homo sapiens
aggagaagtgctccctgg

SEQ ID NO: 1467984 - DNA, 22 bp, Homo sapiens
aggagaatagcagagagccaaa

SEQ ID NO: 1467985 - DNA, 14 bp, Homo sapiens
aggagaatcacctg

SEQ ID NO: 1467986 - DNA, 22 bp, Homo sapiens
aggagaatcacctgaaccccag

SEQ ID NO: 1467987 - DNA, 12 bp, Homo sapiens
aggagaatcact

SEQ ID NO: 1467988 - DNA, 15 bp, Homo sapiens
aggagaatgagcctc

SEQ ID NO: 1467989 - DNA, 20 bp, Homo sapiens
aggagaatggtgtgaacccg

SEQ ID NO: 1467990 - DNA, 15 bp, Homo sapiens
aggagacagaaagcc

SEQ ID NO: 1467991 - DNA, 13 bp, Homo sapiens
aggagacagagcc

SEQ ID NO: 1467992 - DNA, 15 bp, Homo sapiens
aggagacagagccaa

SEQ ID NO: 1467993 - DNA, 21 bp, Homo sapiens
aggagacagagccaagcactg

SEQ ID NO: 1467994 - DNA, 20 bp, Homo sapiens
aggagaccaagtcctggcta

SEQ ID NO: 1467995 - DNA, 16 bp, Homo sapiens
aggagaccagctcaga

SEQ ID NO: 1467996 - DNA, 13 bp, Homo sapiens
aggagacctccag

SEQ ID NO: 1467997 - DNA, 14 bp, Homo sapiens
aggagactcacctc

SEQ ID NO: 1467998 - DNA, 19 bp, Homo sapiens
aggagactcacctctgcct

SEQ ID NO: 1467999 - DNA, 19 bp, Homo sapiens
aggagagacccctcccctc

SEQ ID NO: 1468000 - DNA, 16 bp, Homo sapiens
aggagagagtcccaga

SEQ ID NO: 1468001 - DNA, 15 bp, Homo sapiens
aggagagcctgctgc

SEQ ID NO: 1468002 - DNA, 16 bp, Homo sapiens
aggagagcctgctgca

SEQ ID NO: 1468003 - DNA, 19 bp, Homo sapiens
aggagaggggaagggccag

SEQ ID NO: 1468004 - DNA, 22 bp, Homo sapiens
aggagaggggaagggccagtct

SEQ ID NO: 1468005 - DNA, 21 bp, Homo sapiens
aggagagtcccagagcaggag

SEQ ID NO: 1468006 - DNA, 20 bp, Homo sapiens
aggagagtcggtctgctttg

SEQ ID NO: 1468007 - DNA, 17 bp, Homo sapiens
aggagagtgcagatctg

SEQ ID NO: 1468008 - DNA, 23 bp, Homo sapiens
aggagatagacgggttgaaagac

SEQ ID NO: 1468009 - DNA, 18 bp, Homo sapiens
aggagatatctgagggag

SEQ ID NO: 1468010 - DNA, 20 bp, Homo sapiens
aggagatatctgagggagga

SEQ ID NO: 1468011 - DNA, 23 bp, Homo sapiens
aggagatcgacaccatcctggct

SEQ ID NO: 1468012 - DNA, 14 bp, Homo sapiens
aggagatgaccagg

SEQ ID NO: 1468013 - DNA, 15 bp, Homo sapiens
aggagatggagggct

SEQ ID NO: 1468014 - DNA, 19 bp, Homo sapiens
aggagatttaccacttttt

SEQ ID NO: 1468015 - DNA, 20 bp, Homo sapiens
aggagcaaaaatctgagaaa

SEQ ID NO: 1468016 - DNA, 22 bp, Homo sapiens
aggagcacatactacctagaag

SEQ ID NO: 1468017 - DNA, 16 bp, Homo sapiens
aggagcacctgaaccc

SEQ ID NO: 1468018 - DNA, 14 bp, Homo sapiens
aggagcagaaagat

SEQ ID NO: 1468019 - DNA, 13 bp, Homo sapiens
aggagcagagggc

SEQ ID NO: 1468020 - DNA, 15 bp, Homo sapiens
aggagcagagggcag

SEQ ID NO: 1468021 - DNA, 17 bp, Homo sapiens
aggagcagcagccagca

SEQ ID NO: 1468022 - DNA, 19 bp, Homo sapiens
aggagcagcagccagcacc

SEQ ID NO: 1468023 - DNA, 15 bp, Homo sapiens
aggagcagcgggaac

SEQ ID NO: 1468024 - DNA, 14 bp, Homo sapiens
aggagcagctgtgc

SEQ ID NO: 1468025 - DNA, 18 bp, Homo sapiens
aggagcagcttccttctg

SEQ ID NO: 1468026 - DNA, 19 bp, Homo sapiens
aggagcagcttccttctgg

SEQ ID NO: 1468027 - DNA, 22 bp, Homo sapiens
aggagcagcttccttctgggac

SEQ ID NO: 1468028 - DNA, 23 bp, Homo sapiens
aggagcagcttccttctgggact

SEQ ID NO: 1468029 - DNA, 23 bp, Homo sapiens
aggagcagcttttggtctccttg

SEQ ID NO: 1468030 - DNA, 22 bp, Homo sapiens
aggagcatgcgcagaggccagt

SEQ ID NO: 1468031 - DNA, 17 bp, Homo sapiens
aggagccaccagttctc

SEQ ID NO: 1468032 - DNA, 18 bp, Homo sapiens
aggagcccagccagaaag

SEQ ID NO: 1468033 - DNA, 13 bp, Homo sapiens
aggagccccagct

SEQ ID NO: 1468034 - DNA, 13 bp, Homo sapiens
aggagcctcagaa

SEQ ID NO: 1468035 - DNA, 11 bp, Homo sapiens
aggagcctggc

SEQ ID NO: 1468036 - DNA, 12 bp, Homo sapiens
aggagcctgtgc

SEQ ID NO: 1468037 - DNA, 23 bp, Homo sapiens
aggagccttcctttctcctgccc

SEQ ID NO: 1468038 - DNA, 13 bp, Homo sapiens
aggagccttgctg

SEQ ID NO: 1468039 - DNA, 17 bp, Homo sapiens
aggagccttgctgggcc

SEQ ID NO: 1468040 - DNA, 21 bp, Homo sapiens
aggagccttgctgggccaggg

SEQ ID NO: 1468041 - DNA, 16 bp, Homo sapiens
aggagccttttgctct

SEQ ID NO: 1468042 - DNA, 19 bp, Homo sapiens
aggagccttttgctctctg

SEQ ID NO: 1468043 - DNA, 16 bp, Homo sapiens
aggagcctttttaaaa

SEQ ID NO: 1468044 - DNA, 14 bp, Homo sapiens
aggagcgagcatgt

SEQ ID NO: 1468045 - DNA, 15 bp, Homo sapiens
aggagcgagcatgtc

SEQ ID NO: 1468046 - DNA, 22 bp, Homo sapiens
aggagcgtggactctgctagac

SEQ ID NO: 1468047 - DNA, 14 bp, Homo sapiens
aggagctaaggctc

SEQ ID NO: 1468048 - DNA, 19 bp, Homo sapiens
aggagctaaggctctatga

SEQ ID NO: 1468049 - DNA, 18 bp, Homo sapiens
aggagctactgacattcc

SEQ ID NO: 1468050 - DNA, 24 bp, Homo sapiens
aggagctagcccagtccctggagc

SEQ ID NO: 1468051 - DNA, 14 bp, Homo sapiens
aggagctcaccctg

SEQ ID NO: 1468052 - DNA, 21 bp, Homo sapiens
aggagctcaccctgcccgctc

SEQ ID NO: 1468053 - DNA, 16 bp, Homo sapiens
aggagctcctggaagc

SEQ ID NO: 1468054 - DNA, 19 bp, Homo sapiens
aggagctgatggcagctgg

SEQ ID NO: 1468055 - DNA, 19 bp, Homo sapiens
aggagctgatttccaggcc

SEQ ID NO: 1468056 - DNA, 20 bp, Homo sapiens
aggagctgatttccaggccc

SEQ ID NO: 1468057 - DNA, 21 bp, Homo sapiens
aggagctgatttccaggcccc

SEQ ID NO: 1468058 - DNA, 22 bp, Homo sapiens
aggagctgatttccaggcccct

SEQ ID NO: 1468059 - DNA, 23 bp, Homo sapiens
aggagctgatttccaggcccctg

SEQ ID NO: 1468060 - DNA, 15 bp, Homo sapiens
aggagctgcactgat

SEQ ID NO: 1468061 - DNA, 19 bp, Homo sapiens
aggagctgccttggctcag

SEQ ID NO: 1468062 - DNA, 22 bp, Homo sapiens
aggagctgccttggctcagaca

SEQ ID NO: 1468063 - DNA, 13 bp, Homo sapiens
aggagctgctggc

SEQ ID NO: 1468064 - DNA, 14 bp, Homo sapiens
aggagctgctggct

SEQ ID NO: 1468065 - DNA, 17 bp, Homo sapiens
aggagctgctggcttgc

SEQ ID NO: 1468066 - DNA, 22 bp, Homo sapiens
aggagctggaggggtggggagc

SEQ ID NO: 1468067 - DNA, 14 bp, Homo sapiens
aggagctggcctgt

SEQ ID NO: 1468068 - DNA, 16 bp, Homo sapiens
aggagctggcctgtgg

SEQ ID NO: 1468069 - DNA, 18 bp, Homo sapiens
aggagctggcctgtggca

SEQ ID NO: 1468070 - DNA, 15 bp, Homo sapiens
aggagctgggagccg

SEQ ID NO: 1468071 - DNA, 17 bp, Homo sapiens
aggagctgggagccggg

SEQ ID NO: 1468072 - DNA, 16 bp, Homo sapiens
aggagctgggaggaaa

SEQ ID NO: 1468073 - DNA, 17 bp, Homo sapiens
aggagctgggaggaaaa

SEQ ID NO: 1468074 - DNA, 20 bp, Homo sapiens
aggagctgggcagaaggcca

SEQ ID NO: 1468075 - DNA, 12 bp, Homo sapiens
aggagctgggcc

SEQ ID NO: 1468076 - DNA, 20 bp, Homo sapiens
aggagctgggcccctgcaca

SEQ ID NO: 1468077 - DNA, 21 bp, Homo sapiens
aggagctggggatccctcccc

SEQ ID NO: 1468078 - DNA, 20 bp, Homo sapiens
aggagctgggggaaggcagg

SEQ ID NO: 1468079 - DNA, 20 bp, Homo sapiens
aggagctgtcaccaaggaaa

SEQ ID NO: 1468080 - DNA, 16 bp, Homo sapiens
aggagcttacccaagc

SEQ ID NO: 1468081 - DNA, 22 bp, Homo sapiens
aggcatgtgccacccacccaac

SEQ ID NO: 1468082 - DNA, 23 bp, Homo sapiens
aggcattgccttctctgcccaca

SEQ ID NO: 1468083 - DNA, 20 bp, Homo sapiens
aggcattgttagtttagtgt

SEQ ID NO: 1468084 - DNA, 21 bp, Homo sapiens
aggcattgtttttaagaaaaa

SEQ ID NO: 1468085 - DNA, 20 bp, Homo sapiens
aggcatttctatcacatatt

SEQ ID NO: 1468086 - DNA, 23 bp, Homo sapiens
aggcatttggtctcactacttga

SEQ ID NO: 1468087 - DNA, 12 bp, Homo sapiens
aggcattttgtt

SEQ ID NO: 1468088 - DNA, 16 bp, Homo sapiens
aggccaaatgcacaag

SEQ ID NO: 1468089 - DNA, 22 bp, Homo sapiens
aggccaaatgcacaagctcaga

SEQ ID NO: 1468090 - DNA, 15 bp, Homo sapiens
aggccaaccagcccg

SEQ ID NO: 1468091 - DNA, 14 bp, Homo sapiens
aggccaagatggct

SEQ ID NO: 1468092 - DNA, 16 bp, Homo sapiens
aggccaagatggctgc

SEQ ID NO: 1468093 - DNA, 19 bp, Homo sapiens
aggccaagatggctgctgc

SEQ ID NO: 1468094 - DNA, 23 bp, Homo sapiens
aggccaagatggctgctgcctgc

SEQ ID NO: 1468095 - DNA, 21 bp, Homo sapiens
aggccaagcagtgcctgccta

SEQ ID NO: 1468096 - DNA, 14 bp, Homo sapiens
aggccaaggcaggt

SEQ ID NO: 1468097 - DNA, 23 bp, Homo sapiens
aggccaagtccgcagaagccctg

SEQ ID NO: 1468098 - DNA, 22 bp, Homo sapiens
aggccaagtctaatgaagagaa

SEQ ID NO: 1468099 - DNA, 15 bp, Homo sapiens
aggccacattgctgg

SEQ ID NO: 1468100 - DNA, 13 bp, Homo sapiens
aggccacccactg

SEQ ID NO: 1468101 - DNA, 16 bp, Homo sapiens
aggccacccactgacc

SEQ ID NO: 1468102 - DNA, 23 bp, Homo sapiens
aggccaccccgctgatggagccc

SEQ ID NO: 1468103 - DNA, 22 bp, Homo sapiens
aggccaccgggacagacctgga

SEQ ID NO: 1468104 - DNA, 15 bp, Homo sapiens
aggccacctatgcca

SEQ ID NO: 1468105 - DNA, 15 bp, Homo sapiens
aggccacctccccag

SEQ ID NO: 1468106 - DNA, 16 bp, Homo sapiens
aggccacctctccaag

SEQ ID NO: 1468107 - DNA, 14 bp, Homo sapiens
aggccacctctgcc

SEQ ID NO: 1468108 - DNA, 14 bp, Homo sapiens
aggccactcctcca

SEQ ID NO: 1468109 - DNA, 14 bp, Homo sapiens
aggccactgtgagc

SEQ ID NO: 1468110 - DNA, 18 bp, Homo sapiens
aggccactgtgagcgctg

SEQ ID NO: 1468111 - DNA, 23 bp, Homo sapiens
aggccactgtggccagagctgga

SEQ ID NO: 1468112 - DNA, 17 bp, Homo sapiens
aggccagagtggcctgg

SEQ ID NO: 1468113 - DNA, 19 bp, Homo sapiens
aggccagagtggcctggcc

SEQ ID NO: 1468114 - DNA, 20 bp, Homo sapiens
aggccagagtggcctggcca

SEQ ID NO: 1468115 - DNA, 19 bp, Homo sapiens
aggccagcaacattggcac

SEQ ID NO: 1468116 - DNA, 13 bp, Homo sapiens
aggccagccccac

SEQ ID NO: 1468117 - DNA, 15 bp, Homo sapiens
aggccagccccaccc

SEQ ID NO: 1468118 - DNA, 23 bp, Homo sapiens
aggccagcctccgagagggagag

SEQ ID NO: 1468119 - DNA, 21 bp, Homo sapiens
aggccaggagtttgagaccag

SEQ ID NO: 1468120 - DNA, 11 bp, Homo sapiens
aggccaggctc

SEQ ID NO: 1468121 - DNA, 12 bp, Homo sapiens
aggccaggctcc

SEQ ID NO: 1468122 - DNA, 22 bp, Homo sapiens
aggccaggctccttcctgtctt

SEQ ID NO: 1468123 - DNA, 19 bp, Homo sapiens
aggccagggcagcaaggga

SEQ ID NO: 1468124 - DNA, 12 bp, Homo sapiens
aggccagggcct

SEQ ID NO: 1468125 - DNA, 24 bp, Homo sapiens
aggccaggtccctggaccagcctc

SEQ ID NO: 1468126 - DNA, 23 bp, Homo sapiens
aggccagttaaagtagatcacct

SEQ ID NO: 1468127 - DNA, 19 bp, Homo sapiens
aggccatctcaggagatgg

SEQ ID NO: 1468128 - DNA, 15 bp, Homo sapiens
aggccatgtgagcca

SEQ ID NO: 1468129 - DNA, 22 bp, Homo sapiens
aggccatgtgagccaccgctgc

SEQ ID NO: 1468130 - DNA, 14 bp, Homo sapiens
aggcccaactgtga

SEQ ID NO: 1468131 - DNA, 22 bp, Homo sapiens
aggcccaaggagcttacccaag

SEQ ID NO: 1468132 - DNA, 19 bp, Homo sapiens
aggcccaccatcaccaccg

SEQ ID NO: 1468133 - DNA, 21 bp, Homo sapiens
aggcccaccatcaccaccgcc

SEQ ID NO: 1468134 - DNA, 16 bp, Homo sapiens
aggcccactccccagc

SEQ ID NO: 1468135 - DNA, 12 bp, Homo sapiens
aggcccagcatg

SEQ ID NO: 1468136 - DNA, 19 bp, Homo sapiens
aggcccagcatgcaggtgg

SEQ ID NO: 1468137 - DNA, 15 bp, Homo sapiens
aggcccagcccctcc

SEQ ID NO: 1468138 - DNA, 15 bp, Homo sapiens
aggcccagccctcag

SEQ ID NO: 1468139 - DNA, 17 bp, Homo sapiens
aggcccagcgcggccag

SEQ ID NO: 1468140 - DNA, 16 bp, Homo sapiens
aggcccagcgggcaga

SEQ ID NO: 1468141 - DNA, 23 bp, Homo sapiens
aggcccaggaatcggagcgaagc

SEQ ID NO: 1468142 - DNA, 19 bp, Homo sapiens
aggcccaggagacctccag

SEQ ID NO: 1468143 - DNA, 21 bp, Homo sapiens
aggcccaggagacctccagct

SEQ ID NO: 1468144 - DNA, 15 bp, Homo sapiens
aggcccaggcaccac

SEQ ID NO: 1468145 - DNA, 19 bp, Homo sapiens
aggcccaggcaccaccagg

SEQ ID NO: 1468146 - DNA, 13 bp, Homo sapiens
aggcccaggctgg

SEQ ID NO: 1468147 - DNA, 17 bp, Homo sapiens
aggcccaggctgggaac

SEQ ID NO: 1468148 - DNA, 12 bp, Homo sapiens
aggcccatctca

SEQ ID NO: 1468149 - DNA, 17 bp, Homo sapiens
aggcccatgctatgagt

SEQ ID NO: 1468150 - DNA, 16 bp, Homo sapiens
aggccccaccggccag

SEQ ID NO: 1468151 - DNA, 17 bp, Homo sapiens
aggccccaccggccagg

SEQ ID NO: 1468152 - DNA, 21 bp, Homo sapiens
aggccccaccggccaggccgc

SEQ ID NO: 1468153 - DNA, 22 bp, Homo sapiens
aggccccagagagaccctgcaa

SEQ ID NO: 1468154 - DNA, 14 bp, Homo sapiens
aggccccagaggcc

SEQ ID NO: 1468155 - DNA, 12 bp, Homo sapiens
aggccccagcct

SEQ ID NO: 1468156 - DNA, 13 bp, Homo sapiens
aggccccaggctg

SEQ ID NO: 1468157 - DNA, 15 bp, Homo sapiens
aggccccaggctgag

SEQ ID NO: 1468158 - DNA, 17 bp, Homo sapiens
aggcccccacttgcctc

SEQ ID NO: 1468159 - DNA, 18 bp, Homo sapiens
aggcccccacttgcctct

SEQ ID NO: 1468160 - DNA, 14 bp, Homo sapiens
aggcccccagccca

SEQ ID NO: 1468161 - DNA, 19 bp, Homo sapiens
aggcccccgtcagggagag

SEQ ID NO: 1468162 - DNA, 13 bp, Homo sapiens
aggccccctgcat

SEQ ID NO: 1468163 - DNA, 22 bp, Homo sapiens
aggccccgatggactcctgacc

SEQ ID NO: 1468164 - DNA, 18 bp, Homo sapiens
aggccccgcttgtccagc

SEQ ID NO: 1468165 - DNA, 22 bp, Homo sapiens
aggccccgcttgtccagcgcct

SEQ ID NO: 1468166 - DNA, 15 bp, Homo sapiens
aggcccctgaggact

SEQ ID NO: 1468167 - DNA, 17 bp, Homo sapiens
aggcccctgaggactgg

SEQ ID NO: 1468168 - DNA, 20 bp, Homo sapiens
aggcccctgaggactggaga

SEQ ID NO: 1468169 - DNA, 17 bp, Homo sapiens
aggcccctgaggcagcc

SEQ ID NO: 1468170 - DNA, 20 bp, Homo sapiens
aggcccctggcccagcggcc

SEQ ID NO: 1468171 - DNA, 17 bp, Homo sapiens
aggcccctgggctctca

SEQ ID NO: 1468172 - DNA, 15 bp, Homo sapiens
aggccccttccctgg

SEQ ID NO: 1468173 - DNA, 16 bp, Homo sapiens
aggcccgcccgcccac

SEQ ID NO: 1468174 - DNA, 14 bp, Homo sapiens
aggcccggtgcagc

SEQ ID NO: 1468175 - DNA, 16 bp, Homo sapiens
aggcccgtcggagctg

SEQ ID NO: 1468176 - DNA, 19 bp, Homo sapiens
aggcccgtcggagctgcct

SEQ ID NO: 1468177 - DNA, 22 bp, Homo sapiens
aggcccgtcggagctgcctgca

SEQ ID NO: 1468178 - DNA, 21 bp, Homo sapiens
aggccctcctctcccatcctt

SEQ ID NO: 1468179 - DNA, 12 bp, Homo sapiens
aggccctctgcc

SEQ ID NO: 1468180 - DNA, 13 bp, Homo sapiens
aggccctctgcct

SEQ ID NO: 1468181 - DNA, 22 bp, Homo sapiens
aggccctgctttttttcttaaa

SEQ ID NO: 1468182 - DNA, 20 bp, Homo sapiens
aggccctggaggtctccagg

SEQ ID NO: 1468183 - DNA, 15 bp, Homo sapiens
aggccctggcctccc

SEQ ID NO: 1468184 - DNA, 21 bp, Homo sapiens
aggccctggcctcccctgcca

SEQ ID NO: 1468185 - DNA, 23 bp, Homo sapiens
aggccctggcctcccctgccacc

SEQ ID NO: 1468186 - DNA, 21 bp, Homo sapiens
aggccctggggagcttttgcc

SEQ ID NO: 1468187 - DNA, 19 bp, Homo sapiens
aggccctggtgtcaggcag

SEQ ID NO: 1468188 - DNA, 23 bp, Homo sapiens
aggccctggttcctgctgtcctg

SEQ ID NO: 1468189 - DNA, 17 bp, Homo sapiens
aggcccttcctctccac

SEQ ID NO: 1468190 - DNA, 18 bp, Homo sapiens
aggcccttcctctccact

SEQ ID NO: 1468191 - DNA, 17 bp, Homo sapiens
aggcccttcctctttgg

SEQ ID NO: 1468192 - DNA, 13 bp, Homo sapiens
aggcccttgtcct

SEQ ID NO: 1468193 - DNA, 12 bp, Homo sapiens
aggccctttggc

SEQ ID NO: 1468194 - DNA, 13 bp, Homo sapiens
aggccctttggct

SEQ ID NO: 1468195 - DNA, 20 bp, Homo sapiens
aggctgggcctcccctgggc

SEQ ID NO: 1468196 - DNA, 18 bp, Homo sapiens
aggctgggctctgcctgt

SEQ ID NO: 1468197 - DNA, 21 bp, Homo sapiens
aggctgggctctgcctgtctg

SEQ ID NO: 1468198 - DNA, 17 bp, Homo sapiens
aggctggtctaaaactc

SEQ ID NO: 1468199 - DNA, 21 bp, Homo sapiens
aggctgtcctgtacattgtgg

SEQ ID NO: 1468200 - DNA, 21 bp, Homo sapiens
aggctgtcttctcaggctctg

SEQ ID NO: 1468201 - DNA, 16 bp, Homo sapiens
aggctgtggtcacagc

SEQ ID NO: 1468202 - DNA, 19 bp, Homo sapiens
aggctgttaaatacaggaa

SEQ ID NO: 1468203 - DNA, 20 bp, Homo sapiens
aggctgttcccatgtagccc

SEQ ID NO: 1468204 - DNA, 20 bp, Homo sapiens
aggctgttctgcactgaaaa

SEQ ID NO: 1468205 - DNA, 14 bp, Homo sapiens
aggcttaaacccat

SEQ ID NO: 1468206 - DNA, 16 bp, Homo sapiens
aggcttaggcctctct

SEQ ID NO: 1468207 - DNA, 15 bp, Homo sapiens
aggcttagtttgtgt

SEQ ID NO: 1468208 - DNA, 12 bp, Homo sapiens
aggcttccaggc

SEQ ID NO: 1468209 - DNA, 15 bp, Homo sapiens
aggcttccaggctct

SEQ ID NO: 1468210 - DNA, 19 bp, Homo sapiens
aggcttccatccccgtcca

SEQ ID NO: 1468211 - DNA, 20 bp, Homo sapiens
aggcttcctgcgtcctcctc

SEQ ID NO: 1468212 - DNA, 22 bp, Homo sapiens
aggcttcctgcgtcctcctcac

SEQ ID NO: 1468213 - DNA, 16 bp, Homo sapiens
aggcttcctgggtcct

SEQ ID NO: 1468214 - DNA, 23 bp, Homo sapiens
aggcttcggacagtgcccatgca

SEQ ID NO: 1468215 - DNA, 14 bp, Homo sapiens
aggcttctccgcca

SEQ ID NO: 1468216 - DNA, 17 bp, Homo sapiens
aggcttctccgccagcc

SEQ ID NO: 1468217 - DNA, 18 bp, Homo sapiens
aggcttctccgccagcct

SEQ ID NO: 1468218 - DNA, 20 bp, Homo sapiens
aggcttctccgccagcctcc

SEQ ID NO: 1468219 - DNA, 21 bp, Homo sapiens
aggcttctccgccagcctcct

SEQ ID NO: 1468220 - DNA, 23 bp, Homo sapiens
aggcttctccgccagcctcctct

SEQ ID NO: 1468221 - DNA, 12 bp, Homo sapiens
aggcttctcctt

SEQ ID NO: 1468222 - DNA, 13 bp, Homo sapiens
aggcttgaagctg

SEQ ID NO: 1468223 - DNA, 21 bp, Homo sapiens
aggcttgcccagtacatttaa

SEQ ID NO: 1468224 - DNA, 19 bp, Homo sapiens
aggcttgtcactagcagct

SEQ ID NO: 1468225 - DNA, 22 bp, Homo sapiens
aggcttgtcactagcagctgca

SEQ ID NO: 1468226 - DNA, 22 bp, Homo sapiens
aggctttatgataatagattct

SEQ ID NO: 1468227 - DNA, 22 bp, Homo sapiens
aggctttcccacttcccaccct

SEQ ID NO: 1468228 - DNA, 18 bp, Homo sapiens
aggctttgggtggctcac

SEQ ID NO: 1468229 - DNA, 18 bp, Homo sapiens
aggcttttcactgcctgt

SEQ ID NO: 1468230 - DNA, 22 bp, Homo sapiens
aggcttttgtttcctttttcag

SEQ ID NO: 1468231 - DNA, 15 bp, Homo sapiens
agggaaaaaaaatgt

SEQ ID NO: 1468232 - DNA, 23 bp, Homo sapiens
agggaaaaatcaagtattataaa

SEQ ID NO: 1468233 - DNA, 15 bp, Homo sapiens
agggaaaccttggag

SEQ ID NO: 1468234 - DNA, 21 bp, Homo sapiens
agggaaaccttggagaggaga

SEQ ID NO: 1468235 - DNA, 14 bp, Homo sapiens
agggaaactgccag

SEQ ID NO: 1468236 - DNA, 19 bp, Homo sapiens
agggaaactgccagcaacg

SEQ ID NO: 1468237 - DNA, 16 bp, Homo sapiens
agggaaactgggaaac

SEQ ID NO: 1468238 - DNA, 14 bp, Homo sapiens
agggaaagcctctg

SEQ ID NO: 1468239 - DNA, 15 bp, Homo sapiens
agggaaaggggtgct

SEQ ID NO: 1468240 - DNA, 19 bp, Homo sapiens
agggaaaggggtgctttta

SEQ ID NO: 1468241 - DNA, 15 bp, Homo sapiens
agggaacagacagga

SEQ ID NO: 1468242 - DNA, 20 bp, Homo sapiens
agggaacagccccagggttg

SEQ ID NO: 1468243 - DNA, 19 bp, Homo sapiens
agggaacggggtccttcaa

SEQ ID NO: 1468244 - DNA, 12 bp, Homo sapiens
agggaactagat

SEQ ID NO: 1468245 - DNA, 12 bp, Homo sapiens
agggaagaccag

SEQ ID NO: 1468246 - DNA, 14 bp, Homo sapiens
agggaagaccagaa

SEQ ID NO: 1468247 - DNA, 18 bp, Homo sapiens
agggaagaccagaattcc

SEQ ID NO: 1468248 - DNA, 23 bp, Homo sapiens
agggaagcccagctccagggcca

SEQ ID NO: 1468249 - DNA, 22 bp, Homo sapiens
agggaaggacaggaccctcagg

SEQ ID NO: 1468250 - DNA, 16 bp, Homo sapiens
agggaaggagcccagc

SEQ ID NO: 1468251 - DNA, 20 bp, Homo sapiens
agggaaggataaagccactt

SEQ ID NO: 1468252 - DNA, 14 bp, Homo sapiens
agggaaggcctgac

SEQ ID NO: 1468253 - DNA, 14 bp, Homo sapiens
agggaagggagaaa

SEQ ID NO: 1468254 - DNA, 17 bp, Homo sapiens
agggaagggagaaagta

SEQ ID NO: 1468255 - DNA, 17 bp, Homo sapiens
agggaagtaacagacac

SEQ ID NO: 1468256 - DNA, 18 bp, Homo sapiens
agggaagtgaggcccaag

SEQ ID NO: 1468257 - DNA, 23 bp, Homo sapiens
agggaagtgaggcccaaggagct

SEQ ID NO: 1468258 - DNA, 13 bp, Homo sapiens
agggaagtgggga

SEQ ID NO: 1468259 - DNA, 14 bp, Homo sapiens
agggaagtggggag

SEQ ID NO: 1468260 - DNA, 15 bp, Homo sapiens
agggaatccaagcct

SEQ ID NO: 1468261 - DNA, 16 bp, Homo sapiens
agggaatccaagcctc

SEQ ID NO: 1468262 - DNA, 16 bp, Homo sapiens
agggaatgttccctgc

SEQ ID NO: 1468263 - DNA, 17 bp, Homo sapiens
agggaatgttccctgca

SEQ ID NO: 1468264 - DNA, 19 bp, Homo sapiens
agggaatgttccctgcacc

SEQ ID NO: 1468265 - DNA, 23 bp, Homo sapiens
agggaatgttccctgcaccctgg

SEQ ID NO: 1468266 - DNA, 12 bp, Homo sapiens
agggaattgctc

SEQ ID NO: 1468267 - DNA, 13 bp, Homo sapiens
agggacaaaactt

SEQ ID NO: 1468268 - DNA, 21 bp, Homo sapiens
agggacaagggattctgggaa

SEQ ID NO: 1468269 - DNA, 19 bp, Homo sapiens
agggacagagacacctgca

SEQ ID NO: 1468270 - DNA, 20 bp, Homo sapiens
agggacagagacacctgcac

SEQ ID NO: 1468271 - DNA, 17 bp, Homo sapiens
agggacagaggccccag

SEQ ID NO: 1468272 - DNA, 20 bp, Homo sapiens
agggacagaggccccagcct

SEQ ID NO: 1468273 - DNA, 22 bp, Homo sapiens
agggacagatgaatgccgtgga

SEQ ID NO: 1468274 - DNA, 20 bp, Homo sapiens
agggacagcaagtgagcaga

SEQ ID NO: 1468275 - DNA, 19 bp, Homo sapiens
agggacagctgctgggacc

SEQ ID NO: 1468276 - DNA, 17 bp, Homo sapiens
agggacaggataagagg

SEQ ID NO: 1468277 - DNA, 17 bp, Homo sapiens
agggacaggctgaagag

SEQ ID NO: 1468278 - DNA, 20 bp, Homo sapiens
agggacaggctgaagagagg

SEQ ID NO: 1468279 - DNA, 16 bp, Homo sapiens
agggacatgccctgtg

SEQ ID NO: 1468280 - DNA, 17 bp, Homo sapiens
agggaccaactgggccc

SEQ ID NO: 1468281 - DNA, 14 bp, Homo sapiens
agggaccagccaag

SEQ ID NO: 1468282 - DNA, 15 bp, Homo sapiens
agggaccagggccac

SEQ ID NO: 1468283 - DNA, 19 bp, Homo sapiens
agggacccaggtgtgcctg

SEQ ID NO: 1468284 - DNA, 21 bp, Homo sapiens
agggacccaggtgtgcctgtg

SEQ ID NO: 1468285 - DNA, 16 bp, Homo sapiens
agggacccccccccaa

SEQ ID NO: 1468286 - DNA, 13 bp, Homo sapiens
agggacctgctca

SEQ ID NO: 1468287 - DNA, 22 bp, Homo sapiens
agggaccttcatgcccttctga

SEQ ID NO: 1468288 - DNA, 18 bp, Homo sapiens
agggaccttggagagctc

SEQ ID NO: 1468289 - DNA, 17 bp, Homo sapiens
agggacgctttgtctgt

SEQ ID NO: 1468290 - DNA, 22 bp, Homo sapiens
agggactacccatagacatgaa

SEQ ID NO: 1468291 - DNA, 17 bp, Homo sapiens
agggactcaagggaaag

SEQ ID NO: 1468292 - DNA, 23 bp, Homo sapiens
agggactcaagggaaaggcaagc

SEQ ID NO: 1468293 - DNA, 18 bp, Homo sapiens
agggactgccaggctgtt

SEQ ID NO: 1468294 - DNA, 13 bp, Homo sapiens
agggacttaaaaa

SEQ ID NO: 1468295 - DNA, 21 bp, Homo sapiens
agggacttgtttagagagcct

SEQ ID NO: 1468296 - DNA, 18 bp, Homo sapiens
agggacttttattttctt

SEQ ID NO: 1468297 - DNA, 13 bp, Homo sapiens
agggagaaaagag

SEQ ID NO: 1468298 - DNA, 16 bp, Homo sapiens
agggagaaaagagaaa

SEQ ID NO: 1468299 - DNA, 17 bp, Homo sapiens
agggagaaaatccaggt

SEQ ID NO: 1468300 - DNA, 20 bp, Homo sapiens
agggagaaaatccaggtcat

SEQ ID NO: 1468301 - DNA, 10 bp, Homo sapiens
agggagaaga

SEQ ID NO: 1468302 - DNA, 21 bp, Homo sapiens
agggagaagacaacagaaaga

SEQ ID NO: 1468303 - DNA, 13 bp, Homo sapiens
agggagaagagaa

SEQ ID NO: 1468304 - DNA, 11 bp, Homo sapiens
agggagaagga

SEQ ID NO: 1468305 - DNA, 18 bp, Homo sapiens
agggagaagggatggagg

SEQ ID NO: 1468306 - DNA, 19 bp, Homo sapiens
agggagaataaaattccta

SEQ ID NO: 1468307 - DNA, 15 bp, Homo sapiens
agggagaatcctccc

SEQ ID NO: 1468308 - DNA, 21 bp, Homo sapiens
agggagaatcctcccttccca

SEQ ID NO: 1468309 - DNA, 17 bp, Homo sapiens
agggctgttggacagct

SEQ ID NO: 1468310 - DNA, 19 bp, Homo sapiens
agggctgttggacagctgc

SEQ ID NO: 1468311 - DNA, 20 bp, Homo sapiens
agggctgttggacagctgct

SEQ ID NO: 1468312 - DNA, 12 bp, Homo sapiens
agggcttcctct

SEQ ID NO: 1468313 - DNA, 13 bp, Homo sapiens
agggcttctgcac

SEQ ID NO: 1468314 - DNA, 15 bp, Homo sapiens
agggcttctgcaccc

SEQ ID NO: 1468315 - DNA, 17 bp, Homo sapiens
agggcttctgcaccctc

SEQ ID NO: 1468316 - DNA, 18 bp, Homo sapiens
agggcttctgcaccctcc

SEQ ID NO: 1468317 - DNA, 17 bp, Homo sapiens
agggcttggcccagcgc

SEQ ID NO: 1468318 - DNA, 17 bp, Homo sapiens
agggctttaaaattctc

SEQ ID NO: 1468319 - DNA, 18 bp, Homo sapiens
agggctttaaaattctct

SEQ ID NO: 1468320 - DNA, 23 bp, Homo sapiens
agggctttctgggtgtgtccagg

SEQ ID NO: 1468321 - DNA, 15 bp, Homo sapiens
agggctttggttcct

SEQ ID NO: 1468322 - DNA, 22 bp, Homo sapiens
agggcttttattttttcttttg

SEQ ID NO: 1468323 - DNA, 21 bp, Homo sapiens
aggggaaaccagtgtagcctt

SEQ ID NO: 1468324 - DNA, 17 bp, Homo sapiens
aggggaaagacttccat

SEQ ID NO: 1468325 - DNA, 20 bp, Homo sapiens
aggggaaagacttccatcta

SEQ ID NO: 1468326 - DNA, 13 bp, Homo sapiens
aggggaacctgcc

SEQ ID NO: 1468327 - DNA, 14 bp, Homo sapiens
aggggaacctgcca

SEQ ID NO: 1468328 - DNA, 15 bp, Homo sapiens
aggggaacctgccat

SEQ ID NO: 1468329 - DNA, 15 bp, Homo sapiens
aggggaagaggcctg

SEQ ID NO: 1468330 - DNA, 20 bp, Homo sapiens
aggggaaggaaggagggcac

SEQ ID NO: 1468331 - DNA, 12 bp, Homo sapiens
aggggaaggggc

SEQ ID NO: 1468332 - DNA, 16 bp, Homo sapiens
aggggaaggggctgag

SEQ ID NO: 1468333 - DNA, 17 bp, Homo sapiens
aggggaaggggctgagg

SEQ ID NO: 1468334 - DNA, 19 bp, Homo sapiens
aggggaataatagaagaac

SEQ ID NO: 1468335 - DNA, 15 bp, Homo sapiens
aggggaatcagaact

SEQ ID NO: 1468336 - DNA, 21 bp, Homo sapiens
aggggaattccctccccctcc

SEQ ID NO: 1468337 - DNA, 15 bp, Homo sapiens
aggggacaaggaagg

SEQ ID NO: 1468338 - DNA, 16 bp, Homo sapiens
aggggagagagggact

SEQ ID NO: 1468339 - DNA, 19 bp, Homo sapiens
aggggagagctttgtgctt

SEQ ID NO: 1468340 - DNA, 10 bp, Homo sapiens
aggggagagg

SEQ ID NO: 1468341 - DNA, 17 bp, Homo sapiens
aggggagagggtctgga

SEQ ID NO: 1468342 - DNA, 17 bp, Homo sapiens
aggggaggaaaaaagaa

SEQ ID NO: 1468343 - DNA, 16 bp, Homo sapiens
aggggaggagcctgtg

SEQ ID NO: 1468344 - DNA, 20 bp, Homo sapiens
aggggaggcacactttctgg

SEQ ID NO: 1468345 - DNA, 14 bp, Homo sapiens
aggggagggcaggc

SEQ ID NO: 1468346 - DNA, 17 bp, Homo sapiens
aggggagggcaggcttg

SEQ ID NO: 1468347 - DNA, 12 bp, Homo sapiens
aggggaggggcc

SEQ ID NO: 1468348 - DNA, 14 bp, Homo sapiens
aggggaggggccta

SEQ ID NO: 1468349 - DNA, 15 bp, Homo sapiens
aggggaggggcctag

SEQ ID NO: 1468350 - DNA, 21 bp, Homo sapiens
aggggaggggcctagggagcc

SEQ ID NO: 1468351 - DNA, 18 bp, Homo sapiens
aggggagggggatccgac

SEQ ID NO: 1468352 - DNA, 23 bp, Homo sapiens
aggggatcatgttaaaaatagca

SEQ ID NO: 1468353 - DNA, 17 bp, Homo sapiens
aggggatccagccactt

SEQ ID NO: 1468354 - DNA, 19 bp, Homo sapiens
aggggatggaattcttcct

SEQ ID NO: 1468355 - DNA, 18 bp, Homo sapiens
aggggatggggatagagg

SEQ ID NO: 1468356 - DNA, 19 bp, Homo sapiens
aggggcaacgaagaaaaaa

SEQ ID NO: 1468357 - DNA, 19 bp, Homo sapiens
aggggcaagctaggcccca

SEQ ID NO: 1468358 - DNA, 22 bp, Homo sapiens
aggggcaagctaggccccagag

SEQ ID NO: 1468359 - DNA, 19 bp, Homo sapiens
aggggcaaggggctggctg

SEQ ID NO: 1468360 - DNA, 21 bp, Homo sapiens
aggggcacaccactgccctgc

SEQ ID NO: 1468361 - DNA, 23 bp, Homo sapiens
aggggcacaccactgccctgcct

SEQ ID NO: 1468362 - DNA, 13 bp, Homo sapiens
aggggcagcaagg

SEQ ID NO: 1468363 - DNA, 14 bp, Homo sapiens
aggggcagcaaggc

SEQ ID NO: 1468364 - DNA, 18 bp, Homo sapiens
aggggcagcaaggccttg

SEQ ID NO: 1468365 - DNA, 16 bp, Homo sapiens
aggggcagcccttgct

SEQ ID NO: 1468366 - DNA, 13 bp, Homo sapiens
aggggcagccgct

SEQ ID NO: 1468367 - DNA, 13 bp, Homo sapiens
aggggcaggcctg

SEQ ID NO: 1468368 - DNA, 14 bp, Homo sapiens
aggggcaggcctgg

SEQ ID NO: 1468369 - DNA, 22 bp, Homo sapiens
aggggcaggcctgggacccagc

SEQ ID NO: 1468370 - DNA, 12 bp, Homo sapiens
aggggcaggtgt

SEQ ID NO: 1468371 - DNA, 14 bp, Homo sapiens
aggggcatctgccc

SEQ ID NO: 1468372 - DNA, 15 bp, Homo sapiens
aggggcatctgcccc

SEQ ID NO: 1468373 - DNA, 22 bp, Homo sapiens
aggggcatctgcccctccccca

SEQ ID NO: 1468374 - DNA, 19 bp, Homo sapiens
aggggcatgtattggcctg

SEQ ID NO: 1468375 - DNA, 20 bp, Homo sapiens
aggggcatgtattggcctgg

SEQ ID NO: 1468376 - DNA, 23 bp, Homo sapiens
aggggcatttcacagtgcccaag

SEQ ID NO: 1468377 - DNA, 16 bp, Homo sapiens
aggggccacctcctcc

SEQ ID NO: 1468378 - DNA, 22 bp, Homo sapiens
aggggcccaaattctttcagtg

SEQ ID NO: 1468379 - DNA, 18 bp, Homo sapiens
aggggcccaagccccatc

SEQ ID NO: 1468380 - DNA, 19 bp, Homo sapiens
aggggcccaagccccatct

SEQ ID NO: 1468381 - DNA, 22 bp, Homo sapiens
aggggcccacaggaagctcagc

SEQ ID NO: 1468382 - DNA, 14 bp, Homo sapiens
aggggcccacccac

SEQ ID NO: 1468383 - DNA, 16 bp, Homo sapiens
aggggcccacccacat

SEQ ID NO: 1468384 - DNA, 16 bp, Homo sapiens
aggggccccggggctg

SEQ ID NO: 1468385 - DNA, 19 bp, Homo sapiens
aggggccccggggctggca

SEQ ID NO: 1468386 - DNA, 21 bp, Homo sapiens
aggggccccggggctggcaag

SEQ ID NO: 1468387 - DNA, 19 bp, Homo sapiens
aggggccctcactcttgaa

SEQ ID NO: 1468388 - DNA, 16 bp, Homo sapiens
aggggccctggccagg

SEQ ID NO: 1468389 - DNA, 12 bp, Homo sapiens
aggggccctggt

SEQ ID NO: 1468390 - DNA, 14 bp, Homo sapiens
aggggccggccctg

SEQ ID NO: 1468391 - DNA, 15 bp, Homo sapiens
aggggccggccctgt

SEQ ID NO: 1468392 - DNA, 17 bp, Homo sapiens
aggggcctagggagccg

SEQ ID NO: 1468393 - DNA, 23 bp, Homo sapiens
aggggcctctgttcctttctctg

SEQ ID NO: 1468394 - DNA, 11 bp, Homo sapiens
aggggcctgga

SEQ ID NO: 1468395 - DNA, 14 bp, Homo sapiens
aggggcctggagat

SEQ ID NO: 1468396 - DNA, 18 bp, Homo sapiens
aggggcctggagatcctc

SEQ ID NO: 1468397 - DNA, 12 bp, Homo sapiens
aggggcctggca

SEQ ID NO: 1468398 - DNA, 13 bp, Homo sapiens
aggggcctggcag

SEQ ID NO: 1468399 - DNA, 23 bp, Homo sapiens
aggggcctggcagccgtgccttc

SEQ ID NO: 1468400 - DNA, 20 bp, Homo sapiens
aggggccttagggcactggg

SEQ ID NO: 1468401 - DNA, 22 bp, Homo sapiens
aggggccttagggcactgggct

SEQ ID NO: 1468402 - DNA, 13 bp, Homo sapiens
aggggcgagcacc

SEQ ID NO: 1468403 - DNA, 15 bp, Homo sapiens
aggggcgctggccca

SEQ ID NO: 1468404 - DNA, 19 bp, Homo sapiens
aggggcgctggcccagccg

SEQ ID NO: 1468405 - DNA, 20 bp, Homo sapiens
aggggcgctggcccagccgg

SEQ ID NO: 1468406 - DNA, 23 bp, Homo sapiens
aggggcgctggcccagccggcct

SEQ ID NO: 1468407 - DNA, 14 bp, Homo sapiens
aggggcggcaggag

SEQ ID NO: 1468408 - DNA, 18 bp, Homo sapiens
aggggcggcaggagggag

SEQ ID NO: 1468409 - DNA, 20 bp, Homo sapiens
aggggcggcaggagggaggt

SEQ ID NO: 1468410 - DNA, 14 bp, Homo sapiens
aggggcggggcagg

SEQ ID NO: 1468411 - DNA, 16 bp, Homo sapiens
aggggcggggcaggaa

SEQ ID NO: 1468412 - DNA, 14 bp, Homo sapiens
aggggctcctgagt

SEQ ID NO: 1468413 - DNA, 13 bp, Homo sapiens
aggggctcctgga

SEQ ID NO: 1468414 - DNA, 20 bp, Homo sapiens
aggggctgaggacgagaccc

SEQ ID NO: 1468415 - DNA, 14 bp, Homo sapiens
aggggctgctgggg

SEQ ID NO: 1468416 - DNA, 19 bp, Homo sapiens
aggggctgtggccgtctcc

SEQ ID NO: 1468417 - DNA, 13 bp, Homo sapiens
aggggcttcctgg

SEQ ID NO: 1468418 - DNA, 22 bp, Homo sapiens
aggggctttctcttccccttcc

SEQ ID NO: 1468419 - DNA, 23 bp, Homo sapiens
agggggagccggtaactgtcctg

SEQ ID NO: 1468420 - DNA, 18 bp, Homo sapiens
agggggagtagccaagct

SEQ ID NO: 1468421 - DNA, 23 bp, Homo sapiens
agggggatgccactcctccctcc

SEQ ID NO: 1468422 - DNA, 19 bp, Homo sapiens
agggggccccgccagggct

SEQ ID NO: 1468423 - DNA, 20 bp, Homo sapiens
agggggcccgaacagggact

SEQ ID NO: 1468424 - DNA, 17 bp, Homo sapiens
aggtgggcagctgggcc

SEQ ID NO: 1468425 - DNA, 13 bp, Homo sapiens
aggtgggcaggtg

SEQ ID NO: 1468426 - DNA, 22 bp, Homo sapiens
aggtgggcaggtggtggcactg

SEQ ID NO: 1468427 - DNA, 16 bp, Homo sapiens
aggtgggcccaggacc

SEQ ID NO: 1468428 - DNA, 19 bp, Homo sapiens
aggtgggccttgctacctc

SEQ ID NO: 1468429 - DNA, 15 bp, Homo sapiens
aggtgggctgcctgc

SEQ ID NO: 1468430 - DNA, 16 bp, Homo sapiens
aggtgggctgcctgct

SEQ ID NO: 1468431 - DNA, 17 bp, Homo sapiens
aggtgggctgcctgctg

SEQ ID NO: 1468432 - DNA, 17 bp, Homo sapiens
aggtggggccctgcccc

SEQ ID NO: 1468433 - DNA, 19 bp, Homo sapiens
aggtggggccctgccccta

SEQ ID NO: 1468434 - DNA, 22 bp, Homo sapiens
aggtggggccctgcccctagga

SEQ ID NO: 1468435 - DNA, 22 bp, Homo sapiens
aggtggggtctttgtgagagtg

SEQ ID NO: 1468436 - DNA, 19 bp, Homo sapiens
aggtgggtccaggaaggca

SEQ ID NO: 1468437 - DNA, 22 bp, Homo sapiens
aggtgggtccaggaaggcagct

SEQ ID NO: 1468438 - DNA, 21 bp, Homo sapiens
aggtgggtgattcctcccagg

SEQ ID NO: 1468439 - DNA, 23 bp, Homo sapiens
aggtgggttttcttcccatcact

SEQ ID NO: 1468440 - DNA, 16 bp, Homo sapiens
aggtggtaaattcaga

SEQ ID NO: 1468441 - DNA, 23 bp, Homo sapiens
aggtggtgaattttccaagaaca

SEQ ID NO: 1468442 - DNA, 20 bp, Homo sapiens
aggtggtggcactgagcccc

SEQ ID NO: 1468443 - DNA, 23 bp, Homo sapiens
aggtggtgggacactgggcagca

SEQ ID NO: 1468444 - DNA, 15 bp, Homo sapiens
aggtgtagaaaaggt

SEQ ID NO: 1468445 - DNA, 23 bp, Homo sapiens
aggtgtatgccacacctggcctt

SEQ ID NO: 1468446 - DNA, 13 bp, Homo sapiens
aggtgtcaggccc

SEQ ID NO: 1468447 - DNA, 14 bp, Homo sapiens
aggtgtcaggcccg

SEQ ID NO: 1468448 - DNA, 22 bp, Homo sapiens
aggtgtcaggcccgtcggagct

SEQ ID NO: 1468449 - DNA, 23 bp, Homo sapiens
aggtgtcaggcccgtcggagctg

SEQ ID NO: 1468450 - DNA, 20 bp, Homo sapiens
aggtgtccagggtcctctag

SEQ ID NO: 1468451 - DNA, 22 bp, Homo sapiens
aggtgtccccaacgtcccctcc

SEQ ID NO: 1468452 - DNA, 15 bp, Homo sapiens
aggtgtccctgcctt

SEQ ID NO: 1468453 - DNA, 14 bp, Homo sapiens
aggtgtcgaggcca

SEQ ID NO: 1468454 - DNA, 22 bp, Homo sapiens
aggtgtctggggtgagggagtt

SEQ ID NO: 1468455 - DNA, 23 bp, Homo sapiens
aggtgtcttttccactcctatgg

SEQ ID NO: 1468456 - DNA, 16 bp, Homo sapiens
aggtgtgactctagca

SEQ ID NO: 1468457 - DNA, 21 bp, Homo sapiens
aggtgtgcaaagatctctaga

SEQ ID NO: 1468458 - DNA, 14 bp, Homo sapiens
aggtgtggctgtca

SEQ ID NO: 1468459 - DNA, 18 bp, Homo sapiens
aggtgttaacattccaag

SEQ ID NO: 1468460 - DNA, 23 bp, Homo sapiens
aggtgttaacattccaagactct

SEQ ID NO: 1468461 - DNA, 23 bp, Homo sapiens
aggtgttatttggaaccttgttt

SEQ ID NO: 1468462 - DNA, 13 bp, Homo sapiens
aggtgttctgctg

SEQ ID NO: 1468463 - DNA, 14 bp, Homo sapiens
aggtgttctgctga

SEQ ID NO: 1468464 - DNA, 15 bp, Homo sapiens
aggtgttctgctgat

SEQ ID NO: 1468465 - DNA, 22 bp, Homo sapiens
aggtgttgccaaatatgtcctg

SEQ ID NO: 1468466 - DNA, 20 bp, Homo sapiens
aggtgttgccatttctctgc

SEQ ID NO: 1468467 - DNA, 20 bp, Homo sapiens
aggtgtttccatttctcaat

SEQ ID NO: 1468468 - DNA, 22 bp, Homo sapiens
aggtgtttgaacagaggccaca

SEQ ID NO: 1468469 - DNA, 15 bp, Homo sapiens
aggttacgaagacaa

SEQ ID NO: 1468470 - DNA, 14 bp, Homo sapiens
aggttactgagtga

SEQ ID NO: 1468471 - DNA, 17 bp, Homo sapiens
aggttactgagtgagtt

SEQ ID NO: 1468472 - DNA, 14 bp, Homo sapiens
aggttactttagtt

SEQ ID NO: 1468473 - DNA, 19 bp, Homo sapiens
aggttagaaaggcagccct

SEQ ID NO: 1468474 - DNA, 22 bp, Homo sapiens
aggttagaaaggcagccctcac

SEQ ID NO: 1468475 - DNA, 14 bp, Homo sapiens
aggttatctgcctg

SEQ ID NO: 1468476 - DNA, 19 bp, Homo sapiens
aggttatctgcctggcctg

SEQ ID NO: 1468477 - DNA, 15 bp, Homo sapiens
aggttatgctatttg

SEQ ID NO: 1468478 - DNA, 19 bp, Homo sapiens
aggttattttgctttggtt

SEQ ID NO: 1468479 - DNA, 21 bp, Homo sapiens
aggttccatccaccaccttgc

SEQ ID NO: 1468480 - DNA, 19 bp, Homo sapiens
aggttcccgacaccagaag

SEQ ID NO: 1468481 - DNA, 22 bp, Homo sapiens
aggttcccgacaccagaagctg

SEQ ID NO: 1468482 - DNA, 12 bp, Homo sapiens
aggttcctctgc

SEQ ID NO: 1468483 - DNA, 13 bp, Homo sapiens
aggttcctctgcc

SEQ ID NO: 1468484 - DNA, 15 bp, Homo sapiens
aggttcctctgcctg

SEQ ID NO: 1468485 - DNA, 17 bp, Homo sapiens
aggttcctctgcctgcc

SEQ ID NO: 1468486 - DNA, 11 bp, Homo sapiens
aggttctaaag

SEQ ID NO: 1468487 - DNA, 17 bp, Homo sapiens
aggttctaaagttctaa

SEQ ID NO: 1468488 - DNA, 19 bp, Homo sapiens
aggttctaaagttctaaga

SEQ ID NO: 1468489 - DNA, 14 bp, Homo sapiens
aggttctaacccta

SEQ ID NO: 1468490 - DNA, 15 bp, Homo sapiens
aggttctaaggccta

SEQ ID NO: 1468491 - DNA, 22 bp, Homo sapiens
aggttctaaggcctaggattct

SEQ ID NO: 1468492 - DNA, 17 bp, Homo sapiens
aggttctaggtttcaaa

SEQ ID NO: 1468493 - DNA, 15 bp, Homo sapiens
aggttctcagacctc

SEQ ID NO: 1468494 - DNA, 13 bp, Homo sapiens
aggttctccaaca

SEQ ID NO: 1468495 - DNA, 16 bp, Homo sapiens
aggttctgggcctctg

SEQ ID NO: 1468496 - DNA, 14 bp, Homo sapiens
aggttctggttcca

SEQ ID NO: 1468497 - DNA, 19 bp, Homo sapiens
aggttcttcccttttacat

SEQ ID NO: 1468498 - DNA, 14 bp, Homo sapiens
aggttcttgatgtc

SEQ ID NO: 1468499 - DNA, 12 bp, Homo sapiens
aggttgaaagac

SEQ ID NO: 1468500 - DNA, 20 bp, Homo sapiens
aggttgaggggctcctggaa

SEQ ID NO: 1468501 - DNA, 14 bp, Homo sapiens
aggttgcagctgct

SEQ ID NO: 1468502 - DNA, 17 bp, Homo sapiens
aggttgcagctgctctt

SEQ ID NO: 1468503 - DNA, 14 bp, Homo sapiens
aggttgcagtgagc

SEQ ID NO: 1468504 - DNA, 16 bp, Homo sapiens
aggttgctgtttcaca

SEQ ID NO: 1468505 - DNA, 15 bp, Homo sapiens
aggttggagcccagg

SEQ ID NO: 1468506 - DNA, 18 bp, Homo sapiens
aggttgggaacatgctgg

SEQ ID NO: 1468507 - DNA, 19 bp, Homo sapiens
aggttgggcttccatgcct

SEQ ID NO: 1468508 - DNA, 19 bp, Homo sapiens
aggttggggtgtactagtt

SEQ ID NO: 1468509 - DNA, 22 bp, Homo sapiens
aggttgggtgctgctaattctt

SEQ ID NO: 1468510 - DNA, 14 bp, Homo sapiens
aggttggtgaattt

SEQ ID NO: 1468511 - DNA, 13 bp, Homo sapiens
aggttggtgactg

SEQ ID NO: 1468512 - DNA, 20 bp, Homo sapiens
aggttggtggggggtccagt

SEQ ID NO: 1468513 - DNA, 14 bp, Homo sapiens
aggttgtagcatgg

SEQ ID NO: 1468514 - DNA, 17 bp, Homo sapiens
aggttgtctccaggcca

SEQ ID NO: 1468515 - DNA, 16 bp, Homo sapiens
aggttgtctgaagtca

SEQ ID NO: 1468516 - DNA, 14 bp, Homo sapiens
aggttgtgcagggt

SEQ ID NO: 1468517 - DNA, 24 bp, Homo sapiens
aggttgtggatgctccagggcagc

SEQ ID NO: 1468518 - DNA, 15 bp, Homo sapiens
aggtttaaagagtct

SEQ ID NO: 1468519 - DNA, 22 bp, Homo sapiens
aggtttacaataggagtggtga

SEQ ID NO: 1468520 - DNA, 15 bp, Homo sapiens
aggtttactgtgaag

SEQ ID NO: 1468521 - DNA, 14 bp, Homo sapiens
aggtttcaaagatg

SEQ ID NO: 1468522 - DNA, 17 bp, Homo sapiens
aggtttcaaagatgctg

SEQ ID NO: 1468523 - DNA, 20 bp, Homo sapiens
aggtttctctcttcccttct

SEQ ID NO: 1468524 - DNA, 19 bp, Homo sapiens
aggtttgccagtgaagact

SEQ ID NO: 1468525 - DNA, 17 bp, Homo sapiens
aggtttgcttcctcagt

SEQ ID NO: 1468526 - DNA, 22 bp, Homo sapiens
aggtttggaaggagcagaaaac

SEQ ID NO: 1468527 - DNA, 17 bp, Homo sapiens
aggtttggtccagcctg

SEQ ID NO: 1468528 - DNA, 10 bp, Homo sapiens
aggtttgtga

SEQ ID NO: 1468529 - DNA, 15 bp, Homo sapiens
aggtttgtgttttct

SEQ ID NO: 1468530 - DNA, 17 bp, Homo sapiens
aggtttgttttgtgaat

SEQ ID NO: 1468531 - DNA, 21 bp, Homo sapiens
aggttttaaagtgattaaacg

SEQ ID NO: 1468532 - DNA, 17 bp, Homo sapiens
aggttttaatgtctgtt

SEQ ID NO: 1468533 - DNA, 15 bp, Homo sapiens
aggttttaggttcta

SEQ ID NO: 1468534 - DNA, 17 bp, Homo sapiens
aggttttataaggctga

SEQ ID NO: 1468535 - DNA, 17 bp, Homo sapiens
aggttttggagagtttg

SEQ ID NO: 1468536 - DNA, 17 bp, Homo sapiens
aggttttgtaaaactgt

SEQ ID NO: 1468537 - DNA, 17 bp, Homo sapiens
aggtttttcatctgaaa

SEQ ID NO: 1468538 - DNA, 20 bp, Homo sapiens
agtatttaagcctaaagatt

SEQ ID NO: 1468539 - DNA, 17 bp, Homo sapiens
agtatttatatatttat

SEQ ID NO: 1468540 - DNA, 19 bp, Homo sapiens
agtatttatatatttataa

SEQ ID NO: 1468541 - DNA, 13 bp, Homo sapiens
agtatttatgggt

SEQ ID NO: 1468542 - DNA, 18 bp, Homo sapiens
agtatttcagtgttttca

SEQ ID NO: 1468543 - DNA, 16 bp, Homo sapiens
agtatttcatgctggg

SEQ ID NO: 1468544 - DNA, 13 bp, Homo sapiens
agtatttcccagc

SEQ ID NO: 1468545 - DNA, 13 bp, Homo sapiens
agtatttcccttc

SEQ ID NO: 1468546 - DNA, 14 bp, Homo sapiens
agtatttctcagga

SEQ ID NO: 1468547 - DNA, 15 bp, Homo sapiens
agtatttctcaggaa

SEQ ID NO: 1468548 - DNA, 11 bp, Homo sapiens
agtatttctga

SEQ ID NO: 1468549 - DNA, 16 bp, Homo sapiens
agtatttctgattttg

SEQ ID NO: 1468550 - DNA, 16 bp, Homo sapiens
agtatttgagagttct

SEQ ID NO: 1468551 - DNA, 18 bp, Homo sapiens
agtatttggtccaaaaaa

SEQ ID NO: 1468552 - DNA, 18 bp, Homo sapiens
agtattttatctggaaca

SEQ ID NO: 1468553 - DNA, 23 bp, Homo sapiens
agtattttcttctctgtgagaag

SEQ ID NO: 1468554 - DNA, 15 bp, Homo sapiens
agtattttgtgtcct

SEQ ID NO: 1468555 - DNA, 14 bp, Homo sapiens
agtatttttaaagg

SEQ ID NO: 1468556 - DNA, 13 bp, Homo sapiens
agtatttttaaca

SEQ ID NO: 1468557 - DNA, 14 bp, Homo sapiens
agtatttttaacac

SEQ ID NO: 1468558 - DNA, 16 bp, Homo sapiens
agtatttttgacagaa

SEQ ID NO: 1468559 - DNA, 16 bp, Homo sapiens
agtatttttttcttac

SEQ ID NO: 1468560 - DNA, 16 bp, Homo sapiens
agtatttttttttaat

SEQ ID NO: 1468561 - DNA, 20 bp, Homo sapiens
agtcaaaaaattatttgcta

SEQ ID NO: 1468562 - DNA, 12 bp, Homo sapiens
agtcaaaacaaa

SEQ ID NO: 1468563 - DNA, 18 bp, Homo sapiens
agtcaaaaggtgcctgtg

SEQ ID NO: 1468564 - DNA, 21 bp, Homo sapiens
agtcaaaaggtgcctgtgagg

SEQ ID NO: 1468565 - DNA, 22 bp, Homo sapiens
agtcaaagtgttgctgtggctc

SEQ ID NO: 1468566 - DNA, 16 bp, Homo sapiens
agtcaaatccagtggt

SEQ ID NO: 1468567 - DNA, 17 bp, Homo sapiens
agtcaaatccagtggtg

SEQ ID NO: 1468568 - DNA, 18 bp, Homo sapiens
agtcaaatccagtggtgg

SEQ ID NO: 1468569 - DNA, 23 bp, Homo sapiens
agtcaaatgccaaacactagctc

SEQ ID NO: 1468570 - DNA, 17 bp, Homo sapiens
agtcaacagtaaaccac

SEQ ID NO: 1468571 - DNA, 21 bp, Homo sapiens
agtcaacagtaaaccactgaa

SEQ ID NO: 1468572 - DNA, 15 bp, Homo sapiens
agtcaacagttcaaa

SEQ ID NO: 1468573 - DNA, 18 bp, Homo sapiens
agtcaacagttcaaagaa

SEQ ID NO: 1468574 - DNA, 21 bp, Homo sapiens
agtcaacagttcaaagaagtc

SEQ ID NO: 1468575 - DNA, 16 bp, Homo sapiens
agtcaacctgcttttt

SEQ ID NO: 1468576 - DNA, 14 bp, Homo sapiens
agtcaactggagca

SEQ ID NO: 1468577 - DNA, 15 bp, Homo sapiens
agtcaagcacatgta

SEQ ID NO: 1468578 - DNA, 13 bp, Homo sapiens
agtcaaggcctgc

SEQ ID NO: 1468579 - DNA, 14 bp, Homo sapiens
agtcaaggcctgct

SEQ ID NO: 1468580 - DNA, 19 bp, Homo sapiens
agtcaaggcctgctccctg

SEQ ID NO: 1468581 - DNA, 11 bp, Homo sapiens
agtcacacagt

SEQ ID NO: 1468582 - DNA, 16 bp, Homo sapiens
agtcacactgctagca

SEQ ID NO: 1468583 - DNA, 15 bp, Homo sapiens
agtcacagctgcagc

SEQ ID NO: 1468584 - DNA, 16 bp, Homo sapiens
agtcacagctgcagct

SEQ ID NO: 1468585 - DNA, 22 bp, Homo sapiens
agtcacagctgcagctgggccc

SEQ ID NO: 1468586 - DNA, 16 bp, Homo sapiens
agtcacattgatgtaa

SEQ ID NO: 1468587 - DNA, 19 bp, Homo sapiens
agtcaccaggaatgttaaa

SEQ ID NO: 1468588 - DNA, 22 bp, Homo sapiens
agtcacccaaacacttctgctt

SEQ ID NO: 1468589 - DNA, 20 bp, Homo sapiens
agtcacccatgaagacagga

SEQ ID NO: 1468590 - DNA, 17 bp, Homo sapiens
agtcaccgacagcggcc

SEQ ID NO: 1468591 - DNA, 17 bp, Homo sapiens
agtcacctcctccactc

SEQ ID NO: 1468592 - DNA, 13 bp, Homo sapiens
agtcacctctgtc

SEQ ID NO: 1468593 - DNA, 22 bp, Homo sapiens
agtcacctgcaagccccagggc

SEQ ID NO: 1468594 - DNA, 23 bp, Homo sapiens
agtcacctgcaagccccagggcc

SEQ ID NO: 1468595 - DNA, 13 bp, Homo sapiens
agtcacctgctcc

SEQ ID NO: 1468596 - DNA, 21 bp, Homo sapiens
agtcacctgctccagaagatg

SEQ ID NO: 1468597 - DNA, 17 bp, Homo sapiens
agtcacctgctggttgt

SEQ ID NO: 1468598 - DNA, 21 bp, Homo sapiens
agtcacggctgcgcactgtgt

SEQ ID NO: 1468599 - DNA, 18 bp, Homo sapiens
agtcactaccttcatgca

SEQ ID NO: 1468600 - DNA, 13 bp, Homo sapiens
agtcactagaagt

SEQ ID NO: 1468601 - DNA, 15 bp, Homo sapiens
agtcactagaagtcc

SEQ ID NO: 1468602 - DNA, 13 bp, Homo sapiens
agtcactccctct

SEQ ID NO: 1468603 - DNA, 15 bp, Homo sapiens
agtcactcctctcta

SEQ ID NO: 1468604 - DNA, 21 bp, Homo sapiens
agtcactcctctctagggcag

SEQ ID NO: 1468605 - DNA, 16 bp, Homo sapiens
agtcactgaacaaaac

SEQ ID NO: 1468606 - DNA, 23 bp, Homo sapiens
agtcactggaggttgaagccaag

SEQ ID NO: 1468607 - DNA, 13 bp, Homo sapiens
agtcactggcagc

SEQ ID NO: 1468608 - DNA, 16 bp, Homo sapiens
agtcactggcagcctg

SEQ ID NO: 1468609 - DNA, 18 bp, Homo sapiens
agtcagatgggtctgata

SEQ ID NO: 1468610 - DNA, 19 bp, Homo sapiens
agtcagatttttatttatg

SEQ ID NO: 1468611 - DNA, 13 bp, Homo sapiens
agtcagcaccttg

SEQ ID NO: 1468612 - DNA, 22 bp, Homo sapiens
agtcagcaccttggcccaggag

SEQ ID NO: 1468613 - DNA, 16 bp, Homo sapiens
agtcagccacactggg

SEQ ID NO: 1468614 - DNA, 20 bp, Homo sapiens
agtcagccacactgggcctg

SEQ ID NO: 1468615 - DNA, 15 bp, Homo sapiens
agtcagccagtggct

SEQ ID NO: 1468616 - DNA, 22 bp, Homo sapiens
agtcagccttccccctcccagg

SEQ ID NO: 1468617 - DNA, 23 bp, Homo sapiens
agtcagccttccccctcccaggg

SEQ ID NO: 1468618 - DNA, 17 bp, Homo sapiens
agtcaggaatggctgca

SEQ ID NO: 1468619 - DNA, 16 bp, Homo sapiens
agtcaggctgcagagg

SEQ ID NO: 1468620 - DNA, 12 bp, Homo sapiens
agtcaggcttct

SEQ ID NO: 1468621 - DNA, 18 bp, Homo sapiens
agtcaggcttctcttgct

SEQ ID NO: 1468622 - DNA, 19 bp, Homo sapiens
agtcaggcttctcttgcta

SEQ ID NO: 1468623 - DNA, 21 bp, Homo sapiens
agtcaggggtcaggtgtcagg

SEQ ID NO: 1468624 - DNA, 23 bp, Homo sapiens
agtcaggggtcaggtgtcaggcc

SEQ ID NO: 1468625 - DNA, 14 bp, Homo sapiens
agtcaggtaatata

SEQ ID NO: 1468626 - DNA, 19 bp, Homo sapiens
agtcagtacacccaatttt

SEQ ID NO: 1468627 - DNA, 18 bp, Homo sapiens
agtcagtacccaccacct

SEQ ID NO: 1468628 - DNA, 21 bp, Homo sapiens
agtcagtcatgatggcaccac

SEQ ID NO: 1468629 - DNA, 20 bp, Homo sapiens
agtcagtgcatttcaaggaa

SEQ ID NO: 1468630 - DNA, 23 bp, Homo sapiens
agtcagtgctctcagctggcagt

SEQ ID NO: 1468631 - DNA, 17 bp, Homo sapiens
agtcagttcccggagca

SEQ ID NO: 1468632 - DNA, 19 bp, Homo sapiens
agtcagttcccggagcaca

SEQ ID NO: 1468633 - DNA, 22 bp, Homo sapiens
agtcagttcccggagcacagcc

SEQ ID NO: 1468634 - DNA, 23 bp, Homo sapiens
agtcagttcccggagcacagccc

SEQ ID NO: 1468635 - DNA, 14 bp, Homo sapiens
agtcataaacctta

SEQ ID NO: 1468636 - DNA, 20 bp, Homo sapiens
agtcataaaccttaagtaag

SEQ ID NO: 1468637 - DNA, 15 bp, Homo sapiens
agtcatcaaagcaga

SEQ ID NO: 1468638 - DNA, 19 bp, Homo sapiens
agtcatcatgaactggctt

SEQ ID NO: 1468639 - DNA, 13 bp, Homo sapiens
agtcatccagtct

SEQ ID NO: 1468640 - DNA, 18 bp, Homo sapiens
agtcatctacttaataaa

SEQ ID NO: 1468641 - DNA, 19 bp, Homo sapiens
agtcatctccatcagctgt

SEQ ID NO: 1468642 - DNA, 20 bp, Homo sapiens
agtcatctccatcagctgta

SEQ ID NO: 1468643 - DNA, 15 bp, Homo sapiens
agtcatctgtaagag

SEQ ID NO: 1468644 - DNA, 20 bp, Homo sapiens
agtcatctgtaagagcttgc

SEQ ID NO: 1468645 - DNA, 21 bp, Homo sapiens
agtcatctgtaagagcttgct

SEQ ID NO: 1468646 - DNA, 19 bp, Homo sapiens
agtcatctgttagggcctt

SEQ ID NO: 1468647 - DNA, 15 bp, Homo sapiens
agtcatgatctccct

SEQ ID NO: 1468648 - DNA, 16 bp, Homo sapiens
agtcatgatctccctg

SEQ ID NO: 1468649 - DNA, 17 bp, Homo sapiens
agtcatgatctccctgc

SEQ ID NO: 1468650 - DNA, 18 bp, Homo sapiens
agtcatgatctccctgcc

SEQ ID NO: 1468651 - DNA, 19 bp, Homo sapiens
agtcatggggtccctgctg

SEQ ID NO: 1468652 - DNA, 22 bp, Homo sapiens
agtcattatgagaggcaatgat

SEQ ID NO: 1468653 - DNA, 18 bp, Homo sapiens
agtgcctaaaattgtatg

SEQ ID NO: 1468654 - DNA, 16 bp, Homo sapiens
agtgcctcacctcgaa

SEQ ID NO: 1468655 - DNA, 17 bp, Homo sapiens
agtgcctcgaggcaccg

SEQ ID NO: 1468656 - DNA, 14 bp, Homo sapiens
agtgcctcttccag

SEQ ID NO: 1468657 - DNA, 21 bp, Homo sapiens
agtgcctcttccagtgaacat

SEQ ID NO: 1468658 - DNA, 18 bp, Homo sapiens
agtgcctgacacactaac

SEQ ID NO: 1468659 - DNA, 19 bp, Homo sapiens
agtgcctggagtcaggtgt

SEQ ID NO: 1468660 - DNA, 18 bp, Homo sapiens
agtgcctgggaatgtatt

SEQ ID NO: 1468661 - DNA, 16 bp, Homo sapiens
agtgccttacctcctg

SEQ ID NO: 1468662 - DNA, 20 bp, Homo sapiens
agtgccttacctcctgccca

SEQ ID NO: 1468663 - DNA, 18 bp, Homo sapiens
agtgccttcaataaatgg

SEQ ID NO: 1468664 - DNA, 15 bp, Homo sapiens
agtgccttccataat

SEQ ID NO: 1468665 - DNA, 16 bp, Homo sapiens
agtgccttccataatt

SEQ ID NO: 1468666 - DNA, 19 bp, Homo sapiens
agtgccttcctgtttttca

SEQ ID NO: 1468667 - DNA, 12 bp, Homo sapiens
agtgccttctct

SEQ ID NO: 1468668 - DNA, 19 bp, Homo sapiens
agtgccttctctcagctcc

SEQ ID NO: 1468669 - DNA, 21 bp, Homo sapiens
agtgccttggggaatttcctc

SEQ ID NO: 1468670 - DNA, 19 bp, Homo sapiens
agtgccttttgcagaagag

SEQ ID NO: 1468671 - DNA, 20 bp, Homo sapiens
agtgccttttgcagaagagg

SEQ ID NO: 1468672 - DNA, 22 bp, Homo sapiens
agtgccttttgcagaagagggt

SEQ ID NO: 1468673 - DNA, 18 bp, Homo sapiens
agtgcctttttcctagaa

SEQ ID NO: 1468674 - DNA, 15 bp, Homo sapiens
agtgcgtgtgtgtat

SEQ ID NO: 1468675 - DNA, 22 bp, Homo sapiens
agtgctaaacaagtaagaaaaa

SEQ ID NO: 1468676 - DNA, 16 bp, Homo sapiens
agtgctaaggttctaa

SEQ ID NO: 1468677 - DNA, 17 bp, Homo sapiens
agtgctaaggttctaag

SEQ ID NO: 1468678 - DNA, 14 bp, Homo sapiens
agtgctactgaaag

SEQ ID NO: 1468679 - DNA, 18 bp, Homo sapiens
agtgctataaatgccaga

SEQ ID NO: 1468680 - DNA, 20 bp, Homo sapiens
agtgctataaatgccagagc

SEQ ID NO: 1468681 - DNA, 15 bp, Homo sapiens
agtgctattctgtgt

SEQ ID NO: 1468682 - DNA, 19 bp, Homo sapiens
agtgctattctgtgttgaa

SEQ ID NO: 1468683 - DNA, 15 bp, Homo sapiens
agtgctccctggagg

SEQ ID NO: 1468684 - DNA, 16 bp, Homo sapiens
agtgctccctggaggc

SEQ ID NO: 1468685 - DNA, 23 bp, Homo sapiens
agtgctccctggaggcacgcacc

SEQ ID NO: 1468686 - DNA, 19 bp, Homo sapiens
agtgctctaggctgccccg

SEQ ID NO: 1468687 - DNA, 22 bp, Homo sapiens
agtgctcttggctgacccctct

SEQ ID NO: 1468688 - DNA, 14 bp, Homo sapiens
agtgctcttttctc

SEQ ID NO: 1468689 - DNA, 19 bp, Homo sapiens
agtgctgaaagaattcctt

SEQ ID NO: 1468690 - DNA, 14 bp, Homo sapiens
agtgctgaacagtg

SEQ ID NO: 1468691 - DNA, 16 bp, Homo sapiens
agtgctgaacagtgga

SEQ ID NO: 1468692 - DNA, 19 bp, Homo sapiens
agtgctgaatttccctctc

SEQ ID NO: 1468693 - DNA, 21 bp, Homo sapiens
agtgctgcagggctttaaaat

SEQ ID NO: 1468694 - DNA, 11 bp, Homo sapiens
agtgctgccat

SEQ ID NO: 1468695 - DNA, 14 bp, Homo sapiens
agtgctgccatgcc

SEQ ID NO: 1468696 - DNA, 15 bp, Homo sapiens
agtgctgccatgcca

SEQ ID NO: 1468697 - DNA, 16 bp, Homo sapiens
agtgctgccatgccac

SEQ ID NO: 1468698 - DNA, 17 bp, Homo sapiens
agtgctgccatgccact

SEQ ID NO: 1468699 - DNA, 19 bp, Homo sapiens
agtgctgccatgccactgc

SEQ ID NO: 1468700 - DNA, 15 bp, Homo sapiens
agtgctgcttctctt

SEQ ID NO: 1468701 - DNA, 18 bp, Homo sapiens
agtgctggaagggaggaa

SEQ ID NO: 1468702 - DNA, 17 bp, Homo sapiens
agtgctggatttgatga

SEQ ID NO: 1468703 - DNA, 20 bp, Homo sapiens
agtgctggcattacaggtgt

SEQ ID NO: 1468704 - DNA, 19 bp, Homo sapiens
agtgctggcccacccagtc

SEQ ID NO: 1468705 - DNA, 20 bp, Homo sapiens
agtgctggcccacccagtcc

SEQ ID NO: 1468706 - DNA, 17 bp, Homo sapiens
agtgctgggatgacagg

SEQ ID NO: 1468707 - DNA, 18 bp, Homo sapiens
agtgctgtaatattgtaa

SEQ ID NO: 1468708 - DNA, 16 bp, Homo sapiens
agtgctgtacccttcc

SEQ ID NO: 1468709 - DNA, 16 bp, Homo sapiens
agtgctgtggcctggg

SEQ ID NO: 1468710 - DNA, 22 bp, Homo sapiens
agtgctgttgggatatagtcaa

SEQ ID NO: 1468711 - DNA, 21 bp, Homo sapiens
agtgctgtttattaatcttag

SEQ ID NO: 1468712 - DNA, 22 bp, Homo sapiens
agtgctgtttattaatcttagt

SEQ ID NO: 1468713 - DNA, 19 bp, Homo sapiens
agtgcttaaaaatcattga

SEQ ID NO: 1468714 - DNA, 19 bp, Homo sapiens
agtgcttcaagggtaatct

SEQ ID NO: 1468715 - DNA, 18 bp, Homo sapiens
agtgcttcagagtttgtg

SEQ ID NO: 1468716 - DNA, 21 bp, Homo sapiens
agtgcttcagagtttgtgtgt

SEQ ID NO: 1468717 - DNA, 14 bp, Homo sapiens
agtgcttcagcctg

SEQ ID NO: 1468718 - DNA, 19 bp, Homo sapiens
agtgcttcagcctgaggct

SEQ ID NO: 1468719 - DNA, 16 bp, Homo sapiens
agtgcttccaaggatg

SEQ ID NO: 1468720 - DNA, 14 bp, Homo sapiens
agtgcttctctaca

SEQ ID NO: 1468721 - DNA, 21 bp, Homo sapiens
agtgcttcttactattaagca

SEQ ID NO: 1468722 - DNA, 19 bp, Homo sapiens
agtgcttgagtttggggaa

SEQ ID NO: 1468723 - DNA, 19 bp, Homo sapiens
agtgctttacatgctgtgc

SEQ ID NO: 1468724 - DNA, 16 bp, Homo sapiens
agtgctttgcatgtat

SEQ ID NO: 1468725 - DNA, 20 bp, Homo sapiens
agtgcttttttttttttgac

SEQ ID NO: 1468726 - DNA, 15 bp, Homo sapiens
agtggaaactcagcc

SEQ ID NO: 1468727 - DNA, 15 bp, Homo sapiens
agtggaaatgttcta

SEQ ID NO: 1468728 - DNA, 16 bp, Homo sapiens
agtggaacgaaaatga

SEQ ID NO: 1468729 - DNA, 24 bp, Homo sapiens
agtggaacgaaaatgaaagctact

SEQ ID NO: 1468730 - DNA, 16 bp, Homo sapiens
agtggaagagcagcct

SEQ ID NO: 1468731 - DNA, 17 bp, Homo sapiens
agtggaagagcagcctg

SEQ ID NO: 1468732 - DNA, 20 bp, Homo sapiens
agtggaagagcagcctgatg

SEQ ID NO: 1468733 - DNA, 15 bp, Homo sapiens
agtggaatgcaggga

SEQ ID NO: 1468734 - DNA, 17 bp, Homo sapiens
agtggaatgcagggaag

SEQ ID NO: 1468735 - DNA, 19 bp, Homo sapiens
agtggaatgcagggaagag

SEQ ID NO: 1468736 - DNA, 20 bp, Homo sapiens
agtggaatgcagggaagagg

SEQ ID NO: 1468737 - DNA, 21 bp, Homo sapiens
agtggaatgcagggaagaggg

SEQ ID NO: 1468738 - DNA, 19 bp, Homo sapiens
agtggacatcgtaggcagc

SEQ ID NO: 1468739 - DNA, 21 bp, Homo sapiens
agtggacatcgtaggcagcca

SEQ ID NO: 1468740 - DNA, 23 bp, Homo sapiens
agtggacatcgtaggcagccacg

SEQ ID NO: 1468741 - DNA, 14 bp, Homo sapiens
agtggaccaggaca

SEQ ID NO: 1468742 - DNA, 15 bp, Homo sapiens
agtggaccaggacag

SEQ ID NO: 1468743 - DNA, 20 bp, Homo sapiens
agtggaccaggacaggacca

SEQ ID NO: 1468744 - DNA, 19 bp, Homo sapiens
agtggaccttaggccttcc

SEQ ID NO: 1468745 - DNA, 23 bp, Homo sapiens
agtggaccttaggccttcctctc

SEQ ID NO: 1468746 - DNA, 18 bp, Homo sapiens
agtggaccttgagaccac

SEQ ID NO: 1468747 - DNA, 21 bp, Homo sapiens
agtggactcttccctctcgct

SEQ ID NO: 1468748 - DNA, 22 bp, Homo sapiens
agtggactcttccctctcgctc

SEQ ID NO: 1468749 - DNA, 22 bp, Homo sapiens
agtggacttgttttaattttag

SEQ ID NO: 1468750 - DNA, 12 bp, Homo sapiens
agtggagacagt

SEQ ID NO: 1468751 - DNA, 15 bp, Homo sapiens
agtggagctgggagg

SEQ ID NO: 1468752 - DNA, 17 bp, Homo sapiens
agtggaggattatcagt

SEQ ID NO: 1468753 - DNA, 13 bp, Homo sapiens
agtggaggcattg

SEQ ID NO: 1468754 - DNA, 15 bp, Homo sapiens
agtggaggcattgtt

SEQ ID NO: 1468755 - DNA, 19 bp, Homo sapiens
agtggaggcgggcttggaa

SEQ ID NO: 1468756 - DNA, 15 bp, Homo sapiens
agtggaggctgctgt

SEQ ID NO: 1468757 - DNA, 18 bp, Homo sapiens
agtggagtctgagtctga

SEQ ID NO: 1468758 - DNA, 19 bp, Homo sapiens
agtggagtctgagtctgag

SEQ ID NO: 1468759 - DNA, 19 bp, Homo sapiens
agtggataatcaggaaaaa

SEQ ID NO: 1468760 - DNA, 15 bp, Homo sapiens
agtggatgatgtttc

SEQ ID NO: 1468761 - DNA, 16 bp, Homo sapiens
agtggatgggaatttg

SEQ ID NO: 1468762 - DNA, 17 bp, Homo sapiens
agtggatgggaatttgt

SEQ ID NO: 1468763 - DNA, 17 bp, Homo sapiens
agtggattctggatggc

SEQ ID NO: 1468764 - DNA, 18 bp, Homo sapiens
agtggattggctttgtgc

SEQ ID NO: 1468765 - DNA, 23 bp, Homo sapiens
agtggcaagaccaaaatgacaat

SEQ ID NO: 1468766 - DNA, 17 bp, Homo sapiens
agtggcaatatagaaac

SEQ ID NO: 1468767 - DNA, 14 bp, Homo sapiens
agttcctcttttgt

SEQ ID NO: 1468768 - DNA, 22 bp, Homo sapiens
agttcctgagtgcgtggatctg

SEQ ID NO: 1468769 - DNA, 14 bp, Homo sapiens
agttcctgctccgt

SEQ ID NO: 1468770 - DNA, 15 bp, Homo sapiens
agttcctgctccgtg

SEQ ID NO: 1468771 - DNA, 13 bp, Homo sapiens
agttcctgggaac

SEQ ID NO: 1468772 - DNA, 17 bp, Homo sapiens
agttcctgtggctccct

SEQ ID NO: 1468773 - DNA, 23 bp, Homo sapiens
agttccttatccctctcttcccc

SEQ ID NO: 1468774 - DNA, 10 bp, Homo sapiens
agttccttgc

SEQ ID NO: 1468775 - DNA, 19 bp, Homo sapiens
agttcctttccttttcttt

SEQ ID NO: 1468776 - DNA, 18 bp, Homo sapiens
agttcgagaccaacctga

SEQ ID NO: 1468777 - DNA, 14 bp, Homo sapiens
agttcgagaccagc

SEQ ID NO: 1468778 - DNA, 15 bp, Homo sapiens
agttctaaattttgt

SEQ ID NO: 1468779 - DNA, 14 bp, Homo sapiens
agttctaagattct

SEQ ID NO: 1468780 - DNA, 16 bp, Homo sapiens
agttctaagattctga

SEQ ID NO: 1468781 - DNA, 22 bp, Homo sapiens
agttctaagttcatgtttgtaa

SEQ ID NO: 1468782 - DNA, 18 bp, Homo sapiens
agttctaataatttctaa

SEQ ID NO: 1468783 - DNA, 20 bp, Homo sapiens
agttctaataatttctaatg

SEQ ID NO: 1468784 - DNA, 20 bp, Homo sapiens
agttctagaaggtctccaag

SEQ ID NO: 1468785 - DNA, 10 bp, Homo sapiens
agttctagac

SEQ ID NO: 1468786 - DNA, 22 bp, Homo sapiens
agttctagacatggaggttcta

SEQ ID NO: 1468787 - DNA, 14 bp, Homo sapiens
agttctaggcactg

SEQ ID NO: 1468788 - DNA, 19 bp, Homo sapiens
agttctataagtgaggaag

SEQ ID NO: 1468789 - DNA, 18 bp, Homo sapiens
agttctatccccaagctg

SEQ ID NO: 1468790 - DNA, 16 bp, Homo sapiens
agttctatttctatct

SEQ ID NO: 1468791 - DNA, 23 bp, Homo sapiens
agttctatttctatctgcaaata

SEQ ID NO: 1468792 - DNA, 13 bp, Homo sapiens
agttctcactggg

SEQ ID NO: 1468793 - DNA, 19 bp, Homo sapiens
agttctcactgggaagaag

SEQ ID NO: 1468794 - DNA, 14 bp, Homo sapiens
agttctcagaataa

SEQ ID NO: 1468795 - DNA, 21 bp, Homo sapiens
agttctccagcttcagctcaa

SEQ ID NO: 1468796 - DNA, 14 bp, Homo sapiens
agttctcccaacaa

SEQ ID NO: 1468797 - DNA, 22 bp, Homo sapiens
agttctcccaacaacatgaaac

SEQ ID NO: 1468798 - DNA, 18 bp, Homo sapiens
agttctccttttgaactt

SEQ ID NO: 1468799 - DNA, 18 bp, Homo sapiens
agttctctcatcggaggc

SEQ ID NO: 1468800 - DNA, 16 bp, Homo sapiens
agttctctgggaagtg

SEQ ID NO: 1468801 - DNA, 15 bp, Homo sapiens
agttctctttggaaa

SEQ ID NO: 1468802 - DNA, 16 bp, Homo sapiens
agttctctttggaaat

SEQ ID NO: 1468803 - DNA, 17 bp, Homo sapiens
agttctctttggaaata

SEQ ID NO: 1468804 - DNA, 22 bp, Homo sapiens
agttctctttggaaatagcatg

SEQ ID NO: 1468805 - DNA, 13 bp, Homo sapiens
agttctgaaagct

SEQ ID NO: 1468806 - DNA, 14 bp, Homo sapiens
agttctgagtgttt

SEQ ID NO: 1468807 - DNA, 18 bp, Homo sapiens
agttctgctttctgcctc

SEQ ID NO: 1468808 - DNA, 13 bp, Homo sapiens
agttctgtgaaga

SEQ ID NO: 1468809 - DNA, 14 bp, Homo sapiens
agttctgtgaagag

SEQ ID NO: 1468810 - DNA, 21 bp, Homo sapiens
agttctgtgactaggaaaaaa

SEQ ID NO: 1468811 - DNA, 22 bp, Homo sapiens
agttctgtggtttcatgttagt

SEQ ID NO: 1468812 - DNA, 15 bp, Homo sapiens
agttctgtgtacttt

SEQ ID NO: 1468813 - DNA, 18 bp, Homo sapiens
agttcttaacccagtgtc

SEQ ID NO: 1468814 - DNA, 22 bp, Homo sapiens
agttcttagctatccttggctt

SEQ ID NO: 1468815 - DNA, 19 bp, Homo sapiens
agttcttagctttgaaact

SEQ ID NO: 1468816 - DNA, 17 bp, Homo sapiens
agttcttatgaggaggg

SEQ ID NO: 1468817 - DNA, 22 bp, Homo sapiens
agttcttattttagtatacgta

SEQ ID NO: 1468818 - DNA, 20 bp, Homo sapiens
agttcttctttctttcttaa

SEQ ID NO: 1468819 - DNA, 23 bp, Homo sapiens
agttcttggtccctccagaacca

SEQ ID NO: 1468820 - DNA, 12 bp, Homo sapiens
agttctttcctc

SEQ ID NO: 1468821 - DNA, 18 bp, Homo sapiens
agttctttcctccccctg

SEQ ID NO: 1468822 - DNA, 22 bp, Homo sapiens
agttctttcctccccctgcaac

SEQ ID NO: 1468823 - DNA, 15 bp, Homo sapiens
agttctttcctcttt

SEQ ID NO: 1468824 - DNA, 15 bp, Homo sapiens
agttctttggattct

SEQ ID NO: 1468825 - DNA, 18 bp, Homo sapiens
agttctttgggccagaca

SEQ ID NO: 1468826 - DNA, 19 bp, Homo sapiens
agttctttgttcatagccc

SEQ ID NO: 1468827 - DNA, 22 bp, Homo sapiens
agttctttgttcatagcccagt

SEQ ID NO: 1468828 - DNA, 14 bp, Homo sapiens
agttctttttgcca

SEQ ID NO: 1468829 - DNA, 23 bp, Homo sapiens
agttctttttgccagttttccct

SEQ ID NO: 1468830 - DNA, 14 bp, Homo sapiens
agttgaaaagactc

SEQ ID NO: 1468831 - DNA, 19 bp, Homo sapiens
agttgaaaagactccaaag

SEQ ID NO: 1468832 - DNA, 20 bp, Homo sapiens
agttgaaaagactccaaaga

SEQ ID NO: 1468833 - DNA, 16 bp, Homo sapiens
agttgaaaagccaaag

SEQ ID NO: 1468834 - DNA, 19 bp, Homo sapiens
agttgaaaagccaaaggtc

SEQ ID NO: 1468835 - DNA, 16 bp, Homo sapiens
agttgaagctaagatt

SEQ ID NO: 1468836 - DNA, 12 bp, Homo sapiens
agttgaattttt

SEQ ID NO: 1468837 - DNA, 13 bp, Homo sapiens
agttgaatttttt

SEQ ID NO: 1468838 - DNA, 18 bp, Homo sapiens
agttgaattttttttaac

SEQ ID NO: 1468839 - DNA, 22 bp, Homo sapiens
agttgaattttttttaacattc

SEQ ID NO: 1468840 - DNA, 18 bp, Homo sapiens
agttgacaacctagaatg

SEQ ID NO: 1468841 - DNA, 17 bp, Homo sapiens
agttgacatgagattta

SEQ ID NO: 1468842 - DNA, 17 bp, Homo sapiens
agttgacatgggtgggg

SEQ ID NO: 1468843 - DNA, 15 bp, Homo sapiens
agttgacttctgaca

SEQ ID NO: 1468844 - DNA, 16 bp, Homo sapiens
agttgagccccaagtc

SEQ ID NO: 1468845 - DNA, 15 bp, Homo sapiens
agttgaggacttctt

SEQ ID NO: 1468846 - DNA, 19 bp, Homo sapiens
agttgagtctcctctctga

SEQ ID NO: 1468847 - DNA, 17 bp, Homo sapiens
agttgataacccctctt

SEQ ID NO: 1468848 - DNA, 15 bp, Homo sapiens
agttgatctggaacc

SEQ ID NO: 1468849 - DNA, 18 bp, Homo sapiens
agttgatctggaacccag

SEQ ID NO: 1468850 - DNA, 19 bp, Homo sapiens
agttgatctggaacccaga

SEQ ID NO: 1468851 - DNA, 23 bp, Homo sapiens
agttgatctggaacccagactca

SEQ ID NO: 1468852 - DNA, 15 bp, Homo sapiens
agttgatgttgcatt

SEQ ID NO: 1468853 - DNA, 18 bp, Homo sapiens
agttgattcagccctcag

SEQ ID NO: 1468854 - DNA, 21 bp, Homo sapiens
agttgattttacaattgaaat

SEQ ID NO: 1468855 - DNA, 17 bp, Homo sapiens
agttgcaataatacttc

SEQ ID NO: 1468856 - DNA, 18 bp, Homo sapiens
agttgcactaactgctgg

SEQ ID NO: 1468857 - DNA, 15 bp, Homo sapiens
agttgcactcaggtg

SEQ ID NO: 1468858 - DNA, 17 bp, Homo sapiens
agttgcagctgatgcct

SEQ ID NO: 1468859 - DNA, 18 bp, Homo sapiens
agttgcatgtagtaacac

SEQ ID NO: 1468860 - DNA, 18 bp, Homo sapiens
agttgccgtctaggattg

SEQ ID NO: 1468861 - DNA, 20 bp, Homo sapiens
agttgcgacggagagaaaaa

SEQ ID NO: 1468862 - DNA, 21 bp, Homo sapiens
agttgctaagtgtgcttagtt

SEQ ID NO: 1468863 - DNA, 15 bp, Homo sapiens
agttgctcaaaaaga

SEQ ID NO: 1468864 - DNA, 18 bp, Homo sapiens
agttgctcacatgtcttt

SEQ ID NO: 1468865 - DNA, 16 bp, Homo sapiens
agttgctgatccctgc

SEQ ID NO: 1468866 - DNA, 14 bp, Homo sapiens
agttgctgtttatt

SEQ ID NO: 1468867 - DNA, 18 bp, Homo sapiens
agttgctttgccagagca

SEQ ID NO: 1468868 - DNA, 20 bp, Homo sapiens
agttgctttgccagagcagg

SEQ ID NO: 1468869 - DNA, 21 bp, Homo sapiens
agttggaaccgtgtccagcac

SEQ ID NO: 1468870 - DNA, 22 bp, Homo sapiens
agttggaaccgtgtccagcaca

SEQ ID NO: 1468871 - DNA, 10 bp, Homo sapiens
agttggaagg

SEQ ID NO: 1468872 - DNA, 12 bp, Homo sapiens
agttggaaggat

SEQ ID NO: 1468873 - DNA, 19 bp, Homo sapiens
agttggaaggatctgctga

SEQ ID NO: 1468874 - DNA, 18 bp, Homo sapiens
agttggaccagaggaagc

SEQ ID NO: 1468875 - DNA, 13 bp, Homo sapiens
agttggactgggt

SEQ ID NO: 1468876 - DNA, 17 bp, Homo sapiens
agttggactgggttgcg

SEQ ID NO: 1468877 - DNA, 16 bp, Homo sapiens
agttggagtagaatgt

SEQ ID NO: 1468878 - DNA, 20 bp, Homo sapiens
agttggcagagaaggcctct

SEQ ID NO: 1468879 - DNA, 20 bp, Homo sapiens
agttggccatgatgtctttt

SEQ ID NO: 1468880 - DNA, 15 bp, Homo sapiens
agttggctcaggcag

SEQ ID NO: 1468881 - DNA, 16 bp, Homo sapiens
agttggctcaggcaga

SEQ ID NO: 1468882 - DNA, 17 bp, Homo sapiens
ataaatcagtatttttt

SEQ ID NO: 1468883 - DNA, 12 bp, Homo sapiens
ataaatcataaa

SEQ ID NO: 1468884 - DNA, 15 bp, Homo sapiens
ataaatcataaagtc

SEQ ID NO: 1468885 - DNA, 20 bp, Homo sapiens
ataaatccacccatgttatc

SEQ ID NO: 1468886 - DNA, 15 bp, Homo sapiens
ataaatccagtgacc

SEQ ID NO: 1468887 - DNA, 22 bp, Homo sapiens
ataaatccagtgacctctctct

SEQ ID NO: 1468888 - DNA, 19 bp, Homo sapiens
ataaatctaggatgtgatg

SEQ ID NO: 1468889 - DNA, 20 bp, Homo sapiens
ataaatctaggatgtgatga

SEQ ID NO: 1468890 - DNA, 18 bp, Homo sapiens
ataaatctgacccagtgc

SEQ ID NO: 1468891 - DNA, 12 bp, Homo sapiens
ataaatctgtct

SEQ ID NO: 1468892 - DNA, 12 bp, Homo sapiens
ataaatgaatga

SEQ ID NO: 1468893 - DNA, 15 bp, Homo sapiens
ataaatgaatgaata

SEQ ID NO: 1468894 - DNA, 17 bp, Homo sapiens
ataaatgagctatgtat

SEQ ID NO: 1468895 - DNA, 13 bp, Homo sapiens
ataaatgagctgt

SEQ ID NO: 1468896 - DNA, 18 bp, Homo sapiens
ataaatgattcaaaaagt

SEQ ID NO: 1468897 - DNA, 18 bp, Homo sapiens
ataaatgcataatttatg

SEQ ID NO: 1468898 - DNA, 14 bp, Homo sapiens
ataaatgccagagc

SEQ ID NO: 1468899 - DNA, 16 bp, Homo sapiens
ataaatgccagagcca

SEQ ID NO: 1468900 - DNA, 21 bp, Homo sapiens
ataaatgccagagccaacctg

SEQ ID NO: 1468901 - DNA, 13 bp, Homo sapiens
ataaatgtatcat

SEQ ID NO: 1468902 - DNA, 17 bp, Homo sapiens
ataaatgtatcatagaa

SEQ ID NO: 1468903 - DNA, 15 bp, Homo sapiens
ataaatgtatcttat

SEQ ID NO: 1468904 - DNA, 18 bp, Homo sapiens
ataaatgtatcttattca

SEQ ID NO: 1468905 - DNA, 12 bp, Homo sapiens
ataaatgtctgt

SEQ ID NO: 1468906 - DNA, 13 bp, Homo sapiens
ataaatgtgttcc

SEQ ID NO: 1468907 - DNA, 21 bp, Homo sapiens
ataaatgttacctaattatta

SEQ ID NO: 1468908 - DNA, 12 bp, Homo sapiens
ataaatgtttaa

SEQ ID NO: 1468909 - DNA, 20 bp, Homo sapiens
ataaatgtttaaatataaat

SEQ ID NO: 1468910 - DNA, 23 bp, Homo sapiens
ataaattactatctgttgaaaag

SEQ ID NO: 1468911 - DNA, 14 bp, Homo sapiens
ataaattagttgtt

SEQ ID NO: 1468912 - DNA, 22 bp, Homo sapiens
ataaattcaacacttattttct

SEQ ID NO: 1468913 - DNA, 19 bp, Homo sapiens
ataaattcacctagtctaa

SEQ ID NO: 1468914 - DNA, 16 bp, Homo sapiens
ataaattggattattt

SEQ ID NO: 1468915 - DNA, 18 bp, Homo sapiens
ataaattggattattttc

SEQ ID NO: 1468916 - DNA, 20 bp, Homo sapiens
ataaattgtttggcttcctc

SEQ ID NO: 1468917 - DNA, 20 bp, Homo sapiens
ataaatttcccagttaaaga

SEQ ID NO: 1468918 - DNA, 22 bp, Homo sapiens
ataaatttcccagttaaagatt

SEQ ID NO: 1468919 - DNA, 14 bp, Homo sapiens
ataaattttgtttc

SEQ ID NO: 1468920 - DNA, 18 bp, Homo sapiens
ataacaaaaaataaattt

SEQ ID NO: 1468921 - DNA, 15 bp, Homo sapiens
ataacaaaactgtgc

SEQ ID NO: 1468922 - DNA, 13 bp, Homo sapiens
ataacaaagaacc

SEQ ID NO: 1468923 - DNA, 17 bp, Homo sapiens
ataacaaccttttacat

SEQ ID NO: 1468924 - DNA, 13 bp, Homo sapiens
ataacaactctat

SEQ ID NO: 1468925 - DNA, 16 bp, Homo sapiens
ataacaagatctttca

SEQ ID NO: 1468926 - DNA, 18 bp, Homo sapiens
ataacaaggagatttctt

SEQ ID NO: 1468927 - DNA, 19 bp, Homo sapiens
ataacaaggagatttctta

SEQ ID NO: 1468928 - DNA, 14 bp, Homo sapiens
ataacacaatatga

SEQ ID NO: 1468929 - DNA, 22 bp, Homo sapiens
ataacacagagagacagacttg

SEQ ID NO: 1468930 - DNA, 13 bp, Homo sapiens
ataacacattttt

SEQ ID NO: 1468931 - DNA, 14 bp, Homo sapiens
ataacactgtattt

SEQ ID NO: 1468932 - DNA, 22 bp, Homo sapiens
ataacactgtattttaatgtac

SEQ ID NO: 1468933 - DNA, 19 bp, Homo sapiens
ataacagcgtttattatac

SEQ ID NO: 1468934 - DNA, 16 bp, Homo sapiens
ataacagtaaatgtgc

SEQ ID NO: 1468935 - DNA, 14 bp, Homo sapiens
ataacagttatatt

SEQ ID NO: 1468936 - DNA, 14 bp, Homo sapiens
ataacatatatgga

SEQ ID NO: 1468937 - DNA, 20 bp, Homo sapiens
ataacatatatggaagagga

SEQ ID NO: 1468938 - DNA, 15 bp, Homo sapiens
ataacatatctaaag

SEQ ID NO: 1468939 - DNA, 16 bp, Homo sapiens
ataacatatctaaagt

SEQ ID NO: 1468940 - DNA, 17 bp, Homo sapiens
ataacatccagagcttt

SEQ ID NO: 1468941 - DNA, 20 bp, Homo sapiens
ataacatctttattgaaatt

SEQ ID NO: 1468942 - DNA, 14 bp, Homo sapiens
ataaccaaaaaatg

SEQ ID NO: 1468943 - DNA, 12 bp, Homo sapiens
ataaccaaagag

SEQ ID NO: 1468944 - DNA, 23 bp, Homo sapiens
ataaccacaaagcacagtttgaa

SEQ ID NO: 1468945 - DNA, 18 bp, Homo sapiens
ataacgtgttcaatattt

SEQ ID NO: 1468946 - DNA, 14 bp, Homo sapiens
ataactaaataaag

SEQ ID NO: 1468947 - DNA, 19 bp, Homo sapiens
ataactaatgctaagaaat

SEQ ID NO: 1468948 - DNA, 13 bp, Homo sapiens
ataactagccaga

SEQ ID NO: 1468949 - DNA, 16 bp, Homo sapiens
ataactagccagacaa

SEQ ID NO: 1468950 - DNA, 23 bp, Homo sapiens
ataactagccagacaaaatttga

SEQ ID NO: 1468951 - DNA, 20 bp, Homo sapiens
ataactatctttttgaaagc

SEQ ID NO: 1468952 - DNA, 18 bp, Homo sapiens
ataactattttaaatatc

SEQ ID NO: 1468953 - DNA, 11 bp, Homo sapiens
ataactctgca

SEQ ID NO: 1468954 - DNA, 19 bp, Homo sapiens
ataactctgcactactcct

SEQ ID NO: 1468955 - DNA, 16 bp, Homo sapiens
ataactgagcttagag

SEQ ID NO: 1468956 - DNA, 15 bp, Homo sapiens
ataactgagttatat

SEQ ID NO: 1468957 - DNA, 17 bp, Homo sapiens
ataactgagttatattg

SEQ ID NO: 1468958 - DNA, 22 bp, Homo sapiens
ataactgatctcaagtatatgt

SEQ ID NO: 1468959 - DNA, 17 bp, Homo sapiens
ataactggaaaacagaa

SEQ ID NO: 1468960 - DNA, 23 bp, Homo sapiens
ataactggaaaacagaacactta

SEQ ID NO: 1468961 - DNA, 18 bp, Homo sapiens
ataactgtatttgaaata

SEQ ID NO: 1468962 - DNA, 19 bp, Homo sapiens
ataacttaaaaatgtaaat

SEQ ID NO: 1468963 - DNA, 12 bp, Homo sapiens
ataacttcctgt

SEQ ID NO: 1468964 - DNA, 22 bp, Homo sapiens
ataacttctatattttaataga

SEQ ID NO: 1468965 - DNA, 23 bp, Homo sapiens
ataacttctatattttaatagaa

SEQ ID NO: 1468966 - DNA, 21 bp, Homo sapiens
ataacttgctgaatttcaggc

SEQ ID NO: 1468967 - DNA, 22 bp, Homo sapiens
ataacttgctgaatttcaggca

SEQ ID NO: 1468968 - DNA, 16 bp, Homo sapiens
ataactttaaatcttt

SEQ ID NO: 1468969 - DNA, 11 bp, Homo sapiens
ataagaaaaac

SEQ ID NO: 1468970 - DNA, 15 bp, Homo sapiens
ataagaaaaactttt

SEQ ID NO: 1468971 - DNA, 15 bp, Homo sapiens
ataagaaaaatcatg

SEQ ID NO: 1468972 - DNA, 18 bp, Homo sapiens
ataagaaaagcctgaact

SEQ ID NO: 1468973 - DNA, 22 bp, Homo sapiens
ataagaacaataggtaaagcta

SEQ ID NO: 1468974 - DNA, 13 bp, Homo sapiens
ataagaacagatc

SEQ ID NO: 1468975 - DNA, 14 bp, Homo sapiens
ataagaacagatca

SEQ ID NO: 1468976 - DNA, 23 bp, Homo sapiens
ataagaagaagttcatgtccaaa

SEQ ID NO: 1468977 - DNA, 20 bp, Homo sapiens
ataagaagcaatctttgaaa

SEQ ID NO: 1468978 - DNA, 22 bp, Homo sapiens
ataagaagccttaatttgcaca

SEQ ID NO: 1468979 - DNA, 15 bp, Homo sapiens
ataagaaggcaattt

SEQ ID NO: 1468980 - DNA, 18 bp, Homo sapiens
ataagaatggagcagtac

SEQ ID NO: 1468981 - DNA, 13 bp, Homo sapiens
ataagacaaacac

SEQ ID NO: 1468982 - DNA, 14 bp, Homo sapiens
ataagacaaacact

SEQ ID NO: 1468983 - DNA, 20 bp, Homo sapiens
ataagacaagagatctacac

SEQ ID NO: 1468984 - DNA, 18 bp, Homo sapiens
ataagagaaagaaaatga

SEQ ID NO: 1468985 - DNA, 19 bp, Homo sapiens
ataagagaaagaggccaga

SEQ ID NO: 1468986 - DNA, 19 bp, Homo sapiens
ataagagaagtctcattcg

SEQ ID NO: 1468987 - DNA, 12 bp, Homo sapiens
ataagagatttg

SEQ ID NO: 1468988 - DNA, 20 bp, Homo sapiens
ataagagtgattagagctgc

SEQ ID NO: 1468989 - DNA, 23 bp, Homo sapiens
ataagagttgctttgccagagca

SEQ ID NO: 1468990 - DNA, 13 bp, Homo sapiens
ataagataaatgt

SEQ ID NO: 1468991 - DNA, 16 bp, Homo sapiens
ataagatacacagctc

SEQ ID NO: 1468992 - DNA, 19 bp, Homo sapiens
ataagatatatacaaggtg

SEQ ID NO: 1468993 - DNA, 14 bp, Homo sapiens
ataagattcatatt

SEQ ID NO: 1468994 - DNA, 21 bp, Homo sapiens
ataagattcatatttacttct

SEQ ID NO: 1468995 - DNA, 13 bp, Homo sapiens
ataagattctaac

SEQ ID NO: 1468996 - DNA, 23 bp, Homo sapiens
ataagcaaagggagcactgggtt

SEQ ID NO: 1468997 - DNA, 14 bp, Homo sapiens
atactggactcagg

SEQ ID NO: 1468998 - DNA, 15 bp, Homo sapiens
atactggactcagga

SEQ ID NO: 1468999 - DNA, 19 bp, Homo sapiens
atactggactcaggaactt

SEQ ID NO: 1469000 - DNA, 14 bp, Homo sapiens
atactggcctggac

SEQ ID NO: 1469001 - DNA, 21 bp, Homo sapiens
atactggtgcagtcattatga

SEQ ID NO: 1469002 - DNA, 23 bp, Homo sapiens
atactggttatagttgatatgta

SEQ ID NO: 1469003 - DNA, 19 bp, Homo sapiens
atactgtatattcaggact

SEQ ID NO: 1469004 - DNA, 21 bp, Homo sapiens
atactgtcaaacaataaaggg

SEQ ID NO: 1469005 - DNA, 21 bp, Homo sapiens
atactgtcggttttttttaaa

SEQ ID NO: 1469006 - DNA, 15 bp, Homo sapiens
atactgtctgggatt

SEQ ID NO: 1469007 - DNA, 14 bp, Homo sapiens
atactgtgtgggat

SEQ ID NO: 1469008 - DNA, 23 bp, Homo sapiens
atactgtgtgttttcccaaagca

SEQ ID NO: 1469009 - DNA, 15 bp, Homo sapiens
atactgttattcttt

SEQ ID NO: 1469010 - DNA, 13 bp, Homo sapiens
atactgtttgtaa

SEQ ID NO: 1469011 - DNA, 18 bp, Homo sapiens
atactgtttgtaatatac

SEQ ID NO: 1469012 - DNA, 16 bp, Homo sapiens
atacttaaaaattaat

SEQ ID NO: 1469013 - DNA, 23 bp, Homo sapiens
atacttaacacgtgaatattttg

SEQ ID NO: 1469014 - DNA, 13 bp, Homo sapiens
atacttaatgtgg

SEQ ID NO: 1469015 - DNA, 16 bp, Homo sapiens
atacttactataattt

SEQ ID NO: 1469016 - DNA, 14 bp, Homo sapiens
atacttagtggtat

SEQ ID NO: 1469017 - DNA, 22 bp, Homo sapiens
atacttattttattttttacca

SEQ ID NO: 1469018 - DNA, 18 bp, Homo sapiens
atacttcgatgatgatga

SEQ ID NO: 1469019 - DNA, 16 bp, Homo sapiens
atacttgaagggccag

SEQ ID NO: 1469020 - DNA, 20 bp, Homo sapiens
atacttgaagggccagagcc

SEQ ID NO: 1469021 - DNA, 22 bp, Homo sapiens
atacttgaagggccagagccag

SEQ ID NO: 1469022 - DNA, 20 bp, Homo sapiens
atacttgagattttcctcca

SEQ ID NO: 1469023 - DNA, 17 bp, Homo sapiens
atacttgccttctgata

SEQ ID NO: 1469024 - DNA, 16 bp, Homo sapiens
atacttgtttttgtaa

SEQ ID NO: 1469025 - DNA, 19 bp, Homo sapiens
atactttaagttaaatatg

SEQ ID NO: 1469026 - DNA, 12 bp, Homo sapiens
atactttacatg

SEQ ID NO: 1469027 - DNA, 18 bp, Homo sapiens
atactttagtagacattt

SEQ ID NO: 1469028 - DNA, 13 bp, Homo sapiens
atactttattgaa

SEQ ID NO: 1469029 - DNA, 16 bp, Homo sapiens
atactttattgaaagg

SEQ ID NO: 1469030 - DNA, 15 bp, Homo sapiens
atactttatttctga

SEQ ID NO: 1469031 - DNA, 13 bp, Homo sapiens
atactttccatgt

SEQ ID NO: 1469032 - DNA, 15 bp, Homo sapiens
atactttctctctag

SEQ ID NO: 1469033 - DNA, 22 bp, Homo sapiens
atactttgaaaggagatgtctt

SEQ ID NO: 1469034 - DNA, 17 bp, Homo sapiens
atactttgacaaggaaa

SEQ ID NO: 1469035 - DNA, 16 bp, Homo sapiens
atactttgttctgttg

SEQ ID NO: 1469036 - DNA, 21 bp, Homo sapiens
atacttttaaagttttgtcag

SEQ ID NO: 1469037 - DNA, 17 bp, Homo sapiens
atacttttgtaatctat

SEQ ID NO: 1469038 - DNA, 17 bp, Homo sapiens
atacttttgtgtattct

SEQ ID NO: 1469039 - DNA, 22 bp, Homo sapiens
atacttttgtgtattctgtgga

SEQ ID NO: 1469040 - DNA, 15 bp, Homo sapiens
atagaaaaatgtata

SEQ ID NO: 1469041 - DNA, 17 bp, Homo sapiens
atagaaaatccttcagc

SEQ ID NO: 1469042 - DNA, 15 bp, Homo sapiens
atagaaacatgacac

SEQ ID NO: 1469043 - DNA, 21 bp, Homo sapiens
atagaaacgtaaactatgacc

SEQ ID NO: 1469044 - DNA, 13 bp, Homo sapiens
atagaaagctgga

SEQ ID NO: 1469045 - DNA, 21 bp, Homo sapiens
atagaaagctggactgaccaa

SEQ ID NO: 1469046 - DNA, 13 bp, Homo sapiens
atagaaataaatt

SEQ ID NO: 1469047 - DNA, 14 bp, Homo sapiens
atagaaataaattc

SEQ ID NO: 1469048 - DNA, 12 bp, Homo sapiens
atagaaatggaa

SEQ ID NO: 1469049 - DNA, 20 bp, Homo sapiens
atagaaatggaaattttgct

SEQ ID NO: 1469050 - DNA, 23 bp, Homo sapiens
atagaaatggaaattttgctatc

SEQ ID NO: 1469051 - DNA, 17 bp, Homo sapiens
atagaaattttgtaaga

SEQ ID NO: 1469052 - DNA, 18 bp, Homo sapiens
atagaaattttgtaagaa

SEQ ID NO: 1469053 - DNA, 16 bp, Homo sapiens
atagaagagaagagcc

SEQ ID NO: 1469054 - DNA, 14 bp, Homo sapiens
atagaagattgttg

SEQ ID NO: 1469055 - DNA, 16 bp, Homo sapiens
atagaaggaatttgta

SEQ ID NO: 1469056 - DNA, 17 bp, Homo sapiens
atagaaggaatttgtac

SEQ ID NO: 1469057 - DNA, 18 bp, Homo sapiens
atagaaggaatttgtact

SEQ ID NO: 1469058 - DNA, 12 bp, Homo sapiens
atagaataaagg

SEQ ID NO: 1469059 - DNA, 18 bp, Homo sapiens
atagaataaaggcagttt

SEQ ID NO: 1469060 - DNA, 19 bp, Homo sapiens
atagaataaaggcagtttt

SEQ ID NO: 1469061 - DNA, 22 bp, Homo sapiens
atagaataaaggcagttttcta

SEQ ID NO: 1469062 - DNA, 19 bp, Homo sapiens
atagaataattcttttctg

SEQ ID NO: 1469063 - DNA, 13 bp, Homo sapiens
atagaatactttt

SEQ ID NO: 1469064 - DNA, 22 bp, Homo sapiens
atagaatatttattacctctga

SEQ ID NO: 1469065 - DNA, 13 bp, Homo sapiens
atagaattcagaa

SEQ ID NO: 1469066 - DNA, 14 bp, Homo sapiens
atagacaaaagaat

SEQ ID NO: 1469067 - DNA, 19 bp, Homo sapiens
atagacaaatagaaaatgg

SEQ ID NO: 1469068 - DNA, 13 bp, Homo sapiens
atagacaggtcct

SEQ ID NO: 1469069 - DNA, 16 bp, Homo sapiens
atagacattctcacat

SEQ ID NO: 1469070 - DNA, 21 bp, Homo sapiens
atagaccctctttcttgtttg

SEQ ID NO: 1469071 - DNA, 15 bp, Homo sapiens
atagacgggttgaaa

SEQ ID NO: 1469072 - DNA, 16 bp, Homo sapiens
atagacgggttgaaag

SEQ ID NO: 1469073 - DNA, 21 bp, Homo sapiens
atagacgggttgaaagacatc

SEQ ID NO: 1469074 - DNA, 23 bp, Homo sapiens
atagacgggttgaaagacatcaa

SEQ ID NO: 1469075 - DNA, 20 bp, Homo sapiens
atagacgtttggactgattt

SEQ ID NO: 1469076 - DNA, 22 bp, Homo sapiens
atagactagtcctatggaaaaa

SEQ ID NO: 1469077 - DNA, 20 bp, Homo sapiens
atagactgaggtataaagac

SEQ ID NO: 1469078 - DNA, 15 bp, Homo sapiens
atagacttgggatgg

SEQ ID NO: 1469079 - DNA, 14 bp, Homo sapiens
atagagactgtaga

SEQ ID NO: 1469080 - DNA, 22 bp, Homo sapiens
atagagatttgtctaattgcat

SEQ ID NO: 1469081 - DNA, 22 bp, Homo sapiens
atagagcaaaattgatgtgttt

SEQ ID NO: 1469082 - DNA, 15 bp, Homo sapiens
atagagcagaaattc

SEQ ID NO: 1469083 - DNA, 18 bp, Homo sapiens
atagagcttttaaaaatg

SEQ ID NO: 1469084 - DNA, 14 bp, Homo sapiens
atagagctttttaa

SEQ ID NO: 1469085 - DNA, 23 bp, Homo sapiens
atagaggatagggagaatattta

SEQ ID NO: 1469086 - DNA, 22 bp, Homo sapiens
atagaggcttctccgccagcct

SEQ ID NO: 1469087 - DNA, 23 bp, Homo sapiens
atagagtaaaaagaaaacaaaac

SEQ ID NO: 1469088 - DNA, 21 bp, Homo sapiens
atagagtgtacttaactattc

SEQ ID NO: 1469089 - DNA, 23 bp, Homo sapiens
atagagtgtagtttacagaaaaa

SEQ ID NO: 1469090 - DNA, 15 bp, Homo sapiens
atagataatattgtt

SEQ ID NO: 1469091 - DNA, 16 bp, Homo sapiens
atagataatattgttt

SEQ ID NO: 1469092 - DNA, 13 bp, Homo sapiens
atagataattatc

SEQ ID NO: 1469093 - DNA, 23 bp, Homo sapiens
atagatcctggttaccactcttt

SEQ ID NO: 1469094 - DNA, 21 bp, Homo sapiens
atagatcttctgaaatgaaac

SEQ ID NO: 1469095 - DNA, 16 bp, Homo sapiens
atagatgcaagatatt

SEQ ID NO: 1469096 - DNA, 19 bp, Homo sapiens
atagatgcaagatatttat

SEQ ID NO: 1469097 - DNA, 15 bp, Homo sapiens
atagatgctggccca

SEQ ID NO: 1469098 - DNA, 13 bp, Homo sapiens
atagatgtaattt

SEQ ID NO: 1469099 - DNA, 14 bp, Homo sapiens
atagatgtgtggac

SEQ ID NO: 1469100 - DNA, 18 bp, Homo sapiens
atagattaatggcactga

SEQ ID NO: 1469101 - DNA, 21 bp, Homo sapiens
atagattataacttgtctaaa

SEQ ID NO: 1469102 - DNA, 16 bp, Homo sapiens
atagattattataaac

SEQ ID NO: 1469103 - DNA, 21 bp, Homo sapiens
atagattattataaactataa

SEQ ID NO: 1469104 - DNA, 16 bp, Homo sapiens
atagatttagctattt

SEQ ID NO: 1469105 - DNA, 23 bp, Homo sapiens
atagcaaatgttttgacatgaaa

SEQ ID NO: 1469106 - DNA, 15 bp, Homo sapiens
atagcaacaggaaaa

SEQ ID NO: 1469107 - DNA, 19 bp, Homo sapiens
atagcaagtgaatttttct

SEQ ID NO: 1469108 - DNA, 22 bp, Homo sapiens
atagcaagtgaatttttctcta

SEQ ID NO: 1469109 - DNA, 20 bp, Homo sapiens
atagcactaaccaatgcctt

SEQ ID NO: 1469110 - DNA, 17 bp, Homo sapiens
atagcagagagccaaat

SEQ ID NO: 1469111 - DNA, 19 bp, Homo sapiens
atatgcttaaaataagcag

SEQ ID NO: 1469112 - DNA, 14 bp, Homo sapiens
atatgcttatacac

SEQ ID NO: 1469113 - DNA, 16 bp, Homo sapiens
atatgcttatacactt

SEQ ID NO: 1469114 - DNA, 21 bp, Homo sapiens
atatgcttatacacttacact

SEQ ID NO: 1469115 - DNA, 14 bp, Homo sapiens
atatgctttattaa

SEQ ID NO: 1469116 - DNA, 19 bp, Homo sapiens
atatgctttattaatgttt

SEQ ID NO: 1469117 - DNA, 20 bp, Homo sapiens
atatgctttattaatgtttt

SEQ ID NO: 1469118 - DNA, 19 bp, Homo sapiens
atatgcttttggaagttaa

SEQ ID NO: 1469119 - DNA, 18 bp, Homo sapiens
atatgctttttctcagat

SEQ ID NO: 1469120 - DNA, 21 bp, Homo sapiens
atatggaggattctttcccca

SEQ ID NO: 1469121 - DNA, 21 bp, Homo sapiens
atatggagtgagtcacctgct

SEQ ID NO: 1469122 - DNA, 15 bp, Homo sapiens
atatggctataaata

SEQ ID NO: 1469123 - DNA, 12 bp, Homo sapiens
atatggctgccc

SEQ ID NO: 1469124 - DNA, 14 bp, Homo sapiens
atatggctgcccag

SEQ ID NO: 1469125 - DNA, 16 bp, Homo sapiens
atatggggaatatatt

SEQ ID NO: 1469126 - DNA, 23 bp, Homo sapiens
atatgggttagatgttgccatgt

SEQ ID NO: 1469127 - DNA, 14 bp, Homo sapiens
atatggtatatata

SEQ ID NO: 1469128 - DNA, 19 bp, Homo sapiens
atatggtatatatacatat

SEQ ID NO: 1469129 - DNA, 19 bp, Homo sapiens
atatggtcatatacatatt

SEQ ID NO: 1469130 - DNA, 13 bp, Homo sapiens
atatggtggaaaa

SEQ ID NO: 1469131 - DNA, 14 bp, Homo sapiens
atatggtgtatttt

SEQ ID NO: 1469132 - DNA, 19 bp, Homo sapiens
atatggttctccaagaaac

SEQ ID NO: 1469133 - DNA, 22 bp, Homo sapiens
atatggttctccaagaaactga

SEQ ID NO: 1469134 - DNA, 14 bp, Homo sapiens
atatgtaacagttg

SEQ ID NO: 1469135 - DNA, 17 bp, Homo sapiens
atatgtaagaacacatt

SEQ ID NO: 1469136 - DNA, 15 bp, Homo sapiens
atatgtaagtacttc

SEQ ID NO: 1469137 - DNA, 21 bp, Homo sapiens
atatgtaatataaatttaagc

SEQ ID NO: 1469138 - DNA, 22 bp, Homo sapiens
atatgtaatataaatttaagca

SEQ ID NO: 1469139 - DNA, 13 bp, Homo sapiens
atatgtacatttc

SEQ ID NO: 1469140 - DNA, 17 bp, Homo sapiens
atatgtactaagaatgt

SEQ ID NO: 1469141 - DNA, 21 bp, Homo sapiens
atatgtactaagaatgtcctt

SEQ ID NO: 1469142 - DNA, 19 bp, Homo sapiens
atatgtacttgtttgctat

SEQ ID NO: 1469143 - DNA, 14 bp, Homo sapiens
atatgtagtattaa

SEQ ID NO: 1469144 - DNA, 21 bp, Homo sapiens
atatgtatatatatatatgca

SEQ ID NO: 1469145 - DNA, 23 bp, Homo sapiens
atatgtatgggtagggtaaatca

SEQ ID NO: 1469146 - DNA, 21 bp, Homo sapiens
atatgtattaacactactcaa

SEQ ID NO: 1469147 - DNA, 18 bp, Homo sapiens
atatgtattacctctggc

SEQ ID NO: 1469148 - DNA, 13 bp, Homo sapiens
atatgtattcttt

SEQ ID NO: 1469149 - DNA, 16 bp, Homo sapiens
atatgtattttcctaa

SEQ ID NO: 1469150 - DNA, 21 bp, Homo sapiens
atatgtattttcctaagtgtt

SEQ ID NO: 1469151 - DNA, 14 bp, Homo sapiens
atatgtcaagccat

SEQ ID NO: 1469152 - DNA, 14 bp, Homo sapiens
atatgtcagggcgt

SEQ ID NO: 1469153 - DNA, 14 bp, Homo sapiens
atatgtcatttact

SEQ ID NO: 1469154 - DNA, 16 bp, Homo sapiens
atatgtcgtagaattc

SEQ ID NO: 1469155 - DNA, 19 bp, Homo sapiens
atatgtcgtagaattcctt

SEQ ID NO: 1469156 - DNA, 13 bp, Homo sapiens
atatgtgaacatt

SEQ ID NO: 1469157 - DNA, 12 bp, Homo sapiens
atatgtgatttt

SEQ ID NO: 1469158 - DNA, 17 bp, Homo sapiens
atatgtgcagtcttgct

SEQ ID NO: 1469159 - DNA, 16 bp, Homo sapiens
atatgtgccttaagtt

SEQ ID NO: 1469160 - DNA, 22 bp, Homo sapiens
atatgtgtatgcacagtaaaaa

SEQ ID NO: 1469161 - DNA, 12 bp, Homo sapiens
atatgtgtatgt

SEQ ID NO: 1469162 - DNA, 20 bp, Homo sapiens
atatgttaacctcagtgtca

SEQ ID NO: 1469163 - DNA, 18 bp, Homo sapiens
atatgttgctataataaa

SEQ ID NO: 1469164 - DNA, 15 bp, Homo sapiens
atatgttggtttaat

SEQ ID NO: 1469165 - DNA, 17 bp, Homo sapiens
atatgttggtttaatta

SEQ ID NO: 1469166 - DNA, 22 bp, Homo sapiens
atatgtttaccttttaattaat

SEQ ID NO: 1469167 - DNA, 14 bp, Homo sapiens
atatgtttatatac

SEQ ID NO: 1469168 - DNA, 15 bp, Homo sapiens
atatgtttatatact

SEQ ID NO: 1469169 - DNA, 13 bp, Homo sapiens
atatgtttcaaac

SEQ ID NO: 1469170 - DNA, 16 bp, Homo sapiens
atatgtttcaaacttt

SEQ ID NO: 1469171 - DNA, 13 bp, Homo sapiens
atatgtttgtgcc

SEQ ID NO: 1469172 - DNA, 18 bp, Homo sapiens
atattaaaatctgatgta

SEQ ID NO: 1469173 - DNA, 18 bp, Homo sapiens
atattaaaatgtcggatt

SEQ ID NO: 1469174 - DNA, 22 bp, Homo sapiens
atattaaaattccaaattcatg

SEQ ID NO: 1469175 - DNA, 18 bp, Homo sapiens
atattaaaattgttaata

SEQ ID NO: 1469176 - DNA, 22 bp, Homo sapiens
atattaaacaaagtttcagagt

SEQ ID NO: 1469177 - DNA, 23 bp, Homo sapiens
atattaaacatacataatacaat

SEQ ID NO: 1469178 - DNA, 12 bp, Homo sapiens
atattaaagatt

SEQ ID NO: 1469179 - DNA, 17 bp, Homo sapiens
atattaaatacagacac

SEQ ID NO: 1469180 - DNA, 20 bp, Homo sapiens
atattaaatacagacactaa

SEQ ID NO: 1469181 - DNA, 15 bp, Homo sapiens
atattaacattcttt

SEQ ID NO: 1469182 - DNA, 22 bp, Homo sapiens
atattaagaaagactatctaaa

SEQ ID NO: 1469183 - DNA, 24 bp, Homo sapiens
atattaagaaagactatctaaatg

SEQ ID NO: 1469184 - DNA, 18 bp, Homo sapiens
atattaagacagtgtaca

SEQ ID NO: 1469185 - DNA, 12 bp, Homo sapiens
atattaagcact

SEQ ID NO: 1469186 - DNA, 23 bp, Homo sapiens
atattaagcatgacagaaaatat

SEQ ID NO: 1469187 - DNA, 14 bp, Homo sapiens
atattaatcaaaat

SEQ ID NO: 1469188 - DNA, 23 bp, Homo sapiens
atattaattagcaggttgggcta

SEQ ID NO: 1469189 - DNA, 22 bp, Homo sapiens
atattacatttatttatccaga

SEQ ID NO: 1469190 - DNA, 13 bp, Homo sapiens
atattactgtctt

SEQ ID NO: 1469191 - DNA, 17 bp, Homo sapiens
atattactgttgcattt

SEQ ID NO: 1469192 - DNA, 20 bp, Homo sapiens
atattagctttactgtttgt

SEQ ID NO: 1469193 - DNA, 21 bp, Homo sapiens
atattagctttactgtttgtt

SEQ ID NO: 1469194 - DNA, 15 bp, Homo sapiens
atattagtgattctg

SEQ ID NO: 1469195 - DNA, 16 bp, Homo sapiens
atattagtgattctga

SEQ ID NO: 1469196 - DNA, 20 bp, Homo sapiens
atattatactgacagaggct

SEQ ID NO: 1469197 - DNA, 13 bp, Homo sapiens
atattatagaaaa

SEQ ID NO: 1469198 - DNA, 18 bp, Homo sapiens
atattatataggatattg

SEQ ID NO: 1469199 - DNA, 17 bp, Homo sapiens
atattatatatatctat

SEQ ID NO: 1469200 - DNA, 18 bp, Homo sapiens
atattatattttttctat

SEQ ID NO: 1469201 - DNA, 16 bp, Homo sapiens
atattatggaagattt

SEQ ID NO: 1469202 - DNA, 13 bp, Homo sapiens
atattatgtcttc

SEQ ID NO: 1469203 - DNA, 14 bp, Homo sapiens
atattatgtcttct

SEQ ID NO: 1469204 - DNA, 13 bp, Homo sapiens
atattattagaaa

SEQ ID NO: 1469205 - DNA, 19 bp, Homo sapiens
atattattataatcttata

SEQ ID NO: 1469206 - DNA, 12 bp, Homo sapiens
atattatttctt

SEQ ID NO: 1469207 - DNA, 17 bp, Homo sapiens
atattatttcttctctt

SEQ ID NO: 1469208 - DNA, 19 bp, Homo sapiens
atattcaatgcatttaaaa

SEQ ID NO: 1469209 - DNA, 14 bp, Homo sapiens
atattcaatgtatt

SEQ ID NO: 1469210 - DNA, 16 bp, Homo sapiens
atattcaatgtattga

SEQ ID NO: 1469211 - DNA, 16 bp, Homo sapiens
atattcacagactgat

SEQ ID NO: 1469212 - DNA, 15 bp, Homo sapiens
atattcactctccat

SEQ ID NO: 1469213 - DNA, 19 bp, Homo sapiens
atattcagggtaaatagga

SEQ ID NO: 1469214 - DNA, 18 bp, Homo sapiens
atattcatggttgttttt

SEQ ID NO: 1469215 - DNA, 21 bp, Homo sapiens
atattcatttaaaacattgca

SEQ ID NO: 1469216 - DNA, 17 bp, Homo sapiens
atattccagatctttca

SEQ ID NO: 1469217 - DNA, 15 bp, Homo sapiens
atattccatgggact

SEQ ID NO: 1469218 - DNA, 15 bp, Homo sapiens
atattcccattttat

SEQ ID NO: 1469219 - DNA, 18 bp, Homo sapiens
atattccgtatttaaagt

SEQ ID NO: 1469220 - DNA, 17 bp, Homo sapiens
atattcctgaatgaaat

SEQ ID NO: 1469221 - DNA, 13 bp, Homo sapiens
atattctaagcca

SEQ ID NO: 1469222 - DNA, 19 bp, Homo sapiens
atattctacacatgtaaaa

SEQ ID NO: 1469223 - DNA, 21 bp, Homo sapiens
atattctagtgtaacactgca

SEQ ID NO: 1469224 - DNA, 18 bp, Homo sapiens
atattctatatgaattta

SEQ ID NO: 1469225 - DNA, 20 bp, Homo sapiens
atattctatatgaatttaaa

SEQ ID NO: 1469226 - DNA, 14 bp, Homo sapiens
atcactccctggat

SEQ ID NO: 1469227 - DNA, 21 bp, Homo sapiens
atcactctcagtgcttcttac

SEQ ID NO: 1469228 - DNA, 17 bp, Homo sapiens
atcactctctgctggca

SEQ ID NO: 1469229 - DNA, 22 bp, Homo sapiens
atcactgaattaagccatcagg

SEQ ID NO: 1469230 - DNA, 13 bp, Homo sapiens
atcactgactctg

SEQ ID NO: 1469231 - DNA, 11 bp, Homo sapiens
atcactgccaa

SEQ ID NO: 1469232 - DNA, 12 bp, Homo sapiens
atcactgccaca

SEQ ID NO: 1469233 - DNA, 18 bp, Homo sapiens
atcactgccacactctcc

SEQ ID NO: 1469234 - DNA, 22 bp, Homo sapiens
atcactgccacactctccatca

SEQ ID NO: 1469235 - DNA, 19 bp, Homo sapiens
atcactgccctttttgaaa

SEQ ID NO: 1469236 - DNA, 21 bp, Homo sapiens
atcactgccctttttgaaatc

SEQ ID NO: 1469237 - DNA, 19 bp, Homo sapiens
atcactggagcaccaggca

SEQ ID NO: 1469238 - DNA, 13 bp, Homo sapiens
atcactggagccc

SEQ ID NO: 1469239 - DNA, 23 bp, Homo sapiens
atcactggcaatgaaaaattctc

SEQ ID NO: 1469240 - DNA, 16 bp, Homo sapiens
atcactggctggcctg

SEQ ID NO: 1469241 - DNA, 22 bp, Homo sapiens
atcactggttgcacttatgatt

SEQ ID NO: 1469242 - DNA, 23 bp, Homo sapiens
atcactgtagtttagttctgttg

SEQ ID NO: 1469243 - DNA, 17 bp, Homo sapiens
atcactgtgctcagcca

SEQ ID NO: 1469244 - DNA, 18 bp, Homo sapiens
atcactgtgctcagccac

SEQ ID NO: 1469245 - DNA, 18 bp, Homo sapiens
atcacttactatccattt

SEQ ID NO: 1469246 - DNA, 14 bp, Homo sapiens
atcacttctccccg

SEQ ID NO: 1469247 - DNA, 16 bp, Homo sapiens
atcacttctccccgca

SEQ ID NO: 1469248 - DNA, 18 bp, Homo sapiens
atcacttgtacaaaataa

SEQ ID NO: 1469249 - DNA, 17 bp, Homo sapiens
atcacttgttgttttac

SEQ ID NO: 1469250 - DNA, 17 bp, Homo sapiens
atcactttacctgcagg

SEQ ID NO: 1469251 - DNA, 21 bp, Homo sapiens
atcactttacctgcaggctcc

SEQ ID NO: 1469252 - DNA, 16 bp, Homo sapiens
atcactttctcagttt

SEQ ID NO: 1469253 - DNA, 20 bp, Homo sapiens
atcactttctcagttttcat

SEQ ID NO: 1469254 - DNA, 23 bp, Homo sapiens
atcactttgagcctgggaaataa

SEQ ID NO: 1469255 - DNA, 16 bp, Homo sapiens
atcactttgtctaact

SEQ ID NO: 1469256 - DNA, 20 bp, Homo sapiens
atcagaaaataaaatattca

SEQ ID NO: 1469257 - DNA, 19 bp, Homo sapiens
atcagaaagctttattttg

SEQ ID NO: 1469258 - DNA, 18 bp, Homo sapiens
atcagaaagtaacaatct

SEQ ID NO: 1469259 - DNA, 22 bp, Homo sapiens
atcagaaagtaacaatctatgg

SEQ ID NO: 1469260 - DNA, 14 bp, Homo sapiens
atcagaacagcaga

SEQ ID NO: 1469261 - DNA, 19 bp, Homo sapiens
atcagaacattcagctctg

SEQ ID NO: 1469262 - DNA, 21 bp, Homo sapiens
atcagaacattcagctctgga

SEQ ID NO: 1469263 - DNA, 22 bp, Homo sapiens
atcagaactcaaatggggccag

SEQ ID NO: 1469264 - DNA, 23 bp, Homo sapiens
atcagaactcaaatggggccaga

SEQ ID NO: 1469265 - DNA, 22 bp, Homo sapiens
atcagaagaaaggccaaggtgc

SEQ ID NO: 1469266 - DNA, 14 bp, Homo sapiens
atcagacaagcact

SEQ ID NO: 1469267 - DNA, 20 bp, Homo sapiens
atcagacaagcactatttta

SEQ ID NO: 1469268 - DNA, 16 bp, Homo sapiens
atcagaccataatgtt

SEQ ID NO: 1469269 - DNA, 18 bp, Homo sapiens
atcagaccctaccccacc

SEQ ID NO: 1469270 - DNA, 19 bp, Homo sapiens
atcagaccctaccccacca

SEQ ID NO: 1469271 - DNA, 21 bp, Homo sapiens
atcagactagccactcctgcc

SEQ ID NO: 1469272 - DNA, 22 bp, Homo sapiens
atcagagacaaaatatttccca

SEQ ID NO: 1469273 - DNA, 22 bp, Homo sapiens
atcagagagtgtacatcatgtt

SEQ ID NO: 1469274 - DNA, 17 bp, Homo sapiens
atcagagctccagtttg

SEQ ID NO: 1469275 - DNA, 20 bp, Homo sapiens
atcagaggtttgcttcctca

SEQ ID NO: 1469276 - DNA, 22 bp, Homo sapiens
atcagaggtttgcttcctcagt

SEQ ID NO: 1469277 - DNA, 15 bp, Homo sapiens
atcagatatttctta

SEQ ID NO: 1469278 - DNA, 17 bp, Homo sapiens
atcagatgactctctcc

SEQ ID NO: 1469279 - DNA, 15 bp, Homo sapiens
atcagatgcctgctt

SEQ ID NO: 1469280 - DNA, 16 bp, Homo sapiens
atcagattcctgacta

SEQ ID NO: 1469281 - DNA, 14 bp, Homo sapiens
atcagcaaagaaaa

SEQ ID NO: 1469282 - DNA, 16 bp, Homo sapiens
atcagcaatttcagaa

SEQ ID NO: 1469283 - DNA, 14 bp, Homo sapiens
atcagcactgaaaa

SEQ ID NO: 1469284 - DNA, 14 bp, Homo sapiens
atcagcattcaaaa

SEQ ID NO: 1469285 - DNA, 21 bp, Homo sapiens
atcagccagcccatggccccc

SEQ ID NO: 1469286 - DNA, 17 bp, Homo sapiens
atcagcccagtgcaaac

SEQ ID NO: 1469287 - DNA, 12 bp, Homo sapiens
atcagcccctca

SEQ ID NO: 1469288 - DNA, 14 bp, Homo sapiens
atcagcccctcaaa

SEQ ID NO: 1469289 - DNA, 19 bp, Homo sapiens
atcagcctgagtctcctgt

SEQ ID NO: 1469290 - DNA, 20 bp, Homo sapiens
atcagcctgagtctcctgtg

SEQ ID NO: 1469291 - DNA, 14 bp, Homo sapiens
atcagctgaattca

SEQ ID NO: 1469292 - DNA, 22 bp, Homo sapiens
atcagctgctgaaacaacaaat

SEQ ID NO: 1469293 - DNA, 13 bp, Homo sapiens
atcagctgctgac

SEQ ID NO: 1469294 - DNA, 18 bp, Homo sapiens
atcagcttttgttctaga

SEQ ID NO: 1469295 - DNA, 19 bp, Homo sapiens
atcagcttttgttctagac

SEQ ID NO: 1469296 - DNA, 16 bp, Homo sapiens
atcaggaattgtcaaa

SEQ ID NO: 1469297 - DNA, 13 bp, Homo sapiens
atcaggcactggt

SEQ ID NO: 1469298 - DNA, 17 bp, Homo sapiens
atcaggcactggtggca

SEQ ID NO: 1469299 - DNA, 13 bp, Homo sapiens
atcaggccattgt

SEQ ID NO: 1469300 - DNA, 18 bp, Homo sapiens
atcaggcctaatctcata

SEQ ID NO: 1469301 - DNA, 13 bp, Homo sapiens
atcaggcttcctg

SEQ ID NO: 1469302 - DNA, 19 bp, Homo sapiens
atcaggcttcctggtgaga

SEQ ID NO: 1469303 - DNA, 12 bp, Homo sapiens
atcagtaaatag

SEQ ID NO: 1469304 - DNA, 15 bp, Homo sapiens
atcagtaaccccctt

SEQ ID NO: 1469305 - DNA, 17 bp, Homo sapiens
atcagtaagaggtgtta

SEQ ID NO: 1469306 - DNA, 15 bp, Homo sapiens
atcagtaatatttat

SEQ ID NO: 1469307 - DNA, 17 bp, Homo sapiens
atcagtagatttctggc

SEQ ID NO: 1469308 - DNA, 16 bp, Homo sapiens
atcagtaggatatact

SEQ ID NO: 1469309 - DNA, 18 bp, Homo sapiens
atcagtagtttgcatttc

SEQ ID NO: 1469310 - DNA, 19 bp, Homo sapiens
atcagtagtttgcatttca

SEQ ID NO: 1469311 - DNA, 23 bp, Homo sapiens
atcagtagtttgcatttcagaaa

SEQ ID NO: 1469312 - DNA, 14 bp, Homo sapiens
atcagtataattct

SEQ ID NO: 1469313 - DNA, 16 bp, Homo sapiens
atcagtataattctgt

SEQ ID NO: 1469314 - DNA, 22 bp, Homo sapiens
atcagtataattctgtactgat

SEQ ID NO: 1469315 - DNA, 16 bp, Homo sapiens
atcagtccctatgtat

SEQ ID NO: 1469316 - DNA, 14 bp, Homo sapiens
atcagtcctttgat

SEQ ID NO: 1469317 - DNA, 18 bp, Homo sapiens
atcagtcgttttagtgtc

SEQ ID NO: 1469318 - DNA, 19 bp, Homo sapiens
atcagtcgttttagtgtct

SEQ ID NO: 1469319 - DNA, 13 bp, Homo sapiens
atcagtgaggagg

SEQ ID NO: 1469320 - DNA, 19 bp, Homo sapiens
atcagtgaggagggatgtg

SEQ ID NO: 1469321 - DNA, 15 bp, Homo sapiens
atcagtgataattgg

SEQ ID NO: 1469322 - DNA, 20 bp, Homo sapiens
atcagtgataattggtttga

SEQ ID NO: 1469323 - DNA, 22 bp, Homo sapiens
atcagtgatctatgtttgtgtg

SEQ ID NO: 1469324 - DNA, 20 bp, Homo sapiens
atcagtgctcgagacacagt

SEQ ID NO: 1469325 - DNA, 19 bp, Homo sapiens
atcagtgtgtctaaatttg

SEQ ID NO: 1469326 - DNA, 23 bp, Homo sapiens
atcagtgtgtctaaatttgaatg

SEQ ID NO: 1469327 - DNA, 20 bp, Homo sapiens
atcagttacccactcggtcc

SEQ ID NO: 1469328 - DNA, 16 bp, Homo sapiens
atcagttactcagccc

SEQ ID NO: 1469329 - DNA, 17 bp, Homo sapiens
atcagttactcagccct

SEQ ID NO: 1469330 - DNA, 18 bp, Homo sapiens
atcagttactctgaaggg

SEQ ID NO: 1469331 - DNA, 17 bp, Homo sapiens
atcagttcattagaaat

SEQ ID NO: 1469332 - DNA, 19 bp, Homo sapiens
atcagttcattagaaatat

SEQ ID NO: 1469333 - DNA, 16 bp, Homo sapiens
atcagttgactttaag

SEQ ID NO: 1469334 - DNA, 13 bp, Homo sapiens
atcagttgtgaat

SEQ ID NO: 1469335 - DNA, 14 bp, Homo sapiens
atcagttgtgaata

SEQ ID NO: 1469336 - DNA, 14 bp, Homo sapiens
atcataagtatttg

SEQ ID NO: 1469337 - DNA, 22 bp, Homo sapiens
atcataagttatgcctctgaca

SEQ ID NO: 1469338 - DNA, 20 bp, Homo sapiens
atcataatgtattatttaaa

SEQ ID NO: 1469339 - DNA, 15 bp, Homo sapiens
atcatactcttctaa

SEQ ID NO: 1469340 - DNA, 20 bp, Homo sapiens
atccactctaccctcccacc

SEQ ID NO: 1469341 - DNA, 22 bp, Homo sapiens
atccactctaccctcccacccc

SEQ ID NO: 1469342 - DNA, 23 bp, Homo sapiens
atccactctaccctcccaccccc

SEQ ID NO: 1469343 - DNA, 12 bp, Homo sapiens
atccactttgca

SEQ ID NO: 1469344 - DNA, 18 bp, Homo sapiens
atccagaacagtggctcg

SEQ ID NO: 1469345 - DNA, 20 bp, Homo sapiens
atccagacctggctccactc

SEQ ID NO: 1469346 - DNA, 23 bp, Homo sapiens
atccagactcagagctctctcta

SEQ ID NO: 1469347 - DNA, 12 bp, Homo sapiens
atccagaggaac

SEQ ID NO: 1469348 - DNA, 22 bp, Homo sapiens
atccagaggaacaagcatgtct

SEQ ID NO: 1469349 - DNA, 17 bp, Homo sapiens
atccagagtgattctag

SEQ ID NO: 1469350 - DNA, 22 bp, Homo sapiens
atccagagtttagaggaaaaaa

SEQ ID NO: 1469351 - DNA, 10 bp, Homo sapiens
atccagccac

SEQ ID NO: 1469352 - DNA, 12 bp, Homo sapiens
atccagccactt

SEQ ID NO: 1469353 - DNA, 19 bp, Homo sapiens
atccagccacttccccctc

SEQ ID NO: 1469354 - DNA, 23 bp, Homo sapiens
atccagcctaacttacattctta

SEQ ID NO: 1469355 - DNA, 17 bp, Homo sapiens
atccagcctccagggca

SEQ ID NO: 1469356 - DNA, 18 bp, Homo sapiens
atccagcctccagggcat

SEQ ID NO: 1469357 - DNA, 22 bp, Homo sapiens
atccagcctccagggcattgct

SEQ ID NO: 1469358 - DNA, 21 bp, Homo sapiens
atccagcgagagagtttcaaa

SEQ ID NO: 1469359 - DNA, 18 bp, Homo sapiens
atccaggaggcagtggac

SEQ ID NO: 1469360 - DNA, 17 bp, Homo sapiens
atccaggcacagctgag

SEQ ID NO: 1469361 - DNA, 22 bp, Homo sapiens
atccaggcagatccaggactat

SEQ ID NO: 1469362 - DNA, 15 bp, Homo sapiens
atccaggcaggagca

SEQ ID NO: 1469363 - DNA, 24 bp, Homo sapiens
atccaggcagtcgggggctggcct

SEQ ID NO: 1469364 - DNA, 14 bp, Homo sapiens
atccagggacagag

SEQ ID NO: 1469365 - DNA, 21 bp, Homo sapiens
atccaggtcatgcagttcctg

SEQ ID NO: 1469366 - DNA, 23 bp, Homo sapiens
atccaggtcatgcagttcctggc

SEQ ID NO: 1469367 - DNA, 19 bp, Homo sapiens
atccagtgacctctctctc

SEQ ID NO: 1469368 - DNA, 10 bp, Homo sapiens
atccagtgca

SEQ ID NO: 1469369 - DNA, 23 bp, Homo sapiens
atccagtgggcccggagaaacct

SEQ ID NO: 1469370 - DNA, 14 bp, Homo sapiens
atccagtggtgggt

SEQ ID NO: 1469371 - DNA, 19 bp, Homo sapiens
atccagtggtgggtaattg

SEQ ID NO: 1469372 - DNA, 17 bp, Homo sapiens
atccataaatgtgttcc

SEQ ID NO: 1469373 - DNA, 16 bp, Homo sapiens
atccatacaaaactat

SEQ ID NO: 1469374 - DNA, 23 bp, Homo sapiens
atccataggactaccgcaggccc

SEQ ID NO: 1469375 - DNA, 14 bp, Homo sapiens
atccatagtgactt

SEQ ID NO: 1469376 - DNA, 22 bp, Homo sapiens
atccatagtgacttttcaagta

SEQ ID NO: 1469377 - DNA, 15 bp, Homo sapiens
atccatccatctcca

SEQ ID NO: 1469378 - DNA, 14 bp, Homo sapiens
atccatccctccat

SEQ ID NO: 1469379 - DNA, 14 bp, Homo sapiens
atccatcttgagcc

SEQ ID NO: 1469380 - DNA, 18 bp, Homo sapiens
atccatctttttcttttt

SEQ ID NO: 1469381 - DNA, 21 bp, Homo sapiens
atccatgacctagttttccat

SEQ ID NO: 1469382 - DNA, 22 bp, Homo sapiens
atccatgacctagttttccatg

SEQ ID NO: 1469383 - DNA, 18 bp, Homo sapiens
atccatggggggagaagt

SEQ ID NO: 1469384 - DNA, 20 bp, Homo sapiens
atccatgttagtttttactt

SEQ ID NO: 1469385 - DNA, 21 bp, Homo sapiens
atccattaaaaagttgttctt

SEQ ID NO: 1469386 - DNA, 18 bp, Homo sapiens
atccattcctcagggaca

SEQ ID NO: 1469387 - DNA, 22 bp, Homo sapiens
atccattcctcagggacagaga

SEQ ID NO: 1469388 - DNA, 15 bp, Homo sapiens
atccatttatctttt

SEQ ID NO: 1469389 - DNA, 18 bp, Homo sapiens
atccatttcatctatttc

SEQ ID NO: 1469390 - DNA, 21 bp, Homo sapiens
atccatttcatctatttctga

SEQ ID NO: 1469391 - DNA, 17 bp, Homo sapiens
atccatttccattgctt

SEQ ID NO: 1469392 - DNA, 19 bp, Homo sapiens
atccattttacacagcacc

SEQ ID NO: 1469393 - DNA, 15 bp, Homo sapiens
atccattttctaaac

SEQ ID NO: 1469394 - DNA, 20 bp, Homo sapiens
atccattttctaaactgttt

SEQ ID NO: 1469395 - DNA, 15 bp, Homo sapiens
atcccaaacttcgga

SEQ ID NO: 1469396 - DNA, 16 bp, Homo sapiens
atcccaaacttcggaa

SEQ ID NO: 1469397 - DNA, 15 bp, Homo sapiens
atcccaaagcaagga

SEQ ID NO: 1469398 - DNA, 22 bp, Homo sapiens
atcccaaccaggcacctcttcc

SEQ ID NO: 1469399 - DNA, 14 bp, Homo sapiens
atcccaagcctcct

SEQ ID NO: 1469400 - DNA, 15 bp, Homo sapiens
atcccaagtgccagt

SEQ ID NO: 1469401 - DNA, 17 bp, Homo sapiens
atcccaatcaaagaatt

SEQ ID NO: 1469402 - DNA, 14 bp, Homo sapiens
atcccacaccctgg

SEQ ID NO: 1469403 - DNA, 13 bp, Homo sapiens
atcccacatccaa

SEQ ID NO: 1469404 - DNA, 15 bp, Homo sapiens
atcccaccaaccctc

SEQ ID NO: 1469405 - DNA, 23 bp, Homo sapiens
atcccacccacatgtgacacata

SEQ ID NO: 1469406 - DNA, 20 bp, Homo sapiens
atcccacccccgaccctgcc

SEQ ID NO: 1469407 - DNA, 19 bp, Homo sapiens
atcccaccccctcctcccc

SEQ ID NO: 1469408 - DNA, 18 bp, Homo sapiens
atcccacctccatcccag

SEQ ID NO: 1469409 - DNA, 12 bp, Homo sapiens
atcccactggcg

SEQ ID NO: 1469410 - DNA, 14 bp, Homo sapiens
atcccagaccagcc

SEQ ID NO: 1469411 - DNA, 22 bp, Homo sapiens
atcccagacctgtcgtctctcc

SEQ ID NO: 1469412 - DNA, 22 bp, Homo sapiens
atcccagcactttgggaggctg

SEQ ID NO: 1469413 - DNA, 23 bp, Homo sapiens
atcccagcggctggtgcagggcc

SEQ ID NO: 1469414 - DNA, 17 bp, Homo sapiens
atcccagctactcagga

SEQ ID NO: 1469415 - DNA, 13 bp, Homo sapiens
atcccaggccagg

SEQ ID NO: 1469416 - DNA, 16 bp, Homo sapiens
atcccagtcactcctc

SEQ ID NO: 1469417 - DNA, 21 bp, Homo sapiens
atcccatcgtctcggccttca

SEQ ID NO: 1469418 - DNA, 18 bp, Homo sapiens
atcccatgaacacactgt

SEQ ID NO: 1469419 - DNA, 12 bp, Homo sapiens
atcccattccag

SEQ ID NO: 1469420 - DNA, 15 bp, Homo sapiens
atcccatttcccaaa

SEQ ID NO: 1469421 - DNA, 14 bp, Homo sapiens
atccccaagtgtga

SEQ ID NO: 1469422 - DNA, 12 bp, Homo sapiens
atccccaataat

SEQ ID NO: 1469423 - DNA, 19 bp, Homo sapiens
atccccaataattgcagaa

SEQ ID NO: 1469424 - DNA, 19 bp, Homo sapiens
atccccaccttcacctcgg

SEQ ID NO: 1469425 - DNA, 20 bp, Homo sapiens
atccccagagcccagctctt

SEQ ID NO: 1469426 - DNA, 23 bp, Homo sapiens
atccccagagcccagctcttgct

SEQ ID NO: 1469427 - DNA, 15 bp, Homo sapiens
atccccaggccaggt

SEQ ID NO: 1469428 - DNA, 12 bp, Homo sapiens
atccccagggca

SEQ ID NO: 1469429 - DNA, 16 bp, Homo sapiens
atcccccactgccaca

SEQ ID NO: 1469430 - DNA, 20 bp, Homo sapiens
atcccccactgccacaccct

SEQ ID NO: 1469431 - DNA, 20 bp, Homo sapiens
atccccccatcttgcttccc

SEQ ID NO: 1469432 - DNA, 19 bp, Homo sapiens
atcccccctgctgcccagt

SEQ ID NO: 1469433 - DNA, 22 bp, Homo sapiens
atccccctccccccaggttcct

SEQ ID NO: 1469434 - DNA, 12 bp, Homo sapiens
atccccctgccc

SEQ ID NO: 1469435 - DNA, 15 bp, Homo sapiens
atccccctgccctcg

SEQ ID NO: 1469436 - DNA, 21 bp, Homo sapiens
atccccgcctggccaggagca

SEQ ID NO: 1469437 - DNA, 13 bp, Homo sapiens
atcccctaaaata

SEQ ID NO: 1469438 - DNA, 15 bp, Homo sapiens
atcccctccctgtca

SEQ ID NO: 1469439 - DNA, 23 bp, Homo sapiens
atcccctcgtcctgtcccagagg

SEQ ID NO: 1469440 - DNA, 19 bp, Homo sapiens
atcccctgcctcctgccac

SEQ ID NO: 1469441 - DNA, 21 bp, Homo sapiens
atccccttctcccctgcactg

SEQ ID NO: 1469442 - DNA, 17 bp, Homo sapiens
atcccgaagccatcact

SEQ ID NO: 1469443 - DNA, 20 bp, Homo sapiens
atcccgaagccatcacttct

SEQ ID NO: 1469444 - DNA, 23 bp, Homo sapiens
atcccgatacctcagccctggcc

SEQ ID NO: 1469445 - DNA, 20 bp, Homo sapiens
atcccgattcaccctgtcca

SEQ ID NO: 1469446 - DNA, 22 bp, Homo sapiens
atcccgcctcttcttcttcaga

SEQ ID NO: 1469447 - DNA, 13 bp, Homo sapiens
atcccggcctctt

SEQ ID NO: 1469448 - DNA, 18 bp, Homo sapiens
atcccgtatcacagtgtt

SEQ ID NO: 1469449 - DNA, 16 bp, Homo sapiens
atcccgtgttctcctt

SEQ ID NO: 1469450 - DNA, 20 bp, Homo sapiens
atccctattctgtgttttat

SEQ ID NO: 1469451 - DNA, 18 bp, Homo sapiens
atccctcaccttctgagt

SEQ ID NO: 1469452 - DNA, 15 bp, Homo sapiens
atccctccccagttc

SEQ ID NO: 1469453 - DNA, 15 bp, Homo sapiens
atccctcccccagca

SEQ ID NO: 1469454 - DNA, 17 bp, Homo sapiens
atctacagtacttccag

SEQ ID NO: 1469455 - DNA, 20 bp, Homo sapiens
atctacatcttttttcacaa

SEQ ID NO: 1469456 - DNA, 13 bp, Homo sapiens
atctacatttgtt

SEQ ID NO: 1469457 - DNA, 23 bp, Homo sapiens
atctaccagtggtgctcaatgca

SEQ ID NO: 1469458 - DNA, 14 bp, Homo sapiens
atctaccccagact

SEQ ID NO: 1469459 - DNA, 14 bp, Homo sapiens
atctaccttttctg

SEQ ID NO: 1469460 - DNA, 23 bp, Homo sapiens
atctactgaattggcttccagat

SEQ ID NO: 1469461 - DNA, 17 bp, Homo sapiens
atctactggaaatgtag

SEQ ID NO: 1469462 - DNA, 23 bp, Homo sapiens
atctactggaaatgtagcactta

SEQ ID NO: 1469463 - DNA, 20 bp, Homo sapiens
atctacttctgtaattgtgt

SEQ ID NO: 1469464 - DNA, 20 bp, Homo sapiens
atctagcaagaagattctaa

SEQ ID NO: 1469465 - DNA, 21 bp, Homo sapiens
atctagcaagaagattctaaa

SEQ ID NO: 1469466 - DNA, 21 bp, Homo sapiens
atctagccagcccctcttccc

SEQ ID NO: 1469467 - DNA, 20 bp, Homo sapiens
atctagcctaaagtatacaa

SEQ ID NO: 1469468 - DNA, 18 bp, Homo sapiens
atctagctctagttcaaa

SEQ ID NO: 1469469 - DNA, 17 bp, Homo sapiens
atctaggtgtggctgtg

SEQ ID NO: 1469470 - DNA, 21 bp, Homo sapiens
atctaggtgtggctgtgaagg

SEQ ID NO: 1469471 - DNA, 14 bp, Homo sapiens
atctagtaatatat

SEQ ID NO: 1469472 - DNA, 16 bp, Homo sapiens
atctagtaatatattt

SEQ ID NO: 1469473 - DNA, 19 bp, Homo sapiens
atctagtatgaaattatat

SEQ ID NO: 1469474 - DNA, 17 bp, Homo sapiens
atctagtcacaaagact

SEQ ID NO: 1469475 - DNA, 23 bp, Homo sapiens
atctagtgggttgacctttaaat

SEQ ID NO: 1469476 - DNA, 18 bp, Homo sapiens
atctagttttttttgtaa

SEQ ID NO: 1469477 - DNA, 15 bp, Homo sapiens
atctataaactataa

SEQ ID NO: 1469478 - DNA, 13 bp, Homo sapiens
atctataaagaag

SEQ ID NO: 1469479 - DNA, 23 bp, Homo sapiens
atctataatttacctaagattac

SEQ ID NO: 1469480 - DNA, 21 bp, Homo sapiens
atctataggcagcttctaaga

SEQ ID NO: 1469481 - DNA, 22 bp, Homo sapiens
atctataggcagcttctaagag

SEQ ID NO: 1469482 - DNA, 15 bp, Homo sapiens
atctatatatgtgta

SEQ ID NO: 1469483 - DNA, 18 bp, Homo sapiens
atctatatatgtgtatgt

SEQ ID NO: 1469484 - DNA, 15 bp, Homo sapiens
atctatatcatattt

SEQ ID NO: 1469485 - DNA, 18 bp, Homo sapiens
atctatatcatatttctg

SEQ ID NO: 1469486 - DNA, 18 bp, Homo sapiens
atctatattttcagagct

SEQ ID NO: 1469487 - DNA, 14 bp, Homo sapiens
atctatcacctgtc

SEQ ID NO: 1469488 - DNA, 15 bp, Homo sapiens
atctatcacctgtca

SEQ ID NO: 1469489 - DNA, 16 bp, Homo sapiens
atctatcacctgtcat

SEQ ID NO: 1469490 - DNA, 19 bp, Homo sapiens
atctatctgcttatgcagt

SEQ ID NO: 1469491 - DNA, 13 bp, Homo sapiens
atctatctgtgct

SEQ ID NO: 1469492 - DNA, 13 bp, Homo sapiens
atctatcttccaa

SEQ ID NO: 1469493 - DNA, 15 bp, Homo sapiens
atctatgaagtatat

SEQ ID NO: 1469494 - DNA, 15 bp, Homo sapiens
atctatgatgtttct

SEQ ID NO: 1469495 - DNA, 19 bp, Homo sapiens
atctatgccaaagatcact

SEQ ID NO: 1469496 - DNA, 21 bp, Homo sapiens
atctatgccaaagatcacttg

SEQ ID NO: 1469497 - DNA, 13 bp, Homo sapiens
atctatggcttat

SEQ ID NO: 1469498 - DNA, 18 bp, Homo sapiens
atctatggcttatttcta

SEQ ID NO: 1469499 - DNA, 19 bp, Homo sapiens
atctatggcttatttctat

SEQ ID NO: 1469500 - DNA, 17 bp, Homo sapiens
atctatgggaagatact

SEQ ID NO: 1469501 - DNA, 13 bp, Homo sapiens
atctatgtggaaa

SEQ ID NO: 1469502 - DNA, 19 bp, Homo sapiens
atctatgtttgtgtgattt

SEQ ID NO: 1469503 - DNA, 18 bp, Homo sapiens
atctattaatatatgtat

SEQ ID NO: 1469504 - DNA, 17 bp, Homo sapiens
atctattatactgtatt

SEQ ID NO: 1469505 - DNA, 18 bp, Homo sapiens
atctattatactgtatta

SEQ ID NO: 1469506 - DNA, 15 bp, Homo sapiens
atctattatttggag

SEQ ID NO: 1469507 - DNA, 21 bp, Homo sapiens
atctattcagacaagcaacag

SEQ ID NO: 1469508 - DNA, 23 bp, Homo sapiens
atctattctctccaaaaatgcac

SEQ ID NO: 1469509 - DNA, 17 bp, Homo sapiens
atctattctgagaaaac

SEQ ID NO: 1469510 - DNA, 19 bp, Homo sapiens
atctattgcagagactcat

SEQ ID NO: 1469511 - DNA, 20 bp, Homo sapiens
atctattggctgatctatgc

SEQ ID NO: 1469512 - DNA, 13 bp, Homo sapiens
atctatttattaa

SEQ ID NO: 1469513 - DNA, 19 bp, Homo sapiens
atctatttattaatattta

SEQ ID NO: 1469514 - DNA, 13 bp, Homo sapiens
atctatttgtaca

SEQ ID NO: 1469515 - DNA, 14 bp, Homo sapiens
atctatttgtacaa

SEQ ID NO: 1469516 - DNA, 23 bp, Homo sapiens
atctatttgtacaattttaaagt

SEQ ID NO: 1469517 - DNA, 16 bp, Homo sapiens
atctcaaaacaaaaca

SEQ ID NO: 1469518 - DNA, 19 bp, Homo sapiens
atctcaaaactgcactgtc

SEQ ID NO: 1469519 - DNA, 15 bp, Homo sapiens
atctcaaaggagaaa

SEQ ID NO: 1469520 - DNA, 23 bp, Homo sapiens
atctcaaataactaaaaggtatg

SEQ ID NO: 1469521 - DNA, 14 bp, Homo sapiens
atctcaatcttggt

SEQ ID NO: 1469522 - DNA, 22 bp, Homo sapiens
atctcaatcttggtttgtcagt

SEQ ID NO: 1469523 - DNA, 18 bp, Homo sapiens
atctcaattgaaagcttt

SEQ ID NO: 1469524 - DNA, 13 bp, Homo sapiens
atctcacaggctg

SEQ ID NO: 1469525 - DNA, 17 bp, Homo sapiens
atctcacaggctgagaa

SEQ ID NO: 1469526 - DNA, 17 bp, Homo sapiens
atctcagaaagtgcctg

SEQ ID NO: 1469527 - DNA, 17 bp, Homo sapiens
atctcagatatttgcac

SEQ ID NO: 1469528 - DNA, 11 bp, Homo sapiens
atctcagccca

SEQ ID NO: 1469529 - DNA, 14 bp, Homo sapiens
atctcagctcactg

SEQ ID NO: 1469530 - DNA, 19 bp, Homo sapiens
atctcaggacacttccgta

SEQ ID NO: 1469531 - DNA, 12 bp, Homo sapiens
atctcaggagct

SEQ ID NO: 1469532 - DNA, 21 bp, Homo sapiens
atctcaggagcttgcaagaag

SEQ ID NO: 1469533 - DNA, 18 bp, Homo sapiens
atctcagggaagcccagc

SEQ ID NO: 1469534 - DNA, 19 bp, Homo sapiens
atctcagggaagcccagct

SEQ ID NO: 1469535 - DNA, 23 bp, Homo sapiens
atctcagggaagcccagctccag

SEQ ID NO: 1469536 - DNA, 17 bp, Homo sapiens
atctcaggggctgtttg

SEQ ID NO: 1469537 - DNA, 14 bp, Homo sapiens
atctcaggtgccac

SEQ ID NO: 1469538 - DNA, 24 bp, Homo sapiens
atctcaggtgccactccctgagct

SEQ ID NO: 1469539 - DNA, 19 bp, Homo sapiens
atctcagttgtttgcttct

SEQ ID NO: 1469540 - DNA, 19 bp, Homo sapiens
atctcataatgctttgtta

SEQ ID NO: 1469541 - DNA, 15 bp, Homo sapiens
atctcatctatctca

SEQ ID NO: 1469542 - DNA, 18 bp, Homo sapiens
atctcatgaggggagagg

SEQ ID NO: 1469543 - DNA, 18 bp, Homo sapiens
atctccaaggcagggacc

SEQ ID NO: 1469544 - DNA, 22 bp, Homo sapiens
atctccagggagcaagacagag

SEQ ID NO: 1469545 - DNA, 23 bp, Homo sapiens
atctccagggagcaagacagaga

SEQ ID NO: 1469546 - DNA, 20 bp, Homo sapiens
atctccagggagtcccctcc

SEQ ID NO: 1469547 - DNA, 14 bp, Homo sapiens
atctccccactcta

SEQ ID NO: 1469548 - DNA, 13 bp, Homo sapiens
atctccccaggcc

SEQ ID NO: 1469549 - DNA, 17 bp, Homo sapiens
atctccccaggcctcca

SEQ ID NO: 1469550 - DNA, 19 bp, Homo sapiens
atctccccaggcctccagc

SEQ ID NO: 1469551 - DNA, 16 bp, Homo sapiens
atctcccctagctcac

SEQ ID NO: 1469552 - DNA, 18 bp, Homo sapiens
atctcccctagctcacca

SEQ ID NO: 1469553 - DNA, 23 bp, Homo sapiens
atctcccctcctcacagttgcca

SEQ ID NO: 1469554 - DNA, 14 bp, Homo sapiens
atctccctcccaca

SEQ ID NO: 1469555 - DNA, 17 bp, Homo sapiens
atctccctcctccaggt

SEQ ID NO: 1469556 - DNA, 19 bp, Homo sapiens
atctccctcctccaggtcg

SEQ ID NO: 1469557 - DNA, 12 bp, Homo sapiens
atctccctgccg

SEQ ID NO: 1469558 - DNA, 19 bp, Homo sapiens
atctccctgccgcctcaat

SEQ ID NO: 1469559 - DNA, 18 bp, Homo sapiens
atctccctgcctggcccc

SEQ ID NO: 1469560 - DNA, 14 bp, Homo sapiens
atctccctggctca

SEQ ID NO: 1469561 - DNA, 21 bp, Homo sapiens
atctccctggctcactggcag

SEQ ID NO: 1469562 - DNA, 19 bp, Homo sapiens
atctccgcatcgcatcctc

SEQ ID NO: 1469563 - DNA, 18 bp, Homo sapiens
atctccgcctccacactg

SEQ ID NO: 1469564 - DNA, 17 bp, Homo sapiens
atctccgttccatctgg

SEQ ID NO: 1469565 - DNA, 15 bp, Homo sapiens
atctcctaacaaaag

SEQ ID NO: 1469566 - DNA, 19 bp, Homo sapiens
atctcctcaagtccccaag

SEQ ID NO: 1469567 - DNA, 17 bp, Homo sapiens
atctcctgaatctaaca

SEQ ID NO: 1469568 - DNA, 21 bp, Homo sapiens
atcttaatgaatgagtctgtt

SEQ ID NO: 1469569 - DNA, 19 bp, Homo sapiens
atcttaattctttgttctg

SEQ ID NO: 1469570 - DNA, 22 bp, Homo sapiens
atcttaattctttgttctgttt

SEQ ID NO: 1469571 - DNA, 15 bp, Homo sapiens
atcttacaatattga

SEQ ID NO: 1469572 - DNA, 14 bp, Homo sapiens
atcttactgaaggt

SEQ ID NO: 1469573 - DNA, 15 bp, Homo sapiens
atcttactgaaggta

SEQ ID NO: 1469574 - DNA, 13 bp, Homo sapiens
atcttagtgtatg

SEQ ID NO: 1469575 - DNA, 17 bp, Homo sapiens
atcttatagttctaggc

SEQ ID NO: 1469576 - DNA, 18 bp, Homo sapiens
atcttattccgagcattc

SEQ ID NO: 1469577 - DNA, 23 bp, Homo sapiens
atcttattttcatgtatatgtgt

SEQ ID NO: 1469578 - DNA, 16 bp, Homo sapiens
atcttattttctcaat

SEQ ID NO: 1469579 - DNA, 17 bp, Homo sapiens
atcttcaaactttcact

SEQ ID NO: 1469580 - DNA, 15 bp, Homo sapiens
atcttcaaagcttga

SEQ ID NO: 1469581 - DNA, 20 bp, Homo sapiens
atcttcaatatgaatctata

SEQ ID NO: 1469582 - DNA, 13 bp, Homo sapiens
atcttcacctcag

SEQ ID NO: 1469583 - DNA, 21 bp, Homo sapiens
atcttcacgacaatgttgaga

SEQ ID NO: 1469584 - DNA, 14 bp, Homo sapiens
atcttcactagaag

SEQ ID NO: 1469585 - DNA, 23 bp, Homo sapiens
atcttcacttctaaatgcatatc

SEQ ID NO: 1469586 - DNA, 13 bp, Homo sapiens
atcttcagcccag

SEQ ID NO: 1469587 - DNA, 20 bp, Homo sapiens
atcttcagttttatctttaa

SEQ ID NO: 1469588 - DNA, 16 bp, Homo sapiens
atcttcctgctgctgt

SEQ ID NO: 1469589 - DNA, 15 bp, Homo sapiens
atcttcctgtgtcct

SEQ ID NO: 1469590 - DNA, 13 bp, Homo sapiens
atcttctactttt

SEQ ID NO: 1469591 - DNA, 14 bp, Homo sapiens
atcttctactttta

SEQ ID NO: 1469592 - DNA, 15 bp, Homo sapiens
atcttctatttttat

SEQ ID NO: 1469593 - DNA, 16 bp, Homo sapiens
atcttctcaagttcta

SEQ ID NO: 1469594 - DNA, 19 bp, Homo sapiens
atcttctcaagttctaaga

SEQ ID NO: 1469595 - DNA, 23 bp, Homo sapiens
atcttctcaagttctaagattct

SEQ ID NO: 1469596 - DNA, 19 bp, Homo sapiens
atcttctccatctggcagg

SEQ ID NO: 1469597 - DNA, 22 bp, Homo sapiens
atcttctccccgaggctgcccc

SEQ ID NO: 1469598 - DNA, 21 bp, Homo sapiens
atcttctcccttgtcctgctt

SEQ ID NO: 1469599 - DNA, 16 bp, Homo sapiens
atcttctgccttctca

SEQ ID NO: 1469600 - DNA, 11 bp, Homo sapiens
atcttctggag

SEQ ID NO: 1469601 - DNA, 15 bp, Homo sapiens
atcttctggagaagc

SEQ ID NO: 1469602 - DNA, 11 bp, Homo sapiens
atcttctggat

SEQ ID NO: 1469603 - DNA, 12 bp, Homo sapiens
atcttctggatt

SEQ ID NO: 1469604 - DNA, 17 bp, Homo sapiens
atcttcttatgcaattt

SEQ ID NO: 1469605 - DNA, 14 bp, Homo sapiens
atcttctttataat

SEQ ID NO: 1469606 - DNA, 15 bp, Homo sapiens
atcttctttcctcaa

SEQ ID NO: 1469607 - DNA, 20 bp, Homo sapiens
atcttgaaggaaaaattcaa

SEQ ID NO: 1469608 - DNA, 20 bp, Homo sapiens
atcttgaatccttccattcc

SEQ ID NO: 1469609 - DNA, 21 bp, Homo sapiens
atcttgaccaacagaaacctt

SEQ ID NO: 1469610 - DNA, 15 bp, Homo sapiens
atcttgagagctgct

SEQ ID NO: 1469611 - DNA, 17 bp, Homo sapiens
atcttgagagctgctga

SEQ ID NO: 1469612 - DNA, 22 bp, Homo sapiens
atcttgcctaaatcccaagaaa

SEQ ID NO: 1469613 - DNA, 14 bp, Homo sapiens
atcttgcctccagg

SEQ ID NO: 1469614 - DNA, 20 bp, Homo sapiens
atcttgcctgtctggctcag

SEQ ID NO: 1469615 - DNA, 17 bp, Homo sapiens
atcttgcttcattgtta

SEQ ID NO: 1469616 - DNA, 23 bp, Homo sapiens
atcttgcttcattgttacatgta

SEQ ID NO: 1469617 - DNA, 14 bp, Homo sapiens
atcttgcttcccta

SEQ ID NO: 1469618 - DNA, 23 bp, Homo sapiens
atcttgcttccctaatctatggt

SEQ ID NO: 1469619 - DNA, 14 bp, Homo sapiens
atcttgctttcttt

SEQ ID NO: 1469620 - DNA, 16 bp, Homo sapiens
atcttggacaaatcac

SEQ ID NO: 1469621 - DNA, 19 bp, Homo sapiens
atcttggactgacatttag

SEQ ID NO: 1469622 - DNA, 21 bp, Homo sapiens
atcttggctatgtaattcttg

SEQ ID NO: 1469623 - DNA, 13 bp, Homo sapiens
atcttgggactgg

SEQ ID NO: 1469624 - DNA, 16 bp, Homo sapiens
atcttgggggggtggc

SEQ ID NO: 1469625 - DNA, 20 bp, Homo sapiens
atcttgggggggtggccgct

SEQ ID NO: 1469626 - DNA, 12 bp, Homo sapiens
atcttgggtgta

SEQ ID NO: 1469627 - DNA, 20 bp, Homo sapiens
atcttgggtgtattctctgt

SEQ ID NO: 1469628 - DNA, 22 bp, Homo sapiens
atcttgggtgtattctctgtaa

SEQ ID NO: 1469629 - DNA, 21 bp, Homo sapiens
atcttggtagttctgtgcctc

SEQ ID NO: 1469630 - DNA, 22 bp, Homo sapiens
atcttggtttgtcagtttatct

SEQ ID NO: 1469631 - DNA, 18 bp, Homo sapiens
atcttgtagctttatcaa

SEQ ID NO: 1469632 - DNA, 15 bp, Homo sapiens
atcttgtcatgtgta

SEQ ID NO: 1469633 - DNA, 21 bp, Homo sapiens
atcttgtgagtggataatcag

SEQ ID NO: 1469634 - DNA, 22 bp, Homo sapiens
atcttgtgagtggataatcagg

SEQ ID NO: 1469635 - DNA, 19 bp, Homo sapiens
atcttgtgctagaatactt

SEQ ID NO: 1469636 - DNA, 14 bp, Homo sapiens
atcttgtgcttctt

SEQ ID NO: 1469637 - DNA, 17 bp, Homo sapiens
atcttgtggggccagga

SEQ ID NO: 1469638 - DNA, 22 bp, Homo sapiens
atcttgtgtgattaacttattt

SEQ ID NO: 1469639 - DNA, 23 bp, Homo sapiens
atcttgtgtgattaacttattta

SEQ ID NO: 1469640 - DNA, 16 bp, Homo sapiens
atcttgttaatgtcat

SEQ ID NO: 1469641 - DNA, 20 bp, Homo sapiens
atcttgttaatgtcattgct

SEQ ID NO: 1469642 - DNA, 14 bp, Homo sapiens
atcttgttactgct

SEQ ID NO: 1469643 - DNA, 15 bp, Homo sapiens
atcttgttcaggaaa

SEQ ID NO: 1469644 - DNA, 15 bp, Homo sapiens
atcttgtttttccac

SEQ ID NO: 1469645 - DNA, 18 bp, Homo sapiens
atctttaaaaagcagtcc

SEQ ID NO: 1469646 - DNA, 20 bp, Homo sapiens
atctttaaaaagcagtcctc

SEQ ID NO: 1469647 - DNA, 14 bp, Homo sapiens
atctttaagaaaaa

SEQ ID NO: 1469648 - DNA, 16 bp, Homo sapiens
atctttaagaatgctt

SEQ ID NO: 1469649 - DNA, 16 bp, Homo sapiens
atctttaccaaaaacc

SEQ ID NO: 1469650 - DNA, 16 bp, Homo sapiens
atctttagatatttgc

SEQ ID NO: 1469651 - DNA, 18 bp, Homo sapiens
atctttatgctgtatttt

SEQ ID NO: 1469652 - DNA, 22 bp, Homo sapiens
atctttcacacttccaccagcc

SEQ ID NO: 1469653 - DNA, 14 bp, Homo sapiens
atctttcacttgaa

SEQ ID NO: 1469654 - DNA, 12 bp, Homo sapiens
atctttcagaaa

SEQ ID NO: 1469655 - DNA, 16 bp, Homo sapiens
atctttcagaaatata

SEQ ID NO: 1469656 - DNA, 22 bp, Homo sapiens
atctttcagaaatataacacat

SEQ ID NO: 1469657 - DNA, 12 bp, Homo sapiens
atctttcaggaa

SEQ ID NO: 1469658 - DNA, 23 bp, Homo sapiens
atctttccaggcttccctgactt

SEQ ID NO: 1469659 - DNA, 15 bp, Homo sapiens
atctttctacagaga

SEQ ID NO: 1469660 - DNA, 19 bp, Homo sapiens
atctttctccctcaactga

SEQ ID NO: 1469661 - DNA, 13 bp, Homo sapiens
atctttctcttcc

SEQ ID NO: 1469662 - DNA, 13 bp, Homo sapiens
atctttctgcaga

SEQ ID NO: 1469663 - DNA, 14 bp, Homo sapiens
atctttctgggagc

SEQ ID NO: 1469664 - DNA, 17 bp, Homo sapiens
atctttctttacctgag

SEQ ID NO: 1469665 - DNA, 20 bp, Homo sapiens
atctttctttacctgagacc

SEQ ID NO: 1469666 - DNA, 15 bp, Homo sapiens
atctttctttccaaa

SEQ ID NO: 1469667 - DNA, 20 bp, Homo sapiens
atctttctttccaaaacatt

SEQ ID NO: 1469668 - DNA, 21 bp, Homo sapiens
atctttgaacttctgactact

SEQ ID NO: 1469669 - DNA, 13 bp, Homo sapiens
atctttgactgaa

SEQ ID NO: 1469670 - DNA, 16 bp, Homo sapiens
atctttgattctcctt

SEQ ID NO: 1469671 - DNA, 20 bp, Homo sapiens
atctttgattctccttcagc

SEQ ID NO: 1469672 - DNA, 16 bp, Homo sapiens
atctttgccaacatgg

SEQ ID NO: 1469673 - DNA, 17 bp, Homo sapiens
atctttgcgaaaagata

SEQ ID NO: 1469674 - DNA, 18 bp, Homo sapiens
atctttgcgaaaagataa

SEQ ID NO: 1469675 - DNA, 23 bp, Homo sapiens
atctttgcgaaaagataaacctg

SEQ ID NO: 1469676 - DNA, 10 bp, Homo sapiens
atctttgctg

SEQ ID NO: 1469677 - DNA, 16 bp, Homo sapiens
atctttgtaaatgcat

SEQ ID NO: 1469678 - DNA, 17 bp, Homo sapiens
atcttttaaagtgttac

SEQ ID NO: 1469679 - DNA, 18 bp, Homo sapiens
atcttttaaagtgttact

SEQ ID NO: 1469680 - DNA, 22 bp, Homo sapiens
atcttttaaagtgttacttttt

SEQ ID NO: 1469681 - DNA, 14 bp, Homo sapiens
atcttttaaattgc

SEQ ID NO: 1469682 - DNA, 21 bp, Homo sapiens
atcttttaattgtttccagga

SEQ ID NO: 1469683 - DNA, 14 bp, Homo sapiens
atcttttagaagtg

SEQ ID NO: 1469684 - DNA, 15 bp, Homo sapiens
atcttttattttgga

SEQ ID NO: 1469685 - DNA, 20 bp, Homo sapiens
atcttttattttggaactat

SEQ ID NO: 1469686 - DNA, 20 bp, Homo sapiens
atcttttcaaggcatttgtc

SEQ ID NO: 1469687 - DNA, 12 bp, Homo sapiens
atcttttcctga

SEQ ID NO: 1469688 - DNA, 19 bp, Homo sapiens
atcttttctaatcacagtg

SEQ ID NO: 1469689 - DNA, 19 bp, Homo sapiens
atcttttctagagacacat

SEQ ID NO: 1469690 - DNA, 17 bp, Homo sapiens
atcttttgaagctttct

SEQ ID NO: 1469691 - DNA, 16 bp, Homo sapiens
atcttttggaagtttt

SEQ ID NO: 1469692 - DNA, 20 bp, Homo sapiens
atcttttggaagttttgcta

SEQ ID NO: 1469693 - DNA, 21 bp, Homo sapiens
atcttttgtaagacatttcct

SEQ ID NO: 1469694 - DNA, 17 bp, Homo sapiens
atcttttgtatatctaa

SEQ ID NO: 1469695 - DNA, 21 bp, Homo sapiens
atcttttgtatatctaagact

SEQ ID NO: 1469696 - DNA, 22 bp, Homo sapiens
atcttttgtattaagaaaggaa

SEQ ID NO: 1469697 - DNA, 15 bp, Homo sapiens
atctttttgcttcta

SEQ ID NO: 1469698 - DNA, 17 bp, Homo sapiens
atctttttgcttctact

SEQ ID NO: 1469699 - DNA, 16 bp, Homo sapiens
atcttttttagcataa

SEQ ID NO: 1469700 - DNA, 17 bp, Homo sapiens
atcttttttcacaaatt

SEQ ID NO: 1469701 - DNA, 16 bp, Homo sapiens
atgaaaaagctgcttc

SEQ ID NO: 1469702 - DNA, 13 bp, Homo sapiens
atgaaaaatataa

SEQ ID NO: 1469703 - DNA, 20 bp, Homo sapiens
atgaaaaatctcaattgaaa

SEQ ID NO: 1469704 - DNA, 17 bp, Homo sapiens
atgaaaactaaggattt

SEQ ID NO: 1469705 - DNA, 23 bp, Homo sapiens
atgaaaactagcattacattatt

SEQ ID NO: 1469706 - DNA, 17 bp, Homo sapiens
atgaaaagattcttctg

SEQ ID NO: 1469707 - DNA, 18 bp, Homo sapiens
atgaaaagctttgtttgt

SEQ ID NO: 1469708 - DNA, 23 bp, Homo sapiens
atgaaaagctttgtttgttcttg

SEQ ID NO: 1469709 - DNA, 16 bp, Homo sapiens
atgaaaagtatattga

SEQ ID NO: 1469710 - DNA, 18 bp, Homo sapiens
atgaaaataattttccaa

SEQ ID NO: 1469711 - DNA, 22 bp, Homo sapiens
atgaaaatatagacattctcac

SEQ ID NO: 1469712 - DNA, 20 bp, Homo sapiens
atgaaaatccttttaaccat

SEQ ID NO: 1469713 - DNA, 13 bp, Homo sapiens
atgaaaatgtcag

SEQ ID NO: 1469714 - DNA, 22 bp, Homo sapiens
atgaaaccttattttttcccaa

SEQ ID NO: 1469715 - DNA, 18 bp, Homo sapiens
atgaaactcctgattttg

SEQ ID NO: 1469716 - DNA, 19 bp, Homo sapiens
atgaaactcctgattttgt

SEQ ID NO: 1469717 - DNA, 14 bp, Homo sapiens
atgaaagaaaggcc

SEQ ID NO: 1469718 - DNA, 12 bp, Homo sapiens
atgaaagactgt

SEQ ID NO: 1469719 - DNA, 13 bp, Homo sapiens
atgaaagactgta

SEQ ID NO: 1469720 - DNA, 16 bp, Homo sapiens
atgaaagactgtacaa

SEQ ID NO: 1469721 - DNA, 17 bp, Homo sapiens
atgaaagactgtacaaa

SEQ ID NO: 1469722 - DNA, 21 bp, Homo sapiens
atgaaagatttttactaatat

SEQ ID NO: 1469723 - DNA, 12 bp, Homo sapiens
atgaaagcatgt

SEQ ID NO: 1469724 - DNA, 18 bp, Homo sapiens
atgaaagcatgtggcatg

SEQ ID NO: 1469725 - DNA, 22 bp, Homo sapiens
atgaaagctgattactgtcaat

SEQ ID NO: 1469726 - DNA, 18 bp, Homo sapiens
atgaaagctgttccttgg

SEQ ID NO: 1469727 - DNA, 21 bp, Homo sapiens
atgaaagggaaactgggaaac

SEQ ID NO: 1469728 - DNA, 21 bp, Homo sapiens
atgaaagggtttgtaatactt

SEQ ID NO: 1469729 - DNA, 23 bp, Homo sapiens
atgaaagggtttgtaatacttta

SEQ ID NO: 1469730 - DNA, 20 bp, Homo sapiens
atgaaagtctagaaataaaa

SEQ ID NO: 1469731 - DNA, 13 bp, Homo sapiens
atgaaagttttgc

SEQ ID NO: 1469732 - DNA, 24 bp, Homo sapiens
atgaaataaattctgacttatgaa

SEQ ID NO: 1469733 - DNA, 20 bp, Homo sapiens
atgaaatacacaagtaaaca

SEQ ID NO: 1469734 - DNA, 19 bp, Homo sapiens
atgaaatatcagactagtg

SEQ ID NO: 1469735 - DNA, 15 bp, Homo sapiens
atgaaatatctgtat

SEQ ID NO: 1469736 - DNA, 14 bp, Homo sapiens
atgaaatcaaatgt

SEQ ID NO: 1469737 - DNA, 18 bp, Homo sapiens
atgaaatcaaatgtatgt

SEQ ID NO: 1469738 - DNA, 19 bp, Homo sapiens
atgaaatctgctagaaagt

SEQ ID NO: 1469739 - DNA, 12 bp, Homo sapiens
atgaaatgaatg

SEQ ID NO: 1469740 - DNA, 18 bp, Homo sapiens
atgaaatgtgaattttta

SEQ ID NO: 1469741 - DNA, 22 bp, Homo sapiens
atgaaatgtgaatttttattgt

SEQ ID NO: 1469742 - DNA, 18 bp, Homo sapiens
atgaaatgtggaagtcag

SEQ ID NO: 1469743 - DNA, 16 bp, Homo sapiens
atgaaattacttatca

SEQ ID NO: 1469744 - DNA, 23 bp, Homo sapiens
atgaaattcttatgttgaatatg

SEQ ID NO: 1469745 - DNA, 16 bp, Homo sapiens
atgaaattcttcctaa

SEQ ID NO: 1469746 - DNA, 18 bp, Homo sapiens
atgaaattcttgaagttc

SEQ ID NO: 1469747 - DNA, 20 bp, Homo sapiens
atgaaattgtctagcagagc

SEQ ID NO: 1469748 - DNA, 19 bp, Homo sapiens
atgaacaaattctttagta

SEQ ID NO: 1469749 - DNA, 13 bp, Homo sapiens
atgaacacactgt

SEQ ID NO: 1469750 - DNA, 14 bp, Homo sapiens
atgaacacagacaa

SEQ ID NO: 1469751 - DNA, 15 bp, Homo sapiens
atgaacagctgtgtc

SEQ ID NO: 1469752 - DNA, 16 bp, Homo sapiens
atgaacatctcttgaa

SEQ ID NO: 1469753 - DNA, 14 bp, Homo sapiens
atgaacattgtact

SEQ ID NO: 1469754 - DNA, 17 bp, Homo sapiens
atgaacattgtactgtt

SEQ ID NO: 1469755 - DNA, 18 bp, Homo sapiens
atgaacattttgtggagt

SEQ ID NO: 1469756 - DNA, 20 bp, Homo sapiens
atgaaccagccggggcctta

SEQ ID NO: 1469757 - DNA, 18 bp, Homo sapiens
atgaacccgaggctgaga

SEQ ID NO: 1469758 - DNA, 15 bp, Homo sapiens
atgaacctattttca

SEQ ID NO: 1469759 - DNA, 16 bp, Homo sapiens
atgaacctattttcat

SEQ ID NO: 1469760 - DNA, 19 bp, Homo sapiens
atgaacctattttcatttg

SEQ ID NO: 1469761 - DNA, 21 bp, Homo sapiens
atgaacctattttcatttgta

SEQ ID NO: 1469762 - DNA, 22 bp, Homo sapiens
atgaacctattttcatttgtac

SEQ ID NO: 1469763 - DNA, 20 bp, Homo sapiens
atgaactggcttgtacattt

SEQ ID NO: 1469764 - DNA, 12 bp, Homo sapiens
atgaactgtccg

SEQ ID NO: 1469765 - DNA, 16 bp, Homo sapiens
atgaacttattctgta

SEQ ID NO: 1469766 - DNA, 18 bp, Homo sapiens
atgaacttattctgtaga

SEQ ID NO: 1469767 - DNA, 16 bp, Homo sapiens
atgaacttccatttgt

SEQ ID NO: 1469768 - DNA, 14 bp, Homo sapiens
atgaagaaaaagta

SEQ ID NO: 1469769 - DNA, 15 bp, Homo sapiens
atgaagaaaaagtac

SEQ ID NO: 1469770 - DNA, 17 bp, Homo sapiens
atgaagaaaaagtacaa

SEQ ID NO: 1469771 - DNA, 17 bp, Homo sapiens
atgaagaaaatacttaa

SEQ ID NO: 1469772 - DNA, 18 bp, Homo sapiens
atgaagaaagtcaaaaaa

SEQ ID NO: 1469773 - DNA, 17 bp, Homo sapiens
atgaagaacacagcatg

SEQ ID NO: 1469774 - DNA, 18 bp, Homo sapiens
atgaagaacacagcatgt

SEQ ID NO: 1469775 - DNA, 13 bp, Homo sapiens
atgaagaagacaa

SEQ ID NO: 1469776 - DNA, 16 bp, Homo sapiens
atgaagaagacacctc

SEQ ID NO: 1469777 - DNA, 22 bp, Homo sapiens
atgaagactgttaaatgaaacc

SEQ ID NO: 1469778 - DNA, 13 bp, Homo sapiens
atgaagagaaaaa

SEQ ID NO: 1469779 - DNA, 19 bp, Homo sapiens
atgaagagaaaaaaaggaa

SEQ ID NO: 1469780 - DNA, 22 bp, Homo sapiens
atgaagattctcctgtgctaga

SEQ ID NO: 1469781 - DNA, 15 bp, Homo sapiens
atgaagcagctttaa

SEQ ID NO: 1469782 - DNA, 15 bp, Homo sapiens
atgaagcccaagtga

SEQ ID NO: 1469783 - DNA, 22 bp, Homo sapiens
atgaagctaataaaattcgctt

SEQ ID NO: 1469784 - DNA, 15 bp, Homo sapiens
atgaagctacctcaa

SEQ ID NO: 1469785 - DNA, 21 bp, Homo sapiens
atgaagctgccatccttgctg

SEQ ID NO: 1469786 - DNA, 22 bp, Homo sapiens
atgaagctgtataattaattgt

SEQ ID NO: 1469787 - DNA, 21 bp, Homo sapiens
atgaaggcaaaaactgtactg

SEQ ID NO: 1469788 - DNA, 20 bp, Homo sapiens
atgaagggacagctgctggg

SEQ ID NO: 1469789 - DNA, 17 bp, Homo sapiens
atgaagggcgagtgaat

SEQ ID NO: 1469790 - DNA, 16 bp, Homo sapiens
atgaaggttaggattt

SEQ ID NO: 1469791 - DNA, 20 bp, Homo sapiens
atgaaggttaggatttaaca

SEQ ID NO: 1469792 - DNA, 22 bp, Homo sapiens
atgaaggttaggatttaacagt

SEQ ID NO: 1469793 - DNA, 16 bp, Homo sapiens
atgaagtaaattatgt

SEQ ID NO: 1469794 - DNA, 14 bp, Homo sapiens
atgaagtatataat

SEQ ID NO: 1469795 - DNA, 15 bp, Homo sapiens
atgaagtgcacagga

SEQ ID NO: 1469796 - DNA, 13 bp, Homo sapiens
atgaagttgctgt

SEQ ID NO: 1469797 - DNA, 14 bp, Homo sapiens
atgatctctctgaa

SEQ ID NO: 1469798 - DNA, 18 bp, Homo sapiens
atgatctggacttcctat

SEQ ID NO: 1469799 - DNA, 15 bp, Homo sapiens
atgatcttctttata

SEQ ID NO: 1469800 - DNA, 17 bp, Homo sapiens
atgatgacaaaaaatgt

SEQ ID NO: 1469801 - DNA, 14 bp, Homo sapiens
atgatgacccacta

SEQ ID NO: 1469802 - DNA, 17 bp, Homo sapiens
atgatgacgacgacaac

SEQ ID NO: 1469803 - DNA, 20 bp, Homo sapiens
atgatgagccttcgtgcccc

SEQ ID NO: 1469804 - DNA, 20 bp, Homo sapiens
atgatgatgtggaagaactt

SEQ ID NO: 1469805 - DNA, 15 bp, Homo sapiens
atgatgatgttaacc

SEQ ID NO: 1469806 - DNA, 14 bp, Homo sapiens
atgatgcatacagt

SEQ ID NO: 1469807 - DNA, 16 bp, Homo sapiens
atgatgcatacagttt

SEQ ID NO: 1469808 - DNA, 17 bp, Homo sapiens
atgatgccaacctctgg

SEQ ID NO: 1469809 - DNA, 18 bp, Homo sapiens
atgatgcttttatagctg

SEQ ID NO: 1469810 - DNA, 12 bp, Homo sapiens
atgatggagcaa

SEQ ID NO: 1469811 - DNA, 15 bp, Homo sapiens
atgatggagcaactg

SEQ ID NO: 1469812 - DNA, 21 bp, Homo sapiens
atgatggatcaccattatatt

SEQ ID NO: 1469813 - DNA, 16 bp, Homo sapiens
atgatggcagagccag

SEQ ID NO: 1469814 - DNA, 18 bp, Homo sapiens
atgatggcagagccaggc

SEQ ID NO: 1469815 - DNA, 15 bp, Homo sapiens
atgatgggaaaatat

SEQ ID NO: 1469816 - DNA, 16 bp, Homo sapiens
atgatgggaaaatatt

SEQ ID NO: 1469817 - DNA, 20 bp, Homo sapiens
atgatggtttccaatttcat

SEQ ID NO: 1469818 - DNA, 17 bp, Homo sapiens
atgatggttttaaactt

SEQ ID NO: 1469819 - DNA, 21 bp, Homo sapiens
atgatgtaatctctctgcagc

SEQ ID NO: 1469820 - DNA, 18 bp, Homo sapiens
atgatgtacagattcttt

SEQ ID NO: 1469821 - DNA, 21 bp, Homo sapiens
atgatgtacagattctttcag

SEQ ID NO: 1469822 - DNA, 17 bp, Homo sapiens
atgatgtgggtgtcctg

SEQ ID NO: 1469823 - DNA, 17 bp, Homo sapiens
atgatgtgtgagtgtaa

SEQ ID NO: 1469824 - DNA, 18 bp, Homo sapiens
atgatgtttcttttgcaa

SEQ ID NO: 1469825 - DNA, 16 bp, Homo sapiens
atgatgtttgcccaaa

SEQ ID NO: 1469826 - DNA, 19 bp, Homo sapiens
atgatgtttgcccaaaatt

SEQ ID NO: 1469827 - DNA, 18 bp, Homo sapiens
atgattaaataagattct

SEQ ID NO: 1469828 - DNA, 13 bp, Homo sapiens
atgattaatcaaa

SEQ ID NO: 1469829 - DNA, 15 bp, Homo sapiens
atgattactggcctt

SEQ ID NO: 1469830 - DNA, 15 bp, Homo sapiens
atgattatattcaca

SEQ ID NO: 1469831 - DNA, 17 bp, Homo sapiens
atgattatgccactgct

SEQ ID NO: 1469832 - DNA, 17 bp, Homo sapiens
atgattatttgtattta

SEQ ID NO: 1469833 - DNA, 13 bp, Homo sapiens
atgattcaaaaag

SEQ ID NO: 1469834 - DNA, 23 bp, Homo sapiens
atgattcacatgctaaagccagg

SEQ ID NO: 1469835 - DNA, 22 bp, Homo sapiens
atgattccaatctctgttctgt

SEQ ID NO: 1469836 - DNA, 20 bp, Homo sapiens
atgattccgtgtgtgtactg

SEQ ID NO: 1469837 - DNA, 19 bp, Homo sapiens
atgattcctggacatcacc

SEQ ID NO: 1469838 - DNA, 23 bp, Homo sapiens
atgattctaatttttaagcaaaa

SEQ ID NO: 1469839 - DNA, 23 bp, Homo sapiens
atgattctgcttttaccatgccc

SEQ ID NO: 1469840 - DNA, 20 bp, Homo sapiens
atgattgaaaagaagaaagt

SEQ ID NO: 1469841 - DNA, 19 bp, Homo sapiens
atgattgcagaattgttta

SEQ ID NO: 1469842 - DNA, 22 bp, Homo sapiens
atgattggattattcatttaaa

SEQ ID NO: 1469843 - DNA, 13 bp, Homo sapiens
atgatttaaaaca

SEQ ID NO: 1469844 - DNA, 14 bp, Homo sapiens
atgatttaaaacat

SEQ ID NO: 1469845 - DNA, 17 bp, Homo sapiens
atgatttcaatagcttt

SEQ ID NO: 1469846 - DNA, 19 bp, Homo sapiens
atgatttcatcttctggaa

SEQ ID NO: 1469847 - DNA, 23 bp, Homo sapiens
atgatttgtcccagcctggggct

SEQ ID NO: 1469848 - DNA, 13 bp, Homo sapiens
atgatttgtggaa

SEQ ID NO: 1469849 - DNA, 21 bp, Homo sapiens
atgattttaagtttctctgca

SEQ ID NO: 1469850 - DNA, 14 bp, Homo sapiens
atgattttcctttt

SEQ ID NO: 1469851 - DNA, 20 bp, Homo sapiens
atgattttcctttttcttcg

SEQ ID NO: 1469852 - DNA, 14 bp, Homo sapiens
atgattttttaagc

SEQ ID NO: 1469853 - DNA, 17 bp, Homo sapiens
atgcaaaaaatcttaat

SEQ ID NO: 1469854 - DNA, 23 bp, Homo sapiens
atgcaaaaaatcttaatactgtt

SEQ ID NO: 1469855 - DNA, 17 bp, Homo sapiens
atgcaaaaactctttga

SEQ ID NO: 1469856 - DNA, 14 bp, Homo sapiens
atgcaaaaggttta

SEQ ID NO: 1469857 - DNA, 15 bp, Homo sapiens
atgcaaaatagacat

SEQ ID NO: 1469858 - DNA, 19 bp, Homo sapiens
atgcaaaatagacatcttt

SEQ ID NO: 1469859 - DNA, 13 bp, Homo sapiens
atgcaaaatgaaa

SEQ ID NO: 1469860 - DNA, 17 bp, Homo sapiens
atgcaaaattgttttca

SEQ ID NO: 1469861 - DNA, 24 bp, Homo sapiens
atgcaaaattgttttcacttgtat

SEQ ID NO: 1469862 - DNA, 21 bp, Homo sapiens
atgcaaacaggttgttttcta

SEQ ID NO: 1469863 - DNA, 13 bp, Homo sapiens
atgcaaagcactg

SEQ ID NO: 1469864 - DNA, 16 bp, Homo sapiens
atgcaaagctgaagac

SEQ ID NO: 1469865 - DNA, 22 bp, Homo sapiens
atgcaaagctgaagaccatgga

SEQ ID NO: 1469866 - DNA, 16 bp, Homo sapiens
atgcaaatacaatcag

SEQ ID NO: 1469867 - DNA, 23 bp, Homo sapiens
atgcaaatagtagacatttgtgt

SEQ ID NO: 1469868 - DNA, 18 bp, Homo sapiens
atgcaaatcaattactgg

SEQ ID NO: 1469869 - DNA, 14 bp, Homo sapiens
atgcaaatgagctc

SEQ ID NO: 1469870 - DNA, 19 bp, Homo sapiens
atgcaaatgagctctgaaa

SEQ ID NO: 1469871 - DNA, 21 bp, Homo sapiens
atgcaaatgagctctgaaatc

SEQ ID NO: 1469872 - DNA, 20 bp, Homo sapiens
atgcaaatgttttgaaatga

SEQ ID NO: 1469873 - DNA, 23 bp, Homo sapiens
atgcaactggagttccttatccc

SEQ ID NO: 1469874 - DNA, 20 bp, Homo sapiens
atgcaagagtgattgcagct

SEQ ID NO: 1469875 - DNA, 18 bp, Homo sapiens
atgcaagagtggactgaa

SEQ ID NO: 1469876 - DNA, 14 bp, Homo sapiens
atgcaagcagagga

SEQ ID NO: 1469877 - DNA, 22 bp, Homo sapiens
atgcaagcagaggaccagggcc

SEQ ID NO: 1469878 - DNA, 23 bp, Homo sapiens
atgcaagctagtggcttcaaaat

SEQ ID NO: 1469879 - DNA, 13 bp, Homo sapiens
atgcaaggaagga

SEQ ID NO: 1469880 - DNA, 15 bp, Homo sapiens
atgcaaggaaggaaa

SEQ ID NO: 1469881 - DNA, 14 bp, Homo sapiens
atgcaataaaattt

SEQ ID NO: 1469882 - DNA, 17 bp, Homo sapiens
atgcaataactctggga

SEQ ID NO: 1469883 - DNA, 9 bp, Homo sapiens
atgcaatat

SEQ ID NO: 1469884 - DNA, 21 bp, Homo sapiens
atgcaatataagcataaaaga

SEQ ID NO: 1469885 - DNA, 22 bp, Homo sapiens
atgcaatcagacaagtgttttg

SEQ ID NO: 1469886 - DNA, 17 bp, Homo sapiens
atgcaatccttccctgc

SEQ ID NO: 1469887 - DNA, 23 bp, Homo sapiens
atgcaatgcttcattattcaaga

SEQ ID NO: 1469888 - DNA, 16 bp, Homo sapiens
atgcaatgtgctactg

SEQ ID NO: 1469889 - DNA, 20 bp, Homo sapiens
atgcaattttattaaatgca

SEQ ID NO: 1469890 - DNA, 16 bp, Homo sapiens
atgcacaacagagtaa

SEQ ID NO: 1469891 - DNA, 14 bp, Homo sapiens
atgcacacatatat

SEQ ID NO: 1469892 - DNA, 24 bp, Homo sapiens
atgcacacggctggtcactctgcc

SEQ ID NO: 1469893 - DNA, 22 bp, Homo sapiens
atgcacactcatgcacacagat

SEQ ID NO: 1469894 - DNA, 22 bp, Homo sapiens
atgcacagatgccatggcctgt

SEQ ID NO: 1469895 - DNA, 20 bp, Homo sapiens
atgcacagtacaataatgta

SEQ ID NO: 1469896 - DNA, 18 bp, Homo sapiens
atgcacagtatttgtaat

SEQ ID NO: 1469897 - DNA, 18 bp, Homo sapiens
atgcacatatggactctg

SEQ ID NO: 1469898 - DNA, 22 bp, Homo sapiens
atgcacatgctgtctggccctg

SEQ ID NO: 1469899 - DNA, 23 bp, Homo sapiens
atgcacatgctgtctggccctgg

SEQ ID NO: 1469900 - DNA, 15 bp, Homo sapiens
atgcaccaccaagcc

SEQ ID NO: 1469901 - DNA, 21 bp, Homo sapiens
atgcaccttgtgtctgtacac

SEQ ID NO: 1469902 - DNA, 17 bp, Homo sapiens
atgcacgtggggcccac

SEQ ID NO: 1469903 - DNA, 18 bp, Homo sapiens
atgcacgtggggcccact

SEQ ID NO: 1469904 - DNA, 20 bp, Homo sapiens
atgcactgaaaacttagcca

SEQ ID NO: 1469905 - DNA, 12 bp, Homo sapiens
atgcactgcctg

SEQ ID NO: 1469906 - DNA, 13 bp, Homo sapiens
atgcactgtgaag

SEQ ID NO: 1469907 - DNA, 13 bp, Homo sapiens
atgcactgtggtt

SEQ ID NO: 1469908 - DNA, 20 bp, Homo sapiens
atgcactgtggtttcagatg

SEQ ID NO: 1469909 - DNA, 20 bp, Homo sapiens
atgcacttttagaaatgcat

SEQ ID NO: 1469910 - DNA, 21 bp, Homo sapiens
atgcagaaatagacaaaaagt

SEQ ID NO: 1469911 - DNA, 13 bp, Homo sapiens
atgctccccacag

SEQ ID NO: 1469912 - DNA, 16 bp, Homo sapiens
atgctccctcccctgc

SEQ ID NO: 1469913 - DNA, 19 bp, Homo sapiens
atgctccctcccctgccct

SEQ ID NO: 1469914 - DNA, 20 bp, Homo sapiens
atgctccctcccctgccctg

SEQ ID NO: 1469915 - DNA, 17 bp, Homo sapiens
atgctccctcctctcct

SEQ ID NO: 1469916 - DNA, 22 bp, Homo sapiens
atgctcctagtttgacctcaca

SEQ ID NO: 1469917 - DNA, 19 bp, Homo sapiens
atgctccttgagaggagaa

SEQ ID NO: 1469918 - DNA, 14 bp, Homo sapiens
atgctcgtgtgatt

SEQ ID NO: 1469919 - DNA, 16 bp, Homo sapiens
atgctcgtgtgatttc

SEQ ID NO: 1469920 - DNA, 13 bp, Homo sapiens
atgctctctgcag

SEQ ID NO: 1469921 - DNA, 15 bp, Homo sapiens
atgctctgcatgtta

SEQ ID NO: 1469922 - DNA, 13 bp, Homo sapiens
atgctctgcccca

SEQ ID NO: 1469923 - DNA, 12 bp, Homo sapiens
atgctctggaag

SEQ ID NO: 1469924 - DNA, 17 bp, Homo sapiens
atgctcttgaaatattc

SEQ ID NO: 1469925 - DNA, 15 bp, Homo sapiens
atgctctttcccagg

SEQ ID NO: 1469926 - DNA, 17 bp, Homo sapiens
atgctctttcccaggac

SEQ ID NO: 1469927 - DNA, 17 bp, Homo sapiens
atgctcttttgcacaag

SEQ ID NO: 1469928 - DNA, 18 bp, Homo sapiens
atgctgaatactcctccc

SEQ ID NO: 1469929 - DNA, 18 bp, Homo sapiens
atgctgaatgccccctgc

SEQ ID NO: 1469930 - DNA, 21 bp, Homo sapiens
atgctgacctcacctggtcct

SEQ ID NO: 1469931 - DNA, 19 bp, Homo sapiens
atgctgactgtactcctcc

SEQ ID NO: 1469932 - DNA, 20 bp, Homo sapiens
atgctgactgtactcctccc

SEQ ID NO: 1469933 - DNA, 21 bp, Homo sapiens
atgctgaggccacccactgac

SEQ ID NO: 1469934 - DNA, 17 bp, Homo sapiens
atgctgaggcccctagg

SEQ ID NO: 1469935 - DNA, 17 bp, Homo sapiens
atgctgaggcctgggcc

SEQ ID NO: 1469936 - DNA, 22 bp, Homo sapiens
atgctgaggcctgggccgctgc

SEQ ID NO: 1469937 - DNA, 12 bp, Homo sapiens
atgctgatcatc

SEQ ID NO: 1469938 - DNA, 14 bp, Homo sapiens
atgctgatcatcgc

SEQ ID NO: 1469939 - DNA, 21 bp, Homo sapiens
atgctgatcttttaaaatcat

SEQ ID NO: 1469940 - DNA, 14 bp, Homo sapiens
atgctgcagcagag

SEQ ID NO: 1469941 - DNA, 18 bp, Homo sapiens
atgctgcaggacttgaga

SEQ ID NO: 1469942 - DNA, 19 bp, Homo sapiens
atgctgcaggacttgagaa

SEQ ID NO: 1469943 - DNA, 22 bp, Homo sapiens
atgctgccccgttccctgtcag

SEQ ID NO: 1469944 - DNA, 24 bp, Homo sapiens
atgctgccccgttccctgtcagag

SEQ ID NO: 1469945 - DNA, 12 bp, Homo sapiens
atgctgcctgag

SEQ ID NO: 1469946 - DNA, 14 bp, Homo sapiens
atgctgcctgcctg

SEQ ID NO: 1469947 - DNA, 15 bp, Homo sapiens
atgctgcctgcctgt

SEQ ID NO: 1469948 - DNA, 21 bp, Homo sapiens
atgctgcctgtatttgagaga

SEQ ID NO: 1469949 - DNA, 22 bp, Homo sapiens
atgctgcctgtatttgagagac

SEQ ID NO: 1469950 - DNA, 18 bp, Homo sapiens
atgctgccttttctttaa

SEQ ID NO: 1469951 - DNA, 14 bp, Homo sapiens
atgctgctcatcca

SEQ ID NO: 1469952 - DNA, 13 bp, Homo sapiens
atgctgctgggga

SEQ ID NO: 1469953 - DNA, 17 bp, Homo sapiens
atgctgctggggaagac

SEQ ID NO: 1469954 - DNA, 17 bp, Homo sapiens
atgctgctttcccctgt

SEQ ID NO: 1469955 - DNA, 18 bp, Homo sapiens
atgctgctttcccctgtg

SEQ ID NO: 1469956 - DNA, 14 bp, Homo sapiens
atgctgctttctgc

SEQ ID NO: 1469957 - DNA, 19 bp, Homo sapiens
atgctgctttttggcacag

SEQ ID NO: 1469958 - DNA, 22 bp, Homo sapiens
atgctgctttttggcacagttg

SEQ ID NO: 1469959 - DNA, 14 bp, Homo sapiens
atgctggaaataaa

SEQ ID NO: 1469960 - DNA, 21 bp, Homo sapiens
atgctggacggcattcctgct

SEQ ID NO: 1469961 - DNA, 20 bp, Homo sapiens
atgctggactggaggcccct

SEQ ID NO: 1469962 - DNA, 15 bp, Homo sapiens
atgctggaggccctc

SEQ ID NO: 1469963 - DNA, 19 bp, Homo sapiens
atgctggatgtctgccaat

SEQ ID NO: 1469964 - DNA, 12 bp, Homo sapiens
atgctggcccag

SEQ ID NO: 1469965 - DNA, 15 bp, Homo sapiens
atgctggcccagggc

SEQ ID NO: 1469966 - DNA, 21 bp, Homo sapiens
atgctggcccagggcccagag

SEQ ID NO: 1469967 - DNA, 18 bp, Homo sapiens
atgctggccgctcctccc

SEQ ID NO: 1469968 - DNA, 15 bp, Homo sapiens
atgctgggactcagc

SEQ ID NO: 1469969 - DNA, 16 bp, Homo sapiens
atgctgggactcagcc

SEQ ID NO: 1469970 - DNA, 19 bp, Homo sapiens
atgctgggattacaggcgt

SEQ ID NO: 1469971 - DNA, 14 bp, Homo sapiens
atgctgggccactg

SEQ ID NO: 1469972 - DNA, 16 bp, Homo sapiens
atgctgggctgggccc

SEQ ID NO: 1469973 - DNA, 22 bp, Homo sapiens
atgctggggcaagtccctgact

SEQ ID NO: 1469974 - DNA, 23 bp, Homo sapiens
atgctgggttggtgcacagtgat

SEQ ID NO: 1469975 - DNA, 19 bp, Homo sapiens
atgctgggtttatagatgt

SEQ ID NO: 1469976 - DNA, 18 bp, Homo sapiens
atgctggtggaaagatag

SEQ ID NO: 1469977 - DNA, 22 bp, Homo sapiens
atgctggttttcctaaatgcag

SEQ ID NO: 1469978 - DNA, 13 bp, Homo sapiens
atgctgtatttta

SEQ ID NO: 1469979 - DNA, 23 bp, Homo sapiens
atgctgtcatggtcctttctgga

SEQ ID NO: 1469980 - DNA, 22 bp, Homo sapiens
atgctgtgagtctttggttcta

SEQ ID NO: 1469981 - DNA, 17 bp, Homo sapiens
atgctgtgatacactga

SEQ ID NO: 1469982 - DNA, 17 bp, Homo sapiens
atgctgtgctatgaatt

SEQ ID NO: 1469983 - DNA, 18 bp, Homo sapiens
atgctgtgctccatattt

SEQ ID NO: 1469984 - DNA, 14 bp, Homo sapiens
atgctgtgctcttt

SEQ ID NO: 1469985 - DNA, 16 bp, Homo sapiens
atgctgtgctctttga

SEQ ID NO: 1469986 - DNA, 21 bp, Homo sapiens
atgctgttaatatttctaaaa

SEQ ID NO: 1469987 - DNA, 19 bp, Homo sapiens
atgctgttatgtccagaaa

SEQ ID NO: 1469988 - DNA, 20 bp, Homo sapiens
atgctgttatgtccagaaat

SEQ ID NO: 1469989 - DNA, 14 bp, Homo sapiens
atgctgttgagggc

SEQ ID NO: 1469990 - DNA, 18 bp, Homo sapiens
atgctgttgcctcatcta

SEQ ID NO: 1469991 - DNA, 15 bp, Homo sapiens
atgctgttgtaaaca

SEQ ID NO: 1469992 - DNA, 22 bp, Homo sapiens
atgctgttgtaaacaacgtgta

SEQ ID NO: 1469993 - DNA, 24 bp, Homo sapiens
atgctgtttctaagaaaatgtagt

SEQ ID NO: 1469994 - DNA, 18 bp, Homo sapiens
atgcttaaaaaataatac

SEQ ID NO: 1469995 - DNA, 17 bp, Homo sapiens
atgcttaaaataagcag

SEQ ID NO: 1469996 - DNA, 15 bp, Homo sapiens
atgcttacaaaaaag

SEQ ID NO: 1469997 - DNA, 22 bp, Homo sapiens
atgcttacaggaaaacctgcag

SEQ ID NO: 1469998 - DNA, 23 bp, Homo sapiens
atgcttagtccctcatgcaaatc

SEQ ID NO: 1469999 - DNA, 19 bp, Homo sapiens
atgcttatcatctaaagat

SEQ ID NO: 1470000 - DNA, 20 bp, Homo sapiens
atgcttcatcattccctctc

SEQ ID NO: 1470001 - DNA, 17 bp, Homo sapiens
atgcttcattcaatatt

SEQ ID NO: 1470002 - DNA, 20 bp, Homo sapiens
atgcttcattcaatattgac

SEQ ID NO: 1470003 - DNA, 23 bp, Homo sapiens
atgcttccacaggcaaaactcag

SEQ ID NO: 1470004 - DNA, 15 bp, Homo sapiens
atgcttcctagaagt

SEQ ID NO: 1470005 - DNA, 16 bp, Homo sapiens
atgcttcctagaagtt

SEQ ID NO: 1470006 - DNA, 15 bp, Homo sapiens
atgcttcctgacaat

SEQ ID NO: 1470007 - DNA, 20 bp, Homo sapiens
atgcttcctgacaatcaact

SEQ ID NO: 1470008 - DNA, 14 bp, Homo sapiens
atgcttcctttctc

SEQ ID NO: 1470009 - DNA, 19 bp, Homo sapiens
atgcttctataattttgcc

SEQ ID NO: 1470010 - DNA, 14 bp, Homo sapiens
atgcttctgagagc

SEQ ID NO: 1470011 - DNA, 14 bp, Homo sapiens
atgcttctgggaga

SEQ ID NO: 1470012 - DNA, 14 bp, Homo sapiens
atgcttcttctcaa

SEQ ID NO: 1470013 - DNA, 15 bp, Homo sapiens
atgcttcttctcaaa

SEQ ID NO: 1470014 - DNA, 17 bp, Homo sapiens
atgcttgacatacctac

SEQ ID NO: 1470015 - DNA, 18 bp, Homo sapiens
atgcttgatgtttggcct

SEQ ID NO: 1470016 - DNA, 17 bp, Homo sapiens
atgcttggagcaatcag

SEQ ID NO: 1470017 - DNA, 19 bp, Homo sapiens
atgcttggagcaatcagaa

SEQ ID NO: 1470018 - DNA, 14 bp, Homo sapiens
atgcttgggccctg

SEQ ID NO: 1470019 - DNA, 13 bp, Homo sapiens
atgcttgggctga

SEQ ID NO: 1470020 - DNA, 20 bp, Homo sapiens
atgcttgtaacaagaaaaca

SEQ ID NO: 1470021 - DNA, 15 bp, Homo sapiens
atgctttccaaaacc

SEQ ID NO: 1470022 - DNA, 16 bp, Homo sapiens
atgctttccctgagga

SEQ ID NO: 1470023 - DNA, 20 bp, Homo sapiens
atgctttccctgaggaatga

SEQ ID NO: 1470024 - DNA, 22 bp, Homo sapiens
atgctttgccataaccacattt

SEQ ID NO: 1470025 - DNA, 15 bp, Homo sapiens
atgggctcttccaac

SEQ ID NO: 1470026 - DNA, 23 bp, Homo sapiens
atgggctgtgtcctaaggcccat

SEQ ID NO: 1470027 - DNA, 20 bp, Homo sapiens
atgggcttcctgatgatgat

SEQ ID NO: 1470028 - DNA, 20 bp, Homo sapiens
atgggcttggacttcctggg

SEQ ID NO: 1470029 - DNA, 23 bp, Homo sapiens
atggggaaaccctggagccatcc

SEQ ID NO: 1470030 - DNA, 22 bp, Homo sapiens
atggggaatctaagagagctgc

SEQ ID NO: 1470031 - DNA, 13 bp, Homo sapiens
atggggagaaagg

SEQ ID NO: 1470032 - DNA, 21 bp, Homo sapiens
atggggaggcaagtgtggggg

SEQ ID NO: 1470033 - DNA, 15 bp, Homo sapiens
atggggaggcagcag

SEQ ID NO: 1470034 - DNA, 11 bp, Homo sapiens
atggggaggga

SEQ ID NO: 1470035 - DNA, 16 bp, Homo sapiens
atggggatagaggaaa

SEQ ID NO: 1470036 - DNA, 21 bp, Homo sapiens
atggggcaagacagaaaagtg

SEQ ID NO: 1470037 - DNA, 14 bp, Homo sapiens
atggggcagaaatc

SEQ ID NO: 1470038 - DNA, 16 bp, Homo sapiens
atggggcagaagagaa

SEQ ID NO: 1470039 - DNA, 15 bp, Homo sapiens
atggggccagatcca

SEQ ID NO: 1470040 - DNA, 19 bp, Homo sapiens
atggggccagatccagcct

SEQ ID NO: 1470041 - DNA, 19 bp, Homo sapiens
atggggctgaacggggaga

SEQ ID NO: 1470042 - DNA, 22 bp, Homo sapiens
atggggctgaacggggagaaaa

SEQ ID NO: 1470043 - DNA, 19 bp, Homo sapiens
atggggctggcatgttttc

SEQ ID NO: 1470044 - DNA, 20 bp, Homo sapiens
atggggctggcatgttttct

SEQ ID NO: 1470045 - DNA, 18 bp, Homo sapiens
atgggggaactcagatcc

SEQ ID NO: 1470046 - DNA, 19 bp, Homo sapiens
atgggggaactcagatcca

SEQ ID NO: 1470047 - DNA, 15 bp, Homo sapiens
atgggggcagggctg

SEQ ID NO: 1470048 - DNA, 16 bp, Homo sapiens
atgggggctgccagcg

SEQ ID NO: 1470049 - DNA, 12 bp, Homo sapiens
atggggggagaa

SEQ ID NO: 1470050 - DNA, 17 bp, Homo sapiens
atggggggcgggccagg

SEQ ID NO: 1470051 - DNA, 21 bp, Homo sapiens
atggggggcgggccagggtgg

SEQ ID NO: 1470052 - DNA, 22 bp, Homo sapiens
atggggggcgggccagggtggg

SEQ ID NO: 1470053 - DNA, 17 bp, Homo sapiens
atgggggggagggaggg

SEQ ID NO: 1470054 - DNA, 17 bp, Homo sapiens
atgggggtagcagctgg

SEQ ID NO: 1470055 - DNA, 17 bp, Homo sapiens
atgggggtgcaggcagc

SEQ ID NO: 1470056 - DNA, 21 bp, Homo sapiens
atgggggtgcaggcagccttg

SEQ ID NO: 1470057 - DNA, 14 bp, Homo sapiens
atgggggtttcacc

SEQ ID NO: 1470058 - DNA, 19 bp, Homo sapiens
atggggtggggtagggctg

SEQ ID NO: 1470059 - DNA, 22 bp, Homo sapiens
atggggttcctggttgttcctg

SEQ ID NO: 1470060 - DNA, 13 bp, Homo sapiens
atggggttctgga

SEQ ID NO: 1470061 - DNA, 16 bp, Homo sapiens
atgggtatgctcaggt

SEQ ID NO: 1470062 - DNA, 22 bp, Homo sapiens
atgggtattaaacttgtcagaa

SEQ ID NO: 1470063 - DNA, 19 bp, Homo sapiens
atgggtatttttataacaa

SEQ ID NO: 1470064 - DNA, 12 bp, Homo sapiens
atgggtcacagg

SEQ ID NO: 1470065 - DNA, 13 bp, Homo sapiens
atgggtcagagct

SEQ ID NO: 1470066 - DNA, 19 bp, Homo sapiens
atgggtcccttgaaggaag

SEQ ID NO: 1470067 - DNA, 20 bp, Homo sapiens
atgggtcccttgaaggaaga

SEQ ID NO: 1470068 - DNA, 21 bp, Homo sapiens
atgggtgttgtatggggaggc

SEQ ID NO: 1470069 - DNA, 18 bp, Homo sapiens
atgggtgtttttaataaa

SEQ ID NO: 1470070 - DNA, 22 bp, Homo sapiens
atgggttatttttattaaatgt

SEQ ID NO: 1470071 - DNA, 23 bp, Homo sapiens
atgggttatttttattaaatgta

SEQ ID NO: 1470072 - DNA, 14 bp, Homo sapiens
atgggttccagagg

SEQ ID NO: 1470073 - DNA, 14 bp, Homo sapiens
atgggttgcatttg

SEQ ID NO: 1470074 - DNA, 13 bp, Homo sapiens
atggtaagagaaa

SEQ ID NO: 1470075 - DNA, 15 bp, Homo sapiens
atggtaagagaaaag

SEQ ID NO: 1470076 - DNA, 22 bp, Homo sapiens
atggtacagcttctggagcaga

SEQ ID NO: 1470077 - DNA, 17 bp, Homo sapiens
atggtaccaatcatgaa

SEQ ID NO: 1470078 - DNA, 20 bp, Homo sapiens
atggtaccaatcatgaatct

SEQ ID NO: 1470079 - DNA, 15 bp, Homo sapiens
atggtagattctgtt

SEQ ID NO: 1470080 - DNA, 15 bp, Homo sapiens
atggtagggagagac

SEQ ID NO: 1470081 - DNA, 20 bp, Homo sapiens
atggtataaaaggttgccaa

SEQ ID NO: 1470082 - DNA, 19 bp, Homo sapiens
atggtataatggttgactg

SEQ ID NO: 1470083 - DNA, 19 bp, Homo sapiens
atggtatatatacatatat

SEQ ID NO: 1470084 - DNA, 23 bp, Homo sapiens
atggtatcatatattaaaacaat

SEQ ID NO: 1470085 - DNA, 21 bp, Homo sapiens
atggtatctgggtaagaagaa

SEQ ID NO: 1470086 - DNA, 17 bp, Homo sapiens
atggtatgatcaataaa

SEQ ID NO: 1470087 - DNA, 17 bp, Homo sapiens
atggtatttgctgtatt

SEQ ID NO: 1470088 - DNA, 20 bp, Homo sapiens
atggtcaagttcccaactga

SEQ ID NO: 1470089 - DNA, 13 bp, Homo sapiens
atggtcatataca

SEQ ID NO: 1470090 - DNA, 19 bp, Homo sapiens
atggtccaattagtttcct

SEQ ID NO: 1470091 - DNA, 12 bp, Homo sapiens
atggtccagaaa

SEQ ID NO: 1470092 - DNA, 20 bp, Homo sapiens
atggtccagaaactcctgtt

SEQ ID NO: 1470093 - DNA, 18 bp, Homo sapiens
atggtccatttgttcctg

SEQ ID NO: 1470094 - DNA, 17 bp, Homo sapiens
atggtcccatccaggca

SEQ ID NO: 1470095 - DNA, 18 bp, Homo sapiens
atggtcccatccaggcag

SEQ ID NO: 1470096 - DNA, 16 bp, Homo sapiens
atggtccgtgcccagg

SEQ ID NO: 1470097 - DNA, 17 bp, Homo sapiens
atggtccgtgcccaggc

SEQ ID NO: 1470098 - DNA, 23 bp, Homo sapiens
atggtcctcacaagcctcttctg

SEQ ID NO: 1470099 - DNA, 19 bp, Homo sapiens
atggtcctggggctctgtg

SEQ ID NO: 1470100 - DNA, 23 bp, Homo sapiens
atggtcgagaaagaggcaccagg

SEQ ID NO: 1470101 - DNA, 15 bp, Homo sapiens
atggtcgcccaggag

SEQ ID NO: 1470102 - DNA, 16 bp, Homo sapiens
atggtcgcccaggaga

SEQ ID NO: 1470103 - DNA, 15 bp, Homo sapiens
atggtcggatctcac

SEQ ID NO: 1470104 - DNA, 14 bp, Homo sapiens
atggtctcaatctc

SEQ ID NO: 1470105 - DNA, 19 bp, Homo sapiens
atggtctccatatcagctc

SEQ ID NO: 1470106 - DNA, 16 bp, Homo sapiens
atggtcttacattgga

SEQ ID NO: 1470107 - DNA, 13 bp, Homo sapiens
atggtctttgctc

SEQ ID NO: 1470108 - DNA, 24 bp, Homo sapiens
atggtgaaaccccgtctctactaa

SEQ ID NO: 1470109 - DNA, 17 bp, Homo sapiens
atggtgaggctgtcagt

SEQ ID NO: 1470110 - DNA, 16 bp, Homo sapiens
atggtgattttaaatg

SEQ ID NO: 1470111 - DNA, 17 bp, Homo sapiens
atggtgattttaaatgt

SEQ ID NO: 1470112 - DNA, 20 bp, Homo sapiens
atggtgccccaggaccagct

SEQ ID NO: 1470113 - DNA, 22 bp, Homo sapiens
atggtgccccaggaccagctca

SEQ ID NO: 1470114 - DNA, 15 bp, Homo sapiens
atggtgcctgagagg

SEQ ID NO: 1470115 - DNA, 18 bp, Homo sapiens
atggtgcctgagaggcag

SEQ ID NO: 1470116 - DNA, 20 bp, Homo sapiens
atggtgcctgagaggcaggc

SEQ ID NO: 1470117 - DNA, 23 bp, Homo sapiens
atggtgcctgagaggcaggcata

SEQ ID NO: 1470118 - DNA, 13 bp, Homo sapiens
atggtgctgccca

SEQ ID NO: 1470119 - DNA, 19 bp, Homo sapiens
atggtggaaaacgaagctc

SEQ ID NO: 1470120 - DNA, 21 bp, Homo sapiens
atggtggcacacgcctgtagt

SEQ ID NO: 1470121 - DNA, 21 bp, Homo sapiens
atggtggcgctttctcctgtg

SEQ ID NO: 1470122 - DNA, 17 bp, Homo sapiens
atggtggctcatgcctg

SEQ ID NO: 1470123 - DNA, 21 bp, Homo sapiens
atggtgggagagactgtgagg

SEQ ID NO: 1470124 - DNA, 16 bp, Homo sapiens
atggtggttattttaa

SEQ ID NO: 1470125 - DNA, 13 bp, Homo sapiens
atggtgtacataa

SEQ ID NO: 1470126 - DNA, 19 bp, Homo sapiens
atggtgtagaacactaatt

SEQ ID NO: 1470127 - DNA, 16 bp, Homo sapiens
atggtgtagctgtcct

SEQ ID NO: 1470128 - DNA, 17 bp, Homo sapiens
atggtgtagctgtcctc

SEQ ID NO: 1470129 - DNA, 18 bp, Homo sapiens
atggtgtgaaagtcagat

SEQ ID NO: 1470130 - DNA, 22 bp, Homo sapiens
atggtgtgaaagtcagatgccc

SEQ ID NO: 1470131 - DNA, 20 bp, Homo sapiens
atggtgtggggggctggggg

SEQ ID NO: 1470132 - DNA, 17 bp, Homo sapiens
atggtgttttgtcagac

SEQ ID NO: 1470133 - DNA, 14 bp, Homo sapiens
atggttaaaaaggc

SEQ ID NO: 1470134 - DNA, 18 bp, Homo sapiens
atggttaagagtccaaga

SEQ ID NO: 1470135 - DNA, 17 bp, Homo sapiens
atggttaatactattaa

SEQ ID NO: 1470136 - DNA, 21 bp, Homo sapiens
atggttaatttttcctgcatg

SEQ ID NO: 1470137 - DNA, 22 bp, Homo sapiens
atggttaatttttcctgcatgt

SEQ ID NO: 1470138 - DNA, 12 bp, Homo sapiens
atggttagtgtg

SEQ ID NO: 1470139 - DNA, 20 bp, Homo sapiens
atggttccatgcctgagggt

SEQ ID NO: 1470140 - DNA, 16 bp, Homo sapiens
atggttcccaataaaa

SEQ ID NO: 1470141 - DNA, 20 bp, Homo sapiens
atggttcctctcttggcaat

SEQ ID NO: 1470142 - DNA, 20 bp, Homo sapiens
atggttccttccctgggaag

SEQ ID NO: 1470143 - DNA, 16 bp, Homo sapiens
atggttctcaggcctg

SEQ ID NO: 1470144 - DNA, 19 bp, Homo sapiens
atggttctggctgtttgag

SEQ ID NO: 1470145 - DNA, 13 bp, Homo sapiens
atggttctgtgac

SEQ ID NO: 1470146 - DNA, 21 bp, Homo sapiens
atggttctgtgacccatctgt

SEQ ID NO: 1470147 - DNA, 13 bp, Homo sapiens
atggttgaatgaa

SEQ ID NO: 1470148 - DNA, 15 bp, Homo sapiens
atggttgaatgaata

SEQ ID NO: 1470149 - DNA, 19 bp, Homo sapiens
atggttgagaaatgaataa

SEQ ID NO: 1470150 - DNA, 14 bp, Homo sapiens
atggttgatggaaa

SEQ ID NO: 1470151 - DNA, 18 bp, Homo sapiens
atggttgatggaaaataa

SEQ ID NO: 1470152 - DNA, 13 bp, Homo sapiens
atggttgcagata

SEQ ID NO: 1470153 - DNA, 21 bp, Homo sapiens
atggttggttttatttgtcag

SEQ ID NO: 1470154 - DNA, 13 bp, Homo sapiens
atggtttcaaaga

SEQ ID NO: 1470155 - DNA, 15 bp, Homo sapiens
atggtttcctctgga

SEQ ID NO: 1470156 - DNA, 16 bp, Homo sapiens
atggtttcctctggat

SEQ ID NO: 1470157 - DNA, 16 bp, Homo sapiens
atggtttgatatgtag

SEQ ID NO: 1470158 - DNA, 15 bp, Homo sapiens
atggttttaaacttt

SEQ ID NO: 1470159 - DNA, 13 bp, Homo sapiens
atggttttaagaa

SEQ ID NO: 1470160 - DNA, 15 bp, Homo sapiens
atggttttcaaaata

SEQ ID NO: 1470161 - DNA, 15 bp, Homo sapiens
atggttttgtgccat

SEQ ID NO: 1470162 - DNA, 19 bp, Homo sapiens
atggttttgtgccatctgt

SEQ ID NO: 1470163 - DNA, 14 bp, Homo sapiens
atgtaaaacccttt

SEQ ID NO: 1470164 - DNA, 21 bp, Homo sapiens
atgtaaaagagtcatctggta

SEQ ID NO: 1470165 - DNA, 13 bp, Homo sapiens
atgtaaaagccta

SEQ ID NO: 1470166 - DNA, 21 bp, Homo sapiens
atgtaaaaggtattaaattga

SEQ ID NO: 1470167 - DNA, 17 bp, Homo sapiens
atgtaaaatatgtaaaa

SEQ ID NO: 1470168 - DNA, 20 bp, Homo sapiens
atgtaaaatatgtaaaacta

SEQ ID NO: 1470169 - DNA, 12 bp, Homo sapiens
atgtaaaatctt

SEQ ID NO: 1470170 - DNA, 15 bp, Homo sapiens
atgtaaaatcttgtc

SEQ ID NO: 1470171 - DNA, 16 bp, Homo sapiens
atgtaaaatcttgtca

SEQ ID NO: 1470172 - DNA, 20 bp, Homo sapiens
atgtaaaatcttgtcatgtg

SEQ ID NO: 1470173 - DNA, 14 bp, Homo sapiens
atgtaaaatgaatt

SEQ ID NO: 1470174 - DNA, 22 bp, Homo sapiens
atgtaaaatgaattgaaaaaca

SEQ ID NO: 1470175 - DNA, 12 bp, Homo sapiens
atgtaaaattca

SEQ ID NO: 1470176 - DNA, 13 bp, Homo sapiens
atgtaaacaaatc

SEQ ID NO: 1470177 - DNA, 22 bp, Homo sapiens
atgtaaacaaatctttccatat

SEQ ID NO: 1470178 - DNA, 18 bp, Homo sapiens
atgtaaacaatgtaaagt

SEQ ID NO: 1470179 - DNA, 17 bp, Homo sapiens
atgtaaacagtgcctgc

SEQ ID NO: 1470180 - DNA, 22 bp, Homo sapiens
atgtaaacagtgcctgctgaat

SEQ ID NO: 1470181 - DNA, 14 bp, Homo sapiens
atgtaaagatattt

SEQ ID NO: 1470182 - DNA, 15 bp, Homo sapiens
atgtaaagttatgta

SEQ ID NO: 1470183 - DNA, 23 bp, Homo sapiens
atgtaaataaactatttatatca

SEQ ID NO: 1470184 - DNA, 21 bp, Homo sapiens
atgtaaataaaggatttctag

SEQ ID NO: 1470185 - DNA, 17 bp, Homo sapiens
atgtaaatacaatttgt

SEQ ID NO: 1470186 - DNA, 20 bp, Homo sapiens
atgtaaatacaatttgtact

SEQ ID NO: 1470187 - DNA, 20 bp, Homo sapiens
atgtaaatcacttcattgtt

SEQ ID NO: 1470188 - DNA, 21 bp, Homo sapiens
atgtaaatcacttcattgttt

SEQ ID NO: 1470189 - DNA, 20 bp, Homo sapiens
atgtaaatctgctttgtggt

SEQ ID NO: 1470190 - DNA, 19 bp, Homo sapiens
atgtaaatttgtactattt

SEQ ID NO: 1470191 - DNA, 20 bp, Homo sapiens
atgtaaattttgtatgaaaa

SEQ ID NO: 1470192 - DNA, 21 bp, Homo sapiens
atgtaacatcataattacatt

SEQ ID NO: 1470193 - DNA, 13 bp, Homo sapiens
atgtaaccaagct

SEQ ID NO: 1470194 - DNA, 14 bp, Homo sapiens
atgtaaccaagctg

SEQ ID NO: 1470195 - DNA, 22 bp, Homo sapiens
atgtaactccagatagagaaat

SEQ ID NO: 1470196 - DNA, 15 bp, Homo sapiens
atgtaacttattatt

SEQ ID NO: 1470197 - DNA, 17 bp, Homo sapiens
atgtaacttttgtaaga

SEQ ID NO: 1470198 - DNA, 15 bp, Homo sapiens
atgtaagaaaatgtt

SEQ ID NO: 1470199 - DNA, 16 bp, Homo sapiens
atgtaagaacacattt

SEQ ID NO: 1470200 - DNA, 22 bp, Homo sapiens
atgtaagaacacattttaaata

SEQ ID NO: 1470201 - DNA, 12 bp, Homo sapiens
atgtaagcaaag

SEQ ID NO: 1470202 - DNA, 22 bp, Homo sapiens
atgtaagcatactttgtaaata

SEQ ID NO: 1470203 - DNA, 15 bp, Homo sapiens
atgtaaggactgtaa

SEQ ID NO: 1470204 - DNA, 14 bp, Homo sapiens
atgtaaggatgagg

SEQ ID NO: 1470205 - DNA, 17 bp, Homo sapiens
atgtaaggattctggaa

SEQ ID NO: 1470206 - DNA, 23 bp, Homo sapiens
atgtaaggcactgtcaggaatgg

SEQ ID NO: 1470207 - DNA, 19 bp, Homo sapiens
atgtaagggaaactgccag

SEQ ID NO: 1470208 - DNA, 22 bp, Homo sapiens
atgtaaggtatatcattctaaa

SEQ ID NO: 1470209 - DNA, 22 bp, Homo sapiens
atgtaagtaattgcatttctgc

SEQ ID NO: 1470210 - DNA, 18 bp, Homo sapiens
atgtaagtgggcccaccc

SEQ ID NO: 1470211 - DNA, 16 bp, Homo sapiens
atgtaagtgtggtttt

SEQ ID NO: 1470212 - DNA, 14 bp, Homo sapiens
atgtaataaacttt

SEQ ID NO: 1470213 - DNA, 17 bp, Homo sapiens
atgtaataaattcaaaa

SEQ ID NO: 1470214 - DNA, 15 bp, Homo sapiens
atgtaatataatgta

SEQ ID NO: 1470215 - DNA, 19 bp, Homo sapiens
atgtaatataatgtatttt

SEQ ID NO: 1470216 - DNA, 21 bp, Homo sapiens
atgtaatataatgtattttct

SEQ ID NO: 1470217 - DNA, 16 bp, Homo sapiens
atgtaatatattgtac

SEQ ID NO: 1470218 - DNA, 15 bp, Homo sapiens
atgtaatatatttca

SEQ ID NO: 1470219 - DNA, 22 bp, Homo sapiens
atgtaatatatttcagacattt

SEQ ID NO: 1470220 - DNA, 17 bp, Homo sapiens
atgtaatcatttatctt

SEQ ID NO: 1470221 - DNA, 18 bp, Homo sapiens
atgtaatccttttgttta

SEQ ID NO: 1470222 - DNA, 20 bp, Homo sapiens
atgtaatctctctgcagctg

SEQ ID NO: 1470223 - DNA, 22 bp, Homo sapiens
atgtaatctctctgcagctgcc

SEQ ID NO: 1470224 - DNA, 15 bp, Homo sapiens
atgtaattgaataaa

SEQ ID NO: 1470225 - DNA, 21 bp, Homo sapiens
atgtaattgtccctctgtggc

SEQ ID NO: 1470226 - DNA, 12 bp, Homo sapiens
atgtaatttaaa

SEQ ID NO: 1470227 - DNA, 15 bp, Homo sapiens
atgtaatttatgcaa

SEQ ID NO: 1470228 - DNA, 13 bp, Homo sapiens
atgtaatttcaaa

SEQ ID NO: 1470229 - DNA, 19 bp, Homo sapiens
atgtaatttcaaaatacat

SEQ ID NO: 1470230 - DNA, 23 bp, Homo sapiens
atgtaattttattttaaaatttc

SEQ ID NO: 1470231 - DNA, 21 bp, Homo sapiens
atgtacaagttttgtataaat

SEQ ID NO: 1470232 - DNA, 16 bp, Homo sapiens
atgtacaatacaatgt

SEQ ID NO: 1470233 - DNA, 21 bp, Homo sapiens
atgtacaatacaatgtacaat

SEQ ID NO: 1470234 - DNA, 15 bp, Homo sapiens
atgtacaattatgtc

SEQ ID NO: 1470235 - DNA, 15 bp, Homo sapiens
atgtacagattcttt

SEQ ID NO: 1470236 - DNA, 16 bp, Homo sapiens
atgtacagattctttc

SEQ ID NO: 1470237 - DNA, 20 bp, Homo sapiens
atgtacagattttatttgta

SEQ ID NO: 1470238 - DNA, 19 bp, Homo sapiens
atgtacatagtaaagtatt

SEQ ID NO: 1470239 - DNA, 17 bp, Homo sapiens
atgtacatgtattaaat

SEQ ID NO: 1470240 - DNA, 13 bp, Homo sapiens
atgtacatgtgta

SEQ ID NO: 1470241 - DNA, 14 bp, Homo sapiens
atgtacatgtgtag

SEQ ID NO: 1470242 - DNA, 20 bp, Homo sapiens
atgtacatttccaaattcac

SEQ ID NO: 1470243 - DNA, 17 bp, Homo sapiens
atgtaccatgaatattt

SEQ ID NO: 1470244 - DNA, 18 bp, Homo sapiens
atgtaccatgaatattta

SEQ ID NO: 1470245 - DNA, 15 bp, Homo sapiens
atgtaccatgtacat

SEQ ID NO: 1470246 - DNA, 22 bp, Homo sapiens
atgtaccttctttcactctgtc

SEQ ID NO: 1470247 - DNA, 13 bp, Homo sapiens
atgtactaagaat

SEQ ID NO: 1470248 - DNA, 22 bp, Homo sapiens
atgtactaagaatgtccttatt

SEQ ID NO: 1470249 - DNA, 20 bp, Homo sapiens
atgtactacagctatatttg

SEQ ID NO: 1470250 - DNA, 17 bp, Homo sapiens
atgtactatgtctgaac

SEQ ID NO: 1470251 - DNA, 19 bp, Homo sapiens
atgtactcacatataacat

SEQ ID NO: 1470252 - DNA, 19 bp, Homo sapiens
atgtactgatttcagtaag

SEQ ID NO: 1470253 - DNA, 18 bp, Homo sapiens
atgtactgcaaagtcgcc

SEQ ID NO: 1470254 - DNA, 21 bp, Homo sapiens
atgtgcctttctttgcctctg

SEQ ID NO: 1470255 - DNA, 19 bp, Homo sapiens
atgtgctagtcactggcag

SEQ ID NO: 1470256 - DNA, 22 bp, Homo sapiens
atgtgctataatctgtttttac

SEQ ID NO: 1470257 - DNA, 18 bp, Homo sapiens
atgtgctatacacacaca

SEQ ID NO: 1470258 - DNA, 18 bp, Homo sapiens
atgtgctatactgcatac

SEQ ID NO: 1470259 - DNA, 21 bp, Homo sapiens
atgtgctgcggtcactcaggc

SEQ ID NO: 1470260 - DNA, 21 bp, Homo sapiens
atgtgctggtgaacactgtga

SEQ ID NO: 1470261 - DNA, 22 bp, Homo sapiens
atgtgctggtgaacactgtgac

SEQ ID NO: 1470262 - DNA, 15 bp, Homo sapiens
atgtgctttgctgca

SEQ ID NO: 1470263 - DNA, 14 bp, Homo sapiens
atgtggaagagcat

SEQ ID NO: 1470264 - DNA, 17 bp, Homo sapiens
atgtggacttaggaagg

SEQ ID NO: 1470265 - DNA, 16 bp, Homo sapiens
atgtggagcagcagcc

SEQ ID NO: 1470266 - DNA, 21 bp, Homo sapiens
atgtggaggaagagccacctg

SEQ ID NO: 1470267 - DNA, 23 bp, Homo sapiens
atgtggaggaagagccacctgca

SEQ ID NO: 1470268 - DNA, 17 bp, Homo sapiens
atgtggcaaagtgctgt

SEQ ID NO: 1470269 - DNA, 11 bp, Homo sapiens
atgtggcagct

SEQ ID NO: 1470270 - DNA, 12 bp, Homo sapiens
atgtggcagctg

SEQ ID NO: 1470271 - DNA, 24 bp, Homo sapiens
atgtggcagctggggagcagctga

SEQ ID NO: 1470272 - DNA, 14 bp, Homo sapiens
atgtggccctggcc

SEQ ID NO: 1470273 - DNA, 18 bp, Homo sapiens
atgtggccgaggactttg

SEQ ID NO: 1470274 - DNA, 19 bp, Homo sapiens
atgtggcctgtggcctgtg

SEQ ID NO: 1470275 - DNA, 22 bp, Homo sapiens
atgtggctgtatcttgtttttc

SEQ ID NO: 1470276 - DNA, 18 bp, Homo sapiens
atgtggcttggtttggtc

SEQ ID NO: 1470277 - DNA, 17 bp, Homo sapiens
atgtgggatattgaatg

SEQ ID NO: 1470278 - DNA, 14 bp, Homo sapiens
atgtgggattatgg

SEQ ID NO: 1470279 - DNA, 18 bp, Homo sapiens
atgtgggattatgggtca

SEQ ID NO: 1470280 - DNA, 20 bp, Homo sapiens
atgtgggattatgggtcaca

SEQ ID NO: 1470281 - DNA, 15 bp, Homo sapiens
atgtgggcacggagg

SEQ ID NO: 1470282 - DNA, 16 bp, Homo sapiens
atgtgggcgcccaccc

SEQ ID NO: 1470283 - DNA, 23 bp, Homo sapiens
atgtgggcgcccaccctgggctc

SEQ ID NO: 1470284 - DNA, 16 bp, Homo sapiens
atgtggggacagggct

SEQ ID NO: 1470285 - DNA, 18 bp, Homo sapiens
atgtggggctgagctggg

SEQ ID NO: 1470286 - DNA, 20 bp, Homo sapiens
atgtgggtaagaggagcaga

SEQ ID NO: 1470287 - DNA, 21 bp, Homo sapiens
atgtgggtggagaagggaggg

SEQ ID NO: 1470288 - DNA, 15 bp, Homo sapiens
atgtggtaagtggag

SEQ ID NO: 1470289 - DNA, 20 bp, Homo sapiens
atgtggtgacacctccccct

SEQ ID NO: 1470290 - DNA, 15 bp, Homo sapiens
atgtggtgggacagg

SEQ ID NO: 1470291 - DNA, 20 bp, Homo sapiens
atgtggttacttcctactgt

SEQ ID NO: 1470292 - DNA, 13 bp, Homo sapiens
atgtgtaagtatt

SEQ ID NO: 1470293 - DNA, 11 bp, Homo sapiens
atgtgtacata

SEQ ID NO: 1470294 - DNA, 13 bp, Homo sapiens
atgtgtacatata

SEQ ID NO: 1470295 - DNA, 14 bp, Homo sapiens
atgtgtacatatat

SEQ ID NO: 1470296 - DNA, 18 bp, Homo sapiens
atgtgtacatatatgtat

SEQ ID NO: 1470297 - DNA, 14 bp, Homo sapiens
atgtgtacatggca

SEQ ID NO: 1470298 - DNA, 22 bp, Homo sapiens
atgtgtacatggcagagtttgt

SEQ ID NO: 1470299 - DNA, 23 bp, Homo sapiens
atgtgtagcctgtgcatgtatgt

SEQ ID NO: 1470300 - DNA, 16 bp, Homo sapiens
atgtgtagggaaagtt

SEQ ID NO: 1470301 - DNA, 23 bp, Homo sapiens
atgtgtataaaaataaaaaagat

SEQ ID NO: 1470302 - DNA, 14 bp, Homo sapiens
atgtgtatttatac

SEQ ID NO: 1470303 - DNA, 14 bp, Homo sapiens
atgtgtatttctta

SEQ ID NO: 1470304 - DNA, 16 bp, Homo sapiens
atgtgtatttcttata

SEQ ID NO: 1470305 - DNA, 21 bp, Homo sapiens
atgtgtatttttcaaggcatt

SEQ ID NO: 1470306 - DNA, 23 bp, Homo sapiens
atgtgtcatgaagaatgtttctg

SEQ ID NO: 1470307 - DNA, 20 bp, Homo sapiens
atgtgtcattggaagccatc

SEQ ID NO: 1470308 - DNA, 17 bp, Homo sapiens
atgtgtccatgtgaaat

SEQ ID NO: 1470309 - DNA, 12 bp, Homo sapiens
atgtgtctttat

SEQ ID NO: 1470310 - DNA, 16 bp, Homo sapiens
atgtgtgagtgcatgt

SEQ ID NO: 1470311 - DNA, 11 bp, Homo sapiens
atgtgtgcatg

SEQ ID NO: 1470312 - DNA, 13 bp, Homo sapiens
atgtgtgcatgtg

SEQ ID NO: 1470313 - DNA, 14 bp, Homo sapiens
atgtgtgcatgtga

SEQ ID NO: 1470314 - DNA, 17 bp, Homo sapiens
atgtgtgcatgtgagca

SEQ ID NO: 1470315 - DNA, 14 bp, Homo sapiens
atgtgtggcctgca

SEQ ID NO: 1470316 - DNA, 16 bp, Homo sapiens
atgtgtggctcattct

SEQ ID NO: 1470317 - DNA, 15 bp, Homo sapiens
atgtgtggggcatgg

SEQ ID NO: 1470318 - DNA, 21 bp, Homo sapiens
atgtgtgtgtatgtttgcaca

SEQ ID NO: 1470319 - DNA, 14 bp, Homo sapiens
atgtgtgttttttc

SEQ ID NO: 1470320 - DNA, 14 bp, Homo sapiens
atgtgttatgaaca

SEQ ID NO: 1470321 - DNA, 16 bp, Homo sapiens
atgtgttatgaacatc

SEQ ID NO: 1470322 - DNA, 13 bp, Homo sapiens
atgtgttctaagc

SEQ ID NO: 1470323 - DNA, 23 bp, Homo sapiens
atgtgttcttctttctctgtatt

SEQ ID NO: 1470324 - DNA, 21 bp, Homo sapiens
atgtgttcttttctcctttac

SEQ ID NO: 1470325 - DNA, 14 bp, Homo sapiens
atgtgttgcaaatt

SEQ ID NO: 1470326 - DNA, 20 bp, Homo sapiens
atgtgttgcaaattattcta

SEQ ID NO: 1470327 - DNA, 18 bp, Homo sapiens
atgtgtttatgtgagctg

SEQ ID NO: 1470328 - DNA, 12 bp, Homo sapiens
atgtgtttccat

SEQ ID NO: 1470329 - DNA, 20 bp, Homo sapiens
atgtgtttttctatatagtt

SEQ ID NO: 1470330 - DNA, 17 bp, Homo sapiens
atgttaaaaatagcagt

SEQ ID NO: 1470331 - DNA, 16 bp, Homo sapiens
atgttaaacaccattt

SEQ ID NO: 1470332 - DNA, 19 bp, Homo sapiens
atgttaaagcatcagagat

SEQ ID NO: 1470333 - DNA, 22 bp, Homo sapiens
atgttaacaagaggggaaaaca

SEQ ID NO: 1470334 - DNA, 23 bp, Homo sapiens
atgttaaccagaataaagttctg

SEQ ID NO: 1470335 - DNA, 21 bp, Homo sapiens
atgttaagaatgaagttctgc

SEQ ID NO: 1470336 - DNA, 20 bp, Homo sapiens
atgttaagggaagaattcca

SEQ ID NO: 1470337 - DNA, 16 bp, Homo sapiens
atgttaagttacagtt

SEQ ID NO: 1470338 - DNA, 14 bp, Homo sapiens
atgttaagttatat

SEQ ID NO: 1470339 - DNA, 22 bp, Homo sapiens
atgttaattcagcactgatttc

SEQ ID NO: 1470340 - DNA, 17 bp, Homo sapiens
atgttaatttatttagt

SEQ ID NO: 1470341 - DNA, 21 bp, Homo sapiens
atgttacacattaaacaggat

SEQ ID NO: 1470342 - DNA, 20 bp, Homo sapiens
atgttacatctgttttaaat

SEQ ID NO: 1470343 - DNA, 15 bp, Homo sapiens
atgttacctctgaat

SEQ ID NO: 1470344 - DNA, 21 bp, Homo sapiens
atgttacggcatcacacttat

SEQ ID NO: 1470345 - DNA, 20 bp, Homo sapiens
atgttactaaattttctaat

SEQ ID NO: 1470346 - DNA, 21 bp, Homo sapiens
atgttactattttctacaatt

SEQ ID NO: 1470347 - DNA, 14 bp, Homo sapiens
atgttactcagtgt

SEQ ID NO: 1470348 - DNA, 20 bp, Homo sapiens
atgttactccctgttttagt

SEQ ID NO: 1470349 - DNA, 21 bp, Homo sapiens
atgttactccctgttttagtt

SEQ ID NO: 1470350 - DNA, 15 bp, Homo sapiens
atgttagaagaagag

SEQ ID NO: 1470351 - DNA, 16 bp, Homo sapiens
atgttagaagaagagg

SEQ ID NO: 1470352 - DNA, 16 bp, Homo sapiens
atgttagaatcaaata

SEQ ID NO: 1470353 - DNA, 16 bp, Homo sapiens
atgttagaggttttaa

SEQ ID NO: 1470354 - DNA, 21 bp, Homo sapiens
atgttagttaccttatagtta

SEQ ID NO: 1470355 - DNA, 17 bp, Homo sapiens
atgttatacaaggcaag

SEQ ID NO: 1470356 - DNA, 20 bp, Homo sapiens
atgttatacaaggcaagcat

SEQ ID NO: 1470357 - DNA, 20 bp, Homo sapiens
atgttatcggattactgaat

SEQ ID NO: 1470358 - DNA, 20 bp, Homo sapiens
atgttatcttctcaagttct

SEQ ID NO: 1470359 - DNA, 17 bp, Homo sapiens
atgttatgcataaagtc

SEQ ID NO: 1470360 - DNA, 17 bp, Homo sapiens
atgttatgggatgtaaa

SEQ ID NO: 1470361 - DNA, 12 bp, Homo sapiens
atgttatgtata

SEQ ID NO: 1470362 - DNA, 15 bp, Homo sapiens
atgttattagatgtt

SEQ ID NO: 1470363 - DNA, 15 bp, Homo sapiens
atgttattgcataat

SEQ ID NO: 1470364 - DNA, 17 bp, Homo sapiens
atgttcaaagccacatt

SEQ ID NO: 1470365 - DNA, 15 bp, Homo sapiens
atgttcactgtgagt

SEQ ID NO: 1470366 - DNA, 16 bp, Homo sapiens
atgttcagcactgtcc

SEQ ID NO: 1470367 - DNA, 13 bp, Homo sapiens
atgttcattataa

SEQ ID NO: 1470368 - DNA, 21 bp, Homo sapiens
attacaaatggtgaatggatt

SEQ ID NO: 1470369 - DNA, 13 bp, Homo sapiens
attacaaattgct

SEQ ID NO: 1470370 - DNA, 14 bp, Homo sapiens
attacaaattgctt

SEQ ID NO: 1470371 - DNA, 15 bp, Homo sapiens
attacaaattgctta

SEQ ID NO: 1470372 - DNA, 20 bp, Homo sapiens
attacaacagtagagaggga

SEQ ID NO: 1470373 - DNA, 15 bp, Homo sapiens
attacaacagtgaga

SEQ ID NO: 1470374 - DNA, 13 bp, Homo sapiens
attacaacattta

SEQ ID NO: 1470375 - DNA, 19 bp, Homo sapiens
attacaaggcaatggaaac

SEQ ID NO: 1470376 - DNA, 15 bp, Homo sapiens
attacaatgtatctt

SEQ ID NO: 1470377 - DNA, 18 bp, Homo sapiens
attacaatgtatctttat

SEQ ID NO: 1470378 - DNA, 13 bp, Homo sapiens
attacaattttat

SEQ ID NO: 1470379 - DNA, 16 bp, Homo sapiens
attacaattttctgta

SEQ ID NO: 1470380 - DNA, 21 bp, Homo sapiens
attacacaaagaacttgctgc

SEQ ID NO: 1470381 - DNA, 14 bp, Homo sapiens
attacactaaatta

SEQ ID NO: 1470382 - DNA, 12 bp, Homo sapiens
attacagaatat

SEQ ID NO: 1470383 - DNA, 17 bp, Homo sapiens
attacagatttagttta

SEQ ID NO: 1470384 - DNA, 12 bp, Homo sapiens
attacagtgaaa

SEQ ID NO: 1470385 - DNA, 15 bp, Homo sapiens
attacagtgggtgcc

SEQ ID NO: 1470386 - DNA, 20 bp, Homo sapiens
attacagtgtcctaccactc

SEQ ID NO: 1470387 - DNA, 23 bp, Homo sapiens
attacagtgtcctaccactctaa

SEQ ID NO: 1470388 - DNA, 17 bp, Homo sapiens
attacataatcaaagct

SEQ ID NO: 1470389 - DNA, 19 bp, Homo sapiens
attacataatcaaagctac

SEQ ID NO: 1470390 - DNA, 12 bp, Homo sapiens
attacatacaga

SEQ ID NO: 1470391 - DNA, 13 bp, Homo sapiens
attacatacagat

SEQ ID NO: 1470392 - DNA, 16 bp, Homo sapiens
attacatctttcacat

SEQ ID NO: 1470393 - DNA, 16 bp, Homo sapiens
attacatgtaatttga

SEQ ID NO: 1470394 - DNA, 17 bp, Homo sapiens
attacattattaaacga

SEQ ID NO: 1470395 - DNA, 14 bp, Homo sapiens
attacattcctaac

SEQ ID NO: 1470396 - DNA, 21 bp, Homo sapiens
attacattcctaactagaatt

SEQ ID NO: 1470397 - DNA, 23 bp, Homo sapiens
attacattcctaactagaattag

SEQ ID NO: 1470398 - DNA, 19 bp, Homo sapiens
attacatttgtaatttaag

SEQ ID NO: 1470399 - DNA, 16 bp, Homo sapiens
attaccaacctgttac

SEQ ID NO: 1470400 - DNA, 18 bp, Homo sapiens
attaccagcaagaataaa

SEQ ID NO: 1470401 - DNA, 22 bp, Homo sapiens
attaccagggactatctttgct

SEQ ID NO: 1470402 - DNA, 23 bp, Homo sapiens
attaccagggactatctttgctg

SEQ ID NO: 1470403 - DNA, 22 bp, Homo sapiens
attaccattaattacatacaga

SEQ ID NO: 1470404 - DNA, 15 bp, Homo sapiens
attacccataaacag

SEQ ID NO: 1470405 - DNA, 13 bp, Homo sapiens
attaccccctcct

SEQ ID NO: 1470406 - DNA, 20 bp, Homo sapiens
attaccccctccttcagaca

SEQ ID NO: 1470407 - DNA, 20 bp, Homo sapiens
attacccctatacctgagcc

SEQ ID NO: 1470408 - DNA, 21 bp, Homo sapiens
attacccctatacctgagcct

SEQ ID NO: 1470409 - DNA, 23 bp, Homo sapiens
attacccctatacctgagcctca

SEQ ID NO: 1470410 - DNA, 20 bp, Homo sapiens
attacctaatttttttcctg

SEQ ID NO: 1470411 - DNA, 22 bp, Homo sapiens
attacctccatccatccttcca

SEQ ID NO: 1470412 - DNA, 21 bp, Homo sapiens
attacctggagaagaatggct

SEQ ID NO: 1470413 - DNA, 19 bp, Homo sapiens
attacctggatgttctttt

SEQ ID NO: 1470414 - DNA, 11 bp, Homo sapiens
attacctgtac

SEQ ID NO: 1470415 - DNA, 15 bp, Homo sapiens
attacctttaatttt

SEQ ID NO: 1470416 - DNA, 16 bp, Homo sapiens
attacctttaatttta

SEQ ID NO: 1470417 - DNA, 19 bp, Homo sapiens
attactaattttacacatt

SEQ ID NO: 1470418 - DNA, 20 bp, Homo sapiens
attactaattttacacatta

SEQ ID NO: 1470419 - DNA, 21 bp, Homo sapiens
attactacaaaatttgaaatt

SEQ ID NO: 1470420 - DNA, 14 bp, Homo sapiens
attactagagttgg

SEQ ID NO: 1470421 - DNA, 21 bp, Homo sapiens
attactcgatcaaaaccttcc

SEQ ID NO: 1470422 - DNA, 21 bp, Homo sapiens
attactctcattctttgaaca

SEQ ID NO: 1470423 - DNA, 21 bp, Homo sapiens
attactctttttcaataaatt

SEQ ID NO: 1470424 - DNA, 13 bp, Homo sapiens
attactgacattt

SEQ ID NO: 1470425 - DNA, 16 bp, Homo sapiens
attactgacatttctt

SEQ ID NO: 1470426 - DNA, 13 bp, Homo sapiens
attactgccattc

SEQ ID NO: 1470427 - DNA, 21 bp, Homo sapiens
attactggcctttttcattta

SEQ ID NO: 1470428 - DNA, 16 bp, Homo sapiens
attactgtcaataaac

SEQ ID NO: 1470429 - DNA, 15 bp, Homo sapiens
attactgtctttatt

SEQ ID NO: 1470430 - DNA, 12 bp, Homo sapiens
attactgtgatt

SEQ ID NO: 1470431 - DNA, 19 bp, Homo sapiens
attactgtgatttctggct

SEQ ID NO: 1470432 - DNA, 14 bp, Homo sapiens
attactgttgcatt

SEQ ID NO: 1470433 - DNA, 20 bp, Homo sapiens
attactgttgcatttacttt

SEQ ID NO: 1470434 - DNA, 20 bp, Homo sapiens
attacttaggttattttgct

SEQ ID NO: 1470435 - DNA, 21 bp, Homo sapiens
attacttaggttattttgctt

SEQ ID NO: 1470436 - DNA, 19 bp, Homo sapiens
attacttatttttgacagt

SEQ ID NO: 1470437 - DNA, 22 bp, Homo sapiens
attacttcactatacaaacaaa

SEQ ID NO: 1470438 - DNA, 22 bp, Homo sapiens
attacttgtaaataaagtctat

SEQ ID NO: 1470439 - DNA, 14 bp, Homo sapiens
attactttaaaata

SEQ ID NO: 1470440 - DNA, 23 bp, Homo sapiens
attactttggggctaatttaaca

SEQ ID NO: 1470441 - DNA, 15 bp, Homo sapiens
attactttgtctttt

SEQ ID NO: 1470442 - DNA, 18 bp, Homo sapiens
attactttgtcttttcaa

SEQ ID NO: 1470443 - DNA, 16 bp, Homo sapiens
attacttttaaatatt

SEQ ID NO: 1470444 - DNA, 18 bp, Homo sapiens
attacttttgcaaactgt

SEQ ID NO: 1470445 - DNA, 22 bp, Homo sapiens
attagaaattacctgtggatat

SEQ ID NO: 1470446 - DNA, 15 bp, Homo sapiens
attagaaattagctg

SEQ ID NO: 1470447 - DNA, 17 bp, Homo sapiens
attagaaattggctgga

SEQ ID NO: 1470448 - DNA, 12 bp, Homo sapiens
attagaatgccg

SEQ ID NO: 1470449 - DNA, 14 bp, Homo sapiens
attagaattattta

SEQ ID NO: 1470450 - DNA, 14 bp, Homo sapiens
attagacagaacac

SEQ ID NO: 1470451 - DNA, 15 bp, Homo sapiens
attagacagaacacc

SEQ ID NO: 1470452 - DNA, 18 bp, Homo sapiens
attagactgaatttaact

SEQ ID NO: 1470453 - DNA, 19 bp, Homo sapiens
attagactttagaaataaa

SEQ ID NO: 1470454 - DNA, 20 bp, Homo sapiens
attagactttagaaataaat

SEQ ID NO: 1470455 - DNA, 15 bp, Homo sapiens
attagagaacatcct

SEQ ID NO: 1470456 - DNA, 19 bp, Homo sapiens
attagagggaggagaatga

SEQ ID NO: 1470457 - DNA, 21 bp, Homo sapiens
attagagggaggagaatgagc

SEQ ID NO: 1470458 - DNA, 18 bp, Homo sapiens
attagagtatttcccttc

SEQ ID NO: 1470459 - DNA, 13 bp, Homo sapiens
attagataatatt

SEQ ID NO: 1470460 - DNA, 14 bp, Homo sapiens
attagataatattt

SEQ ID NO: 1470461 - DNA, 22 bp, Homo sapiens
attagatattaggggggaaagt

SEQ ID NO: 1470462 - DNA, 18 bp, Homo sapiens
attagatctaaacagtta

SEQ ID NO: 1470463 - DNA, 19 bp, Homo sapiens
attagatcttcaaacagaa

SEQ ID NO: 1470464 - DNA, 21 bp, Homo sapiens
attagattgcaaagcaatgaa

SEQ ID NO: 1470465 - DNA, 14 bp, Homo sapiens
attagatttgtgca

SEQ ID NO: 1470466 - DNA, 22 bp, Homo sapiens
attagcaaagcaaaaggctgag

SEQ ID NO: 1470467 - DNA, 14 bp, Homo sapiens
attagcagttgctc

SEQ ID NO: 1470468 - DNA, 23 bp, Homo sapiens
attagccaactgtttccctgctg

SEQ ID NO: 1470469 - DNA, 17 bp, Homo sapiens
attagccacaaaattgg

SEQ ID NO: 1470470 - DNA, 18 bp, Homo sapiens
attagccgggcatggtgg

SEQ ID NO: 1470471 - DNA, 15 bp, Homo sapiens
attagctttactgtt

SEQ ID NO: 1470472 - DNA, 20 bp, Homo sapiens
attagctttactgtttgtta

SEQ ID NO: 1470473 - DNA, 23 bp, Homo sapiens
attaggacaatcagtcccctccc

SEQ ID NO: 1470474 - DNA, 22 bp, Homo sapiens
attaggatctgcaaacaatgaa

SEQ ID NO: 1470475 - DNA, 17 bp, Homo sapiens
attaggctgtaactact

SEQ ID NO: 1470476 - DNA, 22 bp, Homo sapiens
attaggctgtaactactttata

SEQ ID NO: 1470477 - DNA, 16 bp, Homo sapiens
attagggagagaagat

SEQ ID NO: 1470478 - DNA, 19 bp, Homo sapiens
attagggcatttgagaaat

SEQ ID NO: 1470479 - DNA, 18 bp, Homo sapiens
attaggtagactttgctt

SEQ ID NO: 1470480 - DNA, 13 bp, Homo sapiens
attaggtgttgaa

SEQ ID NO: 1470481 - DNA, 16 bp, Homo sapiens
attagtaaatgcttat

SEQ ID NO: 1470482 - DNA, 16 bp, Homo sapiens
attcactaatcttgaa

SEQ ID NO: 1470483 - DNA, 19 bp, Homo sapiens
attcactccagtcaacaga

SEQ ID NO: 1470484 - DNA, 13 bp, Homo sapiens
attcactcccaca

SEQ ID NO: 1470485 - DNA, 19 bp, Homo sapiens
attcactcttccagaatcc

SEQ ID NO: 1470486 - DNA, 23 bp, Homo sapiens
attcacttcagtttaatgtctcc

SEQ ID NO: 1470487 - DNA, 23 bp, Homo sapiens
attcagacaacattatgatctaa

SEQ ID NO: 1470488 - DNA, 21 bp, Homo sapiens
attcagatatatttttcacag

SEQ ID NO: 1470489 - DNA, 23 bp, Homo sapiens
attcagatcactgaatttataaa

SEQ ID NO: 1470490 - DNA, 13 bp, Homo sapiens
attcagatcgaaa

SEQ ID NO: 1470491 - DNA, 20 bp, Homo sapiens
attcagatgaatagatggaa

SEQ ID NO: 1470492 - DNA, 14 bp, Homo sapiens
attcagcaaaccat

SEQ ID NO: 1470493 - DNA, 15 bp, Homo sapiens
attcagcaaatattt

SEQ ID NO: 1470494 - DNA, 14 bp, Homo sapiens
attcagcactgatt

SEQ ID NO: 1470495 - DNA, 17 bp, Homo sapiens
attcagcactgatttca

SEQ ID NO: 1470496 - DNA, 19 bp, Homo sapiens
attcagcactgatttcaca

SEQ ID NO: 1470497 - DNA, 18 bp, Homo sapiens
attcagcagcaaattttc

SEQ ID NO: 1470498 - DNA, 19 bp, Homo sapiens
attcagcagcaaattttca

SEQ ID NO: 1470499 - DNA, 21 bp, Homo sapiens
attcagcatttgatttccatg

SEQ ID NO: 1470500 - DNA, 14 bp, Homo sapiens
attcagcctgtttg

SEQ ID NO: 1470501 - DNA, 16 bp, Homo sapiens
attcagctctggagaa

SEQ ID NO: 1470502 - DNA, 21 bp, Homo sapiens
attcagctctggagaacagtg

SEQ ID NO: 1470503 - DNA, 21 bp, Homo sapiens
attcaggaatgtgtggcctgc

SEQ ID NO: 1470504 - DNA, 22 bp, Homo sapiens
attcaggacttaacggctccag

SEQ ID NO: 1470505 - DNA, 14 bp, Homo sapiens
attcaggcagcagt

SEQ ID NO: 1470506 - DNA, 17 bp, Homo sapiens
attcaggccagcccagc

SEQ ID NO: 1470507 - DNA, 19 bp, Homo sapiens
attcaggccagcccagcca

SEQ ID NO: 1470508 - DNA, 20 bp, Homo sapiens
attcaggccagcccagccag

SEQ ID NO: 1470509 - DNA, 21 bp, Homo sapiens
attcaggccagcccagccagg

SEQ ID NO: 1470510 - DNA, 16 bp, Homo sapiens
attcaggctactcatt

SEQ ID NO: 1470511 - DNA, 14 bp, Homo sapiens
attcaggtacagaa

SEQ ID NO: 1470512 - DNA, 18 bp, Homo sapiens
attcaggtacagaaaaca

SEQ ID NO: 1470513 - DNA, 13 bp, Homo sapiens
attcaggtatgtt

SEQ ID NO: 1470514 - DNA, 21 bp, Homo sapiens
attcaggtggccagaagagct

SEQ ID NO: 1470515 - DNA, 16 bp, Homo sapiens
attcagtaaacaaatt

SEQ ID NO: 1470516 - DNA, 15 bp, Homo sapiens
attcagtaataactc

SEQ ID NO: 1470517 - DNA, 13 bp, Homo sapiens
attcagtaatgca

SEQ ID NO: 1470518 - DNA, 19 bp, Homo sapiens
attcagtattaaagggggg

SEQ ID NO: 1470519 - DNA, 17 bp, Homo sapiens
attcagtctcagctgct

SEQ ID NO: 1470520 - DNA, 15 bp, Homo sapiens
attcagtcttctgga

SEQ ID NO: 1470521 - DNA, 21 bp, Homo sapiens
attcagtgagggtcttcttac

SEQ ID NO: 1470522 - DNA, 20 bp, Homo sapiens
attcagtgctgtggcctggg

SEQ ID NO: 1470523 - DNA, 17 bp, Homo sapiens
attcagtgcttcttaaa

SEQ ID NO: 1470524 - DNA, 17 bp, Homo sapiens
attcatagcatcctgat

SEQ ID NO: 1470525 - DNA, 18 bp, Homo sapiens
attcatagcatcctgatt

SEQ ID NO: 1470526 - DNA, 17 bp, Homo sapiens
attcatagtaaaatacc

SEQ ID NO: 1470527 - DNA, 18 bp, Homo sapiens
attcatagtaaaatacct

SEQ ID NO: 1470528 - DNA, 17 bp, Homo sapiens
attcatagtaagattga

SEQ ID NO: 1470529 - DNA, 17 bp, Homo sapiens
attcatagttttatatc

SEQ ID NO: 1470530 - DNA, 20 bp, Homo sapiens
attcatatttacttcttata

SEQ ID NO: 1470531 - DNA, 22 bp, Homo sapiens
attcatatttgtactttctgtt

SEQ ID NO: 1470532 - DNA, 14 bp, Homo sapiens
attcatcagcattt

SEQ ID NO: 1470533 - DNA, 13 bp, Homo sapiens
attcatccttcca

SEQ ID NO: 1470534 - DNA, 19 bp, Homo sapiens
attcatctatttcgagtgt

SEQ ID NO: 1470535 - DNA, 18 bp, Homo sapiens
attcatctgggaggcaga

SEQ ID NO: 1470536 - DNA, 17 bp, Homo sapiens
attcatcttgtgtttta

SEQ ID NO: 1470537 - DNA, 15 bp, Homo sapiens
attcatgccatctgt

SEQ ID NO: 1470538 - DNA, 20 bp, Homo sapiens
attcatgccatctgttttca

SEQ ID NO: 1470539 - DNA, 20 bp, Homo sapiens
attcatggcatgcttaaatt

SEQ ID NO: 1470540 - DNA, 13 bp, Homo sapiens
attcatgttcatg

SEQ ID NO: 1470541 - DNA, 14 bp, Homo sapiens
attcatgttcatgt

SEQ ID NO: 1470542 - DNA, 13 bp, Homo sapiens
attcattaattag

SEQ ID NO: 1470543 - DNA, 18 bp, Homo sapiens
attcattctgcattgcta

SEQ ID NO: 1470544 - DNA, 17 bp, Homo sapiens
attcattgttttgcaaa

SEQ ID NO: 1470545 - DNA, 17 bp, Homo sapiens
attcatttaaaatgatt

SEQ ID NO: 1470546 - DNA, 12 bp, Homo sapiens
attcatttcctg

SEQ ID NO: 1470547 - DNA, 14 bp, Homo sapiens
attcatttcctgcc

SEQ ID NO: 1470548 - DNA, 11 bp, Homo sapiens
attcatttgta

SEQ ID NO: 1470549 - DNA, 12 bp, Homo sapiens
attcatttgtat

SEQ ID NO: 1470550 - DNA, 18 bp, Homo sapiens
attcatttgtattgctta

SEQ ID NO: 1470551 - DNA, 18 bp, Homo sapiens
attcatttgtggcaatta

SEQ ID NO: 1470552 - DNA, 13 bp, Homo sapiens
attccaaaatatt

SEQ ID NO: 1470553 - DNA, 14 bp, Homo sapiens
attccaaacatggt

SEQ ID NO: 1470554 - DNA, 16 bp, Homo sapiens
attccaaagtctctaa

SEQ ID NO: 1470555 - DNA, 14 bp, Homo sapiens
attccaacagctca

SEQ ID NO: 1470556 - DNA, 20 bp, Homo sapiens
attccaacatttctcactga

SEQ ID NO: 1470557 - DNA, 14 bp, Homo sapiens
attccaacccagcc

SEQ ID NO: 1470558 - DNA, 20 bp, Homo sapiens
attccaactgggcatttcaa

SEQ ID NO: 1470559 - DNA, 21 bp, Homo sapiens
attccaactgggcatttcaat

SEQ ID NO: 1470560 - DNA, 19 bp, Homo sapiens
attccaagccttattttga

SEQ ID NO: 1470561 - DNA, 16 bp, Homo sapiens
attccacatctgtttc

SEQ ID NO: 1470562 - DNA, 19 bp, Homo sapiens
attccacatctgtttcaaa

SEQ ID NO: 1470563 - DNA, 23 bp, Homo sapiens
attccaccaggattaatctctaa

SEQ ID NO: 1470564 - DNA, 16 bp, Homo sapiens
attccactacacctgg

SEQ ID NO: 1470565 - DNA, 18 bp, Homo sapiens
attccactacacctggct

SEQ ID NO: 1470566 - DNA, 22 bp, Homo sapiens
attccactacacctggctgagg

SEQ ID NO: 1470567 - DNA, 13 bp, Homo sapiens
attccactgaaac

SEQ ID NO: 1470568 - DNA, 19 bp, Homo sapiens
attccagaatcttgacttt

SEQ ID NO: 1470569 - DNA, 21 bp, Homo sapiens
attccagaatcttgactttct

SEQ ID NO: 1470570 - DNA, 22 bp, Homo sapiens
attccagaatcttgactttctg

SEQ ID NO: 1470571 - DNA, 18 bp, Homo sapiens
attccagagagtggctcc

SEQ ID NO: 1470572 - DNA, 21 bp, Homo sapiens
attccagagagtggctcctcc

SEQ ID NO: 1470573 - DNA, 15 bp, Homo sapiens
attccagagtgctga

SEQ ID NO: 1470574 - DNA, 14 bp, Homo sapiens
attccagagttaaa

SEQ ID NO: 1470575 - DNA, 13 bp, Homo sapiens
attccagcccctc

SEQ ID NO: 1470576 - DNA, 16 bp, Homo sapiens
attccagctctgcccc

SEQ ID NO: 1470577 - DNA, 15 bp, Homo sapiens
attccaggaattcct

SEQ ID NO: 1470578 - DNA, 15 bp, Homo sapiens
attccagtacagtat

SEQ ID NO: 1470579 - DNA, 22 bp, Homo sapiens
attccagtcaaatctgggctca

SEQ ID NO: 1470580 - DNA, 20 bp, Homo sapiens
attccataatacataacatt

SEQ ID NO: 1470581 - DNA, 16 bp, Homo sapiens
attccatacttctctc

SEQ ID NO: 1470582 - DNA, 17 bp, Homo sapiens
attccatacttctctca

SEQ ID NO: 1470583 - DNA, 14 bp, Homo sapiens
attccatccatata

SEQ ID NO: 1470584 - DNA, 13 bp, Homo sapiens
attccatcttgta

SEQ ID NO: 1470585 - DNA, 16 bp, Homo sapiens
attccatgaatgtatc

SEQ ID NO: 1470586 - DNA, 17 bp, Homo sapiens
attccatgaatgtatca

SEQ ID NO: 1470587 - DNA, 23 bp, Homo sapiens
attccatgaatgtatcaggaaat

SEQ ID NO: 1470588 - DNA, 15 bp, Homo sapiens
attccatgagctgct

SEQ ID NO: 1470589 - DNA, 16 bp, Homo sapiens
attccatgagctgctc

SEQ ID NO: 1470590 - DNA, 21 bp, Homo sapiens
attccatgagctgctcattac

SEQ ID NO: 1470591 - DNA, 23 bp, Homo sapiens
attccattggtccaagattccgg

SEQ ID NO: 1470592 - DNA, 19 bp, Homo sapiens
attcccaagtatgccttaa

SEQ ID NO: 1470593 - DNA, 17 bp, Homo sapiens
attcccactcaccagcc

SEQ ID NO: 1470594 - DNA, 14 bp, Homo sapiens
attcccactgccag

SEQ ID NO: 1470595 - DNA, 12 bp, Homo sapiens
attcccagagac

SEQ ID NO: 1470596 - DNA, 16 bp, Homo sapiens
attcccagagacagga

SEQ ID NO: 1470597 - DNA, 14 bp, Homo sapiens
attctagtcaactg

SEQ ID NO: 1470598 - DNA, 20 bp, Homo sapiens
attctagtcaactgctgttt

SEQ ID NO: 1470599 - DNA, 16 bp, Homo sapiens
attctagtctctgatt

SEQ ID NO: 1470600 - DNA, 23 bp, Homo sapiens
attctagtctctgatttgcaaat

SEQ ID NO: 1470601 - DNA, 17 bp, Homo sapiens
attctagttttgtcaaa

SEQ ID NO: 1470602 - DNA, 19 bp, Homo sapiens
attctatatgaatttaaat

SEQ ID NO: 1470603 - DNA, 23 bp, Homo sapiens
attctatatgaatttaaatataa

SEQ ID NO: 1470604 - DNA, 15 bp, Homo sapiens
attctatgagaacaa

SEQ ID NO: 1470605 - DNA, 21 bp, Homo sapiens
attctatgcctgtatttccaa

SEQ ID NO: 1470606 - DNA, 15 bp, Homo sapiens
attctatttgctggg

SEQ ID NO: 1470607 - DNA, 18 bp, Homo sapiens
attctatttgctgggctt

SEQ ID NO: 1470608 - DNA, 17 bp, Homo sapiens
attctcaaaggagcgag

SEQ ID NO: 1470609 - DNA, 22 bp, Homo sapiens
attctcaagacctgagtatttt

SEQ ID NO: 1470610 - DNA, 17 bp, Homo sapiens
attctcaccctgtgaaa

SEQ ID NO: 1470611 - DNA, 14 bp, Homo sapiens
attctcactccacc

SEQ ID NO: 1470612 - DNA, 15 bp, Homo sapiens
attctcactccacca

SEQ ID NO: 1470613 - DNA, 13 bp, Homo sapiens
attctcagaattc

SEQ ID NO: 1470614 - DNA, 22 bp, Homo sapiens
attctcagaattcggtgtgctg

SEQ ID NO: 1470615 - DNA, 12 bp, Homo sapiens
attctcattaaa

SEQ ID NO: 1470616 - DNA, 17 bp, Homo sapiens
attctcatttgttctca

SEQ ID NO: 1470617 - DNA, 22 bp, Homo sapiens
attctcccaggtaccagctgcg

SEQ ID NO: 1470618 - DNA, 12 bp, Homo sapiens
attctcccctcc

SEQ ID NO: 1470619 - DNA, 14 bp, Homo sapiens
attctcccctccct

SEQ ID NO: 1470620 - DNA, 17 bp, Homo sapiens
attctcccgcctcagcc

SEQ ID NO: 1470621 - DNA, 19 bp, Homo sapiens
attctcccgcttcctggcc

SEQ ID NO: 1470622 - DNA, 15 bp, Homo sapiens
attctccctgacctt

SEQ ID NO: 1470623 - DNA, 15 bp, Homo sapiens
attctcctgcctcag

SEQ ID NO: 1470624 - DNA, 18 bp, Homo sapiens
attctcctgcctcagcct

SEQ ID NO: 1470625 - DNA, 11 bp, Homo sapiens
attctcctgga

SEQ ID NO: 1470626 - DNA, 19 bp, Homo sapiens
attctcctgtctcagcctc

SEQ ID NO: 1470627 - DNA, 23 bp, Homo sapiens
attctcctgtctcagcctcctga

SEQ ID NO: 1470628 - DNA, 14 bp, Homo sapiens
attctcctgtgcta

SEQ ID NO: 1470629 - DNA, 13 bp, Homo sapiens
attctccttcagc

SEQ ID NO: 1470630 - DNA, 17 bp, Homo sapiens
attctccttcagccctc

SEQ ID NO: 1470631 - DNA, 18 bp, Homo sapiens
attctccttcagccctca

SEQ ID NO: 1470632 - DNA, 16 bp, Homo sapiens
attctcggggccctgt

SEQ ID NO: 1470633 - DNA, 19 bp, Homo sapiens
attctctccaaaaatgcac

SEQ ID NO: 1470634 - DNA, 20 bp, Homo sapiens
attctctcccatcctggggc

SEQ ID NO: 1470635 - DNA, 12 bp, Homo sapiens
attctctctcct

SEQ ID NO: 1470636 - DNA, 15 bp, Homo sapiens
attctctctcctgtc

SEQ ID NO: 1470637 - DNA, 20 bp, Homo sapiens
attctctggctgtaaggctc

SEQ ID NO: 1470638 - DNA, 14 bp, Homo sapiens
attctctgtaagtg

SEQ ID NO: 1470639 - DNA, 11 bp, Homo sapiens
attctctgtgg

SEQ ID NO: 1470640 - DNA, 18 bp, Homo sapiens
attctctgtgtctaagat

SEQ ID NO: 1470641 - DNA, 20 bp, Homo sapiens
attctctgtgtctaagattc

SEQ ID NO: 1470642 - DNA, 22 bp, Homo sapiens
attctctgtgtctaagattcta

SEQ ID NO: 1470643 - DNA, 23 bp, Homo sapiens
attctctgtgtctaagattctag

SEQ ID NO: 1470644 - DNA, 14 bp, Homo sapiens
attctcttatccaa

SEQ ID NO: 1470645 - DNA, 16 bp, Homo sapiens
attctcttcttgctat

SEQ ID NO: 1470646 - DNA, 22 bp, Homo sapiens
attctcttgagataaggtttta

SEQ ID NO: 1470647 - DNA, 22 bp, Homo sapiens
attctcttgtataagatcctag

SEQ ID NO: 1470648 - DNA, 17 bp, Homo sapiens
attctctttaaaaaaga

SEQ ID NO: 1470649 - DNA, 20 bp, Homo sapiens
attctctttaccttctaaaa

SEQ ID NO: 1470650 - DNA, 12 bp, Homo sapiens
attctcttttaa

SEQ ID NO: 1470651 - DNA, 19 bp, Homo sapiens
attctgaaaactgaatgtc

SEQ ID NO: 1470652 - DNA, 22 bp, Homo sapiens
attctgaaaactgaatgtcaag

SEQ ID NO: 1470653 - DNA, 14 bp, Homo sapiens
attctgaaccagaa

SEQ ID NO: 1470654 - DNA, 14 bp, Homo sapiens
attctgaatctcaa

SEQ ID NO: 1470655 - DNA, 18 bp, Homo sapiens
attctgaccgttaaaaaa

SEQ ID NO: 1470656 - DNA, 15 bp, Homo sapiens
attctgactgtccag

SEQ ID NO: 1470657 - DNA, 17 bp, Homo sapiens
attctgaggaagtctta

SEQ ID NO: 1470658 - DNA, 15 bp, Homo sapiens
attctgaggccctgc

SEQ ID NO: 1470659 - DNA, 18 bp, Homo sapiens
attctgaggccctgccca

SEQ ID NO: 1470660 - DNA, 23 bp, Homo sapiens
attctgagttttgtgtttgttgt

SEQ ID NO: 1470661 - DNA, 17 bp, Homo sapiens
attctgatgtttctgtg

SEQ ID NO: 1470662 - DNA, 18 bp, Homo sapiens
attctgattagagatata

SEQ ID NO: 1470663 - DNA, 13 bp, Homo sapiens
attctgatttcag

SEQ ID NO: 1470664 - DNA, 19 bp, Homo sapiens
attctgatttcagtttttc

SEQ ID NO: 1470665 - DNA, 23 bp, Homo sapiens
attctgatttcagtttttcattt

SEQ ID NO: 1470666 - DNA, 19 bp, Homo sapiens
attctgatttggaaaaaga

SEQ ID NO: 1470667 - DNA, 13 bp, Homo sapiens
attctgcagcatg

SEQ ID NO: 1470668 - DNA, 22 bp, Homo sapiens
attctgcattgctagataaaag

SEQ ID NO: 1470669 - DNA, 18 bp, Homo sapiens
attctgcccaaaaatatg

SEQ ID NO: 1470670 - DNA, 19 bp, Homo sapiens
attctgcccaaaaatatgg

SEQ ID NO: 1470671 - DNA, 17 bp, Homo sapiens
attctgccctccttaat

SEQ ID NO: 1470672 - DNA, 20 bp, Homo sapiens
attctgccgccccctcctga

SEQ ID NO: 1470673 - DNA, 22 bp, Homo sapiens
attctgccgccccctcctgaac

SEQ ID NO: 1470674 - DNA, 17 bp, Homo sapiens
attctgcctagagtgta

SEQ ID NO: 1470675 - DNA, 18 bp, Homo sapiens
attctgcctatgtaaaat

SEQ ID NO: 1470676 - DNA, 20 bp, Homo sapiens
attctgcctcagcctcctga

SEQ ID NO: 1470677 - DNA, 22 bp, Homo sapiens
attctgcctcagcctcctgagt

SEQ ID NO: 1470678 - DNA, 19 bp, Homo sapiens
attctgctacctcactggg

SEQ ID NO: 1470679 - DNA, 16 bp, Homo sapiens
attctgcttgtgacat

SEQ ID NO: 1470680 - DNA, 20 bp, Homo sapiens
attctggaggggagagcttt

SEQ ID NO: 1470681 - DNA, 18 bp, Homo sapiens
attctggatctcctgctg

SEQ ID NO: 1470682 - DNA, 19 bp, Homo sapiens
attctggatctcctgctgc

SEQ ID NO: 1470683 - DNA, 14 bp, Homo sapiens
attctggcccagcc

SEQ ID NO: 1470684 - DNA, 16 bp, Homo sapiens
attctggctttaagcc

SEQ ID NO: 1470685 - DNA, 19 bp, Homo sapiens
attctgggaggcaagaaaa

SEQ ID NO: 1470686 - DNA, 19 bp, Homo sapiens
attctgggctcctggaacc

SEQ ID NO: 1470687 - DNA, 18 bp, Homo sapiens
attctgggcttggggtgt

SEQ ID NO: 1470688 - DNA, 16 bp, Homo sapiens
attctggttccagggt

SEQ ID NO: 1470689 - DNA, 15 bp, Homo sapiens
attctgtagattctg

SEQ ID NO: 1470690 - DNA, 20 bp, Homo sapiens
attctgtatctttcatcctt

SEQ ID NO: 1470691 - DNA, 18 bp, Homo sapiens
attctgtcatagaaagtg

SEQ ID NO: 1470692 - DNA, 21 bp, Homo sapiens
attctgtcttgttcattttga

SEQ ID NO: 1470693 - DNA, 20 bp, Homo sapiens
attctgtgatcttttaaagt

SEQ ID NO: 1470694 - DNA, 14 bp, Homo sapiens
attctgtgccattt

SEQ ID NO: 1470695 - DNA, 17 bp, Homo sapiens
attctgtggattctata

SEQ ID NO: 1470696 - DNA, 19 bp, Homo sapiens
attctgtggattctatatt

SEQ ID NO: 1470697 - DNA, 20 bp, Homo sapiens
attctgtgtgtgactctggg

SEQ ID NO: 1470698 - DNA, 17 bp, Homo sapiens
attctgtgttttatcta

SEQ ID NO: 1470699 - DNA, 18 bp, Homo sapiens
attctgttactttgctat

SEQ ID NO: 1470700 - DNA, 16 bp, Homo sapiens
attctgttgttccatt

SEQ ID NO: 1470701 - DNA, 20 bp, Homo sapiens
attctgttgttccattttat

SEQ ID NO: 1470702 - DNA, 23 bp, Homo sapiens
attctgttgttccattttatgca

SEQ ID NO: 1470703 - DNA, 12 bp, Homo sapiens
attctgttttgc

SEQ ID NO: 1470704 - DNA, 14 bp, Homo sapiens
attcttaaaaattg

SEQ ID NO: 1470705 - DNA, 23 bp, Homo sapiens
attcttaaaaggcccatagcagc

SEQ ID NO: 1470706 - DNA, 22 bp, Homo sapiens
attcttacaattgcactgctgt

SEQ ID NO: 1470707 - DNA, 15 bp, Homo sapiens
attcttacatgtttt

SEQ ID NO: 1470708 - DNA, 17 bp, Homo sapiens
attcttacatgttttct

SEQ ID NO: 1470709 - DNA, 20 bp, Homo sapiens
attcttactgttaaccaaat

SEQ ID NO: 1470710 - DNA, 23 bp, Homo sapiens
attcttagatacactaaaaatct

SEQ ID NO: 1470711 - DNA, 20 bp, Homo sapiens
attggccactgggtctcact

SEQ ID NO: 1470712 - DNA, 14 bp, Homo sapiens
attggcctctgtat

SEQ ID NO: 1470713 - DNA, 12 bp, Homo sapiens
attggcctggcc

SEQ ID NO: 1470714 - DNA, 12 bp, Homo sapiens
attggcctgtag

SEQ ID NO: 1470715 - DNA, 22 bp, Homo sapiens
attggcctgtagagttgctgag

SEQ ID NO: 1470716 - DNA, 23 bp, Homo sapiens
attggcctgtagagttgctgaga

SEQ ID NO: 1470717 - DNA, 15 bp, Homo sapiens
attggctataacatg

SEQ ID NO: 1470718 - DNA, 19 bp, Homo sapiens
attggctatgatggtgaca

SEQ ID NO: 1470719 - DNA, 13 bp, Homo sapiens
attggctcacact

SEQ ID NO: 1470720 - DNA, 17 bp, Homo sapiens
attggctcacactgaga

SEQ ID NO: 1470721 - DNA, 22 bp, Homo sapiens
attggctgcttaaactggaaag

SEQ ID NO: 1470722 - DNA, 19 bp, Homo sapiens
attggctggttaatgggaa

SEQ ID NO: 1470723 - DNA, 22 bp, Homo sapiens
attggcttccagattttaaatt

SEQ ID NO: 1470724 - DNA, 23 bp, Homo sapiens
attggctttaaacacccttcaca

SEQ ID NO: 1470725 - DNA, 18 bp, Homo sapiens
attgggagcttgggaatg

SEQ ID NO: 1470726 - DNA, 19 bp, Homo sapiens
attgggccttttggatatg

SEQ ID NO: 1470727 - DNA, 17 bp, Homo sapiens
attgggcttcaatcact

SEQ ID NO: 1470728 - DNA, 12 bp, Homo sapiens
attggggaggag

SEQ ID NO: 1470729 - DNA, 19 bp, Homo sapiens
attggtaaaaacagcagct

SEQ ID NO: 1470730 - DNA, 20 bp, Homo sapiens
attggtaaggcctctggact

SEQ ID NO: 1470731 - DNA, 15 bp, Homo sapiens
attggtaattacctg

SEQ ID NO: 1470732 - DNA, 19 bp, Homo sapiens
attggtatagccatgattt

SEQ ID NO: 1470733 - DNA, 15 bp, Homo sapiens
attggtccagcttgc

SEQ ID NO: 1470734 - DNA, 13 bp, Homo sapiens
attggtggaattc

SEQ ID NO: 1470735 - DNA, 21 bp, Homo sapiens
attggtggcagattttacaaa

SEQ ID NO: 1470736 - DNA, 20 bp, Homo sapiens
attggtgttcgtttccatca

SEQ ID NO: 1470737 - DNA, 23 bp, Homo sapiens
attggttggaagctaccagagct

SEQ ID NO: 1470738 - DNA, 16 bp, Homo sapiens
attggttggcaaacta

SEQ ID NO: 1470739 - DNA, 14 bp, Homo sapiens
attggttgtgcctt

SEQ ID NO: 1470740 - DNA, 23 bp, Homo sapiens
attggttgtgccttcccttctct

SEQ ID NO: 1470741 - DNA, 15 bp, Homo sapiens
attggttttcctgtg

SEQ ID NO: 1470742 - DNA, 16 bp, Homo sapiens
attggtttttactgaa

SEQ ID NO: 1470743 - DNA, 15 bp, Homo sapiens
attggtttttttgta

SEQ ID NO: 1470744 - DNA, 14 bp, Homo sapiens
attgtaaaacaggt

SEQ ID NO: 1470745 - DNA, 23 bp, Homo sapiens
attgtaaaaccccatctctacta

SEQ ID NO: 1470746 - DNA, 14 bp, Homo sapiens
attgtaaaactttg

SEQ ID NO: 1470747 - DNA, 13 bp, Homo sapiens
attgtaaatactg

SEQ ID NO: 1470748 - DNA, 15 bp, Homo sapiens
attgtaaatactgga

SEQ ID NO: 1470749 - DNA, 18 bp, Homo sapiens
attgtaaatactggactc

SEQ ID NO: 1470750 - DNA, 14 bp, Homo sapiens
attgtaaatagtat

SEQ ID NO: 1470751 - DNA, 14 bp, Homo sapiens
attgtaaatcactt

SEQ ID NO: 1470752 - DNA, 15 bp, Homo sapiens
attgtaaatgtgctt

SEQ ID NO: 1470753 - DNA, 18 bp, Homo sapiens
attgtaagtgaaattaag

SEQ ID NO: 1470754 - DNA, 12 bp, Homo sapiens
attgtaatgttg

SEQ ID NO: 1470755 - DNA, 20 bp, Homo sapiens
attgtaatgttgtgaataat

SEQ ID NO: 1470756 - DNA, 23 bp, Homo sapiens
attgtaatgttgtgaataattac

SEQ ID NO: 1470757 - DNA, 18 bp, Homo sapiens
attgtacaaaattaagca

SEQ ID NO: 1470758 - DNA, 21 bp, Homo sapiens
attgtacaaaattaagcaaat

SEQ ID NO: 1470759 - DNA, 22 bp, Homo sapiens
attgtacaaaattaagcaaatg

SEQ ID NO: 1470760 - DNA, 12 bp, Homo sapiens
attgtacaataa

SEQ ID NO: 1470761 - DNA, 13 bp, Homo sapiens
attgtacaataaa

SEQ ID NO: 1470762 - DNA, 14 bp, Homo sapiens
attgtacaataaat

SEQ ID NO: 1470763 - DNA, 22 bp, Homo sapiens
attgtacagactgttttactgt

SEQ ID NO: 1470764 - DNA, 12 bp, Homo sapiens
attgtacataaa

SEQ ID NO: 1470765 - DNA, 15 bp, Homo sapiens
attgtacataaaaga

SEQ ID NO: 1470766 - DNA, 19 bp, Homo sapiens
attgtactgttgctttaat

SEQ ID NO: 1470767 - DNA, 14 bp, Homo sapiens
attgtacttagcca

SEQ ID NO: 1470768 - DNA, 23 bp, Homo sapiens
attgtacttagccagttcaaagt

SEQ ID NO: 1470769 - DNA, 19 bp, Homo sapiens
attgtagaaacacagtttt

SEQ ID NO: 1470770 - DNA, 20 bp, Homo sapiens
attgtaggcagtggccccta

SEQ ID NO: 1470771 - DNA, 19 bp, Homo sapiens
attgtagggttattagtcc

SEQ ID NO: 1470772 - DNA, 22 bp, Homo sapiens
attgtagttctgtgtacttttt

SEQ ID NO: 1470773 - DNA, 21 bp, Homo sapiens
attgtataaaaagtttcacag

SEQ ID NO: 1470774 - DNA, 14 bp, Homo sapiens
attgtataagtcaa

SEQ ID NO: 1470775 - DNA, 17 bp, Homo sapiens
attgtataagtcaagca

SEQ ID NO: 1470776 - DNA, 20 bp, Homo sapiens
attgtatatatattcatata

SEQ ID NO: 1470777 - DNA, 15 bp, Homo sapiens
attgtatattgtaat

SEQ ID NO: 1470778 - DNA, 17 bp, Homo sapiens
attgtatattgtaattt

SEQ ID NO: 1470779 - DNA, 14 bp, Homo sapiens
attgtatcatttga

SEQ ID NO: 1470780 - DNA, 15 bp, Homo sapiens
attgtatgcagggag

SEQ ID NO: 1470781 - DNA, 17 bp, Homo sapiens
attgtattaggaaaata

SEQ ID NO: 1470782 - DNA, 14 bp, Homo sapiens
attgtattgaaaac

SEQ ID NO: 1470783 - DNA, 17 bp, Homo sapiens
attgtattgaaaacact

SEQ ID NO: 1470784 - DNA, 14 bp, Homo sapiens
attgtcagatattt

SEQ ID NO: 1470785 - DNA, 19 bp, Homo sapiens
attgtccaggtgaggccca

SEQ ID NO: 1470786 - DNA, 13 bp, Homo sapiens
attgtcctccttt

SEQ ID NO: 1470787 - DNA, 13 bp, Homo sapiens
attgtccttcaga

SEQ ID NO: 1470788 - DNA, 15 bp, Homo sapiens
attgtccttcagagc

SEQ ID NO: 1470789 - DNA, 18 bp, Homo sapiens
attgtccttcagagctct

SEQ ID NO: 1470790 - DNA, 22 bp, Homo sapiens
attgtcgaaaagagtcttccaa

SEQ ID NO: 1470791 - DNA, 18 bp, Homo sapiens
attgtctacatagtgaca

SEQ ID NO: 1470792 - DNA, 18 bp, Homo sapiens
attgtctactcctagaag

SEQ ID NO: 1470793 - DNA, 13 bp, Homo sapiens
attgtctatttat

SEQ ID NO: 1470794 - DNA, 18 bp, Homo sapiens
attgtctcctatatattt

SEQ ID NO: 1470795 - DNA, 18 bp, Homo sapiens
attgtctgaacttgcatt

SEQ ID NO: 1470796 - DNA, 16 bp, Homo sapiens
attgtctgctgatgca

SEQ ID NO: 1470797 - DNA, 14 bp, Homo sapiens
attgtctgtctaca

SEQ ID NO: 1470798 - DNA, 19 bp, Homo sapiens
attgtctgtctacatttct

SEQ ID NO: 1470799 - DNA, 13 bp, Homo sapiens
attgtctgtctct

SEQ ID NO: 1470800 - DNA, 13 bp, Homo sapiens
attgtctttgaat

SEQ ID NO: 1470801 - DNA, 22 bp, Homo sapiens
attgtcttttagacaactagat

SEQ ID NO: 1470802 - DNA, 17 bp, Homo sapiens
attgtcttttttttcct

SEQ ID NO: 1470803 - DNA, 18 bp, Homo sapiens
attgtcttttttttcctt

SEQ ID NO: 1470804 - DNA, 20 bp, Homo sapiens
attgtcttttttttcctttg

SEQ ID NO: 1470805 - DNA, 22 bp, Homo sapiens
attgtcttttttttcctttgaa

SEQ ID NO: 1470806 - DNA, 22 bp, Homo sapiens
attgtgaaccctagctgtgtca

SEQ ID NO: 1470807 - DNA, 15 bp, Homo sapiens
attgtgaagtacata

SEQ ID NO: 1470808 - DNA, 17 bp, Homo sapiens
attgtgaccaatacatt

SEQ ID NO: 1470809 - DNA, 20 bp, Homo sapiens
attgtgaccaatacatttgt

SEQ ID NO: 1470810 - DNA, 22 bp, Homo sapiens
attgtgaccaatacatttgtat

SEQ ID NO: 1470811 - DNA, 15 bp, Homo sapiens
attgtgacttcactg

SEQ ID NO: 1470812 - DNA, 13 bp, Homo sapiens
attgtgatgtgtc

SEQ ID NO: 1470813 - DNA, 13 bp, Homo sapiens
attgtgctgccat

SEQ ID NO: 1470814 - DNA, 15 bp, Homo sapiens
attgtgcttcacagt

SEQ ID NO: 1470815 - DNA, 24 bp, Homo sapiens
attgtgcttcacagtagagccagc

SEQ ID NO: 1470816 - DNA, 16 bp, Homo sapiens
attgtggaaaaccagg

SEQ ID NO: 1470817 - DNA, 17 bp, Homo sapiens
attgtggattaatgtca

SEQ ID NO: 1470818 - DNA, 23 bp, Homo sapiens
attgtggattataaaaaatgtaa

SEQ ID NO: 1470819 - DNA, 19 bp, Homo sapiens
attgtggctcctatctgtg

SEQ ID NO: 1470820 - DNA, 14 bp, Homo sapiens
attgtggtgggccc

SEQ ID NO: 1470821 - DNA, 17 bp, Homo sapiens
attgtgtaaaaaatgga

SEQ ID NO: 1470822 - DNA, 19 bp, Homo sapiens
attgtgtaaaaaatggaaa

SEQ ID NO: 1470823 - DNA, 22 bp, Homo sapiens
attgtgtaaaaaatggaaaaaa

SEQ ID NO: 1470824 - DNA, 14 bp, Homo sapiens
attgtgtacataga

SEQ ID NO: 1470825 - DNA, 15 bp, Homo sapiens
attgtgtagcctttt

SEQ ID NO: 1470826 - DNA, 18 bp, Homo sapiens
atttatgacctaagtcag

SEQ ID NO: 1470827 - DNA, 18 bp, Homo sapiens
atttatgagtttttgata

SEQ ID NO: 1470828 - DNA, 18 bp, Homo sapiens
atttatgatcacttggaa

SEQ ID NO: 1470829 - DNA, 16 bp, Homo sapiens
atttatgcaaggtatt

SEQ ID NO: 1470830 - DNA, 15 bp, Homo sapiens
atttatgcactgtgg

SEQ ID NO: 1470831 - DNA, 15 bp, Homo sapiens
atttatgcatttcat

SEQ ID NO: 1470832 - DNA, 20 bp, Homo sapiens
atttatgcctctgtatttaa

SEQ ID NO: 1470833 - DNA, 16 bp, Homo sapiens
atttatgggcccctgg

SEQ ID NO: 1470834 - DNA, 12 bp, Homo sapiens
atttatgtagat

SEQ ID NO: 1470835 - DNA, 21 bp, Homo sapiens
atttatgtgtagaatttgaaa

SEQ ID NO: 1470836 - DNA, 23 bp, Homo sapiens
atttattaaacagatttttacaa

SEQ ID NO: 1470837 - DNA, 15 bp, Homo sapiens
atttattaagtctgg

SEQ ID NO: 1470838 - DNA, 14 bp, Homo sapiens
atttattaatattt

SEQ ID NO: 1470839 - DNA, 19 bp, Homo sapiens
atttattactaacctccct

SEQ ID NO: 1470840 - DNA, 13 bp, Homo sapiens
atttattatttat

SEQ ID NO: 1470841 - DNA, 14 bp, Homo sapiens
atttattcactgta

SEQ ID NO: 1470842 - DNA, 16 bp, Homo sapiens
atttattgaaattttt

SEQ ID NO: 1470843 - DNA, 19 bp, Homo sapiens
atttattgactttgacaat

SEQ ID NO: 1470844 - DNA, 21 bp, Homo sapiens
atttattgcaggatggtgtct

SEQ ID NO: 1470845 - DNA, 13 bp, Homo sapiens
atttattgtatta

SEQ ID NO: 1470846 - DNA, 17 bp, Homo sapiens
atttattgtctgtctac

SEQ ID NO: 1470847 - DNA, 23 bp, Homo sapiens
atttattgtctgtctacatttct

SEQ ID NO: 1470848 - DNA, 23 bp, Homo sapiens
atttattgttagaaaatgactta

SEQ ID NO: 1470849 - DNA, 17 bp, Homo sapiens
atttattgtttatgtaa

SEQ ID NO: 1470850 - DNA, 13 bp, Homo sapiens
atttatttaaaag

SEQ ID NO: 1470851 - DNA, 14 bp, Homo sapiens
atttatttaaaaga

SEQ ID NO: 1470852 - DNA, 16 bp, Homo sapiens
atttatttaaaagatt

SEQ ID NO: 1470853 - DNA, 12 bp, Homo sapiens
atttatttaaat

SEQ ID NO: 1470854 - DNA, 15 bp, Homo sapiens
atttatttaatattt

SEQ ID NO: 1470855 - DNA, 19 bp, Homo sapiens
atttatttatgaaaaaata

SEQ ID NO: 1470856 - DNA, 15 bp, Homo sapiens
atttatttatgtact

SEQ ID NO: 1470857 - DNA, 15 bp, Homo sapiens
atttatttccagtgg

SEQ ID NO: 1470858 - DNA, 12 bp, Homo sapiens
atttatttggag

SEQ ID NO: 1470859 - DNA, 20 bp, Homo sapiens
atttattttataagaaaaac

SEQ ID NO: 1470860 - DNA, 19 bp, Homo sapiens
atttattttattctatgta

SEQ ID NO: 1470861 - DNA, 21 bp, Homo sapiens
atttattttattctatgtatg

SEQ ID NO: 1470862 - DNA, 21 bp, Homo sapiens
atttattttatttatttaatt

SEQ ID NO: 1470863 - DNA, 14 bp, Homo sapiens
atttattttcagta

SEQ ID NO: 1470864 - DNA, 22 bp, Homo sapiens
atttattttcagtatactgtgt

SEQ ID NO: 1470865 - DNA, 17 bp, Homo sapiens
atttattttcctaaaga

SEQ ID NO: 1470866 - DNA, 20 bp, Homo sapiens
atttattttgactgtgattt

SEQ ID NO: 1470867 - DNA, 14 bp, Homo sapiens
atttattttttaca

SEQ ID NO: 1470868 - DNA, 22 bp, Homo sapiens
atttcaaaatacatttgtaagt

SEQ ID NO: 1470869 - DNA, 19 bp, Homo sapiens
atttcaaacatcagctgaa

SEQ ID NO: 1470870 - DNA, 22 bp, Homo sapiens
atttcaaacatcagctgaattc

SEQ ID NO: 1470871 - DNA, 23 bp, Homo sapiens
atttcaaacatcagctgaattca

SEQ ID NO: 1470872 - DNA, 20 bp, Homo sapiens
atttcaaagccctgcctctg

SEQ ID NO: 1470873 - DNA, 21 bp, Homo sapiens
atttcaaagccctgcctctgt

SEQ ID NO: 1470874 - DNA, 12 bp, Homo sapiens
atttcaaatgta

SEQ ID NO: 1470875 - DNA, 15 bp, Homo sapiens
atttcaacaagaata

SEQ ID NO: 1470876 - DNA, 21 bp, Homo sapiens
atttcaacaagaatattgtat

SEQ ID NO: 1470877 - DNA, 18 bp, Homo sapiens
atttcaacatgagtgtat

SEQ ID NO: 1470878 - DNA, 15 bp, Homo sapiens
atttcaagaccttct

SEQ ID NO: 1470879 - DNA, 19 bp, Homo sapiens
atttcaagagatttaatta

SEQ ID NO: 1470880 - DNA, 22 bp, Homo sapiens
atttcaatcccacgtacttata

SEQ ID NO: 1470881 - DNA, 15 bp, Homo sapiens
atttcaatcttttaa

SEQ ID NO: 1470882 - DNA, 13 bp, Homo sapiens
atttcacaacaga

SEQ ID NO: 1470883 - DNA, 19 bp, Homo sapiens
atttcacagagcacgcctg

SEQ ID NO: 1470884 - DNA, 15 bp, Homo sapiens
atttcacagcctttc

SEQ ID NO: 1470885 - DNA, 17 bp, Homo sapiens
atttcacagtgcccaag

SEQ ID NO: 1470886 - DNA, 13 bp, Homo sapiens
atttcacattaat

SEQ ID NO: 1470887 - DNA, 16 bp, Homo sapiens
atttcacctgtgacaa

SEQ ID NO: 1470888 - DNA, 22 bp, Homo sapiens
atttcacctgtgacaaaggatg

SEQ ID NO: 1470889 - DNA, 15 bp, Homo sapiens
atttcactaggactc

SEQ ID NO: 1470890 - DNA, 19 bp, Homo sapiens
atttcagaaaatgaaaaat

SEQ ID NO: 1470891 - DNA, 12 bp, Homo sapiens
atttcagaagtt

SEQ ID NO: 1470892 - DNA, 18 bp, Homo sapiens
atttcagactcccattcc

SEQ ID NO: 1470893 - DNA, 23 bp, Homo sapiens
atttcagactcccattcctgaag

SEQ ID NO: 1470894 - DNA, 16 bp, Homo sapiens
atttcagactgcagag

SEQ ID NO: 1470895 - DNA, 19 bp, Homo sapiens
atttcagagagaatcaaga

SEQ ID NO: 1470896 - DNA, 15 bp, Homo sapiens
atttcagaggctgca

SEQ ID NO: 1470897 - DNA, 17 bp, Homo sapiens
atttcagaggctgcagg

SEQ ID NO: 1470898 - DNA, 14 bp, Homo sapiens
atttcaggaattta

SEQ ID NO: 1470899 - DNA, 22 bp, Homo sapiens
atttcaggatactctgtcagat

SEQ ID NO: 1470900 - DNA, 19 bp, Homo sapiens
atttcaggcattttgttct

SEQ ID NO: 1470901 - DNA, 19 bp, Homo sapiens
atttcaggggtcgtcacca

SEQ ID NO: 1470902 - DNA, 21 bp, Homo sapiens
atttcagtggaatagatgtct

SEQ ID NO: 1470903 - DNA, 14 bp, Homo sapiens
atttcagtggcttc

SEQ ID NO: 1470904 - DNA, 15 bp, Homo sapiens
atttcagtggcttcc

SEQ ID NO: 1470905 - DNA, 17 bp, Homo sapiens
atttcagtgtaaagtgt

SEQ ID NO: 1470906 - DNA, 19 bp, Homo sapiens
atttcagtgttacctgtgt

SEQ ID NO: 1470907 - DNA, 21 bp, Homo sapiens
atttcagtgttacctgtgtgc

SEQ ID NO: 1470908 - DNA, 15 bp, Homo sapiens
atttcagtttttcat

SEQ ID NO: 1470909 - DNA, 16 bp, Homo sapiens
atttcagtttttcatt

SEQ ID NO: 1470910 - DNA, 19 bp, Homo sapiens
atttcagtttttcatttgt

SEQ ID NO: 1470911 - DNA, 22 bp, Homo sapiens
atttcatacaacagaaaccaga

SEQ ID NO: 1470912 - DNA, 20 bp, Homo sapiens
atttcatacctatcatctta

SEQ ID NO: 1470913 - DNA, 18 bp, Homo sapiens
atttcatcattgtttctg

SEQ ID NO: 1470914 - DNA, 13 bp, Homo sapiens
atttcatctattt

SEQ ID NO: 1470915 - DNA, 14 bp, Homo sapiens
atttcatctatttc

SEQ ID NO: 1470916 - DNA, 15 bp, Homo sapiens
atttcatctatttct

SEQ ID NO: 1470917 - DNA, 11 bp, Homo sapiens
atttcatctgc

SEQ ID NO: 1470918 - DNA, 19 bp, Homo sapiens
atttcatctgctctccttc

SEQ ID NO: 1470919 - DNA, 14 bp, Homo sapiens
atttcatcttctgg

SEQ ID NO: 1470920 - DNA, 16 bp, Homo sapiens
atttcatcttctggaa

SEQ ID NO: 1470921 - DNA, 20 bp, Homo sapiens
atttcatcttctggaatatt

SEQ ID NO: 1470922 - DNA, 19 bp, Homo sapiens
atttcatgaaaaagctgct

SEQ ID NO: 1470923 - DNA, 15 bp, Homo sapiens
atttcatgatttcat

SEQ ID NO: 1470924 - DNA, 18 bp, Homo sapiens
atttcatgctatctctgt

SEQ ID NO: 1470925 - DNA, 14 bp, Homo sapiens
atttcatgtgtcaa

SEQ ID NO: 1470926 - DNA, 15 bp, Homo sapiens
atttcattcaaatca

SEQ ID NO: 1470927 - DNA, 23 bp, Homo sapiens
atttcatttccaactcaggttaa

SEQ ID NO: 1470928 - DNA, 21 bp, Homo sapiens
atttcattttgtaacaaatga

SEQ ID NO: 1470929 - DNA, 15 bp, Homo sapiens
atttccaaaagcaca

SEQ ID NO: 1470930 - DNA, 20 bp, Homo sapiens
atttccaacaccacagacac

SEQ ID NO: 1470931 - DNA, 22 bp, Homo sapiens
atttccaacaccacagacacac

SEQ ID NO: 1470932 - DNA, 21 bp, Homo sapiens
atttccaccaagggtatctgc

SEQ ID NO: 1470933 - DNA, 14 bp, Homo sapiens
atttccactatttt

SEQ ID NO: 1470934 - DNA, 20 bp, Homo sapiens
atttccactattttcaaaga

SEQ ID NO: 1470935 - DNA, 21 bp, Homo sapiens
atttccactattttcaaagaa

SEQ ID NO: 1470936 - DNA, 14 bp, Homo sapiens
atttccactgaaca

SEQ ID NO: 1470937 - DNA, 20 bp, Homo sapiens
atttccaggaaaaaataaaa

SEQ ID NO: 1470938 - DNA, 13 bp, Homo sapiens
atttccaggcccc

SEQ ID NO: 1470939 - DNA, 22 bp, Homo sapiens
atttccaggcccctgaggactg

SEQ ID NO: 1470940 - DNA, 23 bp, Homo sapiens
atttccaggcccctgaggactgg

SEQ ID NO: 1470941 - DNA, 10 bp, Homo sapiens
atttgtaaag

SEQ ID NO: 1470942 - DNA, 16 bp, Homo sapiens
atttgtaactttgcag

SEQ ID NO: 1470943 - DNA, 23 bp, Homo sapiens
atttgtaattaaaagcaaatcat

SEQ ID NO: 1470944 - DNA, 15 bp, Homo sapiens
atttgtaattgctta

SEQ ID NO: 1470945 - DNA, 20 bp, Homo sapiens
atttgtaattgcttacattt

SEQ ID NO: 1470946 - DNA, 20 bp, Homo sapiens
atttgtacaaggtaattgtt

SEQ ID NO: 1470947 - DNA, 14 bp, Homo sapiens
atttgtacaatggt

SEQ ID NO: 1470948 - DNA, 21 bp, Homo sapiens
atttgtacatatgtaaaataa

SEQ ID NO: 1470949 - DNA, 21 bp, Homo sapiens
atttgtacctctaagtacata

SEQ ID NO: 1470950 - DNA, 22 bp, Homo sapiens
atttgtactatttaactgacta

SEQ ID NO: 1470951 - DNA, 19 bp, Homo sapiens
atttgtacttttttcttaa

SEQ ID NO: 1470952 - DNA, 18 bp, Homo sapiens
atttgtagcactgagggt

SEQ ID NO: 1470953 - DNA, 22 bp, Homo sapiens
atttgtataaagcattactctt

SEQ ID NO: 1470954 - DNA, 23 bp, Homo sapiens
atttgtataaagcattactcttt

SEQ ID NO: 1470955 - DNA, 23 bp, Homo sapiens
atttgtatattgtggatgtgttc

SEQ ID NO: 1470956 - DNA, 15 bp, Homo sapiens
atttgtatcacaaat

SEQ ID NO: 1470957 - DNA, 16 bp, Homo sapiens
atttgtattttgtgat

SEQ ID NO: 1470958 - DNA, 16 bp, Homo sapiens
atttgtcacagaaatc

SEQ ID NO: 1470959 - DNA, 20 bp, Homo sapiens
atttgtcagtatttttgccg

SEQ ID NO: 1470960 - DNA, 17 bp, Homo sapiens
atttgtcagtttggttg

SEQ ID NO: 1470961 - DNA, 20 bp, Homo sapiens
atttgtcccagcctggggct

SEQ ID NO: 1470962 - DNA, 18 bp, Homo sapiens
atttgtccttttatttct

SEQ ID NO: 1470963 - DNA, 19 bp, Homo sapiens
atttgtccttttatttctc

SEQ ID NO: 1470964 - DNA, 14 bp, Homo sapiens
atttgtctttttgt

SEQ ID NO: 1470965 - DNA, 22 bp, Homo sapiens
atttgtctttttgttgtaaaac

SEQ ID NO: 1470966 - DNA, 17 bp, Homo sapiens
atttgtgaactggaaga

SEQ ID NO: 1470967 - DNA, 14 bp, Homo sapiens
atttgtgcaaacat

SEQ ID NO: 1470968 - DNA, 17 bp, Homo sapiens
atttgtgcaaacatgga

SEQ ID NO: 1470969 - DNA, 14 bp, Homo sapiens
atttgtgcttttta

SEQ ID NO: 1470970 - DNA, 22 bp, Homo sapiens
atttgtgctttttaagaatatt

SEQ ID NO: 1470971 - DNA, 22 bp, Homo sapiens
atttgtggggagggatttgggg

SEQ ID NO: 1470972 - DNA, 19 bp, Homo sapiens
atttgtggtaatctacacc

SEQ ID NO: 1470973 - DNA, 21 bp, Homo sapiens
atttgtgtaaatgagtaaaac

SEQ ID NO: 1470974 - DNA, 16 bp, Homo sapiens
atttgtgtggaaatca

SEQ ID NO: 1470975 - DNA, 13 bp, Homo sapiens
atttgtgttttaa

SEQ ID NO: 1470976 - DNA, 14 bp, Homo sapiens
atttgttaaaatta

SEQ ID NO: 1470977 - DNA, 21 bp, Homo sapiens
atttgttaaaattatcaatat

SEQ ID NO: 1470978 - DNA, 15 bp, Homo sapiens
atttgttactgtatt

SEQ ID NO: 1470979 - DNA, 11 bp, Homo sapiens
atttgttcctg

SEQ ID NO: 1470980 - DNA, 13 bp, Homo sapiens
atttgttcctgct

SEQ ID NO: 1470981 - DNA, 14 bp, Homo sapiens
atttgttcctgctt

SEQ ID NO: 1470982 - DNA, 12 bp, Homo sapiens
atttgttcctgg

SEQ ID NO: 1470983 - DNA, 20 bp, Homo sapiens
atttgttcttaaaaaaataa

SEQ ID NO: 1470984 - DNA, 13 bp, Homo sapiens
atttgttcttgta

SEQ ID NO: 1470985 - DNA, 17 bp, Homo sapiens
atttgttcttgtattta

SEQ ID NO: 1470986 - DNA, 14 bp, Homo sapiens
atttgttgaaatta

SEQ ID NO: 1470987 - DNA, 17 bp, Homo sapiens
atttgttgacagcaaaa

SEQ ID NO: 1470988 - DNA, 13 bp, Homo sapiens
atttgttggaatg

SEQ ID NO: 1470989 - DNA, 12 bp, Homo sapiens
atttgtttaaaa

SEQ ID NO: 1470990 - DNA, 16 bp, Homo sapiens
atttgtttaaaaggat

SEQ ID NO: 1470991 - DNA, 21 bp, Homo sapiens
atttgtttcatttctgcagat

SEQ ID NO: 1470992 - DNA, 20 bp, Homo sapiens
atttgtttcccccacagttt

SEQ ID NO: 1470993 - DNA, 12 bp, Homo sapiens
atttgtttgtat

SEQ ID NO: 1470994 - DNA, 16 bp, Homo sapiens
atttgtttgtattcat

SEQ ID NO: 1470995 - DNA, 15 bp, Homo sapiens
atttgttttagcatt

SEQ ID NO: 1470996 - DNA, 21 bp, Homo sapiens
atttgttttgacggatgattg

SEQ ID NO: 1470997 - DNA, 16 bp, Homo sapiens
atttgttttgcttttg

SEQ ID NO: 1470998 - DNA, 18 bp, Homo sapiens
atttgttttgcttttgtt

SEQ ID NO: 1470999 - DNA, 18 bp, Homo sapiens
attttaaaaaagccttcc

SEQ ID NO: 1471000 - DNA, 13 bp, Homo sapiens
attttaaaaaagg

SEQ ID NO: 1471001 - DNA, 16 bp, Homo sapiens
attttaaaaaataaca

SEQ ID NO: 1471002 - DNA, 17 bp, Homo sapiens
attttaaaaaataacat

SEQ ID NO: 1471003 - DNA, 14 bp, Homo sapiens
attttaaaacattt

SEQ ID NO: 1471004 - DNA, 15 bp, Homo sapiens
attttaaaagtctat

SEQ ID NO: 1471005 - DNA, 18 bp, Homo sapiens
attttaaaagtctatttt

SEQ ID NO: 1471006 - DNA, 22 bp, Homo sapiens
attttaaaatgtacatgtatta

SEQ ID NO: 1471007 - DNA, 13 bp, Homo sapiens
attttaaaatttc

SEQ ID NO: 1471008 - DNA, 13 bp, Homo sapiens
attttaaagtatg

SEQ ID NO: 1471009 - DNA, 18 bp, Homo sapiens
attttaaagttagtatct

SEQ ID NO: 1471010 - DNA, 21 bp, Homo sapiens
attttaaagttagtatctttt

SEQ ID NO: 1471011 - DNA, 20 bp, Homo sapiens
attttaaataaaagtgatca

SEQ ID NO: 1471012 - DNA, 16 bp, Homo sapiens
attttaaattttatgt

SEQ ID NO: 1471013 - DNA, 11 bp, Homo sapiens
attttaacaag

SEQ ID NO: 1471014 - DNA, 17 bp, Homo sapiens
attttaacctagatgtt

SEQ ID NO: 1471015 - DNA, 22 bp, Homo sapiens
attttaacctagatgtttaaca

SEQ ID NO: 1471016 - DNA, 17 bp, Homo sapiens
attttaactatttttgt

SEQ ID NO: 1471017 - DNA, 20 bp, Homo sapiens
attttaactgccaatcctta

SEQ ID NO: 1471018 - DNA, 16 bp, Homo sapiens
attttaagcctttgtt

SEQ ID NO: 1471019 - DNA, 16 bp, Homo sapiens
attttaagggggaaaa

SEQ ID NO: 1471020 - DNA, 22 bp, Homo sapiens
attttaaggttctcagacctcc

SEQ ID NO: 1471021 - DNA, 16 bp, Homo sapiens
attttaagtgctttgt

SEQ ID NO: 1471022 - DNA, 21 bp, Homo sapiens
attttaataacatatctaaag

SEQ ID NO: 1471023 - DNA, 13 bp, Homo sapiens
attttaatagaaa

SEQ ID NO: 1471024 - DNA, 22 bp, Homo sapiens
attttaatagcctgtcataggt

SEQ ID NO: 1471025 - DNA, 17 bp, Homo sapiens
attttaatattttgtat

SEQ ID NO: 1471026 - DNA, 14 bp, Homo sapiens
attttaatgaaatc

SEQ ID NO: 1471027 - DNA, 19 bp, Homo sapiens
attttaatgaaatcaaatg

SEQ ID NO: 1471028 - DNA, 20 bp, Homo sapiens
attttaatgctgtttctaag

SEQ ID NO: 1471029 - DNA, 12 bp, Homo sapiens
attttaatgtga

SEQ ID NO: 1471030 - DNA, 13 bp, Homo sapiens
attttaatgtgaa

SEQ ID NO: 1471031 - DNA, 14 bp, Homo sapiens
attttaatgtgaag

SEQ ID NO: 1471032 - DNA, 13 bp, Homo sapiens
attttaattctct

SEQ ID NO: 1471033 - DNA, 14 bp, Homo sapiens
attttaatttcagg

SEQ ID NO: 1471034 - DNA, 17 bp, Homo sapiens
attttaatttttaaatg

SEQ ID NO: 1471035 - DNA, 18 bp, Homo sapiens
attttaatttttaaatgc

SEQ ID NO: 1471036 - DNA, 16 bp, Homo sapiens
attttacaaaagatgt

SEQ ID NO: 1471037 - DNA, 17 bp, Homo sapiens
attttacaattgaaatg

SEQ ID NO: 1471038 - DNA, 12 bp, Homo sapiens
attttacaattt

SEQ ID NO: 1471039 - DNA, 14 bp, Homo sapiens
attttacacagaaa

SEQ ID NO: 1471040 - DNA, 19 bp, Homo sapiens
attttacacagaaacactg

SEQ ID NO: 1471041 - DNA, 22 bp, Homo sapiens
attttacagctcattaaacttt

SEQ ID NO: 1471042 - DNA, 12 bp, Homo sapiens
attttaccaaag

SEQ ID NO: 1471043 - DNA, 22 bp, Homo sapiens
attttaccctgaggtcactgct

SEQ ID NO: 1471044 - DNA, 15 bp, Homo sapiens
attttactgtctatg

SEQ ID NO: 1471045 - DNA, 15 bp, Homo sapiens
attttagaaatattc

SEQ ID NO: 1471046 - DNA, 14 bp, Homo sapiens
attttagacattca

SEQ ID NO: 1471047 - DNA, 23 bp, Homo sapiens
attttagcaaagcgggttataat

SEQ ID NO: 1471048 - DNA, 12 bp, Homo sapiens
attttagcattt

SEQ ID NO: 1471049 - DNA, 19 bp, Homo sapiens
attttaggagctaaggctc

SEQ ID NO: 1471050 - DNA, 20 bp, Homo sapiens
attttaggagctaaggctct

SEQ ID NO: 1471051 - DNA, 21 bp, Homo sapiens
attttaggagctaaggctcta

SEQ ID NO: 1471052 - DNA, 15 bp, Homo sapiens
attttaggcaagttt

SEQ ID NO: 1471053 - DNA, 12 bp, Homo sapiens
attttagtatac

SEQ ID NO: 1471054 - DNA, 20 bp, Homo sapiens
attttagtattcattctgca

SEQ ID NO: 1471055 - DNA, 14 bp, Homo sapiens
attttagtgactgt

SEQ ID NO: 1471056 - DNA, 12 bp, Homo sapiens
attttgcagcag

SEQ ID NO: 1471057 - DNA, 12 bp, Homo sapiens
attttgcatact

SEQ ID NO: 1471058 - DNA, 15 bp, Homo sapiens
attttgcattccaga

SEQ ID NO: 1471059 - DNA, 16 bp, Homo sapiens
attttgccagttggac

SEQ ID NO: 1471060 - DNA, 13 bp, Homo sapiens
attttgcctttaa

SEQ ID NO: 1471061 - DNA, 17 bp, Homo sapiens
attttgctaactgggtt

SEQ ID NO: 1471062 - DNA, 21 bp, Homo sapiens
attttgctaactgggttaaat

SEQ ID NO: 1471063 - DNA, 22 bp, Homo sapiens
attttgctaactgggttaaata

SEQ ID NO: 1471064 - DNA, 16 bp, Homo sapiens
attttgctaactggtt

SEQ ID NO: 1471065 - DNA, 19 bp, Homo sapiens
attttgctatcaacaataa

SEQ ID NO: 1471066 - DNA, 14 bp, Homo sapiens
attttgctgagttg

SEQ ID NO: 1471067 - DNA, 14 bp, Homo sapiens
attttgctggaata

SEQ ID NO: 1471068 - DNA, 19 bp, Homo sapiens
attttgctggaattcctaa

SEQ ID NO: 1471069 - DNA, 12 bp, Homo sapiens
attttgctttaa

SEQ ID NO: 1471070 - DNA, 19 bp, Homo sapiens
attttgctttggttaaaaa

SEQ ID NO: 1471071 - DNA, 20 bp, Homo sapiens
attttggaaaataaattatt

SEQ ID NO: 1471072 - DNA, 17 bp, Homo sapiens
attttggaactatgaag

SEQ ID NO: 1471073 - DNA, 20 bp, Homo sapiens
attttggaataatttctatt

SEQ ID NO: 1471074 - DNA, 22 bp, Homo sapiens
attttggagagtttcctgaaac

SEQ ID NO: 1471075 - DNA, 19 bp, Homo sapiens
attttggagattataataa

SEQ ID NO: 1471076 - DNA, 22 bp, Homo sapiens
attttggcgaatctcaaaatta

SEQ ID NO: 1471077 - DNA, 15 bp, Homo sapiens
attttgggaatcttt

SEQ ID NO: 1471078 - DNA, 16 bp, Homo sapiens
attttgggaatctttt

SEQ ID NO: 1471079 - DNA, 21 bp, Homo sapiens
attttgggccttgctaaattg

SEQ ID NO: 1471080 - DNA, 16 bp, Homo sapiens
attttggggctatatt

SEQ ID NO: 1471081 - DNA, 20 bp, Homo sapiens
attttggggttgtgttgtca

SEQ ID NO: 1471082 - DNA, 22 bp, Homo sapiens
attttgggtcaacttgacacca

SEQ ID NO: 1471083 - DNA, 22 bp, Homo sapiens
attttggttttgttcccctcct

SEQ ID NO: 1471084 - DNA, 23 bp, Homo sapiens
attttgtaaataataaaatagta

SEQ ID NO: 1471085 - DNA, 16 bp, Homo sapiens
attttgtaagaaggca

SEQ ID NO: 1471086 - DNA, 22 bp, Homo sapiens
attttgtacatgtatgaaattg

SEQ ID NO: 1471087 - DNA, 13 bp, Homo sapiens
attttgtacattg

SEQ ID NO: 1471088 - DNA, 14 bp, Homo sapiens
attttgtatattgt

SEQ ID NO: 1471089 - DNA, 13 bp, Homo sapiens
attttgtatggag

SEQ ID NO: 1471090 - DNA, 19 bp, Homo sapiens
attttgtattacatctaat

SEQ ID NO: 1471091 - DNA, 15 bp, Homo sapiens
attttgtattttcaa

SEQ ID NO: 1471092 - DNA, 22 bp, Homo sapiens
attttgtattttcaactttata

SEQ ID NO: 1471093 - DNA, 18 bp, Homo sapiens
attttgtccatgtccccc

SEQ ID NO: 1471094 - DNA, 16 bp, Homo sapiens
attttgtcttaagtgt

SEQ ID NO: 1471095 - DNA, 20 bp, Homo sapiens
attttgtcttaagtgtttct

SEQ ID NO: 1471096 - DNA, 23 bp, Homo sapiens
attttgtcttaagtgtttctcaa

SEQ ID NO: 1471097 - DNA, 18 bp, Homo sapiens
attttgtgaagtgaagga

SEQ ID NO: 1471098 - DNA, 13 bp, Homo sapiens
attttgtgcattc

SEQ ID NO: 1471099 - DNA, 20 bp, Homo sapiens
attttgtgcattctttggta

SEQ ID NO: 1471100 - DNA, 21 bp, Homo sapiens
attttgtgtcctccaggagct

SEQ ID NO: 1471101 - DNA, 12 bp, Homo sapiens
attttgtgtgag

SEQ ID NO: 1471102 - DNA, 17 bp, Homo sapiens
attttgtgttgaagagc

SEQ ID NO: 1471103 - DNA, 14 bp, Homo sapiens
attttgttaaagct

SEQ ID NO: 1471104 - DNA, 15 bp, Homo sapiens
attttgttcatacat

SEQ ID NO: 1471105 - DNA, 15 bp, Homo sapiens
attttgttctctggg

SEQ ID NO: 1471106 - DNA, 18 bp, Homo sapiens
attttgttctctgggaga

SEQ ID NO: 1471107 - DNA, 14 bp, Homo sapiens
attttgttgaaatt

SEQ ID NO: 1471108 - DNA, 14 bp, Homo sapiens
attttgttgttcct

SEQ ID NO: 1471109 - DNA, 23 bp, Homo sapiens
attttgttgttcctctatacttt

SEQ ID NO: 1471110 - DNA, 12 bp, Homo sapiens
attttgtttaca

SEQ ID NO: 1471111 - DNA, 20 bp, Homo sapiens
attttgtttcagaattttgt

SEQ ID NO: 1471112 - DNA, 21 bp, Homo sapiens
attttgtttcagaattttgta

SEQ ID NO: 1471113 - DNA, 13 bp, Homo sapiens
atttttaaaaaga

SEQ ID NO: 1471114 - DNA, 17 bp, Homo sapiens
atttttaaaatatttat

SEQ ID NO: 1471115 - DNA, 14 bp, Homo sapiens
atttttaaagtaga

SEQ ID NO: 1471116 - DNA, 18 bp, Homo sapiens
atttttaacacttaaatt

SEQ ID NO: 1471117 - DNA, 20 bp, Homo sapiens
atttttaagataataatata

SEQ ID NO: 1471118 - DNA, 17 bp, Homo sapiens
atttttaatcatgaaat

SEQ ID NO: 1471119 - DNA, 13 bp, Homo sapiens
atttttaatgtat

SEQ ID NO: 1471120 - DNA, 13 bp, Homo sapiens
atttttacaataa

SEQ ID NO: 1471121 - DNA, 17 bp, Homo sapiens
atttttacctgtttaaa

SEQ ID NO: 1471122 - DNA, 16 bp, Homo sapiens
atttttataaatactg

SEQ ID NO: 1471123 - DNA, 12 bp, Homo sapiens
atttttataatt

SEQ ID NO: 1471124 - DNA, 21 bp, Homo sapiens
atttttataattgtacaaaat

SEQ ID NO: 1471125 - DNA, 20 bp, Homo sapiens
atttttatacaaacctacca

SEQ ID NO: 1471126 - DNA, 20 bp, Homo sapiens
atttttatatcagcctgagt

SEQ ID NO: 1471127 - DNA, 17 bp, Homo sapiens
atttttatatttccttt

SEQ ID NO: 1471128 - DNA, 19 bp, Homo sapiens
atttttatctttcgtgata

SEQ ID NO: 1471129 - DNA, 16 bp, Homo sapiens
atttttatgcagacag

SEQ ID NO: 1471130 - DNA, 14 bp, Homo sapiens
atttttatgtaaaa

SEQ ID NO: 1471131 - DNA, 23 bp, Homo sapiens
atttttatgttttgaaagacaga

SEQ ID NO: 1471132 - DNA, 16 bp, Homo sapiens
atttttattaaagcat

SEQ ID NO: 1471133 - DNA, 16 bp, Homo sapiens
atttttattaaatgta

SEQ ID NO: 1471134 - DNA, 21 bp, Homo sapiens
atttttattaaatgtatttta

SEQ ID NO: 1471135 - DNA, 17 bp, Homo sapiens
atttttattaattttag

SEQ ID NO: 1471136 - DNA, 17 bp, Homo sapiens
atttttatttctgactc

SEQ ID NO: 1471137 - DNA, 16 bp, Homo sapiens
atttttatttcttttt

SEQ ID NO: 1471138 - DNA, 18 bp, Homo sapiens
atttttatttctttttaa

SEQ ID NO: 1471139 - DNA, 17 bp, Homo sapiens
atttttcaatatattga

SEQ ID NO: 1471140 - DNA, 20 bp, Homo sapiens
atttttcaatatattgaact

SEQ ID NO: 1471141 - DNA, 18 bp, Homo sapiens
atttttcacatatctagt

SEQ ID NO: 1471142 - DNA, 21 bp, Homo sapiens
atttttcacatatctagtatg

SEQ ID NO: 1471143 - DNA, 15 bp, Homo sapiens
atttttcataaacaa

SEQ ID NO: 1471144 - DNA, 13 bp, Homo sapiens
atttttccaacta

SEQ ID NO: 1471145 - DNA, 21 bp, Homo sapiens
atttttccaactactaataga

SEQ ID NO: 1471146 - DNA, 20 bp, Homo sapiens
atttttccatttatttatga

SEQ ID NO: 1471147 - DNA, 15 bp, Homo sapiens
atttttcccagtatt

SEQ ID NO: 1471148 - DNA, 16 bp, Homo sapiens
atttttcctgcatgtt

SEQ ID NO: 1471149 - DNA, 12 bp, Homo sapiens
atttttctaaaa

SEQ ID NO: 1471150 - DNA, 18 bp, Homo sapiens
atttttctataaatcagt

SEQ ID NO: 1471151 - DNA, 15 bp, Homo sapiens
atttttctcccaaga

SEQ ID NO: 1471152 - DNA, 13 bp, Homo sapiens
atttttctcttgt

SEQ ID NO: 1471153 - DNA, 19 bp, Homo sapiens
atttttcttatttcatttc

SEQ ID NO: 1471154 - DNA, 12 bp, Homo sapiens
atttttgacaga

SEQ ID NO: 1471155 - DNA, 23 bp, Homo sapiens
atttttgagccaagcttcaaccc

SEQ ID NO: 1471156 - DNA, 18 bp, Homo sapiens
atttttgagttacaattt

SEQ ID NO: 1471157 - DNA, 21 bp, Homo sapiens
atttttgataaagcctcaagg

SEQ ID NO: 1471158 - DNA, 12 bp, Homo sapiens
atttttgatgta

SEQ ID NO: 1471159 - DNA, 20 bp, Homo sapiens
atttttgatgtatatatcta

SEQ ID NO: 1471160 - DNA, 12 bp, Homo sapiens
atttttgcctct

SEQ ID NO: 1471161 - DNA, 18 bp, Homo sapiens
atttttgcctcttccagt

SEQ ID NO: 1471162 - DNA, 22 bp, Homo sapiens
atttttgctaggagccccagct

SEQ ID NO: 1471163 - DNA, 20 bp, Homo sapiens
atttttgctccaatatccat

SEQ ID NO: 1471164 - DNA, 20 bp, Homo sapiens
atttttgctgaattcatcta

SEQ ID NO: 1471165 - DNA, 14 bp, Homo sapiens
atttttggagaaat

SEQ ID NO: 1471166 - DNA, 16 bp, Homo sapiens
atttttggagaaatgt

SEQ ID NO: 1471167 - DNA, 23 bp, Homo sapiens
atttttggagaaatgtcataaat

SEQ ID NO: 1471168 - DNA, 20 bp, Homo sapiens
atttttggggcatcctggat

SEQ ID NO: 1471169 - DNA, 19 bp, Homo sapiens
atttttggttgtcaatatt

SEQ ID NO: 1471170 - DNA, 22 bp, Homo sapiens
atttttgtaagacaatccatgt

SEQ ID NO: 1471171 - DNA, 16 bp, Homo sapiens
caaaaccaagccttgg

SEQ ID NO: 1471172 - DNA, 14 bp, Homo sapiens
caaaaccatgcctg

SEQ ID NO: 1471173 - DNA, 22 bp, Homo sapiens
caaaaccatgcctggtattttc

SEQ ID NO: 1471174 - DNA, 13 bp, Homo sapiens
caaaacccacctt

SEQ ID NO: 1471175 - DNA, 15 bp, Homo sapiens
caaaacccagggcaa

SEQ ID NO: 1471176 - DNA, 23 bp, Homo sapiens
caaaacccctaagagactgcgtt

SEQ ID NO: 1471177 - DNA, 17 bp, Homo sapiens
caaaaccctgaagccat

SEQ ID NO: 1471178 - DNA, 14 bp, Homo sapiens
caaaacctaacttg

SEQ ID NO: 1471179 - DNA, 14 bp, Homo sapiens
caaaacctcaaacc

SEQ ID NO: 1471180 - DNA, 19 bp, Homo sapiens
caaaacctcaaaccagtca

SEQ ID NO: 1471181 - DNA, 20 bp, Homo sapiens
caaaacctcatgacagccag

SEQ ID NO: 1471182 - DNA, 21 bp, Homo sapiens
caaaacctcatgacagccaga

SEQ ID NO: 1471183 - DNA, 15 bp, Homo sapiens
caaaacgagggctga

SEQ ID NO: 1471184 - DNA, 15 bp, Homo sapiens
caaaacgatgaagtt

SEQ ID NO: 1471185 - DNA, 13 bp, Homo sapiens
caaaacggggcag

SEQ ID NO: 1471186 - DNA, 14 bp, Homo sapiens
caaaacgtcttatt

SEQ ID NO: 1471187 - DNA, 19 bp, Homo sapiens
caaaactatcggttcaagt

SEQ ID NO: 1471188 - DNA, 21 bp, Homo sapiens
caaaactccgtctcaaaaaaa

SEQ ID NO: 1471189 - DNA, 14 bp, Homo sapiens
caaaactgcactgt

SEQ ID NO: 1471190 - DNA, 12 bp, Homo sapiens
caaaactgctcc

SEQ ID NO: 1471191 - DNA, 14 bp, Homo sapiens
caaaactgtgcaga

SEQ ID NO: 1471192 - DNA, 13 bp, Homo sapiens
caaaacttctctt

SEQ ID NO: 1471193 - DNA, 12 bp, Homo sapiens
caaaacttgaaa

SEQ ID NO: 1471194 - DNA, 20 bp, Homo sapiens
caaaacttgaaagaagtttt

SEQ ID NO: 1471195 - DNA, 14 bp, Homo sapiens
caaaacttgcatct

SEQ ID NO: 1471196 - DNA, 23 bp, Homo sapiens
caaaactttaggccctgccccag

SEQ ID NO: 1471197 - DNA, 21 bp, Homo sapiens
caaaagaaaaaaaaaagcacc

SEQ ID NO: 1471198 - DNA, 22 bp, Homo sapiens
caaaagaaaaaagcaagtacaa

SEQ ID NO: 1471199 - DNA, 16 bp, Homo sapiens
caaaagaaaattgata

SEQ ID NO: 1471200 - DNA, 23 bp, Homo sapiens
caaaagaaatctcctaacaaaag

SEQ ID NO: 1471201 - DNA, 13 bp, Homo sapiens
caaaagaagcccc

SEQ ID NO: 1471202 - DNA, 12 bp, Homo sapiens
caaaagagagaa

SEQ ID NO: 1471203 - DNA, 16 bp, Homo sapiens
caaaagagagaatgag

SEQ ID NO: 1471204 - DNA, 15 bp, Homo sapiens
caaaagatacaaaag

SEQ ID NO: 1471205 - DNA, 16 bp, Homo sapiens
caaaagattgctgaaa

SEQ ID NO: 1471206 - DNA, 20 bp, Homo sapiens
caaaagatttggaaagatat

SEQ ID NO: 1471207 - DNA, 15 bp, Homo sapiens
caaaagcaaatgaga

SEQ ID NO: 1471208 - DNA, 16 bp, Homo sapiens
caaaagcacatgtatt

SEQ ID NO: 1471209 - DNA, 17 bp, Homo sapiens
caaaagcagctaaatgt

SEQ ID NO: 1471210 - DNA, 19 bp, Homo sapiens
caaaagcctcagaaaggga

SEQ ID NO: 1471211 - DNA, 19 bp, Homo sapiens
caaaagctttttaaaattt

SEQ ID NO: 1471212 - DNA, 16 bp, Homo sapiens
caaaaggaaagctgtg

SEQ ID NO: 1471213 - DNA, 21 bp, Homo sapiens
caaaaggctcgtttggatctg

SEQ ID NO: 1471214 - DNA, 18 bp, Homo sapiens
caaaaggctgagaaggaa

SEQ ID NO: 1471215 - DNA, 22 bp, Homo sapiens
caaaagggtcttgactctaaat

SEQ ID NO: 1471216 - DNA, 18 bp, Homo sapiens
caaaagggtgtatagtgt

SEQ ID NO: 1471217 - DNA, 20 bp, Homo sapiens
caaaagggtttaaactgatt

SEQ ID NO: 1471218 - DNA, 22 bp, Homo sapiens
caaaagggtttaaactgattca

SEQ ID NO: 1471219 - DNA, 22 bp, Homo sapiens
caaaaggtgcctgtgaggcagg

SEQ ID NO: 1471220 - DNA, 20 bp, Homo sapiens
caaaaggttaataaagtaat

SEQ ID NO: 1471221 - DNA, 18 bp, Homo sapiens
caaaagttattaaaattg

SEQ ID NO: 1471222 - DNA, 18 bp, Homo sapiens
caaaagttccaagagtct

SEQ ID NO: 1471223 - DNA, 19 bp, Homo sapiens
caaaataaaaagtgacaca

SEQ ID NO: 1471224 - DNA, 20 bp, Homo sapiens
caaaataaagcaatgtgttt

SEQ ID NO: 1471225 - DNA, 17 bp, Homo sapiens
caaaataataaaaatca

SEQ ID NO: 1471226 - DNA, 11 bp, Homo sapiens
caaaatacatt

SEQ ID NO: 1471227 - DNA, 20 bp, Homo sapiens
caaaatacattctttttgct

SEQ ID NO: 1471228 - DNA, 23 bp, Homo sapiens
caaaatacattctttttgctcta

SEQ ID NO: 1471229 - DNA, 15 bp, Homo sapiens
caaaatacatttgta

SEQ ID NO: 1471230 - DNA, 15 bp, Homo sapiens
caaaatagttctatt

SEQ ID NO: 1471231 - DNA, 16 bp, Homo sapiens
caaaatagttctattt

SEQ ID NO: 1471232 - DNA, 19 bp, Homo sapiens
caaaatagttctatttcta

SEQ ID NO: 1471233 - DNA, 20 bp, Homo sapiens
caaaatagttctatttctat

SEQ ID NO: 1471234 - DNA, 22 bp, Homo sapiens
caaaatagttctatttctatct

SEQ ID NO: 1471235 - DNA, 14 bp, Homo sapiens
caaaatatagttaa

SEQ ID NO: 1471236 - DNA, 19 bp, Homo sapiens
caaaatatattttcagtac

SEQ ID NO: 1471237 - DNA, 15 bp, Homo sapiens
caaaatatttcccat

SEQ ID NO: 1471238 - DNA, 16 bp, Homo sapiens
caaaatatttgtacat

SEQ ID NO: 1471239 - DNA, 17 bp, Homo sapiens
caaaatatttgtacata

SEQ ID NO: 1471240 - DNA, 16 bp, Homo sapiens
caaaatcaattaaaat

SEQ ID NO: 1471241 - DNA, 16 bp, Homo sapiens
caaaatcattttaatg

SEQ ID NO: 1471242 - DNA, 16 bp, Homo sapiens
caaaatccaaaaagaa

SEQ ID NO: 1471243 - DNA, 22 bp, Homo sapiens
caaaatccaaaaagaaatgatg

SEQ ID NO: 1471244 - DNA, 21 bp, Homo sapiens
caaaatcgtttttaatttaaa

SEQ ID NO: 1471245 - DNA, 17 bp, Homo sapiens
caaaatctcctggcttt

SEQ ID NO: 1471246 - DNA, 20 bp, Homo sapiens
caaaatcttgttaatgtcat

SEQ ID NO: 1471247 - DNA, 22 bp, Homo sapiens
caaaatgaatgcaaaattgttt

SEQ ID NO: 1471248 - DNA, 12 bp, Homo sapiens
caaaatgccaag

SEQ ID NO: 1471249 - DNA, 23 bp, Homo sapiens
caaaatgtaggcttagtttgtgt

SEQ ID NO: 1471250 - DNA, 15 bp, Homo sapiens
caaaatgtagggtta

SEQ ID NO: 1471251 - DNA, 19 bp, Homo sapiens
caaaatgttatcttctcaa

SEQ ID NO: 1471252 - DNA, 12 bp, Homo sapiens
caaaattagaaa

SEQ ID NO: 1471253 - DNA, 21 bp, Homo sapiens
caaaattagatcctaagatgt

SEQ ID NO: 1471254 - DNA, 23 bp, Homo sapiens
caaaattagatcctaagatgtgt

SEQ ID NO: 1471255 - DNA, 17 bp, Homo sapiens
caaaattcaaagcatgg

SEQ ID NO: 1471256 - DNA, 19 bp, Homo sapiens
caaaattctagctgtatga

SEQ ID NO: 1471257 - DNA, 13 bp, Homo sapiens
caaaattgacatt

SEQ ID NO: 1471258 - DNA, 12 bp, Homo sapiens
caaaattgagca

SEQ ID NO: 1471259 - DNA, 15 bp, Homo sapiens
caaaattgatgtgtt

SEQ ID NO: 1471260 - DNA, 20 bp, Homo sapiens
caaaattgcttctaaaacaa

SEQ ID NO: 1471261 - DNA, 19 bp, Homo sapiens
caaaattgttttcacttgt

SEQ ID NO: 1471262 - DNA, 21 bp, Homo sapiens
caaaattgttttcacttgtat

SEQ ID NO: 1471263 - DNA, 20 bp, Homo sapiens
caaaattgttttgagctttc

SEQ ID NO: 1471264 - DNA, 23 bp, Homo sapiens
caaaattgttttgagctttccat

SEQ ID NO: 1471265 - DNA, 19 bp, Homo sapiens
caaaatttattttataaga

SEQ ID NO: 1471266 - DNA, 22 bp, Homo sapiens
caaaatttattttataagaaaa

SEQ ID NO: 1471267 - DNA, 15 bp, Homo sapiens
caaaatttccagtac

SEQ ID NO: 1471268 - DNA, 18 bp, Homo sapiens
caaaatttccagtacctt

SEQ ID NO: 1471269 - DNA, 13 bp, Homo sapiens
caaaatttgacta

SEQ ID NO: 1471270 - DNA, 23 bp, Homo sapiens
caaaatttgactaattttacatg

SEQ ID NO: 1471271 - DNA, 17 bp, Homo sapiens
caaaattttaagtagga

SEQ ID NO: 1471272 - DNA, 13 bp, Homo sapiens
caaaattttattc

SEQ ID NO: 1471273 - DNA, 21 bp, Homo sapiens
caaacaaaaaggttctcaggt

SEQ ID NO: 1471274 - DNA, 15 bp, Homo sapiens
caaacaaaatttcta

SEQ ID NO: 1471275 - DNA, 15 bp, Homo sapiens
caaacaaacaaaact

SEQ ID NO: 1471276 - DNA, 17 bp, Homo sapiens
caaacaaatatgcaaaa

SEQ ID NO: 1471277 - DNA, 14 bp, Homo sapiens
caaacaacctgccc

SEQ ID NO: 1471278 - DNA, 17 bp, Homo sapiens
caaacaaggaagccaaa

SEQ ID NO: 1471279 - DNA, 21 bp, Homo sapiens
caaacaatgaagaattatgta

SEQ ID NO: 1471280 - DNA, 17 bp, Homo sapiens
caaacaatggaaactga

SEQ ID NO: 1471281 - DNA, 21 bp, Homo sapiens
caaacaatggaaactgaatgc

SEQ ID NO: 1471282 - DNA, 22 bp, Homo sapiens
caaacaatggaaactgaatgct

SEQ ID NO: 1471283 - DNA, 14 bp, Homo sapiens
caaacacaaatgca

SEQ ID NO: 1471284 - DNA, 11 bp, Homo sapiens
caaacaccagt

SEQ ID NO: 1471285 - DNA, 13 bp, Homo sapiens
caaatacctcaat

SEQ ID NO: 1471286 - DNA, 15 bp, Homo sapiens
caaatacctcaattt

SEQ ID NO: 1471287 - DNA, 16 bp, Homo sapiens
caaatacctcaatttt

SEQ ID NO: 1471288 - DNA, 20 bp, Homo sapiens
caaatacctcaatttttgtt

SEQ ID NO: 1471289 - DNA, 13 bp, Homo sapiens
caaatagcaaaga

SEQ ID NO: 1471290 - DNA, 14 bp, Homo sapiens
caaatagccccaga

SEQ ID NO: 1471291 - DNA, 15 bp, Homo sapiens
caaatagccccagac

SEQ ID NO: 1471292 - DNA, 17 bp, Homo sapiens
caaatagccccagactg

SEQ ID NO: 1471293 - DNA, 18 bp, Homo sapiens
caaatagccccagactgg

SEQ ID NO: 1471294 - DNA, 13 bp, Homo sapiens
caaatagttgcat

SEQ ID NO: 1471295 - DNA, 17 bp, Homo sapiens
caaatatacattttcta

SEQ ID NO: 1471296 - DNA, 21 bp, Homo sapiens
caaatatacattttctaaata

SEQ ID NO: 1471297 - DNA, 12 bp, Homo sapiens
caaatatgcaaa

SEQ ID NO: 1471298 - DNA, 22 bp, Homo sapiens
caaatatgctgttatgtccaga

SEQ ID NO: 1471299 - DNA, 17 bp, Homo sapiens
caaatatgtattttcct

SEQ ID NO: 1471300 - DNA, 18 bp, Homo sapiens
caaatatgtattttccta

SEQ ID NO: 1471301 - DNA, 15 bp, Homo sapiens
caaatattaaagatt

SEQ ID NO: 1471302 - DNA, 22 bp, Homo sapiens
caaatattaaagattctcttta

SEQ ID NO: 1471303 - DNA, 13 bp, Homo sapiens
caaatattgaagt

SEQ ID NO: 1471304 - DNA, 18 bp, Homo sapiens
caaatattgaagttgttt

SEQ ID NO: 1471305 - DNA, 18 bp, Homo sapiens
caaatattgttgacaact

SEQ ID NO: 1471306 - DNA, 22 bp, Homo sapiens
caaatattgttgacaactgtga

SEQ ID NO: 1471307 - DNA, 13 bp, Homo sapiens
caaatatttggag

SEQ ID NO: 1471308 - DNA, 14 bp, Homo sapiens
caaatcagaacttt

SEQ ID NO: 1471309 - DNA, 14 bp, Homo sapiens
caaatcagaagtca

SEQ ID NO: 1471310 - DNA, 16 bp, Homo sapiens
caaatcaggcttttgt

SEQ ID NO: 1471311 - DNA, 20 bp, Homo sapiens
caaatcagttactaagaaga

SEQ ID NO: 1471312 - DNA, 16 bp, Homo sapiens
caaatcagttagtttt

SEQ ID NO: 1471313 - DNA, 18 bp, Homo sapiens
caaatcatttgtttaaaa

SEQ ID NO: 1471314 - DNA, 13 bp, Homo sapiens
caaatccagtggt

SEQ ID NO: 1471315 - DNA, 14 bp, Homo sapiens
caaatccagtggtg

SEQ ID NO: 1471316 - DNA, 15 bp, Homo sapiens
caaatccagtggtgg

SEQ ID NO: 1471317 - DNA, 20 bp, Homo sapiens
caaatcctggaaggacacag

SEQ ID NO: 1471318 - DNA, 11 bp, Homo sapiens
caaatccttgg

SEQ ID NO: 1471319 - DNA, 22 bp, Homo sapiens
caaatcgatttagtaagtatgt

SEQ ID NO: 1471320 - DNA, 21 bp, Homo sapiens
caaatcgtggcacgtattgct

SEQ ID NO: 1471321 - DNA, 14 bp, Homo sapiens
caaatctaatctct

SEQ ID NO: 1471322 - DNA, 18 bp, Homo sapiens
caaatctaccactgtatg

SEQ ID NO: 1471323 - DNA, 24 bp, Homo sapiens
caaatctattacttttgcaaactg

SEQ ID NO: 1471324 - DNA, 13 bp, Homo sapiens
caaatctattcag

SEQ ID NO: 1471325 - DNA, 15 bp, Homo sapiens
caaatctctgttact

SEQ ID NO: 1471326 - DNA, 16 bp, Homo sapiens
caaatctgatggcctt

SEQ ID NO: 1471327 - DNA, 21 bp, Homo sapiens
caaatctgccaagagagatgt

SEQ ID NO: 1471328 - DNA, 12 bp, Homo sapiens
caaatctgtata

SEQ ID NO: 1471329 - DNA, 15 bp, Homo sapiens
caaatctgtatatgt

SEQ ID NO: 1471330 - DNA, 16 bp, Homo sapiens
caaatctgtcctctgt

SEQ ID NO: 1471331 - DNA, 13 bp, Homo sapiens
caaatcttaagaa

SEQ ID NO: 1471332 - DNA, 16 bp, Homo sapiens
caaatgaatttgctaa

SEQ ID NO: 1471333 - DNA, 20 bp, Homo sapiens
caaatgaatttgctaaatac

SEQ ID NO: 1471334 - DNA, 16 bp, Homo sapiens
caaatgacagatttct

SEQ ID NO: 1471335 - DNA, 14 bp, Homo sapiens
caaatgacatgcac

SEQ ID NO: 1471336 - DNA, 16 bp, Homo sapiens
caaatgacatgcactg

SEQ ID NO: 1471337 - DNA, 17 bp, Homo sapiens
caaatgacatgcactga

SEQ ID NO: 1471338 - DNA, 20 bp, Homo sapiens
caaatgacatgcactgaccc

SEQ ID NO: 1471339 - DNA, 14 bp, Homo sapiens
caaatgaccgagcc

SEQ ID NO: 1471340 - DNA, 20 bp, Homo sapiens
caaatgagatctaagccttt

SEQ ID NO: 1471341 - DNA, 16 bp, Homo sapiens
caaatgagctctgaaa

SEQ ID NO: 1471342 - DNA, 20 bp, Homo sapiens
caaatgagctctgaaatctt

SEQ ID NO: 1471343 - DNA, 21 bp, Homo sapiens
caaatgagtaacatttgctgt

SEQ ID NO: 1471344 - DNA, 23 bp, Homo sapiens
caaatgagtttaaaaaaataaca

SEQ ID NO: 1471345 - DNA, 19 bp, Homo sapiens
caaatgcaaaaactctttg

SEQ ID NO: 1471346 - DNA, 16 bp, Homo sapiens
caaatgcacaagctca

SEQ ID NO: 1471347 - DNA, 18 bp, Homo sapiens
caaatgcacaagctcaga

SEQ ID NO: 1471348 - DNA, 16 bp, Homo sapiens
caaatgcagaatactt

SEQ ID NO: 1471349 - DNA, 12 bp, Homo sapiens
caaatgcataaa

SEQ ID NO: 1471350 - DNA, 19 bp, Homo sapiens
caaatgcatgcttcttctc

SEQ ID NO: 1471351 - DNA, 20 bp, Homo sapiens
caaatgcatgcttcttctca

SEQ ID NO: 1471352 - DNA, 21 bp, Homo sapiens
caaatgccaaacactagctct

SEQ ID NO: 1471353 - DNA, 19 bp, Homo sapiens
caaatggagctttctgtat

SEQ ID NO: 1471354 - DNA, 22 bp, Homo sapiens
caaatggattttgggagtgact

SEQ ID NO: 1471355 - DNA, 21 bp, Homo sapiens
caaatggccagttttctggta

SEQ ID NO: 1471356 - DNA, 19 bp, Homo sapiens
caaatgggactgatgtcat

SEQ ID NO: 1471357 - DNA, 17 bp, Homo sapiens
caaatggggccagatcc

SEQ ID NO: 1471358 - DNA, 18 bp, Homo sapiens
caaatggggccagatcca

SEQ ID NO: 1471359 - DNA, 23 bp, Homo sapiens
caaatgggtgcccgtatccagag

SEQ ID NO: 1471360 - DNA, 14 bp, Homo sapiens
caaatgtaaatcaa

SEQ ID NO: 1471361 - DNA, 15 bp, Homo sapiens
caaatgtatgtatca

SEQ ID NO: 1471362 - DNA, 18 bp, Homo sapiens
caaatgtcattgtctact

SEQ ID NO: 1471363 - DNA, 19 bp, Homo sapiens
caaatgtcctccagaagcc

SEQ ID NO: 1471364 - DNA, 16 bp, Homo sapiens
caaatgtctaattgtc

SEQ ID NO: 1471365 - DNA, 15 bp, Homo sapiens
caaatgtgaaacgga

SEQ ID NO: 1471366 - DNA, 14 bp, Homo sapiens
caaatgtgacctgt

SEQ ID NO: 1471367 - DNA, 17 bp, Homo sapiens
caaatgtgacctgtgtc

SEQ ID NO: 1471368 - DNA, 16 bp, Homo sapiens
caaatgtgatcaactg

SEQ ID NO: 1471369 - DNA, 22 bp, Homo sapiens
caaatgtgtacgtgcatgctgt

SEQ ID NO: 1471370 - DNA, 23 bp, Homo sapiens
caaatgtgtcagaataggaaaac

SEQ ID NO: 1471371 - DNA, 19 bp, Homo sapiens
caaatgtgtttttctatat

SEQ ID NO: 1471372 - DNA, 21 bp, Homo sapiens
caaatgttatgcataaagtca

SEQ ID NO: 1471373 - DNA, 20 bp, Homo sapiens
caaatgttcatatttattga

SEQ ID NO: 1471374 - DNA, 19 bp, Homo sapiens
caaatgttctaagtttcta

SEQ ID NO: 1471375 - DNA, 22 bp, Homo sapiens
caaatgttctaagtttctaaga

SEQ ID NO: 1471376 - DNA, 23 bp, Homo sapiens
caaatgttctaagtttctaagat

SEQ ID NO: 1471377 - DNA, 13 bp, Homo sapiens
caaatgtttcctt

SEQ ID NO: 1471378 - DNA, 18 bp, Homo sapiens
caaatgtttccttaaaca

SEQ ID NO: 1471379 - DNA, 19 bp, Homo sapiens
caaatgtttctaaggtaac

SEQ ID NO: 1471380 - DNA, 20 bp, Homo sapiens
caaatgtttgaaaacaaaaa

SEQ ID NO: 1471381 - DNA, 17 bp, Homo sapiens
caaatgttttgaaatga

SEQ ID NO: 1471382 - DNA, 13 bp, Homo sapiens
caaattaaaaaaa

SEQ ID NO: 1471383 - DNA, 19 bp, Homo sapiens
caaattaaaaaaaaattgt

SEQ ID NO: 1471384 - DNA, 21 bp, Homo sapiens
caaattaaaaaaaaattgtat

SEQ ID NO: 1471385 - DNA, 14 bp, Homo sapiens
caaattaaaacaaa

SEQ ID NO: 1471386 - DNA, 13 bp, Homo sapiens
caaattaatttta

SEQ ID NO: 1471387 - DNA, 23 bp, Homo sapiens
caaattacaaaaggctcgtttgg

SEQ ID NO: 1471388 - DNA, 18 bp, Homo sapiens
caaattagaagacattta

SEQ ID NO: 1471389 - DNA, 16 bp, Homo sapiens
caaattagttggtttg

SEQ ID NO: 1471390 - DNA, 14 bp, Homo sapiens
caaattataatgta

SEQ ID NO: 1471391 - DNA, 15 bp, Homo sapiens
caaattataatgtat

SEQ ID NO: 1471392 - DNA, 20 bp, Homo sapiens
caaattataatgtattcata

SEQ ID NO: 1471393 - DNA, 14 bp, Homo sapiens
caaattattttaat

SEQ ID NO: 1471394 - DNA, 16 bp, Homo sapiens
caaattcatattctgt

SEQ ID NO: 1471395 - DNA, 15 bp, Homo sapiens
caaattcatttttaa

SEQ ID NO: 1471396 - DNA, 20 bp, Homo sapiens
caaattctacaacttttcct

SEQ ID NO: 1471397 - DNA, 15 bp, Homo sapiens
caaattcttctgaac

SEQ ID NO: 1471398 - DNA, 16 bp, Homo sapiens
caaattctttagtact

SEQ ID NO: 1471399 - DNA, 19 bp, Homo sapiens
caaattctttagtactcaa

SEQ ID NO: 1471400 - DNA, 17 bp, Homo sapiens
caagagaatctgatcaa

SEQ ID NO: 1471401 - DNA, 14 bp, Homo sapiens
caagagagaaagaa

SEQ ID NO: 1471402 - DNA, 17 bp, Homo sapiens
caagagatagagaccat

SEQ ID NO: 1471403 - DNA, 12 bp, Homo sapiens
caagagatctac

SEQ ID NO: 1471404 - DNA, 14 bp, Homo sapiens
caagagatctacac

SEQ ID NO: 1471405 - DNA, 15 bp, Homo sapiens
caagagatctacaca

SEQ ID NO: 1471406 - DNA, 16 bp, Homo sapiens
caagagatctgtgtgg

SEQ ID NO: 1471407 - DNA, 21 bp, Homo sapiens
caagagatctgtgtggctcct

SEQ ID NO: 1471408 - DNA, 23 bp, Homo sapiens
caagagatgaagagtgagagggc

SEQ ID NO: 1471409 - DNA, 19 bp, Homo sapiens
caagagcaaaactccgtct

SEQ ID NO: 1471410 - DNA, 15 bp, Homo sapiens
caagagcagaggcag

SEQ ID NO: 1471411 - DNA, 16 bp, Homo sapiens
caagagcagaggcagc

SEQ ID NO: 1471412 - DNA, 18 bp, Homo sapiens
caagagcagctgggaact

SEQ ID NO: 1471413 - DNA, 19 bp, Homo sapiens
caagagcccagcagggcct

SEQ ID NO: 1471414 - DNA, 22 bp, Homo sapiens
caagagccctgtggccgccacc

SEQ ID NO: 1471415 - DNA, 12 bp, Homo sapiens
caagagccttgg

SEQ ID NO: 1471416 - DNA, 18 bp, Homo sapiens
caagagccttggtgtcca

SEQ ID NO: 1471417 - DNA, 23 bp, Homo sapiens
caagagccttggtgtccacctgg

SEQ ID NO: 1471418 - DNA, 15 bp, Homo sapiens
caagaggactgagac

SEQ ID NO: 1471419 - DNA, 15 bp, Homo sapiens
caagaggctgaggca

SEQ ID NO: 1471420 - DNA, 13 bp, Homo sapiens
caagaggggaaaa

SEQ ID NO: 1471421 - DNA, 22 bp, Homo sapiens
caagagggtcctttagtacctg

SEQ ID NO: 1471422 - DNA, 21 bp, Homo sapiens
caagagggtgacagcttcctt

SEQ ID NO: 1471423 - DNA, 14 bp, Homo sapiens
caagagggtggatc

SEQ ID NO: 1471424 - DNA, 12 bp, Homo sapiens
caagaggtctga

SEQ ID NO: 1471425 - DNA, 14 bp, Homo sapiens
caagaggtctgagc

SEQ ID NO: 1471426 - DNA, 18 bp, Homo sapiens
caagagtccggatttcta

SEQ ID NO: 1471427 - DNA, 19 bp, Homo sapiens
caagagtccggatttctaa

SEQ ID NO: 1471428 - DNA, 14 bp, Homo sapiens
caagagtctaaaga

SEQ ID NO: 1471429 - DNA, 20 bp, Homo sapiens
caagagtctaatagtctttg

SEQ ID NO: 1471430 - DNA, 22 bp, Homo sapiens
caagagtttcttgtaagccatc

SEQ ID NO: 1471431 - DNA, 21 bp, Homo sapiens
caagatattattaatttttat

SEQ ID NO: 1471432 - DNA, 15 bp, Homo sapiens
caagatattgtacat

SEQ ID NO: 1471433 - DNA, 16 bp, Homo sapiens
caagatattgtacata

SEQ ID NO: 1471434 - DNA, 21 bp, Homo sapiens
caagatattgtacataaaaga

SEQ ID NO: 1471435 - DNA, 18 bp, Homo sapiens
caagatccatctaaactg

SEQ ID NO: 1471436 - DNA, 18 bp, Homo sapiens
caagatcgcaccactgca

SEQ ID NO: 1471437 - DNA, 18 bp, Homo sapiens
caagatcttgtctccact

SEQ ID NO: 1471438 - DNA, 21 bp, Homo sapiens
caagatcttgtctccactaaa

SEQ ID NO: 1471439 - DNA, 13 bp, Homo sapiens
caagatctttcag

SEQ ID NO: 1471440 - DNA, 14 bp, Homo sapiens
caagatctttcagg

SEQ ID NO: 1471441 - DNA, 17 bp, Homo sapiens
caagatgacagctcttc

SEQ ID NO: 1471442 - DNA, 23 bp, Homo sapiens
caagatgacagctcttctaagga

SEQ ID NO: 1471443 - DNA, 21 bp, Homo sapiens
caagatgagattggcatggct

SEQ ID NO: 1471444 - DNA, 18 bp, Homo sapiens
caagatggctgctgcctg

SEQ ID NO: 1471445 - DNA, 22 bp, Homo sapiens
caagatggctgctgcctgctca

SEQ ID NO: 1471446 - DNA, 18 bp, Homo sapiens
caagatgggggcagggct

SEQ ID NO: 1471447 - DNA, 23 bp, Homo sapiens
caagatggtccatttgttcctgc

SEQ ID NO: 1471448 - DNA, 21 bp, Homo sapiens
caagatggtgttatcttttga

SEQ ID NO: 1471449 - DNA, 16 bp, Homo sapiens
caagatggttctagca

SEQ ID NO: 1471450 - DNA, 16 bp, Homo sapiens
caagatgtcagactgg

SEQ ID NO: 1471451 - DNA, 23 bp, Homo sapiens
caagatgtgaattattgacactg

SEQ ID NO: 1471452 - DNA, 17 bp, Homo sapiens
caagatgttttgtataa

SEQ ID NO: 1471453 - DNA, 12 bp, Homo sapiens
caagattagaag

SEQ ID NO: 1471454 - DNA, 20 bp, Homo sapiens
caagattagaagctgaaaac

SEQ ID NO: 1471455 - DNA, 15 bp, Homo sapiens
caagattcccagaga

SEQ ID NO: 1471456 - DNA, 14 bp, Homo sapiens
caagattctaaagc

SEQ ID NO: 1471457 - DNA, 16 bp, Homo sapiens
caagattctaaagctc

SEQ ID NO: 1471458 - DNA, 13 bp, Homo sapiens
caagattctagat

SEQ ID NO: 1471459 - DNA, 14 bp, Homo sapiens
caagattctagatg

SEQ ID NO: 1471460 - DNA, 17 bp, Homo sapiens
caagattctagatgatt

SEQ ID NO: 1471461 - DNA, 12 bp, Homo sapiens
caagattgaaaa

SEQ ID NO: 1471462 - DNA, 14 bp, Homo sapiens
caagatttagaaaa

SEQ ID NO: 1471463 - DNA, 15 bp, Homo sapiens
caagatttagaaaaa

SEQ ID NO: 1471464 - DNA, 23 bp, Homo sapiens
caagatttccctaaaaattccac

SEQ ID NO: 1471465 - DNA, 21 bp, Homo sapiens
caagattttagggcttttatt

SEQ ID NO: 1471466 - DNA, 17 bp, Homo sapiens
caagattttccacaaga

SEQ ID NO: 1471467 - DNA, 16 bp, Homo sapiens
caagcaataattgttt

SEQ ID NO: 1471468 - DNA, 19 bp, Homo sapiens
caagcaataattgtttcca

SEQ ID NO: 1471469 - DNA, 14 bp, Homo sapiens
caagcaatgatgac

SEQ ID NO: 1471470 - DNA, 15 bp, Homo sapiens
caagcaatgatgacc

SEQ ID NO: 1471471 - DNA, 17 bp, Homo sapiens
caagcaatgatgaccca

SEQ ID NO: 1471472 - DNA, 16 bp, Homo sapiens
caagcacaacccacca

SEQ ID NO: 1471473 - DNA, 14 bp, Homo sapiens
caagcactatttta

SEQ ID NO: 1471474 - DNA, 18 bp, Homo sapiens
caagcactcgagaccatc

SEQ ID NO: 1471475 - DNA, 22 bp, Homo sapiens
caagcactcgagaccatcctgg

SEQ ID NO: 1471476 - DNA, 16 bp, Homo sapiens
caagcactgctcacgt

SEQ ID NO: 1471477 - DNA, 22 bp, Homo sapiens
caagcactgctcacgtctctgc

SEQ ID NO: 1471478 - DNA, 13 bp, Homo sapiens
caagcacttccca

SEQ ID NO: 1471479 - DNA, 17 bp, Homo sapiens
caagcacttcccaggat

SEQ ID NO: 1471480 - DNA, 20 bp, Homo sapiens
caagcagaggaccagggcct

SEQ ID NO: 1471481 - DNA, 21 bp, Homo sapiens
caagcagaggaccagggcctt

SEQ ID NO: 1471482 - DNA, 22 bp, Homo sapiens
caagcagaggaccagggccttt

SEQ ID NO: 1471483 - DNA, 21 bp, Homo sapiens
caagcagagtgcacagctgtc

SEQ ID NO: 1471484 - DNA, 13 bp, Homo sapiens
caagcagccagcc

SEQ ID NO: 1471485 - DNA, 17 bp, Homo sapiens
caagcagccagccagtc

SEQ ID NO: 1471486 - DNA, 15 bp, Homo sapiens
caagcagcccttgct

SEQ ID NO: 1471487 - DNA, 19 bp, Homo sapiens
caagcagctggtcagtctt

SEQ ID NO: 1471488 - DNA, 20 bp, Homo sapiens
caagcagtcgtgcctgtgtc

SEQ ID NO: 1471489 - DNA, 21 bp, Homo sapiens
caagcagtcgtgcctgtgtcc

SEQ ID NO: 1471490 - DNA, 12 bp, Homo sapiens
caagcatttcat

SEQ ID NO: 1471491 - DNA, 20 bp, Homo sapiens
caagcatttcatgaaaaagc

SEQ ID NO: 1471492 - DNA, 15 bp, Homo sapiens
caagccaaacattct

SEQ ID NO: 1471493 - DNA, 15 bp, Homo sapiens
caagccaaagagcct

SEQ ID NO: 1471494 - DNA, 16 bp, Homo sapiens
caagccaaagagcctc

SEQ ID NO: 1471495 - DNA, 21 bp, Homo sapiens
caagccaaagagcctcccacc

SEQ ID NO: 1471496 - DNA, 18 bp, Homo sapiens
caagccaacgacaaagcc

SEQ ID NO: 1471497 - DNA, 20 bp, Homo sapiens
caagccaacttgtaaataca

SEQ ID NO: 1471498 - DNA, 21 bp, Homo sapiens
caagccaagggaacctgtgtc

SEQ ID NO: 1471499 - DNA, 23 bp, Homo sapiens
caagccaagggaacctgtgtccg

SEQ ID NO: 1471500 - DNA, 15 bp, Homo sapiens
caagccaatcccctc

SEQ ID NO: 1471501 - DNA, 22 bp, Homo sapiens
caagccaatcccctccttgggc

SEQ ID NO: 1471502 - DNA, 19 bp, Homo sapiens
caagccacaagctgacccc

SEQ ID NO: 1471503 - DNA, 14 bp, Homo sapiens
caagccagagtttt

SEQ ID NO: 1471504 - DNA, 19 bp, Homo sapiens
caagccagccccctccagc

SEQ ID NO: 1471505 - DNA, 22 bp, Homo sapiens
caagccagccccctccagctca

SEQ ID NO: 1471506 - DNA, 19 bp, Homo sapiens
caagccaggctcactcaca

SEQ ID NO: 1471507 - DNA, 20 bp, Homo sapiens
caagccaggctcactcacag

SEQ ID NO: 1471508 - DNA, 18 bp, Homo sapiens
caagccagggtgtgtctc

SEQ ID NO: 1471509 - DNA, 12 bp, Homo sapiens
caagccccatct

SEQ ID NO: 1471510 - DNA, 17 bp, Homo sapiens
caagccccatttcctca

SEQ ID NO: 1471511 - DNA, 16 bp, Homo sapiens
caagcccctcagccct

SEQ ID NO: 1471512 - DNA, 17 bp, Homo sapiens
caagcccctcagccctt

SEQ ID NO: 1471513 - DNA, 18 bp, Homo sapiens
caagcccgttagccccag

SEQ ID NO: 1471514 - DNA, 18 bp, Homo sapiens
caatagctttaccctcag

SEQ ID NO: 1471515 - DNA, 16 bp, Homo sapiens
caataggctgtaatca

SEQ ID NO: 1471516 - DNA, 16 bp, Homo sapiens
caatagtttttaaaag

SEQ ID NO: 1471517 - DNA, 21 bp, Homo sapiens
caatagttttttacttctctt

SEQ ID NO: 1471518 - DNA, 20 bp, Homo sapiens
caatataaaactgtacttca

SEQ ID NO: 1471519 - DNA, 22 bp, Homo sapiens
caatataaaaggcaaatgtgta

SEQ ID NO: 1471520 - DNA, 19 bp, Homo sapiens
caatataactgagttatat

SEQ ID NO: 1471521 - DNA, 12 bp, Homo sapiens
caatatagaaac

SEQ ID NO: 1471522 - DNA, 12 bp, Homo sapiens
caatatatatta

SEQ ID NO: 1471523 - DNA, 20 bp, Homo sapiens
caatatattgaacttttgta

SEQ ID NO: 1471524 - DNA, 17 bp, Homo sapiens
caatatcagctttgata

SEQ ID NO: 1471525 - DNA, 17 bp, Homo sapiens
caatatccattctgtag

SEQ ID NO: 1471526 - DNA, 19 bp, Homo sapiens
caatatccctcttgtaagt

SEQ ID NO: 1471527 - DNA, 19 bp, Homo sapiens
caatatcttgcttgaactt

SEQ ID NO: 1471528 - DNA, 20 bp, Homo sapiens
caatatgtgagtgccttttg

SEQ ID NO: 1471529 - DNA, 22 bp, Homo sapiens
caatatgtgagtgccttttgca

SEQ ID NO: 1471530 - DNA, 12 bp, Homo sapiens
caatattaaata

SEQ ID NO: 1471531 - DNA, 19 bp, Homo sapiens
caatattactttgtctttt

SEQ ID NO: 1471532 - DNA, 23 bp, Homo sapiens
caatattactttgtcttttcaat

SEQ ID NO: 1471533 - DNA, 13 bp, Homo sapiens
caatattataatt

SEQ ID NO: 1471534 - DNA, 21 bp, Homo sapiens
caatattcctgaatgaaatat

SEQ ID NO: 1471535 - DNA, 16 bp, Homo sapiens
caatattctgtaacta

SEQ ID NO: 1471536 - DNA, 16 bp, Homo sapiens
caatattgacatttgt

SEQ ID NO: 1471537 - DNA, 16 bp, Homo sapiens
caatattgattgggaa

SEQ ID NO: 1471538 - DNA, 20 bp, Homo sapiens
caatattgattgggaaaaca

SEQ ID NO: 1471539 - DNA, 21 bp, Homo sapiens
caatattgattgggaaaacat

SEQ ID NO: 1471540 - DNA, 19 bp, Homo sapiens
caatatttagaaaattttg

SEQ ID NO: 1471541 - DNA, 21 bp, Homo sapiens
caatatttagaaaattttgta

SEQ ID NO: 1471542 - DNA, 17 bp, Homo sapiens
caatatttattacacaa

SEQ ID NO: 1471543 - DNA, 15 bp, Homo sapiens
caatatttgaatttt

SEQ ID NO: 1471544 - DNA, 17 bp, Homo sapiens
caatattttcttttccc

SEQ ID NO: 1471545 - DNA, 22 bp, Homo sapiens
caatattttttattcagtaaac

SEQ ID NO: 1471546 - DNA, 14 bp, Homo sapiens
caatcaaagaatta

SEQ ID NO: 1471547 - DNA, 18 bp, Homo sapiens
caatcaaaggaaaatagt

SEQ ID NO: 1471548 - DNA, 14 bp, Homo sapiens
caatcaaatctgct

SEQ ID NO: 1471549 - DNA, 15 bp, Homo sapiens
caatcaactttactg

SEQ ID NO: 1471550 - DNA, 16 bp, Homo sapiens
caatcaactttactgt

SEQ ID NO: 1471551 - DNA, 18 bp, Homo sapiens
caatcaaggttataattt

SEQ ID NO: 1471552 - DNA, 16 bp, Homo sapiens
caatcaccaccaggta

SEQ ID NO: 1471553 - DNA, 19 bp, Homo sapiens
caatcagaacttcaggtgt

SEQ ID NO: 1471554 - DNA, 23 bp, Homo sapiens
caatcagagctccagtttgcatt

SEQ ID NO: 1471555 - DNA, 18 bp, Homo sapiens
caatcagcccagtgcaaa

SEQ ID NO: 1471556 - DNA, 19 bp, Homo sapiens
caatcagcttttgttctag

SEQ ID NO: 1471557 - DNA, 21 bp, Homo sapiens
caatcagcttttgttctagac

SEQ ID NO: 1471558 - DNA, 22 bp, Homo sapiens
caatcagcttttgttctagact

SEQ ID NO: 1471559 - DNA, 16 bp, Homo sapiens
caatcagtataattct

SEQ ID NO: 1471560 - DNA, 20 bp, Homo sapiens
caatcagtcccctcccatct

SEQ ID NO: 1471561 - DNA, 21 bp, Homo sapiens
caatcagtcccctcccatctg

SEQ ID NO: 1471562 - DNA, 22 bp, Homo sapiens
caatcagtcccctcccatctgg

SEQ ID NO: 1471563 - DNA, 15 bp, Homo sapiens
caatcagttgacttt

SEQ ID NO: 1471564 - DNA, 17 bp, Homo sapiens
caatccataactttagt

SEQ ID NO: 1471565 - DNA, 17 bp, Homo sapiens
caatcccaccaaccctc

SEQ ID NO: 1471566 - DNA, 14 bp, Homo sapiens
caatcccctccttg

SEQ ID NO: 1471567 - DNA, 20 bp, Homo sapiens
caatcccctccttgggcact

SEQ ID NO: 1471568 - DNA, 15 bp, Homo sapiens
caatcccgtgaaaga

SEQ ID NO: 1471569 - DNA, 18 bp, Homo sapiens
caatcccgtgaaagaatt

SEQ ID NO: 1471570 - DNA, 20 bp, Homo sapiens
caatccctcaccttctgagt

SEQ ID NO: 1471571 - DNA, 20 bp, Homo sapiens
caatccctttattaccccct

SEQ ID NO: 1471572 - DNA, 17 bp, Homo sapiens
caatcctaacacattat

SEQ ID NO: 1471573 - DNA, 21 bp, Homo sapiens
caatcctaatttctcctccct

SEQ ID NO: 1471574 - DNA, 14 bp, Homo sapiens
caatcctcactggg

SEQ ID NO: 1471575 - DNA, 17 bp, Homo sapiens
caatcctcactgggtgg

SEQ ID NO: 1471576 - DNA, 18 bp, Homo sapiens
caatcctcactgggtggg

SEQ ID NO: 1471577 - DNA, 15 bp, Homo sapiens
caatcctctctcccc

SEQ ID NO: 1471578 - DNA, 17 bp, Homo sapiens
caatcctgtctttctga

SEQ ID NO: 1471579 - DNA, 19 bp, Homo sapiens
caatccttttgataaattt

SEQ ID NO: 1471580 - DNA, 17 bp, Homo sapiens
caatctaacaataatat

SEQ ID NO: 1471581 - DNA, 19 bp, Homo sapiens
caatctaacaataatattt

SEQ ID NO: 1471582 - DNA, 17 bp, Homo sapiens
caatctcccgctgctgc

SEQ ID NO: 1471583 - DNA, 18 bp, Homo sapiens
caatctcggctcactgca

SEQ ID NO: 1471584 - DNA, 10 bp, Homo sapiens
caatctctgg

SEQ ID NO: 1471585 - DNA, 23 bp, Homo sapiens
caatctctgttctgtttggcact

SEQ ID NO: 1471586 - DNA, 21 bp, Homo sapiens
caatctggctcactgcagcct

SEQ ID NO: 1471587 - DNA, 12 bp, Homo sapiens
caatctgtaaac

SEQ ID NO: 1471588 - DNA, 16 bp, Homo sapiens
caatctgtaaactgtg

SEQ ID NO: 1471589 - DNA, 16 bp, Homo sapiens
caatcttattccgagc

SEQ ID NO: 1471590 - DNA, 23 bp, Homo sapiens
caatcttgttactgctgattctt

SEQ ID NO: 1471591 - DNA, 23 bp, Homo sapiens
caatctttaacaacctctgagcc

SEQ ID NO: 1471592 - DNA, 14 bp, Homo sapiens
caatctttgaaata

SEQ ID NO: 1471593 - DNA, 12 bp, Homo sapiens
caatgaaaacat

SEQ ID NO: 1471594 - DNA, 14 bp, Homo sapiens
caatgaacagctcc

SEQ ID NO: 1471595 - DNA, 15 bp, Homo sapiens
caatgaacagctcct

SEQ ID NO: 1471596 - DNA, 15 bp, Homo sapiens
caatgaaccataaat

SEQ ID NO: 1471597 - DNA, 17 bp, Homo sapiens
caatgaaccataaattc

SEQ ID NO: 1471598 - DNA, 18 bp, Homo sapiens
caatgaactgcttttcct

SEQ ID NO: 1471599 - DNA, 14 bp, Homo sapiens
caatgaagaagaca

SEQ ID NO: 1471600 - DNA, 17 bp, Homo sapiens
caatgaagaagacaaag

SEQ ID NO: 1471601 - DNA, 18 bp, Homo sapiens
caatgaagtgaaaaagtt

SEQ ID NO: 1471602 - DNA, 20 bp, Homo sapiens
caatgacacccatgccagag

SEQ ID NO: 1471603 - DNA, 19 bp, Homo sapiens
caatgaggcagatagcact

SEQ ID NO: 1471604 - DNA, 18 bp, Homo sapiens
caatgatagtaagaaaag

SEQ ID NO: 1471605 - DNA, 19 bp, Homo sapiens
caatgatgacccactaaag

SEQ ID NO: 1471606 - DNA, 21 bp, Homo sapiens
caatgatgacccactaaagag

SEQ ID NO: 1471607 - DNA, 21 bp, Homo sapiens
caatgatggcaattttgtaac

SEQ ID NO: 1471608 - DNA, 13 bp, Homo sapiens
caatgatggtcac

SEQ ID NO: 1471609 - DNA, 21 bp, Homo sapiens
caatgcaagagtgattgcagc

SEQ ID NO: 1471610 - DNA, 14 bp, Homo sapiens
caatgcattggcct

SEQ ID NO: 1471611 - DNA, 17 bp, Homo sapiens
caatgcattggcctctg

SEQ ID NO: 1471612 - DNA, 14 bp, Homo sapiens
caatgccatgaaca

SEQ ID NO: 1471613 - DNA, 14 bp, Homo sapiens
caatgccctgccat

SEQ ID NO: 1471614 - DNA, 16 bp, Homo sapiens
caatgccctgccatta

SEQ ID NO: 1471615 - DNA, 16 bp, Homo sapiens
caatgcctacagctgt

SEQ ID NO: 1471616 - DNA, 15 bp, Homo sapiens
caatgcctttttaga

SEQ ID NO: 1471617 - DNA, 17 bp, Homo sapiens
caatgcctttttagatg

SEQ ID NO: 1471618 - DNA, 20 bp, Homo sapiens
caatgcctttttagatgtat

SEQ ID NO: 1471619 - DNA, 22 bp, Homo sapiens
caatgcggcccactttcctgag

SEQ ID NO: 1471620 - DNA, 23 bp, Homo sapiens
caatgcggcccactttcctgagc

SEQ ID NO: 1471621 - DNA, 15 bp, Homo sapiens
caatgctatcactgt

SEQ ID NO: 1471622 - DNA, 14 bp, Homo sapiens
caatgctgatttgg

SEQ ID NO: 1471623 - DNA, 18 bp, Homo sapiens
caatgctgttgtaaacaa

SEQ ID NO: 1471624 - DNA, 18 bp, Homo sapiens
caatgctttgggaggcca

SEQ ID NO: 1471625 - DNA, 20 bp, Homo sapiens
caatgctttgggaggccaag

SEQ ID NO: 1471626 - DNA, 15 bp, Homo sapiens
caatggaaactgaat

SEQ ID NO: 1471627 - DNA, 18 bp, Homo sapiens
caatggatcagccaaggc

SEQ ID NO: 1471628 - DNA, 15 bp, Homo sapiens
cacagacctggagcc

SEQ ID NO: 1471629 - DNA, 19 bp, Homo sapiens
cacagacctggagcccctg

SEQ ID NO: 1471630 - DNA, 23 bp, Homo sapiens
cacagacctggagcccctgggtg

SEQ ID NO: 1471631 - DNA, 21 bp, Homo sapiens
cacagacgttaggcatttcct

SEQ ID NO: 1471632 - DNA, 16 bp, Homo sapiens
cacagacttctggaag

SEQ ID NO: 1471633 - DNA, 18 bp, Homo sapiens
cacagacttctggaaggc

SEQ ID NO: 1471634 - DNA, 22 bp, Homo sapiens
cacagacttctggaaggctggc

SEQ ID NO: 1471635 - DNA, 13 bp, Homo sapiens
cacagacttgcac

SEQ ID NO: 1471636 - DNA, 20 bp, Homo sapiens
cacagacttgcactgaagcc

SEQ ID NO: 1471637 - DNA, 15 bp, Homo sapiens
cacagagaagctcct

SEQ ID NO: 1471638 - DNA, 18 bp, Homo sapiens
cacagagaagctcctgct

SEQ ID NO: 1471639 - DNA, 11 bp, Homo sapiens
cacagagaagg

SEQ ID NO: 1471640 - DNA, 17 bp, Homo sapiens
cacagagagcttggcaa

SEQ ID NO: 1471641 - DNA, 10 bp, Homo sapiens
cacagagagg

SEQ ID NO: 1471642 - DNA, 13 bp, Homo sapiens
cacagagaggagg

SEQ ID NO: 1471643 - DNA, 16 bp, Homo sapiens
cacagagaggagggga

SEQ ID NO: 1471644 - DNA, 16 bp, Homo sapiens
cacagagcaaaagagg

SEQ ID NO: 1471645 - DNA, 23 bp, Homo sapiens
cacagagcaagagataagtcttt

SEQ ID NO: 1471646 - DNA, 20 bp, Homo sapiens
cacagagcacgcctgccatc

SEQ ID NO: 1471647 - DNA, 22 bp, Homo sapiens
cacagagctttggtctgtgtgt

SEQ ID NO: 1471648 - DNA, 18 bp, Homo sapiens
cacagaggcttcttcaga

SEQ ID NO: 1471649 - DNA, 13 bp, Homo sapiens
cacagagtgagcc

SEQ ID NO: 1471650 - DNA, 16 bp, Homo sapiens
cacagagtgagccagt

SEQ ID NO: 1471651 - DNA, 19 bp, Homo sapiens
cacagataattttttctta

SEQ ID NO: 1471652 - DNA, 20 bp, Homo sapiens
cacagatggctttcagggca

SEQ ID NO: 1471653 - DNA, 20 bp, Homo sapiens
cacagatgggtattaaactt

SEQ ID NO: 1471654 - DNA, 21 bp, Homo sapiens
cacagattatgttcctgctgt

SEQ ID NO: 1471655 - DNA, 13 bp, Homo sapiens
cacagatttgcat

SEQ ID NO: 1471656 - DNA, 13 bp, Homo sapiens
cacagcaagccat

SEQ ID NO: 1471657 - DNA, 15 bp, Homo sapiens
cacagcacaagggca

SEQ ID NO: 1471658 - DNA, 16 bp, Homo sapiens
cacagcacaccagccg

SEQ ID NO: 1471659 - DNA, 21 bp, Homo sapiens
cacagcacaccagccgctgca

SEQ ID NO: 1471660 - DNA, 24 bp, Homo sapiens
cacagcaccgggggagagggacac

SEQ ID NO: 1471661 - DNA, 22 bp, Homo sapiens
cacagcagcacctcctccatgc

SEQ ID NO: 1471662 - DNA, 23 bp, Homo sapiens
cacagcagctgcaggggcctctg

SEQ ID NO: 1471663 - DNA, 19 bp, Homo sapiens
cacagcagcttcaccagag

SEQ ID NO: 1471664 - DNA, 12 bp, Homo sapiens
cacagcagtgag

SEQ ID NO: 1471665 - DNA, 14 bp, Homo sapiens
cacagcagtgtccc

SEQ ID NO: 1471666 - DNA, 15 bp, Homo sapiens
cacagcagtgtcccc

SEQ ID NO: 1471667 - DNA, 22 bp, Homo sapiens
cacagcagttgaaaagactcca

SEQ ID NO: 1471668 - DNA, 22 bp, Homo sapiens
cacagcatcgggagcacccaga

SEQ ID NO: 1471669 - DNA, 16 bp, Homo sapiens
cacagcatggaggagg

SEQ ID NO: 1471670 - DNA, 15 bp, Homo sapiens
cacagcatgtgccaa

SEQ ID NO: 1471671 - DNA, 17 bp, Homo sapiens
cacagcatgtgccaaga

SEQ ID NO: 1471672 - DNA, 18 bp, Homo sapiens
cacagcatttgctttcct

SEQ ID NO: 1471673 - DNA, 16 bp, Homo sapiens
cacagccaaatttaaa

SEQ ID NO: 1471674 - DNA, 20 bp, Homo sapiens
cacagccagacttgcttcct

SEQ ID NO: 1471675 - DNA, 17 bp, Homo sapiens
cacagcccaaaatttga

SEQ ID NO: 1471676 - DNA, 13 bp, Homo sapiens
cacagcccagcca

SEQ ID NO: 1471677 - DNA, 16 bp, Homo sapiens
cacagcccagccacgg

SEQ ID NO: 1471678 - DNA, 16 bp, Homo sapiens
cacagccccaacctcc

SEQ ID NO: 1471679 - DNA, 18 bp, Homo sapiens
cacagcccccttgccctc

SEQ ID NO: 1471680 - DNA, 19 bp, Homo sapiens
cacagcccccttgccctcc

SEQ ID NO: 1471681 - DNA, 22 bp, Homo sapiens
cacagcccccttgccctccgcc

SEQ ID NO: 1471682 - DNA, 17 bp, Homo sapiens
cacagcccctcaaagac

SEQ ID NO: 1471683 - DNA, 19 bp, Homo sapiens
cacagccctgagtgtccca

SEQ ID NO: 1471684 - DNA, 22 bp, Homo sapiens
cacagccctgagtgtcccaagc

SEQ ID NO: 1471685 - DNA, 15 bp, Homo sapiens
cacagccctgggagg

SEQ ID NO: 1471686 - DNA, 13 bp, Homo sapiens
cacagcctggact

SEQ ID NO: 1471687 - DNA, 13 bp, Homo sapiens
cacagccttcgga

SEQ ID NO: 1471688 - DNA, 19 bp, Homo sapiens
cacagcctttcgttctgct

SEQ ID NO: 1471689 - DNA, 23 bp, Homo sapiens
cacagcctttcgttctgctgacc

SEQ ID NO: 1471690 - DNA, 14 bp, Homo sapiens
cacagcgagggcag

SEQ ID NO: 1471691 - DNA, 17 bp, Homo sapiens
cacagcggaggagacca

SEQ ID NO: 1471692 - DNA, 21 bp, Homo sapiens
cacagcggaggagaccagctc

SEQ ID NO: 1471693 - DNA, 23 bp, Homo sapiens
cacagcggaggagaccagctcag

SEQ ID NO: 1471694 - DNA, 20 bp, Homo sapiens
cacagcggaggtgtggagcc

SEQ ID NO: 1471695 - DNA, 21 bp, Homo sapiens
cacagcggaggtgtggagccg

SEQ ID NO: 1471696 - DNA, 21 bp, Homo sapiens
cacagcggagtctgtcctgtg

SEQ ID NO: 1471697 - DNA, 23 bp, Homo sapiens
cacagcggagtctgtcctgtgac

SEQ ID NO: 1471698 - DNA, 18 bp, Homo sapiens
cacagcgtccctggcgca

SEQ ID NO: 1471699 - DNA, 19 bp, Homo sapiens
cacagcgtccctggcgcag

SEQ ID NO: 1471700 - DNA, 22 bp, Homo sapiens
cacagctacaaccctaccctgg

SEQ ID NO: 1471701 - DNA, 20 bp, Homo sapiens
cacagctacttggtttgtgt

SEQ ID NO: 1471702 - DNA, 16 bp, Homo sapiens
cacagctcagctgccc

SEQ ID NO: 1471703 - DNA, 17 bp, Homo sapiens
cacagctcagctgccca

SEQ ID NO: 1471704 - DNA, 21 bp, Homo sapiens
cacagctcagctgcccatccc

SEQ ID NO: 1471705 - DNA, 23 bp, Homo sapiens
cacagctcagctgcccatcccag

SEQ ID NO: 1471706 - DNA, 15 bp, Homo sapiens
cacagctcccacccc

SEQ ID NO: 1471707 - DNA, 13 bp, Homo sapiens
cacagctcccggc

SEQ ID NO: 1471708 - DNA, 21 bp, Homo sapiens
cacagctctccggtctctctc

SEQ ID NO: 1471709 - DNA, 11 bp, Homo sapiens
cacagctcttc

SEQ ID NO: 1471710 - DNA, 13 bp, Homo sapiens
cacagctcttcat

SEQ ID NO: 1471711 - DNA, 15 bp, Homo sapiens
cacagctgcagctga

SEQ ID NO: 1471712 - DNA, 13 bp, Homo sapiens
cacagctgcccta

SEQ ID NO: 1471713 - DNA, 22 bp, Homo sapiens
cacagctgccctagctgacccc

SEQ ID NO: 1471714 - DNA, 14 bp, Homo sapiens
cacagctgctggcc

SEQ ID NO: 1471715 - DNA, 16 bp, Homo sapiens
cacagctgctggccag

SEQ ID NO: 1471716 - DNA, 13 bp, Homo sapiens
cacagctgcttgt

SEQ ID NO: 1471717 - DNA, 13 bp, Homo sapiens
cacagctggctct

SEQ ID NO: 1471718 - DNA, 13 bp, Homo sapiens
cacagctgggcag

SEQ ID NO: 1471719 - DNA, 14 bp, Homo sapiens
cacagctgggcagg

SEQ ID NO: 1471720 - DNA, 16 bp, Homo sapiens
cacagctgggcagggt

SEQ ID NO: 1471721 - DNA, 17 bp, Homo sapiens
cacagctgggcagggtg

SEQ ID NO: 1471722 - DNA, 17 bp, Homo sapiens
cacagctgggcatgcca

SEQ ID NO: 1471723 - DNA, 18 bp, Homo sapiens
cacagcttcagccaggag

SEQ ID NO: 1471724 - DNA, 18 bp, Homo sapiens
cacagcttgacctgaggc

SEQ ID NO: 1471725 - DNA, 19 bp, Homo sapiens
cacagcttgacctgaggct

SEQ ID NO: 1471726 - DNA, 20 bp, Homo sapiens
cacagcttgacctgaggctg

SEQ ID NO: 1471727 - DNA, 12 bp, Homo sapiens
cacagcttttgc

SEQ ID NO: 1471728 - DNA, 23 bp, Homo sapiens
cacaggaaaccaacacccaaagc

SEQ ID NO: 1471729 - DNA, 22 bp, Homo sapiens
cacaggaaatgggaaaaaactt

SEQ ID NO: 1471730 - DNA, 15 bp, Homo sapiens
cacaggaagaaagca

SEQ ID NO: 1471731 - DNA, 22 bp, Homo sapiens
cacaggaagcctgcagtcctgg

SEQ ID NO: 1471732 - DNA, 24 bp, Homo sapiens
cacaggaagctcagccttctcctc

SEQ ID NO: 1471733 - DNA, 21 bp, Homo sapiens
cacaggacacctggccgcctc

SEQ ID NO: 1471734 - DNA, 19 bp, Homo sapiens
cacaggagtcttcagaccc

SEQ ID NO: 1471735 - DNA, 11 bp, Homo sapiens
cacaggcagct

SEQ ID NO: 1471736 - DNA, 16 bp, Homo sapiens
cacaggcagctggatg

SEQ ID NO: 1471737 - DNA, 21 bp, Homo sapiens
cacaggcagctggatgagact

SEQ ID NO: 1471738 - DNA, 18 bp, Homo sapiens
cacaggcagtgcatgtga

SEQ ID NO: 1471739 - DNA, 23 bp, Homo sapiens
cacaggcagtgcatgtgaagcat

SEQ ID NO: 1471740 - DNA, 13 bp, Homo sapiens
cacaggccagatg

SEQ ID NO: 1471741 - DNA, 13 bp, Homo sapiens
cacaggccctagc

SEQ ID NO: 1471742 - DNA, 21 bp, Homo sapiens
caccaaccaggccttcatcct

SEQ ID NO: 1471743 - DNA, 16 bp, Homo sapiens
caccaacttgccacat

SEQ ID NO: 1471744 - DNA, 13 bp, Homo sapiens
caccaagccaagg

SEQ ID NO: 1471745 - DNA, 14 bp, Homo sapiens
caccaagccaaggg

SEQ ID NO: 1471746 - DNA, 15 bp, Homo sapiens
caccaagctcacagt

SEQ ID NO: 1471747 - DNA, 17 bp, Homo sapiens
caccaagggtatctgct

SEQ ID NO: 1471748 - DNA, 22 bp, Homo sapiens
caccaagtggctgggtgccctc

SEQ ID NO: 1471749 - DNA, 20 bp, Homo sapiens
caccaataaatcagaccatg

SEQ ID NO: 1471750 - DNA, 15 bp, Homo sapiens
caccaataaatgttt

SEQ ID NO: 1471751 - DNA, 12 bp, Homo sapiens
caccaatgaaaa

SEQ ID NO: 1471752 - DNA, 15 bp, Homo sapiens
caccaatgaaaacat

SEQ ID NO: 1471753 - DNA, 17 bp, Homo sapiens
caccacactgaatctcc

SEQ ID NO: 1471754 - DNA, 12 bp, Homo sapiens
caccacagacac

SEQ ID NO: 1471755 - DNA, 14 bp, Homo sapiens
caccacagacacac

SEQ ID NO: 1471756 - DNA, 19 bp, Homo sapiens
caccacagacacacacacg

SEQ ID NO: 1471757 - DNA, 13 bp, Homo sapiens
caccacagccagc

SEQ ID NO: 1471758 - DNA, 17 bp, Homo sapiens
caccacatagcatgctt

SEQ ID NO: 1471759 - DNA, 20 bp, Homo sapiens
caccacatagcatgcttcct

SEQ ID NO: 1471760 - DNA, 14 bp, Homo sapiens
caccaccacactac

SEQ ID NO: 1471761 - DNA, 16 bp, Homo sapiens
caccaccactggccac

SEQ ID NO: 1471762 - DNA, 18 bp, Homo sapiens
caccaccactggccacca

SEQ ID NO: 1471763 - DNA, 23 bp, Homo sapiens
caccaccactggccaccaggctg

SEQ ID NO: 1471764 - DNA, 14 bp, Homo sapiens
caccaccaggagca

SEQ ID NO: 1471765 - DNA, 21 bp, Homo sapiens
caccaccaggagcagcagcca

SEQ ID NO: 1471766 - DNA, 14 bp, Homo sapiens
caccacccacccca

SEQ ID NO: 1471767 - DNA, 12 bp, Homo sapiens
caccaccctgcc

SEQ ID NO: 1471768 - DNA, 22 bp, Homo sapiens
caccaccctgccccccctaaga

SEQ ID NO: 1471769 - DNA, 17 bp, Homo sapiens
caccaccggccccctcc

SEQ ID NO: 1471770 - DNA, 16 bp, Homo sapiens
caccacctcactcctg

SEQ ID NO: 1471771 - DNA, 12 bp, Homo sapiens
caccacctctcc

SEQ ID NO: 1471772 - DNA, 13 bp, Homo sapiens
caccaccttccca

SEQ ID NO: 1471773 - DNA, 19 bp, Homo sapiens
caccaccttcccagctctc

SEQ ID NO: 1471774 - DNA, 18 bp, Homo sapiens
caccaccttcttctccta

SEQ ID NO: 1471775 - DNA, 20 bp, Homo sapiens
caccacgatgtggccctggc

SEQ ID NO: 1471776 - DNA, 17 bp, Homo sapiens
caccacggctcactgca

SEQ ID NO: 1471777 - DNA, 15 bp, Homo sapiens
caccacgtccagctg

SEQ ID NO: 1471778 - DNA, 19 bp, Homo sapiens
caccacgtctggctccctg

SEQ ID NO: 1471779 - DNA, 22 bp, Homo sapiens
caccacgtctggctccctgccc

SEQ ID NO: 1471780 - DNA, 15 bp, Homo sapiens
caccacgtgcagtat

SEQ ID NO: 1471781 - DNA, 16 bp, Homo sapiens
caccactaccagccag

SEQ ID NO: 1471782 - DNA, 17 bp, Homo sapiens
caccactaccagccagc

SEQ ID NO: 1471783 - DNA, 21 bp, Homo sapiens
caccactaggaatcccagagg

SEQ ID NO: 1471784 - DNA, 18 bp, Homo sapiens
caccactgacgtttctgg

SEQ ID NO: 1471785 - DNA, 15 bp, Homo sapiens
caccactgcactcca

SEQ ID NO: 1471786 - DNA, 16 bp, Homo sapiens
caccactgcactccag

SEQ ID NO: 1471787 - DNA, 19 bp, Homo sapiens
caccactgcactccagcct

SEQ ID NO: 1471788 - DNA, 16 bp, Homo sapiens
caccactgccctgcct

SEQ ID NO: 1471789 - DNA, 18 bp, Homo sapiens
caccactgccctgcctgc

SEQ ID NO: 1471790 - DNA, 20 bp, Homo sapiens
caccactgccctgcctgccc

SEQ ID NO: 1471791 - DNA, 21 bp, Homo sapiens
caccactgccctgcctgccca

SEQ ID NO: 1471792 - DNA, 14 bp, Homo sapiens
caccactgcctgac

SEQ ID NO: 1471793 - DNA, 18 bp, Homo sapiens
caccactgcttcccactg

SEQ ID NO: 1471794 - DNA, 13 bp, Homo sapiens
caccactggccac

SEQ ID NO: 1471795 - DNA, 19 bp, Homo sapiens
caccactgtactccagccc

SEQ ID NO: 1471796 - DNA, 21 bp, Homo sapiens
caccagaaatatcgctgatgc

SEQ ID NO: 1471797 - DNA, 17 bp, Homo sapiens
caccagaagctgttggg

SEQ ID NO: 1471798 - DNA, 18 bp, Homo sapiens
caccagacacccaggact

SEQ ID NO: 1471799 - DNA, 15 bp, Homo sapiens
caccagagcttctct

SEQ ID NO: 1471800 - DNA, 11 bp, Homo sapiens
caccagaggcc

SEQ ID NO: 1471801 - DNA, 23 bp, Homo sapiens
caccagaggccgaaggtgcctca

SEQ ID NO: 1471802 - DNA, 23 bp, Homo sapiens
caccagagtgaaagggctatggc

SEQ ID NO: 1471803 - DNA, 14 bp, Homo sapiens
caccagcaacatct

SEQ ID NO: 1471804 - DNA, 14 bp, Homo sapiens
caccagcagcactg

SEQ ID NO: 1471805 - DNA, 15 bp, Homo sapiens
caccagcagcatggc

SEQ ID NO: 1471806 - DNA, 20 bp, Homo sapiens
caccagcatcacctgcctgt

SEQ ID NO: 1471807 - DNA, 12 bp, Homo sapiens
caccagccccac

SEQ ID NO: 1471808 - DNA, 14 bp, Homo sapiens
caccagccccactg

SEQ ID NO: 1471809 - DNA, 22 bp, Homo sapiens
caccagccccactgccagcagc

SEQ ID NO: 1471810 - DNA, 23 bp, Homo sapiens
caccagccccactgccagcagca

SEQ ID NO: 1471811 - DNA, 24 bp, Homo sapiens
caccagccccctggatgggcattg

SEQ ID NO: 1471812 - DNA, 15 bp, Homo sapiens
caccagcccggcctg

SEQ ID NO: 1471813 - DNA, 13 bp, Homo sapiens
caccagccgctgc

SEQ ID NO: 1471814 - DNA, 14 bp, Homo sapiens
caccagccgctgca

SEQ ID NO: 1471815 - DNA, 17 bp, Homo sapiens
caccagccgctgcaggg

SEQ ID NO: 1471816 - DNA, 22 bp, Homo sapiens
caccagccgctgcagggctccc

SEQ ID NO: 1471817 - DNA, 10 bp, Homo sapiens
caccagcctg

SEQ ID NO: 1471818 - DNA, 13 bp, Homo sapiens
caccagcctgctg

SEQ ID NO: 1471819 - DNA, 14 bp, Homo sapiens
caccagcctgctga

SEQ ID NO: 1471820 - DNA, 15 bp, Homo sapiens
caccagcctgctgac

SEQ ID NO: 1471821 - DNA, 23 bp, Homo sapiens
caccagcctgctgacagacacta

SEQ ID NO: 1471822 - DNA, 23 bp, Homo sapiens
caccagcctggtgcccatcctcc

SEQ ID NO: 1471823 - DNA, 20 bp, Homo sapiens
caccagcctttctcccaggc

SEQ ID NO: 1471824 - DNA, 22 bp, Homo sapiens
caccagcctttctcccaggcca

SEQ ID NO: 1471825 - DNA, 13 bp, Homo sapiens
caccagctcccaa

SEQ ID NO: 1471826 - DNA, 13 bp, Homo sapiens
caccagctctgtg

SEQ ID NO: 1471827 - DNA, 14 bp, Homo sapiens
caccagctctgtgg

SEQ ID NO: 1471828 - DNA, 11 bp, Homo sapiens
caccagctgct

SEQ ID NO: 1471829 - DNA, 14 bp, Homo sapiens
caccagctgctctg

SEQ ID NO: 1471830 - DNA, 18 bp, Homo sapiens
caccagctgctctgcccc

SEQ ID NO: 1471831 - DNA, 12 bp, Homo sapiens
caccagctgctg

SEQ ID NO: 1471832 - DNA, 16 bp, Homo sapiens
caccagctgctgtgcc

SEQ ID NO: 1471833 - DNA, 20 bp, Homo sapiens
caccagctgctgtgccccac

SEQ ID NO: 1471834 - DNA, 17 bp, Homo sapiens
caccaggaatgttaaag

SEQ ID NO: 1471835 - DNA, 17 bp, Homo sapiens
caccaggagaaccacta

SEQ ID NO: 1471836 - DNA, 14 bp, Homo sapiens
caccaggagcagca

SEQ ID NO: 1471837 - DNA, 22 bp, Homo sapiens
caccaggcacgaacccacctgc

SEQ ID NO: 1471838 - DNA, 13 bp, Homo sapiens
caccaggccgggc

SEQ ID NO: 1471839 - DNA, 15 bp, Homo sapiens
caccaggcctggcct

SEQ ID NO: 1471840 - DNA, 23 bp, Homo sapiens
caccaggcgctaattcaaggaat

SEQ ID NO: 1471841 - DNA, 21 bp, Homo sapiens
caccaggctgctcagggctgg

SEQ ID NO: 1471842 - DNA, 15 bp, Homo sapiens
caccagggaagaaga

SEQ ID NO: 1471843 - DNA, 16 bp, Homo sapiens
caccaggggaaggaag

SEQ ID NO: 1471844 - DNA, 19 bp, Homo sapiens
caccaggggaaggaaggag

SEQ ID NO: 1471845 - DNA, 20 bp, Homo sapiens
caccaggggaggagcctgtg

SEQ ID NO: 1471846 - DNA, 23 bp, Homo sapiens
caccaggggtgctcacctctgcc

SEQ ID NO: 1471847 - DNA, 21 bp, Homo sapiens
caccagggtccgcaccagctg

SEQ ID NO: 1471848 - DNA, 23 bp, Homo sapiens
caccagggtccgcaccagctgct

SEQ ID NO: 1471849 - DNA, 17 bp, Homo sapiens
caccaggttgggaacat

SEQ ID NO: 1471850 - DNA, 19 bp, Homo sapiens
caccagtcacctcgtctcc

SEQ ID NO: 1471851 - DNA, 15 bp, Homo sapiens
caccagtgtcctccc

SEQ ID NO: 1471852 - DNA, 19 bp, Homo sapiens
caccagtgtcctcccctca

SEQ ID NO: 1471853 - DNA, 11 bp, Homo sapiens
caccagttctc

SEQ ID NO: 1471854 - DNA, 18 bp, Homo sapiens
caccatactccttgcttc

SEQ ID NO: 1471855 - DNA, 17 bp, Homo sapiens
caccatagtgtcacaga

SEQ ID NO: 1471856 - DNA, 15 bp, Homo sapiens
caccatatgaattgt

SEQ ID NO: 1471857 - DNA, 13 bp, Homo sapiens
caccgctgccagc

SEQ ID NO: 1471858 - DNA, 19 bp, Homo sapiens
caccgctgcctaagtggct

SEQ ID NO: 1471859 - DNA, 22 bp, Homo sapiens
caccgctggtccctgccctccc

SEQ ID NO: 1471860 - DNA, 18 bp, Homo sapiens
caccgcttctgccttttc

SEQ ID NO: 1471861 - DNA, 14 bp, Homo sapiens
caccggcctcggcc

SEQ ID NO: 1471862 - DNA, 18 bp, Homo sapiens
caccggcctgtgggtctc

SEQ ID NO: 1471863 - DNA, 20 bp, Homo sapiens
caccggcctgtgggtctctg

SEQ ID NO: 1471864 - DNA, 16 bp, Homo sapiens
caccggcgctgcaggt

SEQ ID NO: 1471865 - DNA, 18 bp, Homo sapiens
caccgggacagacctgga

SEQ ID NO: 1471866 - DNA, 19 bp, Homo sapiens
caccgggacagacctggac

SEQ ID NO: 1471867 - DNA, 14 bp, Homo sapiens
caccgggcagggcc

SEQ ID NO: 1471868 - DNA, 19 bp, Homo sapiens
caccgtcatggcttaatgt

SEQ ID NO: 1471869 - DNA, 23 bp, Homo sapiens
caccgtcatggcttaatgtttat

SEQ ID NO: 1471870 - DNA, 16 bp, Homo sapiens
caccgtccaggcccca

SEQ ID NO: 1471871 - DNA, 14 bp, Homo sapiens
caccgtccctcagt

SEQ ID NO: 1471872 - DNA, 15 bp, Homo sapiens
caccgtccctcagtg

SEQ ID NO: 1471873 - DNA, 14 bp, Homo sapiens
caccgtccgccctg

SEQ ID NO: 1471874 - DNA, 18 bp, Homo sapiens
caccgtccgccctgctcc

SEQ ID NO: 1471875 - DNA, 20 bp, Homo sapiens
caccgtgggcagtgccaccc

SEQ ID NO: 1471876 - DNA, 12 bp, Homo sapiens
caccgtggtcag

SEQ ID NO: 1471877 - DNA, 20 bp, Homo sapiens
caccgttaggattcaggcag

SEQ ID NO: 1471878 - DNA, 20 bp, Homo sapiens
caccgttcgtacgcccagga

SEQ ID NO: 1471879 - DNA, 21 bp, Homo sapiens
caccgtttgtcccccggggca

SEQ ID NO: 1471880 - DNA, 15 bp, Homo sapiens
cacctaaagcagcca

SEQ ID NO: 1471881 - DNA, 12 bp, Homo sapiens
cacctaactctt

SEQ ID NO: 1471882 - DNA, 21 bp, Homo sapiens
cacctaactcttttctatttt

SEQ ID NO: 1471883 - DNA, 16 bp, Homo sapiens
cacctaagtctctgtg

SEQ ID NO: 1471884 - DNA, 20 bp, Homo sapiens
cacctaatgtttatgagcca

SEQ ID NO: 1471885 - DNA, 16 bp, Homo sapiens
cacctacacaggagtc

SEQ ID NO: 1471886 - DNA, 15 bp, Homo sapiens
cacctaccatgctgc

SEQ ID NO: 1471887 - DNA, 20 bp, Homo sapiens
cacctactgcactttccccc

SEQ ID NO: 1471888 - DNA, 23 bp, Homo sapiens
cacctactgcactttcccccttc

SEQ ID NO: 1471889 - DNA, 15 bp, Homo sapiens
cacctagcagcctca

SEQ ID NO: 1471890 - DNA, 20 bp, Homo sapiens
cacctagtctgtaactcttt

SEQ ID NO: 1471891 - DNA, 15 bp, Homo sapiens
cacctagtgccccag

SEQ ID NO: 1471892 - DNA, 16 bp, Homo sapiens
cacctagtgccccaga

SEQ ID NO: 1471893 - DNA, 17 bp, Homo sapiens
cacctagtgcttccact

SEQ ID NO: 1471894 - DNA, 14 bp, Homo sapiens
cacctatgccagtg

SEQ ID NO: 1471895 - DNA, 15 bp, Homo sapiens
cacctatttaatgtt

SEQ ID NO: 1471896 - DNA, 23 bp, Homo sapiens
cacctcaaaataccatgccattt

SEQ ID NO: 1471897 - DNA, 23 bp, Homo sapiens
cacctcaaggtcatcaaacattt

SEQ ID NO: 1471898 - DNA, 23 bp, Homo sapiens
cacctcacctgagacctccactc

SEQ ID NO: 1471899 - DNA, 17 bp, Homo sapiens
cacctcagagcagggcc

SEQ ID NO: 1471900 - DNA, 19 bp, Homo sapiens
cacctcagagcagggccaa

SEQ ID NO: 1471901 - DNA, 23 bp, Homo sapiens
cacctcagagcagggccaaagca

SEQ ID NO: 1471902 - DNA, 21 bp, Homo sapiens
cacctcagagtggagttgaaa

SEQ ID NO: 1471903 - DNA, 16 bp, Homo sapiens
cacctcagcctcctga

SEQ ID NO: 1471904 - DNA, 12 bp, Homo sapiens
cacctcagcctg

SEQ ID NO: 1471905 - DNA, 15 bp, Homo sapiens
cacctcaggccaggt

SEQ ID NO: 1471906 - DNA, 12 bp, Homo sapiens
cacctcagggca

SEQ ID NO: 1471907 - DNA, 17 bp, Homo sapiens
cacctcagttcccttgg

SEQ ID NO: 1471908 - DNA, 15 bp, Homo sapiens
cacctcatcactgga

SEQ ID NO: 1471909 - DNA, 15 bp, Homo sapiens
cacctcatgcccacc

SEQ ID NO: 1471910 - DNA, 18 bp, Homo sapiens
cacctcatgcccaccccc

SEQ ID NO: 1471911 - DNA, 14 bp, Homo sapiens
cacctcattctgaa

SEQ ID NO: 1471912 - DNA, 13 bp, Homo sapiens
cacctccaccccc

SEQ ID NO: 1471913 - DNA, 23 bp, Homo sapiens
cacctccacccccgccacggcca

SEQ ID NO: 1471914 - DNA, 24 bp, Homo sapiens
cacctccacccccgccacggccac

SEQ ID NO: 1471915 - DNA, 14 bp, Homo sapiens
cacctccagcctga

SEQ ID NO: 1471916 - DNA, 14 bp, Homo sapiens
cacctccagctgcc

SEQ ID NO: 1471917 - DNA, 12 bp, Homo sapiens
cacctccaggca

SEQ ID NO: 1471918 - DNA, 14 bp, Homo sapiens
cacctccaggcagg

SEQ ID NO: 1471919 - DNA, 18 bp, Homo sapiens
cacctccaggcaggccag

SEQ ID NO: 1471920 - DNA, 19 bp, Homo sapiens
cacctccaggcaggccagg

SEQ ID NO: 1471921 - DNA, 23 bp, Homo sapiens
cacctccaggcaggccaggctgc

SEQ ID NO: 1471922 - DNA, 15 bp, Homo sapiens
cacctccaggcctgt

SEQ ID NO: 1471923 - DNA, 18 bp, Homo sapiens
cacctccaggcctgttgc

SEQ ID NO: 1471924 - DNA, 14 bp, Homo sapiens
cacctcccacccca

SEQ ID NO: 1471925 - DNA, 15 bp, Homo sapiens
cacctcccaccccac

SEQ ID NO: 1471926 - DNA, 16 bp, Homo sapiens
cacctcccaccccact

SEQ ID NO: 1471927 - DNA, 18 bp, Homo sapiens
cacctcccaccccactcc

SEQ ID NO: 1471928 - DNA, 19 bp, Homo sapiens
cacctcccaccccactcca

SEQ ID NO: 1471929 - DNA, 18 bp, Homo sapiens
cacctcccactcctgctg

SEQ ID NO: 1471930 - DNA, 13 bp, Homo sapiens
cacctcccagccc

SEQ ID NO: 1471931 - DNA, 14 bp, Homo sapiens
cacctccccagcat

SEQ ID NO: 1471932 - DNA, 11 bp, Homo sapiens
cacctccccca

SEQ ID NO: 1471933 - DNA, 16 bp, Homo sapiens
cacctcccccaaaccc

SEQ ID NO: 1471934 - DNA, 19 bp, Homo sapiens
cacctcccccaaaccctgc

SEQ ID NO: 1471935 - DNA, 14 bp, Homo sapiens
cacctccccccact

SEQ ID NO: 1471936 - DNA, 18 bp, Homo sapiens
cacctccccccactgcag

SEQ ID NO: 1471937 - DNA, 23 bp, Homo sapiens
cacctccccccactgcaggcccc

SEQ ID NO: 1471938 - DNA, 16 bp, Homo sapiens
cacctccccctccccg

SEQ ID NO: 1471939 - DNA, 18 bp, Homo sapiens
cacctccccctccccggc

SEQ ID NO: 1471940 - DNA, 21 bp, Homo sapiens
cacctccccctccccggccac

SEQ ID NO: 1471941 - DNA, 18 bp, Homo sapiens
cacctcccctatccaccc

SEQ ID NO: 1471942 - DNA, 19 bp, Homo sapiens
cacctcccctatccaccca

SEQ ID NO: 1471943 - DNA, 13 bp, Homo sapiens
cacctcccttccc

SEQ ID NO: 1471944 - DNA, 14 bp, Homo sapiens
cacctcccttccca

SEQ ID NO: 1471945 - DNA, 22 bp, Homo sapiens
cacctcccttcccacctactgc

SEQ ID NO: 1471946 - DNA, 20 bp, Homo sapiens
cacctcccttccctccctga

SEQ ID NO: 1471947 - DNA, 22 bp, Homo sapiens
cacctcccttccctccctgagg

SEQ ID NO: 1471948 - DNA, 22 bp, Homo sapiens
cacctcctccactcactccagc

SEQ ID NO: 1471949 - DNA, 23 bp, Homo sapiens
cacctcctccactcactccagcc

SEQ ID NO: 1471950 - DNA, 12 bp, Homo sapiens
cacctcctccat

SEQ ID NO: 1471951 - DNA, 14 bp, Homo sapiens
cacctcctccccct

SEQ ID NO: 1471952 - DNA, 14 bp, Homo sapiens
cacctcctgagaag

SEQ ID NO: 1471953 - DNA, 23 bp, Homo sapiens
cacctcctgagaaggcgaggaga

SEQ ID NO: 1471954 - DNA, 17 bp, Homo sapiens
cacctcgcccttcagcc

SEQ ID NO: 1471955 - DNA, 20 bp, Homo sapiens
cacctcggggacaccagagc

SEQ ID NO: 1471956 - DNA, 21 bp, Homo sapiens
cacctcggggacaccagagct

SEQ ID NO: 1471957 - DNA, 18 bp, Homo sapiens
cacctcgtctccctggtg

SEQ ID NO: 1471958 - DNA, 19 bp, Homo sapiens
cacctcgtctccctggtgc

SEQ ID NO: 1471959 - DNA, 11 bp, Homo sapiens
cacctctccaa

SEQ ID NO: 1471960 - DNA, 16 bp, Homo sapiens
cacctctctctgagga

SEQ ID NO: 1471961 - DNA, 12 bp, Homo sapiens
cacctctgagga

SEQ ID NO: 1471962 - DNA, 16 bp, Homo sapiens
cacctctgaggacaga

SEQ ID NO: 1471963 - DNA, 21 bp, Homo sapiens
cacctctgaggacagaggccg

SEQ ID NO: 1471964 - DNA, 14 bp, Homo sapiens
cacctctgcctcaa

SEQ ID NO: 1471965 - DNA, 22 bp, Homo sapiens
cacctctgcctctagtccccaa

SEQ ID NO: 1471966 - DNA, 19 bp, Homo sapiens
cacctctggactggctaga

SEQ ID NO: 1471967 - DNA, 19 bp, Homo sapiens
cacctcttccactccttct

SEQ ID NO: 1471968 - DNA, 12 bp, Homo sapiens
cacctcttccga

SEQ ID NO: 1471969 - DNA, 13 bp, Homo sapiens
cacctcttcctct

SEQ ID NO: 1471970 - DNA, 17 bp, Homo sapiens
cacctcttcctctggtt

SEQ ID NO: 1471971 - DNA, 24 bp, Homo sapiens
cacctcttcctctggttcctttca

SEQ ID NO: 1471972 - DNA, 12 bp, Homo sapiens
cacctctttaaa

SEQ ID NO: 1471973 - DNA, 18 bp, Homo sapiens
cacctctttaaaaactca

SEQ ID NO: 1471974 - DNA, 15 bp, Homo sapiens
cacctgaaccccaga

SEQ ID NO: 1471975 - DNA, 17 bp, Homo sapiens
cacctgaaccccagagg

SEQ ID NO: 1471976 - DNA, 19 bp, Homo sapiens
cacctgaaccccagaggca

SEQ ID NO: 1471977 - DNA, 13 bp, Homo sapiens
cacctgaactgaa

SEQ ID NO: 1471978 - DNA, 19 bp, Homo sapiens
cacctgaactgaacaccat

SEQ ID NO: 1471979 - DNA, 20 bp, Homo sapiens
cacctgactctgaaatctga

SEQ ID NO: 1471980 - DNA, 17 bp, Homo sapiens
cacctgagaccctactg

SEQ ID NO: 1471981 - DNA, 17 bp, Homo sapiens
cacctgagcgctgtgga

SEQ ID NO: 1471982 - DNA, 18 bp, Homo sapiens
cacctgagcgctgtggac

SEQ ID NO: 1471983 - DNA, 15 bp, Homo sapiens
cacctgaggtgggcc

SEQ ID NO: 1471984 - DNA, 17 bp, Homo sapiens
cacctgaggtgggccca

SEQ ID NO: 1471985 - DNA, 11 bp, Homo sapiens
cacctgcaaga

SEQ ID NO: 1471986 - DNA, 19 bp, Homo sapiens
cacctgcaagccccagggc

SEQ ID NO: 1471987 - DNA, 21 bp, Homo sapiens
cacctgcaagccccagggcct

SEQ ID NO: 1471988 - DNA, 22 bp, Homo sapiens
cacctgcaagccccagggcctg

SEQ ID NO: 1471989 - DNA, 15 bp, Homo sapiens
cacctgcactaacag

SEQ ID NO: 1471990 - DNA, 11 bp, Homo sapiens
cacctgcagcc

SEQ ID NO: 1471991 - DNA, 14 bp, Homo sapiens
cacctgcagtgcca

SEQ ID NO: 1471992 - DNA, 21 bp, Homo sapiens
cacctgcagtgccagctccct

SEQ ID NO: 1471993 - DNA, 15 bp, Homo sapiens
cacctgccaccccct

SEQ ID NO: 1471994 - DNA, 17 bp, Homo sapiens
cacctgccagaggatgc

SEQ ID NO: 1471995 - DNA, 13 bp, Homo sapiens
cacctgccagcct

SEQ ID NO: 1471996 - DNA, 17 bp, Homo sapiens
cacctgccagcctggct

SEQ ID NO: 1471997 - DNA, 22 bp, Homo sapiens
cacctgccatttgcaccctccg

SEQ ID NO: 1471998 - DNA, 22 bp, Homo sapiens
cacctgcccatcacagggttgg

SEQ ID NO: 1471999 - DNA, 21 bp, Homo sapiens
cacctgccgacctcgtcctcc

SEQ ID NO: 1472000 - DNA, 23 bp, Homo sapiens
cacctgccgacctcgtcctcccc

SEQ ID NO: 1472001 - DNA, 17 bp, Homo sapiens
cacctgccgcatgctcc

SEQ ID NO: 1472002 - DNA, 18 bp, Homo sapiens
cacctgccgcatgctccc

SEQ ID NO: 1472003 - DNA, 12 bp, Homo sapiens
cacctgcctcca

SEQ ID NO: 1472004 - DNA, 18 bp, Homo sapiens
cacctgcctccaccagca

SEQ ID NO: 1472005 - DNA, 23 bp, Homo sapiens
cacctgcctcggcctcccaaagt

SEQ ID NO: 1472006 - DNA, 23 bp, Homo sapiens
cacctgcctgcagagcaggaaat

SEQ ID NO: 1472007 - DNA, 18 bp, Homo sapiens
cacctgcctgttaggaga

SEQ ID NO: 1472008 - DNA, 23 bp, Homo sapiens
cacctgcctgttaggagaagctg

SEQ ID NO: 1472009 - DNA, 13 bp, Homo sapiens
cacctgcgcacag

SEQ ID NO: 1472010 - DNA, 20 bp, Homo sapiens
cacctgcgcacaggtgggag

SEQ ID NO: 1472011 - DNA, 12 bp, Homo sapiens
cacctgctccag

SEQ ID NO: 1472012 - DNA, 19 bp, Homo sapiens
cacctgctgcgtccccact

SEQ ID NO: 1472013 - DNA, 20 bp, Homo sapiens
cacctgctgcgtccccactc

SEQ ID NO: 1472014 - DNA, 21 bp, Homo sapiens
cacctgctgcgtccccactcc

SEQ ID NO: 1472015 - DNA, 12 bp, Homo sapiens
cacctgctgctt

SEQ ID NO: 1472016 - DNA, 18 bp, Homo sapiens
cacctgcttctgaactca

SEQ ID NO: 1472017 - DNA, 21 bp, Homo sapiens
cacctggacgaagagcaggcc

SEQ ID NO: 1472018 - DNA, 11 bp, Homo sapiens
cacctggagag

SEQ ID NO: 1472019 - DNA, 13 bp, Homo sapiens
cacctggccacct

SEQ ID NO: 1472020 - DNA, 15 bp, Homo sapiens
cacctggccacctga

SEQ ID NO: 1472021 - DNA, 21 bp, Homo sapiens
cacctggccacctgaggtggg

SEQ ID NO: 1472022 - DNA, 22 bp, Homo sapiens
cacctggccccatgtctctcag

SEQ ID NO: 1472023 - DNA, 16 bp, Homo sapiens
cacctggccctgcttc

SEQ ID NO: 1472024 - DNA, 19 bp, Homo sapiens
cacctggccgcctccagga

SEQ ID NO: 1472025 - DNA, 23 bp, Homo sapiens
cacctggccgcctccaggagcct

SEQ ID NO: 1472026 - DNA, 12 bp, Homo sapiens
cacctggcctgc

SEQ ID NO: 1472027 - DNA, 14 bp, Homo sapiens
cacctggcctgctg

SEQ ID NO: 1472028 - DNA, 17 bp, Homo sapiens
cacctggcctgctggga

SEQ ID NO: 1472029 - DNA, 22 bp, Homo sapiens
cacctggcctgggccacacctg

SEQ ID NO: 1472030 - DNA, 13 bp, Homo sapiens
cacctggccttaa

SEQ ID NO: 1472031 - DNA, 23 bp, Homo sapiens
cacctgggagaaggtctccaagg

SEQ ID NO: 1472032 - DNA, 15 bp, Homo sapiens
cacctgggccgggct

SEQ ID NO: 1472033 - DNA, 18 bp, Homo sapiens
cacctggtactgacccag

SEQ ID NO: 1472034 - DNA, 21 bp, Homo sapiens
cacctggtcctccgcctactg

SEQ ID NO: 1472035 - DNA, 16 bp, Homo sapiens
cacctggtgcgggcct

SEQ ID NO: 1472036 - DNA, 18 bp, Homo sapiens
cacctggtggatacctgg

SEQ ID NO: 1472037 - DNA, 11 bp, Homo sapiens
cacctggttgc

SEQ ID NO: 1472038 - DNA, 14 bp, Homo sapiens
cacctgtaaacctg

SEQ ID NO: 1472039 - DNA, 15 bp, Homo sapiens
cacctgtacattctt

SEQ ID NO: 1472040 - DNA, 15 bp, Homo sapiens
cacctgtagtcccag

SEQ ID NO: 1472041 - DNA, 16 bp, Homo sapiens
cacctgtagtcccagc

SEQ ID NO: 1472042 - DNA, 20 bp, Homo sapiens
cacctgtccccaccctccac

SEQ ID NO: 1472043 - DNA, 21 bp, Homo sapiens
cacctgtccccaccctccact

SEQ ID NO: 1472044 - DNA, 19 bp, Homo sapiens
cacctgtctcagcctccca

SEQ ID NO: 1472045 - DNA, 20 bp, Homo sapiens
cacctgtgagtttaaagcaa

SEQ ID NO: 1472046 - DNA, 16 bp, Homo sapiens
cacctgtgccctcacc

SEQ ID NO: 1472047 - DNA, 17 bp, Homo sapiens
cacctgtgccctcacca

SEQ ID NO: 1472048 - DNA, 23 bp, Homo sapiens
cacctgtgccctcaccaccacac

SEQ ID NO: 1472049 - DNA, 15 bp, Homo sapiens
cacctgttaaaatgt

SEQ ID NO: 1472050 - DNA, 19 bp, Homo sapiens
cacctgtttttaagctgtt

SEQ ID NO: 1472051 - DNA, 21 bp, Homo sapiens
caccttagggtggctttaatt

SEQ ID NO: 1472052 - DNA, 14 bp, Homo sapiens
caccttagtacttt

SEQ ID NO: 1472053 - DNA, 14 bp, Homo sapiens
caccttcaaaatgt

SEQ ID NO: 1472054 - DNA, 18 bp, Homo sapiens
caccttccagctcctgta

SEQ ID NO: 1472055 - DNA, 14 bp, Homo sapiens
caccttccagggcc

SEQ ID NO: 1472056 - DNA, 13 bp, Homo sapiens
caccttcccagct

SEQ ID NO: 1472057 - DNA, 19 bp, Homo sapiens
caccttcccagctctccct

SEQ ID NO: 1472058 - DNA, 13 bp, Homo sapiens
caccttcccttct

SEQ ID NO: 1472059 - DNA, 20 bp, Homo sapiens
caccttcccttctacaagga

SEQ ID NO: 1472060 - DNA, 21 bp, Homo sapiens
caccttcccttctacaaggac

SEQ ID NO: 1472061 - DNA, 15 bp, Homo sapiens
caccttccgacatcc

SEQ ID NO: 1472062 - DNA, 19 bp, Homo sapiens
caccttcctcctccccgct

SEQ ID NO: 1472063 - DNA, 21 bp, Homo sapiens
caccttctagtcttggccagc

SEQ ID NO: 1472064 - DNA, 16 bp, Homo sapiens
caccttggacatcctc

SEQ ID NO: 1472065 - DNA, 17 bp, Homo sapiens
caccttggacatcctcc

SEQ ID NO: 1472066 - DNA, 18 bp, Homo sapiens
caccttggacatcctcct

SEQ ID NO: 1472067 - DNA, 22 bp, Homo sapiens
caccttggacatcctcctccca

SEQ ID NO: 1472068 - DNA, 22 bp, Homo sapiens
caccttggaggccttccctggc

SEQ ID NO: 1472069 - DNA, 23 bp, Homo sapiens
caccttggaggccttccctggcc

SEQ ID NO: 1472070 - DNA, 14 bp, Homo sapiens
caccttggcccagg

SEQ ID NO: 1472071 - DNA, 22 bp, Homo sapiens
caccttggcccaggagctctgc

SEQ ID NO: 1472072 - DNA, 11 bp, Homo sapiens
caccttggcct

SEQ ID NO: 1472073 - DNA, 21 bp, Homo sapiens
caccttggggtccctccaccc

SEQ ID NO: 1472074 - DNA, 20 bp, Homo sapiens
caccttgtcatgtaccatca

SEQ ID NO: 1472075 - DNA, 15 bp, Homo sapiens
caccttgtcctggct

SEQ ID NO: 1472076 - DNA, 17 bp, Homo sapiens
caccttgtgcctggggt

SEQ ID NO: 1472077 - DNA, 20 bp, Homo sapiens
cacctttactgtgcttattt

SEQ ID NO: 1472078 - DNA, 14 bp, Homo sapiens
cacctttgccacaa

SEQ ID NO: 1472079 - DNA, 16 bp, Homo sapiens
cacctttggtgcagag

SEQ ID NO: 1472080 - DNA, 16 bp, Homo sapiens
cacctttgtaagacat

SEQ ID NO: 1472081 - DNA, 21 bp, Homo sapiens
cacctttgtaagacatttgta

SEQ ID NO: 1472082 - DNA, 12 bp, Homo sapiens
cacctttttgca

SEQ ID NO: 1472083 - DNA, 16 bp, Homo sapiens
cacgaacccacctgct

SEQ ID NO: 1472084 - DNA, 22 bp, Homo sapiens
cacgaacccacctgctgagaga

SEQ ID NO: 1472085 - DNA, 15 bp, Homo sapiens
cacgacagcacacac

SEQ ID NO: 1472086 - DNA, 18 bp, Homo sapiens
cacgacagcacacacagt

SEQ ID NO: 1472087 - DNA, 23 bp, Homo sapiens
cactccagtgctcagctgtggct

SEQ ID NO: 1472088 - DNA, 23 bp, Homo sapiens
cactccatgcttagtcactgcct

SEQ ID NO: 1472089 - DNA, 15 bp, Homo sapiens
cactccatggccacc

SEQ ID NO: 1472090 - DNA, 19 bp, Homo sapiens
cactcccaagggacagcaa

SEQ ID NO: 1472091 - DNA, 17 bp, Homo sapiens
cactcccacctgacaca

SEQ ID NO: 1472092 - DNA, 16 bp, Homo sapiens
cactcccagcagctca

SEQ ID NO: 1472093 - DNA, 18 bp, Homo sapiens
cactcccagcagctcaac

SEQ ID NO: 1472094 - DNA, 15 bp, Homo sapiens
cactccccagagctg

SEQ ID NO: 1472095 - DNA, 17 bp, Homo sapiens
cactccccagagctgtg

SEQ ID NO: 1472096 - DNA, 18 bp, Homo sapiens
cactccccagagctgtgc

SEQ ID NO: 1472097 - DNA, 20 bp, Homo sapiens
cactccccagagctgtgcca

SEQ ID NO: 1472098 - DNA, 17 bp, Homo sapiens
cactccccagccccagc

SEQ ID NO: 1472099 - DNA, 18 bp, Homo sapiens
cactccccagccccagcc

SEQ ID NO: 1472100 - DNA, 17 bp, Homo sapiens
cactcccctgcactgga

SEQ ID NO: 1472101 - DNA, 21 bp, Homo sapiens
cactcccggcactccatgctt

SEQ ID NO: 1472102 - DNA, 21 bp, Homo sapiens
cactcccggcctaggcacctc

SEQ ID NO: 1472103 - DNA, 22 bp, Homo sapiens
cactcccggcctaggcacctcc

SEQ ID NO: 1472104 - DNA, 13 bp, Homo sapiens
cactccctggcct

SEQ ID NO: 1472105 - DNA, 15 bp, Homo sapiens
cactccctggccttg

SEQ ID NO: 1472106 - DNA, 17 bp, Homo sapiens
cactccctggccttgcc

SEQ ID NO: 1472107 - DNA, 18 bp, Homo sapiens
cactcccttgctggcccc

SEQ ID NO: 1472108 - DNA, 19 bp, Homo sapiens
cactccgagaggtgggcca

SEQ ID NO: 1472109 - DNA, 17 bp, Homo sapiens
cactccgcgccgatgcc

SEQ ID NO: 1472110 - DNA, 22 bp, Homo sapiens
cactccgcgccgatgccaccgg

SEQ ID NO: 1472111 - DNA, 23 bp, Homo sapiens
cactccggcctgggtgacagagt

SEQ ID NO: 1472112 - DNA, 17 bp, Homo sapiens
cactccggtgtgcctgc

SEQ ID NO: 1472113 - DNA, 15 bp, Homo sapiens
cactcctccaaagga

SEQ ID NO: 1472114 - DNA, 17 bp, Homo sapiens
cactcctcctcggaaga

SEQ ID NO: 1472115 - DNA, 13 bp, Homo sapiens
cactcctgctgca

SEQ ID NO: 1472116 - DNA, 11 bp, Homo sapiens
cactcctgggg

SEQ ID NO: 1472117 - DNA, 12 bp, Homo sapiens
cactcctggggc

SEQ ID NO: 1472118 - DNA, 19 bp, Homo sapiens
cactcctgtccctgtagct

SEQ ID NO: 1472119 - DNA, 22 bp, Homo sapiens
cactcctgtccctgtagctcag

SEQ ID NO: 1472120 - DNA, 14 bp, Homo sapiens
cactccttgtcccc

SEQ ID NO: 1472121 - DNA, 22 bp, Homo sapiens
cactcgacccagaatggagcct

SEQ ID NO: 1472122 - DNA, 22 bp, Homo sapiens
cactcgagaccatcctggcccc

SEQ ID NO: 1472123 - DNA, 17 bp, Homo sapiens
cactcgccatttcctca

SEQ ID NO: 1472124 - DNA, 21 bp, Homo sapiens
cactcgccatttcctcacgtg

SEQ ID NO: 1472125 - DNA, 24 bp, Homo sapiens
cactcgccatttcctcacgtgcag

SEQ ID NO: 1472126 - DNA, 12 bp, Homo sapiens
cactcggtccca

SEQ ID NO: 1472127 - DNA, 15 bp, Homo sapiens
cactcgtaggggatg

SEQ ID NO: 1472128 - DNA, 21 bp, Homo sapiens
cactcgtccaagggacagccc

SEQ ID NO: 1472129 - DNA, 17 bp, Homo sapiens
cactctaccctcccacc

SEQ ID NO: 1472130 - DNA, 18 bp, Homo sapiens
cactctaccctcccaccc

SEQ ID NO: 1472131 - DNA, 19 bp, Homo sapiens
cactctaccctcccacccc

SEQ ID NO: 1472132 - DNA, 11 bp, Homo sapiens
cactctagatt

SEQ ID NO: 1472133 - DNA, 17 bp, Homo sapiens
cactctaggggtcaggc

SEQ ID NO: 1472134 - DNA, 14 bp, Homo sapiens
cactctagttctag

SEQ ID NO: 1472135 - DNA, 18 bp, Homo sapiens
cactctagttctagatga

SEQ ID NO: 1472136 - DNA, 15 bp, Homo sapiens
cactctatatgtagt

SEQ ID NO: 1472137 - DNA, 18 bp, Homo sapiens
cactctatgagttggact

SEQ ID NO: 1472138 - DNA, 12 bp, Homo sapiens
cactctccccac

SEQ ID NO: 1472139 - DNA, 16 bp, Homo sapiens
cactctcctcccctcc

SEQ ID NO: 1472140 - DNA, 22 bp, Homo sapiens
cactctcctcccctccctcaga

SEQ ID NO: 1472141 - DNA, 14 bp, Homo sapiens
cactctctgctggc

SEQ ID NO: 1472142 - DNA, 19 bp, Homo sapiens
cactctgattcacctcttc

SEQ ID NO: 1472143 - DNA, 15 bp, Homo sapiens
cactctgcccccatt

SEQ ID NO: 1472144 - DNA, 13 bp, Homo sapiens
cactctgccctct

SEQ ID NO: 1472145 - DNA, 14 bp, Homo sapiens
cactctgccctctg

SEQ ID NO: 1472146 - DNA, 18 bp, Homo sapiens
cactctgccctctgctgc

SEQ ID NO: 1472147 - DNA, 20 bp, Homo sapiens
cactctgccctctgctgctg

SEQ ID NO: 1472148 - DNA, 20 bp, Homo sapiens
cactctgcctctgcctgcat

SEQ ID NO: 1472149 - DNA, 13 bp, Homo sapiens
cactctgcctgcc

SEQ ID NO: 1472150 - DNA, 15 bp, Homo sapiens
cactctgcctgcctg

SEQ ID NO: 1472151 - DNA, 15 bp, Homo sapiens
cactctgctctgccc

SEQ ID NO: 1472152 - DNA, 16 bp, Homo sapiens
cactctgctctgccct

SEQ ID NO: 1472153 - DNA, 14 bp, Homo sapiens
cactctgcttctct

SEQ ID NO: 1472154 - DNA, 17 bp, Homo sapiens
cactctgcttctctgac

SEQ ID NO: 1472155 - DNA, 19 bp, Homo sapiens
cactctgtagtcaaaaaag

SEQ ID NO: 1472156 - DNA, 11 bp, Homo sapiens
cactcttccag

SEQ ID NO: 1472157 - DNA, 18 bp, Homo sapiens
cactcttgatctctcttg

SEQ ID NO: 1472158 - DNA, 17 bp, Homo sapiens
cactcttgttcccacac

SEQ ID NO: 1472159 - DNA, 12 bp, Homo sapiens
cactctttgtaa

SEQ ID NO: 1472160 - DNA, 15 bp, Homo sapiens
cactctttgtaagag

SEQ ID NO: 1472161 - DNA, 16 bp, Homo sapiens
cactcttttgctgtgc

SEQ ID NO: 1472162 - DNA, 12 bp, Homo sapiens
cactgaaaaaat

SEQ ID NO: 1472163 - DNA, 16 bp, Homo sapiens
cactgaaaaaatatat

SEQ ID NO: 1472164 - DNA, 17 bp, Homo sapiens
cactgaaaaaatatatg

SEQ ID NO: 1472165 - DNA, 12 bp, Homo sapiens
cactgaaaacat

SEQ ID NO: 1472166 - DNA, 21 bp, Homo sapiens
cactgaaaaggttcttcatcc

SEQ ID NO: 1472167 - DNA, 17 bp, Homo sapiens
cactgaaacctctgcct

SEQ ID NO: 1472168 - DNA, 17 bp, Homo sapiens
cactgaaaggaaaaatg

SEQ ID NO: 1472169 - DNA, 17 bp, Homo sapiens
cactgaaagttttgtaa

SEQ ID NO: 1472170 - DNA, 21 bp, Homo sapiens
cactgaaagttttgtaaaaga

SEQ ID NO: 1472171 - DNA, 13 bp, Homo sapiens
cactgaacaaaac

SEQ ID NO: 1472172 - DNA, 21 bp, Homo sapiens
cactgaacaaaacctacacac

SEQ ID NO: 1472173 - DNA, 14 bp, Homo sapiens
cactgaacagaatt

SEQ ID NO: 1472174 - DNA, 20 bp, Homo sapiens
cactgaacctgggaaagaga

SEQ ID NO: 1472175 - DNA, 21 bp, Homo sapiens
cactgaagaagtcactgaaca

SEQ ID NO: 1472176 - DNA, 20 bp, Homo sapiens
cactgaagccggacagctgc

SEQ ID NO: 1472177 - DNA, 21 bp, Homo sapiens
cactgaagccggacagctgcc

SEQ ID NO: 1472178 - DNA, 17 bp, Homo sapiens
cactgaagctgggattc

SEQ ID NO: 1472179 - DNA, 22 bp, Homo sapiens
cactgaataatggaattatgta

SEQ ID NO: 1472180 - DNA, 17 bp, Homo sapiens
cactgaattcactccag

SEQ ID NO: 1472181 - DNA, 14 bp, Homo sapiens
cactgacacccagt

SEQ ID NO: 1472182 - DNA, 19 bp, Homo sapiens
cactgacaccctggtcctg

SEQ ID NO: 1472183 - DNA, 24 bp, Homo sapiens
cactgacaccctggtcctgacttc

SEQ ID NO: 1472184 - DNA, 13 bp, Homo sapiens
cactgacagattt

SEQ ID NO: 1472185 - DNA, 23 bp, Homo sapiens
cactgacatcaattttaccctga

SEQ ID NO: 1472186 - DNA, 14 bp, Homo sapiens
cactgaccagaact

SEQ ID NO: 1472187 - DNA, 23 bp, Homo sapiens
cactgaccatccactctaccctc

SEQ ID NO: 1472188 - DNA, 18 bp, Homo sapiens
cactgacccaactgatcc

SEQ ID NO: 1472189 - DNA, 21 bp, Homo sapiens
cactgacccaactgatcctgc

SEQ ID NO: 1472190 - DNA, 18 bp, Homo sapiens
cactgacccttccagaca

SEQ ID NO: 1472191 - DNA, 18 bp, Homo sapiens
cactgacctgtcatgccc

SEQ ID NO: 1472192 - DNA, 23 bp, Homo sapiens
cactgacctgtcatgcccccctc

SEQ ID NO: 1472193 - DNA, 15 bp, Homo sapiens
cactgacttctaagt

SEQ ID NO: 1472194 - DNA, 20 bp, Homo sapiens
cactgacttctaagtaaaac

SEQ ID NO: 1472195 - DNA, 16 bp, Homo sapiens
cactgacttgctgtgt

SEQ ID NO: 1472196 - DNA, 18 bp, Homo sapiens
cactgagaatgtaagaac

SEQ ID NO: 1472197 - DNA, 21 bp, Homo sapiens
cactgagagcctttttgaaag

SEQ ID NO: 1472198 - DNA, 14 bp, Homo sapiens
cactgagaggcctg

SEQ ID NO: 1472199 - DNA, 14 bp, Homo sapiens
cactgagagggcaa

SEQ ID NO: 1472200 - DNA, 20 bp, Homo sapiens
cactgagcaagatcttgtct

SEQ ID NO: 1472201 - DNA, 18 bp, Homo sapiens
cactgagcatcactagtg

SEQ ID NO: 1472202 - DNA, 11 bp, Homo sapiens
cactgagcccc

SEQ ID NO: 1472203 - DNA, 13 bp, Homo sapiens
cactgagcccccc

SEQ ID NO: 1472204 - DNA, 12 bp, Homo sapiens
cactgagcctgg

SEQ ID NO: 1472205 - DNA, 14 bp, Homo sapiens
cactgaggaagaac

SEQ ID NO: 1472206 - DNA, 17 bp, Homo sapiens
cactgaggaagaacggg

SEQ ID NO: 1472207 - DNA, 13 bp, Homo sapiens
cactgaggactgt

SEQ ID NO: 1472208 - DNA, 14 bp, Homo sapiens
cactgaggagacag

SEQ ID NO: 1472209 - DNA, 21 bp, Homo sapiens
cactgaggagacagaaagcct

SEQ ID NO: 1472210 - DNA, 22 bp, Homo sapiens
cactgaggagacagaaagcctc

SEQ ID NO: 1472211 - DNA, 19 bp, Homo sapiens
cactgaggcttaggcctct

SEQ ID NO: 1472212 - DNA, 20 bp, Homo sapiens
cactgaggcttaggcctctc

SEQ ID NO: 1472213 - DNA, 21 bp, Homo sapiens
cactgaggcttaggcctctct

SEQ ID NO: 1472214 - DNA, 15 bp, Homo sapiens
cactgatcacccaat

SEQ ID NO: 1472215 - DNA, 24 bp, Homo sapiens
cactgatctctactaccacaagga

SEQ ID NO: 1472216 - DNA, 21 bp, Homo sapiens
cactgatctgctagtgctgta

SEQ ID NO: 1472217 - DNA, 16 bp, Homo sapiens
cactgatttggagata

SEQ ID NO: 1472218 - DNA, 19 bp, Homo sapiens
cactgcaacctcacctccc

SEQ ID NO: 1472219 - DNA, 20 bp, Homo sapiens
cactgcaacctcacctcccg

SEQ ID NO: 1472220 - DNA, 13 bp, Homo sapiens
cactgcaacctcc

SEQ ID NO: 1472221 - DNA, 14 bp, Homo sapiens
cactgcaacctcca

SEQ ID NO: 1472222 - DNA, 16 bp, Homo sapiens
cactgcaacctccgcc

SEQ ID NO: 1472223 - DNA, 16 bp, Homo sapiens
cactgcaacttctgcc

SEQ ID NO: 1472224 - DNA, 17 bp, Homo sapiens
cactgcaagaagtcttg

SEQ ID NO: 1472225 - DNA, 17 bp, Homo sapiens
cactgcaagagccttgg

SEQ ID NO: 1472226 - DNA, 19 bp, Homo sapiens
cactgcaagagccttggtg

SEQ ID NO: 1472227 - DNA, 20 bp, Homo sapiens
cactgcaagagccttggtgt

SEQ ID NO: 1472228 - DNA, 17 bp, Homo sapiens
cactgcacacagtgact

SEQ ID NO: 1472229 - DNA, 23 bp, Homo sapiens
cactgcacagtgcatctcagccc

SEQ ID NO: 1472230 - DNA, 17 bp, Homo sapiens
cactgcactcaacctta

SEQ ID NO: 1472231 - DNA, 16 bp, Homo sapiens
cactgcactccagcct

SEQ ID NO: 1472232 - DNA, 19 bp, Homo sapiens
cactgcactccagcctgag

SEQ ID NO: 1472233 - DNA, 24 bp, Homo sapiens
cactgcactccagcctgagtgaca

SEQ ID NO: 1472234 - DNA, 13 bp, Homo sapiens
cactgcaggcccc

SEQ ID NO: 1472235 - DNA, 14 bp, Homo sapiens
cactgcagtcagat

SEQ ID NO: 1472236 - DNA, 14 bp, Homo sapiens
cactgccaacccct

SEQ ID NO: 1472237 - DNA, 17 bp, Homo sapiens
cactgccacaccctccc

SEQ ID NO: 1472238 - DNA, 12 bp, Homo sapiens
cactgccagcag

SEQ ID NO: 1472239 - DNA, 11 bp, Homo sapiens
cactgccaggc

SEQ ID NO: 1472240 - DNA, 15 bp, Homo sapiens
cactgccaggcacct

SEQ ID NO: 1472241 - DNA, 14 bp, Homo sapiens
cactgccaggccag

SEQ ID NO: 1472242 - DNA, 16 bp, Homo sapiens
cactgccaggccagcc

SEQ ID NO: 1472243 - DNA, 19 bp, Homo sapiens
cactgccaggccagcctcc

SEQ ID NO: 1472244 - DNA, 20 bp, Homo sapiens
cactgccaggggttcttgag

SEQ ID NO: 1472245 - DNA, 20 bp, Homo sapiens
cactgccatattgtgtaatt

SEQ ID NO: 1472246 - DNA, 17 bp, Homo sapiens
cactgccatctgatgcc

SEQ ID NO: 1472247 - DNA, 16 bp, Homo sapiens
cactgccatcttagtt

SEQ ID NO: 1472248 - DNA, 20 bp, Homo sapiens
cactgccatcttagtttgga

SEQ ID NO: 1472249 - DNA, 22 bp, Homo sapiens
cactgccatcttagtttggatt

SEQ ID NO: 1472250 - DNA, 19 bp, Homo sapiens
cactgccattacccagtgc

SEQ ID NO: 1472251 - DNA, 21 bp, Homo sapiens
cactgccattagactgaattt

SEQ ID NO: 1472252 - DNA, 15 bp, Homo sapiens
cactgcccaccccct

SEQ ID NO: 1472253 - DNA, 16 bp, Homo sapiens
cactgcccaccccctc

SEQ ID NO: 1472254 - DNA, 14 bp, Homo sapiens
cactgccccccgag

SEQ ID NO: 1472255 - DNA, 21 bp, Homo sapiens
cactgccccccgaggctgcta

SEQ ID NO: 1472256 - DNA, 11 bp, Homo sapiens
cactgccctgc

SEQ ID NO: 1472257 - DNA, 15 bp, Homo sapiens
cactgccctgcctgc

SEQ ID NO: 1472258 - DNA, 14 bp, Homo sapiens
cactgccctggcag

SEQ ID NO: 1472259 - DNA, 18 bp, Homo sapiens
cactgccctggcagcagc

SEQ ID NO: 1472260 - DNA, 18 bp, Homo sapiens
cactgcccttttcaggaa

SEQ ID NO: 1472261 - DNA, 19 bp, Homo sapiens
cactgcctctccctggccc

SEQ ID NO: 1472262 - DNA, 12 bp, Homo sapiens
cactgcctgcct

SEQ ID NO: 1472263 - DNA, 13 bp, Homo sapiens
cactgcctgcctc

SEQ ID NO: 1472264 - DNA, 23 bp, Homo sapiens
cactgcctgcctcccctccgcag

SEQ ID NO: 1472265 - DNA, 11 bp, Homo sapiens
cactgcctggg

SEQ ID NO: 1472266 - DNA, 19 bp, Homo sapiens
cactgccttcgcttcttgc

SEQ ID NO: 1472267 - DNA, 17 bp, Homo sapiens
cactgcgcaggtctctt

SEQ ID NO: 1472268 - DNA, 23 bp, Homo sapiens
cactgcgcaggtctcttctgggc

SEQ ID NO: 1472269 - DNA, 15 bp, Homo sapiens
cactgcggaagccaa

SEQ ID NO: 1472270 - DNA, 16 bp, Homo sapiens
cactgcggaagccaaa

SEQ ID NO: 1472271 - DNA, 19 bp, Homo sapiens
cactgcggaagccaaaggc

SEQ ID NO: 1472272 - DNA, 21 bp, Homo sapiens
cactgctagagacgctgatcc

SEQ ID NO: 1472273 - DNA, 21 bp, Homo sapiens
cactgctcgtggactgtgctg

SEQ ID NO: 1472274 - DNA, 18 bp, Homo sapiens
cactgctctaacagccct

SEQ ID NO: 1472275 - DNA, 13 bp, Homo sapiens
cactgctgcacca

SEQ ID NO: 1472276 - DNA, 16 bp, Homo sapiens
cactgctggctgcctt

SEQ ID NO: 1472277 - DNA, 21 bp, Homo sapiens
cactgctggctgccttagaac

SEQ ID NO: 1472278 - DNA, 14 bp, Homo sapiens
cactgctgtccaca

SEQ ID NO: 1472279 - DNA, 16 bp, Homo sapiens
cactgctgtccacatg

SEQ ID NO: 1472280 - DNA, 18 bp, Homo sapiens
cactgctgttcctgctcc

SEQ ID NO: 1472281 - DNA, 12 bp, Homo sapiens
cactgcttccca

SEQ ID NO: 1472282 - DNA, 14 bp, Homo sapiens
cactgcttcccact

SEQ ID NO: 1472283 - DNA, 17 bp, Homo sapiens
cactgcttgaactaggc

SEQ ID NO: 1472284 - DNA, 13 bp, Homo sapiens
cactgcttttccc

SEQ ID NO: 1472285 - DNA, 19 bp, Homo sapiens
cactggaaaggggagagcc

SEQ ID NO: 1472286 - DNA, 22 bp, Homo sapiens
cactggaaaggggagagcctgc

SEQ ID NO: 1472287 - DNA, 17 bp, Homo sapiens
cactggaagatttatga

SEQ ID NO: 1472288 - DNA, 14 bp, Homo sapiens
cactggaccaggtc

SEQ ID NO: 1472289 - DNA, 17 bp, Homo sapiens
cactggaccaggtcctg

SEQ ID NO: 1472290 - DNA, 18 bp, Homo sapiens
cactggaccaggtcctgc

SEQ ID NO: 1472291 - DNA, 12 bp, Homo sapiens
cactggagccca

SEQ ID NO: 1472292 - DNA, 15 bp, Homo sapiens
cactggaggagcagc

SEQ ID NO: 1472293 - DNA, 15 bp, Homo sapiens
cactggaggggccca

SEQ ID NO: 1472294 - DNA, 19 bp, Homo sapiens
cactggaggggcccaccca

SEQ ID NO: 1472295 - DNA, 20 bp, Homo sapiens
cactggaggggcccacccac

SEQ ID NO: 1472296 - DNA, 20 bp, Homo sapiens
cactggaggttgaagccaag

SEQ ID NO: 1472297 - DNA, 16 bp, Homo sapiens
cactggagtccagtct

SEQ ID NO: 1472298 - DNA, 17 bp, Homo sapiens
cactggagtgcagggag

SEQ ID NO: 1472299 - DNA, 20 bp, Homo sapiens
cactggagtgcagggaggag

SEQ ID NO: 1472300 - DNA, 23 bp, Homo sapiens
cactggatgcaaagaaaatcaga

SEQ ID NO: 1472301 - DNA, 19 bp, Homo sapiens
cactggcagcctgcacctg

SEQ ID NO: 1472302 - DNA, 14 bp, Homo sapiens
cactggcaggtgtg

SEQ ID NO: 1472303 - DNA, 22 bp, Homo sapiens
cactggcaggtgtgggatctgg

SEQ ID NO: 1472304 - DNA, 17 bp, Homo sapiens
cactggcatagccctcc

SEQ ID NO: 1472305 - DNA, 13 bp, Homo sapiens
cactggccagaga

SEQ ID NO: 1472306 - DNA, 18 bp, Homo sapiens
cactggccagagagggcc

SEQ ID NO: 1472307 - DNA, 13 bp, Homo sapiens
cactggcccctca

SEQ ID NO: 1472308 - DNA, 14 bp, Homo sapiens
cactggcctgggtc

SEQ ID NO: 1472309 - DNA, 22 bp, Homo sapiens
cactggcgccttctcggagctg

SEQ ID NO: 1472310 - DNA, 16 bp, Homo sapiens
cactggctctccaagt

SEQ ID NO: 1472311 - DNA, 22 bp, Homo sapiens
cactggctctccaagtgccaga

SEQ ID NO: 1472312 - DNA, 14 bp, Homo sapiens
cactggctggggca

SEQ ID NO: 1472313 - DNA, 18 bp, Homo sapiens
cactgggacagctggctg

SEQ ID NO: 1472314 - DNA, 19 bp, Homo sapiens
cactgggacagctggctgg

SEQ ID NO: 1472315 - DNA, 20 bp, Homo sapiens
cactgggacagctggctggg

SEQ ID NO: 1472316 - DNA, 17 bp, Homo sapiens
cactgggagggggtggg

SEQ ID NO: 1472317 - DNA, 17 bp, Homo sapiens
cagaaaagcacctgccg

SEQ ID NO: 1472318 - DNA, 13 bp, Homo sapiens
cagaaaagtgcct

SEQ ID NO: 1472319 - DNA, 22 bp, Homo sapiens
cagaaaataaaatattcactct

SEQ ID NO: 1472320 - DNA, 21 bp, Homo sapiens
cagaaaatatgtattaacact

SEQ ID NO: 1472321 - DNA, 19 bp, Homo sapiens
cagaaaatattatgtgttt

SEQ ID NO: 1472322 - DNA, 16 bp, Homo sapiens
cagaaaattagccggg

SEQ ID NO: 1472323 - DNA, 16 bp, Homo sapiens
cagaaaattgcacaat

SEQ ID NO: 1472324 - DNA, 18 bp, Homo sapiens
cagaaacaaaaacactaa

SEQ ID NO: 1472325 - DNA, 17 bp, Homo sapiens
cagaaacaaaaagcccc

SEQ ID NO: 1472326 - DNA, 16 bp, Homo sapiens
cagaaacaacagggga

SEQ ID NO: 1472327 - DNA, 23 bp, Homo sapiens
cagaaacacccctctgtctagga

SEQ ID NO: 1472328 - DNA, 14 bp, Homo sapiens
cagaaacactgcct

SEQ ID NO: 1472329 - DNA, 19 bp, Homo sapiens
cagaaacactgccttttta

SEQ ID NO: 1472330 - DNA, 17 bp, Homo sapiens
cagaaacatcagttact

SEQ ID NO: 1472331 - DNA, 23 bp, Homo sapiens
cagaaacatcagttactctgaag

SEQ ID NO: 1472332 - DNA, 18 bp, Homo sapiens
cagaaaccagaaaagcaa

SEQ ID NO: 1472333 - DNA, 11 bp, Homo sapiens
cagaaaccttt

SEQ ID NO: 1472334 - DNA, 16 bp, Homo sapiens
cagaaaccttttattt

SEQ ID NO: 1472335 - DNA, 17 bp, Homo sapiens
cagaaaccttttatttt

SEQ ID NO: 1472336 - DNA, 23 bp, Homo sapiens
cagaaacgagatcgggaagcaga

SEQ ID NO: 1472337 - DNA, 17 bp, Homo sapiens
cagaaactccttttgct

SEQ ID NO: 1472338 - DNA, 21 bp, Homo sapiens
cagaaagcctccgctgggctt

SEQ ID NO: 1472339 - DNA, 22 bp, Homo sapiens
cagaaagcctccgctgggcttc

SEQ ID NO: 1472340 - DNA, 18 bp, Homo sapiens
cagaaagctctacatttg

SEQ ID NO: 1472341 - DNA, 15 bp, Homo sapiens
cagaaagctgcctgg

SEQ ID NO: 1472342 - DNA, 13 bp, Homo sapiens
cagaaaggagaga

SEQ ID NO: 1472343 - DNA, 20 bp, Homo sapiens
cagaaaggatatttaagaaa

SEQ ID NO: 1472344 - DNA, 22 bp, Homo sapiens
cagaaaggatatttaagaaaat

SEQ ID NO: 1472345 - DNA, 20 bp, Homo sapiens
cagaaaggttttcttctttt

SEQ ID NO: 1472346 - DNA, 18 bp, Homo sapiens
cagaaagtgataagtgca

SEQ ID NO: 1472347 - DNA, 22 bp, Homo sapiens
cagaaagtgataagtgcaggga

SEQ ID NO: 1472348 - DNA, 16 bp, Homo sapiens
cagaaagtgcctgaca

SEQ ID NO: 1472349 - DNA, 23 bp, Homo sapiens
cagaaagtgcctgacacactaac

SEQ ID NO: 1472350 - DNA, 23 bp, Homo sapiens
cagaaagtggccatgccaccctg

SEQ ID NO: 1472351 - DNA, 15 bp, Homo sapiens
cagaaataataaaaa

SEQ ID NO: 1472352 - DNA, 21 bp, Homo sapiens
cagaaatacaaaaaattagct

SEQ ID NO: 1472353 - DNA, 19 bp, Homo sapiens
cagaaatacagataaatga

SEQ ID NO: 1472354 - DNA, 16 bp, Homo sapiens
cagaaatactgctctg

SEQ ID NO: 1472355 - DNA, 20 bp, Homo sapiens
cagaaatataacacattttt

SEQ ID NO: 1472356 - DNA, 16 bp, Homo sapiens
cagaaatcagaggaga

SEQ ID NO: 1472357 - DNA, 19 bp, Homo sapiens
cagaaatctagaagactgt

SEQ ID NO: 1472358 - DNA, 14 bp, Homo sapiens
cagaaatgctgcct

SEQ ID NO: 1472359 - DNA, 19 bp, Homo sapiens
cagaaatgctgcctgcctg

SEQ ID NO: 1472360 - DNA, 23 bp, Homo sapiens
cagaaatgctgcctgcctgtctg

SEQ ID NO: 1472361 - DNA, 15 bp, Homo sapiens
cagaaatggaaagca

SEQ ID NO: 1472362 - DNA, 17 bp, Homo sapiens
cagaaatggaaagcaga

SEQ ID NO: 1472363 - DNA, 16 bp, Homo sapiens
cagaaattagccgggc

SEQ ID NO: 1472364 - DNA, 16 bp, Homo sapiens
cagaaattcaatttgg

SEQ ID NO: 1472365 - DNA, 18 bp, Homo sapiens
cagaaattctggcccagc

SEQ ID NO: 1472366 - DNA, 21 bp, Homo sapiens
cagaaattctggcccagccaa

SEQ ID NO: 1472367 - DNA, 14 bp, Homo sapiens
cagaaatttttatt

SEQ ID NO: 1472368 - DNA, 15 bp, Homo sapiens
cagaaatttttattt

SEQ ID NO: 1472369 - DNA, 18 bp, Homo sapiens
cagaaatttttatttttc

SEQ ID NO: 1472370 - DNA, 12 bp, Homo sapiens
cagaacaaatgt

SEQ ID NO: 1472371 - DNA, 20 bp, Homo sapiens
cagaacaaatgtgtttttct

SEQ ID NO: 1472372 - DNA, 21 bp, Homo sapiens
cagaacaaatgtgtttttcta

SEQ ID NO: 1472373 - DNA, 13 bp, Homo sapiens
cagaacacacaga

SEQ ID NO: 1472374 - DNA, 21 bp, Homo sapiens
cagaacaccccgctctggcag

SEQ ID NO: 1472375 - DNA, 13 bp, Homo sapiens
cagaacactgcag

SEQ ID NO: 1472376 - DNA, 21 bp, Homo sapiens
cagaacagcagaggttctttt

SEQ ID NO: 1472377 - DNA, 13 bp, Homo sapiens
cagaacagccctc

SEQ ID NO: 1472378 - DNA, 22 bp, Homo sapiens
cagaacatactgattgggaggt

SEQ ID NO: 1472379 - DNA, 16 bp, Homo sapiens
cagaacatatgttgca

SEQ ID NO: 1472380 - DNA, 17 bp, Homo sapiens
cagaacatcattagaac

SEQ ID NO: 1472381 - DNA, 14 bp, Homo sapiens
cagaacatgttaag

SEQ ID NO: 1472382 - DNA, 17 bp, Homo sapiens
cagaacattcagctctg

SEQ ID NO: 1472383 - DNA, 20 bp, Homo sapiens
cagaacattcagctctggag

SEQ ID NO: 1472384 - DNA, 19 bp, Homo sapiens
cagaaccaaaagggaggct

SEQ ID NO: 1472385 - DNA, 20 bp, Homo sapiens
cagaaccaccccggccccct

SEQ ID NO: 1472386 - DNA, 18 bp, Homo sapiens
cagaaccagatgagtaaa

SEQ ID NO: 1472387 - DNA, 15 bp, Homo sapiens
cagaaccatccatag

SEQ ID NO: 1472388 - DNA, 22 bp, Homo sapiens
cagaacccccaggtggcctgcg

SEQ ID NO: 1472389 - DNA, 23 bp, Homo sapiens
cagaacccctacatgaaacagaa

SEQ ID NO: 1472390 - DNA, 15 bp, Homo sapiens
cagaacctcttcccc

SEQ ID NO: 1472391 - DNA, 16 bp, Homo sapiens
cagaacctcttcccca

SEQ ID NO: 1472392 - DNA, 18 bp, Homo sapiens
cagaacctcttccccaga

SEQ ID NO: 1472393 - DNA, 22 bp, Homo sapiens
cagaacctgcacacaggacagc

SEQ ID NO: 1472394 - DNA, 21 bp, Homo sapiens
cagaaccttcaacccagtggg

SEQ ID NO: 1472395 - DNA, 17 bp, Homo sapiens
cagaactaaactcattt

SEQ ID NO: 1472396 - DNA, 18 bp, Homo sapiens
cagaactaaactcattta

SEQ ID NO: 1472397 - DNA, 15 bp, Homo sapiens
cagaactacatattt

SEQ ID NO: 1472398 - DNA, 22 bp, Homo sapiens
cagaactgaaccggctttacca

SEQ ID NO: 1472399 - DNA, 19 bp, Homo sapiens
cagaactgcttactagccc

SEQ ID NO: 1472400 - DNA, 13 bp, Homo sapiens
cagaacttcagaa

SEQ ID NO: 1472401 - DNA, 16 bp, Homo sapiens
cagaacttcagaaaga

SEQ ID NO: 1472402 - DNA, 20 bp, Homo sapiens
cagaacttgctgctgtcttg

SEQ ID NO: 1472403 - DNA, 18 bp, Homo sapiens
cagaactttgggaggcca

SEQ ID NO: 1472404 - DNA, 12 bp, Homo sapiens
cagaagaaaaca

SEQ ID NO: 1472405 - DNA, 12 bp, Homo sapiens
cagaagaaaggc

SEQ ID NO: 1472406 - DNA, 17 bp, Homo sapiens
cagaagaagagaagctg

SEQ ID NO: 1472407 - DNA, 23 bp, Homo sapiens
cagaagaagagaagctgctgacc

SEQ ID NO: 1472408 - DNA, 16 bp, Homo sapiens
cagaagaatattcagg

SEQ ID NO: 1472409 - DNA, 19 bp, Homo sapiens
cagaagaatattcaggact

SEQ ID NO: 1472410 - DNA, 17 bp, Homo sapiens
cagaagaattgaaccca

SEQ ID NO: 1472411 - DNA, 21 bp, Homo sapiens
cagaagaattgaacccaggag

SEQ ID NO: 1472412 - DNA, 19 bp, Homo sapiens
cagaagacactgcaaaggc

SEQ ID NO: 1472413 - DNA, 19 bp, Homo sapiens
cagaagactagaggccagg

SEQ ID NO: 1472414 - DNA, 21 bp, Homo sapiens
cagaagagaaaggactcagtg

SEQ ID NO: 1472415 - DNA, 20 bp, Homo sapiens
cagaagagatgggcttgttt

SEQ ID NO: 1472416 - DNA, 23 bp, Homo sapiens
cagaagagggtgtgtttgaaatc

SEQ ID NO: 1472417 - DNA, 15 bp, Homo sapiens
cagaagataacttga

SEQ ID NO: 1472418 - DNA, 21 bp, Homo sapiens
cagaagatgccagcttctctc

SEQ ID NO: 1472419 - DNA, 15 bp, Homo sapiens
cagaagatgtgaaat

SEQ ID NO: 1472420 - DNA, 20 bp, Homo sapiens
cagaagcacagaatattttt

SEQ ID NO: 1472421 - DNA, 15 bp, Homo sapiens
cagaagcagaggcta

SEQ ID NO: 1472422 - DNA, 16 bp, Homo sapiens
cagaagcaggttcttg

SEQ ID NO: 1472423 - DNA, 18 bp, Homo sapiens
cagaagcaggttcttgat

SEQ ID NO: 1472424 - DNA, 18 bp, Homo sapiens
cagaagcatattttgctg

SEQ ID NO: 1472425 - DNA, 19 bp, Homo sapiens
cagaagcattgcctggact

SEQ ID NO: 1472426 - DNA, 20 bp, Homo sapiens
cagaagcattgcctggactg

SEQ ID NO: 1472427 - DNA, 23 bp, Homo sapiens
cagaagcattgcctggactgacc

SEQ ID NO: 1472428 - DNA, 15 bp, Homo sapiens
cagaagcctctggct

SEQ ID NO: 1472429 - DNA, 14 bp, Homo sapiens
cagaagcctgaggc

SEQ ID NO: 1472430 - DNA, 21 bp, Homo sapiens
cagaagctcttactctttcct

SEQ ID NO: 1472431 - DNA, 24 bp, Homo sapiens
cagagaaaatgagaaaggacagag

SEQ ID NO: 1472432 - DNA, 18 bp, Homo sapiens
cagagaaaggggagccca

SEQ ID NO: 1472433 - DNA, 11 bp, Homo sapiens
cagagaaccat

SEQ ID NO: 1472434 - DNA, 13 bp, Homo sapiens
cagagaaggcctc

SEQ ID NO: 1472435 - DNA, 18 bp, Homo sapiens
cagagaaggcctcttgtg

SEQ ID NO: 1472436 - DNA, 19 bp, Homo sapiens
cagagaatcatacttagca

SEQ ID NO: 1472437 - DNA, 18 bp, Homo sapiens
cagagaatggctgggtca

SEQ ID NO: 1472438 - DNA, 23 bp, Homo sapiens
cagagacaagaaaggcagacaca

SEQ ID NO: 1472439 - DNA, 16 bp, Homo sapiens
cagagacaaggagggc

SEQ ID NO: 1472440 - DNA, 20 bp, Homo sapiens
cagagacaccaaactgccaa

SEQ ID NO: 1472441 - DNA, 13 bp, Homo sapiens
cagagacacctgc

SEQ ID NO: 1472442 - DNA, 16 bp, Homo sapiens
cagagacacctgcacc

SEQ ID NO: 1472443 - DNA, 17 bp, Homo sapiens
cagagacacctgcacct

SEQ ID NO: 1472444 - DNA, 14 bp, Homo sapiens
cagagacactttgt

SEQ ID NO: 1472445 - DNA, 20 bp, Homo sapiens
cagagacactttgtctagtg

SEQ ID NO: 1472446 - DNA, 23 bp, Homo sapiens
cagagacactttgtctagtgtat

SEQ ID NO: 1472447 - DNA, 13 bp, Homo sapiens
cagagacaggaaa

SEQ ID NO: 1472448 - DNA, 23 bp, Homo sapiens
cagagacaggcccaagagatgaa

SEQ ID NO: 1472449 - DNA, 19 bp, Homo sapiens
cagagacatacttgaaggg

SEQ ID NO: 1472450 - DNA, 16 bp, Homo sapiens
cagagacatgggcctc

SEQ ID NO: 1472451 - DNA, 18 bp, Homo sapiens
cagagacatgggcctccc

SEQ ID NO: 1472452 - DNA, 20 bp, Homo sapiens
cagagacatgggcctcccac

SEQ ID NO: 1472453 - DNA, 16 bp, Homo sapiens
cagagaccacaccact

SEQ ID NO: 1472454 - DNA, 13 bp, Homo sapiens
cagagaccagcac

SEQ ID NO: 1472455 - DNA, 18 bp, Homo sapiens
cagagaccagcactcagc

SEQ ID NO: 1472456 - DNA, 21 bp, Homo sapiens
cagagaccagcactcagcctc

SEQ ID NO: 1472457 - DNA, 18 bp, Homo sapiens
cagagaccaggctgtgtc

SEQ ID NO: 1472458 - DNA, 20 bp, Homo sapiens
cagagactcagggccccagc

SEQ ID NO: 1472459 - DNA, 21 bp, Homo sapiens
cagagactcagggccccagca

SEQ ID NO: 1472460 - DNA, 23 bp, Homo sapiens
cagagactcatttcacagccttt

SEQ ID NO: 1472461 - DNA, 21 bp, Homo sapiens
cagagactgtccctgaaacct

SEQ ID NO: 1472462 - DNA, 23 bp, Homo sapiens
cagagagaatgagagcgacacag

SEQ ID NO: 1472463 - DNA, 15 bp, Homo sapiens
cagagagacagactt

SEQ ID NO: 1472464 - DNA, 22 bp, Homo sapiens
cagagagacagacttgagaact

SEQ ID NO: 1472465 - DNA, 18 bp, Homo sapiens
cagagagacccgggaagg

SEQ ID NO: 1472466 - DNA, 19 bp, Homo sapiens
cagagagacctcatcctgc

SEQ ID NO: 1472467 - DNA, 21 bp, Homo sapiens
cagagagagaggacagagggg

SEQ ID NO: 1472468 - DNA, 17 bp, Homo sapiens
cagagagagcaaggaag

SEQ ID NO: 1472469 - DNA, 18 bp, Homo sapiens
cagagagagcaaggaagc

SEQ ID NO: 1472470 - DNA, 17 bp, Homo sapiens
cagagagaggggcctgc

SEQ ID NO: 1472471 - DNA, 15 bp, Homo sapiens
cagagagcatctttc

SEQ ID NO: 1472472 - DNA, 13 bp, Homo sapiens
cagagagccaaat

SEQ ID NO: 1472473 - DNA, 19 bp, Homo sapiens
cagagaggaaattctccac

SEQ ID NO: 1472474 - DNA, 17 bp, Homo sapiens
cagagaggaccaacatc

SEQ ID NO: 1472475 - DNA, 18 bp, Homo sapiens
cagagaggactgtaggga

SEQ ID NO: 1472476 - DNA, 12 bp, Homo sapiens
cagagaggagca

SEQ ID NO: 1472477 - DNA, 17 bp, Homo sapiens
cagagaggagcacctga

SEQ ID NO: 1472478 - DNA, 21 bp, Homo sapiens
cagagaggagcacctgaaccc

SEQ ID NO: 1472479 - DNA, 17 bp, Homo sapiens
cagagaggatacattta

SEQ ID NO: 1472480 - DNA, 20 bp, Homo sapiens
cagagaggatacatttaata

SEQ ID NO: 1472481 - DNA, 13 bp, Homo sapiens
cagagaggccttt

SEQ ID NO: 1472482 - DNA, 20 bp, Homo sapiens
cagagaggccttttggaatg

SEQ ID NO: 1472483 - DNA, 18 bp, Homo sapiens
cagagaggtggagaactg

SEQ ID NO: 1472484 - DNA, 14 bp, Homo sapiens
cagagagtggctcc

SEQ ID NO: 1472485 - DNA, 18 bp, Homo sapiens
cagagagtggctcctccc

SEQ ID NO: 1472486 - DNA, 14 bp, Homo sapiens
cagagagtgtacat

SEQ ID NO: 1472487 - DNA, 20 bp, Homo sapiens
cagagataaaccaataaatc

SEQ ID NO: 1472488 - DNA, 15 bp, Homo sapiens
cagagataggcctgt

SEQ ID NO: 1472489 - DNA, 19 bp, Homo sapiens
cagagatccaaaagaagcc

SEQ ID NO: 1472490 - DNA, 20 bp, Homo sapiens
cagagatccaaaagaagccc

SEQ ID NO: 1472491 - DNA, 19 bp, Homo sapiens
cagagatgagtgtctggag

SEQ ID NO: 1472492 - DNA, 16 bp, Homo sapiens
cagagatgcctccacc

SEQ ID NO: 1472493 - DNA, 18 bp, Homo sapiens
cagagatgcctccaccgc

SEQ ID NO: 1472494 - DNA, 15 bp, Homo sapiens
cagagattctggatc

SEQ ID NO: 1472495 - DNA, 23 bp, Homo sapiens
cagagattctggatctcctgctg

SEQ ID NO: 1472496 - DNA, 18 bp, Homo sapiens
cagagatttcctccatgg

SEQ ID NO: 1472497 - DNA, 16 bp, Homo sapiens
cagagatttctcattg

SEQ ID NO: 1472498 - DNA, 16 bp, Homo sapiens
cagagcaaagcgccca

SEQ ID NO: 1472499 - DNA, 18 bp, Homo sapiens
cagagcaaagcgcccacc

SEQ ID NO: 1472500 - DNA, 22 bp, Homo sapiens
cagagcaaagcgcccacccagg

SEQ ID NO: 1472501 - DNA, 17 bp, Homo sapiens
cagagcaaccagaagga

SEQ ID NO: 1472502 - DNA, 16 bp, Homo sapiens
cagagcaattccaggc

SEQ ID NO: 1472503 - DNA, 17 bp, Homo sapiens
cagagcaattccaggct

SEQ ID NO: 1472504 - DNA, 19 bp, Homo sapiens
cagagcaattccaggctga

SEQ ID NO: 1472505 - DNA, 21 bp, Homo sapiens
cagagcaattccaggctgagc

SEQ ID NO: 1472506 - DNA, 17 bp, Homo sapiens
cagagcacacaggtaca

SEQ ID NO: 1472507 - DNA, 20 bp, Homo sapiens
cagagcacacaggtacagca

SEQ ID NO: 1472508 - DNA, 15 bp, Homo sapiens
cagagcaccccctgc

SEQ ID NO: 1472509 - DNA, 19 bp, Homo sapiens
cagagcagagcaaatgagg

SEQ ID NO: 1472510 - DNA, 14 bp, Homo sapiens
cagagcaggaggcc

SEQ ID NO: 1472511 - DNA, 12 bp, Homo sapiens
cagagcagggcc

SEQ ID NO: 1472512 - DNA, 15 bp, Homo sapiens
cagagccaacctgga

SEQ ID NO: 1472513 - DNA, 19 bp, Homo sapiens
cagagccaacctggacttc

SEQ ID NO: 1472514 - DNA, 22 bp, Homo sapiens
cagagccaacctggacttcctg

SEQ ID NO: 1472515 - DNA, 23 bp, Homo sapiens
cagagccaacctggacttcctgt

SEQ ID NO: 1472516 - DNA, 14 bp, Homo sapiens
cagagccaagcact

SEQ ID NO: 1472517 - DNA, 17 bp, Homo sapiens
cagagccaagcactgct

SEQ ID NO: 1472518 - DNA, 18 bp, Homo sapiens
cagagccaagcactgctc

SEQ ID NO: 1472519 - DNA, 19 bp, Homo sapiens
cagagccaagcactgctca

SEQ ID NO: 1472520 - DNA, 17 bp, Homo sapiens
cagagccactctatgag

SEQ ID NO: 1472521 - DNA, 14 bp, Homo sapiens
cagagccagatgca

SEQ ID NO: 1472522 - DNA, 20 bp, Homo sapiens
cagagccagatgcaggacag

SEQ ID NO: 1472523 - DNA, 22 bp, Homo sapiens
cagagccagatgcaggacagga

SEQ ID NO: 1472524 - DNA, 15 bp, Homo sapiens
cagagccagcctggc

SEQ ID NO: 1472525 - DNA, 22 bp, Homo sapiens
cagagccagcctggctctgccc

SEQ ID NO: 1472526 - DNA, 16 bp, Homo sapiens
cagagccagcctggga

SEQ ID NO: 1472527 - DNA, 17 bp, Homo sapiens
cagagccagcctgggac

SEQ ID NO: 1472528 - DNA, 16 bp, Homo sapiens
cagagccagcggctcc

SEQ ID NO: 1472529 - DNA, 12 bp, Homo sapiens
cagagccaggag

SEQ ID NO: 1472530 - DNA, 13 bp, Homo sapiens
cagagccaggaga

SEQ ID NO: 1472531 - DNA, 23 bp, Homo sapiens
cagagccaggagaagctcagctg

SEQ ID NO: 1472532 - DNA, 11 bp, Homo sapiens
cagagccatgg

SEQ ID NO: 1472533 - DNA, 15 bp, Homo sapiens
cagagccatgggcct

SEQ ID NO: 1472534 - DNA, 17 bp, Homo sapiens
cagagccatgggcctgg

SEQ ID NO: 1472535 - DNA, 18 bp, Homo sapiens
cagagcccagcccaggag

SEQ ID NO: 1472536 - DNA, 12 bp, Homo sapiens
cagagcccagct

SEQ ID NO: 1472537 - DNA, 19 bp, Homo sapiens
cagagcccatgctcaacca

SEQ ID NO: 1472538 - DNA, 16 bp, Homo sapiens
cagagccccacacgga

SEQ ID NO: 1472539 - DNA, 16 bp, Homo sapiens
cagagccccacgctgt

SEQ ID NO: 1472540 - DNA, 16 bp, Homo sapiens
cagagcccccagccct

SEQ ID NO: 1472541 - DNA, 22 bp, Homo sapiens
cagagcccctcctccagcccct

SEQ ID NO: 1472542 - DNA, 14 bp, Homo sapiens
cagagccctccagg

SEQ ID NO: 1472543 - DNA, 16 bp, Homo sapiens
cagagccctccaggcc

SEQ ID NO: 1472544 - DNA, 22 bp, Homo sapiens
cagagccctccaggcctgcagg

SEQ ID NO: 1472545 - DNA, 14 bp, Homo sapiens
cagatgcctccacc

SEQ ID NO: 1472546 - DNA, 22 bp, Homo sapiens
cagatgcctccaccccccagaa

SEQ ID NO: 1472547 - DNA, 15 bp, Homo sapiens
cagatgcctccccaa

SEQ ID NO: 1472548 - DNA, 22 bp, Homo sapiens
cagatgccttctagattcactg

SEQ ID NO: 1472549 - DNA, 21 bp, Homo sapiens
cagatgcgtcccaagatgttg

SEQ ID NO: 1472550 - DNA, 16 bp, Homo sapiens
cagatgctaggaagct

SEQ ID NO: 1472551 - DNA, 19 bp, Homo sapiens
cagatgctccaagattcta

SEQ ID NO: 1472552 - DNA, 20 bp, Homo sapiens
cagatgctccaagattctag

SEQ ID NO: 1472553 - DNA, 23 bp, Homo sapiens
cagatgctccaagattctagatg

SEQ ID NO: 1472554 - DNA, 13 bp, Homo sapiens
cagatgcttctgg

SEQ ID NO: 1472555 - DNA, 17 bp, Homo sapiens
cagatgcttctgggaga

SEQ ID NO: 1472556 - DNA, 19 bp, Homo sapiens
cagatggaaaattcatttt

SEQ ID NO: 1472557 - DNA, 21 bp, Homo sapiens
cagatggaaaattcatttttt

SEQ ID NO: 1472558 - DNA, 19 bp, Homo sapiens
cagatggaagagataaacg

SEQ ID NO: 1472559 - DNA, 16 bp, Homo sapiens
cagatggaatgctgtg

SEQ ID NO: 1472560 - DNA, 22 bp, Homo sapiens
cagatggattgataattgcatt

SEQ ID NO: 1472561 - DNA, 22 bp, Homo sapiens
cagatggatttgcctgtgccac

SEQ ID NO: 1472562 - DNA, 12 bp, Homo sapiens
cagatggcactt

SEQ ID NO: 1472563 - DNA, 18 bp, Homo sapiens
cagatggcccccagctgg

SEQ ID NO: 1472564 - DNA, 22 bp, Homo sapiens
cagatggcccccagctggtgtc

SEQ ID NO: 1472565 - DNA, 18 bp, Homo sapiens
cagatggctttcagggca

SEQ ID NO: 1472566 - DNA, 16 bp, Homo sapiens
cagatggggtctgtga

SEQ ID NO: 1472567 - DNA, 17 bp, Homo sapiens
cagatgggtattaaact

SEQ ID NO: 1472568 - DNA, 20 bp, Homo sapiens
cagatgggtctgatattaat

SEQ ID NO: 1472569 - DNA, 22 bp, Homo sapiens
cagatgggtctgatattaatca

SEQ ID NO: 1472570 - DNA, 14 bp, Homo sapiens
cagatggtttccta

SEQ ID NO: 1472571 - DNA, 23 bp, Homo sapiens
cagatgtaggggaagagatgttt

SEQ ID NO: 1472572 - DNA, 19 bp, Homo sapiens
cagatgtgcaataatttgt

SEQ ID NO: 1472573 - DNA, 11 bp, Homo sapiens
cagatgtgcat

SEQ ID NO: 1472574 - DNA, 18 bp, Homo sapiens
cagatgtgctataatctg

SEQ ID NO: 1472575 - DNA, 20 bp, Homo sapiens
cagatgtgctataatctgtt

SEQ ID NO: 1472576 - DNA, 15 bp, Homo sapiens
cagatgtggggctga

SEQ ID NO: 1472577 - DNA, 23 bp, Homo sapiens
cagatgtggggctgagctgggga

SEQ ID NO: 1472578 - DNA, 17 bp, Homo sapiens
cagatgttagatatttt

SEQ ID NO: 1472579 - DNA, 16 bp, Homo sapiens
cagatgttcaaatatt

SEQ ID NO: 1472580 - DNA, 23 bp, Homo sapiens
cagatgttgcttttgaaaagttg

SEQ ID NO: 1472581 - DNA, 15 bp, Homo sapiens
cagatgttgggagga

SEQ ID NO: 1472582 - DNA, 13 bp, Homo sapiens
cagattaaaaaaa

SEQ ID NO: 1472583 - DNA, 17 bp, Homo sapiens
cagattatgttcctgct

SEQ ID NO: 1472584 - DNA, 19 bp, Homo sapiens
cagattatgttcctgctgt

SEQ ID NO: 1472585 - DNA, 20 bp, Homo sapiens
cagattatgttcctgctgta

SEQ ID NO: 1472586 - DNA, 23 bp, Homo sapiens
cagattatgttcctgctgtattt

SEQ ID NO: 1472587 - DNA, 19 bp, Homo sapiens
cagattcaggccagcccag

SEQ ID NO: 1472588 - DNA, 22 bp, Homo sapiens
cagattcaggccagcccagcca

SEQ ID NO: 1472589 - DNA, 16 bp, Homo sapiens
cagattccaacatttc

SEQ ID NO: 1472590 - DNA, 17 bp, Homo sapiens
cagattcccctgtgtca

SEQ ID NO: 1472591 - DNA, 17 bp, Homo sapiens
cagattcctgggcctgt

SEQ ID NO: 1472592 - DNA, 19 bp, Homo sapiens
cagattcctgggcctgtcc

SEQ ID NO: 1472593 - DNA, 20 bp, Homo sapiens
cagattcctgggcctgtccc

SEQ ID NO: 1472594 - DNA, 14 bp, Homo sapiens
cagattctgatgca

SEQ ID NO: 1472595 - DNA, 12 bp, Homo sapiens
cagattcttcag

SEQ ID NO: 1472596 - DNA, 12 bp, Homo sapiens
cagattgaaaag

SEQ ID NO: 1472597 - DNA, 14 bp, Homo sapiens
cagattgaaaagga

SEQ ID NO: 1472598 - DNA, 22 bp, Homo sapiens
cagattgtgtacatagagcaat

SEQ ID NO: 1472599 - DNA, 23 bp, Homo sapiens
cagattgttaggagtggttctca

SEQ ID NO: 1472600 - DNA, 14 bp, Homo sapiens
cagattgttatcta

SEQ ID NO: 1472601 - DNA, 15 bp, Homo sapiens
cagatttaagcctta

SEQ ID NO: 1472602 - DNA, 20 bp, Homo sapiens
cagatttaagccttacaaag

SEQ ID NO: 1472603 - DNA, 17 bp, Homo sapiens
cagatttagtgaaagct

SEQ ID NO: 1472604 - DNA, 14 bp, Homo sapiens
cagatttccagcct

SEQ ID NO: 1472605 - DNA, 16 bp, Homo sapiens
cagatttctcactata

SEQ ID NO: 1472606 - DNA, 12 bp, Homo sapiens
cagatttgcatt

SEQ ID NO: 1472607 - DNA, 22 bp, Homo sapiens
cagatttggggtataggtctca

SEQ ID NO: 1472608 - DNA, 24 bp, Homo sapiens
cagatttgtctttttgttgtaaaa

SEQ ID NO: 1472609 - DNA, 15 bp, Homo sapiens
cagattttaaatttt

SEQ ID NO: 1472610 - DNA, 15 bp, Homo sapiens
cagattttaattttg

SEQ ID NO: 1472611 - DNA, 23 bp, Homo sapiens
cagattttactgtctatggattt

SEQ ID NO: 1472612 - DNA, 13 bp, Homo sapiens
cagattttatttg

SEQ ID NO: 1472613 - DNA, 17 bp, Homo sapiens
cagattttggccatgaa

SEQ ID NO: 1472614 - DNA, 21 bp, Homo sapiens
cagattttggggttgtgttgt

SEQ ID NO: 1472615 - DNA, 23 bp, Homo sapiens
cagattttgttggcatagctctg

SEQ ID NO: 1472616 - DNA, 20 bp, Homo sapiens
cagatttttatgttttgaaa

SEQ ID NO: 1472617 - DNA, 22 bp, Homo sapiens
cagcaaaagatgtgcaaaatca

SEQ ID NO: 1472618 - DNA, 15 bp, Homo sapiens
cagcaaaatgttgaa

SEQ ID NO: 1472619 - DNA, 21 bp, Homo sapiens
cagcaaacactccaccctcca

SEQ ID NO: 1472620 - DNA, 23 bp, Homo sapiens
cagcaaactaaccagcattccct

SEQ ID NO: 1472621 - DNA, 20 bp, Homo sapiens
cagcaaagcttggtgtcttg

SEQ ID NO: 1472622 - DNA, 12 bp, Homo sapiens
cagcaaatatat

SEQ ID NO: 1472623 - DNA, 14 bp, Homo sapiens
cagcaaatatttat

SEQ ID NO: 1472624 - DNA, 16 bp, Homo sapiens
cagcaaatatttattg

SEQ ID NO: 1472625 - DNA, 14 bp, Homo sapiens
cagcaaattttcag

SEQ ID NO: 1472626 - DNA, 19 bp, Homo sapiens
cagcaacaaaatcatggct

SEQ ID NO: 1472627 - DNA, 22 bp, Homo sapiens
cagcaacaaaatcatggcttag

SEQ ID NO: 1472628 - DNA, 22 bp, Homo sapiens
cagcaacaagactgccaggtgg

SEQ ID NO: 1472629 - DNA, 16 bp, Homo sapiens
cagcaacacagcctgg

SEQ ID NO: 1472630 - DNA, 14 bp, Homo sapiens
cagcaacagcctac

SEQ ID NO: 1472631 - DNA, 20 bp, Homo sapiens
cagcaacaggaatctcagag

SEQ ID NO: 1472632 - DNA, 18 bp, Homo sapiens
cagcaacccttcctgctg

SEQ ID NO: 1472633 - DNA, 19 bp, Homo sapiens
cagcaacccttcctgctgc

SEQ ID NO: 1472634 - DNA, 21 bp, Homo sapiens
cagcaacctgtaactcacatt

SEQ ID NO: 1472635 - DNA, 18 bp, Homo sapiens
cagcaacgcccctccaaa

SEQ ID NO: 1472636 - DNA, 17 bp, Homo sapiens
cagcaacgcttgtagaa

SEQ ID NO: 1472637 - DNA, 14 bp, Homo sapiens
cagcaactgccctt

SEQ ID NO: 1472638 - DNA, 17 bp, Homo sapiens
cagcaactgcccttcca

SEQ ID NO: 1472639 - DNA, 22 bp, Homo sapiens
cagcaacttcttctccatccct

SEQ ID NO: 1472640 - DNA, 14 bp, Homo sapiens
cagcaagaataaaa

SEQ ID NO: 1472641 - DNA, 16 bp, Homo sapiens
cagcaagaataaaaaa

SEQ ID NO: 1472642 - DNA, 23 bp, Homo sapiens
cagcaagacctcatctgtggagc

SEQ ID NO: 1472643 - DNA, 17 bp, Homo sapiens
cagcaagagcacaagag

SEQ ID NO: 1472644 - DNA, 20 bp, Homo sapiens
cagcaagagtaagcagtgtt

SEQ ID NO: 1472645 - DNA, 15 bp, Homo sapiens
cagcaaggctgctgc

SEQ ID NO: 1472646 - DNA, 13 bp, Homo sapiens
cagcaagggacct

SEQ ID NO: 1472647 - DNA, 22 bp, Homo sapiens
cagcaagggagatttttgaatc

SEQ ID NO: 1472648 - DNA, 17 bp, Homo sapiens
cagcaaggggctctgcc

SEQ ID NO: 1472649 - DNA, 20 bp, Homo sapiens
cagcaaggggctctgccctc

SEQ ID NO: 1472650 - DNA, 22 bp, Homo sapiens
cagcaagggtgatgggaaagca

SEQ ID NO: 1472651 - DNA, 20 bp, Homo sapiens
cagcaagtgtttgtgggaca

SEQ ID NO: 1472652 - DNA, 23 bp, Homo sapiens
cagcaagttagaactagccaaac

SEQ ID NO: 1472653 - DNA, 23 bp, Homo sapiens
cagcaatatattaccagcaagaa

SEQ ID NO: 1472654 - DNA, 12 bp, Homo sapiens
cagcaatctgca

SEQ ID NO: 1472655 - DNA, 20 bp, Homo sapiens
cagcaatgatgtccagaaga

SEQ ID NO: 1472656 - DNA, 22 bp, Homo sapiens
cagcaattacaacggagtcaaa

SEQ ID NO: 1472657 - DNA, 13 bp, Homo sapiens
cagcaatttctaa

SEQ ID NO: 1472658 - DNA, 19 bp, Homo sapiens
cagccctccctgtcctcct

SEQ ID NO: 1472659 - DNA, 21 bp, Homo sapiens
cagccctccctgtcctcctcg

SEQ ID NO: 1472660 - DNA, 17 bp, Homo sapiens
cagccctccgaccctca

SEQ ID NO: 1472661 - DNA, 21 bp, Homo sapiens
cagccctccgaccctcatggc

SEQ ID NO: 1472662 - DNA, 22 bp, Homo sapiens
cagccctcctcaccccgtctgg

SEQ ID NO: 1472663 - DNA, 14 bp, Homo sapiens
cagccctcggcctc

SEQ ID NO: 1472664 - DNA, 23 bp, Homo sapiens
cagccctgcagcccaaaacccag

SEQ ID NO: 1472665 - DNA, 15 bp, Homo sapiens
cagccctgctgggga

SEQ ID NO: 1472666 - DNA, 21 bp, Homo sapiens
cagccctgctttgggctgccc

SEQ ID NO: 1472667 - DNA, 22 bp, Homo sapiens
cagccctgctttgggctgccct

SEQ ID NO: 1472668 - DNA, 14 bp, Homo sapiens
cagccctggccctg

SEQ ID NO: 1472669 - DNA, 11 bp, Homo sapiens
cagccctgggc

SEQ ID NO: 1472670 - DNA, 19 bp, Homo sapiens
cagccctgggccccaccac

SEQ ID NO: 1472671 - DNA, 21 bp, Homo sapiens
cagccctgggccccaccacct

SEQ ID NO: 1472672 - DNA, 23 bp, Homo sapiens
cagccctgggccccaccacctag

SEQ ID NO: 1472673 - DNA, 22 bp, Homo sapiens
cagccctgtcccctgaaaaact

SEQ ID NO: 1472674 - DNA, 21 bp, Homo sapiens
cagccctgtctgaaggacact

SEQ ID NO: 1472675 - DNA, 16 bp, Homo sapiens
cagccctgtcttccta

SEQ ID NO: 1472676 - DNA, 23 bp, Homo sapiens
cagcccttatgcggttaattttg

SEQ ID NO: 1472677 - DNA, 21 bp, Homo sapiens
cagcccttgcccccatccctc

SEQ ID NO: 1472678 - DNA, 23 bp, Homo sapiens
cagccctttgggaggctgaggcg

SEQ ID NO: 1472679 - DNA, 12 bp, Homo sapiens
cagccgagccgg

SEQ ID NO: 1472680 - DNA, 14 bp, Homo sapiens
cagccgagctcgtg

SEQ ID NO: 1472681 - DNA, 23 bp, Homo sapiens
cagccgagctcgtgtatcctggg

SEQ ID NO: 1472682 - DNA, 16 bp, Homo sapiens
cagccgaggcctggcc

SEQ ID NO: 1472683 - DNA, 21 bp, Homo sapiens
cagccgaggcctggccaatgc

SEQ ID NO: 1472684 - DNA, 18 bp, Homo sapiens
cagccgccagctgggagc

SEQ ID NO: 1472685 - DNA, 22 bp, Homo sapiens
cagccgccattgccaccaggag

SEQ ID NO: 1472686 - DNA, 18 bp, Homo sapiens
cagccgccttaagctgat

SEQ ID NO: 1472687 - DNA, 14 bp, Homo sapiens
cagccgctaggaga

SEQ ID NO: 1472688 - DNA, 17 bp, Homo sapiens
cagccgctaggagagac

SEQ ID NO: 1472689 - DNA, 21 bp, Homo sapiens
cagccgctaggagagactgaa

SEQ ID NO: 1472690 - DNA, 14 bp, Homo sapiens
cagccgctcctgtc

SEQ ID NO: 1472691 - DNA, 17 bp, Homo sapiens
cagccgctcctgtctgc

SEQ ID NO: 1472692 - DNA, 15 bp, Homo sapiens
cagccggcacagggt

SEQ ID NO: 1472693 - DNA, 15 bp, Homo sapiens
cagccggcctctctg

SEQ ID NO: 1472694 - DNA, 19 bp, Homo sapiens
cagccggcctctctggcct

SEQ ID NO: 1472695 - DNA, 23 bp, Homo sapiens
cagccggcctctctggcctccca

SEQ ID NO: 1472696 - DNA, 18 bp, Homo sapiens
cagccgggcacagtggcg

SEQ ID NO: 1472697 - DNA, 19 bp, Homo sapiens
cagccgtagggtggcactg

SEQ ID NO: 1472698 - DNA, 13 bp, Homo sapiens
cagccgtatttta

SEQ ID NO: 1472699 - DNA, 13 bp, Homo sapiens
cagccgtcccagg

SEQ ID NO: 1472700 - DNA, 17 bp, Homo sapiens
cagccgtcccaggccac

SEQ ID NO: 1472701 - DNA, 20 bp, Homo sapiens
cagccgtcccgcgttcaaga

SEQ ID NO: 1472702 - DNA, 17 bp, Homo sapiens
cagccgtgatgctcagg

SEQ ID NO: 1472703 - DNA, 9 bp, Homo sapiens
cagccgtgc

SEQ ID NO: 1472704 - DNA, 14 bp, Homo sapiens
cagcctaagagact

SEQ ID NO: 1472705 - DNA, 21 bp, Homo sapiens
cagcctaccgctggccctgcc

SEQ ID NO: 1472706 - DNA, 23 bp, Homo sapiens
cagcctaccgctggccctgccgt

SEQ ID NO: 1472707 - DNA, 20 bp, Homo sapiens
cagcctactccgctcactga

SEQ ID NO: 1472708 - DNA, 18 bp, Homo sapiens
cagcctagccgacctcag

SEQ ID NO: 1472709 - DNA, 22 bp, Homo sapiens
cagcctagccgacctcagcctt

SEQ ID NO: 1472710 - DNA, 12 bp, Homo sapiens
cagcctcacaga

SEQ ID NO: 1472711 - DNA, 14 bp, Homo sapiens
cagcctcacagaag

SEQ ID NO: 1472712 - DNA, 19 bp, Homo sapiens
cagcctcagaaggccccag

SEQ ID NO: 1472713 - DNA, 16 bp, Homo sapiens
cagcctcagtgccact

SEQ ID NO: 1472714 - DNA, 15 bp, Homo sapiens
cagcctccaaagtgg

SEQ ID NO: 1472715 - DNA, 19 bp, Homo sapiens
cagcctccaatgcattggc

SEQ ID NO: 1472716 - DNA, 21 bp, Homo sapiens
cagcctccaatgcattggcct

SEQ ID NO: 1472717 - DNA, 20 bp, Homo sapiens
cagcctccaccttgctcttc

SEQ ID NO: 1472718 - DNA, 13 bp, Homo sapiens
cagcctccacttc

SEQ ID NO: 1472719 - DNA, 14 bp, Homo sapiens
cagcctccacttcc

SEQ ID NO: 1472720 - DNA, 20 bp, Homo sapiens
cagcctccagagccagcctg

SEQ ID NO: 1472721 - DNA, 12 bp, Homo sapiens
cagcctccaggg

SEQ ID NO: 1472722 - DNA, 13 bp, Homo sapiens
cagcctccagggc

SEQ ID NO: 1472723 - DNA, 19 bp, Homo sapiens
cagcctcccacccccatct

SEQ ID NO: 1472724 - DNA, 18 bp, Homo sapiens
cagcctcccccgccagcc

SEQ ID NO: 1472725 - DNA, 19 bp, Homo sapiens
cagcctcccgagtagctgg

SEQ ID NO: 1472726 - DNA, 13 bp, Homo sapiens
cagcctccctctg

SEQ ID NO: 1472727 - DNA, 15 bp, Homo sapiens
cagcctccctctgac

SEQ ID NO: 1472728 - DNA, 21 bp, Homo sapiens
cagcctccctctgacctgcag

SEQ ID NO: 1472729 - DNA, 23 bp, Homo sapiens
cagcctccctctgacctgcaggc

SEQ ID NO: 1472730 - DNA, 17 bp, Homo sapiens
cagcctccctgtcactc

SEQ ID NO: 1472731 - DNA, 19 bp, Homo sapiens
cagcctccctgtctccagc

SEQ ID NO: 1472732 - DNA, 23 bp, Homo sapiens
cagcctccctgtctccagctgcc

SEQ ID NO: 1472733 - DNA, 16 bp, Homo sapiens
cagcctcccttccatg

SEQ ID NO: 1472734 - DNA, 20 bp, Homo sapiens
cagcctcccttccatgcccc

SEQ ID NO: 1472735 - DNA, 20 bp, Homo sapiens
cagcctccgcctcccgggtt

SEQ ID NO: 1472736 - DNA, 14 bp, Homo sapiens
cagcctcctctgga

SEQ ID NO: 1472737 - DNA, 16 bp, Homo sapiens
cagcctcctgggggat

SEQ ID NO: 1472738 - DNA, 18 bp, Homo sapiens
cagcctcctgtttgcagg

SEQ ID NO: 1472739 - DNA, 21 bp, Homo sapiens
cagcctcctttgtgtgtattc

SEQ ID NO: 1472740 - DNA, 18 bp, Homo sapiens
cagcctcgttggaagagg

SEQ ID NO: 1472741 - DNA, 22 bp, Homo sapiens
cagcctcgttggaagaggaaca

SEQ ID NO: 1472742 - DNA, 16 bp, Homo sapiens
cagcctctccccaggt

SEQ ID NO: 1472743 - DNA, 16 bp, Homo sapiens
cagcctctcccggctg

SEQ ID NO: 1472744 - DNA, 21 bp, Homo sapiens
cagcctctcccggctgcctgc

SEQ ID NO: 1472745 - DNA, 22 bp, Homo sapiens
cagcctctcttggtttccttcc

SEQ ID NO: 1472746 - DNA, 11 bp, Homo sapiens
cagcctctgcc

SEQ ID NO: 1472747 - DNA, 13 bp, Homo sapiens
cagcctctgccag

SEQ ID NO: 1472748 - DNA, 17 bp, Homo sapiens
cagcctctgtcaggcct

SEQ ID NO: 1472749 - DNA, 20 bp, Homo sapiens
cagcctctgtcaggccttca

SEQ ID NO: 1472750 - DNA, 17 bp, Homo sapiens
cagcctcttgctcagag

SEQ ID NO: 1472751 - DNA, 18 bp, Homo sapiens
cagcctgaaagatacagg

SEQ ID NO: 1472752 - DNA, 13 bp, Homo sapiens
cagcctgaagcct

SEQ ID NO: 1472753 - DNA, 19 bp, Homo sapiens
cagcctgaggctgagactg

SEQ ID NO: 1472754 - DNA, 17 bp, Homo sapiens
cagcctgagtctcctgt

SEQ ID NO: 1472755 - DNA, 22 bp, Homo sapiens
cagcctgagtctcctgtgccca

SEQ ID NO: 1472756 - DNA, 15 bp, Homo sapiens
cagcctgagtgacag

SEQ ID NO: 1472757 - DNA, 15 bp, Homo sapiens
cagcctgcacacacc

SEQ ID NO: 1472758 - DNA, 17 bp, Homo sapiens
cagcctgcacacacctg

SEQ ID NO: 1472759 - DNA, 21 bp, Homo sapiens
cagcctgcacacacctgcctg

SEQ ID NO: 1472760 - DNA, 22 bp, Homo sapiens
cagcctgcacacacctgcctgc

SEQ ID NO: 1472761 - DNA, 23 bp, Homo sapiens
cagcctgcacctggtgggtggtg

SEQ ID NO: 1472762 - DNA, 12 bp, Homo sapiens
cagcctgctctg

SEQ ID NO: 1472763 - DNA, 15 bp, Homo sapiens
cagcctgctctggag

SEQ ID NO: 1472764 - DNA, 11 bp, Homo sapiens
cagcctgctga

SEQ ID NO: 1472765 - DNA, 13 bp, Homo sapiens
cagcctggcacag

SEQ ID NO: 1472766 - DNA, 21 bp, Homo sapiens
cagcctggcacagggcagtgg

SEQ ID NO: 1472767 - DNA, 21 bp, Homo sapiens
cagcctggccacgcagccagg

SEQ ID NO: 1472768 - DNA, 17 bp, Homo sapiens
cagcctggccagacaca

SEQ ID NO: 1472769 - DNA, 23 bp, Homo sapiens
cagcctggcgaaaccccatctct

SEQ ID NO: 1472770 - DNA, 16 bp, Homo sapiens
cagcctggcttctgga

SEQ ID NO: 1472771 - DNA, 17 bp, Homo sapiens
cagcctggcttctggag

SEQ ID NO: 1472772 - DNA, 22 bp, Homo sapiens
cagctgcaaggtactctggtga

SEQ ID NO: 1472773 - DNA, 16 bp, Homo sapiens
cagctgcacattcctg

SEQ ID NO: 1472774 - DNA, 20 bp, Homo sapiens
cagctgcacattcctggccc

SEQ ID NO: 1472775 - DNA, 21 bp, Homo sapiens
cagctgcacattcctggcccc

SEQ ID NO: 1472776 - DNA, 12 bp, Homo sapiens
cagctgcactga

SEQ ID NO: 1472777 - DNA, 18 bp, Homo sapiens
cagctgcactgatgctgc

SEQ ID NO: 1472778 - DNA, 13 bp, Homo sapiens
cagctgcagacca

SEQ ID NO: 1472779 - DNA, 19 bp, Homo sapiens
cagctgcagatgccacacc

SEQ ID NO: 1472780 - DNA, 15 bp, Homo sapiens
cagctgcagctgatc

SEQ ID NO: 1472781 - DNA, 22 bp, Homo sapiens
cagctgcagctgatccatagga

SEQ ID NO: 1472782 - DNA, 13 bp, Homo sapiens
cagctgcagctgg

SEQ ID NO: 1472783 - DNA, 19 bp, Homo sapiens
cagctgcagctgggcccca

SEQ ID NO: 1472784 - DNA, 17 bp, Homo sapiens
cagctgcaggggcctct

SEQ ID NO: 1472785 - DNA, 17 bp, Homo sapiens
cagctgcagtcaacagt

SEQ ID NO: 1472786 - DNA, 22 bp, Homo sapiens
cagctgcagtcaacagttcaaa

SEQ ID NO: 1472787 - DNA, 20 bp, Homo sapiens
cagctgcatttcacatgcct

SEQ ID NO: 1472788 - DNA, 21 bp, Homo sapiens
cagctgccaagcactcgagac

SEQ ID NO: 1472789 - DNA, 15 bp, Homo sapiens
cagctgcccatccca

SEQ ID NO: 1472790 - DNA, 20 bp, Homo sapiens
cagctgcccatcccagtccc

SEQ ID NO: 1472791 - DNA, 17 bp, Homo sapiens
cagctgccccggcccct

SEQ ID NO: 1472792 - DNA, 19 bp, Homo sapiens
cagctgccccggcccctcc

SEQ ID NO: 1472793 - DNA, 22 bp, Homo sapiens
cagctgccccggcccctccccc

SEQ ID NO: 1472794 - DNA, 11 bp, Homo sapiens
cagctgcccta

SEQ ID NO: 1472795 - DNA, 14 bp, Homo sapiens
cagctgccctagct

SEQ ID NO: 1472796 - DNA, 16 bp, Homo sapiens
cagctgccctagctga

SEQ ID NO: 1472797 - DNA, 19 bp, Homo sapiens
cagctgccctagctgaccc

SEQ ID NO: 1472798 - DNA, 19 bp, Homo sapiens
cagctgccctatgggcctg

SEQ ID NO: 1472799 - DNA, 20 bp, Homo sapiens
cagctgccctatgggcctgc

SEQ ID NO: 1472800 - DNA, 17 bp, Homo sapiens
cagctgccgcaccagcc

SEQ ID NO: 1472801 - DNA, 13 bp, Homo sapiens
cagctgcctctgc

SEQ ID NO: 1472802 - DNA, 18 bp, Homo sapiens
cagctgcctctgctccct

SEQ ID NO: 1472803 - DNA, 13 bp, Homo sapiens
cagctgcctgggc

SEQ ID NO: 1472804 - DNA, 14 bp, Homo sapiens
cagctgcgggtctg

SEQ ID NO: 1472805 - DNA, 22 bp, Homo sapiens
cagctgctatttattttcctaa

SEQ ID NO: 1472806 - DNA, 18 bp, Homo sapiens
cagctgctccctggcatt

SEQ ID NO: 1472807 - DNA, 17 bp, Homo sapiens
cagctgctctgcccctt

SEQ ID NO: 1472808 - DNA, 20 bp, Homo sapiens
cagctgctctgccccttggg

SEQ ID NO: 1472809 - DNA, 16 bp, Homo sapiens
cagctgctcttagtgc

SEQ ID NO: 1472810 - DNA, 20 bp, Homo sapiens
cagctgctcttagtgcccgc

SEQ ID NO: 1472811 - DNA, 22 bp, Homo sapiens
cagctgctcttagtgcccgcct

SEQ ID NO: 1472812 - DNA, 12 bp, Homo sapiens
cagctgctcttg

SEQ ID NO: 1472813 - DNA, 21 bp, Homo sapiens
cagctgctcttgcatctgggc

SEQ ID NO: 1472814 - DNA, 21 bp, Homo sapiens
cagctgctgaaacaacaaata

SEQ ID NO: 1472815 - DNA, 16 bp, Homo sapiens
cagctgctgctggaga

SEQ ID NO: 1472816 - DNA, 15 bp, Homo sapiens
cagctgctggagaat

SEQ ID NO: 1472817 - DNA, 13 bp, Homo sapiens
cagctgctggcca

SEQ ID NO: 1472818 - DNA, 14 bp, Homo sapiens
cagctgctggccag

SEQ ID NO: 1472819 - DNA, 11 bp, Homo sapiens
cagctgctggg

SEQ ID NO: 1472820 - DNA, 17 bp, Homo sapiens
cagctgctgggacccac

SEQ ID NO: 1472821 - DNA, 20 bp, Homo sapiens
cagctgctgggacccacctc

SEQ ID NO: 1472822 - DNA, 13 bp, Homo sapiens
cagctgctgtctt

SEQ ID NO: 1472823 - DNA, 14 bp, Homo sapiens
cagctgctgtcttc

SEQ ID NO: 1472824 - DNA, 14 bp, Homo sapiens
cagctgctgtgccc

SEQ ID NO: 1472825 - DNA, 17 bp, Homo sapiens
cagctgcttgtcctgct

SEQ ID NO: 1472826 - DNA, 11 bp, Homo sapiens
cagctgctttt

SEQ ID NO: 1472827 - DNA, 18 bp, Homo sapiens
cagctggagaaatatggt

SEQ ID NO: 1472828 - DNA, 16 bp, Homo sapiens
cagctggagaagaccc

SEQ ID NO: 1472829 - DNA, 21 bp, Homo sapiens
cagctggcccactgctggctg

SEQ ID NO: 1472830 - DNA, 23 bp, Homo sapiens
cagctggcccactgctggctgca

SEQ ID NO: 1472831 - DNA, 14 bp, Homo sapiens
cagctggcctggac

SEQ ID NO: 1472832 - DNA, 13 bp, Homo sapiens
cagctggctgggc

SEQ ID NO: 1472833 - DNA, 19 bp, Homo sapiens
cagctggctgggccttcac

SEQ ID NO: 1472834 - DNA, 18 bp, Homo sapiens
cagctgggacccctccca

SEQ ID NO: 1472835 - DNA, 23 bp, Homo sapiens
cagctgggacccctcccaacctc

SEQ ID NO: 1472836 - DNA, 12 bp, Homo sapiens
cagctgggaggc

SEQ ID NO: 1472837 - DNA, 14 bp, Homo sapiens
cagctgggaggcaa

SEQ ID NO: 1472838 - DNA, 22 bp, Homo sapiens
cagctgggaggcaagaggggtg

SEQ ID NO: 1472839 - DNA, 23 bp, Homo sapiens
cagctgggaggcaagaggggtgg

SEQ ID NO: 1472840 - DNA, 15 bp, Homo sapiens
cagctgggcagggtg

SEQ ID NO: 1472841 - DNA, 14 bp, Homo sapiens
cagctgggcatgcc

SEQ ID NO: 1472842 - DNA, 15 bp, Homo sapiens
cagctgggcatgcca

SEQ ID NO: 1472843 - DNA, 21 bp, Homo sapiens
cagctgggcatgccatgtctg

SEQ ID NO: 1472844 - DNA, 16 bp, Homo sapiens
cagctgggcccagcac

SEQ ID NO: 1472845 - DNA, 20 bp, Homo sapiens
cagctgggccccatgctctg

SEQ ID NO: 1472846 - DNA, 22 bp, Homo sapiens
cagctgggccccatgctctgcc

SEQ ID NO: 1472847 - DNA, 14 bp, Homo sapiens
cagctgggcctcct

SEQ ID NO: 1472848 - DNA, 19 bp, Homo sapiens
cagctgggcctcctgcctc

SEQ ID NO: 1472849 - DNA, 20 bp, Homo sapiens
cagctgggcctcctgcctcc

SEQ ID NO: 1472850 - DNA, 17 bp, Homo sapiens
cagctggggagcagctg

SEQ ID NO: 1472851 - DNA, 19 bp, Homo sapiens
cagctggtgcaaattcaga

SEQ ID NO: 1472852 - DNA, 23 bp, Homo sapiens
cagctggtgccaaatagccccag

SEQ ID NO: 1472853 - DNA, 17 bp, Homo sapiens
cagctggtgccccacct

SEQ ID NO: 1472854 - DNA, 18 bp, Homo sapiens
cagctggtgccccacctg

SEQ ID NO: 1472855 - DNA, 20 bp, Homo sapiens
cagctggtgccccacctgcc

SEQ ID NO: 1472856 - DNA, 20 bp, Homo sapiens
cagctggtgggaagcgtctg

SEQ ID NO: 1472857 - DNA, 22 bp, Homo sapiens
cagctggtgggaagcgtctgtc

SEQ ID NO: 1472858 - DNA, 20 bp, Homo sapiens
cagctgtaagaagagactgg

SEQ ID NO: 1472859 - DNA, 17 bp, Homo sapiens
cagctgtacttcgtctt

SEQ ID NO: 1472860 - DNA, 12 bp, Homo sapiens
cagctgtagcca

SEQ ID NO: 1472861 - DNA, 15 bp, Homo sapiens
cagctgtagccatgg

SEQ ID NO: 1472862 - DNA, 17 bp, Homo sapiens
cagctgtagccatggct

SEQ ID NO: 1472863 - DNA, 15 bp, Homo sapiens
cagctgtccctgtca

SEQ ID NO: 1472864 - DNA, 17 bp, Homo sapiens
cagctgtccctgtcacc

SEQ ID NO: 1472865 - DNA, 22 bp, Homo sapiens
cagctgtccctgtcaccaagct

SEQ ID NO: 1472866 - DNA, 20 bp, Homo sapiens
cagctgtcttcacatgtatg

SEQ ID NO: 1472867 - DNA, 15 bp, Homo sapiens
cagctgtgagaagtc

SEQ ID NO: 1472868 - DNA, 23 bp, Homo sapiens
cagctgtgctgcaccccatgtgg

SEQ ID NO: 1472869 - DNA, 12 bp, Homo sapiens
cagctgtggcag

SEQ ID NO: 1472870 - DNA, 16 bp, Homo sapiens
cagctgtggcagagtt

SEQ ID NO: 1472871 - DNA, 14 bp, Homo sapiens
cagctgtggctgga

SEQ ID NO: 1472872 - DNA, 15 bp, Homo sapiens
cagctgtggctggag

SEQ ID NO: 1472873 - DNA, 16 bp, Homo sapiens
cagctgtggctggagg

SEQ ID NO: 1472874 - DNA, 17 bp, Homo sapiens
cagctgtggctggagga

SEQ ID NO: 1472875 - DNA, 22 bp, Homo sapiens
cagctgtggctggaggagctgg

SEQ ID NO: 1472876 - DNA, 20 bp, Homo sapiens
cagctgtggggaacacagct

SEQ ID NO: 1472877 - DNA, 21 bp, Homo sapiens
cagctgtggggaacacagcta

SEQ ID NO: 1472878 - DNA, 22 bp, Homo sapiens
cagctgtggggaacacagctac

SEQ ID NO: 1472879 - DNA, 11 bp, Homo sapiens
cagctgtgtct

SEQ ID NO: 1472880 - DNA, 15 bp, Homo sapiens
cagctgtgtctgcca

SEQ ID NO: 1472881 - DNA, 21 bp, Homo sapiens
cagctgtgtctgccaaacaca

SEQ ID NO: 1472882 - DNA, 11 bp, Homo sapiens
cagctgtttct

SEQ ID NO: 1472883 - DNA, 14 bp, Homo sapiens
cagctgtttctcat

SEQ ID NO: 1472884 - DNA, 16 bp, Homo sapiens
cagcttaataagtatt

SEQ ID NO: 1472885 - DNA, 16 bp, Homo sapiens
cagcttagagttcttc

SEQ ID NO: 1472886 - DNA, 21 bp, Homo sapiens
cagcttatctcttttatattt

SEQ ID NO: 1472887 - DNA, 22 bp, Homo sapiens
caggatattagttaatgagcca

SEQ ID NO: 1472888 - DNA, 13 bp, Homo sapiens
caggatcactctc

SEQ ID NO: 1472889 - DNA, 18 bp, Homo sapiens
caggatcactctctgctg

SEQ ID NO: 1472890 - DNA, 22 bp, Homo sapiens
caggatcactctctgctggcag

SEQ ID NO: 1472891 - DNA, 14 bp, Homo sapiens
caggatccctcctg

SEQ ID NO: 1472892 - DNA, 16 bp, Homo sapiens
caggatccctcctgag

SEQ ID NO: 1472893 - DNA, 15 bp, Homo sapiens
caggatcctgcagga

SEQ ID NO: 1472894 - DNA, 17 bp, Homo sapiens
caggatcctgcaggaac

SEQ ID NO: 1472895 - DNA, 17 bp, Homo sapiens
caggatctcaagccagc

SEQ ID NO: 1472896 - DNA, 17 bp, Homo sapiens
caggatctgctccaaca

SEQ ID NO: 1472897 - DNA, 19 bp, Homo sapiens
caggatgaattttctgcag

SEQ ID NO: 1472898 - DNA, 21 bp, Homo sapiens
caggatgaattttctgcagct

SEQ ID NO: 1472899 - DNA, 23 bp, Homo sapiens
caggatgaattttctgcagctgt

SEQ ID NO: 1472900 - DNA, 16 bp, Homo sapiens
caggatgaggacagag

SEQ ID NO: 1472901 - DNA, 20 bp, Homo sapiens
caggatgcacatttctggat

SEQ ID NO: 1472902 - DNA, 13 bp, Homo sapiens
caggatgccacgc

SEQ ID NO: 1472903 - DNA, 21 bp, Homo sapiens
caggatgccacgcctggaagg

SEQ ID NO: 1472904 - DNA, 17 bp, Homo sapiens
caggatgcccagatgaa

SEQ ID NO: 1472905 - DNA, 19 bp, Homo sapiens
caggatgcccagggccact

SEQ ID NO: 1472906 - DNA, 15 bp, Homo sapiens
caggatggaggggtg

SEQ ID NO: 1472907 - DNA, 20 bp, Homo sapiens
caggatggggttctggaaat

SEQ ID NO: 1472908 - DNA, 18 bp, Homo sapiens
caggatggtctccatctc

SEQ ID NO: 1472909 - DNA, 21 bp, Homo sapiens
caggatggtctcgatctcctg

SEQ ID NO: 1472910 - DNA, 22 bp, Homo sapiens
caggatggtctcgatctcctga

SEQ ID NO: 1472911 - DNA, 19 bp, Homo sapiens
caggatggtgggcaggatc

SEQ ID NO: 1472912 - DNA, 15 bp, Homo sapiens
caggattcccccagc

SEQ ID NO: 1472913 - DNA, 17 bp, Homo sapiens
caggattcccccagcca

SEQ ID NO: 1472914 - DNA, 17 bp, Homo sapiens
caggattcccttctggg

SEQ ID NO: 1472915 - DNA, 18 bp, Homo sapiens
caggatttaaaaactgga

SEQ ID NO: 1472916 - DNA, 16 bp, Homo sapiens
caggatttaggcctta

SEQ ID NO: 1472917 - DNA, 19 bp, Homo sapiens
caggatttaggccttaaca

SEQ ID NO: 1472918 - DNA, 22 bp, Homo sapiens
caggattttaacaaaagcaaga

SEQ ID NO: 1472919 - DNA, 17 bp, Homo sapiens
caggcaaaacacgcaag

SEQ ID NO: 1472920 - DNA, 20 bp, Homo sapiens
caggcaaaacacgcaagggc

SEQ ID NO: 1472921 - DNA, 22 bp, Homo sapiens
caggcaaaacaggaagggggaa

SEQ ID NO: 1472922 - DNA, 22 bp, Homo sapiens
caggcaaagttttacagagagg

SEQ ID NO: 1472923 - DNA, 12 bp, Homo sapiens
caggcaaattca

SEQ ID NO: 1472924 - DNA, 17 bp, Homo sapiens
caggcaaattggggagg

SEQ ID NO: 1472925 - DNA, 13 bp, Homo sapiens
caggcaacctccc

SEQ ID NO: 1472926 - DNA, 17 bp, Homo sapiens
caggcaacctcccatcc

SEQ ID NO: 1472927 - DNA, 20 bp, Homo sapiens
caggcaacctcccatcccac

SEQ ID NO: 1472928 - DNA, 14 bp, Homo sapiens
caggcaagcagctg

SEQ ID NO: 1472929 - DNA, 13 bp, Homo sapiens
caggcaagcccct

SEQ ID NO: 1472930 - DNA, 16 bp, Homo sapiens
caggcaagcccctcag

SEQ ID NO: 1472931 - DNA, 22 bp, Homo sapiens
caggcaagcccctcagcccttg

SEQ ID NO: 1472932 - DNA, 18 bp, Homo sapiens
caggcaaggttggcgact

SEQ ID NO: 1472933 - DNA, 20 bp, Homo sapiens
caggcacacagctactctcc

SEQ ID NO: 1472934 - DNA, 16 bp, Homo sapiens
caggcacagcagctgc

SEQ ID NO: 1472935 - DNA, 12 bp, Homo sapiens
caggcacagggc

SEQ ID NO: 1472936 - DNA, 17 bp, Homo sapiens
caggcacagggcccgca

SEQ ID NO: 1472937 - DNA, 20 bp, Homo sapiens
caggcacatacacctcgtca

SEQ ID NO: 1472938 - DNA, 21 bp, Homo sapiens
caggcaccgccacgtcccagc

SEQ ID NO: 1472939 - DNA, 23 bp, Homo sapiens
caggcaccgccacgtcccagcat

SEQ ID NO: 1472940 - DNA, 21 bp, Homo sapiens
caggcacctggcctgctggga

SEQ ID NO: 1472941 - DNA, 19 bp, Homo sapiens
caggcacgaacccacctgc

SEQ ID NO: 1472942 - DNA, 22 bp, Homo sapiens
caggcacgaacccacctgctga

SEQ ID NO: 1472943 - DNA, 16 bp, Homo sapiens
caggcacgggtggtcc

SEQ ID NO: 1472944 - DNA, 12 bp, Homo sapiens
caggcactccaa

SEQ ID NO: 1472945 - DNA, 14 bp, Homo sapiens
caggcactggtggc

SEQ ID NO: 1472946 - DNA, 18 bp, Homo sapiens
caggcagacaagagctgc

SEQ ID NO: 1472947 - DNA, 20 bp, Homo sapiens
caggcagacaagagctgctg

SEQ ID NO: 1472948 - DNA, 21 bp, Homo sapiens
caggcagacaagagctgctgt

SEQ ID NO: 1472949 - DNA, 17 bp, Homo sapiens
caggcagaggttttaat

SEQ ID NO: 1472950 - DNA, 18 bp, Homo sapiens
caggcagatccaggacta

SEQ ID NO: 1472951 - DNA, 15 bp, Homo sapiens
caggcagatctgtgc

SEQ ID NO: 1472952 - DNA, 21 bp, Homo sapiens
caggcagatctgtgccccatg

SEQ ID NO: 1472953 - DNA, 12 bp, Homo sapiens
caggcagcagtg

SEQ ID NO: 1472954 - DNA, 14 bp, Homo sapiens
caggcagcctcctt

SEQ ID NO: 1472955 - DNA, 17 bp, Homo sapiens
caggcagcctctgtcag

SEQ ID NO: 1472956 - DNA, 18 bp, Homo sapiens
caggcagctccctcctgc

SEQ ID NO: 1472957 - DNA, 19 bp, Homo sapiens
caggcaggaagggcaggaa

SEQ ID NO: 1472958 - DNA, 15 bp, Homo sapiens
caggcaggccaggct

SEQ ID NO: 1472959 - DNA, 18 bp, Homo sapiens
caggcaggccaggctgcc

SEQ ID NO: 1472960 - DNA, 16 bp, Homo sapiens
caggcaggcgggggct

SEQ ID NO: 1472961 - DNA, 12 bp, Homo sapiens
caggcagggaga

SEQ ID NO: 1472962 - DNA, 16 bp, Homo sapiens
caggcagggctgggcc

SEQ ID NO: 1472963 - DNA, 17 bp, Homo sapiens
caggcaggggtgggggt

SEQ ID NO: 1472964 - DNA, 22 bp, Homo sapiens
caggcaggggtgggggtggagg

SEQ ID NO: 1472965 - DNA, 23 bp, Homo sapiens
caggcaggggtgggggtggaggc

SEQ ID NO: 1472966 - DNA, 17 bp, Homo sapiens
caggcaggtctgcaagg

SEQ ID NO: 1472967 - DNA, 23 bp, Homo sapiens
caggcaggtctgcaagggcccag

SEQ ID NO: 1472968 - DNA, 21 bp, Homo sapiens
caggcaggtggactgactgtg

SEQ ID NO: 1472969 - DNA, 14 bp, Homo sapiens
caggcaggtttgcc

SEQ ID NO: 1472970 - DNA, 18 bp, Homo sapiens
caggcagtcgggggctgg

SEQ ID NO: 1472971 - DNA, 15 bp, Homo sapiens
caggcagtgcatgtg

SEQ ID NO: 1472972 - DNA, 23 bp, Homo sapiens
caggcagtgcatgtgaagcatgc

SEQ ID NO: 1472973 - DNA, 23 bp, Homo sapiens
caggcataagctatcacctagca

SEQ ID NO: 1472974 - DNA, 17 bp, Homo sapiens
caggcatagaggcttct

SEQ ID NO: 1472975 - DNA, 18 bp, Homo sapiens
caggcatagaggcttctc

SEQ ID NO: 1472976 - DNA, 14 bp, Homo sapiens
caggcataggcctg

SEQ ID NO: 1472977 - DNA, 16 bp, Homo sapiens
caggcataggcctggg

SEQ ID NO: 1472978 - DNA, 12 bp, Homo sapiens
caggcatcctcc

SEQ ID NO: 1472979 - DNA, 18 bp, Homo sapiens
caggcatgaatcactgtg

SEQ ID NO: 1472980 - DNA, 23 bp, Homo sapiens
caggcatgaatcactgtgctcag

SEQ ID NO: 1472981 - DNA, 22 bp, Homo sapiens
caggccaaagagtctccagttt

SEQ ID NO: 1472982 - DNA, 16 bp, Homo sapiens
caggccaacagtagcc

SEQ ID NO: 1472983 - DNA, 18 bp, Homo sapiens
caggccaccccgctgatg

SEQ ID NO: 1472984 - DNA, 12 bp, Homo sapiens
caggccacctcc

SEQ ID NO: 1472985 - DNA, 15 bp, Homo sapiens
caggccacctcccca

SEQ ID NO: 1472986 - DNA, 16 bp, Homo sapiens
caggccacctccccag

SEQ ID NO: 1472987 - DNA, 13 bp, Homo sapiens
caggccactgtgg

SEQ ID NO: 1472988 - DNA, 14 bp, Homo sapiens
caggccactgtggc

SEQ ID NO: 1472989 - DNA, 17 bp, Homo sapiens
caggccactgtggccag

SEQ ID NO: 1472990 - DNA, 18 bp, Homo sapiens
caggccactgtggccaga

SEQ ID NO: 1472991 - DNA, 20 bp, Homo sapiens
caggccactgtggccagagc

SEQ ID NO: 1472992 - DNA, 23 bp, Homo sapiens
caggccactgtggccagagctgg

SEQ ID NO: 1472993 - DNA, 23 bp, Homo sapiens
caggccagaataattggcatgtc

SEQ ID NO: 1472994 - DNA, 20 bp, Homo sapiens
caggccagagggcagtggcc

SEQ ID NO: 1472995 - DNA, 16 bp, Homo sapiens
caggccagagtgcagt

SEQ ID NO: 1472996 - DNA, 12 bp, Homo sapiens
caggccagccca

SEQ ID NO: 1472997 - DNA, 19 bp, Homo sapiens
caggccagcccagccaggc

SEQ ID NO: 1472998 - DNA, 20 bp, Homo sapiens
caggccagcccagccaggcc

SEQ ID NO: 1472999 - DNA, 19 bp, Homo sapiens
caggccagcctccgagagg

SEQ ID NO: 1473000 - DNA, 21 bp, Homo sapiens
caggccagcctccgagaggga

SEQ ID NO: 1473001 - DNA, 18 bp, Homo sapiens
cagggcatcttgctggct

SEQ ID NO: 1473002 - DNA, 20 bp, Homo sapiens
cagggcatcttgctggctac

SEQ ID NO: 1473003 - DNA, 15 bp, Homo sapiens
cagggcatgccacgt

SEQ ID NO: 1473004 - DNA, 17 bp, Homo sapiens
cagggcatggctgggaa

SEQ ID NO: 1473005 - DNA, 17 bp, Homo sapiens
cagggccaaagcacagc

SEQ ID NO: 1473006 - DNA, 21 bp, Homo sapiens
cagggccaaagcacagctggg

SEQ ID NO: 1473007 - DNA, 16 bp, Homo sapiens
cagggccacgctccag

SEQ ID NO: 1473008 - DNA, 17 bp, Homo sapiens
cagggccacgctccagc

SEQ ID NO: 1473009 - DNA, 22 bp, Homo sapiens
cagggccacgctccagctgccc

SEQ ID NO: 1473010 - DNA, 19 bp, Homo sapiens
cagggccactcccggcact

SEQ ID NO: 1473011 - DNA, 16 bp, Homo sapiens
cagggccactctgcct

SEQ ID NO: 1473012 - DNA, 17 bp, Homo sapiens
cagggccactctgcctc

SEQ ID NO: 1473013 - DNA, 20 bp, Homo sapiens
cagggccagaaggagggcag

SEQ ID NO: 1473014 - DNA, 21 bp, Homo sapiens
cagggccagaaggagggcaga

SEQ ID NO: 1473015 - DNA, 16 bp, Homo sapiens
cagggccagactggaa

SEQ ID NO: 1473016 - DNA, 17 bp, Homo sapiens
cagggccagactggaag

SEQ ID NO: 1473017 - DNA, 23 bp, Homo sapiens
cagggccaggtgcagaccttggg

SEQ ID NO: 1473018 - DNA, 14 bp, Homo sapiens
cagggccagtggga

SEQ ID NO: 1473019 - DNA, 18 bp, Homo sapiens
cagggccatccactgtga

SEQ ID NO: 1473020 - DNA, 17 bp, Homo sapiens
cagggccatgcagacct

SEQ ID NO: 1473021 - DNA, 17 bp, Homo sapiens
cagggccatgcctgccc

SEQ ID NO: 1473022 - DNA, 16 bp, Homo sapiens
cagggccatgctgagg

SEQ ID NO: 1473023 - DNA, 17 bp, Homo sapiens
cagggccatggctcagg

SEQ ID NO: 1473024 - DNA, 21 bp, Homo sapiens
cagggcccacccccaggaagg

SEQ ID NO: 1473025 - DNA, 19 bp, Homo sapiens
cagggcccagagcccagct

SEQ ID NO: 1473026 - DNA, 14 bp, Homo sapiens
cagggccccagcac

SEQ ID NO: 1473027 - DNA, 15 bp, Homo sapiens
cagggccccagcact

SEQ ID NO: 1473028 - DNA, 16 bp, Homo sapiens
cagggcccccacaggc

SEQ ID NO: 1473029 - DNA, 17 bp, Homo sapiens
cagggccccccaactgt

SEQ ID NO: 1473030 - DNA, 20 bp, Homo sapiens
cagggcccctccctctgccc

SEQ ID NO: 1473031 - DNA, 20 bp, Homo sapiens
cagggcccgcagtgctggga

SEQ ID NO: 1473032 - DNA, 15 bp, Homo sapiens
cagggcccggccaca

SEQ ID NO: 1473033 - DNA, 22 bp, Homo sapiens
cagggcccggccacacccagcg

SEQ ID NO: 1473034 - DNA, 20 bp, Homo sapiens
cagggccctaggcccctcct

SEQ ID NO: 1473035 - DNA, 12 bp, Homo sapiens
cagggccctccc

SEQ ID NO: 1473036 - DNA, 13 bp, Homo sapiens
cagggccctgcag

SEQ ID NO: 1473037 - DNA, 14 bp, Homo sapiens
cagggccctgcaga

SEQ ID NO: 1473038 - DNA, 18 bp, Homo sapiens
cagggccctgcagagggg

SEQ ID NO: 1473039 - DNA, 19 bp, Homo sapiens
cagggccgcccgggcccag

SEQ ID NO: 1473040 - DNA, 21 bp, Homo sapiens
cagggccgcccgggcccagag

SEQ ID NO: 1473041 - DNA, 22 bp, Homo sapiens
cagggccgcccgggcccagagg

SEQ ID NO: 1473042 - DNA, 12 bp, Homo sapiens
cagggccgcggc

SEQ ID NO: 1473043 - DNA, 13 bp, Homo sapiens
cagggcctccagg

SEQ ID NO: 1473044 - DNA, 16 bp, Homo sapiens
cagggcctgagcagct

SEQ ID NO: 1473045 - DNA, 14 bp, Homo sapiens
cagggcctggagcc

SEQ ID NO: 1473046 - DNA, 17 bp, Homo sapiens
cagggcctgggcctcat

SEQ ID NO: 1473047 - DNA, 21 bp, Homo sapiens
cagggcctgggggcagtgact

SEQ ID NO: 1473048 - DNA, 13 bp, Homo sapiens
cagggccttgccc

SEQ ID NO: 1473049 - DNA, 14 bp, Homo sapiens
cagggccttgccca

SEQ ID NO: 1473050 - DNA, 19 bp, Homo sapiens
cagggccttgcccagagat

SEQ ID NO: 1473051 - DNA, 24 bp, Homo sapiens
cagggccttgcccagagatgcctc

SEQ ID NO: 1473052 - DNA, 22 bp, Homo sapiens
cagggcgctcagacggcggcca

SEQ ID NO: 1473053 - DNA, 20 bp, Homo sapiens
cagggcgggcagagggctgg

SEQ ID NO: 1473054 - DNA, 21 bp, Homo sapiens
cagggcgggcagagggctgga

SEQ ID NO: 1473055 - DNA, 22 bp, Homo sapiens
cagggcgggcagagggctggag

SEQ ID NO: 1473056 - DNA, 23 bp, Homo sapiens
cagggcggtaccttgtgcccagg

SEQ ID NO: 1473057 - DNA, 17 bp, Homo sapiens
cagggctaagagctagc

SEQ ID NO: 1473058 - DNA, 15 bp, Homo sapiens
cagggctcagcctgg

SEQ ID NO: 1473059 - DNA, 16 bp, Homo sapiens
cagggctcagcctggt

SEQ ID NO: 1473060 - DNA, 13 bp, Homo sapiens
cagggctccagcc

SEQ ID NO: 1473061 - DNA, 22 bp, Homo sapiens
cagggctccagcccctcttgga

SEQ ID NO: 1473062 - DNA, 14 bp, Homo sapiens
cagggctcccaggg

SEQ ID NO: 1473063 - DNA, 23 bp, Homo sapiens
cagggctcctgtggcagctgccc

SEQ ID NO: 1473064 - DNA, 18 bp, Homo sapiens
cagggctctgcaggccac

SEQ ID NO: 1473065 - DNA, 15 bp, Homo sapiens
cagggctggactgag

SEQ ID NO: 1473066 - DNA, 16 bp, Homo sapiens
cagggctggactgagg

SEQ ID NO: 1473067 - DNA, 18 bp, Homo sapiens
cagggctggactgaggcc

SEQ ID NO: 1473068 - DNA, 22 bp, Homo sapiens
cagggctggactgaggcctgag

SEQ ID NO: 1473069 - DNA, 23 bp, Homo sapiens
cagggctggactgaggcctgagc

SEQ ID NO: 1473070 - DNA, 13 bp, Homo sapiens
cagggctggctcc

SEQ ID NO: 1473071 - DNA, 17 bp, Homo sapiens
cagggctggctcctctg

SEQ ID NO: 1473072 - DNA, 18 bp, Homo sapiens
cagggctggctcctctgc

SEQ ID NO: 1473073 - DNA, 10 bp, Homo sapiens
cagggctggg

SEQ ID NO: 1473074 - DNA, 16 bp, Homo sapiens
cagggctgggaggaag

SEQ ID NO: 1473075 - DNA, 11 bp, Homo sapiens
cagggctgggg

SEQ ID NO: 1473076 - DNA, 12 bp, Homo sapiens
cagggctgggga

SEQ ID NO: 1473077 - DNA, 13 bp, Homo sapiens
cagggctgtgctt

SEQ ID NO: 1473078 - DNA, 14 bp, Homo sapiens
cagggctgtgcttg

SEQ ID NO: 1473079 - DNA, 18 bp, Homo sapiens
cagggcttacctgtacac

SEQ ID NO: 1473080 - DNA, 19 bp, Homo sapiens
cagggcttacctgtacact

SEQ ID NO: 1473081 - DNA, 21 bp, Homo sapiens
cagggcttacctgtacactga

SEQ ID NO: 1473082 - DNA, 23 bp, Homo sapiens
cagggcttacctgtacactgact

SEQ ID NO: 1473083 - DNA, 15 bp, Homo sapiens
cagggctttaaaatt

SEQ ID NO: 1473084 - DNA, 22 bp, Homo sapiens
cagggctttactccgtaacaga

SEQ ID NO: 1473085 - DNA, 14 bp, Homo sapiens
caggggaaaatgaa

SEQ ID NO: 1473086 - DNA, 17 bp, Homo sapiens
caggggaattccctccc

SEQ ID NO: 1473087 - DNA, 16 bp, Homo sapiens
caggggacaggagtcc

SEQ ID NO: 1473088 - DNA, 22 bp, Homo sapiens
caggggacaggagtccactttg

SEQ ID NO: 1473089 - DNA, 20 bp, Homo sapiens
caggggactcagccctgagg

SEQ ID NO: 1473090 - DNA, 20 bp, Homo sapiens
caggggagagggtctggaga

SEQ ID NO: 1473091 - DNA, 13 bp, Homo sapiens
caggggagccagc

SEQ ID NO: 1473092 - DNA, 14 bp, Homo sapiens
caggggagccagct

SEQ ID NO: 1473093 - DNA, 15 bp, Homo sapiens
caggggcagcaaggc

SEQ ID NO: 1473094 - DNA, 15 bp, Homo sapiens
caggggcagccacac

SEQ ID NO: 1473095 - DNA, 11 bp, Homo sapiens
caggggcagga

SEQ ID NO: 1473096 - DNA, 14 bp, Homo sapiens
caggggcaggcctg

SEQ ID NO: 1473097 - DNA, 17 bp, Homo sapiens
caggggccccagatctg

SEQ ID NO: 1473098 - DNA, 23 bp, Homo sapiens
caggggccccagatctgcctggg

SEQ ID NO: 1473099 - DNA, 22 bp, Homo sapiens
caggggcctgcagaaggaaaga

SEQ ID NO: 1473100 - DNA, 22 bp, Homo sapiens
caggggcctggagatcctcctg

SEQ ID NO: 1473101 - DNA, 18 bp, Homo sapiens
caggggcctggaggtctg

SEQ ID NO: 1473102 - DNA, 22 bp, Homo sapiens
caggggcctggaggtctggctg

SEQ ID NO: 1473103 - DNA, 24 bp, Homo sapiens
caggggcctggaggtctggctgag

SEQ ID NO: 1473104 - DNA, 18 bp, Homo sapiens
caggggcggggcaggaat

SEQ ID NO: 1473105 - DNA, 19 bp, Homo sapiens
caggggctctgcttcctca

SEQ ID NO: 1473106 - DNA, 13 bp, Homo sapiens
caggggctgcttc

SEQ ID NO: 1473107 - DNA, 17 bp, Homo sapiens
caggggcttgagaaggt

SEQ ID NO: 1473108 - DNA, 16 bp, Homo sapiens
cagggggagaatgggt

SEQ ID NO: 1473109 - DNA, 22 bp, Homo sapiens
cagggggatgccactcctccct

SEQ ID NO: 1473110 - DNA, 12 bp, Homo sapiens
cagggggccccg

SEQ ID NO: 1473111 - DNA, 11 bp, Homo sapiens
cagggggccct

SEQ ID NO: 1473112 - DNA, 19 bp, Homo sapiens
cagggggcctggagcatgg

SEQ ID NO: 1473113 - DNA, 19 bp, Homo sapiens
caggggggtgaggagctgg

SEQ ID NO: 1473114 - DNA, 21 bp, Homo sapiens
caggggtcaggtgtcaggccc

SEQ ID NO: 1473115 - DNA, 15 bp, Homo sapiens
cagtagctgaacctg

SEQ ID NO: 1473116 - DNA, 17 bp, Homo sapiens
cagtaggataagccact

SEQ ID NO: 1473117 - DNA, 18 bp, Homo sapiens
cagtaggtccaagggcca

SEQ ID NO: 1473118 - DNA, 20 bp, Homo sapiens
cagtaggtcccggccagctc

SEQ ID NO: 1473119 - DNA, 22 bp, Homo sapiens
cagtagtagcctccaggtttcc

SEQ ID NO: 1473120 - DNA, 19 bp, Homo sapiens
cagtagtagtatggcactt

SEQ ID NO: 1473121 - DNA, 15 bp, Homo sapiens
cagtagtttgcattt

SEQ ID NO: 1473122 - DNA, 16 bp, Homo sapiens
cagtagttttcaaaac

SEQ ID NO: 1473123 - DNA, 21 bp, Homo sapiens
cagtagttttgacacttccca

SEQ ID NO: 1473124 - DNA, 20 bp, Homo sapiens
cagtataaccagctgaagtt

SEQ ID NO: 1473125 - DNA, 14 bp, Homo sapiens
cagtataattctgt

SEQ ID NO: 1473126 - DNA, 17 bp, Homo sapiens
cagtatactgtgtggga

SEQ ID NO: 1473127 - DNA, 14 bp, Homo sapiens
cagtatattagtat

SEQ ID NO: 1473128 - DNA, 13 bp, Homo sapiens
cagtatatttata

SEQ ID NO: 1473129 - DNA, 14 bp, Homo sapiens
cagtatatttatag

SEQ ID NO: 1473130 - DNA, 15 bp, Homo sapiens
cagtatatttatagt

SEQ ID NO: 1473131 - DNA, 15 bp, Homo sapiens
cagtatcccacatcc

SEQ ID NO: 1473132 - DNA, 20 bp, Homo sapiens
cagtatctatatatgtgtat

SEQ ID NO: 1473133 - DNA, 22 bp, Homo sapiens
cagtatctatatatgtgtatgt

SEQ ID NO: 1473134 - DNA, 23 bp, Homo sapiens
cagtatctatatatgtgtatgta

SEQ ID NO: 1473135 - DNA, 14 bp, Homo sapiens
cagtatctcttcag

SEQ ID NO: 1473136 - DNA, 16 bp, Homo sapiens
cagtatctcttcagtc

SEQ ID NO: 1473137 - DNA, 19 bp, Homo sapiens
cagtatctcttcagtctct

SEQ ID NO: 1473138 - DNA, 13 bp, Homo sapiens
cagtatgaactat

SEQ ID NO: 1473139 - DNA, 12 bp, Homo sapiens
cagtatgtggaa

SEQ ID NO: 1473140 - DNA, 21 bp, Homo sapiens
cagtatgttccaaaccctcct

SEQ ID NO: 1473141 - DNA, 19 bp, Homo sapiens
cagtattaaaggggggagg

SEQ ID NO: 1473142 - DNA, 19 bp, Homo sapiens
cagtattatagacaaaaga

SEQ ID NO: 1473143 - DNA, 12 bp, Homo sapiens
cagtattatgta

SEQ ID NO: 1473144 - DNA, 15 bp, Homo sapiens
cagtattctgacatg

SEQ ID NO: 1473145 - DNA, 17 bp, Homo sapiens
cagtattgccccctctc

SEQ ID NO: 1473146 - DNA, 23 bp, Homo sapiens
cagtatttgtaattaaaagcaaa

SEQ ID NO: 1473147 - DNA, 15 bp, Homo sapiens
cagtatttgtgggga

SEQ ID NO: 1473148 - DNA, 20 bp, Homo sapiens
cagtattttaaatgaagtga

SEQ ID NO: 1473149 - DNA, 17 bp, Homo sapiens
cagtattttgtgtcctc

SEQ ID NO: 1473150 - DNA, 13 bp, Homo sapiens
cagtatttttaaa

SEQ ID NO: 1473151 - DNA, 13 bp, Homo sapiens
cagtatttttata

SEQ ID NO: 1473152 - DNA, 14 bp, Homo sapiens
cagtatttttatac

SEQ ID NO: 1473153 - DNA, 15 bp, Homo sapiens
cagtcaaatctgggc

SEQ ID NO: 1473154 - DNA, 15 bp, Homo sapiens
cagtcaacagttcaa

SEQ ID NO: 1473155 - DNA, 23 bp, Homo sapiens
cagtcaacagttcaaagaagtca

SEQ ID NO: 1473156 - DNA, 13 bp, Homo sapiens
cagtcacactgtt

SEQ ID NO: 1473157 - DNA, 18 bp, Homo sapiens
cagtcacactgttactcc

SEQ ID NO: 1473158 - DNA, 20 bp, Homo sapiens
cagtcacactgttactccac

SEQ ID NO: 1473159 - DNA, 12 bp, Homo sapiens
cagtcacattga

SEQ ID NO: 1473160 - DNA, 21 bp, Homo sapiens
cagtcactccctctgccttca

SEQ ID NO: 1473161 - DNA, 14 bp, Homo sapiens
cagtcactgctgca

SEQ ID NO: 1473162 - DNA, 20 bp, Homo sapiens
cagtcactgctgcaaggtgg

SEQ ID NO: 1473163 - DNA, 18 bp, Homo sapiens
cagtcagaaggacggcag

SEQ ID NO: 1473164 - DNA, 17 bp, Homo sapiens
cagtcagggacagcagc

SEQ ID NO: 1473165 - DNA, 19 bp, Homo sapiens
cagtcagggacagcagcct

SEQ ID NO: 1473166 - DNA, 22 bp, Homo sapiens
cagtcaggggtcaggtgtcagg

SEQ ID NO: 1473167 - DNA, 16 bp, Homo sapiens
cagtcagtaattgcca

SEQ ID NO: 1473168 - DNA, 15 bp, Homo sapiens
cagtcagtggagcct

SEQ ID NO: 1473169 - DNA, 22 bp, Homo sapiens
cagtcagttcccggagcacagc

SEQ ID NO: 1473170 - DNA, 12 bp, Homo sapiens
cagtcatctccc

SEQ ID NO: 1473171 - DNA, 15 bp, Homo sapiens
cagtcatctcccctc

SEQ ID NO: 1473172 - DNA, 19 bp, Homo sapiens
cagtcatctcccctcctgg

SEQ ID NO: 1473173 - DNA, 16 bp, Homo sapiens
cagtcatctgtaagag

SEQ ID NO: 1473174 - DNA, 14 bp, Homo sapiens
cagtcattctagga

SEQ ID NO: 1473175 - DNA, 18 bp, Homo sapiens
cagtcattctaggatgtg

SEQ ID NO: 1473176 - DNA, 14 bp, Homo sapiens
cagtccaaaatact

SEQ ID NO: 1473177 - DNA, 17 bp, Homo sapiens
cagtccaaatgtcctcc

SEQ ID NO: 1473178 - DNA, 22 bp, Homo sapiens
cagtccaaatgtcctccagaag

SEQ ID NO: 1473179 - DNA, 14 bp, Homo sapiens
cagtccaaccagaa

SEQ ID NO: 1473180 - DNA, 15 bp, Homo sapiens
cagtccacaggggcc

SEQ ID NO: 1473181 - DNA, 20 bp, Homo sapiens
cagtccacaggggccaccac

SEQ ID NO: 1473182 - DNA, 21 bp, Homo sapiens
cagtccacaggggccaccacc

SEQ ID NO: 1473183 - DNA, 15 bp, Homo sapiens
cagtccagccagctc

SEQ ID NO: 1473184 - DNA, 14 bp, Homo sapiens
cagtccatgctcca

SEQ ID NO: 1473185 - DNA, 22 bp, Homo sapiens
cagtcccacaccgctggtccct

SEQ ID NO: 1473186 - DNA, 22 bp, Homo sapiens
cagtcccagggaaggtggggcc

SEQ ID NO: 1473187 - DNA, 19 bp, Homo sapiens
cagtcccatcagagagcga

SEQ ID NO: 1473188 - DNA, 13 bp, Homo sapiens
cagtccccacccc

SEQ ID NO: 1473189 - DNA, 14 bp, Homo sapiens
cagtccccacccct

SEQ ID NO: 1473190 - DNA, 14 bp, Homo sapiens
cagtccccacccgc

SEQ ID NO: 1473191 - DNA, 12 bp, Homo sapiens
cagtccccgagg

SEQ ID NO: 1473192 - DNA, 11 bp, Homo sapiens
cagtccccgct

SEQ ID NO: 1473193 - DNA, 14 bp, Homo sapiens
cagtccccgctagt

SEQ ID NO: 1473194 - DNA, 13 bp, Homo sapiens
cagtcccctccca

SEQ ID NO: 1473195 - DNA, 13 bp, Homo sapiens
cagtcccctctct

SEQ ID NO: 1473196 - DNA, 14 bp, Homo sapiens
cagtcccctctctc

SEQ ID NO: 1473197 - DNA, 16 bp, Homo sapiens
cagtcccctctctctg

SEQ ID NO: 1473198 - DNA, 15 bp, Homo sapiens
cagtccctatgtatt

SEQ ID NO: 1473199 - DNA, 20 bp, Homo sapiens
cagtccctgggggaagccct

SEQ ID NO: 1473200 - DNA, 22 bp, Homo sapiens
cagtccctgggggaagccctgg

SEQ ID NO: 1473201 - DNA, 15 bp, Homo sapiens
cagtccgcctggccg

SEQ ID NO: 1473202 - DNA, 18 bp, Homo sapiens
cagtccgcctggccggct

SEQ ID NO: 1473203 - DNA, 21 bp, Homo sapiens
cagtccgcctggccggctcca

SEQ ID NO: 1473204 - DNA, 15 bp, Homo sapiens
cagtcctatttttca

SEQ ID NO: 1473205 - DNA, 23 bp, Homo sapiens
cagtcctcccaccttggcctccc

SEQ ID NO: 1473206 - DNA, 17 bp, Homo sapiens
cagtcctgcctcagcct

SEQ ID NO: 1473207 - DNA, 14 bp, Homo sapiens
cagtcctgcctggc

SEQ ID NO: 1473208 - DNA, 17 bp, Homo sapiens
cagtcctgcctggccag

SEQ ID NO: 1473209 - DNA, 14 bp, Homo sapiens
cagtcctggaggca

SEQ ID NO: 1473210 - DNA, 19 bp, Homo sapiens
cagtcctggtcctggctgc

SEQ ID NO: 1473211 - DNA, 22 bp, Homo sapiens
cagtcctggtggggctgagcct

SEQ ID NO: 1473212 - DNA, 15 bp, Homo sapiens
cagtccttaaaaatc

SEQ ID NO: 1473213 - DNA, 16 bp, Homo sapiens
cagtccttaaaaatca

SEQ ID NO: 1473214 - DNA, 16 bp, Homo sapiens
cagtcctttcccacca

SEQ ID NO: 1473215 - DNA, 22 bp, Homo sapiens
cagtcctttcccaccattcctg

SEQ ID NO: 1473216 - DNA, 20 bp, Homo sapiens
cagtcctttgtaaacagtgt

SEQ ID NO: 1473217 - DNA, 14 bp, Homo sapiens
cagtcggcatgcca

SEQ ID NO: 1473218 - DNA, 16 bp, Homo sapiens
cagtcggcatgccagg

SEQ ID NO: 1473219 - DNA, 14 bp, Homo sapiens
cagtcgggggctgg

SEQ ID NO: 1473220 - DNA, 16 bp, Homo sapiens
cagtcgggggctggcc

SEQ ID NO: 1473221 - DNA, 19 bp, Homo sapiens
cagtcgggggctggcctag

SEQ ID NO: 1473222 - DNA, 14 bp, Homo sapiens
cagtcgtgcctgtg

SEQ ID NO: 1473223 - DNA, 21 bp, Homo sapiens
cagtctacattgagcatttga

SEQ ID NO: 1473224 - DNA, 14 bp, Homo sapiens
cagtctagttcctg

SEQ ID NO: 1473225 - DNA, 13 bp, Homo sapiens
cagtctatttcca

SEQ ID NO: 1473226 - DNA, 23 bp, Homo sapiens
cagtctatttccactgaacaaaa

SEQ ID NO: 1473227 - DNA, 18 bp, Homo sapiens
cagtctatttccattctt

SEQ ID NO: 1473228 - DNA, 15 bp, Homo sapiens
cagtctcacagagaa

SEQ ID NO: 1473229 - DNA, 12 bp, Homo sapiens
cagtctcagaga

SEQ ID NO: 1473230 - DNA, 17 bp, Homo sapiens
cagtctcagagaccagc

SEQ ID NO: 1473231 - DNA, 13 bp, Homo sapiens
cagttaatttttc

SEQ ID NO: 1473232 - DNA, 16 bp, Homo sapiens
cagttaatttttccaa

SEQ ID NO: 1473233 - DNA, 22 bp, Homo sapiens
cagttaccaaacattacaaaaa

SEQ ID NO: 1473234 - DNA, 21 bp, Homo sapiens
cagttaccttaaagctgaatt

SEQ ID NO: 1473235 - DNA, 19 bp, Homo sapiens
cagttactaagaagaaaat

SEQ ID NO: 1473236 - DNA, 15 bp, Homo sapiens
cagttactcagccct

SEQ ID NO: 1473237 - DNA, 15 bp, Homo sapiens
cagttactctgaagg

SEQ ID NO: 1473238 - DNA, 20 bp, Homo sapiens
cagttacttatgatttaaaa

SEQ ID NO: 1473239 - DNA, 21 bp, Homo sapiens
cagttataagtagcaggccaa

SEQ ID NO: 1473240 - DNA, 22 bp, Homo sapiens
cagttatatttttgtgttttct

SEQ ID NO: 1473241 - DNA, 13 bp, Homo sapiens
cagttatggctat

SEQ ID NO: 1473242 - DNA, 19 bp, Homo sapiens
cagttatggctataggtgc

SEQ ID NO: 1473243 - DNA, 14 bp, Homo sapiens
cagttatgtagttt

SEQ ID NO: 1473244 - DNA, 16 bp, Homo sapiens
cagttatgttcagtca

SEQ ID NO: 1473245 - DNA, 15 bp, Homo sapiens
cagttattacatgta

SEQ ID NO: 1473246 - DNA, 18 bp, Homo sapiens
cagttattacatgtaatt

SEQ ID NO: 1473247 - DNA, 13 bp, Homo sapiens
cagttcaaagaag

SEQ ID NO: 1473248 - DNA, 15 bp, Homo sapiens
cagttcaaagtgtat

SEQ ID NO: 1473249 - DNA, 19 bp, Homo sapiens
cagttcaatctcccgctgc

SEQ ID NO: 1473250 - DNA, 23 bp, Homo sapiens
cagttcaatctcccgctgctgct

SEQ ID NO: 1473251 - DNA, 16 bp, Homo sapiens
cagttcacctgcactt

SEQ ID NO: 1473252 - DNA, 23 bp, Homo sapiens
cagttcagaatggcagtcctgga

SEQ ID NO: 1473253 - DNA, 21 bp, Homo sapiens
cagttcagagttgtacactgt

SEQ ID NO: 1473254 - DNA, 23 bp, Homo sapiens
cagttcagagttgtacactgtgt

SEQ ID NO: 1473255 - DNA, 20 bp, Homo sapiens
cagttcaggagtcccaagga

SEQ ID NO: 1473256 - DNA, 23 bp, Homo sapiens
cagttcagtaataaactgtgttt

SEQ ID NO: 1473257 - DNA, 21 bp, Homo sapiens
cagttcatccgcactgtaaat

SEQ ID NO: 1473258 - DNA, 12 bp, Homo sapiens
cagttcatctat

SEQ ID NO: 1473259 - DNA, 17 bp, Homo sapiens
cagttcatctatggcag

SEQ ID NO: 1473260 - DNA, 21 bp, Homo sapiens
cagttcatctatggcagtcca

SEQ ID NO: 1473261 - DNA, 20 bp, Homo sapiens
cagttcatgtctgaaacaga

SEQ ID NO: 1473262 - DNA, 22 bp, Homo sapiens
cagttcatgtctgaaacagaga

SEQ ID NO: 1473263 - DNA, 16 bp, Homo sapiens
cagttcatgtttgctt

SEQ ID NO: 1473264 - DNA, 19 bp, Homo sapiens
cagttcattgacctcatca

SEQ ID NO: 1473265 - DNA, 22 bp, Homo sapiens
cagttcattgacctcatcatta

SEQ ID NO: 1473266 - DNA, 15 bp, Homo sapiens
cagttcattgcactt

SEQ ID NO: 1473267 - DNA, 18 bp, Homo sapiens
cagttcattgcactttga

SEQ ID NO: 1473268 - DNA, 14 bp, Homo sapiens
cagttcccagctcc

SEQ ID NO: 1473269 - DNA, 17 bp, Homo sapiens
cagttcccagctccccc

SEQ ID NO: 1473270 - DNA, 22 bp, Homo sapiens
cagttcccccagtacctccaag

SEQ ID NO: 1473271 - DNA, 17 bp, Homo sapiens
cagttcccggagcacag

SEQ ID NO: 1473272 - DNA, 22 bp, Homo sapiens
cagttcccggagcacagccctg

SEQ ID NO: 1473273 - DNA, 17 bp, Homo sapiens
cagttcccttggcctca

SEQ ID NO: 1473274 - DNA, 18 bp, Homo sapiens
cagttcccttggcctcag

SEQ ID NO: 1473275 - DNA, 19 bp, Homo sapiens
cagttcccttggcctcaga

SEQ ID NO: 1473276 - DNA, 14 bp, Homo sapiens
cagttcctcgccct

SEQ ID NO: 1473277 - DNA, 17 bp, Homo sapiens
cagttcctcgccctggg

SEQ ID NO: 1473278 - DNA, 21 bp, Homo sapiens
cagttcctggcccatcaactg

SEQ ID NO: 1473279 - DNA, 11 bp, Homo sapiens
cagttcctgta

SEQ ID NO: 1473280 - DNA, 19 bp, Homo sapiens
cagttcctgtggctccctc

SEQ ID NO: 1473281 - DNA, 12 bp, Homo sapiens
cagttctagaag

SEQ ID NO: 1473282 - DNA, 22 bp, Homo sapiens
cagttctagaagccacagtgcc

SEQ ID NO: 1473283 - DNA, 19 bp, Homo sapiens
cagttctagtttgcattcc

SEQ ID NO: 1473284 - DNA, 14 bp, Homo sapiens
cagttctgaaagct

SEQ ID NO: 1473285 - DNA, 15 bp, Homo sapiens
cagttctgagctgta

SEQ ID NO: 1473286 - DNA, 20 bp, Homo sapiens
cagttctgtggtttcatgtt

SEQ ID NO: 1473287 - DNA, 15 bp, Homo sapiens
cagttctttcctctt

SEQ ID NO: 1473288 - DNA, 17 bp, Homo sapiens
cagttctttgggccaga

SEQ ID NO: 1473289 - DNA, 20 bp, Homo sapiens
cagttctttgggccagacat

SEQ ID NO: 1473290 - DNA, 21 bp, Homo sapiens
cagttgaaaagactccaaaga

SEQ ID NO: 1473291 - DNA, 19 bp, Homo sapiens
cagttgacatccaaatcta

SEQ ID NO: 1473292 - DNA, 19 bp, Homo sapiens
cagttgactttaagtgaaa

SEQ ID NO: 1473293 - DNA, 20 bp, Homo sapiens
cagttgcatgtagtaacact

SEQ ID NO: 1473294 - DNA, 21 bp, Homo sapiens
cagttgccaaagttttgctgt

SEQ ID NO: 1473295 - DNA, 17 bp, Homo sapiens
cagttgctcaaaaagaa

SEQ ID NO: 1473296 - DNA, 22 bp, Homo sapiens
cagttgctgatccctgctctct

SEQ ID NO: 1473297 - DNA, 20 bp, Homo sapiens
cagttgctgtgaactttcat

SEQ ID NO: 1473298 - DNA, 17 bp, Homo sapiens
cagttggactctcaggg

SEQ ID NO: 1473299 - DNA, 18 bp, Homo sapiens
cagttggactctcaggga

SEQ ID NO: 1473300 - DNA, 22 bp, Homo sapiens
cagttggagtttgtgtctgttg

SEQ ID NO: 1473301 - DNA, 20 bp, Homo sapiens
cagttggcagagaaggcctc

SEQ ID NO: 1473302 - DNA, 21 bp, Homo sapiens
cagttggcagagaaggcctct

SEQ ID NO: 1473303 - DNA, 18 bp, Homo sapiens
cagttggccaagcagaaa

SEQ ID NO: 1473304 - DNA, 14 bp, Homo sapiens
cagttggctacgtt

SEQ ID NO: 1473305 - DNA, 16 bp, Homo sapiens
cagttgggagcactgg

SEQ ID NO: 1473306 - DNA, 14 bp, Homo sapiens
cagttggtaacttt

SEQ ID NO: 1473307 - DNA, 23 bp, Homo sapiens
cagttggtgattttagatttctt

SEQ ID NO: 1473308 - DNA, 14 bp, Homo sapiens
cagttgtatttaac

SEQ ID NO: 1473309 - DNA, 18 bp, Homo sapiens
cagttgtatttaacagaa

SEQ ID NO: 1473310 - DNA, 14 bp, Homo sapiens
cagttgtccttaaa

SEQ ID NO: 1473311 - DNA, 21 bp, Homo sapiens
cagttgtctattctgagcctt

SEQ ID NO: 1473312 - DNA, 21 bp, Homo sapiens
cagttgtcttatgtgaaaaat

SEQ ID NO: 1473313 - DNA, 23 bp, Homo sapiens
cagttgtcttatgtgaaaaatta

SEQ ID NO: 1473314 - DNA, 16 bp, Homo sapiens
cagttgtgaatacatt

SEQ ID NO: 1473315 - DNA, 20 bp, Homo sapiens
cagttgtgaatacattcttt

SEQ ID NO: 1473316 - DNA, 14 bp, Homo sapiens
cagttgttggcctc

SEQ ID NO: 1473317 - DNA, 15 bp, Homo sapiens
cagttgttggcctcc

SEQ ID NO: 1473318 - DNA, 18 bp, Homo sapiens
cagttgtttgtttttgct

SEQ ID NO: 1473319 - DNA, 16 bp, Homo sapiens
cagtttaatccttcta

SEQ ID NO: 1473320 - DNA, 15 bp, Homo sapiens
cagtttagtgcttta

SEQ ID NO: 1473321 - DNA, 22 bp, Homo sapiens
cagtttatggatatgctgcttt

SEQ ID NO: 1473322 - DNA, 19 bp, Homo sapiens
cagtttatttccactattt

SEQ ID NO: 1473323 - DNA, 22 bp, Homo sapiens
cagtttatttccactattttca

SEQ ID NO: 1473324 - DNA, 18 bp, Homo sapiens
cagtttatttttaaagat

SEQ ID NO: 1473325 - DNA, 22 bp, Homo sapiens
cagtttcaggtgtttagttgca

SEQ ID NO: 1473326 - DNA, 13 bp, Homo sapiens
cagtttccaaatt

SEQ ID NO: 1473327 - DNA, 14 bp, Homo sapiens
cagtttcctggaaa

SEQ ID NO: 1473328 - DNA, 16 bp, Homo sapiens
cagtttctccatcagc

SEQ ID NO: 1473329 - DNA, 18 bp, Homo sapiens
cagtttgaaaatattttg

SEQ ID NO: 1473330 - DNA, 19 bp, Homo sapiens
cagtttgactatgccgtct

SEQ ID NO: 1473331 - DNA, 21 bp, Homo sapiens
cagtttgcagaaaagcacctg

SEQ ID NO: 1473332 - DNA, 21 bp, Homo sapiens
cagtttgccggatacaaactg

SEQ ID NO: 1473333 - DNA, 13 bp, Homo sapiens
cagtttggccctg

SEQ ID NO: 1473334 - DNA, 14 bp, Homo sapiens
cagtttggccctgg

SEQ ID NO: 1473335 - DNA, 21 bp, Homo sapiens
cagtttggccctggagccagg

SEQ ID NO: 1473336 - DNA, 21 bp, Homo sapiens
cagtttggggactcaggacca

SEQ ID NO: 1473337 - DNA, 12 bp, Homo sapiens
cagttttaatac

SEQ ID NO: 1473338 - DNA, 15 bp, Homo sapiens
cagttttactctgct

SEQ ID NO: 1473339 - DNA, 11 bp, Homo sapiens
cagttttcctt

SEQ ID NO: 1473340 - DNA, 14 bp, Homo sapiens
cagttttctgagaa

SEQ ID NO: 1473341 - DNA, 12 bp, Homo sapiens
cagtttttcagg

SEQ ID NO: 1473342 - DNA, 14 bp, Homo sapiens
cagtttttcatttg

SEQ ID NO: 1473343 - DNA, 15 bp, Homo sapiens
cagtttttcatttgt

SEQ ID NO: 1473344 - DNA, 16 bp, Homo sapiens
cagtttttcatttgtt

SEQ ID NO: 1473345 - DNA, 17 bp, Homo sapiens
catagtttcaaatctgt

SEQ ID NO: 1473346 - DNA, 21 bp, Homo sapiens
catataacatgcaaacaggtt

SEQ ID NO: 1473347 - DNA, 20 bp, Homo sapiens
catataagtttgaaggaaac

SEQ ID NO: 1473348 - DNA, 23 bp, Homo sapiens
catataagtttgaaggaaacagt

SEQ ID NO: 1473349 - DNA, 18 bp, Homo sapiens
catatataactagctaga

SEQ ID NO: 1473350 - DNA, 16 bp, Homo sapiens
catatatatatataac

SEQ ID NO: 1473351 - DNA, 14 bp, Homo sapiens
catatatatatgtg

SEQ ID NO: 1473352 - DNA, 15 bp, Homo sapiens
catatatatatgtgt

SEQ ID NO: 1473353 - DNA, 17 bp, Homo sapiens
catatatatatgtgtgt

SEQ ID NO: 1473354 - DNA, 12 bp, Homo sapiens
catatatattac

SEQ ID NO: 1473355 - DNA, 19 bp, Homo sapiens
catatatgtataatatata

SEQ ID NO: 1473356 - DNA, 22 bp, Homo sapiens
catatatgtataatatatatct

SEQ ID NO: 1473357 - DNA, 23 bp, Homo sapiens
catatatgtataatatatatcta

SEQ ID NO: 1473358 - DNA, 21 bp, Homo sapiens
catatatttaacaatgacaag

SEQ ID NO: 1473359 - DNA, 14 bp, Homo sapiens
catatatttattga

SEQ ID NO: 1473360 - DNA, 17 bp, Homo sapiens
catatcacccttccctg

SEQ ID NO: 1473361 - DNA, 18 bp, Homo sapiens
catatcacccttccctgc

SEQ ID NO: 1473362 - DNA, 17 bp, Homo sapiens
catatcagctctctgca

SEQ ID NO: 1473363 - DNA, 14 bp, Homo sapiens
catatcccttccag

SEQ ID NO: 1473364 - DNA, 17 bp, Homo sapiens
catatcccttccagatg

SEQ ID NO: 1473365 - DNA, 19 bp, Homo sapiens
catatcctggtgtctagtt

SEQ ID NO: 1473366 - DNA, 18 bp, Homo sapiens
catatctagtatgaaatt

SEQ ID NO: 1473367 - DNA, 16 bp, Homo sapiens
catatctggagcctga

SEQ ID NO: 1473368 - DNA, 18 bp, Homo sapiens
catatcttctgtttcata

SEQ ID NO: 1473369 - DNA, 19 bp, Homo sapiens
catatcttctgtttcataa

SEQ ID NO: 1473370 - DNA, 11 bp, Homo sapiens
catatgaaaaa

SEQ ID NO: 1473371 - DNA, 23 bp, Homo sapiens
catatgaacacagacaaagtgct

SEQ ID NO: 1473372 - DNA, 16 bp, Homo sapiens
catatgaattgtacag

SEQ ID NO: 1473373 - DNA, 23 bp, Homo sapiens
catatgaccattgagtccctgct

SEQ ID NO: 1473374 - DNA, 20 bp, Homo sapiens
catatgactcacatgatgca

SEQ ID NO: 1473375 - DNA, 17 bp, Homo sapiens
catatgagaatatacct

SEQ ID NO: 1473376 - DNA, 23 bp, Homo sapiens
catatgagcctgccctcactccc

SEQ ID NO: 1473377 - DNA, 15 bp, Homo sapiens
catatgattctgctt

SEQ ID NO: 1473378 - DNA, 19 bp, Homo sapiens
catatgattgaaaagaaga

SEQ ID NO: 1473379 - DNA, 16 bp, Homo sapiens
catatgcaccttgtgt

SEQ ID NO: 1473380 - DNA, 16 bp, Homo sapiens
catatgcagccaacca

SEQ ID NO: 1473381 - DNA, 14 bp, Homo sapiens
catatgctccagga

SEQ ID NO: 1473382 - DNA, 15 bp, Homo sapiens
catatggactctgca

SEQ ID NO: 1473383 - DNA, 17 bp, Homo sapiens
catatggactctgcaca

SEQ ID NO: 1473384 - DNA, 15 bp, Homo sapiens
catatggcccagtgt

SEQ ID NO: 1473385 - DNA, 20 bp, Homo sapiens
catatggcccagtgtcaagt

SEQ ID NO: 1473386 - DNA, 17 bp, Homo sapiens
catatgggttagatgtt

SEQ ID NO: 1473387 - DNA, 21 bp, Homo sapiens
catatgtaacagtcaaatatc

SEQ ID NO: 1473388 - DNA, 12 bp, Homo sapiens
catatgttgcaa

SEQ ID NO: 1473389 - DNA, 15 bp, Homo sapiens
catatgtttctgcta

SEQ ID NO: 1473390 - DNA, 15 bp, Homo sapiens
catattaaataataa

SEQ ID NO: 1473391 - DNA, 14 bp, Homo sapiens
catattaagacagt

SEQ ID NO: 1473392 - DNA, 15 bp, Homo sapiens
catattaatatattt

SEQ ID NO: 1473393 - DNA, 18 bp, Homo sapiens
catattactgttgcattt

SEQ ID NO: 1473394 - DNA, 17 bp, Homo sapiens
catattcatgaaatgtg

SEQ ID NO: 1473395 - DNA, 19 bp, Homo sapiens
catattcatggttgttttt

SEQ ID NO: 1473396 - DNA, 23 bp, Homo sapiens
catattcttgctttcacaaatat

SEQ ID NO: 1473397 - DNA, 22 bp, Homo sapiens
catattgctatctaatggggaa

SEQ ID NO: 1473398 - DNA, 13 bp, Homo sapiens
catattgtaaaac

SEQ ID NO: 1473399 - DNA, 18 bp, Homo sapiens
catattgtgtaatttaag

SEQ ID NO: 1473400 - DNA, 14 bp, Homo sapiens
catatttacttctt

SEQ ID NO: 1473401 - DNA, 16 bp, Homo sapiens
catatttacttcttat

SEQ ID NO: 1473402 - DNA, 14 bp, Homo sapiens
catatttatacttt

SEQ ID NO: 1473403 - DNA, 12 bp, Homo sapiens
catatttatcca

SEQ ID NO: 1473404 - DNA, 16 bp, Homo sapiens
catatttattgcattg

SEQ ID NO: 1473405 - DNA, 17 bp, Homo sapiens
catatttgatttctaat

SEQ ID NO: 1473406 - DNA, 19 bp, Homo sapiens
catatttgccaataaagct

SEQ ID NO: 1473407 - DNA, 20 bp, Homo sapiens
catatttgtactttctgtta

SEQ ID NO: 1473408 - DNA, 21 bp, Homo sapiens
catatttgtactttctgttaa

SEQ ID NO: 1473409 - DNA, 14 bp, Homo sapiens
catatttgtagcta

SEQ ID NO: 1473410 - DNA, 13 bp, Homo sapiens
catattttaaaat

SEQ ID NO: 1473411 - DNA, 17 bp, Homo sapiens
catattttctgtccagt

SEQ ID NO: 1473412 - DNA, 16 bp, Homo sapiens
catattttgagaaact

SEQ ID NO: 1473413 - DNA, 23 bp, Homo sapiens
catatttttatactttattgaaa

SEQ ID NO: 1473414 - DNA, 14 bp, Homo sapiens
catatttttcacat

SEQ ID NO: 1473415 - DNA, 21 bp, Homo sapiens
catattttttatgatggagca

SEQ ID NO: 1473416 - DNA, 12 bp, Homo sapiens
catcaaacattt

SEQ ID NO: 1473417 - DNA, 18 bp, Homo sapiens
catcaaacatttgccaag

SEQ ID NO: 1473418 - DNA, 13 bp, Homo sapiens
catcaaacctcac

SEQ ID NO: 1473419 - DNA, 14 bp, Homo sapiens
catcaaataaactg

SEQ ID NO: 1473420 - DNA, 16 bp, Homo sapiens
catcaacaagatttcc

SEQ ID NO: 1473421 - DNA, 14 bp, Homo sapiens
catcaacatcttgg

SEQ ID NO: 1473422 - DNA, 15 bp, Homo sapiens
catcaacttaaaagt

SEQ ID NO: 1473423 - DNA, 13 bp, Homo sapiens
catcaagaagggc

SEQ ID NO: 1473424 - DNA, 20 bp, Homo sapiens
catcaagaagggctgcatga

SEQ ID NO: 1473425 - DNA, 21 bp, Homo sapiens
catcaagaagggctgcatgat

SEQ ID NO: 1473426 - DNA, 22 bp, Homo sapiens
catcaagaagggctgcatgatg

SEQ ID NO: 1473427 - DNA, 21 bp, Homo sapiens
catcaagaggtgggagggccc

SEQ ID NO: 1473428 - DNA, 13 bp, Homo sapiens
catcaagcacttc

SEQ ID NO: 1473429 - DNA, 19 bp, Homo sapiens
catcaatatccctcttgta

SEQ ID NO: 1473430 - DNA, 14 bp, Homo sapiens
catcaatcctgatt

SEQ ID NO: 1473431 - DNA, 16 bp, Homo sapiens
catcaatcctgattcc

SEQ ID NO: 1473432 - DNA, 13 bp, Homo sapiens
catcacacccatt

SEQ ID NO: 1473433 - DNA, 17 bp, Homo sapiens
catcacacccatttaaa

SEQ ID NO: 1473434 - DNA, 19 bp, Homo sapiens
catcacactgggtggtggc

SEQ ID NO: 1473435 - DNA, 19 bp, Homo sapiens
catcacacttatattttat

SEQ ID NO: 1473436 - DNA, 22 bp, Homo sapiens
catcacacttatattttatgaa

SEQ ID NO: 1473437 - DNA, 13 bp, Homo sapiens
catcacagcccag

SEQ ID NO: 1473438 - DNA, 13 bp, Homo sapiens
catcacagggcag

SEQ ID NO: 1473439 - DNA, 15 bp, Homo sapiens
catcacagggcagag

SEQ ID NO: 1473440 - DNA, 13 bp, Homo sapiens
catcacagggtgg

SEQ ID NO: 1473441 - DNA, 22 bp, Homo sapiens
catcacagggtgggcctcggcc

SEQ ID NO: 1473442 - DNA, 16 bp, Homo sapiens
catcacatgatgaaaa

SEQ ID NO: 1473443 - DNA, 13 bp, Homo sapiens
catcaccaccctt

SEQ ID NO: 1473444 - DNA, 16 bp, Homo sapiens
catcaccacccttcca

SEQ ID NO: 1473445 - DNA, 15 bp, Homo sapiens
catcaccaccgcctc

SEQ ID NO: 1473446 - DNA, 16 bp, Homo sapiens
catcaccaccgcctct

SEQ ID NO: 1473447 - DNA, 20 bp, Homo sapiens
catcaccaccgcctctggcc

SEQ ID NO: 1473448 - DNA, 14 bp, Homo sapiens
catcaccatttcct

SEQ ID NO: 1473449 - DNA, 21 bp, Homo sapiens
catcaccctgggagtttcctg

SEQ ID NO: 1473450 - DNA, 17 bp, Homo sapiens
catcacctatttaatgt

SEQ ID NO: 1473451 - DNA, 12 bp, Homo sapiens
catcacctcagg

SEQ ID NO: 1473452 - DNA, 15 bp, Homo sapiens
catcacctcaggcca

SEQ ID NO: 1473453 - DNA, 16 bp, Homo sapiens
catcacctctttgccc

SEQ ID NO: 1473454 - DNA, 11 bp, Homo sapiens
catcacctgct

SEQ ID NO: 1473455 - DNA, 15 bp, Homo sapiens
catcacgcctgtgca

SEQ ID NO: 1473456 - DNA, 18 bp, Homo sapiens
catcactagaagaaaagc

SEQ ID NO: 1473457 - DNA, 18 bp, Homo sapiens
catcactcatggaacact

SEQ ID NO: 1473458 - DNA, 17 bp, Homo sapiens
catcactccctggatgt

SEQ ID NO: 1473459 - DNA, 17 bp, Homo sapiens
catcactggactgcatg

SEQ ID NO: 1473460 - DNA, 19 bp, Homo sapiens
catcactggactgcatggg

SEQ ID NO: 1473461 - DNA, 22 bp, Homo sapiens
catcacttaacggaccaaagca

SEQ ID NO: 1473462 - DNA, 23 bp, Homo sapiens
catcacttactatccatttcttc

SEQ ID NO: 1473463 - DNA, 15 bp, Homo sapiens
catcacttctccccg

SEQ ID NO: 1473464 - DNA, 16 bp, Homo sapiens
catcagaaaataaaat

SEQ ID NO: 1473465 - DNA, 17 bp, Homo sapiens
catcagaaaataaaata

SEQ ID NO: 1473466 - DNA, 19 bp, Homo sapiens
catcagaaataataaaaaa

SEQ ID NO: 1473467 - DNA, 17 bp, Homo sapiens
catcagaagttactttt

SEQ ID NO: 1473468 - DNA, 14 bp, Homo sapiens
catcagacagatgg

SEQ ID NO: 1473469 - DNA, 23 bp, Homo sapiens
catcagacctgtcttccaaggag

SEQ ID NO: 1473470 - DNA, 18 bp, Homo sapiens
catcagaggtttgcttcc

SEQ ID NO: 1473471 - DNA, 21 bp, Homo sapiens
catcagaggtttgcttcctca

SEQ ID NO: 1473472 - DNA, 16 bp, Homo sapiens
catcagatgcctgctt

SEQ ID NO: 1473473 - DNA, 18 bp, Homo sapiens
catcagatgcctgcttga

SEQ ID NO: 1473474 - DNA, 17 bp, Homo sapiens
catcagattctgtgaga

SEQ ID NO: 1473475 - DNA, 16 bp, Homo sapiens
catcagcaccccagtg

SEQ ID NO: 1473476 - DNA, 13 bp, Homo sapiens
catcagcctgctt

SEQ ID NO: 1473477 - DNA, 20 bp, Homo sapiens
catcagcctgttccagaagg

SEQ ID NO: 1473478 - DNA, 11 bp, Homo sapiens
catcagccttc

SEQ ID NO: 1473479 - DNA, 23 bp, Homo sapiens
catcagctgtaagaagagactgg

SEQ ID NO: 1473480 - DNA, 14 bp, Homo sapiens
catcaggcactggt

SEQ ID NO: 1473481 - DNA, 15 bp, Homo sapiens
catcaggcagtgtta

SEQ ID NO: 1473482 - DNA, 18 bp, Homo sapiens
catcaggctaagaccctg

SEQ ID NO: 1473483 - DNA, 15 bp, Homo sapiens
catcagtagatttct

SEQ ID NO: 1473484 - DNA, 16 bp, Homo sapiens
catcagtgaggaggga

SEQ ID NO: 1473485 - DNA, 22 bp, Homo sapiens
catcagtgttaaaaaatttttg

SEQ ID NO: 1473486 - DNA, 15 bp, Homo sapiens
catcagttcccccag

SEQ ID NO: 1473487 - DNA, 17 bp, Homo sapiens
catcagttcccccagta

SEQ ID NO: 1473488 - DNA, 18 bp, Homo sapiens
catcataaaataaagtat

SEQ ID NO: 1473489 - DNA, 20 bp, Homo sapiens
catcataaaataaagtatat

SEQ ID NO: 1473490 - DNA, 23 bp, Homo sapiens
catcataaaataaagtatatata

SEQ ID NO: 1473491 - DNA, 13 bp, Homo sapiens
catcataattaca

SEQ ID NO: 1473492 - DNA, 22 bp, Homo sapiens
catcataattacattcctaact

SEQ ID NO: 1473493 - DNA, 22 bp, Homo sapiens
catcataggaagggaccaaggc

SEQ ID NO: 1473494 - DNA, 13 bp, Homo sapiens
catcatatattta

SEQ ID NO: 1473495 - DNA, 22 bp, Homo sapiens
catcatattccaacccagccac

SEQ ID NO: 1473496 - DNA, 12 bp, Homo sapiens
catcatattgta

SEQ ID NO: 1473497 - DNA, 20 bp, Homo sapiens
catcatattgtatgtaagta

SEQ ID NO: 1473498 - DNA, 16 bp, Homo sapiens
catcatcactgtaaag

SEQ ID NO: 1473499 - DNA, 16 bp, Homo sapiens
catcatcctaagctat

SEQ ID NO: 1473500 - DNA, 14 bp, Homo sapiens
catcatcctttgtt

SEQ ID NO: 1473501 - DNA, 21 bp, Homo sapiens
catcatcctttgttctgagca

SEQ ID NO: 1473502 - DNA, 21 bp, Homo sapiens
catcatcgttgttattaaaga

SEQ ID NO: 1473503 - DNA, 15 bp, Homo sapiens
catcatctctgaagg

SEQ ID NO: 1473504 - DNA, 16 bp, Homo sapiens
catcatgaactggctt

SEQ ID NO: 1473505 - DNA, 17 bp, Homo sapiens
catcatgaccagcaaat

SEQ ID NO: 1473506 - DNA, 21 bp, Homo sapiens
catcatggactgagctggggg

SEQ ID NO: 1473507 - DNA, 13 bp, Homo sapiens
catcatgtctgta

SEQ ID NO: 1473508 - DNA, 16 bp, Homo sapiens
catcatgttattttat

SEQ ID NO: 1473509 - DNA, 13 bp, Homo sapiens
catcatgtttaca

SEQ ID NO: 1473510 - DNA, 19 bp, Homo sapiens
catcatgtttacagaggac

SEQ ID NO: 1473511 - DNA, 22 bp, Homo sapiens
catcattaataagtgaagaata

SEQ ID NO: 1473512 - DNA, 22 bp, Homo sapiens
catcattaatgactttatgtat

SEQ ID NO: 1473513 - DNA, 17 bp, Homo sapiens
catcattataaacgtga

SEQ ID NO: 1473514 - DNA, 23 bp, Homo sapiens
catcattccctctcatctcaggt

SEQ ID NO: 1473515 - DNA, 17 bp, Homo sapiens
catcattccttgagaaa

SEQ ID NO: 1473516 - DNA, 22 bp, Homo sapiens
catcattccttgagaaaaacaa

SEQ ID NO: 1473517 - DNA, 16 bp, Homo sapiens
catcattgcacctgca

SEQ ID NO: 1473518 - DNA, 17 bp, Homo sapiens
catcattgcacctgcag

SEQ ID NO: 1473519 - DNA, 13 bp, Homo sapiens
catccaaatctag

SEQ ID NO: 1473520 - DNA, 21 bp, Homo sapiens
catccaaccccccacctgcca

SEQ ID NO: 1473521 - DNA, 14 bp, Homo sapiens
catccaaccttccc

SEQ ID NO: 1473522 - DNA, 14 bp, Homo sapiens
catccaacttatgt

SEQ ID NO: 1473523 - DNA, 14 bp, Homo sapiens
catccaagccagag

SEQ ID NO: 1473524 - DNA, 15 bp, Homo sapiens
catccaagccagagt

SEQ ID NO: 1473525 - DNA, 21 bp, Homo sapiens
catccaaggccaggttctccg

SEQ ID NO: 1473526 - DNA, 16 bp, Homo sapiens
catccaagtctttctt

SEQ ID NO: 1473527 - DNA, 15 bp, Homo sapiens
catccaatcctcact

SEQ ID NO: 1473528 - DNA, 19 bp, Homo sapiens
catccaatcctcactgggt

SEQ ID NO: 1473529 - DNA, 23 bp, Homo sapiens
catccacaaatgcagttttagaa

SEQ ID NO: 1473530 - DNA, 22 bp, Homo sapiens
catccacacaacaccaggactt

SEQ ID NO: 1473531 - DNA, 14 bp, Homo sapiens
catccacccagtgc

SEQ ID NO: 1473532 - DNA, 16 bp, Homo sapiens
catccacccagtgctg

SEQ ID NO: 1473533 - DNA, 18 bp, Homo sapiens
catccacccagtgctgcc

SEQ ID NO: 1473534 - DNA, 17 bp, Homo sapiens
catccaccttcccttct

SEQ ID NO: 1473535 - DNA, 19 bp, Homo sapiens
catccactctaccctccca

SEQ ID NO: 1473536 - DNA, 15 bp, Homo sapiens
catccagacctggct

SEQ ID NO: 1473537 - DNA, 17 bp, Homo sapiens
catccagactcagagct

SEQ ID NO: 1473538 - DNA, 13 bp, Homo sapiens
catccagcaagaa

SEQ ID NO: 1473539 - DNA, 14 bp, Homo sapiens
catccagcctccag

SEQ ID NO: 1473540 - DNA, 15 bp, Homo sapiens
catccagcctccagg

SEQ ID NO: 1473541 - DNA, 17 bp, Homo sapiens
catccagcctccagggc

SEQ ID NO: 1473542 - DNA, 18 bp, Homo sapiens
catccagcctccagggca

SEQ ID NO: 1473543 - DNA, 12 bp, Homo sapiens
catccagcctgt

SEQ ID NO: 1473544 - DNA, 14 bp, Homo sapiens
catccagcctgtgt

SEQ ID NO: 1473545 - DNA, 18 bp, Homo sapiens
catccagcgagagagttt

SEQ ID NO: 1473546 - DNA, 19 bp, Homo sapiens
catccaggccagggctcct

SEQ ID NO: 1473547 - DNA, 12 bp, Homo sapiens
catccaggctgg

SEQ ID NO: 1473548 - DNA, 15 bp, Homo sapiens
catccaggctggcca

SEQ ID NO: 1473549 - DNA, 19 bp, Homo sapiens
catccagtgacaaaccatc

SEQ ID NO: 1473550 - DNA, 16 bp, Homo sapiens
catccatagtagtatg

SEQ ID NO: 1473551 - DNA, 17 bp, Homo sapiens
catccatccctccattc

SEQ ID NO: 1473552 - DNA, 20 bp, Homo sapiens
catccatccctccattcatc

SEQ ID NO: 1473553 - DNA, 22 bp, Homo sapiens
catccatggccgggcttggtgg

SEQ ID NO: 1473554 - DNA, 14 bp, Homo sapiens
catccattcctcag

SEQ ID NO: 1473555 - DNA, 18 bp, Homo sapiens
catccattcctcagggac

SEQ ID NO: 1473556 - DNA, 20 bp, Homo sapiens
catccatttcatctatttct

SEQ ID NO: 1473557 - DNA, 14 bp, Homo sapiens
catcccaacagcca

SEQ ID NO: 1473558 - DNA, 20 bp, Homo sapiens
catcccaaccaggcacctct

SEQ ID NO: 1473559 - DNA, 22 bp, Homo sapiens
catcccacttagccgcaccctg

SEQ ID NO: 1473560 - DNA, 15 bp, Homo sapiens
catcccagcctgtgg

SEQ ID NO: 1473561 - DNA, 17 bp, Homo sapiens
catcccagcctgtggtt

SEQ ID NO: 1473562 - DNA, 17 bp, Homo sapiens
catcccagtccctcgcc

SEQ ID NO: 1473563 - DNA, 22 bp, Homo sapiens
catcccattccaggcagcctct

SEQ ID NO: 1473564 - DNA, 15 bp, Homo sapiens
catcccattgccctg

SEQ ID NO: 1473565 - DNA, 16 bp, Homo sapiens
catccccacaatctgg

SEQ ID NO: 1473566 - DNA, 19 bp, Homo sapiens
catccccacaatctggctt

SEQ ID NO: 1473567 - DNA, 15 bp, Homo sapiens
catccccagagccca

SEQ ID NO: 1473568 - DNA, 20 bp, Homo sapiens
catccccagagcccagctct

SEQ ID NO: 1473569 - DNA, 18 bp, Homo sapiens
catccccaggggtcccag

SEQ ID NO: 1473570 - DNA, 21 bp, Homo sapiens
catccccaggtctctccactg

SEQ ID NO: 1473571 - DNA, 22 bp, Homo sapiens
catccccaggtctctccactgc

SEQ ID NO: 1473572 - DNA, 12 bp, Homo sapiens
catcccccaaag

SEQ ID NO: 1473573 - DNA, 19 bp, Homo sapiens
catcccccactgccacacc

SEQ ID NO: 1473574 - DNA, 13 bp, Homo sapiens
catcccccctgct

SEQ ID NO: 1473575 - DNA, 14 bp, Homo sapiens
catgcacagctgta

SEQ ID NO: 1473576 - DNA, 21 bp, Homo sapiens
catgcacagtacaataatgta

SEQ ID NO: 1473577 - DNA, 14 bp, Homo sapiens
catgcacagtattt

SEQ ID NO: 1473578 - DNA, 18 bp, Homo sapiens
catgcacagtatttgtaa

SEQ ID NO: 1473579 - DNA, 21 bp, Homo sapiens
catgcacatgccttaagccag

SEQ ID NO: 1473580 - DNA, 14 bp, Homo sapiens
catgcacattttgt

SEQ ID NO: 1473581 - DNA, 18 bp, Homo sapiens
catgcacattttgtacat

SEQ ID NO: 1473582 - DNA, 18 bp, Homo sapiens
catgcaccaggactggct

SEQ ID NO: 1473583 - DNA, 17 bp, Homo sapiens
catgcactcacccctag

SEQ ID NO: 1473584 - DNA, 22 bp, Homo sapiens
catgcactcacccctagccctg

SEQ ID NO: 1473585 - DNA, 23 bp, Homo sapiens
catgcactcacccctagccctgg

SEQ ID NO: 1473586 - DNA, 17 bp, Homo sapiens
catgcactgacccttcc

SEQ ID NO: 1473587 - DNA, 14 bp, Homo sapiens
catgcactgatgtt

SEQ ID NO: 1473588 - DNA, 10 bp, Homo sapiens
catgcactgt

SEQ ID NO: 1473589 - DNA, 16 bp, Homo sapiens
catgcactgtgaagga

SEQ ID NO: 1473590 - DNA, 16 bp, Homo sapiens
catgcagacctcatgc

SEQ ID NO: 1473591 - DNA, 20 bp, Homo sapiens
catgcagactgttagctttt

SEQ ID NO: 1473592 - DNA, 19 bp, Homo sapiens
catgcagatggggctcccg

SEQ ID NO: 1473593 - DNA, 21 bp, Homo sapiens
catgcagccgtgatcaaggga

SEQ ID NO: 1473594 - DNA, 18 bp, Homo sapiens
catgcagctgctccccag

SEQ ID NO: 1473595 - DNA, 22 bp, Homo sapiens
catgcagctgctccccaggcca

SEQ ID NO: 1473596 - DNA, 12 bp, Homo sapiens
catgcaggaaga

SEQ ID NO: 1473597 - DNA, 22 bp, Homo sapiens
catgcaggaagaggcccactag

SEQ ID NO: 1473598 - DNA, 19 bp, Homo sapiens
catgcaggggtcagtgcag

SEQ ID NO: 1473599 - DNA, 15 bp, Homo sapiens
catgcagttcctggc

SEQ ID NO: 1473600 - DNA, 14 bp, Homo sapiens
catgcatgcaaatg

SEQ ID NO: 1473601 - DNA, 19 bp, Homo sapiens
catgcatgcaaatgagctc

SEQ ID NO: 1473602 - DNA, 18 bp, Homo sapiens
catgcatgtcctgtaaag

SEQ ID NO: 1473603 - DNA, 14 bp, Homo sapiens
catgcattttgcag

SEQ ID NO: 1473604 - DNA, 16 bp, Homo sapiens
catgccaccacccacc

SEQ ID NO: 1473605 - DNA, 14 bp, Homo sapiens
catgccacctggca

SEQ ID NO: 1473606 - DNA, 13 bp, Homo sapiens
catgccagagagg

SEQ ID NO: 1473607 - DNA, 13 bp, Homo sapiens
catgccaggaccc

SEQ ID NO: 1473608 - DNA, 18 bp, Homo sapiens
catgccaggacccgccag

SEQ ID NO: 1473609 - DNA, 17 bp, Homo sapiens
catgccagtgacacttc

SEQ ID NO: 1473610 - DNA, 10 bp, Homo sapiens
catgccatct

SEQ ID NO: 1473611 - DNA, 19 bp, Homo sapiens
catgcccagctctctgacg

SEQ ID NO: 1473612 - DNA, 16 bp, Homo sapiens
catgccccagctctgg

SEQ ID NO: 1473613 - DNA, 14 bp, Homo sapiens
catgccccaggctc

SEQ ID NO: 1473614 - DNA, 18 bp, Homo sapiens
catgccccaggctctcgc

SEQ ID NO: 1473615 - DNA, 14 bp, Homo sapiens
catgcccccctcaa

SEQ ID NO: 1473616 - DNA, 16 bp, Homo sapiens
catgccccctgcagac

SEQ ID NO: 1473617 - DNA, 15 bp, Homo sapiens
catgccccctttcag

SEQ ID NO: 1473618 - DNA, 23 bp, Homo sapiens
catgccctccactccactgcctt

SEQ ID NO: 1473619 - DNA, 14 bp, Homo sapiens
catgccctcctgga

SEQ ID NO: 1473620 - DNA, 12 bp, Homo sapiens
catgcccttctg

SEQ ID NO: 1473621 - DNA, 13 bp, Homo sapiens
catgcccttctga

SEQ ID NO: 1473622 - DNA, 18 bp, Homo sapiens
catgccgcagggagggct

SEQ ID NO: 1473623 - DNA, 20 bp, Homo sapiens
catgccgcgtccctgccccg

SEQ ID NO: 1473624 - DNA, 15 bp, Homo sapiens
catgcctcatgccac

SEQ ID NO: 1473625 - DNA, 16 bp, Homo sapiens
catgcctcatgccaca

SEQ ID NO: 1473626 - DNA, 17 bp, Homo sapiens
catgcctcatgccacac

SEQ ID NO: 1473627 - DNA, 13 bp, Homo sapiens
catgcctgagggt

SEQ ID NO: 1473628 - DNA, 16 bp, Homo sapiens
catgcctgagggtgga

SEQ ID NO: 1473629 - DNA, 20 bp, Homo sapiens
catgcctgccccaaacaaat

SEQ ID NO: 1473630 - DNA, 16 bp, Homo sapiens
catgcctgctccctgt

SEQ ID NO: 1473631 - DNA, 18 bp, Homo sapiens
catgcctgctccctgtct

SEQ ID NO: 1473632 - DNA, 20 bp, Homo sapiens
catgcctgctccctgtctgt

SEQ ID NO: 1473633 - DNA, 21 bp, Homo sapiens
catgcctgctccctgtctgtg

SEQ ID NO: 1473634 - DNA, 22 bp, Homo sapiens
catgcctgctccctgtctgtgt

SEQ ID NO: 1473635 - DNA, 18 bp, Homo sapiens
catgcctgtaatcccaga

SEQ ID NO: 1473636 - DNA, 21 bp, Homo sapiens
catgcctgtagctttcctggt

SEQ ID NO: 1473637 - DNA, 18 bp, Homo sapiens
catgcctgtagtctcagc

SEQ ID NO: 1473638 - DNA, 20 bp, Homo sapiens
catgcctgtccagcctgggc

SEQ ID NO: 1473639 - DNA, 21 bp, Homo sapiens
catgcctgtccagcctgggca

SEQ ID NO: 1473640 - DNA, 14 bp, Homo sapiens
catgcctgtctctg

SEQ ID NO: 1473641 - DNA, 15 bp, Homo sapiens
catgccttccagcac

SEQ ID NO: 1473642 - DNA, 13 bp, Homo sapiens
catgcctttgtaa

SEQ ID NO: 1473643 - DNA, 15 bp, Homo sapiens
catgcgacagcgtcc

SEQ ID NO: 1473644 - DNA, 13 bp, Homo sapiens
catgcgcacaagg

SEQ ID NO: 1473645 - DNA, 23 bp, Homo sapiens
catgcgccccctccgccctgcca

SEQ ID NO: 1473646 - DNA, 15 bp, Homo sapiens
catgcgctcagggcc

SEQ ID NO: 1473647 - DNA, 22 bp, Homo sapiens
catgcgctcagggccatgctga

SEQ ID NO: 1473648 - DNA, 16 bp, Homo sapiens
catgcggcccaggatg

SEQ ID NO: 1473649 - DNA, 15 bp, Homo sapiens
catgcgtatatgtgc

SEQ ID NO: 1473650 - DNA, 22 bp, Homo sapiens
catgcgtgccgcctgctcctca

SEQ ID NO: 1473651 - DNA, 23 bp, Homo sapiens
catgcgtggccacgggggcagtg

SEQ ID NO: 1473652 - DNA, 16 bp, Homo sapiens
catgcgtgtttctgac

SEQ ID NO: 1473653 - DNA, 16 bp, Homo sapiens
catgctatctgttcct

SEQ ID NO: 1473654 - DNA, 20 bp, Homo sapiens
catgctatgagttttctcct

SEQ ID NO: 1473655 - DNA, 14 bp, Homo sapiens
catgctatgttctg

SEQ ID NO: 1473656 - DNA, 19 bp, Homo sapiens
catgctatgttctgtcttc

SEQ ID NO: 1473657 - DNA, 16 bp, Homo sapiens
catgctcaaccactgt

SEQ ID NO: 1473658 - DNA, 14 bp, Homo sapiens
catgctcacacatt

SEQ ID NO: 1473659 - DNA, 19 bp, Homo sapiens
catgctcatctgctggtcc

SEQ ID NO: 1473660 - DNA, 16 bp, Homo sapiens
catgctccactatttt

SEQ ID NO: 1473661 - DNA, 19 bp, Homo sapiens
catgctccactattttatt

SEQ ID NO: 1473662 - DNA, 12 bp, Homo sapiens
catgctccaggg

SEQ ID NO: 1473663 - DNA, 14 bp, Homo sapiens
catgctctctgcag

SEQ ID NO: 1473664 - DNA, 16 bp, Homo sapiens
catgctctctgcagcc

SEQ ID NO: 1473665 - DNA, 19 bp, Homo sapiens
catgctctctgcagccagc

SEQ ID NO: 1473666 - DNA, 20 bp, Homo sapiens
catgctctctgcagccagcc

SEQ ID NO: 1473667 - DNA, 16 bp, Homo sapiens
catgctctgccccaag

SEQ ID NO: 1473668 - DNA, 11 bp, Homo sapiens
catgctctgga

SEQ ID NO: 1473669 - DNA, 13 bp, Homo sapiens
catgctctggaag

SEQ ID NO: 1473670 - DNA, 16 bp, Homo sapiens
catgctctggaagcct

SEQ ID NO: 1473671 - DNA, 22 bp, Homo sapiens
catgctctgtaagttgcttcct

SEQ ID NO: 1473672 - DNA, 21 bp, Homo sapiens
catgctgaatgccccctgctt

SEQ ID NO: 1473673 - DNA, 18 bp, Homo sapiens
catgctgaggcctgggcc

SEQ ID NO: 1473674 - DNA, 14 bp, Homo sapiens
catgctgctgggga

SEQ ID NO: 1473675 - DNA, 21 bp, Homo sapiens
catgctgctggggaagacagt

SEQ ID NO: 1473676 - DNA, 21 bp, Homo sapiens
catgctgctttttggcacagt

SEQ ID NO: 1473677 - DNA, 18 bp, Homo sapiens
catgctggaaataaaaca

SEQ ID NO: 1473678 - DNA, 19 bp, Homo sapiens
catgctggaaataaaacag

SEQ ID NO: 1473679 - DNA, 14 bp, Homo sapiens
catgctgggccact

SEQ ID NO: 1473680 - DNA, 19 bp, Homo sapiens
catgctgggccactgggga

SEQ ID NO: 1473681 - DNA, 20 bp, Homo sapiens
catgctgtgcgcccagggct

SEQ ID NO: 1473682 - DNA, 15 bp, Homo sapiens
catgctgtgctcttt

SEQ ID NO: 1473683 - DNA, 22 bp, Homo sapiens
catgctgtgctctttgaagaga

SEQ ID NO: 1473684 - DNA, 15 bp, Homo sapiens
catgcttagtcactg

SEQ ID NO: 1473685 - DNA, 16 bp, Homo sapiens
catgcttagtcactgc

SEQ ID NO: 1473686 - DNA, 18 bp, Homo sapiens
catgcttagtcactgcct

SEQ ID NO: 1473687 - DNA, 23 bp, Homo sapiens
catgcttcatcattccctctcat

SEQ ID NO: 1473688 - DNA, 18 bp, Homo sapiens
catgcttgaatggagctg

SEQ ID NO: 1473689 - DNA, 14 bp, Homo sapiens
catgcttgacatac

SEQ ID NO: 1473690 - DNA, 22 bp, Homo sapiens
catggtgtggggggctggggga

SEQ ID NO: 1473691 - DNA, 16 bp, Homo sapiens
catggttgagaaatga

SEQ ID NO: 1473692 - DNA, 16 bp, Homo sapiens
catgtaaaagagtcat

SEQ ID NO: 1473693 - DNA, 15 bp, Homo sapiens
catgtaaaatatgta

SEQ ID NO: 1473694 - DNA, 17 bp, Homo sapiens
catgtaaccggcatgtt

SEQ ID NO: 1473695 - DNA, 18 bp, Homo sapiens
catgtaaccggcatgttt

SEQ ID NO: 1473696 - DNA, 15 bp, Homo sapiens
catgtaactatttct

SEQ ID NO: 1473697 - DNA, 16 bp, Homo sapiens
catgtaagaaaatgtt

SEQ ID NO: 1473698 - DNA, 19 bp, Homo sapiens
catgtaaggttgtgcaggg

SEQ ID NO: 1473699 - DNA, 21 bp, Homo sapiens
catgtaataaaaagtatatgt

SEQ ID NO: 1473700 - DNA, 14 bp, Homo sapiens
catgtaatatattt

SEQ ID NO: 1473701 - DNA, 15 bp, Homo sapiens
catgtaatatatttc

SEQ ID NO: 1473702 - DNA, 18 bp, Homo sapiens
catgtaatcccagctact

SEQ ID NO: 1473703 - DNA, 21 bp, Homo sapiens
catgtaattaagtactatgta

SEQ ID NO: 1473704 - DNA, 19 bp, Homo sapiens
catgtaattttattttaaa

SEQ ID NO: 1473705 - DNA, 23 bp, Homo sapiens
catgtacatagtaaagtattttt

SEQ ID NO: 1473706 - DNA, 15 bp, Homo sapiens
catgtaccatcaata

SEQ ID NO: 1473707 - DNA, 19 bp, Homo sapiens
catgtaccatttgcatggc

SEQ ID NO: 1473708 - DNA, 13 bp, Homo sapiens
catgtactacagc

SEQ ID NO: 1473709 - DNA, 17 bp, Homo sapiens
catgtactcaagtacca

SEQ ID NO: 1473710 - DNA, 22 bp, Homo sapiens
catgtactgagccttgtaattc

SEQ ID NO: 1473711 - DNA, 23 bp, Homo sapiens
catgtactgagccttgtaattct

SEQ ID NO: 1473712 - DNA, 16 bp, Homo sapiens
catgtacttcctgtgt

SEQ ID NO: 1473713 - DNA, 17 bp, Homo sapiens
catgtacttcctgtgta

SEQ ID NO: 1473714 - DNA, 21 bp, Homo sapiens
catgtacttcctgtgtactct

SEQ ID NO: 1473715 - DNA, 21 bp, Homo sapiens
catgtacttgtttgcaagcag

SEQ ID NO: 1473716 - DNA, 13 bp, Homo sapiens
catgtagccccct

SEQ ID NO: 1473717 - DNA, 17 bp, Homo sapiens
catgtagtaacactaat

SEQ ID NO: 1473718 - DNA, 21 bp, Homo sapiens
catgtagtaacactaatatat

SEQ ID NO: 1473719 - DNA, 22 bp, Homo sapiens
catgtagtaacactaatatatt

SEQ ID NO: 1473720 - DNA, 14 bp, Homo sapiens
catgtatgaatgta

SEQ ID NO: 1473721 - DNA, 13 bp, Homo sapiens
catgtatgatgag

SEQ ID NO: 1473722 - DNA, 21 bp, Homo sapiens
catgtatggacgtgtgtgaat

SEQ ID NO: 1473723 - DNA, 14 bp, Homo sapiens
catgtatgtataca

SEQ ID NO: 1473724 - DNA, 17 bp, Homo sapiens
catgtatgtcttggaca

SEQ ID NO: 1473725 - DNA, 20 bp, Homo sapiens
catgtattaaattacatttg

SEQ ID NO: 1473726 - DNA, 20 bp, Homo sapiens
catgtattagctcactgaat

SEQ ID NO: 1473727 - DNA, 14 bp, Homo sapiens
catgtattcacaca

SEQ ID NO: 1473728 - DNA, 14 bp, Homo sapiens
catgtattggcctg

SEQ ID NO: 1473729 - DNA, 15 bp, Homo sapiens
catgtattggcctgg

SEQ ID NO: 1473730 - DNA, 16 bp, Homo sapiens
catgtattggcctgga

SEQ ID NO: 1473731 - DNA, 15 bp, Homo sapiens
catgtatttgagcat

SEQ ID NO: 1473732 - DNA, 15 bp, Homo sapiens
catgtatttgttata

SEQ ID NO: 1473733 - DNA, 20 bp, Homo sapiens
catgtatttgttatatataa

SEQ ID NO: 1473734 - DNA, 12 bp, Homo sapiens
catgtcacctca

SEQ ID NO: 1473735 - DNA, 13 bp, Homo sapiens
catgtcacctcag

SEQ ID NO: 1473736 - DNA, 19 bp, Homo sapiens
catgtcagagcttggccct

SEQ ID NO: 1473737 - DNA, 22 bp, Homo sapiens
catgtcatgtaggttgtctaaa

SEQ ID NO: 1473738 - DNA, 19 bp, Homo sapiens
catgtccaaacgtcctctt

SEQ ID NO: 1473739 - DNA, 16 bp, Homo sapiens
catgtccaaagaggct

SEQ ID NO: 1473740 - DNA, 19 bp, Homo sapiens
catgtccaaagaggctgcc

SEQ ID NO: 1473741 - DNA, 19 bp, Homo sapiens
catgtccagcaccttgtgc

SEQ ID NO: 1473742 - DNA, 23 bp, Homo sapiens
catgtccagcaccttgtgcctgg

SEQ ID NO: 1473743 - DNA, 19 bp, Homo sapiens
catgtccatacactttgtt

SEQ ID NO: 1473744 - DNA, 18 bp, Homo sapiens
catgtcccacccacccgc

SEQ ID NO: 1473745 - DNA, 22 bp, Homo sapiens
catgtccctaccgagtctcttc

SEQ ID NO: 1473746 - DNA, 20 bp, Homo sapiens
catgtcctatagtttgtcat

SEQ ID NO: 1473747 - DNA, 22 bp, Homo sapiens
catgtcctgcctattatctgtc

SEQ ID NO: 1473748 - DNA, 21 bp, Homo sapiens
catgtcctgtcctggtcctga

SEQ ID NO: 1473749 - DNA, 17 bp, Homo sapiens
catgtcctttccatctg

SEQ ID NO: 1473750 - DNA, 18 bp, Homo sapiens
catgtcctttccatctgt

SEQ ID NO: 1473751 - DNA, 21 bp, Homo sapiens
catgtcctttgcgcctgtgac

SEQ ID NO: 1473752 - DNA, 21 bp, Homo sapiens
catgtcgctagccagtgctcc

SEQ ID NO: 1473753 - DNA, 12 bp, Homo sapiens
catgtctactgc

SEQ ID NO: 1473754 - DNA, 16 bp, Homo sapiens
catgtctattcagctt

SEQ ID NO: 1473755 - DNA, 16 bp, Homo sapiens
catgtctcctatcctg

SEQ ID NO: 1473756 - DNA, 21 bp, Homo sapiens
catgtctgtatactcctgtca

SEQ ID NO: 1473757 - DNA, 13 bp, Homo sapiens
catgtcttgtaca

SEQ ID NO: 1473758 - DNA, 16 bp, Homo sapiens
catgtgaagtgtatat

SEQ ID NO: 1473759 - DNA, 12 bp, Homo sapiens
catgtgacacat

SEQ ID NO: 1473760 - DNA, 13 bp, Homo sapiens
catgtgacacata

SEQ ID NO: 1473761 - DNA, 22 bp, Homo sapiens
catgtgacttctcccctgccct

SEQ ID NO: 1473762 - DNA, 20 bp, Homo sapiens
catgtgagccaccgctgcca

SEQ ID NO: 1473763 - DNA, 18 bp, Homo sapiens
catgtgagctcttcctat

SEQ ID NO: 1473764 - DNA, 18 bp, Homo sapiens
catgtgaggaggaaaagg

SEQ ID NO: 1473765 - DNA, 23 bp, Homo sapiens
catgtgaggaggaaaaggaaaaa

SEQ ID NO: 1473766 - DNA, 21 bp, Homo sapiens
catgtgagtgacgatgatgta

SEQ ID NO: 1473767 - DNA, 22 bp, Homo sapiens
catgtgatacattttttaagct

SEQ ID NO: 1473768 - DNA, 21 bp, Homo sapiens
catgtgcaaacccactcagag

SEQ ID NO: 1473769 - DNA, 11 bp, Homo sapiens
catgtgcaata

SEQ ID NO: 1473770 - DNA, 19 bp, Homo sapiens
catgtgccaagattctact

SEQ ID NO: 1473771 - DNA, 17 bp, Homo sapiens
catgtgcctgcaccagg

SEQ ID NO: 1473772 - DNA, 14 bp, Homo sapiens
catgtgcctgtcac

SEQ ID NO: 1473773 - DNA, 11 bp, Homo sapiens
catgtgccttt

SEQ ID NO: 1473774 - DNA, 23 bp, Homo sapiens
catgtgcctttctttgcctctgc

SEQ ID NO: 1473775 - DNA, 21 bp, Homo sapiens
catgtgctagtcactggcagc

SEQ ID NO: 1473776 - DNA, 14 bp, Homo sapiens
catgtgctgtgtga

SEQ ID NO: 1473777 - DNA, 21 bp, Homo sapiens
catgtgctgtgtgagtgagca

SEQ ID NO: 1473778 - DNA, 19 bp, Homo sapiens
catgtggagaaaggagtga

SEQ ID NO: 1473779 - DNA, 19 bp, Homo sapiens
catgtggaggggcagcctg

SEQ ID NO: 1473780 - DNA, 15 bp, Homo sapiens
catgtggccccaccc

SEQ ID NO: 1473781 - DNA, 24 bp, Homo sapiens
catgtggcctttatctcaacggaa

SEQ ID NO: 1473782 - DNA, 11 bp, Homo sapiens
catgtggctga

SEQ ID NO: 1473783 - DNA, 12 bp, Homo sapiens
catgtggctgga

SEQ ID NO: 1473784 - DNA, 20 bp, Homo sapiens
catgtgggcgcccaccctgg

SEQ ID NO: 1473785 - DNA, 17 bp, Homo sapiens
catgtgggtgaccaggt

SEQ ID NO: 1473786 - DNA, 18 bp, Homo sapiens
catgtgggtgagccagtg

SEQ ID NO: 1473787 - DNA, 23 bp, Homo sapiens
catgtgggtggagaagggagggt

SEQ ID NO: 1473788 - DNA, 12 bp, Homo sapiens
catgtggtggga

SEQ ID NO: 1473789 - DNA, 21 bp, Homo sapiens
catgtggtgggacagggaccc

SEQ ID NO: 1473790 - DNA, 17 bp, Homo sapiens
catgtgtccatcccagc

SEQ ID NO: 1473791 - DNA, 14 bp, Homo sapiens
catgtgtcccagga

SEQ ID NO: 1473792 - DNA, 13 bp, Homo sapiens
catgtgtgcatgt

SEQ ID NO: 1473793 - DNA, 14 bp, Homo sapiens
catgtgtgcctgtg

SEQ ID NO: 1473794 - DNA, 20 bp, Homo sapiens
catgtgtgtgtctgtctttg

SEQ ID NO: 1473795 - DNA, 13 bp, Homo sapiens
catgtgttaaaat

SEQ ID NO: 1473796 - DNA, 17 bp, Homo sapiens
catgtgttaaaatactc

SEQ ID NO: 1473797 - DNA, 20 bp, Homo sapiens
catgtgttgcaaattattct

SEQ ID NO: 1473798 - DNA, 21 bp, Homo sapiens
catgtgttgcaaattattcta

SEQ ID NO: 1473799 - DNA, 15 bp, Homo sapiens
catgttaaattagaa

SEQ ID NO: 1473800 - DNA, 16 bp, Homo sapiens
catgttaagttacagt

SEQ ID NO: 1473801 - DNA, 17 bp, Homo sapiens
catgttaatgaacagtg

SEQ ID NO: 1473802 - DNA, 16 bp, Homo sapiens
catgttacataagata

SEQ ID NO: 1473803 - DNA, 17 bp, Homo sapiens
catgttacctcctataa

SEQ ID NO: 1473804 - DNA, 23 bp, Homo sapiens
cattctttttgctctaaaatatt

SEQ ID NO: 1473805 - DNA, 14 bp, Homo sapiens
cattgaaagtgctt

SEQ ID NO: 1473806 - DNA, 17 bp, Homo sapiens
cattgaagccgactctg

SEQ ID NO: 1473807 - DNA, 18 bp, Homo sapiens
cattgaagccgactctgg

SEQ ID NO: 1473808 - DNA, 21 bp, Homo sapiens
cattgaagccgactctggccc

SEQ ID NO: 1473809 - DNA, 23 bp, Homo sapiens
cattgaagccgactctggccctg

SEQ ID NO: 1473810 - DNA, 23 bp, Homo sapiens
cattgaaggaaagctatatctat

SEQ ID NO: 1473811 - DNA, 16 bp, Homo sapiens
cattgaccaagaactg

SEQ ID NO: 1473812 - DNA, 20 bp, Homo sapiens
cattgaccagctctcttcct

SEQ ID NO: 1473813 - DNA, 16 bp, Homo sapiens
cattgacctcatcatt

SEQ ID NO: 1473814 - DNA, 14 bp, Homo sapiens
cattgacttcttgg

SEQ ID NO: 1473815 - DNA, 19 bp, Homo sapiens
cattgagcttgcatgcttg

SEQ ID NO: 1473816 - DNA, 22 bp, Homo sapiens
cattgagtattgtttaaaatgt

SEQ ID NO: 1473817 - DNA, 18 bp, Homo sapiens
cattgatgggatttttgt

SEQ ID NO: 1473818 - DNA, 19 bp, Homo sapiens
cattgatgggatttttgtt

SEQ ID NO: 1473819 - DNA, 16 bp, Homo sapiens
cattgattgtcagcta

SEQ ID NO: 1473820 - DNA, 18 bp, Homo sapiens
cattgattgtcagctact

SEQ ID NO: 1473821 - DNA, 21 bp, Homo sapiens
cattgcacataagcttccatt

SEQ ID NO: 1473822 - DNA, 13 bp, Homo sapiens
cattgcacctgca

SEQ ID NO: 1473823 - DNA, 12 bp, Homo sapiens
cattgcactcca

SEQ ID NO: 1473824 - DNA, 16 bp, Homo sapiens
cattgcactccagcct

SEQ ID NO: 1473825 - DNA, 23 bp, Homo sapiens
cattgcactctagcctggcaaca

SEQ ID NO: 1473826 - DNA, 13 bp, Homo sapiens
cattgcagcttca

SEQ ID NO: 1473827 - DNA, 18 bp, Homo sapiens
cattgcagttagccccag

SEQ ID NO: 1473828 - DNA, 12 bp, Homo sapiens
cattgcagttta

SEQ ID NO: 1473829 - DNA, 21 bp, Homo sapiens
cattgccccagacctggaaga

SEQ ID NO: 1473830 - DNA, 12 bp, Homo sapiens
cattgccctggt

SEQ ID NO: 1473831 - DNA, 13 bp, Homo sapiens
cattgcctcctgt

SEQ ID NO: 1473832 - DNA, 22 bp, Homo sapiens
cattgcctcctgttctgcccac

SEQ ID NO: 1473833 - DNA, 23 bp, Homo sapiens
cattgcctcctgttctgcccacg

SEQ ID NO: 1473834 - DNA, 12 bp, Homo sapiens
cattgcctggac

SEQ ID NO: 1473835 - DNA, 17 bp, Homo sapiens
cattgcctggactgacc

SEQ ID NO: 1473836 - DNA, 14 bp, Homo sapiens
cattgcctgtaaca

SEQ ID NO: 1473837 - DNA, 17 bp, Homo sapiens
cattgcctgtaacaatg

SEQ ID NO: 1473838 - DNA, 16 bp, Homo sapiens
cattgcctgttctgct

SEQ ID NO: 1473839 - DNA, 23 bp, Homo sapiens
cattgccttctggagctgggaga

SEQ ID NO: 1473840 - DNA, 17 bp, Homo sapiens
cattgctaccacagact

SEQ ID NO: 1473841 - DNA, 17 bp, Homo sapiens
cattgctagataaaagc

SEQ ID NO: 1473842 - DNA, 16 bp, Homo sapiens
cattgctcagcccgct

SEQ ID NO: 1473843 - DNA, 21 bp, Homo sapiens
cattgctctatgtctgccttc

SEQ ID NO: 1473844 - DNA, 14 bp, Homo sapiens
cattgctgagcctc

SEQ ID NO: 1473845 - DNA, 16 bp, Homo sapiens
cattgctgagcctctg

SEQ ID NO: 1473846 - DNA, 21 bp, Homo sapiens
cattgctgagcctctgctccc

SEQ ID NO: 1473847 - DNA, 21 bp, Homo sapiens
cattgctgctgctaccagcgc

SEQ ID NO: 1473848 - DNA, 19 bp, Homo sapiens
cattgctggtagagacccc

SEQ ID NO: 1473849 - DNA, 20 bp, Homo sapiens
cattgctggtagagaccccc

SEQ ID NO: 1473850 - DNA, 23 bp, Homo sapiens
cattgctggtagagacccccagg

SEQ ID NO: 1473851 - DNA, 11 bp, Homo sapiens
cattgctgtgt

SEQ ID NO: 1473852 - DNA, 17 bp, Homo sapiens
cattgctttactgtcaa

SEQ ID NO: 1473853 - DNA, 17 bp, Homo sapiens
cattggaataaggcatg

SEQ ID NO: 1473854 - DNA, 16 bp, Homo sapiens
cattggaatgttctca

SEQ ID NO: 1473855 - DNA, 22 bp, Homo sapiens
cattggagaagcggtggataac

SEQ ID NO: 1473856 - DNA, 15 bp, Homo sapiens
cattggagagctgtc

SEQ ID NO: 1473857 - DNA, 16 bp, Homo sapiens
cattggagagctgtct

SEQ ID NO: 1473858 - DNA, 23 bp, Homo sapiens
cattggagagctgtcttcctgtg

SEQ ID NO: 1473859 - DNA, 17 bp, Homo sapiens
cattggagcattttcaa

SEQ ID NO: 1473860 - DNA, 10 bp, Homo sapiens
cattggagct

SEQ ID NO: 1473861 - DNA, 11 bp, Homo sapiens
cattggatatt

SEQ ID NO: 1473862 - DNA, 18 bp, Homo sapiens
cattggatattttttact

SEQ ID NO: 1473863 - DNA, 15 bp, Homo sapiens
cattggcccctgagc

SEQ ID NO: 1473864 - DNA, 16 bp, Homo sapiens
cattggcctctgtacc

SEQ ID NO: 1473865 - DNA, 20 bp, Homo sapiens
cattggcctctgtgtacaaa

SEQ ID NO: 1473866 - DNA, 11 bp, Homo sapiens
cattggcctgg

SEQ ID NO: 1473867 - DNA, 13 bp, Homo sapiens
cattggcctggcc

SEQ ID NO: 1473868 - DNA, 16 bp, Homo sapiens
cattggcctggcctcc

SEQ ID NO: 1473869 - DNA, 17 bp, Homo sapiens
cattgggctcacttcta

SEQ ID NO: 1473870 - DNA, 23 bp, Homo sapiens
cattggggtagttgtgtttcaac

SEQ ID NO: 1473871 - DNA, 19 bp, Homo sapiens
cattgggtgggtaaattca

SEQ ID NO: 1473872 - DNA, 13 bp, Homo sapiens
cattgtaaaataa

SEQ ID NO: 1473873 - DNA, 19 bp, Homo sapiens
cattgtacgaagagtattt

SEQ ID NO: 1473874 - DNA, 20 bp, Homo sapiens
cattgtacgaagagtatttt

SEQ ID NO: 1473875 - DNA, 13 bp, Homo sapiens
cattgtactccag

SEQ ID NO: 1473876 - DNA, 18 bp, Homo sapiens
cattgtactccagcctgg

SEQ ID NO: 1473877 - DNA, 16 bp, Homo sapiens
cattgtatgcagggag

SEQ ID NO: 1473878 - DNA, 14 bp, Homo sapiens
cattgtcctccttt

SEQ ID NO: 1473879 - DNA, 16 bp, Homo sapiens
cattgtcctccttttc

SEQ ID NO: 1473880 - DNA, 21 bp, Homo sapiens
cattgtcctccttttcacttt

SEQ ID NO: 1473881 - DNA, 11 bp, Homo sapiens
cattgtcctgt

SEQ ID NO: 1473882 - DNA, 22 bp, Homo sapiens
cattgtcgtataggcatgtaaa

SEQ ID NO: 1473883 - DNA, 13 bp, Homo sapiens
cattgtggctcct

SEQ ID NO: 1473884 - DNA, 16 bp, Homo sapiens
cattgtggctcctatc

SEQ ID NO: 1473885 - DNA, 21 bp, Homo sapiens
cattgtgggatgttcagcact

SEQ ID NO: 1473886 - DNA, 19 bp, Homo sapiens
cattgttataattactaat

SEQ ID NO: 1473887 - DNA, 19 bp, Homo sapiens
cattgttattgtggaagat

SEQ ID NO: 1473888 - DNA, 18 bp, Homo sapiens
cattgttatttaatagct

SEQ ID NO: 1473889 - DNA, 15 bp, Homo sapiens
cattgttatttatac

SEQ ID NO: 1473890 - DNA, 20 bp, Homo sapiens
cattgttcttattctggcat

SEQ ID NO: 1473891 - DNA, 19 bp, Homo sapiens
cattgttgtttttttaata

SEQ ID NO: 1473892 - DNA, 14 bp, Homo sapiens
cattgtttgctgct

SEQ ID NO: 1473893 - DNA, 15 bp, Homo sapiens
cattgtttgtttgta

SEQ ID NO: 1473894 - DNA, 16 bp, Homo sapiens
cattgttttaaaaaga

SEQ ID NO: 1473895 - DNA, 17 bp, Homo sapiens
cattgttttaaaaagaa

SEQ ID NO: 1473896 - DNA, 14 bp, Homo sapiens
cattgttttgaaac

SEQ ID NO: 1473897 - DNA, 15 bp, Homo sapiens
cattgttttgcaaaa

SEQ ID NO: 1473898 - DNA, 21 bp, Homo sapiens
cattgtttttaagaaaaacat

SEQ ID NO: 1473899 - DNA, 13 bp, Homo sapiens
catttaaaacaga

SEQ ID NO: 1473900 - DNA, 12 bp, Homo sapiens
catttaaaagca

SEQ ID NO: 1473901 - DNA, 24 bp, Homo sapiens
catttaaaataccactgtaattga

SEQ ID NO: 1473902 - DNA, 13 bp, Homo sapiens
catttaaaatgat

SEQ ID NO: 1473903 - DNA, 17 bp, Homo sapiens
catttaaaatgattaga

SEQ ID NO: 1473904 - DNA, 14 bp, Homo sapiens
catttaaaatggaa

SEQ ID NO: 1473905 - DNA, 15 bp, Homo sapiens
catttaaaattgcta

SEQ ID NO: 1473906 - DNA, 18 bp, Homo sapiens
catttaaatgtaacttat

SEQ ID NO: 1473907 - DNA, 12 bp, Homo sapiens
catttaaatttt

SEQ ID NO: 1473908 - DNA, 23 bp, Homo sapiens
catttaagtatcttgtgcttctt

SEQ ID NO: 1473909 - DNA, 18 bp, Homo sapiens
catttaataaagatgagt

SEQ ID NO: 1473910 - DNA, 15 bp, Homo sapiens
catttaatacagata

SEQ ID NO: 1473911 - DNA, 13 bp, Homo sapiens
catttacaaataa

SEQ ID NO: 1473912 - DNA, 12 bp, Homo sapiens
catttacatgta

SEQ ID NO: 1473913 - DNA, 20 bp, Homo sapiens
catttacattaggtattaca

SEQ ID NO: 1473914 - DNA, 22 bp, Homo sapiens
catttagaaaatagagctttta

SEQ ID NO: 1473915 - DNA, 12 bp, Homo sapiens
catttagaactt

SEQ ID NO: 1473916 - DNA, 10 bp, Homo sapiens
catttagaat

SEQ ID NO: 1473917 - DNA, 17 bp, Homo sapiens
catttagaatctagaaa

SEQ ID NO: 1473918 - DNA, 18 bp, Homo sapiens
catttagaatctagaaat

SEQ ID NO: 1473919 - DNA, 20 bp, Homo sapiens
catttggtgctggtctattt

SEQ ID NO: 1473920 - DNA, 20 bp, Homo sapiens
catttggtgttcctggaagc

SEQ ID NO: 1473921 - DNA, 20 bp, Homo sapiens
catttgtaagtgtaaaaaat

SEQ ID NO: 1473922 - DNA, 12 bp, Homo sapiens
catttgtaataa

SEQ ID NO: 1473923 - DNA, 13 bp, Homo sapiens
catttgtaataaa

SEQ ID NO: 1473924 - DNA, 15 bp, Homo sapiens
catttgtatattgtg

SEQ ID NO: 1473925 - DNA, 20 bp, Homo sapiens
catttgtatgtcaaagcttt

SEQ ID NO: 1473926 - DNA, 19 bp, Homo sapiens
catttgtattccattgatt

SEQ ID NO: 1473927 - DNA, 18 bp, Homo sapiens
catttgtattgcttattt

SEQ ID NO: 1473928 - DNA, 19 bp, Homo sapiens
catttgtattgcttatttt

SEQ ID NO: 1473929 - DNA, 15 bp, Homo sapiens
catttgtattttgtg

SEQ ID NO: 1473930 - DNA, 19 bp, Homo sapiens
catttgtattttgtgatga

SEQ ID NO: 1473931 - DNA, 21 bp, Homo sapiens
catttgtattttgtgatgaat

SEQ ID NO: 1473932 - DNA, 14 bp, Homo sapiens
catttgtcacagaa

SEQ ID NO: 1473933 - DNA, 21 bp, Homo sapiens
catttgtcagtatttttgccg

SEQ ID NO: 1473934 - DNA, 16 bp, Homo sapiens
catttgtctctacttt

SEQ ID NO: 1473935 - DNA, 21 bp, Homo sapiens
catttgtgctagaaattttca

SEQ ID NO: 1473936 - DNA, 16 bp, Homo sapiens
catttgtggcaattaa

SEQ ID NO: 1473937 - DNA, 18 bp, Homo sapiens
catttgtggcagtccctt

SEQ ID NO: 1473938 - DNA, 21 bp, Homo sapiens
catttgtggtaatctacacca

SEQ ID NO: 1473939 - DNA, 15 bp, Homo sapiens
catttgtgtggaaat

SEQ ID NO: 1473940 - DNA, 22 bp, Homo sapiens
catttgttaaaattatcaatat

SEQ ID NO: 1473941 - DNA, 14 bp, Homo sapiens
catttgttcactga

SEQ ID NO: 1473942 - DNA, 17 bp, Homo sapiens
catttgttcctgcttcc

SEQ ID NO: 1473943 - DNA, 13 bp, Homo sapiens
catttgttcctgg

SEQ ID NO: 1473944 - DNA, 12 bp, Homo sapiens
catttgttttag

SEQ ID NO: 1473945 - DNA, 21 bp, Homo sapiens
catttgttttagcattaccta

SEQ ID NO: 1473946 - DNA, 13 bp, Homo sapiens
catttgttttgct

SEQ ID NO: 1473947 - DNA, 14 bp, Homo sapiens
catttgttttgctt

SEQ ID NO: 1473948 - DNA, 15 bp, Homo sapiens
catttgttttgcttt

SEQ ID NO: 1473949 - DNA, 13 bp, Homo sapiens
cattttaaaaaca

SEQ ID NO: 1473950 - DNA, 19 bp, Homo sapiens
cattttaagtttgtagtaa

SEQ ID NO: 1473951 - DNA, 17 bp, Homo sapiens
cattttaattattattc

SEQ ID NO: 1473952 - DNA, 20 bp, Homo sapiens
cattttacagagaaagaaat

SEQ ID NO: 1473953 - DNA, 21 bp, Homo sapiens
cattttactactgagggaaat

SEQ ID NO: 1473954 - DNA, 17 bp, Homo sapiens
cattttactttttcctg

SEQ ID NO: 1473955 - DNA, 22 bp, Homo sapiens
cattttactttttcctggctca

SEQ ID NO: 1473956 - DNA, 21 bp, Homo sapiens
cattttagcccagtgttttct

SEQ ID NO: 1473957 - DNA, 23 bp, Homo sapiens
cattttaggaaaaaaaaaagcat

SEQ ID NO: 1473958 - DNA, 15 bp, Homo sapiens
cattttagtgactgt

SEQ ID NO: 1473959 - DNA, 22 bp, Homo sapiens
cattttatatttttgtacatat

SEQ ID NO: 1473960 - DNA, 20 bp, Homo sapiens
cattttatcattaaaaatta

SEQ ID NO: 1473961 - DNA, 11 bp, Homo sapiens
cattttatgca

SEQ ID NO: 1473962 - DNA, 22 bp, Homo sapiens
cattttattaataatatttatg

SEQ ID NO: 1473963 - DNA, 17 bp, Homo sapiens
cattttcaactgctttg

SEQ ID NO: 1473964 - DNA, 20 bp, Homo sapiens
cattttcagtcgttgtgctt

SEQ ID NO: 1473965 - DNA, 17 bp, Homo sapiens
cattttccatatcctgg

SEQ ID NO: 1473966 - DNA, 19 bp, Homo sapiens
cattttccatatcctggtg

SEQ ID NO: 1473967 - DNA, 12 bp, Homo sapiens
cattttcccaga

SEQ ID NO: 1473968 - DNA, 14 bp, Homo sapiens
cattttcccatcat

SEQ ID NO: 1473969 - DNA, 20 bp, Homo sapiens
cattttcccatcatcctttg

SEQ ID NO: 1473970 - DNA, 21 bp, Homo sapiens
cattttcccccactactgcag

SEQ ID NO: 1473971 - DNA, 20 bp, Homo sapiens
cattttcctgacatttgttt

SEQ ID NO: 1473972 - DNA, 20 bp, Homo sapiens
cattttcctttccttgtggt

SEQ ID NO: 1473973 - DNA, 12 bp, Homo sapiens
cattttctaaat

SEQ ID NO: 1473974 - DNA, 23 bp, Homo sapiens
cattttctggccagtgtttaaaa

SEQ ID NO: 1473975 - DNA, 22 bp, Homo sapiens
cattttctggtttggcatggtg

SEQ ID NO: 1473976 - DNA, 22 bp, Homo sapiens
cattttcttcagagagctaaat

SEQ ID NO: 1473977 - DNA, 17 bp, Homo sapiens
cattttcttttttaacc

SEQ ID NO: 1473978 - DNA, 22 bp, Homo sapiens
cattttctttttttaactggtg

SEQ ID NO: 1473979 - DNA, 14 bp, Homo sapiens
cattttgaaacaaa

SEQ ID NO: 1473980 - DNA, 15 bp, Homo sapiens
cattttgaaggaaaa

SEQ ID NO: 1473981 - DNA, 16 bp, Homo sapiens
cattttgaaggaaaat

SEQ ID NO: 1473982 - DNA, 21 bp, Homo sapiens
cattttgagctgaaatgctgc

SEQ ID NO: 1473983 - DNA, 21 bp, Homo sapiens
cattttgaggttttgtaaaac

SEQ ID NO: 1473984 - DNA, 14 bp, Homo sapiens
cattttgcaaaatt

SEQ ID NO: 1473985 - DNA, 12 bp, Homo sapiens
cattttgcttta

SEQ ID NO: 1473986 - DNA, 13 bp, Homo sapiens
cattttgctttaa

SEQ ID NO: 1473987 - DNA, 18 bp, Homo sapiens
cattttgctttaatttta

SEQ ID NO: 1473988 - DNA, 22 bp, Homo sapiens
cattttggagagtttcctgaaa

SEQ ID NO: 1473989 - DNA, 19 bp, Homo sapiens
cattttgtatggagttaaa

SEQ ID NO: 1473990 - DNA, 21 bp, Homo sapiens
cattttgtgttgaagagcagc

SEQ ID NO: 1473991 - DNA, 15 bp, Homo sapiens
cattttgtttctgta

SEQ ID NO: 1473992 - DNA, 15 bp, Homo sapiens
catttttaaacttga

SEQ ID NO: 1473993 - DNA, 19 bp, Homo sapiens
catttttaaacttgaaata

SEQ ID NO: 1473994 - DNA, 14 bp, Homo sapiens
catttttaaattct

SEQ ID NO: 1473995 - DNA, 22 bp, Homo sapiens
catttttaaattcttactctgg

SEQ ID NO: 1473996 - DNA, 18 bp, Homo sapiens
catttttaatattactgt

SEQ ID NO: 1473997 - DNA, 23 bp, Homo sapiens
catttttaatattactgtcttta

SEQ ID NO: 1473998 - DNA, 15 bp, Homo sapiens
catttttaatcatga

SEQ ID NO: 1473999 - DNA, 22 bp, Homo sapiens
catttttaatgtatctatttgt

SEQ ID NO: 1474000 - DNA, 15 bp, Homo sapiens
catttttacaataaa

SEQ ID NO: 1474001 - DNA, 22 bp, Homo sapiens
catttttataacctggcaaaat

SEQ ID NO: 1474002 - DNA, 21 bp, Homo sapiens
catttttcaaaaagtaaaaag

SEQ ID NO: 1474003 - DNA, 14 bp, Homo sapiens
catttttcaatata

SEQ ID NO: 1474004 - DNA, 23 bp, Homo sapiens
catttttctataaatcagtattt

SEQ ID NO: 1474005 - DNA, 14 bp, Homo sapiens
catttttcttattt

SEQ ID NO: 1474006 - DNA, 14 bp, Homo sapiens
catttttgagccaa

SEQ ID NO: 1474007 - DNA, 14 bp, Homo sapiens
catttttgtatttt

SEQ ID NO: 1474008 - DNA, 18 bp, Homo sapiens
cattttttaaaaaagcaa

SEQ ID NO: 1474009 - DNA, 18 bp, Homo sapiens
cattttttaagaaaacat

SEQ ID NO: 1474010 - DNA, 18 bp, Homo sapiens
cattttttaaggaaacaa

SEQ ID NO: 1474011 - DNA, 23 bp, Homo sapiens
cattttttaatttacttgttttg

SEQ ID NO: 1474012 - DNA, 20 bp, Homo sapiens
cattttttaggacatcttaa

SEQ ID NO: 1474013 - DNA, 20 bp, Homo sapiens
cattttttatatatatgcat

SEQ ID NO: 1474014 - DNA, 22 bp, Homo sapiens
cattttttatggctgcatagta

SEQ ID NO: 1474015 - DNA, 18 bp, Homo sapiens
catttttttctctctgga

SEQ ID NO: 1474016 - DNA, 23 bp, Homo sapiens
catttttttctctctggagcccc

SEQ ID NO: 1474017 - DNA, 15 bp, Homo sapiens
ccaaaaaaaggaaaa

SEQ ID NO: 1474018 - DNA, 18 bp, Homo sapiens
ccaaaaaggcaaataatg

SEQ ID NO: 1474019 - DNA, 23 bp, Homo sapiens
ccaaaaaggttgctgtttcacaa

SEQ ID NO: 1474020 - DNA, 16 bp, Homo sapiens
ccaaaaataaatatat

SEQ ID NO: 1474021 - DNA, 13 bp, Homo sapiens
ccaaaaatagaaa

SEQ ID NO: 1474022 - DNA, 16 bp, Homo sapiens
ccaaaaatagaaatta

SEQ ID NO: 1474023 - DNA, 19 bp, Homo sapiens
ccaaaaatgtgtaagaaca

SEQ ID NO: 1474024 - DNA, 19 bp, Homo sapiens
ccaaaacaagccaaagagc

SEQ ID NO: 1474025 - DNA, 13 bp, Homo sapiens
ccaaaacatttct

SEQ ID NO: 1474026 - DNA, 16 bp, Homo sapiens
ccaaaacccagggcaa

SEQ ID NO: 1474027 - DNA, 17 bp, Homo sapiens
ccaaaaccctgaagcca

SEQ ID NO: 1474028 - DNA, 23 bp, Homo sapiens
ccaaaacctcatgacagccagag

SEQ ID NO: 1474029 - DNA, 15 bp, Homo sapiens
ccaaaacctgcttcc

SEQ ID NO: 1474030 - DNA, 12 bp, Homo sapiens
ccaaaactgctc

SEQ ID NO: 1474031 - DNA, 11 bp, Homo sapiens
ccaaaactgtg

SEQ ID NO: 1474032 - DNA, 16 bp, Homo sapiens
ccaaaactgtgcagag

SEQ ID NO: 1474033 - DNA, 14 bp, Homo sapiens
ccaacactgtgccc

SEQ ID NO: 1474034 - DNA, 17 bp, Homo sapiens
ccaacactgtgccctgg

SEQ ID NO: 1474035 - DNA, 12 bp, Homo sapiens
ccaacacttcca

SEQ ID NO: 1474036 - DNA, 13 bp, Homo sapiens
ccaacagagtgga

SEQ ID NO: 1474037 - DNA, 15 bp, Homo sapiens
ccaacagcaagtgtt

SEQ ID NO: 1474038 - DNA, 17 bp, Homo sapiens
ccaacagcacctccccg

SEQ ID NO: 1474039 - DNA, 14 bp, Homo sapiens
ccaacagcagtgat

SEQ ID NO: 1474040 - DNA, 12 bp, Homo sapiens
ccaacagccatg

SEQ ID NO: 1474041 - DNA, 18 bp, Homo sapiens
ccaacatccagtcctgct

SEQ ID NO: 1474042 - DNA, 20 bp, Homo sapiens
ccaacatcccattgccctgg

SEQ ID NO: 1474043 - DNA, 16 bp, Homo sapiens
ccaacatgaggacaga

SEQ ID NO: 1474044 - DNA, 18 bp, Homo sapiens
ccaacatgaggacagaag

SEQ ID NO: 1474045 - DNA, 21 bp, Homo sapiens
ccaacatgcactgatgttgtg

SEQ ID NO: 1474046 - DNA, 23 bp, Homo sapiens
ccaacatgcactgatgttgtgtt

SEQ ID NO: 1474047 - DNA, 15 bp, Homo sapiens
ccaacatggagaaac

SEQ ID NO: 1474048 - DNA, 20 bp, Homo sapiens
ccaacatggtgaaaccccca

SEQ ID NO: 1474049 - DNA, 15 bp, Homo sapiens
ccaaccaaataagac

SEQ ID NO: 1474050 - DNA, 12 bp, Homo sapiens
ccaaccagcccg

SEQ ID NO: 1474051 - DNA, 13 bp, Homo sapiens
ccaaccagcccga

SEQ ID NO: 1474052 - DNA, 20 bp, Homo sapiens
ccaaccagcccgacagtgcc

SEQ ID NO: 1474053 - DNA, 21 bp, Homo sapiens
ccaaccagcccgacagtgcca

SEQ ID NO: 1474054 - DNA, 22 bp, Homo sapiens
ccaaccaggccttcatcctcct

SEQ ID NO: 1474055 - DNA, 14 bp, Homo sapiens
ccaacccatcagaa

SEQ ID NO: 1474056 - DNA, 16 bp, Homo sapiens
ccaaccccaacaattg

SEQ ID NO: 1474057 - DNA, 16 bp, Homo sapiens
ccaacccccaccccac

SEQ ID NO: 1474058 - DNA, 19 bp, Homo sapiens
ccaacccccaccccacact

SEQ ID NO: 1474059 - DNA, 18 bp, Homo sapiens
ccaaccccccacctgcca

SEQ ID NO: 1474060 - DNA, 13 bp, Homo sapiens
ccaaccccccagc

SEQ ID NO: 1474061 - DNA, 14 bp, Homo sapiens
ccaacccccctcct

SEQ ID NO: 1474062 - DNA, 15 bp, Homo sapiens
ccaacccccctcctg

SEQ ID NO: 1474063 - DNA, 17 bp, Homo sapiens
ccaacccccctcctgct

SEQ ID NO: 1474064 - DNA, 18 bp, Homo sapiens
ccaacccccctcctgctc

SEQ ID NO: 1474065 - DNA, 21 bp, Homo sapiens
ccaacccctgacctaccccag

SEQ ID NO: 1474066 - DNA, 15 bp, Homo sapiens
ccaacccgaggcccg

SEQ ID NO: 1474067 - DNA, 19 bp, Homo sapiens
ccaaccctatctcctgaca

SEQ ID NO: 1474068 - DNA, 20 bp, Homo sapiens
ccaaccctatctcctgacag

SEQ ID NO: 1474069 - DNA, 14 bp, Homo sapiens
ccaaccctcagagc

SEQ ID NO: 1474070 - DNA, 15 bp, Homo sapiens
ccaaccctcagagcc

SEQ ID NO: 1474071 - DNA, 20 bp, Homo sapiens
ccaaccctgggctggggagg

SEQ ID NO: 1474072 - DNA, 21 bp, Homo sapiens
ccaaccctgggctggggagga

SEQ ID NO: 1474073 - DNA, 16 bp, Homo sapiens
ccaaccctggggaagg

SEQ ID NO: 1474074 - DNA, 20 bp, Homo sapiens
ccaaccctggggaaggagcc

SEQ ID NO: 1474075 - DNA, 13 bp, Homo sapiens
ccaaccctgtggg

SEQ ID NO: 1474076 - DNA, 15 bp, Homo sapiens
ccaaccctgtgggct

SEQ ID NO: 1474077 - DNA, 18 bp, Homo sapiens
ccaacctaacccctttcc

SEQ ID NO: 1474078 - DNA, 15 bp, Homo sapiens
ccaacctcaatgccc

SEQ ID NO: 1474079 - DNA, 18 bp, Homo sapiens
ccaacctcaatgccctgc

SEQ ID NO: 1474080 - DNA, 11 bp, Homo sapiens
ccaacctcctg

SEQ ID NO: 1474081 - DNA, 16 bp, Homo sapiens
ccaacctcctgctctg

SEQ ID NO: 1474082 - DNA, 17 bp, Homo sapiens
ccaacctcctgctctgg

SEQ ID NO: 1474083 - DNA, 13 bp, Homo sapiens
ccaacctctggag

SEQ ID NO: 1474084 - DNA, 18 bp, Homo sapiens
ccaacctgcaaagatctg

SEQ ID NO: 1474085 - DNA, 12 bp, Homo sapiens
ccaacctggact

SEQ ID NO: 1474086 - DNA, 18 bp, Homo sapiens
ccaacctggacttcctgt

SEQ ID NO: 1474087 - DNA, 21 bp, Homo sapiens
ccaacctggacttcctgtcat

SEQ ID NO: 1474088 - DNA, 14 bp, Homo sapiens
ccaacgagacacat

SEQ ID NO: 1474089 - DNA, 13 bp, Homo sapiens
ccaacgcacagga

SEQ ID NO: 1474090 - DNA, 12 bp, Homo sapiens
ccaacgcccctg

SEQ ID NO: 1474091 - DNA, 13 bp, Homo sapiens
ccaacgcccctgt

SEQ ID NO: 1474092 - DNA, 15 bp, Homo sapiens
ccaacgcccctgtgg

SEQ ID NO: 1474093 - DNA, 16 bp, Homo sapiens
ccaacgcccctgtggc

SEQ ID NO: 1474094 - DNA, 17 bp, Homo sapiens
ccaacgcccctgtggcc

SEQ ID NO: 1474095 - DNA, 18 bp, Homo sapiens
ccaacgcccctgtggcca

SEQ ID NO: 1474096 - DNA, 21 bp, Homo sapiens
ccaacgcccctgtggccaact

SEQ ID NO: 1474097 - DNA, 23 bp, Homo sapiens
ccaacgccgccttggccttgcag

SEQ ID NO: 1474098 - DNA, 20 bp, Homo sapiens
ccaacggccctgcagccagc

SEQ ID NO: 1474099 - DNA, 14 bp, Homo sapiens
ccaacgtcccctcc

SEQ ID NO: 1474100 - DNA, 17 bp, Homo sapiens
ccaacgtggacctgcct

SEQ ID NO: 1474101 - DNA, 23 bp, Homo sapiens
ccaactacaaccaagctctctgc

SEQ ID NO: 1474102 - DNA, 15 bp, Homo sapiens
ccaactactactggt

SEQ ID NO: 1474103 - DNA, 17 bp, Homo sapiens
ccaactagcccctgggg

SEQ ID NO: 1474104 - DNA, 23 bp, Homo sapiens
ccaactccatggggttcgagact

SEQ ID NO: 1474105 - DNA, 20 bp, Homo sapiens
ccaactcctttcagccacat

SEQ ID NO: 1474106 - DNA, 19 bp, Homo sapiens
ccaactctccccagtgcct

SEQ ID NO: 1474107 - DNA, 20 bp, Homo sapiens
ccaactctccccagtgcctg

SEQ ID NO: 1474108 - DNA, 17 bp, Homo sapiens
ccaactgatcctgctcc

SEQ ID NO: 1474109 - DNA, 20 bp, Homo sapiens
ccaactgatcctgctccagc

SEQ ID NO: 1474110 - DNA, 21 bp, Homo sapiens
ccaactgatcctgctccagca

SEQ ID NO: 1474111 - DNA, 22 bp, Homo sapiens
ccaactgatcctgctccagcag

SEQ ID NO: 1474112 - DNA, 15 bp, Homo sapiens
ccaactgatctgtta

SEQ ID NO: 1474113 - DNA, 21 bp, Homo sapiens
ccaactgcaaaaaaagcctcc

SEQ ID NO: 1474114 - DNA, 22 bp, Homo sapiens
ccaactgcaaaaaaagcctcca

SEQ ID NO: 1474115 - DNA, 16 bp, Homo sapiens
ccaactgccaggctgc

SEQ ID NO: 1474116 - DNA, 21 bp, Homo sapiens
ccaactgccctaagcccccag

SEQ ID NO: 1474117 - DNA, 18 bp, Homo sapiens
ccaactgcctaaggccct

SEQ ID NO: 1474118 - DNA, 20 bp, Homo sapiens
ccaactgggcatttcaatcc

SEQ ID NO: 1474119 - DNA, 17 bp, Homo sapiens
ccaactgggcccaagac

SEQ ID NO: 1474120 - DNA, 17 bp, Homo sapiens
ccaactgtttccctgct

SEQ ID NO: 1474121 - DNA, 17 bp, Homo sapiens
ccaacttcaccaccccc

SEQ ID NO: 1474122 - DNA, 21 bp, Homo sapiens
ccaacttcatttgatgctaaa

SEQ ID NO: 1474123 - DNA, 13 bp, Homo sapiens
ccaacttgccttt

SEQ ID NO: 1474124 - DNA, 16 bp, Homo sapiens
ccaacttgtctgggaa

SEQ ID NO: 1474125 - DNA, 17 bp, Homo sapiens
ccaactttatcatggaa

SEQ ID NO: 1474126 - DNA, 14 bp, Homo sapiens
ccaactttcacagt

SEQ ID NO: 1474127 - DNA, 21 bp, Homo sapiens
ccaagaaaaataattaaaaaa

SEQ ID NO: 1474128 - DNA, 12 bp, Homo sapiens
ccaagaaactga

SEQ ID NO: 1474129 - DNA, 18 bp, Homo sapiens
ccaagaaactgagaccaa

SEQ ID NO: 1474130 - DNA, 13 bp, Homo sapiens
ccaagaaagcagg

SEQ ID NO: 1474131 - DNA, 19 bp, Homo sapiens
ccaagaactctaaccagtg

SEQ ID NO: 1474132 - DNA, 20 bp, Homo sapiens
ccaagaactctaaccagtgt

SEQ ID NO: 1474133 - DNA, 18 bp, Homo sapiens
ccaagaatccacatttct

SEQ ID NO: 1474134 - DNA, 11 bp, Homo sapiens
ccaagaatgta

SEQ ID NO: 1474135 - DNA, 21 bp, Homo sapiens
ccaagaatgtacgtccagcct

SEQ ID NO: 1474136 - DNA, 14 bp, Homo sapiens
ccaagacagagtct

SEQ ID NO: 1474137 - DNA, 18 bp, Homo sapiens
ccaagacagatgccccag

SEQ ID NO: 1474138 - DNA, 13 bp, Homo sapiens
ccaagacattaat

SEQ ID NO: 1474139 - DNA, 17 bp, Homo sapiens
ccaagactcctcaggca

SEQ ID NO: 1474140 - DNA, 13 bp, Homo sapiens
ccaagactctaga

SEQ ID NO: 1474141 - DNA, 21 bp, Homo sapiens
ccaagactctagagtccaagg

SEQ ID NO: 1474142 - DNA, 13 bp, Homo sapiens
ccaagagaactcg

SEQ ID NO: 1474143 - DNA, 15 bp, Homo sapiens
ccaagagatctgtgt

SEQ ID NO: 1474144 - DNA, 20 bp, Homo sapiens
ccaagagatctgtgtggctc

SEQ ID NO: 1474145 - DNA, 20 bp, Homo sapiens
ccaagagcaaggaaggtaaa

SEQ ID NO: 1474146 - DNA, 22 bp, Homo sapiens
ccaagagcaaggaaggtaaaaa

SEQ ID NO: 1474147 - DNA, 19 bp, Homo sapiens
ccaagagcagaggcagcga

SEQ ID NO: 1474148 - DNA, 15 bp, Homo sapiens
ccacaccttggcctt

SEQ ID NO: 1474149 - DNA, 16 bp, Homo sapiens
ccacaccttggccttc

SEQ ID NO: 1474150 - DNA, 22 bp, Homo sapiens
ccacactaacctgggttccctt

SEQ ID NO: 1474151 - DNA, 23 bp, Homo sapiens
ccacactaacctgggttcccttt

SEQ ID NO: 1474152 - DNA, 18 bp, Homo sapiens
ccacactattaccatgag

SEQ ID NO: 1474153 - DNA, 16 bp, Homo sapiens
ccacactccactctga

SEQ ID NO: 1474154 - DNA, 17 bp, Homo sapiens
ccacactccactctgat

SEQ ID NO: 1474155 - DNA, 14 bp, Homo sapiens
ccacactccactga

SEQ ID NO: 1474156 - DNA, 16 bp, Homo sapiens
ccacactccactgaca

SEQ ID NO: 1474157 - DNA, 23 bp, Homo sapiens
ccacactcccaaggttggagccc

SEQ ID NO: 1474158 - DNA, 13 bp, Homo sapiens
ccacactctccat

SEQ ID NO: 1474159 - DNA, 15 bp, Homo sapiens
ccacactgaatctcc

SEQ ID NO: 1474160 - DNA, 19 bp, Homo sapiens
ccacactgatggctcaaga

SEQ ID NO: 1474161 - DNA, 18 bp, Homo sapiens
ccacactgccagaagaga

SEQ ID NO: 1474162 - DNA, 14 bp, Homo sapiens
ccacactgggcctg

SEQ ID NO: 1474163 - DNA, 16 bp, Homo sapiens
ccacacttgaaacctt

SEQ ID NO: 1474164 - DNA, 21 bp, Homo sapiens
ccacacttgttccagctcttt

SEQ ID NO: 1474165 - DNA, 13 bp, Homo sapiens
ccacactttgaag

SEQ ID NO: 1474166 - DNA, 14 bp, Homo sapiens
ccacactttgaagc

SEQ ID NO: 1474167 - DNA, 23 bp, Homo sapiens
ccacagaaccttcaacccagtgg

SEQ ID NO: 1474168 - DNA, 21 bp, Homo sapiens
ccacagaccacctgcttctga

SEQ ID NO: 1474169 - DNA, 14 bp, Homo sapiens
ccacagacttgcac

SEQ ID NO: 1474170 - DNA, 17 bp, Homo sapiens
ccacagacttgcactga

SEQ ID NO: 1474171 - DNA, 16 bp, Homo sapiens
ccacagagcaggaagc

SEQ ID NO: 1474172 - DNA, 16 bp, Homo sapiens
ccacagagtgagccag

SEQ ID NO: 1474173 - DNA, 18 bp, Homo sapiens
ccacagatgcctccaccc

SEQ ID NO: 1474174 - DNA, 21 bp, Homo sapiens
ccacagcaagccatcatcctc

SEQ ID NO: 1474175 - DNA, 18 bp, Homo sapiens
ccacagcagcagaacaag

SEQ ID NO: 1474176 - DNA, 15 bp, Homo sapiens
ccacagcatcgggag

SEQ ID NO: 1474177 - DNA, 18 bp, Homo sapiens
ccacagccagcacctggc

SEQ ID NO: 1474178 - DNA, 19 bp, Homo sapiens
ccacagccagcacctggca

SEQ ID NO: 1474179 - DNA, 12 bp, Homo sapiens
ccacagccatag

SEQ ID NO: 1474180 - DNA, 11 bp, Homo sapiens
ccacagccccc

SEQ ID NO: 1474181 - DNA, 18 bp, Homo sapiens
ccacagccgcagcctccc

SEQ ID NO: 1474182 - DNA, 19 bp, Homo sapiens
ccacagccttcggacagac

SEQ ID NO: 1474183 - DNA, 18 bp, Homo sapiens
ccacagcgagggcagctg

SEQ ID NO: 1474184 - DNA, 19 bp, Homo sapiens
ccacagcgagggcagctgc

SEQ ID NO: 1474185 - DNA, 20 bp, Homo sapiens
ccacagcggaggagaccagc

SEQ ID NO: 1474186 - DNA, 17 bp, Homo sapiens
ccacagcgtccctggcg

SEQ ID NO: 1474187 - DNA, 16 bp, Homo sapiens
ccacagctcccacccc

SEQ ID NO: 1474188 - DNA, 11 bp, Homo sapiens
ccacagctgct

SEQ ID NO: 1474189 - DNA, 14 bp, Homo sapiens
ccacagctgctgga

SEQ ID NO: 1474190 - DNA, 18 bp, Homo sapiens
ccacagctgctggccagg

SEQ ID NO: 1474191 - DNA, 23 bp, Homo sapiens
ccacagctgctggccagggtaga

SEQ ID NO: 1474192 - DNA, 14 bp, Homo sapiens
ccacagctgggcag

SEQ ID NO: 1474193 - DNA, 19 bp, Homo sapiens
ccacaggaacaacagcatc

SEQ ID NO: 1474194 - DNA, 22 bp, Homo sapiens
ccacaggaagcctgcagtcctg

SEQ ID NO: 1474195 - DNA, 19 bp, Homo sapiens
ccacaggaagctcagcctt

SEQ ID NO: 1474196 - DNA, 19 bp, Homo sapiens
ccacaggagggccagcgct

SEQ ID NO: 1474197 - DNA, 20 bp, Homo sapiens
ccacaggccccccgcagcac

SEQ ID NO: 1474198 - DNA, 15 bp, Homo sapiens
ccacaggcccttcct

SEQ ID NO: 1474199 - DNA, 23 bp, Homo sapiens
ccacaggcccttcctctccactg

SEQ ID NO: 1474200 - DNA, 14 bp, Homo sapiens
ccacaggcctgaga

SEQ ID NO: 1474201 - DNA, 22 bp, Homo sapiens
ccacaggcctgagatttcatct

SEQ ID NO: 1474202 - DNA, 17 bp, Homo sapiens
ccacagggcaaggacac

SEQ ID NO: 1474203 - DNA, 22 bp, Homo sapiens
ccacagggttcaaaatgtctgt

SEQ ID NO: 1474204 - DNA, 14 bp, Homo sapiens
ccacaggtctagac

SEQ ID NO: 1474205 - DNA, 18 bp, Homo sapiens
ccacagtacatatgtaat

SEQ ID NO: 1474206 - DNA, 15 bp, Homo sapiens
ccacagtactcactt

SEQ ID NO: 1474207 - DNA, 14 bp, Homo sapiens
ccacagtcactgga

SEQ ID NO: 1474208 - DNA, 15 bp, Homo sapiens
ccacagtcactggat

SEQ ID NO: 1474209 - DNA, 18 bp, Homo sapiens
ccacagtcagtggagcct

SEQ ID NO: 1474210 - DNA, 14 bp, Homo sapiens
ccacagtgccaccc

SEQ ID NO: 1474211 - DNA, 13 bp, Homo sapiens
ccacagtgctgct

SEQ ID NO: 1474212 - DNA, 13 bp, Homo sapiens
ccacagtgctggg

SEQ ID NO: 1474213 - DNA, 19 bp, Homo sapiens
ccacagtgggtggcacctc

SEQ ID NO: 1474214 - DNA, 22 bp, Homo sapiens
ccacagtgggtggcacctcctg

SEQ ID NO: 1474215 - DNA, 19 bp, Homo sapiens
ccacagtgttgtgcccctt

SEQ ID NO: 1474216 - DNA, 16 bp, Homo sapiens
ccacataaaagcccca

SEQ ID NO: 1474217 - DNA, 23 bp, Homo sapiens
ccacataattctgttactttgct

SEQ ID NO: 1474218 - DNA, 13 bp, Homo sapiens
ccacatagcatgc

SEQ ID NO: 1474219 - DNA, 23 bp, Homo sapiens
ccacatagcatgcttcctttctc

SEQ ID NO: 1474220 - DNA, 21 bp, Homo sapiens
ccacatagtgatggttcccct

SEQ ID NO: 1474221 - DNA, 22 bp, Homo sapiens
ccacatagtgatggttcccctg

SEQ ID NO: 1474222 - DNA, 19 bp, Homo sapiens
ccacatccaactccagcaa

SEQ ID NO: 1474223 - DNA, 16 bp, Homo sapiens
ccacatcccatcgtct

SEQ ID NO: 1474224 - DNA, 16 bp, Homo sapiens
ccacatccccagagcc

SEQ ID NO: 1474225 - DNA, 21 bp, Homo sapiens
ccacatccccagagcccagct

SEQ ID NO: 1474226 - DNA, 20 bp, Homo sapiens
ccacatcctccgtccagccg

SEQ ID NO: 1474227 - DNA, 14 bp, Homo sapiens
ccacatctgcatca

SEQ ID NO: 1474228 - DNA, 14 bp, Homo sapiens
ccacatgaaaccta

SEQ ID NO: 1474229 - DNA, 17 bp, Homo sapiens
ccacatgaggccatctc

SEQ ID NO: 1474230 - DNA, 16 bp, Homo sapiens
ccacatgccccaggct

SEQ ID NO: 1474231 - DNA, 20 bp, Homo sapiens
ccacatgccgcgtccctgcc

SEQ ID NO: 1474232 - DNA, 19 bp, Homo sapiens
ccacatgtgacacatatgc

SEQ ID NO: 1474233 - DNA, 16 bp, Homo sapiens
ccacattactttttat

SEQ ID NO: 1474234 - DNA, 17 bp, Homo sapiens
ccacattgctggctgcc

SEQ ID NO: 1474235 - DNA, 15 bp, Homo sapiens
ccacatttctaaaat

SEQ ID NO: 1474236 - DNA, 17 bp, Homo sapiens
ccacatttgggctcagg

SEQ ID NO: 1474237 - DNA, 18 bp, Homo sapiens
ccacatttgggctcaggg

SEQ ID NO: 1474238 - DNA, 15 bp, Homo sapiens
ccaccaaaactgctc

SEQ ID NO: 1474239 - DNA, 16 bp, Homo sapiens
ccaccaaactgcacac

SEQ ID NO: 1474240 - DNA, 22 bp, Homo sapiens
ccaccaaactgcacacacagct

SEQ ID NO: 1474241 - DNA, 24 bp, Homo sapiens
ccaccaaactgcacacacagctcc

SEQ ID NO: 1474242 - DNA, 12 bp, Homo sapiens
ccaccaaagctg

SEQ ID NO: 1474243 - DNA, 12 bp, Homo sapiens
ccaccaacccat

SEQ ID NO: 1474244 - DNA, 19 bp, Homo sapiens
ccaccaactctgcactcca

SEQ ID NO: 1474245 - DNA, 20 bp, Homo sapiens
ccaccaactctgcactccat

SEQ ID NO: 1474246 - DNA, 14 bp, Homo sapiens
ccaccaaggggctc

SEQ ID NO: 1474247 - DNA, 19 bp, Homo sapiens
ccaccaaggggctcttgaa

SEQ ID NO: 1474248 - DNA, 19 bp, Homo sapiens
ccaccaagggtatctgctg

SEQ ID NO: 1474249 - DNA, 20 bp, Homo sapiens
ccaccaataaatcagaccat

SEQ ID NO: 1474250 - DNA, 21 bp, Homo sapiens
ccaccaataaatcagaccatg

SEQ ID NO: 1474251 - DNA, 13 bp, Homo sapiens
ccaccacactgaa

SEQ ID NO: 1474252 - DNA, 14 bp, Homo sapiens
ccaccacagccagc

SEQ ID NO: 1474253 - DNA, 18 bp, Homo sapiens
ccaccacagccagcacct

SEQ ID NO: 1474254 - DNA, 20 bp, Homo sapiens
ccaccacagccagcacctgg

SEQ ID NO: 1474255 - DNA, 12 bp, Homo sapiens
ccaccacctagg

SEQ ID NO: 1474256 - DNA, 18 bp, Homo sapiens
ccaccacctaggccactc

SEQ ID NO: 1474257 - DNA, 20 bp, Homo sapiens
ccaccacctaggccactcct

SEQ ID NO: 1474258 - DNA, 22 bp, Homo sapiens
ccaccacctaggccactcctcc

SEQ ID NO: 1474259 - DNA, 21 bp, Homo sapiens
ccaccacgatgtggccctggc

SEQ ID NO: 1474260 - DNA, 17 bp, Homo sapiens
ccaccacgtctgccagg

SEQ ID NO: 1474261 - DNA, 18 bp, Homo sapiens
ccaccacgtctgccaggc

SEQ ID NO: 1474262 - DNA, 20 bp, Homo sapiens
ccaccacgtctgccaggccc

SEQ ID NO: 1474263 - DNA, 22 bp, Homo sapiens
ccaccacgtctgccaggcccat

SEQ ID NO: 1474264 - DNA, 20 bp, Homo sapiens
ccaccactaggactctgagg

SEQ ID NO: 1474265 - DNA, 23 bp, Homo sapiens
ccaccactggccaccaggctggc

SEQ ID NO: 1474266 - DNA, 11 bp, Homo sapiens
ccaccagcagc

SEQ ID NO: 1474267 - DNA, 12 bp, Homo sapiens
ccaccagcagca

SEQ ID NO: 1474268 - DNA, 14 bp, Homo sapiens
ccaccagcaggcag

SEQ ID NO: 1474269 - DNA, 14 bp, Homo sapiens
ccaccagcctgcac

SEQ ID NO: 1474270 - DNA, 16 bp, Homo sapiens
ccaccagcctgctgac

SEQ ID NO: 1474271 - DNA, 20 bp, Homo sapiens
ccaccaggagcagcagccag

SEQ ID NO: 1474272 - DNA, 21 bp, Homo sapiens
ccaccaggccacctccccagc

SEQ ID NO: 1474273 - DNA, 18 bp, Homo sapiens
ccaccatcaccaccgcct

SEQ ID NO: 1474274 - DNA, 15 bp, Homo sapiens
ccaccatcctgcagc

SEQ ID NO: 1474275 - DNA, 16 bp, Homo sapiens
ccaccatggccagcca

SEQ ID NO: 1474276 - DNA, 21 bp, Homo sapiens
ccaccatggccagccaacttt

SEQ ID NO: 1474277 - DNA, 12 bp, Homo sapiens
ccaccattccct

SEQ ID NO: 1474278 - DNA, 16 bp, Homo sapiens
ccaccattcctgcctt

SEQ ID NO: 1474279 - DNA, 15 bp, Homo sapiens
ccaccattgctggaa

SEQ ID NO: 1474280 - DNA, 20 bp, Homo sapiens
ccacccaagcctgctggctg

SEQ ID NO: 1474281 - DNA, 14 bp, Homo sapiens
ccacccaagcttgg

SEQ ID NO: 1474282 - DNA, 14 bp, Homo sapiens
ccacccacacagct

SEQ ID NO: 1474283 - DNA, 20 bp, Homo sapiens
ccacccacacagctgcccta

SEQ ID NO: 1474284 - DNA, 21 bp, Homo sapiens
ccacccacacagctgccctag

SEQ ID NO: 1474285 - DNA, 13 bp, Homo sapiens
ccacccacagcca

SEQ ID NO: 1474286 - DNA, 11 bp, Homo sapiens
ccacccagccc

SEQ ID NO: 1474287 - DNA, 18 bp, Homo sapiens
ccacccaggagggagggg

SEQ ID NO: 1474288 - DNA, 12 bp, Homo sapiens
ccacccagggaa

SEQ ID NO: 1474289 - DNA, 12 bp, Homo sapiens
ccacccaggtcc

SEQ ID NO: 1474290 - DNA, 22 bp, Homo sapiens
ccacccagtccatgctccaggg

SEQ ID NO: 1474291 - DNA, 16 bp, Homo sapiens
ccacccagtgctgcca

SEQ ID NO: 1474292 - DNA, 19 bp, Homo sapiens
ccacccagtgctgccatgc

SEQ ID NO: 1474293 - DNA, 14 bp, Homo sapiens
ccacccatcgctgt

SEQ ID NO: 1474294 - DNA, 19 bp, Homo sapiens
ccacccatcgtccacccca

SEQ ID NO: 1474295 - DNA, 21 bp, Homo sapiens
ccacccatcttcctgctgctg

SEQ ID NO: 1474296 - DNA, 16 bp, Homo sapiens
ccacccattcccccat

SEQ ID NO: 1474297 - DNA, 18 bp, Homo sapiens
ccaccccactccagccct

SEQ ID NO: 1474298 - DNA, 13 bp, Homo sapiens
ccacccccaaggt

SEQ ID NO: 1474299 - DNA, 13 bp, Homo sapiens
ccacccccagctc

SEQ ID NO: 1474300 - DNA, 21 bp, Homo sapiens
ccaccccccacgtctgtcctc

SEQ ID NO: 1474301 - DNA, 22 bp, Homo sapiens
ccaccccccagaacctgtcctt

SEQ ID NO: 1474302 - DNA, 18 bp, Homo sapiens
ccacccccgaccctgccc

SEQ ID NO: 1474303 - DNA, 20 bp, Homo sapiens
ccacccccgaccctgccctg

SEQ ID NO: 1474304 - DNA, 18 bp, Homo sapiens
ccacccccgccacggcca

SEQ ID NO: 1474305 - DNA, 16 bp, Homo sapiens
ccaccccctccccagg

SEQ ID NO: 1474306 - DNA, 19 bp, Homo sapiens
ccaccccctccccagggga

SEQ ID NO: 1474307 - DNA, 15 bp, Homo sapiens
ccaccccctcctccc

SEQ ID NO: 1474308 - DNA, 15 bp, Homo sapiens
ccaccccctgccctg

SEQ ID NO: 1474309 - DNA, 24 bp, Homo sapiens
ccaccccctgtcccattctagatc

SEQ ID NO: 1474310 - DNA, 18 bp, Homo sapiens
ccacccccttctctgctc

SEQ ID NO: 1474311 - DNA, 16 bp, Homo sapiens
ccaccccctttggttt

SEQ ID NO: 1474312 - DNA, 19 bp, Homo sapiens
ccaccccggccccctgccc

SEQ ID NO: 1474313 - DNA, 18 bp, Homo sapiens
ccaccccgggctctctgc

SEQ ID NO: 1474314 - DNA, 18 bp, Homo sapiens
ccaccccggggaccctgt

SEQ ID NO: 1474315 - DNA, 20 bp, Homo sapiens
ccaccccggggaccctgtga

SEQ ID NO: 1474316 - DNA, 21 bp, Homo sapiens
ccaccccggggaccctgtgac

SEQ ID NO: 1474317 - DNA, 14 bp, Homo sapiens
ccacccctcactcc

SEQ ID NO: 1474318 - DNA, 15 bp, Homo sapiens
ccacccctcactccc

SEQ ID NO: 1474319 - DNA, 13 bp, Homo sapiens
ccacccctccacg

SEQ ID NO: 1474320 - DNA, 15 bp, Homo sapiens
ccacccctccttcct

SEQ ID NO: 1474321 - DNA, 16 bp, Homo sapiens
ccacccctccttcctt

SEQ ID NO: 1474322 - DNA, 14 bp, Homo sapiens
ccacccctgcccag

SEQ ID NO: 1474323 - DNA, 22 bp, Homo sapiens
ccacccctgcccccagccccgg

SEQ ID NO: 1474324 - DNA, 14 bp, Homo sapiens
ccacccctgtgctc

SEQ ID NO: 1474325 - DNA, 14 bp, Homo sapiens
ccaccccttcccca

SEQ ID NO: 1474326 - DNA, 20 bp, Homo sapiens
ccaccccttggaggagagag

SEQ ID NO: 1474327 - DNA, 21 bp, Homo sapiens
ccaccccttggaggagagaga

SEQ ID NO: 1474328 - DNA, 12 bp, Homo sapiens
ccacccgcccga

SEQ ID NO: 1474329 - DNA, 15 bp, Homo sapiens
ccacccgccgcctcc

SEQ ID NO: 1474330 - DNA, 15 bp, Homo sapiens
ccacccgcctgcaga

SEQ ID NO: 1474331 - DNA, 18 bp, Homo sapiens
ccacccgcctgcagagag

SEQ ID NO: 1474332 - DNA, 21 bp, Homo sapiens
ccacccggccacagctgctgg

SEQ ID NO: 1474333 - DNA, 22 bp, Homo sapiens
ccacccggccacagctgctgga

SEQ ID NO: 1474334 - DNA, 19 bp, Homo sapiens
ccacccgttctgctggcct

SEQ ID NO: 1474335 - DNA, 17 bp, Homo sapiens
ccaccctcagcacccct

SEQ ID NO: 1474336 - DNA, 17 bp, Homo sapiens
ccaccctccatgctcct

SEQ ID NO: 1474337 - DNA, 15 bp, Homo sapiens
ccaccctcccctctc

SEQ ID NO: 1474338 - DNA, 13 bp, Homo sapiens
ccaccctcttccc

SEQ ID NO: 1474339 - DNA, 13 bp, Homo sapiens
ccaccctgcccct

SEQ ID NO: 1474340 - DNA, 18 bp, Homo sapiens
ccaccctgctgctggtgc

SEQ ID NO: 1474341 - DNA, 16 bp, Homo sapiens
ccaccctgggccctgg

SEQ ID NO: 1474342 - DNA, 22 bp, Homo sapiens
ccaccctgggccctgggctgga

SEQ ID NO: 1474343 - DNA, 17 bp, Homo sapiens
ccaccctgggctccaca

SEQ ID NO: 1474344 - DNA, 23 bp, Homo sapiens
ccaccctgggctccacacagcag

SEQ ID NO: 1474345 - DNA, 18 bp, Homo sapiens
ccaccctgtcccccagct

SEQ ID NO: 1474346 - DNA, 19 bp, Homo sapiens
ccaccctgtcccccagctc

SEQ ID NO: 1474347 - DNA, 12 bp, Homo sapiens
ccaccctgtggc

SEQ ID NO: 1474348 - DNA, 13 bp, Homo sapiens
ccacccttccatc

SEQ ID NO: 1474349 - DNA, 14 bp, Homo sapiens
ccacccttccatca

SEQ ID NO: 1474350 - DNA, 14 bp, Homo sapiens
ccacccttcccctc

SEQ ID NO: 1474351 - DNA, 12 bp, Homo sapiens
ccacccttggcc

SEQ ID NO: 1474352 - DNA, 20 bp, Homo sapiens
ccaccctttcccccttctct

SEQ ID NO: 1474353 - DNA, 18 bp, Homo sapiens
ccaccgaccaactgccct

SEQ ID NO: 1474354 - DNA, 19 bp, Homo sapiens
ccaccgaccaactgcccta

SEQ ID NO: 1474355 - DNA, 15 bp, Homo sapiens
ccaccgcagcgtccc

SEQ ID NO: 1474356 - DNA, 16 bp, Homo sapiens
ccaccgcaggggactg

SEQ ID NO: 1474357 - DNA, 20 bp, Homo sapiens
ccaccgcaggggactgtctc

SEQ ID NO: 1474358 - DNA, 14 bp, Homo sapiens
ccaccgctgccagc

SEQ ID NO: 1474359 - DNA, 21 bp, Homo sapiens
ccaccgctgccagcacagagc

SEQ ID NO: 1474360 - DNA, 13 bp, Homo sapiens
ccaccggccaggc

SEQ ID NO: 1474361 - DNA, 15 bp, Homo sapiens
ccaccggtccagctg

SEQ ID NO: 1474362 - DNA, 18 bp, Homo sapiens
ccaccggtccagctggcc

SEQ ID NO: 1474363 - DNA, 13 bp, Homo sapiens
ccaccgtccgccc

SEQ ID NO: 1474364 - DNA, 17 bp, Homo sapiens
ccaccgtccgccctgct

SEQ ID NO: 1474365 - DNA, 20 bp, Homo sapiens
ccaccgttaggattcaggca

SEQ ID NO: 1474366 - DNA, 20 bp, Homo sapiens
ccacctacacccctgtgctc

SEQ ID NO: 1474367 - DNA, 21 bp, Homo sapiens
ccacctacacccctgtgctcc

SEQ ID NO: 1474368 - DNA, 14 bp, Homo sapiens
ccacctacccagct

SEQ ID NO: 1474369 - DNA, 14 bp, Homo sapiens
ccacctactgcact

SEQ ID NO: 1474370 - DNA, 22 bp, Homo sapiens
ccacctactgcactttccccct

SEQ ID NO: 1474371 - DNA, 17 bp, Homo sapiens
ccacctacttgtgactg

SEQ ID NO: 1474372 - DNA, 19 bp, Homo sapiens
ccacctacttgtgactgaa

SEQ ID NO: 1474373 - DNA, 14 bp, Homo sapiens
ccacctagaacact

SEQ ID NO: 1474374 - DNA, 16 bp, Homo sapiens
ccacctagaacactaa

SEQ ID NO: 1474375 - DNA, 20 bp, Homo sapiens
ccacctagaagtctccctgc

SEQ ID NO: 1474376 - DNA, 22 bp, Homo sapiens
ccacctagaagtctccctgcac

SEQ ID NO: 1474377 - DNA, 17 bp, Homo sapiens
ccactgtggccagagct

SEQ ID NO: 1474378 - DNA, 21 bp, Homo sapiens
ccactgtggcgttctgctgcc

SEQ ID NO: 1474379 - DNA, 14 bp, Homo sapiens
ccactgttatcaaa

SEQ ID NO: 1474380 - DNA, 22 bp, Homo sapiens
ccactgttctgaaaggagacat

SEQ ID NO: 1474381 - DNA, 21 bp, Homo sapiens
ccactgttgagccccagtgct

SEQ ID NO: 1474382 - DNA, 18 bp, Homo sapiens
ccactgtttctcttgagc

SEQ ID NO: 1474383 - DNA, 22 bp, Homo sapiens
ccactgtttctcttgagctggc

SEQ ID NO: 1474384 - DNA, 15 bp, Homo sapiens
ccacttaatgtatgt

SEQ ID NO: 1474385 - DNA, 17 bp, Homo sapiens
ccacttaatgtatgtta

SEQ ID NO: 1474386 - DNA, 20 bp, Homo sapiens
ccacttaatgtatgttacca

SEQ ID NO: 1474387 - DNA, 19 bp, Homo sapiens
ccacttagaaattgcattt

SEQ ID NO: 1474388 - DNA, 17 bp, Homo sapiens
ccacttcaagtgaccac

SEQ ID NO: 1474389 - DNA, 13 bp, Homo sapiens
ccacttcactgtg

SEQ ID NO: 1474390 - DNA, 21 bp, Homo sapiens
ccacttccaggggaacctgcc

SEQ ID NO: 1474391 - DNA, 23 bp, Homo sapiens
ccacttccccctcttcttctgaa

SEQ ID NO: 1474392 - DNA, 18 bp, Homo sapiens
ccacttcccgtctcagaa

SEQ ID NO: 1474393 - DNA, 14 bp, Homo sapiens
ccacttctccatgc

SEQ ID NO: 1474394 - DNA, 12 bp, Homo sapiens
ccacttctcccc

SEQ ID NO: 1474395 - DNA, 12 bp, Homo sapiens
ccacttctggct

SEQ ID NO: 1474396 - DNA, 19 bp, Homo sapiens
ccacttctggcttcagccc

SEQ ID NO: 1474397 - DNA, 20 bp, Homo sapiens
ccacttctggcttcagcccc

SEQ ID NO: 1474398 - DNA, 18 bp, Homo sapiens
ccacttcttaaaggcctg

SEQ ID NO: 1474399 - DNA, 19 bp, Homo sapiens
ccacttcttgttccccact

SEQ ID NO: 1474400 - DNA, 20 bp, Homo sapiens
ccacttcttgttccccactg

SEQ ID NO: 1474401 - DNA, 23 bp, Homo sapiens
ccacttgacactattcactaaaa

SEQ ID NO: 1474402 - DNA, 13 bp, Homo sapiens
ccacttgagccta

SEQ ID NO: 1474403 - DNA, 15 bp, Homo sapiens
ccacttgaggcctga

SEQ ID NO: 1474404 - DNA, 13 bp, Homo sapiens
ccacttgcctctt

SEQ ID NO: 1474405 - DNA, 19 bp, Homo sapiens
ccacttgcctcttccttga

SEQ ID NO: 1474406 - DNA, 21 bp, Homo sapiens
ccacttggaggcctttcatcc

SEQ ID NO: 1474407 - DNA, 16 bp, Homo sapiens
ccacttgggtcttccc

SEQ ID NO: 1474408 - DNA, 21 bp, Homo sapiens
ccacttgtgggcttcaggtgt

SEQ ID NO: 1474409 - DNA, 16 bp, Homo sapiens
ccacttgtttgcactg

SEQ ID NO: 1474410 - DNA, 18 bp, Homo sapiens
ccacttgtttgcactgtg

SEQ ID NO: 1474411 - DNA, 18 bp, Homo sapiens
ccactttacccacctaga

SEQ ID NO: 1474412 - DNA, 20 bp, Homo sapiens
ccactttcaagctgcactga

SEQ ID NO: 1474413 - DNA, 14 bp, Homo sapiens
ccactttcctgagc

SEQ ID NO: 1474414 - DNA, 17 bp, Homo sapiens
ccactttcctgagctgt

SEQ ID NO: 1474415 - DNA, 24 bp, Homo sapiens
ccactttcctgagctgtcgctgcc

SEQ ID NO: 1474416 - DNA, 13 bp, Homo sapiens
ccactttgaaggg

SEQ ID NO: 1474417 - DNA, 14 bp, Homo sapiens
ccactttggcttct

SEQ ID NO: 1474418 - DNA, 21 bp, Homo sapiens
ccactttggtacatggccagt

SEQ ID NO: 1474419 - DNA, 15 bp, Homo sapiens
ccactttgtaatttt

SEQ ID NO: 1474420 - DNA, 17 bp, Homo sapiens
ccactttttttttttct

SEQ ID NO: 1474421 - DNA, 23 bp, Homo sapiens
ccactttttttttttctgcctga

SEQ ID NO: 1474422 - DNA, 18 bp, Homo sapiens
ccagaaaacctccagtag

SEQ ID NO: 1474423 - DNA, 21 bp, Homo sapiens
ccagaaaacctctcctgaccc

SEQ ID NO: 1474424 - DNA, 13 bp, Homo sapiens
ccagaaaatgaaa

SEQ ID NO: 1474425 - DNA, 14 bp, Homo sapiens
ccagaaaatgaaat

SEQ ID NO: 1474426 - DNA, 19 bp, Homo sapiens
ccagaaacacccctctgtc

SEQ ID NO: 1474427 - DNA, 16 bp, Homo sapiens
ccagaaactccttttg

SEQ ID NO: 1474428 - DNA, 23 bp, Homo sapiens
ccagaaactccttttgctgtctt

SEQ ID NO: 1474429 - DNA, 21 bp, Homo sapiens
ccagaaagcctctctctccct

SEQ ID NO: 1474430 - DNA, 16 bp, Homo sapiens
ccagaaaggagactag

SEQ ID NO: 1474431 - DNA, 15 bp, Homo sapiens
ccagaaaggatattt

SEQ ID NO: 1474432 - DNA, 17 bp, Homo sapiens
ccagaaaggatatttaa

SEQ ID NO: 1474433 - DNA, 16 bp, Homo sapiens
ccagaaatcattttac

SEQ ID NO: 1474434 - DNA, 18 bp, Homo sapiens
ccagaaatggtgagatgt

SEQ ID NO: 1474435 - DNA, 22 bp, Homo sapiens
ccagaaccacacttgaaacctt

SEQ ID NO: 1474436 - DNA, 12 bp, Homo sapiens
ccagaactggac

SEQ ID NO: 1474437 - DNA, 18 bp, Homo sapiens
ccagaagaagagaagctg

SEQ ID NO: 1474438 - DNA, 20 bp, Homo sapiens
ccagaagaagagaagctgct

SEQ ID NO: 1474439 - DNA, 19 bp, Homo sapiens
ccagaagaatattcaggac

SEQ ID NO: 1474440 - DNA, 21 bp, Homo sapiens
ccagaagagaattaagcccta

SEQ ID NO: 1474441 - DNA, 15 bp, Homo sapiens
ccagaagagaattca

SEQ ID NO: 1474442 - DNA, 17 bp, Homo sapiens
ccagaagagaattcagt

SEQ ID NO: 1474443 - DNA, 22 bp, Homo sapiens
ccagaagagaattcagtatttt

SEQ ID NO: 1474444 - DNA, 16 bp, Homo sapiens
ccagaagcctctggct

SEQ ID NO: 1474445 - DNA, 15 bp, Homo sapiens
ccagaagcttccata

SEQ ID NO: 1474446 - DNA, 19 bp, Homo sapiens
ccagaaggagggcagagcc

SEQ ID NO: 1474447 - DNA, 20 bp, Homo sapiens
ccagaaggagggcagagcca

SEQ ID NO: 1474448 - DNA, 20 bp, Homo sapiens
ccagaagtttgtcaagtcaa

SEQ ID NO: 1474449 - DNA, 22 bp, Homo sapiens
ccagaataattggcatgtctcc

SEQ ID NO: 1474450 - DNA, 16 bp, Homo sapiens
ccagaatctaaagcca

SEQ ID NO: 1474451 - DNA, 15 bp, Homo sapiens
ccagaatctctgagc

SEQ ID NO: 1474452 - DNA, 17 bp, Homo sapiens
ccagaatctctgagcca

SEQ ID NO: 1474453 - DNA, 14 bp, Homo sapiens
ccagaatctgctgt

SEQ ID NO: 1474454 - DNA, 23 bp, Homo sapiens
ccagaatctgctgttgccatagc

SEQ ID NO: 1474455 - DNA, 16 bp, Homo sapiens
ccagaatcttgacttt

SEQ ID NO: 1474456 - DNA, 20 bp, Homo sapiens
ccagaatcttgactttctga

SEQ ID NO: 1474457 - DNA, 22 bp, Homo sapiens
ccagaatgctgaactccttgtt

SEQ ID NO: 1474458 - DNA, 13 bp, Homo sapiens
ccagaattcacta

SEQ ID NO: 1474459 - DNA, 22 bp, Homo sapiens
ccagaattcccttgaattgtgt

SEQ ID NO: 1474460 - DNA, 18 bp, Homo sapiens
ccagaattggtaaaaaca

SEQ ID NO: 1474461 - DNA, 14 bp, Homo sapiens
ccagacacaggccc

SEQ ID NO: 1474462 - DNA, 16 bp, Homo sapiens
ccagacaccatgtgca

SEQ ID NO: 1474463 - DNA, 20 bp, Homo sapiens
ccagacaccatgtgcaataa

SEQ ID NO: 1474464 - DNA, 13 bp, Homo sapiens
ccagacacccagg

SEQ ID NO: 1474465 - DNA, 15 bp, Homo sapiens
ccagacacccaggac

SEQ ID NO: 1474466 - DNA, 13 bp, Homo sapiens
ccagacactctgc

SEQ ID NO: 1474467 - DNA, 18 bp, Homo sapiens
ccagacagacatctctgc

SEQ ID NO: 1474468 - DNA, 19 bp, Homo sapiens
ccagacagacatctctgca

SEQ ID NO: 1474469 - DNA, 22 bp, Homo sapiens
ccagacagacatctctgcaccc

SEQ ID NO: 1474470 - DNA, 13 bp, Homo sapiens
ccagacagctccc

SEQ ID NO: 1474471 - DNA, 20 bp, Homo sapiens
ccagacagcttgactgcttt

SEQ ID NO: 1474472 - DNA, 19 bp, Homo sapiens
ccagacatgtggtgggaca

SEQ ID NO: 1474473 - DNA, 23 bp, Homo sapiens
ccagacatgtggtgggacaggga

SEQ ID NO: 1474474 - DNA, 14 bp, Homo sapiens
ccagaccacagcag

SEQ ID NO: 1474475 - DNA, 16 bp, Homo sapiens
ccagaccaggaaaggc

SEQ ID NO: 1474476 - DNA, 17 bp, Homo sapiens
ccagacccctctggcca

SEQ ID NO: 1474477 - DNA, 18 bp, Homo sapiens
ccagacccctctggccag

SEQ ID NO: 1474478 - DNA, 20 bp, Homo sapiens
ccagacccctctggccagga

SEQ ID NO: 1474479 - DNA, 12 bp, Homo sapiens
ccagaccctgaa

SEQ ID NO: 1474480 - DNA, 19 bp, Homo sapiens
ccagaccctgaagatttca

SEQ ID NO: 1474481 - DNA, 14 bp, Homo sapiens
ccagaccctgcctg

SEQ ID NO: 1474482 - DNA, 19 bp, Homo sapiens
ccagaccgtcgcacccaca

SEQ ID NO: 1474483 - DNA, 15 bp, Homo sapiens
ccagacctgatcctg

SEQ ID NO: 1474484 - DNA, 18 bp, Homo sapiens
ccagacctgatcctggag

SEQ ID NO: 1474485 - DNA, 21 bp, Homo sapiens
ccagacctgatcctggaggcc

SEQ ID NO: 1474486 - DNA, 23 bp, Homo sapiens
ccagacctgatcctggaggccca

SEQ ID NO: 1474487 - DNA, 18 bp, Homo sapiens
ccagacctttgaggatat

SEQ ID NO: 1474488 - DNA, 17 bp, Homo sapiens
ccagacgcatagactga

SEQ ID NO: 1474489 - DNA, 16 bp, Homo sapiens
ccagacggttcaccag

SEQ ID NO: 1474490 - DNA, 18 bp, Homo sapiens
ccagacggttcaccagcc

SEQ ID NO: 1474491 - DNA, 20 bp, Homo sapiens
ccagacggttcaccagcctc

SEQ ID NO: 1474492 - DNA, 16 bp, Homo sapiens
ccagactcagagctct

SEQ ID NO: 1474493 - DNA, 17 bp, Homo sapiens
ccagactcagagctctc

SEQ ID NO: 1474494 - DNA, 18 bp, Homo sapiens
ccagactcttgcctgttt

SEQ ID NO: 1474495 - DNA, 13 bp, Homo sapiens
ccagactgagctc

SEQ ID NO: 1474496 - DNA, 21 bp, Homo sapiens
ccagactgagctctccaggcc

SEQ ID NO: 1474497 - DNA, 11 bp, Homo sapiens
ccagactggaa

SEQ ID NO: 1474498 - DNA, 13 bp, Homo sapiens
ccagactgggccc

SEQ ID NO: 1474499 - DNA, 15 bp, Homo sapiens
ccagactgggcccag

SEQ ID NO: 1474500 - DNA, 19 bp, Homo sapiens
ccagactgggcccaggcag

SEQ ID NO: 1474501 - DNA, 20 bp, Homo sapiens
ccagactgggcccaggcagg

SEQ ID NO: 1474502 - DNA, 23 bp, Homo sapiens
ccagactgggcccaggcaggtct

SEQ ID NO: 1474503 - DNA, 15 bp, Homo sapiens
ccagactgttagaaa

SEQ ID NO: 1474504 - DNA, 14 bp, Homo sapiens
ccagacttgcactg

SEQ ID NO: 1474505 - DNA, 15 bp, Homo sapiens
ccagacttgcactgg

SEQ ID NO: 1474506 - DNA, 16 bp, Homo sapiens
ccagacttgcactggg

SEQ ID NO: 1474507 - DNA, 20 bp, Homo sapiens
ccagagaaaggggagcccac

SEQ ID NO: 1474508 - DNA, 23 bp, Homo sapiens
ccagagacaggaaaatcctctgg

SEQ ID NO: 1474509 - DNA, 17 bp, Homo sapiens
ccagagacatacttgaa

SEQ ID NO: 1474510 - DNA, 17 bp, Homo sapiens
ccagagagaccctgcaa

SEQ ID NO: 1474511 - DNA, 20 bp, Homo sapiens
ccagagagaggggcctgcag

SEQ ID NO: 1474512 - DNA, 21 bp, Homo sapiens
ccagagagaggggcctgcagg

SEQ ID NO: 1474513 - DNA, 17 bp, Homo sapiens
ccagagaggagcacctg

SEQ ID NO: 1474514 - DNA, 15 bp, Homo sapiens
ccagagagggcccag

SEQ ID NO: 1474515 - DNA, 23 bp, Homo sapiens
ccagagagggcccagctgtagcc

SEQ ID NO: 1474516 - DNA, 18 bp, Homo sapiens
ccagagaggggctgctct

SEQ ID NO: 1474517 - DNA, 14 bp, Homo sapiens
ccagagagtggctc

SEQ ID NO: 1474518 - DNA, 22 bp, Homo sapiens
ccagagagtggctcctcccggt

SEQ ID NO: 1474519 - DNA, 19 bp, Homo sapiens
ccagagatgagtgtctgga

SEQ ID NO: 1474520 - DNA, 23 bp, Homo sapiens
ccagagatgcctccaccgctgcc

SEQ ID NO: 1474521 - DNA, 16 bp, Homo sapiens
ccagagcaggagcccc

SEQ ID NO: 1474522 - DNA, 17 bp, Homo sapiens
ccagagcaggagcccct

SEQ ID NO: 1474523 - DNA, 15 bp, Homo sapiens
ccagagcaggaggcc

SEQ ID NO: 1474524 - DNA, 11 bp, Homo sapiens
ccagagccaac

SEQ ID NO: 1474525 - DNA, 13 bp, Homo sapiens
ccagagccaacct

SEQ ID NO: 1474526 - DNA, 18 bp, Homo sapiens
ccagagccaacctggact

SEQ ID NO: 1474527 - DNA, 12 bp, Homo sapiens
ccagagccacct

SEQ ID NO: 1474528 - DNA, 18 bp, Homo sapiens
ccagagccacctggatct

SEQ ID NO: 1474529 - DNA, 11 bp, Homo sapiens
ccagagccaga

SEQ ID NO: 1474530 - DNA, 17 bp, Homo sapiens
ccagagccagatgcagg

SEQ ID NO: 1474531 - DNA, 21 bp, Homo sapiens
ccagagccagatgcaggacag

SEQ ID NO: 1474532 - DNA, 12 bp, Homo sapiens
ccagagccagcc

SEQ ID NO: 1474533 - DNA, 20 bp, Homo sapiens
ccagagccagcctgggactc

SEQ ID NO: 1474534 - DNA, 22 bp, Homo sapiens
ccagagccaggggggtgaggag

SEQ ID NO: 1474535 - DNA, 17 bp, Homo sapiens
ccagagcccagctccaa

SEQ ID NO: 1474536 - DNA, 15 bp, Homo sapiens
ccagagcccagctct

SEQ ID NO: 1474537 - DNA, 19 bp, Homo sapiens
ccagagcccagctcttgct

SEQ ID NO: 1474538 - DNA, 21 bp, Homo sapiens
ccagagcccagctcttgctct

SEQ ID NO: 1474539 - DNA, 17 bp, Homo sapiens
ccagagcccatgctcaa

SEQ ID NO: 1474540 - DNA, 17 bp, Homo sapiens
ccagagcccttcactgc

SEQ ID NO: 1474541 - DNA, 20 bp, Homo sapiens
ccagagcccttcactgccat

SEQ ID NO: 1474542 - DNA, 21 bp, Homo sapiens
ccagagcctggctgcccatca

SEQ ID NO: 1474543 - DNA, 23 bp, Homo sapiens
ccagagcctgtctttcagcattc

SEQ ID NO: 1474544 - DNA, 18 bp, Homo sapiens
ccagagccttcaagtgcc

SEQ ID NO: 1474545 - DNA, 22 bp, Homo sapiens
ccagagccttcaagtgccaaac

SEQ ID NO: 1474546 - DNA, 16 bp, Homo sapiens
ccagagcgaggaaagg

SEQ ID NO: 1474547 - DNA, 21 bp, Homo sapiens
ccagagctcatcccccctgct

SEQ ID NO: 1474548 - DNA, 23 bp, Homo sapiens
ccagagctgccgacttggagact

SEQ ID NO: 1474549 - DNA, 17 bp, Homo sapiens
ccagagctggaaggcag

SEQ ID NO: 1474550 - DNA, 19 bp, Homo sapiens
ccagagctggaaggcaggg

SEQ ID NO: 1474551 - DNA, 22 bp, Homo sapiens
ccagagctggaaggcagggcag

SEQ ID NO: 1474552 - DNA, 13 bp, Homo sapiens
ccagagctgtgcc

SEQ ID NO: 1474553 - DNA, 14 bp, Homo sapiens
ccagagctgtgcca

SEQ ID NO: 1474554 - DNA, 17 bp, Homo sapiens
ccagagctgtgccagca

SEQ ID NO: 1474555 - DNA, 14 bp, Homo sapiens
ccagagctgtgcct

SEQ ID NO: 1474556 - DNA, 21 bp, Homo sapiens
ccagagctgtttatggcctca

SEQ ID NO: 1474557 - DNA, 17 bp, Homo sapiens
ccagagcttattggcca

SEQ ID NO: 1474558 - DNA, 13 bp, Homo sapiens
ccagagcttctct

SEQ ID NO: 1474559 - DNA, 20 bp, Homo sapiens
ccagaggaatcctggcagcc

SEQ ID NO: 1474560 - DNA, 21 bp, Homo sapiens
ccagaggaatcctggcagccc

SEQ ID NO: 1474561 - DNA, 22 bp, Homo sapiens
ccagaggaatcctggcagccca

SEQ ID NO: 1474562 - DNA, 15 bp, Homo sapiens
ccagaggagccaagt

SEQ ID NO: 1474563 - DNA, 17 bp, Homo sapiens
ccagaggagccaccagt

SEQ ID NO: 1474564 - DNA, 21 bp, Homo sapiens
ccagaggagccaccagttctc

SEQ ID NO: 1474565 - DNA, 12 bp, Homo sapiens
ccagaggagggc

SEQ ID NO: 1474566 - DNA, 22 bp, Homo sapiens
ccagaggagggcagcagaaggg

SEQ ID NO: 1474567 - DNA, 15 bp, Homo sapiens
ccagaggcccccagc

SEQ ID NO: 1474568 - DNA, 19 bp, Homo sapiens
ccagaggcccccagcccag

SEQ ID NO: 1474569 - DNA, 22 bp, Homo sapiens
ccagaggcccccagcccagggc

SEQ ID NO: 1474570 - DNA, 12 bp, Homo sapiens
ccagaggccctg

SEQ ID NO: 1474571 - DNA, 18 bp, Homo sapiens
ccagaggccgaaggtgcc

SEQ ID NO: 1474572 - DNA, 20 bp, Homo sapiens
ccagaggccgaaggtgcctc

SEQ ID NO: 1474573 - DNA, 23 bp, Homo sapiens
ccagaggccgaaggtgcctcaga

SEQ ID NO: 1474574 - DNA, 19 bp, Homo sapiens
ccagaggctattattttca

SEQ ID NO: 1474575 - DNA, 12 bp, Homo sapiens
ccagaggctccc

SEQ ID NO: 1474576 - DNA, 12 bp, Homo sapiens
ccagaggctggg

SEQ ID NO: 1474577 - DNA, 12 bp, Homo sapiens
ccagagggccag

SEQ ID NO: 1474578 - DNA, 17 bp, Homo sapiens
ccagagggccagcaggc

SEQ ID NO: 1474579 - DNA, 23 bp, Homo sapiens
ccagaggggtgggttcctcttcc

SEQ ID NO: 1474580 - DNA, 15 bp, Homo sapiens
ccagaggtcgcagct

SEQ ID NO: 1474581 - DNA, 12 bp, Homo sapiens
ccagaggtgctt

SEQ ID NO: 1474582 - DNA, 17 bp, Homo sapiens
ccagaggtggagccaag

SEQ ID NO: 1474583 - DNA, 24 bp, Homo sapiens
ccagaggtggagccaagtggtcca

SEQ ID NO: 1474584 - DNA, 16 bp, Homo sapiens
ccagaggtggatgtta

SEQ ID NO: 1474585 - DNA, 19 bp, Homo sapiens
ccagaggtgggatcctccc

SEQ ID NO: 1474586 - DNA, 14 bp, Homo sapiens
ccagaggtgggcag

SEQ ID NO: 1474587 - DNA, 17 bp, Homo sapiens
ccagaggtgggcaggtg

SEQ ID NO: 1474588 - DNA, 19 bp, Homo sapiens
ccagaggtgggcaggtggt

SEQ ID NO: 1474589 - DNA, 18 bp, Homo sapiens
ccagaggttatctgcctg

SEQ ID NO: 1474590 - DNA, 20 bp, Homo sapiens
ccagaggttatctgcctggc

SEQ ID NO: 1474591 - DNA, 17 bp, Homo sapiens
ccagagtcacccagttg

SEQ ID NO: 1474592 - DNA, 17 bp, Homo sapiens
ccagagtcagaggagaa

SEQ ID NO: 1474593 - DNA, 21 bp, Homo sapiens
ccagagtcctttccaaggctt

SEQ ID NO: 1474594 - DNA, 18 bp, Homo sapiens
ccagagtggagtctgagt

SEQ ID NO: 1474595 - DNA, 21 bp, Homo sapiens
ccagagtggagtctgagtctg

SEQ ID NO: 1474596 - DNA, 14 bp, Homo sapiens
ccagagtggcctgg

SEQ ID NO: 1474597 - DNA, 11 bp, Homo sapiens
ccagagttgct

SEQ ID NO: 1474598 - DNA, 21 bp, Homo sapiens
ccagagttgctgggagctgaa

SEQ ID NO: 1474599 - DNA, 21 bp, Homo sapiens
ccagatacacccaaagtatca

SEQ ID NO: 1474600 - DNA, 13 bp, Homo sapiens
ccagatagagaaa

SEQ ID NO: 1474601 - DNA, 13 bp, Homo sapiens
ccagatataactg

SEQ ID NO: 1474602 - DNA, 17 bp, Homo sapiens
ccagatataactgtctt

SEQ ID NO: 1474603 - DNA, 19 bp, Homo sapiens
ccagatataactgtcttgt

SEQ ID NO: 1474604 - DNA, 18 bp, Homo sapiens
ccagatcaccagcccggc

SEQ ID NO: 1474605 - DNA, 22 bp, Homo sapiens
ccagcgcccgctgggctgagcc

SEQ ID NO: 1474606 - DNA, 15 bp, Homo sapiens
ccagcgcggccagcg

SEQ ID NO: 1474607 - DNA, 17 bp, Homo sapiens
ccagcgcggccagcgtc

SEQ ID NO: 1474608 - DNA, 18 bp, Homo sapiens
ccagcgcggccagcgtcc

SEQ ID NO: 1474609 - DNA, 21 bp, Homo sapiens
ccagcgcggccagcgtcccag

SEQ ID NO: 1474610 - DNA, 14 bp, Homo sapiens
ccagcggctccaac

SEQ ID NO: 1474611 - DNA, 18 bp, Homo sapiens
ccagcggctccaactcct

SEQ ID NO: 1474612 - DNA, 14 bp, Homo sapiens
ccagcggctgctca

SEQ ID NO: 1474613 - DNA, 16 bp, Homo sapiens
ccagcggctgctcaag

SEQ ID NO: 1474614 - DNA, 14 bp, Homo sapiens
ccagcgggcacagg

SEQ ID NO: 1474615 - DNA, 15 bp, Homo sapiens
ccagcgggcacaggg

SEQ ID NO: 1474616 - DNA, 16 bp, Homo sapiens
ccagcgggcacagggc

SEQ ID NO: 1474617 - DNA, 19 bp, Homo sapiens
ccagcgggcacagggcacc

SEQ ID NO: 1474618 - DNA, 20 bp, Homo sapiens
ccagcgggcacagggcacca

SEQ ID NO: 1474619 - DNA, 21 bp, Homo sapiens
ccagcgggcacagggcaccag

SEQ ID NO: 1474620 - DNA, 15 bp, Homo sapiens
ccagcgtcactccag

SEQ ID NO: 1474621 - DNA, 13 bp, Homo sapiens
ccagcgtcccagg

SEQ ID NO: 1474622 - DNA, 16 bp, Homo sapiens
ccagcgtcccttggtg

SEQ ID NO: 1474623 - DNA, 13 bp, Homo sapiens
ccagcgtcttgct

SEQ ID NO: 1474624 - DNA, 22 bp, Homo sapiens
ccagcgtgtggagcagagctct

SEQ ID NO: 1474625 - DNA, 21 bp, Homo sapiens
ccagctaaacaccaacccctg

SEQ ID NO: 1474626 - DNA, 15 bp, Homo sapiens
ccagctaagaacctg

SEQ ID NO: 1474627 - DNA, 18 bp, Homo sapiens
ccagctaagaacctggaa

SEQ ID NO: 1474628 - DNA, 19 bp, Homo sapiens
ccagctaagaacctggaac

SEQ ID NO: 1474629 - DNA, 21 bp, Homo sapiens
ccagctaaggacatttcccag

SEQ ID NO: 1474630 - DNA, 19 bp, Homo sapiens
ccagctaaggagtccctgg

SEQ ID NO: 1474631 - DNA, 23 bp, Homo sapiens
ccagctaatctgtagggctggac

SEQ ID NO: 1474632 - DNA, 17 bp, Homo sapiens
ccagctaatttttgtat

SEQ ID NO: 1474633 - DNA, 14 bp, Homo sapiens
ccagctacattcct

SEQ ID NO: 1474634 - DNA, 15 bp, Homo sapiens
ccagctacattcctc

SEQ ID NO: 1474635 - DNA, 20 bp, Homo sapiens
ccagctacattcctcagctg

SEQ ID NO: 1474636 - DNA, 22 bp, Homo sapiens
ccagctacattcctcagctgcc

SEQ ID NO: 1474637 - DNA, 16 bp, Homo sapiens
ccagctaccctttttc

SEQ ID NO: 1474638 - DNA, 16 bp, Homo sapiens
ccagctactcaggagg

SEQ ID NO: 1474639 - DNA, 17 bp, Homo sapiens
ccagctactcaggaggc

SEQ ID NO: 1474640 - DNA, 17 bp, Homo sapiens
ccagctactcgggaggc

SEQ ID NO: 1474641 - DNA, 17 bp, Homo sapiens
ccagctactctgtccag

SEQ ID NO: 1474642 - DNA, 18 bp, Homo sapiens
ccagctactctgtccagg

SEQ ID NO: 1474643 - DNA, 21 bp, Homo sapiens
ccagctactctgtccaggcca

SEQ ID NO: 1474644 - DNA, 20 bp, Homo sapiens
ccagctactggggaggctga

SEQ ID NO: 1474645 - DNA, 15 bp, Homo sapiens
ccagctacttcctcc

SEQ ID NO: 1474646 - DNA, 17 bp, Homo sapiens
ccagctacttgggaggc

SEQ ID NO: 1474647 - DNA, 19 bp, Homo sapiens
ccagctacttgggaggctg

SEQ ID NO: 1474648 - DNA, 20 bp, Homo sapiens
ccagctacttgggaggctga

SEQ ID NO: 1474649 - DNA, 14 bp, Homo sapiens
ccagctcacgtcac

SEQ ID NO: 1474650 - DNA, 15 bp, Homo sapiens
ccagctcacgtcaca

SEQ ID NO: 1474651 - DNA, 13 bp, Homo sapiens
ccagctcaggaca

SEQ ID NO: 1474652 - DNA, 23 bp, Homo sapiens
ccagctcaggacagatgccacac

SEQ ID NO: 1474653 - DNA, 21 bp, Homo sapiens
ccagctcccaacagaggcctc

SEQ ID NO: 1474654 - DNA, 13 bp, Homo sapiens
ccagctccccagg

SEQ ID NO: 1474655 - DNA, 14 bp, Homo sapiens
ccagctccccagga

SEQ ID NO: 1474656 - DNA, 14 bp, Homo sapiens
ccagctccccccgc

SEQ ID NO: 1474657 - DNA, 14 bp, Homo sapiens
ccagctccctctat

SEQ ID NO: 1474658 - DNA, 14 bp, Homo sapiens
ccagctcctgaata

SEQ ID NO: 1474659 - DNA, 21 bp, Homo sapiens
ccagctccttggggcagggcc

SEQ ID NO: 1474660 - DNA, 23 bp, Homo sapiens
ccagctccttggggcagggcctg

SEQ ID NO: 1474661 - DNA, 23 bp, Homo sapiens
ccagctcgctggctttctctctg

SEQ ID NO: 1474662 - DNA, 20 bp, Homo sapiens
ccagctcgtgtgtcctcatg

SEQ ID NO: 1474663 - DNA, 18 bp, Homo sapiens
ccagctctataattgttt

SEQ ID NO: 1474664 - DNA, 12 bp, Homo sapiens
ccagctctcagc

SEQ ID NO: 1474665 - DNA, 14 bp, Homo sapiens
ccagctctcagcca

SEQ ID NO: 1474666 - DNA, 14 bp, Homo sapiens
ccagctctccctct

SEQ ID NO: 1474667 - DNA, 16 bp, Homo sapiens
ccagctctccctctgg

SEQ ID NO: 1474668 - DNA, 22 bp, Homo sapiens
ccagctctccctctggccctgc

SEQ ID NO: 1474669 - DNA, 23 bp, Homo sapiens
ccagctctccctctggccctgcc

SEQ ID NO: 1474670 - DNA, 13 bp, Homo sapiens
ccagctctctgac

SEQ ID NO: 1474671 - DNA, 23 bp, Homo sapiens
ccagctctctgacgcttgtgaca

SEQ ID NO: 1474672 - DNA, 18 bp, Homo sapiens
ccagctctgacatccctt

SEQ ID NO: 1474673 - DNA, 20 bp, Homo sapiens
ccagctctgacatcccttcc

SEQ ID NO: 1474674 - DNA, 21 bp, Homo sapiens
ccagctctgaggggaggcacc

SEQ ID NO: 1474675 - DNA, 13 bp, Homo sapiens
ccagctctgcccc

SEQ ID NO: 1474676 - DNA, 16 bp, Homo sapiens
ccagctctgcccccgc

SEQ ID NO: 1474677 - DNA, 13 bp, Homo sapiens
ccagctctggagt

SEQ ID NO: 1474678 - DNA, 12 bp, Homo sapiens
ccagctctggct

SEQ ID NO: 1474679 - DNA, 24 bp, Homo sapiens
ccagctctgtcctcttggccatcc

SEQ ID NO: 1474680 - DNA, 17 bp, Homo sapiens
ccagctctgtggcctgt

SEQ ID NO: 1474681 - DNA, 18 bp, Homo sapiens
ccagctcttctcttccta

SEQ ID NO: 1474682 - DNA, 21 bp, Homo sapiens
ccagctcttctcttcctagat

SEQ ID NO: 1474683 - DNA, 17 bp, Homo sapiens
ccagctcttgctctctt

SEQ ID NO: 1474684 - DNA, 16 bp, Homo sapiens
ccagctcttggcccct

SEQ ID NO: 1474685 - DNA, 21 bp, Homo sapiens
ccagctcttggcccctgtgtg

SEQ ID NO: 1474686 - DNA, 14 bp, Homo sapiens
ccagctctttagaa

SEQ ID NO: 1474687 - DNA, 17 bp, Homo sapiens
ccagctgaaggcagtgg

SEQ ID NO: 1474688 - DNA, 14 bp, Homo sapiens
ccagctgactaaac

SEQ ID NO: 1474689 - DNA, 18 bp, Homo sapiens
ccagctgcacctgccagc

SEQ ID NO: 1474690 - DNA, 22 bp, Homo sapiens
ccagctgcacctgccagcctgg

SEQ ID NO: 1474691 - DNA, 23 bp, Homo sapiens
ccagctgcacctgccagcctggc

SEQ ID NO: 1474692 - DNA, 13 bp, Homo sapiens
ccagctgcactga

SEQ ID NO: 1474693 - DNA, 18 bp, Homo sapiens
ccagctgcactgatgctg

SEQ ID NO: 1474694 - DNA, 19 bp, Homo sapiens
ccagctgcactgatgctgc

SEQ ID NO: 1474695 - DNA, 13 bp, Homo sapiens
ccagctgccaagt

SEQ ID NO: 1474696 - DNA, 15 bp, Homo sapiens
ccagctgccaagtgc

SEQ ID NO: 1474697 - DNA, 19 bp, Homo sapiens
ccagctgccgaccagagcc

SEQ ID NO: 1474698 - DNA, 15 bp, Homo sapiens
ccagctgcctgggcc

SEQ ID NO: 1474699 - DNA, 19 bp, Homo sapiens
ccagctgcctgggcccgga

SEQ ID NO: 1474700 - DNA, 14 bp, Homo sapiens
ccagctgccttcct

SEQ ID NO: 1474701 - DNA, 19 bp, Homo sapiens
ccagctgccttcctcatcc

SEQ ID NO: 1474702 - DNA, 18 bp, Homo sapiens
ccagctgcgcttgctttt

SEQ ID NO: 1474703 - DNA, 20 bp, Homo sapiens
ccagctgcgcttgcttttct

SEQ ID NO: 1474704 - DNA, 10 bp, Homo sapiens
ccagctgcta

SEQ ID NO: 1474705 - DNA, 12 bp, Homo sapiens
ccagctgctctg

SEQ ID NO: 1474706 - DNA, 14 bp, Homo sapiens
ccagctgctgtctt

SEQ ID NO: 1474707 - DNA, 19 bp, Homo sapiens
ccagctgctgtcttctgga

SEQ ID NO: 1474708 - DNA, 17 bp, Homo sapiens
ccagctgctgtgcccca

SEQ ID NO: 1474709 - DNA, 18 bp, Homo sapiens
ccagctgctgtgccccac

SEQ ID NO: 1474710 - DNA, 15 bp, Homo sapiens
ccagctgcttgacct

SEQ ID NO: 1474711 - DNA, 19 bp, Homo sapiens
ccagctggccacctagaag

SEQ ID NO: 1474712 - DNA, 18 bp, Homo sapiens
ccagctgggagcactggt

SEQ ID NO: 1474713 - DNA, 12 bp, Homo sapiens
ccagctgggagg

SEQ ID NO: 1474714 - DNA, 14 bp, Homo sapiens
ccagctgggaggca

SEQ ID NO: 1474715 - DNA, 16 bp, Homo sapiens
ccagctgggaggcaag

SEQ ID NO: 1474716 - DNA, 19 bp, Homo sapiens
ccagctgggaggcaagagg

SEQ ID NO: 1474717 - DNA, 21 bp, Homo sapiens
ccagctgggaggcaagagggg

SEQ ID NO: 1474718 - DNA, 11 bp, Homo sapiens
ccagctgggct

SEQ ID NO: 1474719 - DNA, 18 bp, Homo sapiens
ccagctgggctctgcaat

SEQ ID NO: 1474720 - DNA, 16 bp, Homo sapiens
ccagggccagggccct

SEQ ID NO: 1474721 - DNA, 17 bp, Homo sapiens
ccagggccagggccctg

SEQ ID NO: 1474722 - DNA, 22 bp, Homo sapiens
ccagggcccacccccaggaagg

SEQ ID NO: 1474723 - DNA, 14 bp, Homo sapiens
ccagggcccagagc

SEQ ID NO: 1474724 - DNA, 15 bp, Homo sapiens
ccagggcccagagcc

SEQ ID NO: 1474725 - DNA, 17 bp, Homo sapiens
ccagggcccagagccca

SEQ ID NO: 1474726 - DNA, 23 bp, Homo sapiens
ccagggcccagagcccagctcca

SEQ ID NO: 1474727 - DNA, 18 bp, Homo sapiens
ccagggcccccacaggcc

SEQ ID NO: 1474728 - DNA, 21 bp, Homo sapiens
ccagggcccctcaccctgcct

SEQ ID NO: 1474729 - DNA, 19 bp, Homo sapiens
ccagggcccctccctctgc

SEQ ID NO: 1474730 - DNA, 21 bp, Homo sapiens
ccagggcccctccctctgccc

SEQ ID NO: 1474731 - DNA, 17 bp, Homo sapiens
ccagggccctcccagcc

SEQ ID NO: 1474732 - DNA, 15 bp, Homo sapiens
ccagggccctgagct

SEQ ID NO: 1474733 - DNA, 18 bp, Homo sapiens
ccagggccctgagctcgg

SEQ ID NO: 1474734 - DNA, 14 bp, Homo sapiens
ccagggcctccagg

SEQ ID NO: 1474735 - DNA, 14 bp, Homo sapiens
ccagggcctctcca

SEQ ID NO: 1474736 - DNA, 14 bp, Homo sapiens
ccagggcctgacac

SEQ ID NO: 1474737 - DNA, 19 bp, Homo sapiens
ccagggctagtgacttgtg

SEQ ID NO: 1474738 - DNA, 19 bp, Homo sapiens
ccagggctatagcagaaag

SEQ ID NO: 1474739 - DNA, 16 bp, Homo sapiens
ccagggctcagcctgg

SEQ ID NO: 1474740 - DNA, 14 bp, Homo sapiens
ccagggctccagcc

SEQ ID NO: 1474741 - DNA, 19 bp, Homo sapiens
ccagggctccagcccctct

SEQ ID NO: 1474742 - DNA, 21 bp, Homo sapiens
ccagggctccagcccctcttg

SEQ ID NO: 1474743 - DNA, 14 bp, Homo sapiens
ccagggctcctgca

SEQ ID NO: 1474744 - DNA, 21 bp, Homo sapiens
ccagggctcctgtggcagctg

SEQ ID NO: 1474745 - DNA, 23 bp, Homo sapiens
ccagggctcctgtggcagctgcc

SEQ ID NO: 1474746 - DNA, 14 bp, Homo sapiens
ccagggctctgcag

SEQ ID NO: 1474747 - DNA, 15 bp, Homo sapiens
ccagggctctgcagc

SEQ ID NO: 1474748 - DNA, 15 bp, Homo sapiens
ccagggctcttctca

SEQ ID NO: 1474749 - DNA, 16 bp, Homo sapiens
ccagggctggactgag

SEQ ID NO: 1474750 - DNA, 18 bp, Homo sapiens
ccagggctgggaggaagg

SEQ ID NO: 1474751 - DNA, 13 bp, Homo sapiens
ccagggctgggga

SEQ ID NO: 1474752 - DNA, 18 bp, Homo sapiens
ccagggctggggacagag

SEQ ID NO: 1474753 - DNA, 22 bp, Homo sapiens
ccagggcttacctgtacactga

SEQ ID NO: 1474754 - DNA, 19 bp, Homo sapiens
ccagggcttttcccaggaa

SEQ ID NO: 1474755 - DNA, 22 bp, Homo sapiens
ccaggggaaggaaggagggcac

SEQ ID NO: 1474756 - DNA, 18 bp, Homo sapiens
ccaggggagatggggagg

SEQ ID NO: 1474757 - DNA, 14 bp, Homo sapiens
ccaggggagccagc

SEQ ID NO: 1474758 - DNA, 19 bp, Homo sapiens
ccaggggagccagctgctt

SEQ ID NO: 1474759 - DNA, 14 bp, Homo sapiens
ccaggggaggagcc

SEQ ID NO: 1474760 - DNA, 17 bp, Homo sapiens
ccaggggaggagcctgt

SEQ ID NO: 1474761 - DNA, 15 bp, Homo sapiens
ccaggggcagcaagg

SEQ ID NO: 1474762 - DNA, 17 bp, Homo sapiens
ccaggggcagcaaggcc

SEQ ID NO: 1474763 - DNA, 16 bp, Homo sapiens
ccaggggcagccacac

SEQ ID NO: 1474764 - DNA, 14 bp, Homo sapiens
ccaggggcaggact

SEQ ID NO: 1474765 - DNA, 21 bp, Homo sapiens
ccaggggcccccgtgttcagg

SEQ ID NO: 1474766 - DNA, 22 bp, Homo sapiens
ccaggggctgcttcctcctgga

SEQ ID NO: 1474767 - DNA, 23 bp, Homo sapiens
ccaggggctgcttcctcctggaa

SEQ ID NO: 1474768 - DNA, 21 bp, Homo sapiens
ccaggggctggtgggacagtg

SEQ ID NO: 1474769 - DNA, 17 bp, Homo sapiens
ccagggggcctggagca

SEQ ID NO: 1474770 - DNA, 15 bp, Homo sapiens
ccaggggtctccctg

SEQ ID NO: 1474771 - DNA, 17 bp, Homo sapiens
ccaggggtctccctggc

SEQ ID NO: 1474772 - DNA, 16 bp, Homo sapiens
ccaggggtgccccctc

SEQ ID NO: 1474773 - DNA, 17 bp, Homo sapiens
ccaggggtgccccctcc

SEQ ID NO: 1474774 - DNA, 18 bp, Homo sapiens
ccaggggtgccccctcct

SEQ ID NO: 1474775 - DNA, 19 bp, Homo sapiens
ccaggggtgccccctcctc

SEQ ID NO: 1474776 - DNA, 20 bp, Homo sapiens
ccaggggtgccccctcctct

SEQ ID NO: 1474777 - DNA, 18 bp, Homo sapiens
ccagggtacccgcctgag

SEQ ID NO: 1474778 - DNA, 23 bp, Homo sapiens
ccagggtacccgcctgagctcct

SEQ ID NO: 1474779 - DNA, 10 bp, Homo sapiens
ccagggtaga

SEQ ID NO: 1474780 - DNA, 19 bp, Homo sapiens
ccagggtagacttggagct

SEQ ID NO: 1474781 - DNA, 16 bp, Homo sapiens
ccagggtcaggcggag

SEQ ID NO: 1474782 - DNA, 18 bp, Homo sapiens
ccagggtccctctgtgta

SEQ ID NO: 1474783 - DNA, 16 bp, Homo sapiens
ccagggtccgcaccag

SEQ ID NO: 1474784 - DNA, 19 bp, Homo sapiens
ccagggtccgcaccagctg

SEQ ID NO: 1474785 - DNA, 14 bp, Homo sapiens
ccagggtcctgtgc

SEQ ID NO: 1474786 - DNA, 15 bp, Homo sapiens
ccagggtcctgtgcc

SEQ ID NO: 1474787 - DNA, 20 bp, Homo sapiens
ccagggtcttgggctactgg

SEQ ID NO: 1474788 - DNA, 22 bp, Homo sapiens
ccagggtcttgggctactggca

SEQ ID NO: 1474789 - DNA, 15 bp, Homo sapiens
ccagggtgagcaggg

SEQ ID NO: 1474790 - DNA, 20 bp, Homo sapiens
ccagggtgtttgcagctgtg

SEQ ID NO: 1474791 - DNA, 20 bp, Homo sapiens
ccagggttgtgctttctagc

SEQ ID NO: 1474792 - DNA, 13 bp, Homo sapiens
ccagggttttgcc

SEQ ID NO: 1474793 - DNA, 15 bp, Homo sapiens
ccaggtacaggagag

SEQ ID NO: 1474794 - DNA, 19 bp, Homo sapiens
ccaggtacaggagaggcag

SEQ ID NO: 1474795 - DNA, 15 bp, Homo sapiens
ccaggtaccagctgc

SEQ ID NO: 1474796 - DNA, 19 bp, Homo sapiens
ccaggtaccagctgcgctt

SEQ ID NO: 1474797 - DNA, 20 bp, Homo sapiens
ccaggtactgcattctctcc

SEQ ID NO: 1474798 - DNA, 22 bp, Homo sapiens
ccaggtatccaaaaatgtgtaa

SEQ ID NO: 1474799 - DNA, 20 bp, Homo sapiens
ccaggtcaccctttgctgtg

SEQ ID NO: 1474800 - DNA, 15 bp, Homo sapiens
ccaggtcagcctgga

SEQ ID NO: 1474801 - DNA, 13 bp, Homo sapiens
ccaggtccagctc

SEQ ID NO: 1474802 - DNA, 21 bp, Homo sapiens
ccaggtcccccgactgcctgt

SEQ ID NO: 1474803 - DNA, 14 bp, Homo sapiens
ccaggtccctggac

SEQ ID NO: 1474804 - DNA, 16 bp, Homo sapiens
ccaggtccctggacca

SEQ ID NO: 1474805 - DNA, 21 bp, Homo sapiens
ccaggtcctgctccgctgcct

SEQ ID NO: 1474806 - DNA, 20 bp, Homo sapiens
ccaggtcggagtgcctggag

SEQ ID NO: 1474807 - DNA, 16 bp, Homo sapiens
ccaggtcgggcagtgg

SEQ ID NO: 1474808 - DNA, 16 bp, Homo sapiens
ccaggtctcactgctt

SEQ ID NO: 1474809 - DNA, 21 bp, Homo sapiens
ccaggtctctccactgctctc

SEQ ID NO: 1474810 - DNA, 23 bp, Homo sapiens
ccaggtctctccactgctctcag

SEQ ID NO: 1474811 - DNA, 21 bp, Homo sapiens
ccaggtgaggcccaagagccc

SEQ ID NO: 1474812 - DNA, 16 bp, Homo sapiens
ccaggtggccactcca

SEQ ID NO: 1474813 - DNA, 21 bp, Homo sapiens
ccaggtggccactccagaccc

SEQ ID NO: 1474814 - DNA, 12 bp, Homo sapiens
ccaggtggcctg

SEQ ID NO: 1474815 - DNA, 17 bp, Homo sapiens
ccaggtggcctgcgtct

SEQ ID NO: 1474816 - DNA, 16 bp, Homo sapiens
ccaggtggctgaccca

SEQ ID NO: 1474817 - DNA, 17 bp, Homo sapiens
ccaggtggctgacccag

SEQ ID NO: 1474818 - DNA, 21 bp, Homo sapiens
ccaggtggctgacccagtccc

SEQ ID NO: 1474819 - DNA, 23 bp, Homo sapiens
ccaggtggctgacccagtccctg

SEQ ID NO: 1474820 - DNA, 13 bp, Homo sapiens
ccaggtgggagcg

SEQ ID NO: 1474821 - DNA, 23 bp, Homo sapiens
ccaggtgtgcacgtggcatgtgg

SEQ ID NO: 1474822 - DNA, 17 bp, Homo sapiens
ccaggtgtgcctgtgct

SEQ ID NO: 1474823 - DNA, 19 bp, Homo sapiens
ccaggtgtgcctgtgctcc

SEQ ID NO: 1474824 - DNA, 23 bp, Homo sapiens
ccaggtgtggctgtcaggacacc

SEQ ID NO: 1474825 - DNA, 20 bp, Homo sapiens
ccaggtgttaacattccaag

SEQ ID NO: 1474826 - DNA, 24 bp, Homo sapiens
ccaggttagcctttgccctgtcac

SEQ ID NO: 1474827 - DNA, 15 bp, Homo sapiens
ccaggttccatccac

SEQ ID NO: 1474828 - DNA, 19 bp, Homo sapiens
ccaggttccatccaccacc

SEQ ID NO: 1474829 - DNA, 14 bp, Homo sapiens
ccaggttccgaaga

SEQ ID NO: 1474830 - DNA, 17 bp, Homo sapiens
ccaggttcgagacccaa

SEQ ID NO: 1474831 - DNA, 21 bp, Homo sapiens
ccaggttctccgttagctcct

SEQ ID NO: 1474832 - DNA, 13 bp, Homo sapiens
ccaggttgaaaga

SEQ ID NO: 1474833 - DNA, 23 bp, Homo sapiens
ccaggttgacaccattctcctgc

SEQ ID NO: 1474834 - DNA, 14 bp, Homo sapiens
ccaggttgcagctg

SEQ ID NO: 1474835 - DNA, 18 bp, Homo sapiens
ccaggttggagtgcagtg

SEQ ID NO: 1474836 - DNA, 21 bp, Homo sapiens
ccaggttgggaacatgctgga

SEQ ID NO: 1474837 - DNA, 22 bp, Homo sapiens
ccaggtttttcatctgaaaagc

SEQ ID NO: 1474838 - DNA, 19 bp, Homo sapiens
ccagtaacgcgtcttcctg

SEQ ID NO: 1474839 - DNA, 22 bp, Homo sapiens
ccagtaacttttttgtgtatgt

SEQ ID NO: 1474840 - DNA, 15 bp, Homo sapiens
ccagtacctccaagc

SEQ ID NO: 1474841 - DNA, 16 bp, Homo sapiens
ccagtacctttgtcac

SEQ ID NO: 1474842 - DNA, 22 bp, Homo sapiens
ccagtagaccttgttacttctg

SEQ ID NO: 1474843 - DNA, 22 bp, Homo sapiens
ccagtagttttgacacttccca

SEQ ID NO: 1474844 - DNA, 13 bp, Homo sapiens
ccagtatcgctca

SEQ ID NO: 1474845 - DNA, 18 bp, Homo sapiens
ccagtatctcttcagtct

SEQ ID NO: 1474846 - DNA, 16 bp, Homo sapiens
ccagtattgccccctc

SEQ ID NO: 1474847 - DNA, 17 bp, Homo sapiens
ccagtatttagaagcca

SEQ ID NO: 1474848 - DNA, 16 bp, Homo sapiens
ccagtcaaatctgggc

SEQ ID NO: 1474849 - DNA, 17 bp, Homo sapiens
ccagtcaaatctgggct

SEQ ID NO: 1474850 - DNA, 14 bp, Homo sapiens
ccagtcaacagatt

SEQ ID NO: 1474851 - DNA, 16 bp, Homo sapiens
ccagtcaagaagaaaa

SEQ ID NO: 1474852 - DNA, 22 bp, Homo sapiens
ccagtcaatgttggttactaaa

SEQ ID NO: 1474853 - DNA, 15 bp, Homo sapiens
ccagtcactcctctc

SEQ ID NO: 1474854 - DNA, 13 bp, Homo sapiens
ccagtcagaaata

SEQ ID NO: 1474855 - DNA, 14 bp, Homo sapiens
ccagtcaggcccag

SEQ ID NO: 1474856 - DNA, 13 bp, Homo sapiens
ccagtcagggaca

SEQ ID NO: 1474857 - DNA, 19 bp, Homo sapiens
ccagtcaggtagttgcaat

SEQ ID NO: 1474858 - DNA, 15 bp, Homo sapiens
ccagtcatctgtaag

SEQ ID NO: 1474859 - DNA, 18 bp, Homo sapiens
ccagtccaaatgtcctcc

SEQ ID NO: 1474860 - DNA, 17 bp, Homo sapiens
ccagtccacctgaggaa

SEQ ID NO: 1474861 - DNA, 14 bp, Homo sapiens
ccagtccaggctgc

SEQ ID NO: 1474862 - DNA, 19 bp, Homo sapiens
ccagtccaggctgccgtgg

SEQ ID NO: 1474863 - DNA, 16 bp, Homo sapiens
ccagtccccacccctg

SEQ ID NO: 1474864 - DNA, 17 bp, Homo sapiens
ccagtccccacccctgc

SEQ ID NO: 1474865 - DNA, 18 bp, Homo sapiens
ccagtccccacccctgcc

SEQ ID NO: 1474866 - DNA, 21 bp, Homo sapiens
ccagtccccacccctgccccc

SEQ ID NO: 1474867 - DNA, 22 bp, Homo sapiens
ccagtccccacccctgccccca

SEQ ID NO: 1474868 - DNA, 14 bp, Homo sapiens
ccagtccccacccg

SEQ ID NO: 1474869 - DNA, 19 bp, Homo sapiens
ccagtccccacccgcctgc

SEQ ID NO: 1474870 - DNA, 23 bp, Homo sapiens
ccagtccccacccgcctgcagag

SEQ ID NO: 1474871 - DNA, 15 bp, Homo sapiens
ccagtccccccaccc

SEQ ID NO: 1474872 - DNA, 17 bp, Homo sapiens
ccagtccccccaccctc

SEQ ID NO: 1474873 - DNA, 14 bp, Homo sapiens
ccagtccccgagga

SEQ ID NO: 1474874 - DNA, 17 bp, Homo sapiens
ccagtccccgtgccccg

SEQ ID NO: 1474875 - DNA, 22 bp, Homo sapiens
ccagtccccgtgccccgcctcc

SEQ ID NO: 1474876 - DNA, 14 bp, Homo sapiens
ccagtcccctttgt

SEQ ID NO: 1474877 - DNA, 22 bp, Homo sapiens
ccagtccctcgccgtccctccc

SEQ ID NO: 1474878 - DNA, 15 bp, Homo sapiens
ccagtccctggggga

SEQ ID NO: 1474879 - DNA, 22 bp, Homo sapiens
ccagtccctgggggaagccctg

SEQ ID NO: 1474880 - DNA, 11 bp, Homo sapiens
ccagtcctgct

SEQ ID NO: 1474881 - DNA, 12 bp, Homo sapiens
ccagtcctgcta

SEQ ID NO: 1474882 - DNA, 15 bp, Homo sapiens
ccagtcctgctacct

SEQ ID NO: 1474883 - DNA, 23 bp, Homo sapiens
ccagtcctggtcctggctgcact

SEQ ID NO: 1474884 - DNA, 23 bp, Homo sapiens
ccagtcgaccccaaaggaacact

SEQ ID NO: 1474885 - DNA, 13 bp, Homo sapiens
ccagtctatttcc

SEQ ID NO: 1474886 - DNA, 20 bp, Homo sapiens
ccagtctatttccactgaac

SEQ ID NO: 1474887 - DNA, 13 bp, Homo sapiens
ccagtctcagaga

SEQ ID NO: 1474888 - DNA, 14 bp, Homo sapiens
ccagtctcagagac

SEQ ID NO: 1474889 - DNA, 17 bp, Homo sapiens
ccagtctcagagaccag

SEQ ID NO: 1474890 - DNA, 23 bp, Homo sapiens
ccagtctcagagaccagcactca

SEQ ID NO: 1474891 - DNA, 12 bp, Homo sapiens
ccagtctcttct

SEQ ID NO: 1474892 - DNA, 20 bp, Homo sapiens
ccagtctggaaaacagaaac

SEQ ID NO: 1474893 - DNA, 18 bp, Homo sapiens
ccagtctgggctgccggg

SEQ ID NO: 1474894 - DNA, 15 bp, Homo sapiens
ccagtctgtctactg

SEQ ID NO: 1474895 - DNA, 16 bp, Homo sapiens
ccagtctgtggatcag

SEQ ID NO: 1474896 - DNA, 16 bp, Homo sapiens
ccagtctgttccccat

SEQ ID NO: 1474897 - DNA, 17 bp, Homo sapiens
ccagtcttcctgacact

SEQ ID NO: 1474898 - DNA, 20 bp, Homo sapiens
ccagtgaacttacacttgga

SEQ ID NO: 1474899 - DNA, 15 bp, Homo sapiens
ccagtgaagatattt

SEQ ID NO: 1474900 - DNA, 19 bp, Homo sapiens
ccagtgaatccctgggagc

SEQ ID NO: 1474901 - DNA, 15 bp, Homo sapiens
ccagtgacagacagg

SEQ ID NO: 1474902 - DNA, 19 bp, Homo sapiens
ccagtgacagacaggctct

SEQ ID NO: 1474903 - DNA, 12 bp, Homo sapiens
ccagtgaggaac

SEQ ID NO: 1474904 - DNA, 22 bp, Homo sapiens
ccagtgagggacgtcagacttg

SEQ ID NO: 1474905 - DNA, 23 bp, Homo sapiens
ccagtgagtacctgcaaaaatga

SEQ ID NO: 1474906 - DNA, 13 bp, Homo sapiens
ccagtgagtggcc

SEQ ID NO: 1474907 - DNA, 15 bp, Homo sapiens
ccagtgagtggcccc

SEQ ID NO: 1474908 - DNA, 12 bp, Homo sapiens
ccagtgcagcca

SEQ ID NO: 1474909 - DNA, 13 bp, Homo sapiens
ccagtgcagccac

SEQ ID NO: 1474910 - DNA, 20 bp, Homo sapiens
ccagtgcagttgtgatttct

SEQ ID NO: 1474911 - DNA, 18 bp, Homo sapiens
ccagtgcatggtggccag

SEQ ID NO: 1474912 - DNA, 19 bp, Homo sapiens
ccagtgcatggtggccaga

SEQ ID NO: 1474913 - DNA, 18 bp, Homo sapiens
ccagtgcattttgtttct

SEQ ID NO: 1474914 - DNA, 17 bp, Homo sapiens
ccagtgccactgccccc

SEQ ID NO: 1474915 - DNA, 14 bp, Homo sapiens
ccagtgcccccact

SEQ ID NO: 1474916 - DNA, 16 bp, Homo sapiens
ccagtgcccccactga

SEQ ID NO: 1474917 - DNA, 18 bp, Homo sapiens
ccagtgcccccactgacc

SEQ ID NO: 1474918 - DNA, 13 bp, Homo sapiens
ccagtgccgagga

SEQ ID NO: 1474919 - DNA, 14 bp, Homo sapiens
ccagtgcctgccac

SEQ ID NO: 1474920 - DNA, 23 bp, Homo sapiens
ccagtgccttacctcctgcccag

SEQ ID NO: 1474921 - DNA, 15 bp, Homo sapiens
ccagtgcgattctgg

SEQ ID NO: 1474922 - DNA, 19 bp, Homo sapiens
ccagtgcggttcctcatct

SEQ ID NO: 1474923 - DNA, 12 bp, Homo sapiens
ccagtgctgaat

SEQ ID NO: 1474924 - DNA, 18 bp, Homo sapiens
ccagtgctgccatgccac

SEQ ID NO: 1474925 - DNA, 23 bp, Homo sapiens
ccagtgctgccatgccactgcca

SEQ ID NO: 1474926 - DNA, 19 bp, Homo sapiens
ccagtgctgcccatgagca

SEQ ID NO: 1474927 - DNA, 14 bp, Homo sapiens
ccagtgctggattt

SEQ ID NO: 1474928 - DNA, 22 bp, Homo sapiens
ccagtggaacagcgggagacct

SEQ ID NO: 1474929 - DNA, 18 bp, Homo sapiens
ccagtggagcctgccgcc

SEQ ID NO: 1474930 - DNA, 16 bp, Homo sapiens
ccagtggaggtttgtc

SEQ ID NO: 1474931 - DNA, 19 bp, Homo sapiens
ccagtggatgccacagccc

SEQ ID NO: 1474932 - DNA, 15 bp, Homo sapiens
ccagtggctggtctc

SEQ ID NO: 1474933 - DNA, 13 bp, Homo sapiens
ccagtgggaagat

SEQ ID NO: 1474934 - DNA, 11 bp, Homo sapiens
ccagtgggagg

SEQ ID NO: 1474935 - DNA, 15 bp, Homo sapiens
ccagtgggaggggca

SEQ ID NO: 1474936 - DNA, 18 bp, Homo sapiens
ccagtgggaggggcaggc

SEQ ID NO: 1474937 - DNA, 23 bp, Homo sapiens
ccagtgggaggggcaggctgaca

SEQ ID NO: 1474938 - DNA, 18 bp, Homo sapiens
ccagtgggccagccacag

SEQ ID NO: 1474939 - DNA, 15 bp, Homo sapiens
ccagtgggcccggag

SEQ ID NO: 1474940 - DNA, 13 bp, Homo sapiens
ccagtggggtccc

SEQ ID NO: 1474941 - DNA, 23 bp, Homo sapiens
ccagtggggtcccccctgagtgg

SEQ ID NO: 1474942 - DNA, 15 bp, Homo sapiens
ccagtggtatcctgt

SEQ ID NO: 1474943 - DNA, 15 bp, Homo sapiens
ccagtgtcccctttc

SEQ ID NO: 1474944 - DNA, 15 bp, Homo sapiens
ccagtgtgatcccaa

SEQ ID NO: 1474945 - DNA, 23 bp, Homo sapiens
ccagtgtgcacgcctgcaggctg

SEQ ID NO: 1474946 - DNA, 20 bp, Homo sapiens
ccagtgtgggcttgaccagg

SEQ ID NO: 1474947 - DNA, 20 bp, Homo sapiens
ccagtgttgtttgtaaataa

SEQ ID NO: 1474948 - DNA, 11 bp, Homo sapiens
ccagtgttttc

SEQ ID NO: 1474949 - DNA, 20 bp, Homo sapiens
ccatgcttagtcactgcctg

SEQ ID NO: 1474950 - DNA, 22 bp, Homo sapiens
ccatgcttagtcactgcctgca

SEQ ID NO: 1474951 - DNA, 23 bp, Homo sapiens
ccatggacttcacataagctcag

SEQ ID NO: 1474952 - DNA, 20 bp, Homo sapiens
ccatggagatgaaatgcctt

SEQ ID NO: 1474953 - DNA, 22 bp, Homo sapiens
ccatggatctgatctgtaccat

SEQ ID NO: 1474954 - DNA, 16 bp, Homo sapiens
ccatggcaccagcccc

SEQ ID NO: 1474955 - DNA, 19 bp, Homo sapiens
ccatggcagcagccaggga

SEQ ID NO: 1474956 - DNA, 21 bp, Homo sapiens
ccatggccaccccgtgccacc

SEQ ID NO: 1474957 - DNA, 14 bp, Homo sapiens
ccatggccccaggc

SEQ ID NO: 1474958 - DNA, 12 bp, Homo sapiens
ccatggccccca

SEQ ID NO: 1474959 - DNA, 17 bp, Homo sapiens
ccatggcccccaataaa

SEQ ID NO: 1474960 - DNA, 21 bp, Homo sapiens
ccatggcccccaataaaggca

SEQ ID NO: 1474961 - DNA, 24 bp, Homo sapiens
ccatggcccccaataaaggcagct

SEQ ID NO: 1474962 - DNA, 19 bp, Homo sapiens
ccatggcgtgtccctctcg

SEQ ID NO: 1474963 - DNA, 21 bp, Homo sapiens
ccatggcgtgtccctctcgga

SEQ ID NO: 1474964 - DNA, 19 bp, Homo sapiens
ccatgggagccagctgctt

SEQ ID NO: 1474965 - DNA, 21 bp, Homo sapiens
ccatgggagccagctgctttt

SEQ ID NO: 1474966 - DNA, 14 bp, Homo sapiens
ccatgggcctgggc

SEQ ID NO: 1474967 - DNA, 16 bp, Homo sapiens
ccatgggcctgggcct

SEQ ID NO: 1474968 - DNA, 15 bp, Homo sapiens
ccatgggctgtgtcc

SEQ ID NO: 1474969 - DNA, 21 bp, Homo sapiens
ccatgggcttggacttcctgg

SEQ ID NO: 1474970 - DNA, 22 bp, Homo sapiens
ccatgggcttggacttcctggg

SEQ ID NO: 1474971 - DNA, 13 bp, Homo sapiens
ccatggggctgcg

SEQ ID NO: 1474972 - DNA, 14 bp, Homo sapiens
ccatggggggagaa

SEQ ID NO: 1474973 - DNA, 16 bp, Homo sapiens
ccatggggtccttgga

SEQ ID NO: 1474974 - DNA, 16 bp, Homo sapiens
ccatggtaaccagcca

SEQ ID NO: 1474975 - DNA, 17 bp, Homo sapiens
ccatggtgctaggaaga

SEQ ID NO: 1474976 - DNA, 22 bp, Homo sapiens
ccatggtgctaggaagaggagt

SEQ ID NO: 1474977 - DNA, 14 bp, Homo sapiens
ccatggttgagaaa

SEQ ID NO: 1474978 - DNA, 18 bp, Homo sapiens
ccatgtactcaagtacca

SEQ ID NO: 1474979 - DNA, 14 bp, Homo sapiens
ccatgtagacccct

SEQ ID NO: 1474980 - DNA, 16 bp, Homo sapiens
ccatgtagcaggactg

SEQ ID NO: 1474981 - DNA, 23 bp, Homo sapiens
ccatgtatggaatcccactgtat

SEQ ID NO: 1474982 - DNA, 18 bp, Homo sapiens
ccatgtatttgttatata

SEQ ID NO: 1474983 - DNA, 13 bp, Homo sapiens
ccatgtcacctca

SEQ ID NO: 1474984 - DNA, 17 bp, Homo sapiens
ccatgtcacctcagctg

SEQ ID NO: 1474985 - DNA, 18 bp, Homo sapiens
ccatgtccaaagaggctg

SEQ ID NO: 1474986 - DNA, 13 bp, Homo sapiens
ccatgtcccaccc

SEQ ID NO: 1474987 - DNA, 20 bp, Homo sapiens
ccatgtcccaccctccctag

SEQ ID NO: 1474988 - DNA, 16 bp, Homo sapiens
ccatgtgaacagcata

SEQ ID NO: 1474989 - DNA, 17 bp, Homo sapiens
ccatgtgagtccctgtg

SEQ ID NO: 1474990 - DNA, 19 bp, Homo sapiens
ccatgtgccatctgtacat

SEQ ID NO: 1474991 - DNA, 20 bp, Homo sapiens
ccatgtgccatctgtacata

SEQ ID NO: 1474992 - DNA, 17 bp, Homo sapiens
ccatgtgcctgcaccag

SEQ ID NO: 1474993 - DNA, 18 bp, Homo sapiens
ccatgtgcctgcaccagg

SEQ ID NO: 1474994 - DNA, 16 bp, Homo sapiens
ccatgtgcctttcttt

SEQ ID NO: 1474995 - DNA, 17 bp, Homo sapiens
ccatgtgcctttctttg

SEQ ID NO: 1474996 - DNA, 21 bp, Homo sapiens
ccatgtgctgcggtcactcag

SEQ ID NO: 1474997 - DNA, 24 bp, Homo sapiens
ccatgtggaaggcaagccaggctc

SEQ ID NO: 1474998 - DNA, 13 bp, Homo sapiens
ccatgtggctgaa

SEQ ID NO: 1474999 - DNA, 15 bp, Homo sapiens
ccatgtggctgaaga

SEQ ID NO: 1475000 - DNA, 11 bp, Homo sapiens
ccatgtgggcg

SEQ ID NO: 1475001 - DNA, 23 bp, Homo sapiens
ccatgtgggcgcccaccctgggc

SEQ ID NO: 1475002 - DNA, 17 bp, Homo sapiens
ccatgtggtggcacagg

SEQ ID NO: 1475003 - DNA, 13 bp, Homo sapiens
ccatgtgtacatt

SEQ ID NO: 1475004 - DNA, 22 bp, Homo sapiens
ccatgtgtacattctgcctaga

SEQ ID NO: 1475005 - DNA, 18 bp, Homo sapiens
ccatgttcattataatct

SEQ ID NO: 1475006 - DNA, 13 bp, Homo sapiens
ccatgttgcccct

SEQ ID NO: 1475007 - DNA, 20 bp, Homo sapiens
ccatgttggccaggatggtc

SEQ ID NO: 1475008 - DNA, 19 bp, Homo sapiens
ccatgttggccaggctggt

SEQ ID NO: 1475009 - DNA, 16 bp, Homo sapiens
ccatgttgtaatgctg

SEQ ID NO: 1475010 - DNA, 22 bp, Homo sapiens
ccatgttgtaatgctgcacttc

SEQ ID NO: 1475011 - DNA, 22 bp, Homo sapiens
ccatgtttagtgaatgactttt

SEQ ID NO: 1475012 - DNA, 16 bp, Homo sapiens
ccatgtttgagctcag

SEQ ID NO: 1475013 - DNA, 17 bp, Homo sapiens
ccatgtttgagctcaga

SEQ ID NO: 1475014 - DNA, 22 bp, Homo sapiens
ccatgtttggttgtaaatgctc

SEQ ID NO: 1475015 - DNA, 21 bp, Homo sapiens
ccatgttttttcttcaaatgt

SEQ ID NO: 1475016 - DNA, 16 bp, Homo sapiens
ccattaaaactgcttt

SEQ ID NO: 1475017 - DNA, 20 bp, Homo sapiens
ccattaaggggaagaatgaa

SEQ ID NO: 1475018 - DNA, 17 bp, Homo sapiens
ccattaatcagttcatt

SEQ ID NO: 1475019 - DNA, 23 bp, Homo sapiens
ccattacagaggtattaaaacta

SEQ ID NO: 1475020 - DNA, 14 bp, Homo sapiens
ccattaccatggag

SEQ ID NO: 1475021 - DNA, 13 bp, Homo sapiens
ccattacctccat

SEQ ID NO: 1475022 - DNA, 16 bp, Homo sapiens
ccattacctgtacctg

SEQ ID NO: 1475023 - DNA, 14 bp, Homo sapiens
ccattagaaaattt

SEQ ID NO: 1475024 - DNA, 16 bp, Homo sapiens
ccattagagtcagcct

SEQ ID NO: 1475025 - DNA, 22 bp, Homo sapiens
ccattaggacaatcagtcccct

SEQ ID NO: 1475026 - DNA, 16 bp, Homo sapiens
ccattaggccagcaac

SEQ ID NO: 1475027 - DNA, 15 bp, Homo sapiens
ccattatgcctggct

SEQ ID NO: 1475028 - DNA, 21 bp, Homo sapiens
ccattattatcaagtagacta

SEQ ID NO: 1475029 - DNA, 17 bp, Homo sapiens
ccattattatttctgtt

SEQ ID NO: 1475030 - DNA, 12 bp, Homo sapiens
ccattattttgt

SEQ ID NO: 1475031 - DNA, 20 bp, Homo sapiens
ccattcacaataaaagctta

SEQ ID NO: 1475032 - DNA, 15 bp, Homo sapiens
ccattcacagagcct

SEQ ID NO: 1475033 - DNA, 22 bp, Homo sapiens
ccattcactagaaaatgagaaa

SEQ ID NO: 1475034 - DNA, 19 bp, Homo sapiens
ccattcactcttccagaat

SEQ ID NO: 1475035 - DNA, 20 bp, Homo sapiens
ccattcagaatatcatcttt

SEQ ID NO: 1475036 - DNA, 11 bp, Homo sapiens
ccattccaaaa

SEQ ID NO: 1475037 - DNA, 13 bp, Homo sapiens
ccattccaaaata

SEQ ID NO: 1475038 - DNA, 20 bp, Homo sapiens
ccattccaggcagcctctgt

SEQ ID NO: 1475039 - DNA, 15 bp, Homo sapiens
ccattccctccattt

SEQ ID NO: 1475040 - DNA, 14 bp, Homo sapiens
ccattcccttggaa

SEQ ID NO: 1475041 - DNA, 13 bp, Homo sapiens
ccattcctcaggg

SEQ ID NO: 1475042 - DNA, 16 bp, Homo sapiens
ccattcctcagggaca

SEQ ID NO: 1475043 - DNA, 16 bp, Homo sapiens
ccattcctgaagaacc

SEQ ID NO: 1475044 - DNA, 11 bp, Homo sapiens
ccattcctgat

SEQ ID NO: 1475045 - DNA, 18 bp, Homo sapiens
ccattcgacctataagaa

SEQ ID NO: 1475046 - DNA, 17 bp, Homo sapiens
ccattctagatcctgca

SEQ ID NO: 1475047 - DNA, 16 bp, Homo sapiens
ccattctataaattca

SEQ ID NO: 1475048 - DNA, 18 bp, Homo sapiens
ccattctcccttctctct

SEQ ID NO: 1475049 - DNA, 14 bp, Homo sapiens
ccattctctctcct

SEQ ID NO: 1475050 - DNA, 22 bp, Homo sapiens
ccattctgcctcagcctcctga

SEQ ID NO: 1475051 - DNA, 12 bp, Homo sapiens
ccattctgtttt

SEQ ID NO: 1475052 - DNA, 14 bp, Homo sapiens
ccattcttcctagt

SEQ ID NO: 1475053 - DNA, 14 bp, Homo sapiens
ccattcttctggtg

SEQ ID NO: 1475054 - DNA, 20 bp, Homo sapiens
ccattctttattcttttact

SEQ ID NO: 1475055 - DNA, 16 bp, Homo sapiens
ccattgaactggaaga

SEQ ID NO: 1475056 - DNA, 20 bp, Homo sapiens
ccattgaagccgactctggc

SEQ ID NO: 1475057 - DNA, 23 bp, Homo sapiens
ccattgaagccgactctggccct

SEQ ID NO: 1475058 - DNA, 12 bp, Homo sapiens
ccattgaaggct

SEQ ID NO: 1475059 - DNA, 17 bp, Homo sapiens
ccattgaaggcttaaac

SEQ ID NO: 1475060 - DNA, 17 bp, Homo sapiens
ccattgaccagctctct

SEQ ID NO: 1475061 - DNA, 15 bp, Homo sapiens
ccattgacctcagct

SEQ ID NO: 1475062 - DNA, 14 bp, Homo sapiens
ccattgagtccctg

SEQ ID NO: 1475063 - DNA, 21 bp, Homo sapiens
ccattgccaccaggagaacca

SEQ ID NO: 1475064 - DNA, 16 bp, Homo sapiens
ccattgccccagacct

SEQ ID NO: 1475065 - DNA, 14 bp, Homo sapiens
ccattgccctggtt

SEQ ID NO: 1475066 - DNA, 13 bp, Homo sapiens
ccattggtgttga

SEQ ID NO: 1475067 - DNA, 17 bp, Homo sapiens
ccattggttcacctgtg

SEQ ID NO: 1475068 - DNA, 19 bp, Homo sapiens
ccattggttcacctgtgac

SEQ ID NO: 1475069 - DNA, 23 bp, Homo sapiens
ccattggttcacctgtgactcct

SEQ ID NO: 1475070 - DNA, 22 bp, Homo sapiens
ccattgtactccagcctgggca

SEQ ID NO: 1475071 - DNA, 19 bp, Homo sapiens
ccattgtcctccttttcac

SEQ ID NO: 1475072 - DNA, 14 bp, Homo sapiens
ccattgttcccttc

SEQ ID NO: 1475073 - DNA, 21 bp, Homo sapiens
ccattgttcccttcctcttcc

SEQ ID NO: 1475074 - DNA, 18 bp, Homo sapiens
ccattgttgtcaaggaag

SEQ ID NO: 1475075 - DNA, 14 bp, Homo sapiens
ccatttaaaaagtt

SEQ ID NO: 1475076 - DNA, 19 bp, Homo sapiens
ccatttaagtatcttgtgc

SEQ ID NO: 1475077 - DNA, 21 bp, Homo sapiens
ccatttaagtatcttgtgctt

SEQ ID NO: 1475078 - DNA, 17 bp, Homo sapiens
ccatttacaaataagag

SEQ ID NO: 1475079 - DNA, 15 bp, Homo sapiens
ccatttagaatctag

SEQ ID NO: 1475080 - DNA, 18 bp, Homo sapiens
ccatttagaatctagaaa

SEQ ID NO: 1475081 - DNA, 22 bp, Homo sapiens
ccatttagaatggtgattttaa

SEQ ID NO: 1475082 - DNA, 23 bp, Homo sapiens
ccatttatgtgtagaatttgaaa

SEQ ID NO: 1475083 - DNA, 12 bp, Homo sapiens
ccatttatttat

SEQ ID NO: 1475084 - DNA, 13 bp, Homo sapiens
ccatttcagagag

SEQ ID NO: 1475085 - DNA, 16 bp, Homo sapiens
ccatttcatctatttc

SEQ ID NO: 1475086 - DNA, 15 bp, Homo sapiens
ccatttccagttcat

SEQ ID NO: 1475087 - DNA, 13 bp, Homo sapiens
ccatttcccatct

SEQ ID NO: 1475088 - DNA, 17 bp, Homo sapiens
ccatttcccatctgcac

SEQ ID NO: 1475089 - DNA, 18 bp, Homo sapiens
ccatttcccatctgcacc

SEQ ID NO: 1475090 - DNA, 22 bp, Homo sapiens
ccatttcccttctggacactga

SEQ ID NO: 1475091 - DNA, 13 bp, Homo sapiens
ccatttcctgaga

SEQ ID NO: 1475092 - DNA, 13 bp, Homo sapiens
ccatttccttgga

SEQ ID NO: 1475093 - DNA, 22 bp, Homo sapiens
ccatttccttggaggccaccgg

SEQ ID NO: 1475094 - DNA, 13 bp, Homo sapiens
ccatttctattta

SEQ ID NO: 1475095 - DNA, 23 bp, Homo sapiens
ccatttctcaatcagtgcagtga

SEQ ID NO: 1475096 - DNA, 18 bp, Homo sapiens
ccatttcttcctcactat

SEQ ID NO: 1475097 - DNA, 22 bp, Homo sapiens
ccatttcttggcattggaattc

SEQ ID NO: 1475098 - DNA, 19 bp, Homo sapiens
ccatttgctcttcagatgc

SEQ ID NO: 1475099 - DNA, 13 bp, Homo sapiens
ccatttgggctct

SEQ ID NO: 1475100 - DNA, 18 bp, Homo sapiens
ccatttgtaataaagtat

SEQ ID NO: 1475101 - DNA, 12 bp, Homo sapiens
ccatttgtattc

SEQ ID NO: 1475102 - DNA, 18 bp, Homo sapiens
ccatttgtgccagaggaa

SEQ ID NO: 1475103 - DNA, 16 bp, Homo sapiens
ccatttgttcctgctt

SEQ ID NO: 1475104 - DNA, 22 bp, Homo sapiens
ccattttctaaactgttttcat

SEQ ID NO: 1475105 - DNA, 14 bp, Homo sapiens
ccattttgcaaaat

SEQ ID NO: 1475106 - DNA, 23 bp, Homo sapiens
ccattttgttattgactaacagg

SEQ ID NO: 1475107 - DNA, 14 bp, Homo sapiens
ccatttttaatgat

SEQ ID NO: 1475108 - DNA, 22 bp, Homo sapiens
ccatttttctcccaagaaacct

SEQ ID NO: 1475109 - DNA, 14 bp, Homo sapiens
ccatttttctgggg

SEQ ID NO: 1475110 - DNA, 21 bp, Homo sapiens
ccatttttgctgaattcatct

SEQ ID NO: 1475111 - DNA, 21 bp, Homo sapiens
ccattttttaaaaaagcaagg

SEQ ID NO: 1475112 - DNA, 17 bp, Homo sapiens
ccattttttaaggaaac

SEQ ID NO: 1475113 - DNA, 18 bp, Homo sapiens
ccattttttaatttactt

SEQ ID NO: 1475114 - DNA, 17 bp, Homo sapiens
ccattttttcttccctt

SEQ ID NO: 1475115 - DNA, 23 bp, Homo sapiens
ccattttttcttcccttttccct

SEQ ID NO: 1475116 - DNA, 23 bp, Homo sapiens
ccattttttttttctttttgggg

SEQ ID NO: 1475117 - DNA, 13 bp, Homo sapiens
cccaaaaaagaac

SEQ ID NO: 1475118 - DNA, 15 bp, Homo sapiens
cccaaaactctgtag

SEQ ID NO: 1475119 - DNA, 18 bp, Homo sapiens
cccaaaatttattttata

SEQ ID NO: 1475120 - DNA, 20 bp, Homo sapiens
cccaaacaaatatgcaaaag

SEQ ID NO: 1475121 - DNA, 21 bp, Homo sapiens
cccaaacaccttccagctcct

SEQ ID NO: 1475122 - DNA, 22 bp, Homo sapiens
cccaaacacttctgctttcact

SEQ ID NO: 1475123 - DNA, 18 bp, Homo sapiens
cccaaaccatgagaattt

SEQ ID NO: 1475124 - DNA, 19 bp, Homo sapiens
cccaaacccaagtgccttc

SEQ ID NO: 1475125 - DNA, 23 bp, Homo sapiens
cccaaacccagtctcctctccat

SEQ ID NO: 1475126 - DNA, 13 bp, Homo sapiens
cccaaagccactg

SEQ ID NO: 1475127 - DNA, 18 bp, Homo sapiens
cccaaagccactggaagg

SEQ ID NO: 1475128 - DNA, 17 bp, Homo sapiens
cccaaagctttcctgcc

SEQ ID NO: 1475129 - DNA, 13 bp, Homo sapiens
cccaaagggtgtg

SEQ ID NO: 1475130 - DNA, 18 bp, Homo sapiens
cccaaagtcctctgctcc

SEQ ID NO: 1475131 - DNA, 15 bp, Homo sapiens
cccaaagtgctgaga

SEQ ID NO: 1475132 - DNA, 15 bp, Homo sapiens
cccaaagtggggagg

SEQ ID NO: 1475133 - DNA, 20 bp, Homo sapiens
cccaaatatgtattttccta

SEQ ID NO: 1475134 - DNA, 16 bp, Homo sapiens
cccaaatcaatacact

SEQ ID NO: 1475135 - DNA, 10 bp, Homo sapiens
cccaaatgat

SEQ ID NO: 1475136 - DNA, 15 bp, Homo sapiens
cccaaatgtgtacac

SEQ ID NO: 1475137 - DNA, 16 bp, Homo sapiens
cccaaattgccttcag

SEQ ID NO: 1475138 - DNA, 20 bp, Homo sapiens
cccaacaacatgaaactgcc

SEQ ID NO: 1475139 - DNA, 23 bp, Homo sapiens
cccaacaacatgaaactgcctat

SEQ ID NO: 1475140 - DNA, 12 bp, Homo sapiens
cccaacaccaaa

SEQ ID NO: 1475141 - DNA, 20 bp, Homo sapiens
cccaacaccccgcctgcctc

SEQ ID NO: 1475142 - DNA, 13 bp, Homo sapiens
cccaacactgtgc

SEQ ID NO: 1475143 - DNA, 16 bp, Homo sapiens
cccaacactgtgccct

SEQ ID NO: 1475144 - DNA, 20 bp, Homo sapiens
cccaacactgtgccctggtg

SEQ ID NO: 1475145 - DNA, 15 bp, Homo sapiens
cccaacagaggcctc

SEQ ID NO: 1475146 - DNA, 20 bp, Homo sapiens
cccaacccattcactacagg

SEQ ID NO: 1475147 - DNA, 18 bp, Homo sapiens
cccaaccccaagccagcc

SEQ ID NO: 1475148 - DNA, 15 bp, Homo sapiens
cccaaccccagggcc

SEQ ID NO: 1475149 - DNA, 13 bp, Homo sapiens
cccaacccccacc

SEQ ID NO: 1475150 - DNA, 14 bp, Homo sapiens
cccaacccccaccc

SEQ ID NO: 1475151 - DNA, 16 bp, Homo sapiens
cccaacccccctcctg

SEQ ID NO: 1475152 - DNA, 22 bp, Homo sapiens
cccaacccccctcctgctcctc

SEQ ID NO: 1475153 - DNA, 19 bp, Homo sapiens
cccaaccctgggctgggga

SEQ ID NO: 1475154 - DNA, 17 bp, Homo sapiens
cccaacccttccctcac

SEQ ID NO: 1475155 - DNA, 15 bp, Homo sapiens
cccaacctcagggct

SEQ ID NO: 1475156 - DNA, 19 bp, Homo sapiens
cccaacctcagggctccca

SEQ ID NO: 1475157 - DNA, 22 bp, Homo sapiens
cccaacctcagggctcccaggg

SEQ ID NO: 1475158 - DNA, 20 bp, Homo sapiens
cccaacggccctgcagccag

SEQ ID NO: 1475159 - DNA, 15 bp, Homo sapiens
cccaacgtcccctcc

SEQ ID NO: 1475160 - DNA, 18 bp, Homo sapiens
cccaactagaagcctagt

SEQ ID NO: 1475161 - DNA, 23 bp, Homo sapiens
cccaactcctggaagctgtgtcc

SEQ ID NO: 1475162 - DNA, 12 bp, Homo sapiens
cccaactctccc

SEQ ID NO: 1475163 - DNA, 23 bp, Homo sapiens
cccaactctccccagtgcctgcc

SEQ ID NO: 1475164 - DNA, 23 bp, Homo sapiens
cccaactgagtcatcttgtgagt

SEQ ID NO: 1475165 - DNA, 16 bp, Homo sapiens
cccaactgatcctgct

SEQ ID NO: 1475166 - DNA, 18 bp, Homo sapiens
cccaactgggggcaaagg

SEQ ID NO: 1475167 - DNA, 15 bp, Homo sapiens
cccaacttcaccacc

SEQ ID NO: 1475168 - DNA, 14 bp, Homo sapiens
cccaagaatgcaag

SEQ ID NO: 1475169 - DNA, 14 bp, Homo sapiens
cccaagagaactcg

SEQ ID NO: 1475170 - DNA, 21 bp, Homo sapiens
cccaagagaaggggaagcact

SEQ ID NO: 1475171 - DNA, 14 bp, Homo sapiens
cccaagaggactga

SEQ ID NO: 1475172 - DNA, 17 bp, Homo sapiens
cccaagaggtctgagcc

SEQ ID NO: 1475173 - DNA, 20 bp, Homo sapiens
cccaagattcacacctgact

SEQ ID NO: 1475174 - DNA, 23 bp, Homo sapiens
cccaagattcacacctgactctg

SEQ ID NO: 1475175 - DNA, 20 bp, Homo sapiens
cccaagcacctgggattaca

SEQ ID NO: 1475176 - DNA, 14 bp, Homo sapiens
cccaagcagccagc

SEQ ID NO: 1475177 - DNA, 14 bp, Homo sapiens
cccaagccagaggc

SEQ ID NO: 1475178 - DNA, 19 bp, Homo sapiens
cccagactgtctccacggc

SEQ ID NO: 1475179 - DNA, 20 bp, Homo sapiens
cccagagaaggacggtgcca

SEQ ID NO: 1475180 - DNA, 15 bp, Homo sapiens
cccagagacaggaaa

SEQ ID NO: 1475181 - DNA, 19 bp, Homo sapiens
cccagagactttgtagatc

SEQ ID NO: 1475182 - DNA, 21 bp, Homo sapiens
cccagagactttgtagatcct

SEQ ID NO: 1475183 - DNA, 18 bp, Homo sapiens
cccagagagaccctgcaa

SEQ ID NO: 1475184 - DNA, 22 bp, Homo sapiens
cccagagagaccctgcaagacc

SEQ ID NO: 1475185 - DNA, 19 bp, Homo sapiens
cccagagagaggggcctgc

SEQ ID NO: 1475186 - DNA, 21 bp, Homo sapiens
cccagagaggaatcagacttc

SEQ ID NO: 1475187 - DNA, 20 bp, Homo sapiens
cccagagatgcctccaccgc

SEQ ID NO: 1475188 - DNA, 19 bp, Homo sapiens
cccagagcaccccctgctc

SEQ ID NO: 1475189 - DNA, 17 bp, Homo sapiens
cccagagcacctcacct

SEQ ID NO: 1475190 - DNA, 12 bp, Homo sapiens
cccagagcccag

SEQ ID NO: 1475191 - DNA, 14 bp, Homo sapiens
cccagagcccagct

SEQ ID NO: 1475192 - DNA, 16 bp, Homo sapiens
cccagagcccagctct

SEQ ID NO: 1475193 - DNA, 18 bp, Homo sapiens
cccagagcccagctcttg

SEQ ID NO: 1475194 - DNA, 20 bp, Homo sapiens
cccagagcctggctgcccat

SEQ ID NO: 1475195 - DNA, 22 bp, Homo sapiens
cccagagctcatcccccctgct

SEQ ID NO: 1475196 - DNA, 15 bp, Homo sapiens
cccagagctgtgcca

SEQ ID NO: 1475197 - DNA, 17 bp, Homo sapiens
cccagagctgtgccagc

SEQ ID NO: 1475198 - DNA, 18 bp, Homo sapiens
cccagagcttattggcca

SEQ ID NO: 1475199 - DNA, 20 bp, Homo sapiens
cccagagcttattggccact

SEQ ID NO: 1475200 - DNA, 20 bp, Homo sapiens
cccagaggagccaccagttc

SEQ ID NO: 1475201 - DNA, 20 bp, Homo sapiens
cccagaggagctgggagccg

SEQ ID NO: 1475202 - DNA, 23 bp, Homo sapiens
cccagaggctcccaatcagcttt

SEQ ID NO: 1475203 - DNA, 13 bp, Homo sapiens
cccagagggccca

SEQ ID NO: 1475204 - DNA, 14 bp, Homo sapiens
cccagagggcccag

SEQ ID NO: 1475205 - DNA, 23 bp, Homo sapiens
cccagaggtgggatcctccctca

SEQ ID NO: 1475206 - DNA, 17 bp, Homo sapiens
cccagaggttatctgcc

SEQ ID NO: 1475207 - DNA, 20 bp, Homo sapiens
cccagaggttatctgcctgg

SEQ ID NO: 1475208 - DNA, 21 bp, Homo sapiens
cccagaggttatctgcctggc

SEQ ID NO: 1475209 - DNA, 17 bp, Homo sapiens
cccagagtcagaggaga

SEQ ID NO: 1475210 - DNA, 16 bp, Homo sapiens
cccagagtgtgggaag

SEQ ID NO: 1475211 - DNA, 20 bp, Homo sapiens
cccagagttgctgtgccgtg

SEQ ID NO: 1475212 - DNA, 20 bp, Homo sapiens
cccagatacgggggctgtga

SEQ ID NO: 1475213 - DNA, 19 bp, Homo sapiens
cccagatcagtcagagccc

SEQ ID NO: 1475214 - DNA, 13 bp, Homo sapiens
cccagatctgcct

SEQ ID NO: 1475215 - DNA, 21 bp, Homo sapiens
cccagatctgcctgggcctgt

SEQ ID NO: 1475216 - DNA, 19 bp, Homo sapiens
cccagatctggtcccttgc

SEQ ID NO: 1475217 - DNA, 20 bp, Homo sapiens
cccagatctggtcccttgca

SEQ ID NO: 1475218 - DNA, 17 bp, Homo sapiens
cccagattcccctgtgt

SEQ ID NO: 1475219 - DNA, 17 bp, Homo sapiens
cccagattggctcacac

SEQ ID NO: 1475220 - DNA, 19 bp, Homo sapiens
cccagattggctcacactg

SEQ ID NO: 1475221 - DNA, 21 bp, Homo sapiens
cccagattggctcacactgag

SEQ ID NO: 1475222 - DNA, 15 bp, Homo sapiens
cccagattgtgtaca

SEQ ID NO: 1475223 - DNA, 23 bp, Homo sapiens
cccagcaagacctcatctgtgga

SEQ ID NO: 1475224 - DNA, 15 bp, Homo sapiens
cccagcaagcgggag

SEQ ID NO: 1475225 - DNA, 22 bp, Homo sapiens
cccagcacctcagcctgcacag

SEQ ID NO: 1475226 - DNA, 15 bp, Homo sapiens
cccagcacctgctcc

SEQ ID NO: 1475227 - DNA, 16 bp, Homo sapiens
cccagcacctgctccc

SEQ ID NO: 1475228 - DNA, 17 bp, Homo sapiens
cccagcactaaagcagt

SEQ ID NO: 1475229 - DNA, 12 bp, Homo sapiens
cccagcactgtg

SEQ ID NO: 1475230 - DNA, 22 bp, Homo sapiens
cccagcactttgggaggcaggg

SEQ ID NO: 1475231 - DNA, 19 bp, Homo sapiens
cccagcagatctcatgtcc

SEQ ID NO: 1475232 - DNA, 12 bp, Homo sapiens
cccagcagctca

SEQ ID NO: 1475233 - DNA, 20 bp, Homo sapiens
cccagcagctcaacctaccc

SEQ ID NO: 1475234 - DNA, 15 bp, Homo sapiens
cccagcaggaagcca

SEQ ID NO: 1475235 - DNA, 19 bp, Homo sapiens
cccagcaggaagccaggct

SEQ ID NO: 1475236 - DNA, 13 bp, Homo sapiens
cccagcaggccca

SEQ ID NO: 1475237 - DNA, 17 bp, Homo sapiens
cccagcaggcccagcat

SEQ ID NO: 1475238 - DNA, 19 bp, Homo sapiens
cccagcaggcccagcatgc

SEQ ID NO: 1475239 - DNA, 13 bp, Homo sapiens
cccagcaggggcc

SEQ ID NO: 1475240 - DNA, 20 bp, Homo sapiens
cccagcaggggccctcactc

SEQ ID NO: 1475241 - DNA, 16 bp, Homo sapiens
cccagcagtttgggag

SEQ ID NO: 1475242 - DNA, 15 bp, Homo sapiens
cccagcatccctgga

SEQ ID NO: 1475243 - DNA, 17 bp, Homo sapiens
cccagcatccctggagc

SEQ ID NO: 1475244 - DNA, 15 bp, Homo sapiens
cccagcatctcccag

SEQ ID NO: 1475245 - DNA, 17 bp, Homo sapiens
cccagcatctcccagca

SEQ ID NO: 1475246 - DNA, 19 bp, Homo sapiens
cccagcatctcccagcaag

SEQ ID NO: 1475247 - DNA, 17 bp, Homo sapiens
cccagcatgcaggtggt

SEQ ID NO: 1475248 - DNA, 18 bp, Homo sapiens
cccagcattccagcccct

SEQ ID NO: 1475249 - DNA, 18 bp, Homo sapiens
cccagcattccagctctg

SEQ ID NO: 1475250 - DNA, 19 bp, Homo sapiens
cccagcattccagctctgc

SEQ ID NO: 1475251 - DNA, 15 bp, Homo sapiens
cccagcattgctggt

SEQ ID NO: 1475252 - DNA, 18 bp, Homo sapiens
cccagcattgctggttct

SEQ ID NO: 1475253 - DNA, 17 bp, Homo sapiens
cccagccaaaccctgtc

SEQ ID NO: 1475254 - DNA, 11 bp, Homo sapiens
cccagccacag

SEQ ID NO: 1475255 - DNA, 16 bp, Homo sapiens
cccagccacaggccaa

SEQ ID NO: 1475256 - DNA, 12 bp, Homo sapiens
cccagccacccc

SEQ ID NO: 1475257 - DNA, 19 bp, Homo sapiens
cccagccaccccgggctct

SEQ ID NO: 1475258 - DNA, 17 bp, Homo sapiens
cccagccacgactgcca

SEQ ID NO: 1475259 - DNA, 18 bp, Homo sapiens
cccagccacgactgccat

SEQ ID NO: 1475260 - DNA, 13 bp, Homo sapiens
cccagccagaaag

SEQ ID NO: 1475261 - DNA, 13 bp, Homo sapiens
cccagccagaggt

SEQ ID NO: 1475262 - DNA, 17 bp, Homo sapiens
cccagccagagttcctg

SEQ ID NO: 1475263 - DNA, 22 bp, Homo sapiens
cccagccagagttcctgcggag

SEQ ID NO: 1475264 - DNA, 15 bp, Homo sapiens
cccagccaggagcag

SEQ ID NO: 1475265 - DNA, 14 bp, Homo sapiens
cccagccaggctcc

SEQ ID NO: 1475266 - DNA, 17 bp, Homo sapiens
cccagccaggctcctac

SEQ ID NO: 1475267 - DNA, 21 bp, Homo sapiens
cccagccatctgcccaggggt

SEQ ID NO: 1475268 - DNA, 18 bp, Homo sapiens
cccagccattaccatgga

SEQ ID NO: 1475269 - DNA, 11 bp, Homo sapiens
cccagcccaat

SEQ ID NO: 1475270 - DNA, 14 bp, Homo sapiens
cccagcccaataaa

SEQ ID NO: 1475271 - DNA, 15 bp, Homo sapiens
cccagcccagagaca

SEQ ID NO: 1475272 - DNA, 13 bp, Homo sapiens
cccagcccagagc

SEQ ID NO: 1475273 - DNA, 20 bp, Homo sapiens
cccagcccagattcccctgt

SEQ ID NO: 1475274 - DNA, 21 bp, Homo sapiens
cccagcccagattcccctgtg

SEQ ID NO: 1475275 - DNA, 12 bp, Homo sapiens
cccagcccagga

SEQ ID NO: 1475276 - DNA, 22 bp, Homo sapiens
cccagcccatccattaggccag

SEQ ID NO: 1475277 - DNA, 21 bp, Homo sapiens
cccagcccattctctctcctg

SEQ ID NO: 1475278 - DNA, 15 bp, Homo sapiens
cccagcccattgctg

SEQ ID NO: 1475279 - DNA, 15 bp, Homo sapiens
cccagccccacccct

SEQ ID NO: 1475280 - DNA, 21 bp, Homo sapiens
cccagccccacccctaagtgc

SEQ ID NO: 1475281 - DNA, 16 bp, Homo sapiens
cccagccccagcccct

SEQ ID NO: 1475282 - DNA, 21 bp, Homo sapiens
cccagcccctccagcaccact

SEQ ID NO: 1475283 - DNA, 18 bp, Homo sapiens
cccagcccctgcccctca

SEQ ID NO: 1475284 - DNA, 13 bp, Homo sapiens
cccagccctggga

SEQ ID NO: 1475285 - DNA, 21 bp, Homo sapiens
cccagccctgggaaccactcc

SEQ ID NO: 1475286 - DNA, 23 bp, Homo sapiens
cccagccctgggaaccactccca

SEQ ID NO: 1475287 - DNA, 14 bp, Homo sapiens
cccagcccttctgc

SEQ ID NO: 1475288 - DNA, 16 bp, Homo sapiens
cccagcccttctgcct

SEQ ID NO: 1475289 - DNA, 17 bp, Homo sapiens
cccagcccttctgcctt

SEQ ID NO: 1475290 - DNA, 15 bp, Homo sapiens
cccagccggcctctc

SEQ ID NO: 1475291 - DNA, 19 bp, Homo sapiens
cccagccggcctctctggc

SEQ ID NO: 1475292 - DNA, 14 bp, Homo sapiens
cccatcatgtggcc

SEQ ID NO: 1475293 - DNA, 14 bp, Homo sapiens
cccatcattccttc

SEQ ID NO: 1475294 - DNA, 16 bp, Homo sapiens
cccatccagccagacc

SEQ ID NO: 1475295 - DNA, 12 bp, Homo sapiens
cccatcccagtc

SEQ ID NO: 1475296 - DNA, 15 bp, Homo sapiens
cccatcccagtccct

SEQ ID NO: 1475297 - DNA, 19 bp, Homo sapiens
cccatcccccactgccaca

SEQ ID NO: 1475298 - DNA, 12 bp, Homo sapiens
cccatccccctg

SEQ ID NO: 1475299 - DNA, 22 bp, Homo sapiens
cccatccctcgggaagcagcca

SEQ ID NO: 1475300 - DNA, 17 bp, Homo sapiens
cccatccctgtcatttt

SEQ ID NO: 1475301 - DNA, 14 bp, Homo sapiens
cccatcctaccctc

SEQ ID NO: 1475302 - DNA, 19 bp, Homo sapiens
cccatcctctaaagcagag

SEQ ID NO: 1475303 - DNA, 15 bp, Homo sapiens
cccatcctgaccagc

SEQ ID NO: 1475304 - DNA, 21 bp, Homo sapiens
cccatcctggggcagcactcc

SEQ ID NO: 1475305 - DNA, 19 bp, Homo sapiens
cccatcgtctcggccttca

SEQ ID NO: 1475306 - DNA, 21 bp, Homo sapiens
cccatctatgtcccttgctgt

SEQ ID NO: 1475307 - DNA, 19 bp, Homo sapiens
cccatctcaggtgccactc

SEQ ID NO: 1475308 - DNA, 19 bp, Homo sapiens
cccatctccccaggcctcc

SEQ ID NO: 1475309 - DNA, 12 bp, Homo sapiens
cccatctccctg

SEQ ID NO: 1475310 - DNA, 20 bp, Homo sapiens
cccatctccctgcctggccc

SEQ ID NO: 1475311 - DNA, 19 bp, Homo sapiens
cccatctccttcccccagc

SEQ ID NO: 1475312 - DNA, 21 bp, Homo sapiens
cccatctctccctcccctgcc

SEQ ID NO: 1475313 - DNA, 24 bp, Homo sapiens
cccatctctctactgctggactgt

SEQ ID NO: 1475314 - DNA, 18 bp, Homo sapiens
cccatctcttcctaccca

SEQ ID NO: 1475315 - DNA, 20 bp, Homo sapiens
cccatctggctttttctgcc

SEQ ID NO: 1475316 - DNA, 21 bp, Homo sapiens
cccatctggctttttctgcca

SEQ ID NO: 1475317 - DNA, 23 bp, Homo sapiens
cccatctgggagtccccttttct

SEQ ID NO: 1475318 - DNA, 19 bp, Homo sapiens
cccatctgtagtaatttat

SEQ ID NO: 1475319 - DNA, 16 bp, Homo sapiens
cccatcttccacctgt

SEQ ID NO: 1475320 - DNA, 18 bp, Homo sapiens
cccatcttcctgctgctg

SEQ ID NO: 1475321 - DNA, 12 bp, Homo sapiens
cccatcttgctt

SEQ ID NO: 1475322 - DNA, 20 bp, Homo sapiens
cccatctttgatccttctga

SEQ ID NO: 1475323 - DNA, 18 bp, Homo sapiens
cccatgaagacaggacag

SEQ ID NO: 1475324 - DNA, 19 bp, Homo sapiens
cccatgaccatactgaggg

SEQ ID NO: 1475325 - DNA, 14 bp, Homo sapiens
cccatgacccaccc

SEQ ID NO: 1475326 - DNA, 15 bp, Homo sapiens
cccatgacccacccc

SEQ ID NO: 1475327 - DNA, 22 bp, Homo sapiens
cccatgacccacccctgtgctc

SEQ ID NO: 1475328 - DNA, 22 bp, Homo sapiens
cccatgactttatatggatgat

SEQ ID NO: 1475329 - DNA, 21 bp, Homo sapiens
cccatgatactccactcccag

SEQ ID NO: 1475330 - DNA, 15 bp, Homo sapiens
cccatgatccctgtg

SEQ ID NO: 1475331 - DNA, 16 bp, Homo sapiens
cccatgcaagcagagg

SEQ ID NO: 1475332 - DNA, 21 bp, Homo sapiens
cccatgcaagcagaggaccag

SEQ ID NO: 1475333 - DNA, 20 bp, Homo sapiens
cccatgcacagtacaataat

SEQ ID NO: 1475334 - DNA, 12 bp, Homo sapiens
cccatgcactgt

SEQ ID NO: 1475335 - DNA, 21 bp, Homo sapiens
cccatgccaaagctagggtgg

SEQ ID NO: 1475336 - DNA, 20 bp, Homo sapiens
cccatgccaccacccacccc

SEQ ID NO: 1475337 - DNA, 13 bp, Homo sapiens
cccatgccagaga

SEQ ID NO: 1475338 - DNA, 15 bp, Homo sapiens
cccatgccagagagg

SEQ ID NO: 1475339 - DNA, 14 bp, Homo sapiens
cccatgcccacctg

SEQ ID NO: 1475340 - DNA, 15 bp, Homo sapiens
cccatgcccacctgc

SEQ ID NO: 1475341 - DNA, 18 bp, Homo sapiens
cccatgcccacctgccca

SEQ ID NO: 1475342 - DNA, 12 bp, Homo sapiens
cccatgcctgtc

SEQ ID NO: 1475343 - DNA, 16 bp, Homo sapiens
cccatgcctgtccagc

SEQ ID NO: 1475344 - DNA, 21 bp, Homo sapiens
cccatgcgtgccgcctgctcc

SEQ ID NO: 1475345 - DNA, 23 bp, Homo sapiens
cccatgcgtgccgcctgctcctc

SEQ ID NO: 1475346 - DNA, 13 bp, Homo sapiens
cccatgctccacc

SEQ ID NO: 1475347 - DNA, 12 bp, Homo sapiens
cccatgctctgc

SEQ ID NO: 1475348 - DNA, 15 bp, Homo sapiens
cccatgctctgcccc

SEQ ID NO: 1475349 - DNA, 20 bp, Homo sapiens
cccatgctctgccccaagcc

SEQ ID NO: 1475350 - DNA, 20 bp, Homo sapiens
cccatgcttacgtgatcctc

SEQ ID NO: 1475351 - DNA, 13 bp, Homo sapiens
cccatggaatatt

SEQ ID NO: 1475352 - DNA, 14 bp, Homo sapiens
cccatggcccccaa

SEQ ID NO: 1475353 - DNA, 17 bp, Homo sapiens
cccatggcccccaataa

SEQ ID NO: 1475354 - DNA, 18 bp, Homo sapiens
cccatggcccccaataaa

SEQ ID NO: 1475355 - DNA, 21 bp, Homo sapiens
cccatggcccccaataaaggc

SEQ ID NO: 1475356 - DNA, 23 bp, Homo sapiens
cccatgggctgagtggggagcag

SEQ ID NO: 1475357 - DNA, 15 bp, Homo sapiens
cccatgggctgtgtc

SEQ ID NO: 1475358 - DNA, 21 bp, Homo sapiens
cccatgggcttggacttcctg

SEQ ID NO: 1475359 - DNA, 20 bp, Homo sapiens
cccatgggggtgagaccctc

SEQ ID NO: 1475360 - DNA, 18 bp, Homo sapiens
cccatggggtccttggag

SEQ ID NO: 1475361 - DNA, 22 bp, Homo sapiens
cccatgggttgtgtgtttattt

SEQ ID NO: 1475362 - DNA, 17 bp, Homo sapiens
cccatggtgctaggaag

SEQ ID NO: 1475363 - DNA, 21 bp, Homo sapiens
cccatgtaatccttttgttta

SEQ ID NO: 1475364 - DNA, 13 bp, Homo sapiens
cccatgtcacctc

SEQ ID NO: 1475365 - DNA, 15 bp, Homo sapiens
cccatgtcacctcag

SEQ ID NO: 1475366 - DNA, 17 bp, Homo sapiens
cccatgtcacctcagct

SEQ ID NO: 1475367 - DNA, 15 bp, Homo sapiens
cccatgtggctgaag

SEQ ID NO: 1475368 - DNA, 16 bp, Homo sapiens
cccatgtggctgaaga

SEQ ID NO: 1475369 - DNA, 17 bp, Homo sapiens
cccatgtgtacattctg

SEQ ID NO: 1475370 - DNA, 23 bp, Homo sapiens
cccatgttagctacacagtgcag

SEQ ID NO: 1475371 - DNA, 18 bp, Homo sapiens
cccatgttgtaatgctgc

SEQ ID NO: 1475372 - DNA, 21 bp, Homo sapiens
cccattaaggggaagaatgaa

SEQ ID NO: 1475373 - DNA, 16 bp, Homo sapiens
cccattcacagagcct

SEQ ID NO: 1475374 - DNA, 14 bp, Homo sapiens
cccattcagacact

SEQ ID NO: 1475375 - DNA, 17 bp, Homo sapiens
cccattcagacacttca

SEQ ID NO: 1475376 - DNA, 20 bp, Homo sapiens
cccattcatattaagacagt

SEQ ID NO: 1475377 - DNA, 21 bp, Homo sapiens
cccattcccccatgtggctga

SEQ ID NO: 1475378 - DNA, 19 bp, Homo sapiens
cccattcgtctgtcccaga

SEQ ID NO: 1475379 - DNA, 20 bp, Homo sapiens
cccattctctctcctgtcca

SEQ ID NO: 1475380 - DNA, 22 bp, Homo sapiens
cccattctgttttcccccagca

SEQ ID NO: 1475381 - DNA, 14 bp, Homo sapiens
cccattgccctggt

SEQ ID NO: 1475382 - DNA, 13 bp, Homo sapiens
cccattgctgcca

SEQ ID NO: 1475383 - DNA, 15 bp, Homo sapiens
cccattgtggctcct

SEQ ID NO: 1475384 - DNA, 20 bp, Homo sapiens
cccattgttgtcaaggaaga

SEQ ID NO: 1475385 - DNA, 20 bp, Homo sapiens
cccatttaaatttttttcct

SEQ ID NO: 1475386 - DNA, 12 bp, Homo sapiens
cccatttagaat

SEQ ID NO: 1475387 - DNA, 23 bp, Homo sapiens
cccatttcaggaatttaaaatta

SEQ ID NO: 1475388 - DNA, 15 bp, Homo sapiens
cccatttcccatctg

SEQ ID NO: 1475389 - DNA, 17 bp, Homo sapiens
cccatttcccatctgca

SEQ ID NO: 1475390 - DNA, 18 bp, Homo sapiens
cccatttcctcacactaa

SEQ ID NO: 1475391 - DNA, 13 bp, Homo sapiens
cccatttccttgg

SEQ ID NO: 1475392 - DNA, 21 bp, Homo sapiens
cccatttgagaagctgaggct

SEQ ID NO: 1475393 - DNA, 19 bp, Homo sapiens
cccattttgcaaaatttcc

SEQ ID NO: 1475394 - DNA, 20 bp, Homo sapiens
cccatttttatatcgatctc

SEQ ID NO: 1475395 - DNA, 13 bp, Homo sapiens
cccatttttctct

SEQ ID NO: 1475396 - DNA, 21 bp, Homo sapiens
cccattttttaaaaaagcaag

SEQ ID NO: 1475397 - DNA, 13 bp, Homo sapiens
ccccaaaatatta

SEQ ID NO: 1475398 - DNA, 19 bp, Homo sapiens
ccccaaacgggctgccctg

SEQ ID NO: 1475399 - DNA, 17 bp, Homo sapiens
ccccaaagacctgcctg

SEQ ID NO: 1475400 - DNA, 19 bp, Homo sapiens
ccccaaagactctggaggt

SEQ ID NO: 1475401 - DNA, 15 bp, Homo sapiens
ccccaaaggaacact

SEQ ID NO: 1475402 - DNA, 19 bp, Homo sapiens
ccccaaaggaacactgaca

SEQ ID NO: 1475403 - DNA, 21 bp, Homo sapiens
ccccaaagggcctcctcaccc

SEQ ID NO: 1475404 - DNA, 15 bp, Homo sapiens
ccccaaatcaataca

SEQ ID NO: 1475405 - DNA, 18 bp, Homo sapiens
ccccaacactgtgccctg

SEQ ID NO: 1475406 - DNA, 16 bp, Homo sapiens
ccccagccctgggaac

SEQ ID NO: 1475407 - DNA, 13 bp, Homo sapiens
ccccagcctccct

SEQ ID NO: 1475408 - DNA, 15 bp, Homo sapiens
ccccagcctccctga

SEQ ID NO: 1475409 - DNA, 17 bp, Homo sapiens
ccccagctaataaacca

SEQ ID NO: 1475410 - DNA, 14 bp, Homo sapiens
ccccagctccccag

SEQ ID NO: 1475411 - DNA, 15 bp, Homo sapiens
ccccagctccccagg

SEQ ID NO: 1475412 - DNA, 17 bp, Homo sapiens
ccccagctcgctggctt

SEQ ID NO: 1475413 - DNA, 12 bp, Homo sapiens
ccccagctctgg

SEQ ID NO: 1475414 - DNA, 13 bp, Homo sapiens
ccccagctctgga

SEQ ID NO: 1475415 - DNA, 14 bp, Homo sapiens
ccccagctctggtg

SEQ ID NO: 1475416 - DNA, 20 bp, Homo sapiens
ccccagctcttctcttccta

SEQ ID NO: 1475417 - DNA, 10 bp, Homo sapiens
ccccagctga

SEQ ID NO: 1475418 - DNA, 15 bp, Homo sapiens
ccccagctgactgtg

SEQ ID NO: 1475419 - DNA, 15 bp, Homo sapiens
ccccagctgggaggc

SEQ ID NO: 1475420 - DNA, 14 bp, Homo sapiens
ccccagcttcctgt

SEQ ID NO: 1475421 - DNA, 19 bp, Homo sapiens
ccccaggaaactagctttt

SEQ ID NO: 1475422 - DNA, 16 bp, Homo sapiens
ccccaggaccagctca

SEQ ID NO: 1475423 - DNA, 17 bp, Homo sapiens
ccccaggactcaccctc

SEQ ID NO: 1475424 - DNA, 19 bp, Homo sapiens
ccccaggactcaccctcat

SEQ ID NO: 1475425 - DNA, 13 bp, Homo sapiens
ccccaggactggg

SEQ ID NO: 1475426 - DNA, 23 bp, Homo sapiens
ccccaggatcactctctgctggc

SEQ ID NO: 1475427 - DNA, 13 bp, Homo sapiens
ccccaggcccacc

SEQ ID NO: 1475428 - DNA, 17 bp, Homo sapiens
ccccaggccggagccca

SEQ ID NO: 1475429 - DNA, 19 bp, Homo sapiens
ccccaggccggagcccaga

SEQ ID NO: 1475430 - DNA, 16 bp, Homo sapiens
ccccaggcctccagcc

SEQ ID NO: 1475431 - DNA, 17 bp, Homo sapiens
ccccaggcctccagcct

SEQ ID NO: 1475432 - DNA, 21 bp, Homo sapiens
ccccaggcctgaaagaggctg

SEQ ID NO: 1475433 - DNA, 23 bp, Homo sapiens
ccccaggcctgaaagaggctgag

SEQ ID NO: 1475434 - DNA, 15 bp, Homo sapiens
ccccaggcctgtcca

SEQ ID NO: 1475435 - DNA, 16 bp, Homo sapiens
ccccaggcctgtccac

SEQ ID NO: 1475436 - DNA, 21 bp, Homo sapiens
ccccaggcctgtccaccctgc

SEQ ID NO: 1475437 - DNA, 19 bp, Homo sapiens
ccccaggctgagagccaga

SEQ ID NO: 1475438 - DNA, 17 bp, Homo sapiens
ccccagggaaggaaaaa

SEQ ID NO: 1475439 - DNA, 12 bp, Homo sapiens
ccccagggcagc

SEQ ID NO: 1475440 - DNA, 11 bp, Homo sapiens
ccccagggccc

SEQ ID NO: 1475441 - DNA, 16 bp, Homo sapiens
ccccagggcccccaca

SEQ ID NO: 1475442 - DNA, 17 bp, Homo sapiens
ccccagggcccccacag

SEQ ID NO: 1475443 - DNA, 13 bp, Homo sapiens
ccccagggcccct

SEQ ID NO: 1475444 - DNA, 15 bp, Homo sapiens
ccccagggcctccag

SEQ ID NO: 1475445 - DNA, 19 bp, Homo sapiens
ccccagggcctccagggcc

SEQ ID NO: 1475446 - DNA, 17 bp, Homo sapiens
ccccaggggaaaatgaa

SEQ ID NO: 1475447 - DNA, 18 bp, Homo sapiens
ccccaggggaaaatgaag

SEQ ID NO: 1475448 - DNA, 15 bp, Homo sapiens
ccccaggggcaggac

SEQ ID NO: 1475449 - DNA, 22 bp, Homo sapiens
ccccagggggtctcacccatgc

SEQ ID NO: 1475450 - DNA, 16 bp, Homo sapiens
ccccagggtcttccct

SEQ ID NO: 1475451 - DNA, 19 bp, Homo sapiens
ccccagggtcttccctacc

SEQ ID NO: 1475452 - DNA, 21 bp, Homo sapiens
ccccaggtccagctctggagg

SEQ ID NO: 1475453 - DNA, 22 bp, Homo sapiens
ccccaggtccagctctggaggg

SEQ ID NO: 1475454 - DNA, 16 bp, Homo sapiens
ccccaggtctctccac

SEQ ID NO: 1475455 - DNA, 11 bp, Homo sapiens
ccccagtccca

SEQ ID NO: 1475456 - DNA, 18 bp, Homo sapiens
ccccagtccccacccctg

SEQ ID NO: 1475457 - DNA, 17 bp, Homo sapiens
ccccagtgcctgccact

SEQ ID NO: 1475458 - DNA, 15 bp, Homo sapiens
ccccagtgctggaag

SEQ ID NO: 1475459 - DNA, 16 bp, Homo sapiens
ccccagttcagaaatt

SEQ ID NO: 1475460 - DNA, 22 bp, Homo sapiens
ccccatacttggctgcttcctg

SEQ ID NO: 1475461 - DNA, 22 bp, Homo sapiens
ccccatcattactggtaaagcc

SEQ ID NO: 1475462 - DNA, 20 bp, Homo sapiens
ccccatcattgcacctgcag

SEQ ID NO: 1475463 - DNA, 22 bp, Homo sapiens
ccccatcattgcacctgcaggc

SEQ ID NO: 1475464 - DNA, 19 bp, Homo sapiens
ccccatccagacctggctc

SEQ ID NO: 1475465 - DNA, 15 bp, Homo sapiens
ccccatccagcctcc

SEQ ID NO: 1475466 - DNA, 17 bp, Homo sapiens
ccccatccagcctccag

SEQ ID NO: 1475467 - DNA, 12 bp, Homo sapiens
ccccatccctcg

SEQ ID NO: 1475468 - DNA, 19 bp, Homo sapiens
ccccatcctcatccctgac

SEQ ID NO: 1475469 - DNA, 14 bp, Homo sapiens
ccccatctccccag

SEQ ID NO: 1475470 - DNA, 13 bp, Homo sapiens
ccccatctccctg

SEQ ID NO: 1475471 - DNA, 14 bp, Homo sapiens
ccccatctccctgc

SEQ ID NO: 1475472 - DNA, 19 bp, Homo sapiens
ccccatctccctgcctggc

SEQ ID NO: 1475473 - DNA, 14 bp, Homo sapiens
ccccatctctacta

SEQ ID NO: 1475474 - DNA, 15 bp, Homo sapiens
ccccatctctcatcc

SEQ ID NO: 1475475 - DNA, 19 bp, Homo sapiens
ccccatctctccctcccct

SEQ ID NO: 1475476 - DNA, 14 bp, Homo sapiens
ccccatcttgcttc

SEQ ID NO: 1475477 - DNA, 20 bp, Homo sapiens
ccccatctttgatccttctg

SEQ ID NO: 1475478 - DNA, 13 bp, Homo sapiens
ccccatgcactgt

SEQ ID NO: 1475479 - DNA, 23 bp, Homo sapiens
ccccatgcactgtgaaggaccct

SEQ ID NO: 1475480 - DNA, 13 bp, Homo sapiens
ccccatgccaaag

SEQ ID NO: 1475481 - DNA, 22 bp, Homo sapiens
ccccatgccaaagctagggtgg

SEQ ID NO: 1475482 - DNA, 19 bp, Homo sapiens
ccccatgccaccacccacc

SEQ ID NO: 1475483 - DNA, 17 bp, Homo sapiens
ccccatgcccctcccct

SEQ ID NO: 1475484 - DNA, 19 bp, Homo sapiens
ccccatgcctgtccagcct

SEQ ID NO: 1475485 - DNA, 22 bp, Homo sapiens
ccccatgcctgtccagcctggg

SEQ ID NO: 1475486 - DNA, 23 bp, Homo sapiens
ccccatgcctgtccagcctgggc

SEQ ID NO: 1475487 - DNA, 24 bp, Homo sapiens
ccccatgcctgtccagcctgggca

SEQ ID NO: 1475488 - DNA, 13 bp, Homo sapiens
ccccatgctctgc

SEQ ID NO: 1475489 - DNA, 15 bp, Homo sapiens
ccccatgctctgccc

SEQ ID NO: 1475490 - DNA, 17 bp, Homo sapiens
ccccatgggcttggact

SEQ ID NO: 1475491 - DNA, 22 bp, Homo sapiens
ccccatgggcttggacttcctg

SEQ ID NO: 1475492 - DNA, 18 bp, Homo sapiens
ccccatggggctgcggga

SEQ ID NO: 1475493 - DNA, 18 bp, Homo sapiens
ccccatgtgcctgcacca

SEQ ID NO: 1475494 - DNA, 18 bp, Homo sapiens
ccccatgtgtcctggttc

SEQ ID NO: 1475495 - DNA, 20 bp, Homo sapiens
ccccatgttgtaatgctgca

SEQ ID NO: 1475496 - DNA, 22 bp, Homo sapiens
ccccatgttgtaatgctgcact

SEQ ID NO: 1475497 - DNA, 19 bp, Homo sapiens
ccccattcctgatcccatg

SEQ ID NO: 1475498 - DNA, 23 bp, Homo sapiens
ccccattcttcctagttttctcc

SEQ ID NO: 1475499 - DNA, 16 bp, Homo sapiens
ccccatttcccatctg

SEQ ID NO: 1475500 - DNA, 17 bp, Homo sapiens
ccccatttcccatctgc

SEQ ID NO: 1475501 - DNA, 20 bp, Homo sapiens
ccccatttcccatctgcacc

SEQ ID NO: 1475502 - DNA, 18 bp, Homo sapiens
cccccaaaatccaaaact

SEQ ID NO: 1475503 - DNA, 14 bp, Homo sapiens
cccccaaaccctgc

SEQ ID NO: 1475504 - DNA, 19 bp, Homo sapiens
cccccaaaccctgcttctg

SEQ ID NO: 1475505 - DNA, 19 bp, Homo sapiens
cccccaaagatagacaggt

SEQ ID NO: 1475506 - DNA, 24 bp, Homo sapiens
cccccaaagatagacaggtcctga

SEQ ID NO: 1475507 - DNA, 19 bp, Homo sapiens
cccccaaattgccttcagc

SEQ ID NO: 1475508 - DNA, 21 bp, Homo sapiens
cccccaacactgtgccctggt

SEQ ID NO: 1475509 - DNA, 23 bp, Homo sapiens
cccccaacactgtgccctggtgg

SEQ ID NO: 1475510 - DNA, 15 bp, Homo sapiens
cccccaacctcaggg

SEQ ID NO: 1475511 - DNA, 23 bp, Homo sapiens
cccccaactgtggtagctccagc

SEQ ID NO: 1475512 - DNA, 16 bp, Homo sapiens
cccccaataaaggcag

SEQ ID NO: 1475513 - DNA, 19 bp, Homo sapiens
cccccaataaaggcagctg

SEQ ID NO: 1475514 - DNA, 21 bp, Homo sapiens
cccccaataaaggcagctgcc

SEQ ID NO: 1475515 - DNA, 19 bp, Homo sapiens
cccccaatcggactgccaa

SEQ ID NO: 1475516 - DNA, 22 bp, Homo sapiens
cccccacaagctgtccctgcag

SEQ ID NO: 1475517 - DNA, 23 bp, Homo sapiens
cccccacaagctgtccctgcagg

SEQ ID NO: 1475518 - DNA, 15 bp, Homo sapiens
cccccaccacactga

SEQ ID NO: 1475519 - DNA, 17 bp, Homo sapiens
cccccaccacactgaat

SEQ ID NO: 1475520 - DNA, 15 bp, Homo sapiens
cccttggattcctgc

SEQ ID NO: 1475521 - DNA, 12 bp, Homo sapiens
cccttggcctca

SEQ ID NO: 1475522 - DNA, 20 bp, Homo sapiens
cccttggcctccatttctgt

SEQ ID NO: 1475523 - DNA, 19 bp, Homo sapiens
cccttggcctgtctcatcc

SEQ ID NO: 1475524 - DNA, 19 bp, Homo sapiens
cccttgggcatccacccag

SEQ ID NO: 1475525 - DNA, 12 bp, Homo sapiens
cccttgggccac

SEQ ID NO: 1475526 - DNA, 14 bp, Homo sapiens
cccttggggcctgg

SEQ ID NO: 1475527 - DNA, 17 bp, Homo sapiens
cccttggggcctggctt

SEQ ID NO: 1475528 - DNA, 19 bp, Homo sapiens
cccttggggcctggcttgc

SEQ ID NO: 1475529 - DNA, 22 bp, Homo sapiens
cccttggggtaagccagagcct

SEQ ID NO: 1475530 - DNA, 11 bp, Homo sapiens
cccttgtattt

SEQ ID NO: 1475531 - DNA, 18 bp, Homo sapiens
cccttgtcatctctctgc

SEQ ID NO: 1475532 - DNA, 18 bp, Homo sapiens
cccttgtcctgccagctg

SEQ ID NO: 1475533 - DNA, 22 bp, Homo sapiens
cccttgtcctgccagctgcctt

SEQ ID NO: 1475534 - DNA, 13 bp, Homo sapiens
cccttgtgccctg

SEQ ID NO: 1475535 - DNA, 15 bp, Homo sapiens
cccttgttgcctgca

SEQ ID NO: 1475536 - DNA, 21 bp, Homo sapiens
cccttgttgtaaaaagcccag

SEQ ID NO: 1475537 - DNA, 19 bp, Homo sapiens
cccttgtttgtcccttcta

SEQ ID NO: 1475538 - DNA, 15 bp, Homo sapiens
ccctttactcagccc

SEQ ID NO: 1475539 - DNA, 20 bp, Homo sapiens
ccctttactcagcccagctg

SEQ ID NO: 1475540 - DNA, 17 bp, Homo sapiens
ccctttagctgtgttat

SEQ ID NO: 1475541 - DNA, 15 bp, Homo sapiens
ccctttccaacctca

SEQ ID NO: 1475542 - DNA, 23 bp, Homo sapiens
ccctttccccgacgcccacccaa

SEQ ID NO: 1475543 - DNA, 14 bp, Homo sapiens
ccctttcctgtccc

SEQ ID NO: 1475544 - DNA, 15 bp, Homo sapiens
ccctttcctgtccca

SEQ ID NO: 1475545 - DNA, 13 bp, Homo sapiens
ccctttccttcca

SEQ ID NO: 1475546 - DNA, 21 bp, Homo sapiens
ccctttccttccttccctggc

SEQ ID NO: 1475547 - DNA, 14 bp, Homo sapiens
ccctttctggctct

SEQ ID NO: 1475548 - DNA, 15 bp, Homo sapiens
ccctttcttggccag

SEQ ID NO: 1475549 - DNA, 16 bp, Homo sapiens
ccctttcttggccagt

SEQ ID NO: 1475550 - DNA, 18 bp, Homo sapiens
ccctttgcactgtaatga

SEQ ID NO: 1475551 - DNA, 14 bp, Homo sapiens
ccctttgccttcat

SEQ ID NO: 1475552 - DNA, 24 bp, Homo sapiens
ccctttggagaacgccagtctccc

SEQ ID NO: 1475553 - DNA, 21 bp, Homo sapiens
ccctttggccccactttgaag

SEQ ID NO: 1475554 - DNA, 20 bp, Homo sapiens
ccctttgggaggctgaggcg

SEQ ID NO: 1475555 - DNA, 15 bp, Homo sapiens
cccttttccagcctc

SEQ ID NO: 1475556 - DNA, 16 bp, Homo sapiens
cccttttctacagtta

SEQ ID NO: 1475557 - DNA, 14 bp, Homo sapiens
cccttttctttgac

SEQ ID NO: 1475558 - DNA, 23 bp, Homo sapiens
cccttttcttttctaccctagcc

SEQ ID NO: 1475559 - DNA, 17 bp, Homo sapiens
cccttttgcctggctgt

SEQ ID NO: 1475560 - DNA, 16 bp, Homo sapiens
ccctttttctccacac

SEQ ID NO: 1475561 - DNA, 16 bp, Homo sapiens
ccctttttctccagct

SEQ ID NO: 1475562 - DNA, 13 bp, Homo sapiens
ccgaagccatcac

SEQ ID NO: 1475563 - DNA, 18 bp, Homo sapiens
ccgaagccgcctgtggac

SEQ ID NO: 1475564 - DNA, 17 bp, Homo sapiens
ccgaagctctggctgaa

SEQ ID NO: 1475565 - DNA, 18 bp, Homo sapiens
ccgaatcccctccctgtc

SEQ ID NO: 1475566 - DNA, 14 bp, Homo sapiens
ccgacactgctgca

SEQ ID NO: 1475567 - DNA, 12 bp, Homo sapiens
ccgacagcctgg

SEQ ID NO: 1475568 - DNA, 14 bp, Homo sapiens
ccgacagcctggca

SEQ ID NO: 1475569 - DNA, 16 bp, Homo sapiens
ccgaccaactgcccta

SEQ ID NO: 1475570 - DNA, 17 bp, Homo sapiens
ccgaccaggctggacac

SEQ ID NO: 1475571 - DNA, 13 bp, Homo sapiens
ccgaccctgccct

SEQ ID NO: 1475572 - DNA, 19 bp, Homo sapiens
ccgacctcgtcctccccct

SEQ ID NO: 1475573 - DNA, 22 bp, Homo sapiens
ccgacctcgtcctccccctgcc

SEQ ID NO: 1475574 - DNA, 23 bp, Homo sapiens
ccgaccttccctccgccttctcc

SEQ ID NO: 1475575 - DNA, 18 bp, Homo sapiens
ccgacgccacagcccagc

SEQ ID NO: 1475576 - DNA, 23 bp, Homo sapiens
ccgacggtgggcatttgtgaggc

SEQ ID NO: 1475577 - DNA, 15 bp, Homo sapiens
ccgactaccccagtc

SEQ ID NO: 1475578 - DNA, 16 bp, Homo sapiens
ccgactaccccagtcc

SEQ ID NO: 1475579 - DNA, 19 bp, Homo sapiens
ccgactctggccctggccc

SEQ ID NO: 1475580 - DNA, 13 bp, Homo sapiens
ccgactgcctgtc

SEQ ID NO: 1475581 - DNA, 16 bp, Homo sapiens
ccgacttcccctgggc

SEQ ID NO: 1475582 - DNA, 18 bp, Homo sapiens
ccgacttcccctgggcaa

SEQ ID NO: 1475583 - DNA, 16 bp, Homo sapiens
ccgacttgctgttttg

SEQ ID NO: 1475584 - DNA, 24 bp, Homo sapiens
ccgacttggagactcctggtctgt

SEQ ID NO: 1475585 - DNA, 19 bp, Homo sapiens
ccgagacaccatcctgagc

SEQ ID NO: 1475586 - DNA, 21 bp, Homo sapiens
ccgagacaccatcctgagcca

SEQ ID NO: 1475587 - DNA, 18 bp, Homo sapiens
ccgagagagctctggccc

SEQ ID NO: 1475588 - DNA, 21 bp, Homo sapiens
ccgagagagctctggccccgc

SEQ ID NO: 1475589 - DNA, 16 bp, Homo sapiens
ccgagagtagccgaga

SEQ ID NO: 1475590 - DNA, 19 bp, Homo sapiens
ccgagatccccagggcagc

SEQ ID NO: 1475591 - DNA, 21 bp, Homo sapiens
ccgagcaaagatcaaaataaa

SEQ ID NO: 1475592 - DNA, 23 bp, Homo sapiens
ccgagcaaagatcaaaataaaaa

SEQ ID NO: 1475593 - DNA, 21 bp, Homo sapiens
ccgagcccagctacattcctc

SEQ ID NO: 1475594 - DNA, 12 bp, Homo sapiens
ccgagccctgga

SEQ ID NO: 1475595 - DNA, 13 bp, Homo sapiens
ccgagccctggag

SEQ ID NO: 1475596 - DNA, 15 bp, Homo sapiens
ccgagctctggtgct

SEQ ID NO: 1475597 - DNA, 16 bp, Homo sapiens
ccgagctgtaggagag

SEQ ID NO: 1475598 - DNA, 21 bp, Homo sapiens
ccgaggaaacgaaacccactc

SEQ ID NO: 1475599 - DNA, 19 bp, Homo sapiens
ccgaggaccaccagcaggc

SEQ ID NO: 1475600 - DNA, 13 bp, Homo sapiens
ccgaggacccagg

SEQ ID NO: 1475601 - DNA, 17 bp, Homo sapiens
ccgaggacccaggaaag

SEQ ID NO: 1475602 - DNA, 15 bp, Homo sapiens
ccgaggagctgggcc

SEQ ID NO: 1475603 - DNA, 22 bp, Homo sapiens
ccgaggatttctgggaccccgc

SEQ ID NO: 1475604 - DNA, 18 bp, Homo sapiens
ccgaggcccagcgggcag

SEQ ID NO: 1475605 - DNA, 19 bp, Homo sapiens
ccgaggcccagcgggcaga

SEQ ID NO: 1475606 - DNA, 13 bp, Homo sapiens
ccgaggcctggcc

SEQ ID NO: 1475607 - DNA, 14 bp, Homo sapiens
ccgaggcctggcca

SEQ ID NO: 1475608 - DNA, 18 bp, Homo sapiens
ccgaggctgccccaggcc

SEQ ID NO: 1475609 - DNA, 19 bp, Homo sapiens
ccgaggctgccccaggccg

SEQ ID NO: 1475610 - DNA, 19 bp, Homo sapiens
ccgagggtcctggctcctg

SEQ ID NO: 1475611 - DNA, 17 bp, Homo sapiens
ccgaggtatggcagagg

SEQ ID NO: 1475612 - DNA, 22 bp, Homo sapiens
ccgagtctcttctccactggat

SEQ ID NO: 1475613 - DNA, 12 bp, Homo sapiens
ccgagtggctgc

SEQ ID NO: 1475614 - DNA, 22 bp, Homo sapiens
ccgagtggctgccggaggagca

SEQ ID NO: 1475615 - DNA, 15 bp, Homo sapiens
ccgatacctcagccc

SEQ ID NO: 1475616 - DNA, 20 bp, Homo sapiens
ccgatcaacatttatgacct

SEQ ID NO: 1475617 - DNA, 22 bp, Homo sapiens
ccgatgctgctttcccctgtgg

SEQ ID NO: 1475618 - DNA, 23 bp, Homo sapiens
ccgatgctgctttcccctgtggg

SEQ ID NO: 1475619 - DNA, 17 bp, Homo sapiens
ccgatgtcgacatgttt

SEQ ID NO: 1475620 - DNA, 17 bp, Homo sapiens
ccgatgtgactgcatca

SEQ ID NO: 1475621 - DNA, 12 bp, Homo sapiens
ccgatttctgct

SEQ ID NO: 1475622 - DNA, 13 bp, Homo sapiens
ccgcaagctctca

SEQ ID NO: 1475623 - DNA, 14 bp, Homo sapiens
ccgcacagccaccc

SEQ ID NO: 1475624 - DNA, 12 bp, Homo sapiens
ccgcacagctca

SEQ ID NO: 1475625 - DNA, 13 bp, Homo sapiens
ccgcacagctcag

SEQ ID NO: 1475626 - DNA, 20 bp, Homo sapiens
ccgcacatggtgtggggggc

SEQ ID NO: 1475627 - DNA, 14 bp, Homo sapiens
ccgcaccagctgct

SEQ ID NO: 1475628 - DNA, 15 bp, Homo sapiens
ccgcaccagctgctc

SEQ ID NO: 1475629 - DNA, 17 bp, Homo sapiens
ccgcaccagctgctctg

SEQ ID NO: 1475630 - DNA, 19 bp, Homo sapiens
ccgcaccagctgctctgcc

SEQ ID NO: 1475631 - DNA, 13 bp, Homo sapiens
ccgcaccccagag

SEQ ID NO: 1475632 - DNA, 17 bp, Homo sapiens
ccgcaccccggcctcag

SEQ ID NO: 1475633 - DNA, 13 bp, Homo sapiens
ccgcacccggctc

SEQ ID NO: 1475634 - DNA, 21 bp, Homo sapiens
ccgcaccctgcacctgctgcg

SEQ ID NO: 1475635 - DNA, 18 bp, Homo sapiens
ccgctccccacctaccca

SEQ ID NO: 1475636 - DNA, 19 bp, Homo sapiens
ccgctccgtctctgtcctc

SEQ ID NO: 1475637 - DNA, 15 bp, Homo sapiens
ccgctcctgtctgcc

SEQ ID NO: 1475638 - DNA, 17 bp, Homo sapiens
ccgctcctgtctgccag

SEQ ID NO: 1475639 - DNA, 12 bp, Homo sapiens
ccgctctaaatt

SEQ ID NO: 1475640 - DNA, 18 bp, Homo sapiens
ccgctctacatcttctgc

SEQ ID NO: 1475641 - DNA, 19 bp, Homo sapiens
ccgctctacatcttctgcc

SEQ ID NO: 1475642 - DNA, 13 bp, Homo sapiens
ccgctctctctga

SEQ ID NO: 1475643 - DNA, 13 bp, Homo sapiens
ccgctgaccctgg

SEQ ID NO: 1475644 - DNA, 17 bp, Homo sapiens
ccgctgaccctgggcct

SEQ ID NO: 1475645 - DNA, 18 bp, Homo sapiens
ccgctgaggggtctcgga

SEQ ID NO: 1475646 - DNA, 14 bp, Homo sapiens
ccgctgatggagcc

SEQ ID NO: 1475647 - DNA, 17 bp, Homo sapiens
ccgctgatggagcccca

SEQ ID NO: 1475648 - DNA, 16 bp, Homo sapiens
ccgctgcacatggaca

SEQ ID NO: 1475649 - DNA, 20 bp, Homo sapiens
ccgctgccaccacgtctgcc

SEQ ID NO: 1475650 - DNA, 21 bp, Homo sapiens
ccgctgccaccacgtctgcca

SEQ ID NO: 1475651 - DNA, 12 bp, Homo sapiens
ccgctgccagca

SEQ ID NO: 1475652 - DNA, 13 bp, Homo sapiens
ccgctgccagcac

SEQ ID NO: 1475653 - DNA, 16 bp, Homo sapiens
ccgctgccagcacaga

SEQ ID NO: 1475654 - DNA, 13 bp, Homo sapiens
ccgctgccccagc

SEQ ID NO: 1475655 - DNA, 23 bp, Homo sapiens
ccgctgccgtgccgcctgcactc

SEQ ID NO: 1475656 - DNA, 19 bp, Homo sapiens
ccgctgcctaagtggctgc

SEQ ID NO: 1475657 - DNA, 12 bp, Homo sapiens
ccgctgcctgga

SEQ ID NO: 1475658 - DNA, 19 bp, Homo sapiens
ccgctgcctggaacaccag

SEQ ID NO: 1475659 - DNA, 11 bp, Homo sapiens
ccgctgctgct

SEQ ID NO: 1475660 - DNA, 20 bp, Homo sapiens
ccgctgctgtgctctgggga

SEQ ID NO: 1475661 - DNA, 18 bp, Homo sapiens
ccgctggctggtgggccc

SEQ ID NO: 1475662 - DNA, 14 bp, Homo sapiens
ccgctgggctgagc

SEQ ID NO: 1475663 - DNA, 12 bp, Homo sapiens
ccgctgggcttc

SEQ ID NO: 1475664 - DNA, 16 bp, Homo sapiens
ccgctggggtccgtct

SEQ ID NO: 1475665 - DNA, 18 bp, Homo sapiens
ccgctggtccctgccctc

SEQ ID NO: 1475666 - DNA, 20 bp, Homo sapiens
ccgctggtccctgccctccc

SEQ ID NO: 1475667 - DNA, 16 bp, Homo sapiens
ccgctgttcacccaca

SEQ ID NO: 1475668 - DNA, 19 bp, Homo sapiens
ccgctgttcacccacaggg

SEQ ID NO: 1475669 - DNA, 14 bp, Homo sapiens
ccgcttccccacag

SEQ ID NO: 1475670 - DNA, 16 bp, Homo sapiens
ccgcttccccacagaa

SEQ ID NO: 1475671 - DNA, 19 bp, Homo sapiens
ccgcttcctggcctccctt

SEQ ID NO: 1475672 - DNA, 17 bp, Homo sapiens
ccgcttggtggcctggg

SEQ ID NO: 1475673 - DNA, 18 bp, Homo sapiens
ccgcttgtccagcgccta

SEQ ID NO: 1475674 - DNA, 11 bp, Homo sapiens
ccgctttctct

SEQ ID NO: 1475675 - DNA, 19 bp, Homo sapiens
ccgcttttgttctcgcaaa

SEQ ID NO: 1475676 - DNA, 21 bp, Homo sapiens
ccggaaggaatgtcagggcca

SEQ ID NO: 1475677 - DNA, 23 bp, Homo sapiens
ccggaaggaggccaaccagcccg

SEQ ID NO: 1475678 - DNA, 21 bp, Homo sapiens
ccggacacggcttcactgacc

SEQ ID NO: 1475679 - DNA, 14 bp, Homo sapiens
ccggacagctgccc

SEQ ID NO: 1475680 - DNA, 19 bp, Homo sapiens
ccggacagctgcccagaca

SEQ ID NO: 1475681 - DNA, 22 bp, Homo sapiens
ccggacccggccgccgccagga

SEQ ID NO: 1475682 - DNA, 14 bp, Homo sapiens
ccggacgcaggtgc

SEQ ID NO: 1475683 - DNA, 22 bp, Homo sapiens
ccggactcaccaacttgccaca

SEQ ID NO: 1475684 - DNA, 14 bp, Homo sapiens
ccggactggcagaa

SEQ ID NO: 1475685 - DNA, 15 bp, Homo sapiens
ccggacttttctgca

SEQ ID NO: 1475686 - DNA, 19 bp, Homo sapiens
ccggagattggacggcctg

SEQ ID NO: 1475687 - DNA, 20 bp, Homo sapiens
ccggagattggacggcctga

SEQ ID NO: 1475688 - DNA, 14 bp, Homo sapiens
ccggagcacagccc

SEQ ID NO: 1475689 - DNA, 17 bp, Homo sapiens
ccggagcacagccctgg

SEQ ID NO: 1475690 - DNA, 23 bp, Homo sapiens
ccggagctggaggatcccctcca

SEQ ID NO: 1475691 - DNA, 21 bp, Homo sapiens
ccggagctttcaaagaaggaa

SEQ ID NO: 1475692 - DNA, 17 bp, Homo sapiens
ccggagggaggcactag

SEQ ID NO: 1475693 - DNA, 21 bp, Homo sapiens
ccggaggggcctggcagccgt

SEQ ID NO: 1475694 - DNA, 13 bp, Homo sapiens
ccggatgtgcttt

SEQ ID NO: 1475695 - DNA, 15 bp, Homo sapiens
ccggatgtgcttttc

SEQ ID NO: 1475696 - DNA, 11 bp, Homo sapiens
ccggatttcta

SEQ ID NO: 1475697 - DNA, 22 bp, Homo sapiens
ccggatttctaacagtccttgc

SEQ ID NO: 1475698 - DNA, 20 bp, Homo sapiens
ccggcacagggtctgctctt

SEQ ID NO: 1475699 - DNA, 15 bp, Homo sapiens
ccggcactccatgct

SEQ ID NO: 1475700 - DNA, 16 bp, Homo sapiens
ccggcaggcctgagaa

SEQ ID NO: 1475701 - DNA, 20 bp, Homo sapiens
ccggcatgagactcagtgca

SEQ ID NO: 1475702 - DNA, 21 bp, Homo sapiens
ccggcatgagactcagtgcag

SEQ ID NO: 1475703 - DNA, 22 bp, Homo sapiens
ccggcatgagactcagtgcaga

SEQ ID NO: 1475704 - DNA, 12 bp, Homo sapiens
ccggccacatgc

SEQ ID NO: 1475705 - DNA, 16 bp, Homo sapiens
ccggccacgctccctc

SEQ ID NO: 1475706 - DNA, 13 bp, Homo sapiens
ccggccagcgggc

SEQ ID NO: 1475707 - DNA, 20 bp, Homo sapiens
ccggccagcgggcacagggc

SEQ ID NO: 1475708 - DNA, 22 bp, Homo sapiens
ccggccaggccgcgcccagcag

SEQ ID NO: 1475709 - DNA, 16 bp, Homo sapiens
ccggcccagtgccact

SEQ ID NO: 1475710 - DNA, 17 bp, Homo sapiens
ccggccccagccagagt

SEQ ID NO: 1475711 - DNA, 18 bp, Homo sapiens
ccggccccagccagagtt

SEQ ID NO: 1475712 - DNA, 15 bp, Homo sapiens
ccggcccccagcagg

SEQ ID NO: 1475713 - DNA, 23 bp, Homo sapiens
ccggccccctccccccagactct

SEQ ID NO: 1475714 - DNA, 12 bp, Homo sapiens
ccggccctggct

SEQ ID NO: 1475715 - DNA, 19 bp, Homo sapiens
ccggccctggcttggaggc

SEQ ID NO: 1475716 - DNA, 14 bp, Homo sapiens
ccggccctgtgtgc

SEQ ID NO: 1475717 - DNA, 16 bp, Homo sapiens
ccggccgccgccagga

SEQ ID NO: 1475718 - DNA, 15 bp, Homo sapiens
ccggccgcgccgccg

SEQ ID NO: 1475719 - DNA, 17 bp, Homo sapiens
ccggccggccctggctt

SEQ ID NO: 1475720 - DNA, 17 bp, Homo sapiens
ccggccggcctggcacc

SEQ ID NO: 1475721 - DNA, 15 bp, Homo sapiens
ccggcctaggcacct

SEQ ID NO: 1475722 - DNA, 23 bp, Homo sapiens
ccggcctccactcccccacctga

SEQ ID NO: 1475723 - DNA, 12 bp, Homo sapiens
ccggcctctctg

SEQ ID NO: 1475724 - DNA, 13 bp, Homo sapiens
ccggcctctctgg

SEQ ID NO: 1475725 - DNA, 22 bp, Homo sapiens
ccggcctctctggcctcccacc

SEQ ID NO: 1475726 - DNA, 20 bp, Homo sapiens
ccggcctgctcccagcagcc

SEQ ID NO: 1475727 - DNA, 12 bp, Homo sapiens
ccggcctggcac

SEQ ID NO: 1475728 - DNA, 21 bp, Homo sapiens
ccggcctgggtgacagagtga

SEQ ID NO: 1475729 - DNA, 11 bp, Homo sapiens
ccggcctgtct

SEQ ID NO: 1475730 - DNA, 13 bp, Homo sapiens
ccggcgctgcagg

SEQ ID NO: 1475731 - DNA, 21 bp, Homo sapiens
ccggcggccctgctgaagctg

SEQ ID NO: 1475732 - DNA, 14 bp, Homo sapiens
ccggcggggcccac

SEQ ID NO: 1475733 - DNA, 18 bp, Homo sapiens
ccggcgggtgacagctcc

SEQ ID NO: 1475734 - DNA, 21 bp, Homo sapiens
ccggcgggtgctctgaggcct

SEQ ID NO: 1475735 - DNA, 22 bp, Homo sapiens
ccggcgggtgctctgaggcctc

SEQ ID NO: 1475736 - DNA, 23 bp, Homo sapiens
ccggctcgagcagtcctgcctca

SEQ ID NO: 1475737 - DNA, 17 bp, Homo sapiens
ccggctctacgggggcc

SEQ ID NO: 1475738 - DNA, 17 bp, Homo sapiens
ccggctctcacctggcc

SEQ ID NO: 1475739 - DNA, 15 bp, Homo sapiens
ccggctctgggcctg

SEQ ID NO: 1475740 - DNA, 18 bp, Homo sapiens
ccggctctgggcctgagg

SEQ ID NO: 1475741 - DNA, 15 bp, Homo sapiens
ccggctgagcccccc

SEQ ID NO: 1475742 - DNA, 19 bp, Homo sapiens
ccggctgagggtgggaggc

SEQ ID NO: 1475743 - DNA, 16 bp, Homo sapiens
ccggctgagtggcagc

SEQ ID NO: 1475744 - DNA, 18 bp, Homo sapiens
ccggctgcatacccgggc

SEQ ID NO: 1475745 - DNA, 22 bp, Homo sapiens
ccggctgcatacccgggcaggg

SEQ ID NO: 1475746 - DNA, 12 bp, Homo sapiens
ccggctgcctgc

SEQ ID NO: 1475747 - DNA, 16 bp, Homo sapiens
ccggctgggcctcctt

SEQ ID NO: 1475748 - DNA, 23 bp, Homo sapiens
ccggctggttttgtaagatgctg

SEQ ID NO: 1475749 - DNA, 15 bp, Homo sapiens
ccggcttcctttccc

SEQ ID NO: 1475750 - DNA, 15 bp, Homo sapiens
cctacagcctgcaca

SEQ ID NO: 1475751 - DNA, 21 bp, Homo sapiens
cctacagcctgcacacacctg

SEQ ID NO: 1475752 - DNA, 17 bp, Homo sapiens
cctacagctttgatccc

SEQ ID NO: 1475753 - DNA, 21 bp, Homo sapiens
cctacagctttgatccctgac

SEQ ID NO: 1475754 - DNA, 16 bp, Homo sapiens
cctacagtgctgtgta

SEQ ID NO: 1475755 - DNA, 17 bp, Homo sapiens
cctacagttttaactgt

SEQ ID NO: 1475756 - DNA, 21 bp, Homo sapiens
cctacatatgctgatctttta

SEQ ID NO: 1475757 - DNA, 14 bp, Homo sapiens
cctacatccccagg

SEQ ID NO: 1475758 - DNA, 18 bp, Homo sapiens
cctacatccccaggtctc

SEQ ID NO: 1475759 - DNA, 15 bp, Homo sapiens
cctaccacagtgtct

SEQ ID NO: 1475760 - DNA, 16 bp, Homo sapiens
cctaccagcgcccgct

SEQ ID NO: 1475761 - DNA, 17 bp, Homo sapiens
cctaccagcgcccgctg

SEQ ID NO: 1475762 - DNA, 22 bp, Homo sapiens
cctaccagcgcccgctgggctg

SEQ ID NO: 1475763 - DNA, 14 bp, Homo sapiens
cctaccatgctgct

SEQ ID NO: 1475764 - DNA, 11 bp, Homo sapiens
cctaccccaca

SEQ ID NO: 1475765 - DNA, 18 bp, Homo sapiens
cctaccccacaccaggcc

SEQ ID NO: 1475766 - DNA, 19 bp, Homo sapiens
cctaccccacaccaggccg

SEQ ID NO: 1475767 - DNA, 13 bp, Homo sapiens
cctaccccaccac

SEQ ID NO: 1475768 - DNA, 15 bp, Homo sapiens
cctaccccagccagg

SEQ ID NO: 1475769 - DNA, 21 bp, Homo sapiens
cctaccccgcagacaccttgg

SEQ ID NO: 1475770 - DNA, 23 bp, Homo sapiens
cctaccctcgggcccacctggcc

SEQ ID NO: 1475771 - DNA, 22 bp, Homo sapiens
cctaccgagtctcttctccact

SEQ ID NO: 1475772 - DNA, 16 bp, Homo sapiens
cctaccgctggccctg

SEQ ID NO: 1475773 - DNA, 19 bp, Homo sapiens
cctaccgctggccctgccg

SEQ ID NO: 1475774 - DNA, 21 bp, Homo sapiens
cctaccgctggccctgccgtt

SEQ ID NO: 1475775 - DNA, 21 bp, Homo sapiens
cctacctcagcctagaccctc

SEQ ID NO: 1475776 - DNA, 12 bp, Homo sapiens
cctacctggtaa

SEQ ID NO: 1475777 - DNA, 16 bp, Homo sapiens
cctacctgtctgctgc

SEQ ID NO: 1475778 - DNA, 20 bp, Homo sapiens
cctacctgtctgctgccagc

SEQ ID NO: 1475779 - DNA, 15 bp, Homo sapiens
cctacctgtgcctga

SEQ ID NO: 1475780 - DNA, 23 bp, Homo sapiens
cctacctgttcagtgtcccgggc

SEQ ID NO: 1475781 - DNA, 13 bp, Homo sapiens
cctaccttgcctc

SEQ ID NO: 1475782 - DNA, 20 bp, Homo sapiens
cctacggagggtgggctctg

SEQ ID NO: 1475783 - DNA, 18 bp, Homo sapiens
cctacgggcgctgcagcc

SEQ ID NO: 1475784 - DNA, 19 bp, Homo sapiens
cctacgggcgctgcagcct

SEQ ID NO: 1475785 - DNA, 18 bp, Homo sapiens
cctacgtttgcaccgcct

SEQ ID NO: 1475786 - DNA, 21 bp, Homo sapiens
cctactacccattgttccctt

SEQ ID NO: 1475787 - DNA, 20 bp, Homo sapiens
cctactccctgcagatgcca

SEQ ID NO: 1475788 - DNA, 17 bp, Homo sapiens
cctactgaagtggctgg

SEQ ID NO: 1475789 - DNA, 13 bp, Homo sapiens
cctactgaatgct

SEQ ID NO: 1475790 - DNA, 14 bp, Homo sapiens
cctactgtccctct

SEQ ID NO: 1475791 - DNA, 12 bp, Homo sapiens
cctactgtcctc

SEQ ID NO: 1475792 - DNA, 16 bp, Homo sapiens
cctactgtcctcagag

SEQ ID NO: 1475793 - DNA, 19 bp, Homo sapiens
cctactgtctaagcagttt

SEQ ID NO: 1475794 - DNA, 15 bp, Homo sapiens
cctactgttctaaag

SEQ ID NO: 1475795 - DNA, 19 bp, Homo sapiens
cctactgttctaaagctct

SEQ ID NO: 1475796 - DNA, 18 bp, Homo sapiens
cctacttccaagaaaaat

SEQ ID NO: 1475797 - DNA, 12 bp, Homo sapiens
cctacttctgac

SEQ ID NO: 1475798 - DNA, 18 bp, Homo sapiens
cctacttgtgactgaagg

SEQ ID NO: 1475799 - DNA, 19 bp, Homo sapiens
cctacttgtgactgaaggg

SEQ ID NO: 1475800 - DNA, 14 bp, Homo sapiens
cctactttgacttt

SEQ ID NO: 1475801 - DNA, 17 bp, Homo sapiens
cctactttgcttccgcc

SEQ ID NO: 1475802 - DNA, 19 bp, Homo sapiens
cctactttgcttccgccac

SEQ ID NO: 1475803 - DNA, 20 bp, Homo sapiens
cctactttgcttccgccact

SEQ ID NO: 1475804 - DNA, 18 bp, Homo sapiens
cctagaaccaagcttcag

SEQ ID NO: 1475805 - DNA, 21 bp, Homo sapiens
cctagaagtaagaagaggagc

SEQ ID NO: 1475806 - DNA, 14 bp, Homo sapiens
cctagaagtctccc

SEQ ID NO: 1475807 - DNA, 20 bp, Homo sapiens
cctagaagtctccctgcaca

SEQ ID NO: 1475808 - DNA, 23 bp, Homo sapiens
cctagaagttactgaatgcacca

SEQ ID NO: 1475809 - DNA, 18 bp, Homo sapiens
cctagaatgtcagatttc

SEQ ID NO: 1475810 - DNA, 19 bp, Homo sapiens
cctagactgtaaacctctc

SEQ ID NO: 1475811 - DNA, 14 bp, Homo sapiens
cctagagagaataa

SEQ ID NO: 1475812 - DNA, 16 bp, Homo sapiens
cctagagagaataaat

SEQ ID NO: 1475813 - DNA, 15 bp, Homo sapiens
cctagagcacactgt

SEQ ID NO: 1475814 - DNA, 18 bp, Homo sapiens
cctagaggcgagccaggc

SEQ ID NO: 1475815 - DNA, 19 bp, Homo sapiens
cctagaggggcaccttttc

SEQ ID NO: 1475816 - DNA, 17 bp, Homo sapiens
cctagaggtagagaaac

SEQ ID NO: 1475817 - DNA, 16 bp, Homo sapiens
cctagaggtgggcagc

SEQ ID NO: 1475818 - DNA, 22 bp, Homo sapiens
cctagaggtgggcagctgggcc

SEQ ID NO: 1475819 - DNA, 23 bp, Homo sapiens
cctagaggtgggcagctgggccc

SEQ ID NO: 1475820 - DNA, 15 bp, Homo sapiens
cctagagtgtagcct

SEQ ID NO: 1475821 - DNA, 14 bp, Homo sapiens
cctagatctgcagg

SEQ ID NO: 1475822 - DNA, 15 bp, Homo sapiens
cctagatctgcaggc

SEQ ID NO: 1475823 - DNA, 23 bp, Homo sapiens
cctagatgcacgtggggcccact

SEQ ID NO: 1475824 - DNA, 18 bp, Homo sapiens
cctagatgtgttctaagc

SEQ ID NO: 1475825 - DNA, 22 bp, Homo sapiens
cctagcaagtaagaatggccaa

SEQ ID NO: 1475826 - DNA, 15 bp, Homo sapiens
cctagcagcccaccc

SEQ ID NO: 1475827 - DNA, 20 bp, Homo sapiens
cctagcagcccaccctgctg

SEQ ID NO: 1475828 - DNA, 16 bp, Homo sapiens
cctagcagtgaactat

SEQ ID NO: 1475829 - DNA, 22 bp, Homo sapiens
cctagcattgcacttggcctca

SEQ ID NO: 1475830 - DNA, 11 bp, Homo sapiens
cctagccacct

SEQ ID NO: 1475831 - DNA, 12 bp, Homo sapiens
cctagccacctc

SEQ ID NO: 1475832 - DNA, 13 bp, Homo sapiens
cctagccacctcc

SEQ ID NO: 1475833 - DNA, 18 bp, Homo sapiens
cctagccacctcccaccc

SEQ ID NO: 1475834 - DNA, 23 bp, Homo sapiens
cctagccacctcccaccccactc

SEQ ID NO: 1475835 - DNA, 14 bp, Homo sapiens
cctagccattcctg

SEQ ID NO: 1475836 - DNA, 21 bp, Homo sapiens
cctagccattcctggtaccca

SEQ ID NO: 1475837 - DNA, 23 bp, Homo sapiens
cctagccccgagacaccatcctg

SEQ ID NO: 1475838 - DNA, 15 bp, Homo sapiens
cctagccgacctcag

SEQ ID NO: 1475839 - DNA, 20 bp, Homo sapiens
cctagccgacctcagccttc

SEQ ID NO: 1475840 - DNA, 15 bp, Homo sapiens
cctagccttgcttgt

SEQ ID NO: 1475841 - DNA, 19 bp, Homo sapiens
cctagcggagcccagcctg

SEQ ID NO: 1475842 - DNA, 20 bp, Homo sapiens
cctagcggagcccagcctgg

SEQ ID NO: 1475843 - DNA, 17 bp, Homo sapiens
cctagctcaccaggcct

SEQ ID NO: 1475844 - DNA, 20 bp, Homo sapiens
cctagctcaccaggcctggc

SEQ ID NO: 1475845 - DNA, 23 bp, Homo sapiens
cctagctcaccaggcctggcctc

SEQ ID NO: 1475846 - DNA, 15 bp, Homo sapiens
cctagctcctgccac

SEQ ID NO: 1475847 - DNA, 13 bp, Homo sapiens
cctagctcttaca

SEQ ID NO: 1475848 - DNA, 13 bp, Homo sapiens
cctagctgacccc

SEQ ID NO: 1475849 - DNA, 13 bp, Homo sapiens
cctagctgtccca

SEQ ID NO: 1475850 - DNA, 18 bp, Homo sapiens
cctagctgtcccatgggg

SEQ ID NO: 1475851 - DNA, 13 bp, Homo sapiens
cctagctgtgtca

SEQ ID NO: 1475852 - DNA, 20 bp, Homo sapiens
cctaggaaaccagctcgtgg

SEQ ID NO: 1475853 - DNA, 16 bp, Homo sapiens
cctaggaaactcacac

SEQ ID NO: 1475854 - DNA, 22 bp, Homo sapiens
cctaggaaactcacactcccct

SEQ ID NO: 1475855 - DNA, 12 bp, Homo sapiens
cctaggagacca

SEQ ID NO: 1475856 - DNA, 20 bp, Homo sapiens
cctaggagatatctgaggga

SEQ ID NO: 1475857 - DNA, 22 bp, Homo sapiens
cctaggagatatctgagggagg

SEQ ID NO: 1475858 - DNA, 20 bp, Homo sapiens
cctaggagctggctggcagg

SEQ ID NO: 1475859 - DNA, 17 bp, Homo sapiens
cctaggaggctggccaa

SEQ ID NO: 1475860 - DNA, 20 bp, Homo sapiens
cctaggagttgagtacagtg

SEQ ID NO: 1475861 - DNA, 22 bp, Homo sapiens
cctaggagttgagtacagtgag

SEQ ID NO: 1475862 - DNA, 14 bp, Homo sapiens
cctaggatgctgca

SEQ ID NO: 1475863 - DNA, 17 bp, Homo sapiens
cctaggatgctgcagca

SEQ ID NO: 1475864 - DNA, 16 bp, Homo sapiens
cctcatggcccctctg

SEQ ID NO: 1475865 - DNA, 18 bp, Homo sapiens
cctcatggcccctctgac

SEQ ID NO: 1475866 - DNA, 12 bp, Homo sapiens
cctcatgtaaca

SEQ ID NO: 1475867 - DNA, 16 bp, Homo sapiens
cctcatgtggctggaa

SEQ ID NO: 1475868 - DNA, 17 bp, Homo sapiens
cctcattcaggaaaact

SEQ ID NO: 1475869 - DNA, 13 bp, Homo sapiens
cctcattgaatcc

SEQ ID NO: 1475870 - DNA, 15 bp, Homo sapiens
cctcattgcctcctg

SEQ ID NO: 1475871 - DNA, 17 bp, Homo sapiens
cctcattgcctcctgtt

SEQ ID NO: 1475872 - DNA, 14 bp, Homo sapiens
cctcattgctacca

SEQ ID NO: 1475873 - DNA, 16 bp, Homo sapiens
cctcattgctaccaca

SEQ ID NO: 1475874 - DNA, 23 bp, Homo sapiens
cctcattgctaccacagacttgc

SEQ ID NO: 1475875 - DNA, 18 bp, Homo sapiens
cctcattttgggggtcat

SEQ ID NO: 1475876 - DNA, 22 bp, Homo sapiens
cctcatttttataacctggcaa

SEQ ID NO: 1475877 - DNA, 11 bp, Homo sapiens
cctccaaagag

SEQ ID NO: 1475878 - DNA, 17 bp, Homo sapiens
cctccaagaatctatct

SEQ ID NO: 1475879 - DNA, 16 bp, Homo sapiens
cctccaagcctgcctc

SEQ ID NO: 1475880 - DNA, 14 bp, Homo sapiens
cctccaaggactaa

SEQ ID NO: 1475881 - DNA, 20 bp, Homo sapiens
cctccaaggaggggctgtaa

SEQ ID NO: 1475882 - DNA, 21 bp, Homo sapiens
cctccaaggaggggctgtaaa

SEQ ID NO: 1475883 - DNA, 17 bp, Homo sapiens
cctccaatgcattggcc

SEQ ID NO: 1475884 - DNA, 19 bp, Homo sapiens
cctccaatgcattggcctc

SEQ ID NO: 1475885 - DNA, 22 bp, Homo sapiens
cctccaatgcattggcctctgt

SEQ ID NO: 1475886 - DNA, 12 bp, Homo sapiens
cctccacagaga

SEQ ID NO: 1475887 - DNA, 21 bp, Homo sapiens
cctccacagagaggaggggac

SEQ ID NO: 1475888 - DNA, 14 bp, Homo sapiens
cctccacagcgagg

SEQ ID NO: 1475889 - DNA, 15 bp, Homo sapiens
cctccacagcgaggg

SEQ ID NO: 1475890 - DNA, 23 bp, Homo sapiens
cctccacagcgagggcagctgct

SEQ ID NO: 1475891 - DNA, 14 bp, Homo sapiens
cctccacagctgca

SEQ ID NO: 1475892 - DNA, 12 bp, Homo sapiens
cctccacatcct

SEQ ID NO: 1475893 - DNA, 14 bp, Homo sapiens
cctccaccaccact

SEQ ID NO: 1475894 - DNA, 19 bp, Homo sapiens
cctccaccaccactggcca

SEQ ID NO: 1475895 - DNA, 16 bp, Homo sapiens
cctccaccaccctttc

SEQ ID NO: 1475896 - DNA, 15 bp, Homo sapiens
cctccaccagcctgc

SEQ ID NO: 1475897 - DNA, 16 bp, Homo sapiens
cctccaccagcctgct

SEQ ID NO: 1475898 - DNA, 20 bp, Homo sapiens
cctccaccagcctgctgaca

SEQ ID NO: 1475899 - DNA, 22 bp, Homo sapiens
cctccaccagcctgctgacaga

SEQ ID NO: 1475900 - DNA, 13 bp, Homo sapiens
cctccacccaccc

SEQ ID NO: 1475901 - DNA, 16 bp, Homo sapiens
cctccacccaccccct

SEQ ID NO: 1475902 - DNA, 16 bp, Homo sapiens
cctccacccccgccac

SEQ ID NO: 1475903 - DNA, 19 bp, Homo sapiens
cctccacccccgccacggc

SEQ ID NO: 1475904 - DNA, 14 bp, Homo sapiens
cctccaccctgcat

SEQ ID NO: 1475905 - DNA, 15 bp, Homo sapiens
cctccaccctgtccc

SEQ ID NO: 1475906 - DNA, 21 bp, Homo sapiens
cctccaccttccattttcccc

SEQ ID NO: 1475907 - DNA, 19 bp, Homo sapiens
cctccaccttgctcttctt

SEQ ID NO: 1475908 - DNA, 18 bp, Homo sapiens
cctccacgtgtccgtcca

SEQ ID NO: 1475909 - DNA, 22 bp, Homo sapiens
cctccacgtgtccgtccaccct

SEQ ID NO: 1475910 - DNA, 20 bp, Homo sapiens
cctccactcccccacctgac

SEQ ID NO: 1475911 - DNA, 15 bp, Homo sapiens
cctccactcgaccca

SEQ ID NO: 1475912 - DNA, 13 bp, Homo sapiens
cctccacttcccg

SEQ ID NO: 1475913 - DNA, 20 bp, Homo sapiens
cctccacttcccgtctcaga

SEQ ID NO: 1475914 - DNA, 21 bp, Homo sapiens
cctccagaactcactggggcc

SEQ ID NO: 1475915 - DNA, 13 bp, Homo sapiens
cctccagaagcct

SEQ ID NO: 1475916 - DNA, 20 bp, Homo sapiens
cctccagaagcctctggcta

SEQ ID NO: 1475917 - DNA, 15 bp, Homo sapiens
cctccagaagctgct

SEQ ID NO: 1475918 - DNA, 14 bp, Homo sapiens
cctccagaccctgc

SEQ ID NO: 1475919 - DNA, 15 bp, Homo sapiens
cctccagaccctgcc

SEQ ID NO: 1475920 - DNA, 20 bp, Homo sapiens
cctccagagccagcctggga

SEQ ID NO: 1475921 - DNA, 21 bp, Homo sapiens
cctccagagccagcctgggac

SEQ ID NO: 1475922 - DNA, 16 bp, Homo sapiens
cctccagaggtcctcc

SEQ ID NO: 1475923 - DNA, 22 bp, Homo sapiens
cctccagaggtcctccgtaggg

SEQ ID NO: 1475924 - DNA, 14 bp, Homo sapiens
cctccagccccatg

SEQ ID NO: 1475925 - DNA, 14 bp, Homo sapiens
cctccagcccctgt

SEQ ID NO: 1475926 - DNA, 17 bp, Homo sapiens
cctccagccgctggcaa

SEQ ID NO: 1475927 - DNA, 15 bp, Homo sapiens
cctccagcctccctg

SEQ ID NO: 1475928 - DNA, 17 bp, Homo sapiens
cctccagcctctcccgg

SEQ ID NO: 1475929 - DNA, 19 bp, Homo sapiens
cctccaggagagagccagg

SEQ ID NO: 1475930 - DNA, 18 bp, Homo sapiens
cctccaggagcttcttgt

SEQ ID NO: 1475931 - DNA, 23 bp, Homo sapiens
cctccaggagcttcttgtttcct

SEQ ID NO: 1475932 - DNA, 14 bp, Homo sapiens
cctccaggcctgca

SEQ ID NO: 1475933 - DNA, 15 bp, Homo sapiens
cctccaggcctgcct

SEQ ID NO: 1475934 - DNA, 19 bp, Homo sapiens
cctccaggcctgcctccca

SEQ ID NO: 1475935 - DNA, 20 bp, Homo sapiens
cctccaggcctgcctcccac

SEQ ID NO: 1475936 - DNA, 13 bp, Homo sapiens
cctccaggcctgt

SEQ ID NO: 1475937 - DNA, 15 bp, Homo sapiens
cctccagggcattgc

SEQ ID NO: 1475938 - DNA, 22 bp, Homo sapiens
cctccagggcattgctcagccc

SEQ ID NO: 1475939 - DNA, 20 bp, Homo sapiens
cctccagggccacgtgccag

SEQ ID NO: 1475940 - DNA, 21 bp, Homo sapiens
cctccagggccacgtgccagg

SEQ ID NO: 1475941 - DNA, 14 bp, Homo sapiens
cctccagggcccag

SEQ ID NO: 1475942 - DNA, 22 bp, Homo sapiens
cctccagggctggactgaggcc

SEQ ID NO: 1475943 - DNA, 21 bp, Homo sapiens
cctccaggtcggagtgcctgg

SEQ ID NO: 1475944 - DNA, 23 bp, Homo sapiens
cctccaggtcggagtgcctggag

SEQ ID NO: 1475945 - DNA, 17 bp, Homo sapiens
cctccagtaccttgctt

SEQ ID NO: 1475946 - DNA, 16 bp, Homo sapiens
cctccagtgctggatt

SEQ ID NO: 1475947 - DNA, 15 bp, Homo sapiens
cctccatagcgacac

SEQ ID NO: 1475948 - DNA, 14 bp, Homo sapiens
cctccatccatcct

SEQ ID NO: 1475949 - DNA, 16 bp, Homo sapiens
cctccatctttctaca

SEQ ID NO: 1475950 - DNA, 20 bp, Homo sapiens
cctccatgccccagctctgg

SEQ ID NO: 1475951 - DNA, 22 bp, Homo sapiens
cctccatgctcctcacctgtct

SEQ ID NO: 1475952 - DNA, 18 bp, Homo sapiens
cctccatggtggaagggg

SEQ ID NO: 1475953 - DNA, 16 bp, Homo sapiens
cctccattcatccttc

SEQ ID NO: 1475954 - DNA, 22 bp, Homo sapiens
cctccattcatccttccatcca

SEQ ID NO: 1475955 - DNA, 13 bp, Homo sapiens
cctccattgctcc

SEQ ID NO: 1475956 - DNA, 13 bp, Homo sapiens
cctccatttccca

SEQ ID NO: 1475957 - DNA, 22 bp, Homo sapiens
cctccatttctctccaggaagt

SEQ ID NO: 1475958 - DNA, 14 bp, Homo sapiens
cctccatttttctc

SEQ ID NO: 1475959 - DNA, 18 bp, Homo sapiens
cctcccaaagtgctggga

SEQ ID NO: 1475960 - DNA, 15 bp, Homo sapiens
cctcccaaccccagg

SEQ ID NO: 1475961 - DNA, 16 bp, Homo sapiens
cctcccaaccccaggg

SEQ ID NO: 1475962 - DNA, 18 bp, Homo sapiens
cctcccaagcgttcctgg

SEQ ID NO: 1475963 - DNA, 24 bp, Homo sapiens
cctcccaagcgttcctggccttct

SEQ ID NO: 1475964 - DNA, 15 bp, Homo sapiens
cctcccaaggagcca

SEQ ID NO: 1475965 - DNA, 19 bp, Homo sapiens
cctcccaaggagccattct

SEQ ID NO: 1475966 - DNA, 19 bp, Homo sapiens
cctcccaaggtcctctcag

SEQ ID NO: 1475967 - DNA, 15 bp, Homo sapiens
cctcccaagtcccac

SEQ ID NO: 1475968 - DNA, 20 bp, Homo sapiens
cctcccaagtcccaccctct

SEQ ID NO: 1475969 - DNA, 18 bp, Homo sapiens
cctcccaatcctctctcc

SEQ ID NO: 1475970 - DNA, 20 bp, Homo sapiens
cctcccaatttcagactccc

SEQ ID NO: 1475971 - DNA, 22 bp, Homo sapiens
cctcccacacccaaagctgagc

SEQ ID NO: 1475972 - DNA, 12 bp, Homo sapiens
cctcccaccaga

SEQ ID NO: 1475973 - DNA, 14 bp, Homo sapiens
cctcccaccccact

SEQ ID NO: 1475974 - DNA, 18 bp, Homo sapiens
cctcccaccccactccag

SEQ ID NO: 1475975 - DNA, 20 bp, Homo sapiens
cctcccaccccactccagcc

SEQ ID NO: 1475976 - DNA, 21 bp, Homo sapiens
cctcccaccccactccagccc

SEQ ID NO: 1475977 - DNA, 12 bp, Homo sapiens
cctcccaccccc

SEQ ID NO: 1475978 - DNA, 13 bp, Homo sapiens
cctcccaccccca

SEQ ID NO: 1475979 - DNA, 19 bp, Homo sapiens
cctctaactcactgcctag

SEQ ID NO: 1475980 - DNA, 24 bp, Homo sapiens
cctctaactcactgcctaggaggc

SEQ ID NO: 1475981 - DNA, 19 bp, Homo sapiens
cctctaaggttgggcaggg

SEQ ID NO: 1475982 - DNA, 14 bp, Homo sapiens
cctctaatgagact

SEQ ID NO: 1475983 - DNA, 17 bp, Homo sapiens
cctctactaaaaagaag

SEQ ID NO: 1475984 - DNA, 15 bp, Homo sapiens
cctctagaagccaag

SEQ ID NO: 1475985 - DNA, 16 bp, Homo sapiens
cctctagaagccaagg

SEQ ID NO: 1475986 - DNA, 17 bp, Homo sapiens
cctctagagaaaagatg

SEQ ID NO: 1475987 - DNA, 22 bp, Homo sapiens
cctctagcccactccctgccta

SEQ ID NO: 1475988 - DNA, 13 bp, Homo sapiens
cctctagtgcctt

SEQ ID NO: 1475989 - DNA, 12 bp, Homo sapiens
cctctatacttt

SEQ ID NO: 1475990 - DNA, 14 bp, Homo sapiens
cctctatactttgt

SEQ ID NO: 1475991 - DNA, 15 bp, Homo sapiens
cctctatactttgtt

SEQ ID NO: 1475992 - DNA, 18 bp, Homo sapiens
cctctatactttgttctg

SEQ ID NO: 1475993 - DNA, 21 bp, Homo sapiens
cctctattaattactgtgtgt

SEQ ID NO: 1475994 - DNA, 13 bp, Homo sapiens
cctctatttatta

SEQ ID NO: 1475995 - DNA, 18 bp, Homo sapiens
cctctatttattagccaa

SEQ ID NO: 1475996 - DNA, 14 bp, Homo sapiens
cctctcacctcagc

SEQ ID NO: 1475997 - DNA, 19 bp, Homo sapiens
cctctcagaacatactgat

SEQ ID NO: 1475998 - DNA, 21 bp, Homo sapiens
cctctcagaactcctgtgtgt

SEQ ID NO: 1475999 - DNA, 18 bp, Homo sapiens
cctctcagcatagcctgc

SEQ ID NO: 1476000 - DNA, 18 bp, Homo sapiens
cctctcagctccaggtgg

SEQ ID NO: 1476001 - DNA, 15 bp, Homo sapiens
cctctcagtgccttc

SEQ ID NO: 1476002 - DNA, 16 bp, Homo sapiens
cctctcagtgccttct

SEQ ID NO: 1476003 - DNA, 19 bp, Homo sapiens
cctctcagtgccttctctc

SEQ ID NO: 1476004 - DNA, 20 bp, Homo sapiens
cctctcagtgccttctctca

SEQ ID NO: 1476005 - DNA, 13 bp, Homo sapiens
cctctcagtgttt

SEQ ID NO: 1476006 - DNA, 17 bp, Homo sapiens
cctctcagttctctccc

SEQ ID NO: 1476007 - DNA, 22 bp, Homo sapiens
cctctcagttctctcccttcct

SEQ ID NO: 1476008 - DNA, 20 bp, Homo sapiens
cctctccaaccactgtgcca

SEQ ID NO: 1476009 - DNA, 12 bp, Homo sapiens
cctctccaaggg

SEQ ID NO: 1476010 - DNA, 13 bp, Homo sapiens
cctctccaagggc

SEQ ID NO: 1476011 - DNA, 18 bp, Homo sapiens
cctctccaagggcttctg

SEQ ID NO: 1476012 - DNA, 22 bp, Homo sapiens
cctctccaagggcttctgcacc

SEQ ID NO: 1476013 - DNA, 17 bp, Homo sapiens
cctctccaccctccggc

SEQ ID NO: 1476014 - DNA, 13 bp, Homo sapiens
cctctccactgcc

SEQ ID NO: 1476015 - DNA, 14 bp, Homo sapiens
cctctccactgcct

SEQ ID NO: 1476016 - DNA, 13 bp, Homo sapiens
cctctccaggcca

SEQ ID NO: 1476017 - DNA, 20 bp, Homo sapiens
cctctccatatctccttccc

SEQ ID NO: 1476018 - DNA, 18 bp, Homo sapiens
cctctcccaggcccgaga

SEQ ID NO: 1476019 - DNA, 14 bp, Homo sapiens
cctctccccagccc

SEQ ID NO: 1476020 - DNA, 21 bp, Homo sapiens
cctctccccagcccagagaca

SEQ ID NO: 1476021 - DNA, 19 bp, Homo sapiens
cctctcccggctgcctgcc

SEQ ID NO: 1476022 - DNA, 19 bp, Homo sapiens
cctctcccgtcagggccca

SEQ ID NO: 1476023 - DNA, 23 bp, Homo sapiens
cctctcccgtcagggcccaagtc

SEQ ID NO: 1476024 - DNA, 16 bp, Homo sapiens
cctctccctctctctg

SEQ ID NO: 1476025 - DNA, 17 bp, Homo sapiens
cctctccctctctctgg

SEQ ID NO: 1476026 - DNA, 13 bp, Homo sapiens
cctctccctgttg

SEQ ID NO: 1476027 - DNA, 13 bp, Homo sapiens
cctctcctgccct

SEQ ID NO: 1476028 - DNA, 17 bp, Homo sapiens
cctctcctgccctctgc

SEQ ID NO: 1476029 - DNA, 14 bp, Homo sapiens
cctctcctgccctg

SEQ ID NO: 1476030 - DNA, 15 bp, Homo sapiens
cctctcctgccctgt

SEQ ID NO: 1476031 - DNA, 13 bp, Homo sapiens
cctctcctgcttc

SEQ ID NO: 1476032 - DNA, 14 bp, Homo sapiens
cctctcctgtagcc

SEQ ID NO: 1476033 - DNA, 13 bp, Homo sapiens
cctctccttcctg

SEQ ID NO: 1476034 - DNA, 15 bp, Homo sapiens
cctctccttcctgtg

SEQ ID NO: 1476035 - DNA, 16 bp, Homo sapiens
cctctccttgggctcc

SEQ ID NO: 1476036 - DNA, 18 bp, Homo sapiens
cctctccttgggctcctg

SEQ ID NO: 1476037 - DNA, 20 bp, Homo sapiens
cctctccttgggctcctggc

SEQ ID NO: 1476038 - DNA, 17 bp, Homo sapiens
cctctcgacggcacgca

SEQ ID NO: 1476039 - DNA, 24 bp, Homo sapiens
cctctcgacggcacgcacttgcct

SEQ ID NO: 1476040 - DNA, 19 bp, Homo sapiens
cctctcgctcccctctgcc

SEQ ID NO: 1476041 - DNA, 21 bp, Homo sapiens
cctctctatcctctcttcctc

SEQ ID NO: 1476042 - DNA, 16 bp, Homo sapiens
cctctctcccatttca

SEQ ID NO: 1476043 - DNA, 14 bp, Homo sapiens
cctctctcccctct

SEQ ID NO: 1476044 - DNA, 23 bp, Homo sapiens
cctctctccttatagacacttgc

SEQ ID NO: 1476045 - DNA, 23 bp, Homo sapiens
cctctctccttggccacagactg

SEQ ID NO: 1476046 - DNA, 19 bp, Homo sapiens
cctctctctaccagtctat

SEQ ID NO: 1476047 - DNA, 16 bp, Homo sapiens
cctctctctccctccc

SEQ ID NO: 1476048 - DNA, 19 bp, Homo sapiens
cctctctctccctccctct

SEQ ID NO: 1476049 - DNA, 12 bp, Homo sapiens
cctctctctctg

SEQ ID NO: 1476050 - DNA, 23 bp, Homo sapiens
cctctctctgggcccaggggctg

SEQ ID NO: 1476051 - DNA, 19 bp, Homo sapiens
cctctctcttctgctccac

SEQ ID NO: 1476052 - DNA, 19 bp, Homo sapiens
cctctctgagactgctaag

SEQ ID NO: 1476053 - DNA, 19 bp, Homo sapiens
cctctctgagtcaaatcca

SEQ ID NO: 1476054 - DNA, 20 bp, Homo sapiens
cctctctgagtcaaatccag

SEQ ID NO: 1476055 - DNA, 21 bp, Homo sapiens
cctctctgagtcaaatccagt

SEQ ID NO: 1476056 - DNA, 22 bp, Homo sapiens
cctctctgagtcaaatccagtg

SEQ ID NO: 1476057 - DNA, 23 bp, Homo sapiens
cctctctgagtcaaatccagtgg

SEQ ID NO: 1476058 - DNA, 22 bp, Homo sapiens
cctctctgatcttgtgctcagc

SEQ ID NO: 1476059 - DNA, 14 bp, Homo sapiens
cctctctgctcctt

SEQ ID NO: 1476060 - DNA, 18 bp, Homo sapiens
cctctctggaaggcccct

SEQ ID NO: 1476061 - DNA, 13 bp, Homo sapiens
cctctctggcctc

SEQ ID NO: 1476062 - DNA, 16 bp, Homo sapiens
cctctctggcctccca

SEQ ID NO: 1476063 - DNA, 17 bp, Homo sapiens
cctctctgtcccttgct

SEQ ID NO: 1476064 - DNA, 15 bp, Homo sapiens
cctctcttccccttc

SEQ ID NO: 1476065 - DNA, 17 bp, Homo sapiens
cctctcttctcaccttt

SEQ ID NO: 1476066 - DNA, 21 bp, Homo sapiens
cctctcttgcacccgcctctc

SEQ ID NO: 1476067 - DNA, 13 bp, Homo sapiens
cctctcttggcta

SEQ ID NO: 1476068 - DNA, 19 bp, Homo sapiens
cctctcttggtttccttcc

SEQ ID NO: 1476069 - DNA, 17 bp, Homo sapiens
cctctgacagtccacag

SEQ ID NO: 1476070 - DNA, 16 bp, Homo sapiens
cctctgacctgcactg

SEQ ID NO: 1476071 - DNA, 16 bp, Homo sapiens
cctctgacctgcaggc

SEQ ID NO: 1476072 - DNA, 23 bp, Homo sapiens
cctctgagcagcctctgccaggc

SEQ ID NO: 1476073 - DNA, 11 bp, Homo sapiens
cctctgaggac

SEQ ID NO: 1476074 - DNA, 24 bp, Homo sapiens
cctctgattttggcatgtggagac

SEQ ID NO: 1476075 - DNA, 21 bp, Homo sapiens
cctctgcaagcttcttgctga

SEQ ID NO: 1476076 - DNA, 16 bp, Homo sapiens
cctctgcacccagaac

SEQ ID NO: 1476077 - DNA, 19 bp, Homo sapiens
cctctgcacctttgcacgt

SEQ ID NO: 1476078 - DNA, 15 bp, Homo sapiens
cctctgcagctgacc

SEQ ID NO: 1476079 - DNA, 19 bp, Homo sapiens
cctctgcagctgacctctg

SEQ ID NO: 1476080 - DNA, 17 bp, Homo sapiens
cctctgcagtctcattt

SEQ ID NO: 1476081 - DNA, 16 bp, Homo sapiens
cctctgcagtgccttg

SEQ ID NO: 1476082 - DNA, 13 bp, Homo sapiens
cctctgccacctc

SEQ ID NO: 1476083 - DNA, 14 bp, Homo sapiens
cctctgccacctcc

SEQ ID NO: 1476084 - DNA, 15 bp, Homo sapiens
cctctgccacctccc

SEQ ID NO: 1476085 - DNA, 20 bp, Homo sapiens
cctctgccacctcccctatc

SEQ ID NO: 1476086 - DNA, 13 bp, Homo sapiens
cctctgccaggcc

SEQ ID NO: 1476087 - DNA, 13 bp, Homo sapiens
cctctgcccagct

SEQ ID NO: 1476088 - DNA, 14 bp, Homo sapiens
cctctgcccagctt

SEQ ID NO: 1476089 - DNA, 16 bp, Homo sapiens
cctctgcccagcttgg

SEQ ID NO: 1476090 - DNA, 17 bp, Homo sapiens
cctctgccccaagcagc

SEQ ID NO: 1476091 - DNA, 18 bp, Homo sapiens
cctctgccccaagcagcc

SEQ ID NO: 1476092 - DNA, 20 bp, Homo sapiens
cctctgccccaagcagccag

SEQ ID NO: 1476093 - DNA, 15 bp, Homo sapiens
cctctgcccttcctg

SEQ ID NO: 1476094 - DNA, 16 bp, Homo sapiens
cctgagtctgggcagc

SEQ ID NO: 1476095 - DNA, 13 bp, Homo sapiens
cctgagtgggctg

SEQ ID NO: 1476096 - DNA, 14 bp, Homo sapiens
cctgagtgggctgg

SEQ ID NO: 1476097 - DNA, 14 bp, Homo sapiens
cctgagtggggcca

SEQ ID NO: 1476098 - DNA, 14 bp, Homo sapiens
cctgagtggtgcca

SEQ ID NO: 1476099 - DNA, 14 bp, Homo sapiens
cctgagtgtcccaa

SEQ ID NO: 1476100 - DNA, 15 bp, Homo sapiens
cctgagtgtcccaag

SEQ ID NO: 1476101 - DNA, 17 bp, Homo sapiens
cctgagtgtcccaagcc

SEQ ID NO: 1476102 - DNA, 22 bp, Homo sapiens
cctgataaacattaaacactgt

SEQ ID NO: 1476103 - DNA, 14 bp, Homo sapiens
cctgatatgattta

SEQ ID NO: 1476104 - DNA, 19 bp, Homo sapiens
cctgatatgatttaaaaca

SEQ ID NO: 1476105 - DNA, 20 bp, Homo sapiens
cctgatatgatttaaaacat

SEQ ID NO: 1476106 - DNA, 17 bp, Homo sapiens
cctgatcccagacctgt

SEQ ID NO: 1476107 - DNA, 21 bp, Homo sapiens
cctgatcccattttcctctga

SEQ ID NO: 1476108 - DNA, 13 bp, Homo sapiens
cctgatccctgaa

SEQ ID NO: 1476109 - DNA, 21 bp, Homo sapiens
cctgatccgtccgaggctgct

SEQ ID NO: 1476110 - DNA, 22 bp, Homo sapiens
cctgatccgtccgaggctgctt

SEQ ID NO: 1476111 - DNA, 18 bp, Homo sapiens
cctgatcctggaggccca

SEQ ID NO: 1476112 - DNA, 23 bp, Homo sapiens
cctgatcgccaacctttccccca

SEQ ID NO: 1476113 - DNA, 13 bp, Homo sapiens
cctgatctggacc

SEQ ID NO: 1476114 - DNA, 22 bp, Homo sapiens
cctgatgaacagtttggggact

SEQ ID NO: 1476115 - DNA, 16 bp, Homo sapiens
cctgatgagattttta

SEQ ID NO: 1476116 - DNA, 19 bp, Homo sapiens
cctgatgcagcctgtggct

SEQ ID NO: 1476117 - DNA, 22 bp, Homo sapiens
cctgatgcgtctacccagactc

SEQ ID NO: 1476118 - DNA, 23 bp, Homo sapiens
cctgatgcgtctacccagactca

SEQ ID NO: 1476119 - DNA, 19 bp, Homo sapiens
cctgatgctccctcccctg

SEQ ID NO: 1476120 - DNA, 15 bp, Homo sapiens
cctgatgctgccccg

SEQ ID NO: 1476121 - DNA, 16 bp, Homo sapiens
cctgatgctgccccgt

SEQ ID NO: 1476122 - DNA, 22 bp, Homo sapiens
cctgatgctgccccgttccctg

SEQ ID NO: 1476123 - DNA, 23 bp, Homo sapiens
cctgatgctgccccgttccctgt

SEQ ID NO: 1476124 - DNA, 20 bp, Homo sapiens
cctgatggagtgtgcagaca

SEQ ID NO: 1476125 - DNA, 17 bp, Homo sapiens
cctgatggccaagagca

SEQ ID NO: 1476126 - DNA, 11 bp, Homo sapiens
cctgatggccc

SEQ ID NO: 1476127 - DNA, 13 bp, Homo sapiens
cctgatggcccaa

SEQ ID NO: 1476128 - DNA, 18 bp, Homo sapiens
cctgatggggaagggact

SEQ ID NO: 1476129 - DNA, 18 bp, Homo sapiens
cctgatggtgctgctcag

SEQ ID NO: 1476130 - DNA, 19 bp, Homo sapiens
cctgatggtgctgctcagg

SEQ ID NO: 1476131 - DNA, 22 bp, Homo sapiens
cctgatggtgctgctcaggccc

SEQ ID NO: 1476132 - DNA, 23 bp, Homo sapiens
cctgatgtcttaacgaataaagg

SEQ ID NO: 1476133 - DNA, 19 bp, Homo sapiens
cctgatgtgtcctcaggga

SEQ ID NO: 1476134 - DNA, 20 bp, Homo sapiens
cctgatgttttgccgtggct

SEQ ID NO: 1476135 - DNA, 18 bp, Homo sapiens
cctgattattgaatgtta

SEQ ID NO: 1476136 - DNA, 13 bp, Homo sapiens
cctgattcttgat

SEQ ID NO: 1476137 - DNA, 20 bp, Homo sapiens
cctgattcttgattcctggc

SEQ ID NO: 1476138 - DNA, 19 bp, Homo sapiens
cctgattgatcacacagtg

SEQ ID NO: 1476139 - DNA, 17 bp, Homo sapiens
cctgattgtgccagtgc

SEQ ID NO: 1476140 - DNA, 18 bp, Homo sapiens
cctgatttagatatgcaa

SEQ ID NO: 1476141 - DNA, 18 bp, Homo sapiens
cctgatttaggagaagcc

SEQ ID NO: 1476142 - DNA, 22 bp, Homo sapiens
cctgatttaggagaagccagga

SEQ ID NO: 1476143 - DNA, 20 bp, Homo sapiens
cctgatttctacaactggag

SEQ ID NO: 1476144 - DNA, 16 bp, Homo sapiens
cctgattttttttcct

SEQ ID NO: 1476145 - DNA, 22 bp, Homo sapiens
cctgattttttttccttttaat

SEQ ID NO: 1476146 - DNA, 13 bp, Homo sapiens
cctgcaaaaatga

SEQ ID NO: 1476147 - DNA, 15 bp, Homo sapiens
cctgcaaactcactg

SEQ ID NO: 1476148 - DNA, 17 bp, Homo sapiens
cctgcaaactcactgct

SEQ ID NO: 1476149 - DNA, 18 bp, Homo sapiens
cctgcaacttccgctgag

SEQ ID NO: 1476150 - DNA, 19 bp, Homo sapiens
cctgcaacttccgctgagg

SEQ ID NO: 1476151 - DNA, 17 bp, Homo sapiens
cctgcaagaccacggag

SEQ ID NO: 1476152 - DNA, 13 bp, Homo sapiens
cctgcaagatgga

SEQ ID NO: 1476153 - DNA, 22 bp, Homo sapiens
cctgcaagatggacacgagcca

SEQ ID NO: 1476154 - DNA, 15 bp, Homo sapiens
cctgcaagccccagg

SEQ ID NO: 1476155 - DNA, 20 bp, Homo sapiens
cctgcaagccccagggcctg

SEQ ID NO: 1476156 - DNA, 17 bp, Homo sapiens
cctgcaagccttctaaa

SEQ ID NO: 1476157 - DNA, 23 bp, Homo sapiens
cctgcaatgtggtgacacctccc

SEQ ID NO: 1476158 - DNA, 17 bp, Homo sapiens
cctgcacaagccagggt

SEQ ID NO: 1476159 - DNA, 19 bp, Homo sapiens
cctgcacaataaaaatgtt

SEQ ID NO: 1476160 - DNA, 15 bp, Homo sapiens
cctgcacacacctgc

SEQ ID NO: 1476161 - DNA, 18 bp, Homo sapiens
cctgcacacacctgcctg

SEQ ID NO: 1476162 - DNA, 19 bp, Homo sapiens
cctgcacacacctgcctgc

SEQ ID NO: 1476163 - DNA, 14 bp, Homo sapiens
cctgcacacagaat

SEQ ID NO: 1476164 - DNA, 16 bp, Homo sapiens
cctgcacacaggacag

SEQ ID NO: 1476165 - DNA, 18 bp, Homo sapiens
cctgcacacaggacagcg

SEQ ID NO: 1476166 - DNA, 16 bp, Homo sapiens
cctgcacagcctctag

SEQ ID NO: 1476167 - DNA, 20 bp, Homo sapiens
cctgcacaggcacacagggc

SEQ ID NO: 1476168 - DNA, 20 bp, Homo sapiens
cctgcacagtgacttctgag

SEQ ID NO: 1476169 - DNA, 22 bp, Homo sapiens
cctgcacagtgacttctgagat

SEQ ID NO: 1476170 - DNA, 19 bp, Homo sapiens
cctgcacagtgtcccccag

SEQ ID NO: 1476171 - DNA, 20 bp, Homo sapiens
cctgcacagtgtcccccagg

SEQ ID NO: 1476172 - DNA, 14 bp, Homo sapiens
cctgcaccaggaga

SEQ ID NO: 1476173 - DNA, 19 bp, Homo sapiens
cctgcacccacccctgccc

SEQ ID NO: 1476174 - DNA, 21 bp, Homo sapiens
cctgcaccccagcattccagc

SEQ ID NO: 1476175 - DNA, 15 bp, Homo sapiens
cctgcaccctggaaa

SEQ ID NO: 1476176 - DNA, 20 bp, Homo sapiens
cctgcaccctggaaagggga

SEQ ID NO: 1476177 - DNA, 12 bp, Homo sapiens
cctgcacccttc

SEQ ID NO: 1476178 - DNA, 17 bp, Homo sapiens
cctgcacccttccctct

SEQ ID NO: 1476179 - DNA, 19 bp, Homo sapiens
cctgcacccttccctcttc

SEQ ID NO: 1476180 - DNA, 17 bp, Homo sapiens
cctgcacctccccccac

SEQ ID NO: 1476181 - DNA, 19 bp, Homo sapiens
cctgcacctccccccactg

SEQ ID NO: 1476182 - DNA, 15 bp, Homo sapiens
cctgcacctggcctg

SEQ ID NO: 1476183 - DNA, 16 bp, Homo sapiens
cctgcacctggcctgg

SEQ ID NO: 1476184 - DNA, 21 bp, Homo sapiens
cctgcacctggcctgggccac

SEQ ID NO: 1476185 - DNA, 21 bp, Homo sapiens
cctgcactaatttgatgttta

SEQ ID NO: 1476186 - DNA, 18 bp, Homo sapiens
cctgcactccctcctgga

SEQ ID NO: 1476187 - DNA, 14 bp, Homo sapiens
cctgcactccctgg

SEQ ID NO: 1476188 - DNA, 17 bp, Homo sapiens
cctgcactccctggcct

SEQ ID NO: 1476189 - DNA, 18 bp, Homo sapiens
cctgcactccctggcctt

SEQ ID NO: 1476190 - DNA, 15 bp, Homo sapiens
cctgcactggagtcc

SEQ ID NO: 1476191 - DNA, 20 bp, Homo sapiens
cctgcactggagtccagtct

SEQ ID NO: 1476192 - DNA, 22 bp, Homo sapiens
cctgcagagagggaactagggc

SEQ ID NO: 1476193 - DNA, 16 bp, Homo sapiens
cctgcagagcacacag

SEQ ID NO: 1476194 - DNA, 19 bp, Homo sapiens
cctgcagaggaccacagtg

SEQ ID NO: 1476195 - DNA, 22 bp, Homo sapiens
cctgcagaggaccacagtgggt

SEQ ID NO: 1476196 - DNA, 14 bp, Homo sapiens
cctgcagatgccac

SEQ ID NO: 1476197 - DNA, 21 bp, Homo sapiens
cctgcagatgccaccctagcc

SEQ ID NO: 1476198 - DNA, 20 bp, Homo sapiens
cctgcagcacatgcgggctc

SEQ ID NO: 1476199 - DNA, 21 bp, Homo sapiens
cctgcagcacatgcgggctcg

SEQ ID NO: 1476200 - DNA, 23 bp, Homo sapiens
cctgcagcaggaatatatgtgtg

SEQ ID NO: 1476201 - DNA, 21 bp, Homo sapiens
cctgcagcccaaaacccaggg

SEQ ID NO: 1476202 - DNA, 22 bp, Homo sapiens
cctgcagccccgcgcctccttc

SEQ ID NO: 1476203 - DNA, 18 bp, Homo sapiens
cctgcagcctcctcctga

SEQ ID NO: 1476204 - DNA, 17 bp, Homo sapiens
cctgcaggaacgagcac

SEQ ID NO: 1476205 - DNA, 22 bp, Homo sapiens
cctgcaggaacgagcactggcc

SEQ ID NO: 1476206 - DNA, 16 bp, Homo sapiens
cctgcaggccaagagc

SEQ ID NO: 1476207 - DNA, 19 bp, Homo sapiens
cctgctgggaaccccgcag

SEQ ID NO: 1476208 - DNA, 12 bp, Homo sapiens
cctgctgggctc

SEQ ID NO: 1476209 - DNA, 17 bp, Homo sapiens
cctgctgggctctccac

SEQ ID NO: 1476210 - DNA, 22 bp, Homo sapiens
cctgctgggctctccacctcag

SEQ ID NO: 1476211 - DNA, 15 bp, Homo sapiens
cctgctggtacctgc

SEQ ID NO: 1476212 - DNA, 12 bp, Homo sapiens
cctgctggtcaa

SEQ ID NO: 1476213 - DNA, 19 bp, Homo sapiens
cctgctggttgttgccagg

SEQ ID NO: 1476214 - DNA, 13 bp, Homo sapiens
cctgctgtatttc

SEQ ID NO: 1476215 - DNA, 15 bp, Homo sapiens
cctgctgtcctggtg

SEQ ID NO: 1476216 - DNA, 17 bp, Homo sapiens
cctgctgtcctggtggc

SEQ ID NO: 1476217 - DNA, 18 bp, Homo sapiens
cctgctgtctctctgggc

SEQ ID NO: 1476218 - DNA, 19 bp, Homo sapiens
cctgctgtctctctgggct

SEQ ID NO: 1476219 - DNA, 20 bp, Homo sapiens
cctgctgtgattccactaca

SEQ ID NO: 1476220 - DNA, 23 bp, Homo sapiens
cctgctgtgattccactacacct

SEQ ID NO: 1476221 - DNA, 21 bp, Homo sapiens
cctgctgtgccatgctgggcc

SEQ ID NO: 1476222 - DNA, 11 bp, Homo sapiens
cctgctgtgct

SEQ ID NO: 1476223 - DNA, 23 bp, Homo sapiens
cctgctgttggtcctctctctgt

SEQ ID NO: 1476224 - DNA, 22 bp, Homo sapiens
cctgcttaatcttcaaagcctt

SEQ ID NO: 1476225 - DNA, 21 bp, Homo sapiens
cctgcttagctgccttgagct

SEQ ID NO: 1476226 - DNA, 21 bp, Homo sapiens
cctgcttccaggaaactccac

SEQ ID NO: 1476227 - DNA, 22 bp, Homo sapiens
cctgcttccaggaaactccaca

SEQ ID NO: 1476228 - DNA, 23 bp, Homo sapiens
cctgcttccccctccccctcctg

SEQ ID NO: 1476229 - DNA, 13 bp, Homo sapiens
cctgcttccctgt

SEQ ID NO: 1476230 - DNA, 15 bp, Homo sapiens
cctgcttcctcagag

SEQ ID NO: 1476231 - DNA, 14 bp, Homo sapiens
cctgcttcctgctt

SEQ ID NO: 1476232 - DNA, 15 bp, Homo sapiens
cctgcttcctgcttg

SEQ ID NO: 1476233 - DNA, 15 bp, Homo sapiens
cctgcttccttcagt

SEQ ID NO: 1476234 - DNA, 13 bp, Homo sapiens
cctgcttctgctg

SEQ ID NO: 1476235 - DNA, 19 bp, Homo sapiens
cctgcttctgctgccctga

SEQ ID NO: 1476236 - DNA, 15 bp, Homo sapiens
cctgcttgccaaggc

SEQ ID NO: 1476237 - DNA, 17 bp, Homo sapiens
cctgcttgccaaggcag

SEQ ID NO: 1476238 - DNA, 22 bp, Homo sapiens
cctgcttgccaaggcagaggcc

SEQ ID NO: 1476239 - DNA, 15 bp, Homo sapiens
cctgctttgcatctt

SEQ ID NO: 1476240 - DNA, 17 bp, Homo sapiens
cctgctttgggctgccc

SEQ ID NO: 1476241 - DNA, 22 bp, Homo sapiens
cctgctttgggctgccctggtg

SEQ ID NO: 1476242 - DNA, 14 bp, Homo sapiens
cctgcttttccagg

SEQ ID NO: 1476243 - DNA, 15 bp, Homo sapiens
cctgcttttccagga

SEQ ID NO: 1476244 - DNA, 23 bp, Homo sapiens
cctgcttttccaggatcctgcag

SEQ ID NO: 1476245 - DNA, 15 bp, Homo sapiens
cctgcttttctgtcc

SEQ ID NO: 1476246 - DNA, 18 bp, Homo sapiens
cctgcttttctgtcctgg

SEQ ID NO: 1476247 - DNA, 20 bp, Homo sapiens
cctgcttttctgtcctgggc

SEQ ID NO: 1476248 - DNA, 16 bp, Homo sapiens
cctgctttttgtgttt

SEQ ID NO: 1476249 - DNA, 21 bp, Homo sapiens
cctggaaaaaaacatcagaaa

SEQ ID NO: 1476250 - DNA, 17 bp, Homo sapiens
cctggaaaaattccaga

SEQ ID NO: 1476251 - DNA, 12 bp, Homo sapiens
cctggaaacagc

SEQ ID NO: 1476252 - DNA, 13 bp, Homo sapiens
cctggaaacagca

SEQ ID NO: 1476253 - DNA, 16 bp, Homo sapiens
cctggaaacagcatga

SEQ ID NO: 1476254 - DNA, 13 bp, Homo sapiens
cctggaaacccac

SEQ ID NO: 1476255 - DNA, 22 bp, Homo sapiens
cctggaaacccacctctctgga

SEQ ID NO: 1476256 - DNA, 20 bp, Homo sapiens
cctggaaaggctcagtctca

SEQ ID NO: 1476257 - DNA, 12 bp, Homo sapiens
cctggaaatgat

SEQ ID NO: 1476258 - DNA, 17 bp, Homo sapiens
cctggaacaccagcagc

SEQ ID NO: 1476259 - DNA, 15 bp, Homo sapiens
cctggaaccagagcc

SEQ ID NO: 1476260 - DNA, 15 bp, Homo sapiens
cctggaaccagggag

SEQ ID NO: 1476261 - DNA, 22 bp, Homo sapiens
cctggaaccgggaagggtggcc

SEQ ID NO: 1476262 - DNA, 17 bp, Homo sapiens
cctggaactcctggcct

SEQ ID NO: 1476263 - DNA, 17 bp, Homo sapiens
cctggaagaacaggcct

SEQ ID NO: 1476264 - DNA, 23 bp, Homo sapiens
cctggaagaacaggcctctccat

SEQ ID NO: 1476265 - DNA, 11 bp, Homo sapiens
cctggaagcag

SEQ ID NO: 1476266 - DNA, 16 bp, Homo sapiens
cctggaagcaggtgct

SEQ ID NO: 1476267 - DNA, 13 bp, Homo sapiens
cctggaagctctc

SEQ ID NO: 1476268 - DNA, 13 bp, Homo sapiens
cctggaagctgtg

SEQ ID NO: 1476269 - DNA, 17 bp, Homo sapiens
cctggaagctgtgtcct

SEQ ID NO: 1476270 - DNA, 18 bp, Homo sapiens
cctggaagctgtgtcctt

SEQ ID NO: 1476271 - DNA, 19 bp, Homo sapiens
cctggaattcagcaccctg

SEQ ID NO: 1476272 - DNA, 21 bp, Homo sapiens
cctggaattcagcaccctggg

SEQ ID NO: 1476273 - DNA, 22 bp, Homo sapiens
cctggacaaggctaacatccca

SEQ ID NO: 1476274 - DNA, 12 bp, Homo sapiens
cctggacacagc

SEQ ID NO: 1476275 - DNA, 15 bp, Homo sapiens
cctggacacagctct

SEQ ID NO: 1476276 - DNA, 16 bp, Homo sapiens
cctggacacagctctt

SEQ ID NO: 1476277 - DNA, 19 bp, Homo sapiens
cctggacaggcagcctcct

SEQ ID NO: 1476278 - DNA, 22 bp, Homo sapiens
cctggacaggcagcctcctttg

SEQ ID NO: 1476279 - DNA, 19 bp, Homo sapiens
cctggaccaaagggaagtg

SEQ ID NO: 1476280 - DNA, 20 bp, Homo sapiens
cctggaccaaagggaagtga

SEQ ID NO: 1476281 - DNA, 22 bp, Homo sapiens
cctggaccaccagccccagcaa

SEQ ID NO: 1476282 - DNA, 17 bp, Homo sapiens
cctggaccagcctcctg

SEQ ID NO: 1476283 - DNA, 13 bp, Homo sapiens
cctggacctgagt

SEQ ID NO: 1476284 - DNA, 20 bp, Homo sapiens
cctggacctgagtcggcccc

SEQ ID NO: 1476285 - DNA, 23 bp, Homo sapiens
cctggacctgccctgggccacac

SEQ ID NO: 1476286 - DNA, 19 bp, Homo sapiens
cctggaccttgacagagca

SEQ ID NO: 1476287 - DNA, 21 bp, Homo sapiens
cctggacgcccccgcccgcac

SEQ ID NO: 1476288 - DNA, 23 bp, Homo sapiens
cctggactaaaggcatccttgtc

SEQ ID NO: 1476289 - DNA, 12 bp, Homo sapiens
cctggactgacc

SEQ ID NO: 1476290 - DNA, 14 bp, Homo sapiens
cctggactgctacc

SEQ ID NO: 1476291 - DNA, 15 bp, Homo sapiens
cctggactttcctgc

SEQ ID NO: 1476292 - DNA, 17 bp, Homo sapiens
cctggactttcctgcaa

SEQ ID NO: 1476293 - DNA, 19 bp, Homo sapiens
cctggactttcctgcaact

SEQ ID NO: 1476294 - DNA, 12 bp, Homo sapiens
cctggagaacta

SEQ ID NO: 1476295 - DNA, 14 bp, Homo sapiens
cctggagagcccca

SEQ ID NO: 1476296 - DNA, 13 bp, Homo sapiens
cctggagatcctc

SEQ ID NO: 1476297 - DNA, 18 bp, Homo sapiens
cctggagatcctcctgca

SEQ ID NO: 1476298 - DNA, 19 bp, Homo sapiens
cctggagatcctcctgcag

SEQ ID NO: 1476299 - DNA, 18 bp, Homo sapiens
cctggagcaggagccccg

SEQ ID NO: 1476300 - DNA, 23 bp, Homo sapiens
cctggagcaggagccccgccaca

SEQ ID NO: 1476301 - DNA, 17 bp, Homo sapiens
cctggagcccacaacct

SEQ ID NO: 1476302 - DNA, 13 bp, Homo sapiens
cctggagcccaga

SEQ ID NO: 1476303 - DNA, 22 bp, Homo sapiens
cctggagccccatcggccaaga

SEQ ID NO: 1476304 - DNA, 17 bp, Homo sapiens
cctggagcccctgggtg

SEQ ID NO: 1476305 - DNA, 15 bp, Homo sapiens
cctggagctctgtgg

SEQ ID NO: 1476306 - DNA, 13 bp, Homo sapiens
cctggaggagaag

SEQ ID NO: 1476307 - DNA, 22 bp, Homo sapiens
cctggaggagaagtattcctgt

SEQ ID NO: 1476308 - DNA, 15 bp, Homo sapiens
cctggaggcacgcac

SEQ ID NO: 1476309 - DNA, 22 bp, Homo sapiens
cctggaggcacgcaccactgct

SEQ ID NO: 1476310 - DNA, 20 bp, Homo sapiens
cctggaggcagggggtgagg

SEQ ID NO: 1476311 - DNA, 19 bp, Homo sapiens
cctggaggggctggggact

SEQ ID NO: 1476312 - DNA, 16 bp, Homo sapiens
cctggaggtctggctg

SEQ ID NO: 1476313 - DNA, 13 bp, Homo sapiens
cctggagtcaggt

SEQ ID NO: 1476314 - DNA, 13 bp, Homo sapiens
cctggagttcttg

SEQ ID NO: 1476315 - DNA, 20 bp, Homo sapiens
cctggagtttaatacagtga

SEQ ID NO: 1476316 - DNA, 17 bp, Homo sapiens
cctggatccagcactgg

SEQ ID NO: 1476317 - DNA, 22 bp, Homo sapiens
cctggatctaccagcataaata

SEQ ID NO: 1476318 - DNA, 19 bp, Homo sapiens
cctggatctccccactcta

SEQ ID NO: 1476319 - DNA, 17 bp, Homo sapiens
cctggatgggcattggg

SEQ ID NO: 1476320 - DNA, 21 bp, Homo sapiens
cctggatgggcattgggctga

SEQ ID NO: 1476321 - DNA, 14 bp, Homo sapiens
cctggatgttgctg

SEQ ID NO: 1476322 - DNA, 23 bp, Homo sapiens
cctggcttctggagcccttgggt

SEQ ID NO: 1476323 - DNA, 15 bp, Homo sapiens
cctggcttgctccag

SEQ ID NO: 1476324 - DNA, 16 bp, Homo sapiens
cctggcttgctccagg

SEQ ID NO: 1476325 - DNA, 13 bp, Homo sapiens
cctggcttggagg

SEQ ID NO: 1476326 - DNA, 14 bp, Homo sapiens
cctggcttggaggc

SEQ ID NO: 1476327 - DNA, 20 bp, Homo sapiens
cctggcttgtaactccacca

SEQ ID NO: 1476328 - DNA, 12 bp, Homo sapiens
cctggctttgcc

SEQ ID NO: 1476329 - DNA, 13 bp, Homo sapiens
cctggctttgcct

SEQ ID NO: 1476330 - DNA, 16 bp, Homo sapiens
cctggcttttcactgc

SEQ ID NO: 1476331 - DNA, 24 bp, Homo sapiens
cctggcttttcactgctggctgcc

SEQ ID NO: 1476332 - DNA, 16 bp, Homo sapiens
cctgggaaaggaccca

SEQ ID NO: 1476333 - DNA, 18 bp, Homo sapiens
cctgggaaaggacccacc

SEQ ID NO: 1476334 - DNA, 15 bp, Homo sapiens
cctgggaaccactcc

SEQ ID NO: 1476335 - DNA, 18 bp, Homo sapiens
cctgggaaggagggagct

SEQ ID NO: 1476336 - DNA, 23 bp, Homo sapiens
cctgggaaggagggagctgctca

SEQ ID NO: 1476337 - DNA, 15 bp, Homo sapiens
cctgggaaggccacc

SEQ ID NO: 1476338 - DNA, 14 bp, Homo sapiens
cctgggacccagct

SEQ ID NO: 1476339 - DNA, 18 bp, Homo sapiens
cctgggacccagctactc

SEQ ID NO: 1476340 - DNA, 17 bp, Homo sapiens
cctgggactcccagtga

SEQ ID NO: 1476341 - DNA, 14 bp, Homo sapiens
cctgggacttccat

SEQ ID NO: 1476342 - DNA, 21 bp, Homo sapiens
cctgggagccagtcctccact

SEQ ID NO: 1476343 - DNA, 14 bp, Homo sapiens
cctgggagcccaga

SEQ ID NO: 1476344 - DNA, 19 bp, Homo sapiens
cctgggaggaaatttgaat

SEQ ID NO: 1476345 - DNA, 23 bp, Homo sapiens
cctgggaggtggaggttgcagtg

SEQ ID NO: 1476346 - DNA, 18 bp, Homo sapiens
cctgggcaaacagagcta

SEQ ID NO: 1476347 - DNA, 21 bp, Homo sapiens
cctgggcaaacagagctactg

SEQ ID NO: 1476348 - DNA, 23 bp, Homo sapiens
cctgggcaaacagagctactgag

SEQ ID NO: 1476349 - DNA, 15 bp, Homo sapiens
cctgggcacccacct

SEQ ID NO: 1476350 - DNA, 19 bp, Homo sapiens
cctgggcacccacctccac

SEQ ID NO: 1476351 - DNA, 20 bp, Homo sapiens
cctgggcacccacctccacc

SEQ ID NO: 1476352 - DNA, 21 bp, Homo sapiens
cctgggcacccacctccaccc

SEQ ID NO: 1476353 - DNA, 13 bp, Homo sapiens
cctgggcagaaag

SEQ ID NO: 1476354 - DNA, 17 bp, Homo sapiens
cctgggcagccaggctg

SEQ ID NO: 1476355 - DNA, 21 bp, Homo sapiens
cctgggcagggttctccaagg

SEQ ID NO: 1476356 - DNA, 17 bp, Homo sapiens
cctgggcatgggtccag

SEQ ID NO: 1476357 - DNA, 19 bp, Homo sapiens
cctgggcatgggtccaggg

SEQ ID NO: 1476358 - DNA, 21 bp, Homo sapiens
cctgggcatgggtccagggcc

SEQ ID NO: 1476359 - DNA, 17 bp, Homo sapiens
cctgggcattgctttcc

SEQ ID NO: 1476360 - DNA, 12 bp, Homo sapiens
cctgggccacac

SEQ ID NO: 1476361 - DNA, 13 bp, Homo sapiens
cctgggccacacc

SEQ ID NO: 1476362 - DNA, 18 bp, Homo sapiens
cctgggccacacctgagc

SEQ ID NO: 1476363 - DNA, 23 bp, Homo sapiens
cctgggccacacctgagcgctgt

SEQ ID NO: 1476364 - DNA, 13 bp, Homo sapiens
cctgggccagaga

SEQ ID NO: 1476365 - DNA, 14 bp, Homo sapiens
cctgggccccacca

SEQ ID NO: 1476366 - DNA, 14 bp, Homo sapiens
cctgggccccagct

SEQ ID NO: 1476367 - DNA, 14 bp, Homo sapiens
cctgggccctgggc

SEQ ID NO: 1476368 - DNA, 16 bp, Homo sapiens
cctgggccctgggctg

SEQ ID NO: 1476369 - DNA, 12 bp, Homo sapiens
cctgggcctgca

SEQ ID NO: 1476370 - DNA, 14 bp, Homo sapiens
cctgggcctgcccc

SEQ ID NO: 1476371 - DNA, 13 bp, Homo sapiens
cctgggcctgctt

SEQ ID NO: 1476372 - DNA, 13 bp, Homo sapiens
cctgggcctgtcc

SEQ ID NO: 1476373 - DNA, 15 bp, Homo sapiens
cctgggcctgtcccc

SEQ ID NO: 1476374 - DNA, 13 bp, Homo sapiens
cctgggcctgtgc

SEQ ID NO: 1476375 - DNA, 20 bp, Homo sapiens
cctgggcctgtgcagcagcc

SEQ ID NO: 1476376 - DNA, 22 bp, Homo sapiens
cctgggcctttgcaagatgctt

SEQ ID NO: 1476377 - DNA, 23 bp, Homo sapiens
cctgggcctttgcaagatgcttg

SEQ ID NO: 1476378 - DNA, 17 bp, Homo sapiens
cctgggcgagcccctcc

SEQ ID NO: 1476379 - DNA, 19 bp, Homo sapiens
cctgggcgccctggaagcc

SEQ ID NO: 1476380 - DNA, 23 bp, Homo sapiens
cctgggctcactgtgctggggca

SEQ ID NO: 1476381 - DNA, 16 bp, Homo sapiens
cctgggctcagcctga

SEQ ID NO: 1476382 - DNA, 18 bp, Homo sapiens
cctgggctctcacccagt

SEQ ID NO: 1476383 - DNA, 22 bp, Homo sapiens
cctgggctctgccccagctctg

SEQ ID NO: 1476384 - DNA, 13 bp, Homo sapiens
cctgggctgggga

SEQ ID NO: 1476385 - DNA, 20 bp, Homo sapiens
cctgggctggggaggaggag

SEQ ID NO: 1476386 - DNA, 19 bp, Homo sapiens
cctgggctgggtggcccct

SEQ ID NO: 1476387 - DNA, 21 bp, Homo sapiens
cctgggctgttggcactcaca

SEQ ID NO: 1476388 - DNA, 22 bp, Homo sapiens
cctgggctgttggcactcacag

SEQ ID NO: 1476389 - DNA, 13 bp, Homo sapiens
cctgggcttggcc

SEQ ID NO: 1476390 - DNA, 14 bp, Homo sapiens
cctgggcttggcct

SEQ ID NO: 1476391 - DNA, 16 bp, Homo sapiens
cctgggcttggcctgc

SEQ ID NO: 1476392 - DNA, 19 bp, Homo sapiens
cctgggcttggcctgctgt

SEQ ID NO: 1476393 - DNA, 21 bp, Homo sapiens
cctgggcttggcctgctgtga

SEQ ID NO: 1476394 - DNA, 18 bp, Homo sapiens
cctggggaaggagccagt

SEQ ID NO: 1476395 - DNA, 16 bp, Homo sapiens
cctggggaccaggagc

SEQ ID NO: 1476396 - DNA, 14 bp, Homo sapiens
cctggggaccccac

SEQ ID NO: 1476397 - DNA, 17 bp, Homo sapiens
cctggggaccccactcc

SEQ ID NO: 1476398 - DNA, 17 bp, Homo sapiens
cctggggaccccacttc

SEQ ID NO: 1476399 - DNA, 20 bp, Homo sapiens
cctggggacgaattccactc

SEQ ID NO: 1476400 - DNA, 18 bp, Homo sapiens
cctggggacttgatgttc

SEQ ID NO: 1476401 - DNA, 15 bp, Homo sapiens
cctggggcagcactc

SEQ ID NO: 1476402 - DNA, 17 bp, Homo sapiens
cctggggcagcactccc

SEQ ID NO: 1476403 - DNA, 13 bp, Homo sapiens
cctggggccccgc

SEQ ID NO: 1476404 - DNA, 22 bp, Homo sapiens
cctggggcctccagaagctgct

SEQ ID NO: 1476405 - DNA, 23 bp, Homo sapiens
cctggggcctccagaagctgctc

SEQ ID NO: 1476406 - DNA, 17 bp, Homo sapiens
cctggggcctggacctg

SEQ ID NO: 1476407 - DNA, 21 bp, Homo sapiens
cctggggcctggacctgcctc

SEQ ID NO: 1476408 - DNA, 15 bp, Homo sapiens
cctggggctccctct

SEQ ID NO: 1476409 - DNA, 14 bp, Homo sapiens
cctggggctccctt

SEQ ID NO: 1476410 - DNA, 19 bp, Homo sapiens
cctggggctgagtctccag

SEQ ID NO: 1476411 - DNA, 18 bp, Homo sapiens
cctggggcttctcctgac

SEQ ID NO: 1476412 - DNA, 18 bp, Homo sapiens
cctgggggaagccctgga

SEQ ID NO: 1476413 - DNA, 19 bp, Homo sapiens
cctgggggaagccctggat

SEQ ID NO: 1476414 - DNA, 15 bp, Homo sapiens
cctgggggcacagga

SEQ ID NO: 1476415 - DNA, 14 bp, Homo sapiens
cctgggggcagtga

SEQ ID NO: 1476416 - DNA, 16 bp, Homo sapiens
cctgggggcagtgact

SEQ ID NO: 1476417 - DNA, 23 bp, Homo sapiens
cctgggggcagtgactggcaggt

SEQ ID NO: 1476418 - DNA, 22 bp, Homo sapiens
cctgggggccttgggtgagtgg

SEQ ID NO: 1476419 - DNA, 13 bp, Homo sapiens
cctggggggcagg

SEQ ID NO: 1476420 - DNA, 22 bp, Homo sapiens
cctggggtataaaactttcctc

SEQ ID NO: 1476421 - DNA, 14 bp, Homo sapiens
cctggggtctggag

SEQ ID NO: 1476422 - DNA, 16 bp, Homo sapiens
cctggggtgcatctcc

SEQ ID NO: 1476423 - DNA, 18 bp, Homo sapiens
cctggggtgttagtggca

SEQ ID NO: 1476424 - DNA, 16 bp, Homo sapiens
cctgggtcacagagtg

SEQ ID NO: 1476425 - DNA, 18 bp, Homo sapiens
cctgggtcacagagtgag

SEQ ID NO: 1476426 - DNA, 16 bp, Homo sapiens
cctgggtcctgcctgg

SEQ ID NO: 1476427 - DNA, 14 bp, Homo sapiens
cctgggtccttttc

SEQ ID NO: 1476428 - DNA, 13 bp, Homo sapiens
cctgggtgacaga

SEQ ID NO: 1476429 - DNA, 22 bp, Homo sapiens
cctgggtgccattcccagcgtt

SEQ ID NO: 1476430 - DNA, 15 bp, Homo sapiens
cctgggtggggctgc

SEQ ID NO: 1476431 - DNA, 16 bp, Homo sapiens
cctgggtggggctgct

SEQ ID NO: 1476432 - DNA, 22 bp, Homo sapiens
cctgggtggggctgctcctcca

SEQ ID NO: 1476433 - DNA, 23 bp, Homo sapiens
cctgggtggggctgctcctccag

SEQ ID NO: 1476434 - DNA, 13 bp, Homo sapiens
cctgggtgggtgg

SEQ ID NO: 1476435 - DNA, 19 bp, Homo sapiens
cctgggtgggtggtgggga

SEQ ID NO: 1476436 - DNA, 20 bp, Homo sapiens
cctgggtgtccccgctgctg

SEQ ID NO: 1476437 - DNA, 18 bp, Homo sapiens
cctgtggggcaggagtgc

SEQ ID NO: 1476438 - DNA, 18 bp, Homo sapiens
cctgtgggtctctgaagg

SEQ ID NO: 1476439 - DNA, 21 bp, Homo sapiens
cctgtggtggctccccctctg

SEQ ID NO: 1476440 - DNA, 23 bp, Homo sapiens
cctgtggtggctccccctctgct

SEQ ID NO: 1476441 - DNA, 21 bp, Homo sapiens
cctgtggttacagtgcagaca

SEQ ID NO: 1476442 - DNA, 18 bp, Homo sapiens
cctgtgtattcaccacca

SEQ ID NO: 1476443 - DNA, 21 bp, Homo sapiens
cctgtgtcccatgacccaccc

SEQ ID NO: 1476444 - DNA, 16 bp, Homo sapiens
cctgtgtgcaggttcc

SEQ ID NO: 1476445 - DNA, 17 bp, Homo sapiens
cctgtgtgcccagcacc

SEQ ID NO: 1476446 - DNA, 19 bp, Homo sapiens
cctgtgtggagagggaatg

SEQ ID NO: 1476447 - DNA, 18 bp, Homo sapiens
cctgtgtgtactctgtcc

SEQ ID NO: 1476448 - DNA, 12 bp, Homo sapiens
cctgtgtgtgtg

SEQ ID NO: 1476449 - DNA, 14 bp, Homo sapiens
cctgttaaaacaac

SEQ ID NO: 1476450 - DNA, 20 bp, Homo sapiens
cctgttaaaagatgaaaata

SEQ ID NO: 1476451 - DNA, 20 bp, Homo sapiens
cctgttaacgtcatctcagg

SEQ ID NO: 1476452 - DNA, 18 bp, Homo sapiens
cctgttacactgggctgg

SEQ ID NO: 1476453 - DNA, 15 bp, Homo sapiens
cctgttactctgtcc

SEQ ID NO: 1476454 - DNA, 16 bp, Homo sapiens
cctgttactctgtccc

SEQ ID NO: 1476455 - DNA, 19 bp, Homo sapiens
cctgttaggagaagctgca

SEQ ID NO: 1476456 - DNA, 21 bp, Homo sapiens
cctgttatttttctgccctgg

SEQ ID NO: 1476457 - DNA, 21 bp, Homo sapiens
cctgttcacagaaaaagcatg

SEQ ID NO: 1476458 - DNA, 21 bp, Homo sapiens
cctgttcactctacttagcat

SEQ ID NO: 1476459 - DNA, 13 bp, Homo sapiens
cctgttccccaga

SEQ ID NO: 1476460 - DNA, 23 bp, Homo sapiens
cctgttccccagagaaaggggag

SEQ ID NO: 1476461 - DNA, 14 bp, Homo sapiens
cctgttccctaccc

SEQ ID NO: 1476462 - DNA, 21 bp, Homo sapiens
cctgttccctagagagaataa

SEQ ID NO: 1476463 - DNA, 22 bp, Homo sapiens
cctgttccctagagagaataaa

SEQ ID NO: 1476464 - DNA, 23 bp, Homo sapiens
cctgttccctagagagaataaat

SEQ ID NO: 1476465 - DNA, 14 bp, Homo sapiens
cctgttctgcccac

SEQ ID NO: 1476466 - DNA, 15 bp, Homo sapiens
cctgttctgcgctgt

SEQ ID NO: 1476467 - DNA, 20 bp, Homo sapiens
cctgttcttagagtgtagct

SEQ ID NO: 1476468 - DNA, 21 bp, Homo sapiens
cctgttcttagagtgtagctg

SEQ ID NO: 1476469 - DNA, 13 bp, Homo sapiens
cctgttcttccta

SEQ ID NO: 1476470 - DNA, 21 bp, Homo sapiens
cctgttgaattttgttctctg

SEQ ID NO: 1476471 - DNA, 23 bp, Homo sapiens
cctgttgaattttgttctctggg

SEQ ID NO: 1476472 - DNA, 15 bp, Homo sapiens
cctgttgatgggaaa

SEQ ID NO: 1476473 - DNA, 15 bp, Homo sapiens
cctgttgccagcaga

SEQ ID NO: 1476474 - DNA, 24 bp, Homo sapiens
cctgttggatttgtttaaaaggat

SEQ ID NO: 1476475 - DNA, 14 bp, Homo sapiens
cctgttggctgctg

SEQ ID NO: 1476476 - DNA, 14 bp, Homo sapiens
cctgtttaaatatt

SEQ ID NO: 1476477 - DNA, 14 bp, Homo sapiens
cctgtttctggcac

SEQ ID NO: 1476478 - DNA, 13 bp, Homo sapiens
cctgtttgaaata

SEQ ID NO: 1476479 - DNA, 17 bp, Homo sapiens
cctgtttgatgtatgtg

SEQ ID NO: 1476480 - DNA, 15 bp, Homo sapiens
cctgtttggcctctc

SEQ ID NO: 1476481 - DNA, 22 bp, Homo sapiens
cctgtttgggaagagcttagaa

SEQ ID NO: 1476482 - DNA, 18 bp, Homo sapiens
cctgttttagtttctgaa

SEQ ID NO: 1476483 - DNA, 20 bp, Homo sapiens
cctgttttagtttctgaact

SEQ ID NO: 1476484 - DNA, 12 bp, Homo sapiens
cctgttttctga

SEQ ID NO: 1476485 - DNA, 19 bp, Homo sapiens
cctgttttctgtttcttct

SEQ ID NO: 1476486 - DNA, 21 bp, Homo sapiens
cctgttttggggctttcccag

SEQ ID NO: 1476487 - DNA, 20 bp, Homo sapiens
cctgtttttcacattttcct

SEQ ID NO: 1476488 - DNA, 15 bp, Homo sapiens
ccttaaaaccaaaga

SEQ ID NO: 1476489 - DNA, 17 bp, Homo sapiens
ccttaaaaggagagaag

SEQ ID NO: 1476490 - DNA, 21 bp, Homo sapiens
ccttaaaattaagttgaaaaa

SEQ ID NO: 1476491 - DNA, 15 bp, Homo sapiens
ccttaacacactggc

SEQ ID NO: 1476492 - DNA, 17 bp, Homo sapiens
ccttaacacactggcca

SEQ ID NO: 1476493 - DNA, 14 bp, Homo sapiens
ccttaacccacctc

SEQ ID NO: 1476494 - DNA, 18 bp, Homo sapiens
ccttaacccacctctcct

SEQ ID NO: 1476495 - DNA, 14 bp, Homo sapiens
ccttaactccaaga

SEQ ID NO: 1476496 - DNA, 15 bp, Homo sapiens
ccttaagaactgtgt

SEQ ID NO: 1476497 - DNA, 12 bp, Homo sapiens
ccttaagaatga

SEQ ID NO: 1476498 - DNA, 22 bp, Homo sapiens
ccttaagacctactgttctaaa

SEQ ID NO: 1476499 - DNA, 23 bp, Homo sapiens
ccttaagacctactgttctaaag

SEQ ID NO: 1476500 - DNA, 15 bp, Homo sapiens
ccttaagcagaacaa

SEQ ID NO: 1476501 - DNA, 19 bp, Homo sapiens
ccttaagccaaactcaggc

SEQ ID NO: 1476502 - DNA, 23 bp, Homo sapiens
ccttaagccaaactcaggcccag

SEQ ID NO: 1476503 - DNA, 14 bp, Homo sapiens
ccttaagtaagcaa

SEQ ID NO: 1476504 - DNA, 20 bp, Homo sapiens
ccttaagtgatttgcctgta

SEQ ID NO: 1476505 - DNA, 15 bp, Homo sapiens
ccttaataaatatgt

SEQ ID NO: 1476506 - DNA, 16 bp, Homo sapiens
ccttaataaatatgta

SEQ ID NO: 1476507 - DNA, 20 bp, Homo sapiens
ccttaatattgaggctgcag

SEQ ID NO: 1476508 - DNA, 21 bp, Homo sapiens
ccttaatattgaggctgcagc

SEQ ID NO: 1476509 - DNA, 14 bp, Homo sapiens
ccttaatctaatct

SEQ ID NO: 1476510 - DNA, 18 bp, Homo sapiens
ccttaatcttgctttctt

SEQ ID NO: 1476511 - DNA, 17 bp, Homo sapiens
ccttaattcactcccac

SEQ ID NO: 1476512 - DNA, 18 bp, Homo sapiens
ccttaatttcctttttga

SEQ ID NO: 1476513 - DNA, 19 bp, Homo sapiens
ccttaatttcctttttgac

SEQ ID NO: 1476514 - DNA, 22 bp, Homo sapiens
ccttacacgtacctctcatcag

SEQ ID NO: 1476515 - DNA, 21 bp, Homo sapiens
ccttacagagcatacaacaga

SEQ ID NO: 1476516 - DNA, 15 bp, Homo sapiens
ccttacatcttttct

SEQ ID NO: 1476517 - DNA, 18 bp, Homo sapiens
ccttacatcttttctaat

SEQ ID NO: 1476518 - DNA, 16 bp, Homo sapiens
ccttacccatctctct

SEQ ID NO: 1476519 - DNA, 15 bp, Homo sapiens
ccttaccccttagcc

SEQ ID NO: 1476520 - DNA, 16 bp, Homo sapiens
ccttaccccttagcct

SEQ ID NO: 1476521 - DNA, 17 bp, Homo sapiens
ccttacctcctgcccag

SEQ ID NO: 1476522 - DNA, 20 bp, Homo sapiens
ccttacctcctgcccaggag

SEQ ID NO: 1476523 - DNA, 16 bp, Homo sapiens
ccttacgctttgtcac

SEQ ID NO: 1476524 - DNA, 19 bp, Homo sapiens
ccttactctgagcccaggc

SEQ ID NO: 1476525 - DNA, 22 bp, Homo sapiens
ccttactctgagcccaggccgt

SEQ ID NO: 1476526 - DNA, 14 bp, Homo sapiens
ccttactctgagga

SEQ ID NO: 1476527 - DNA, 15 bp, Homo sapiens
ccttactctgaggaa

SEQ ID NO: 1476528 - DNA, 17 bp, Homo sapiens
ccttactcttcttgaaa

SEQ ID NO: 1476529 - DNA, 12 bp, Homo sapiens
ccttactgcaga

SEQ ID NO: 1476530 - DNA, 18 bp, Homo sapiens
ccttactggcttacctcc

SEQ ID NO: 1476531 - DNA, 20 bp, Homo sapiens
ccttacttgcttctctagct

SEQ ID NO: 1476532 - DNA, 16 bp, Homo sapiens
ccttagaaaatgtgtc

SEQ ID NO: 1476533 - DNA, 15 bp, Homo sapiens
ccttagaacctttct

SEQ ID NO: 1476534 - DNA, 16 bp, Homo sapiens
ccttagaacctttctt

SEQ ID NO: 1476535 - DNA, 18 bp, Homo sapiens
ccttagacccgccaggtc

SEQ ID NO: 1476536 - DNA, 18 bp, Homo sapiens
ccttagaggtcctctgga

SEQ ID NO: 1476537 - DNA, 20 bp, Homo sapiens
ccttagaggtcctctggagc

SEQ ID NO: 1476538 - DNA, 15 bp, Homo sapiens
ccttagcctccctga

SEQ ID NO: 1476539 - DNA, 16 bp, Homo sapiens
ccttagcctccctgaa

SEQ ID NO: 1476540 - DNA, 17 bp, Homo sapiens
ccttagcgttctggact

SEQ ID NO: 1476541 - DNA, 20 bp, Homo sapiens
ccttagctcttagtctcttt

SEQ ID NO: 1476542 - DNA, 22 bp, Homo sapiens
ccttagctggcattacagctgg

SEQ ID NO: 1476543 - DNA, 17 bp, Homo sapiens
ccttagcttagacctca

SEQ ID NO: 1476544 - DNA, 22 bp, Homo sapiens
ccttagcttagacctcagcctg

SEQ ID NO: 1476545 - DNA, 14 bp, Homo sapiens
ccttaggcctctga

SEQ ID NO: 1476546 - DNA, 23 bp, Homo sapiens
ccttagggtggctttaattgtat

SEQ ID NO: 1476547 - DNA, 15 bp, Homo sapiens
ccttagttggctgga

SEQ ID NO: 1476548 - DNA, 17 bp, Homo sapiens
ccttagttggctggaaa

SEQ ID NO: 1476549 - DNA, 12 bp, Homo sapiens
ccttataaaatc

SEQ ID NO: 1476550 - DNA, 21 bp, Homo sapiens
ccttatagttactgtgtaatt

SEQ ID NO: 1476551 - DNA, 16 bp, Homo sapiens
ccttgcccagggctca

SEQ ID NO: 1476552 - DNA, 18 bp, Homo sapiens
ccttgcccagggctcagc

SEQ ID NO: 1476553 - DNA, 15 bp, Homo sapiens
ccttgccccacctcc

SEQ ID NO: 1476554 - DNA, 16 bp, Homo sapiens
ccttgccccacctccc

SEQ ID NO: 1476555 - DNA, 16 bp, Homo sapiens
ccttgcccgccagcct

SEQ ID NO: 1476556 - DNA, 19 bp, Homo sapiens
ccttgcccgccagcctcag

SEQ ID NO: 1476557 - DNA, 17 bp, Homo sapiens
ccttgcctccccatttc

SEQ ID NO: 1476558 - DNA, 18 bp, Homo sapiens
ccttgcctctgccctgga

SEQ ID NO: 1476559 - DNA, 21 bp, Homo sapiens
ccttgcctgaacatccttcct

SEQ ID NO: 1476560 - DNA, 23 bp, Homo sapiens
ccttgcctgaacatccttccttc

SEQ ID NO: 1476561 - DNA, 13 bp, Homo sapiens
ccttgcctggcct

SEQ ID NO: 1476562 - DNA, 18 bp, Homo sapiens
ccttgccttaataaatat

SEQ ID NO: 1476563 - DNA, 20 bp, Homo sapiens
ccttgccttaataaatatgt

SEQ ID NO: 1476564 - DNA, 18 bp, Homo sapiens
ccttgccttatgggctga

SEQ ID NO: 1476565 - DNA, 14 bp, Homo sapiens
ccttgctacctcaa

SEQ ID NO: 1476566 - DNA, 15 bp, Homo sapiens
ccttgctctcctcat

SEQ ID NO: 1476567 - DNA, 18 bp, Homo sapiens
ccttgctctcctcatctc

SEQ ID NO: 1476568 - DNA, 20 bp, Homo sapiens
ccttgctcttctttctgaga

SEQ ID NO: 1476569 - DNA, 16 bp, Homo sapiens
ccttgctgacaataaa

SEQ ID NO: 1476570 - DNA, 13 bp, Homo sapiens
ccttgctgcagct

SEQ ID NO: 1476571 - DNA, 12 bp, Homo sapiens
ccttgctggccc

SEQ ID NO: 1476572 - DNA, 14 bp, Homo sapiens
ccttgctggcccca

SEQ ID NO: 1476573 - DNA, 15 bp, Homo sapiens
ccttgctggccccag

SEQ ID NO: 1476574 - DNA, 17 bp, Homo sapiens
ccttgctggccccagcc

SEQ ID NO: 1476575 - DNA, 13 bp, Homo sapiens
ccttgctgggact

SEQ ID NO: 1476576 - DNA, 14 bp, Homo sapiens
ccttgctgggccag

SEQ ID NO: 1476577 - DNA, 17 bp, Homo sapiens
ccttgctgggccaggga

SEQ ID NO: 1476578 - DNA, 21 bp, Homo sapiens
ccttgctgtatgctgatcatc

SEQ ID NO: 1476579 - DNA, 19 bp, Homo sapiens
ccttgctgtttgtcctgag

SEQ ID NO: 1476580 - DNA, 16 bp, Homo sapiens
ccttgcttacctctca

SEQ ID NO: 1476581 - DNA, 17 bp, Homo sapiens
ccttgcttacctctcag

SEQ ID NO: 1476582 - DNA, 21 bp, Homo sapiens
ccttgcttgcctgcagggcca

SEQ ID NO: 1476583 - DNA, 12 bp, Homo sapiens
ccttgcttgtta

SEQ ID NO: 1476584 - DNA, 15 bp, Homo sapiens
ccttgctttcggagc

SEQ ID NO: 1476585 - DNA, 21 bp, Homo sapiens
ccttgctttcggagctcctgt

SEQ ID NO: 1476586 - DNA, 22 bp, Homo sapiens
ccttgctttgggctttgcaggc

SEQ ID NO: 1476587 - DNA, 23 bp, Homo sapiens
ccttgctttggggggtgtgctga

SEQ ID NO: 1476588 - DNA, 22 bp, Homo sapiens
ccttggaaacctgccctgcctg

SEQ ID NO: 1476589 - DNA, 17 bp, Homo sapiens
ccttggaaatgtctgct

SEQ ID NO: 1476590 - DNA, 17 bp, Homo sapiens
ccttggacatcctcctc

SEQ ID NO: 1476591 - DNA, 16 bp, Homo sapiens
ccttggaccactcctg

SEQ ID NO: 1476592 - DNA, 22 bp, Homo sapiens
ccttggaccactcctgtccctg

SEQ ID NO: 1476593 - DNA, 19 bp, Homo sapiens
ccttggagagacacagcgt

SEQ ID NO: 1476594 - DNA, 13 bp, Homo sapiens
ccttggagctgcc

SEQ ID NO: 1476595 - DNA, 20 bp, Homo sapiens
ccttggaggatcgtggccaa

SEQ ID NO: 1476596 - DNA, 18 bp, Homo sapiens
ccttggaggctgtcttct

SEQ ID NO: 1476597 - DNA, 22 bp, Homo sapiens
ccttggataatgctgttgcctc

SEQ ID NO: 1476598 - DNA, 18 bp, Homo sapiens
ccttggatgtagtctgag

SEQ ID NO: 1476599 - DNA, 15 bp, Homo sapiens
ccttggcataagaca

SEQ ID NO: 1476600 - DNA, 20 bp, Homo sapiens
ccttggcatgccttccagca

SEQ ID NO: 1476601 - DNA, 15 bp, Homo sapiens
ccttggccacagact

SEQ ID NO: 1476602 - DNA, 17 bp, Homo sapiens
ccttggccacagactga

SEQ ID NO: 1476603 - DNA, 15 bp, Homo sapiens
ccttggccatgcaga

SEQ ID NO: 1476604 - DNA, 14 bp, Homo sapiens
ccttggcccaggag

SEQ ID NO: 1476605 - DNA, 16 bp, Homo sapiens
ccttggcccaggagct

SEQ ID NO: 1476606 - DNA, 13 bp, Homo sapiens
ccttggcctcaga

SEQ ID NO: 1476607 - DNA, 13 bp, Homo sapiens
ccttggccttgca

SEQ ID NO: 1476608 - DNA, 15 bp, Homo sapiens
ccttggctcagacat

SEQ ID NO: 1476609 - DNA, 19 bp, Homo sapiens
ccttggctcccattcactc

SEQ ID NO: 1476610 - DNA, 13 bp, Homo sapiens
ccttggctgcagg

SEQ ID NO: 1476611 - DNA, 19 bp, Homo sapiens
ccttggctttatgcacatt

SEQ ID NO: 1476612 - DNA, 23 bp, Homo sapiens
ccttgggaggttttattctgact

SEQ ID NO: 1476613 - DNA, 15 bp, Homo sapiens
ccttgggcacatctg

SEQ ID NO: 1476614 - DNA, 23 bp, Homo sapiens
ccttgggccagaagtaccagact

SEQ ID NO: 1476615 - DNA, 12 bp, Homo sapiens
ccttgggccctt

SEQ ID NO: 1476616 - DNA, 14 bp, Homo sapiens
ccttgggcctggcc

SEQ ID NO: 1476617 - DNA, 16 bp, Homo sapiens
ccttgggcctggccag

SEQ ID NO: 1476618 - DNA, 14 bp, Homo sapiens
ccttgggctcctgg

SEQ ID NO: 1476619 - DNA, 20 bp, Homo sapiens
ccttgggctcctggctgcca

SEQ ID NO: 1476620 - DNA, 14 bp, Homo sapiens
ccttggggcctggc

SEQ ID NO: 1476621 - DNA, 22 bp, Homo sapiens
ccttggggctcagccacagcct

SEQ ID NO: 1476622 - DNA, 21 bp, Homo sapiens
ccttgggtgagtggcctgcta

SEQ ID NO: 1476623 - DNA, 15 bp, Homo sapiens
ccttgggtggcccct

SEQ ID NO: 1476624 - DNA, 15 bp, Homo sapiens
ccttggtcttccatg

SEQ ID NO: 1476625 - DNA, 19 bp, Homo sapiens
ccttggtgaacacacacgc

SEQ ID NO: 1476626 - DNA, 20 bp, Homo sapiens
ccttggtgctgtgtgcccca

SEQ ID NO: 1476627 - DNA, 16 bp, Homo sapiens
ccttggtggagcagcc

SEQ ID NO: 1476628 - DNA, 15 bp, Homo sapiens
ccttggtttgctagt

SEQ ID NO: 1476629 - DNA, 23 bp, Homo sapiens
ccttggtttttactgctctgaga

SEQ ID NO: 1476630 - DNA, 14 bp, Homo sapiens
ccttgtatttaaat

SEQ ID NO: 1476631 - DNA, 16 bp, Homo sapiens
ccttgtattttgttaa

SEQ ID NO: 1476632 - DNA, 20 bp, Homo sapiens
ccttgtattttgttaaagct

SEQ ID NO: 1476633 - DNA, 21 bp, Homo sapiens
ccttgtattttgttaaagctg

SEQ ID NO: 1476634 - DNA, 14 bp, Homo sapiens
ccttgtcaccagca

SEQ ID NO: 1476635 - DNA, 20 bp, Homo sapiens
ccttgtcaccagcaacatct

SEQ ID NO: 1476636 - DNA, 14 bp, Homo sapiens
ccttgtcctgccag

SEQ ID NO: 1476637 - DNA, 17 bp, Homo sapiens
ccttgtcctgccagctg

SEQ ID NO: 1476638 - DNA, 14 bp, Homo sapiens
ccttgtgccctgcc

SEQ ID NO: 1476639 - DNA, 12 bp, Homo sapiens
ccttgtgcctgg

SEQ ID NO: 1476640 - DNA, 13 bp, Homo sapiens
ccttgtgcctggg

SEQ ID NO: 1476641 - DNA, 21 bp, Homo sapiens
ccttgtggactggctgtgccc

SEQ ID NO: 1476642 - DNA, 20 bp, Homo sapiens
ccttgtgtcaagacatttct

SEQ ID NO: 1476643 - DNA, 14 bp, Homo sapiens
ccttgtgtgtcagg

SEQ ID NO: 1476644 - DNA, 21 bp, Homo sapiens
ccttgtgtgtcaggccctctg

SEQ ID NO: 1476645 - DNA, 13 bp, Homo sapiens
ccttgttgcctgc

SEQ ID NO: 1476646 - DNA, 15 bp, Homo sapiens
ccttgttgcctgcac

SEQ ID NO: 1476647 - DNA, 21 bp, Homo sapiens
ccttgttgcctgcacccttcc

SEQ ID NO: 1476648 - DNA, 17 bp, Homo sapiens
ccttgttggagcctgca

SEQ ID NO: 1476649 - DNA, 18 bp, Homo sapiens
ccttgttggagcctgcag

SEQ ID NO: 1476650 - DNA, 20 bp, Homo sapiens
ccttgttgtaaaaagcccag

SEQ ID NO: 1476651 - DNA, 15 bp, Homo sapiens
ccttgtttctgttgt

SEQ ID NO: 1476652 - DNA, 19 bp, Homo sapiens
ccttgttttattcaaagac

SEQ ID NO: 1476653 - DNA, 16 bp, Homo sapiens
ccttgttttggacagt

SEQ ID NO: 1476654 - DNA, 18 bp, Homo sapiens
cctttaaagtaaaggcct

SEQ ID NO: 1476655 - DNA, 23 bp, Homo sapiens
cctttaaagtatgaatctatgcc

SEQ ID NO: 1476656 - DNA, 16 bp, Homo sapiens
cctttaacagaaactt

SEQ ID NO: 1476657 - DNA, 19 bp, Homo sapiens
cctttaacttttttttctc

SEQ ID NO: 1476658 - DNA, 21 bp, Homo sapiens
cctttaacttttttttctctc

SEQ ID NO: 1476659 - DNA, 20 bp, Homo sapiens
cctttaagatatccatcttt

SEQ ID NO: 1476660 - DNA, 15 bp, Homo sapiens
cctttaattttcttg

SEQ ID NO: 1476661 - DNA, 18 bp, Homo sapiens
cctttaattttcttgttt

SEQ ID NO: 1476662 - DNA, 21 bp, Homo sapiens
cctttaccctctttgctgcag

SEQ ID NO: 1476663 - DNA, 15 bp, Homo sapiens
cctttacgttcatca

SEQ ID NO: 1476664 - DNA, 14 bp, Homo sapiens
cctttactgtgctt

SEQ ID NO: 1476665 - DNA, 22 bp, Homo sapiens
cctttagcgggactcagtgagc

SEQ ID NO: 1476666 - DNA, 17 bp, Homo sapiens
cgaggcaccggcgctgc

SEQ ID NO: 1476667 - DNA, 22 bp, Homo sapiens
cgaggcaccggcgctgcaggta

SEQ ID NO: 1476668 - DNA, 18 bp, Homo sapiens
cgaggcagaaagatacag

SEQ ID NO: 1476669 - DNA, 18 bp, Homo sapiens
cgaggcaggggctctgct

SEQ ID NO: 1476670 - DNA, 17 bp, Homo sapiens
cgaggccacattgctgg

SEQ ID NO: 1476671 - DNA, 21 bp, Homo sapiens
cgaggccacattgctggctgc

SEQ ID NO: 1476672 - DNA, 17 bp, Homo sapiens
cgaggcccagcgggcag

SEQ ID NO: 1476673 - DNA, 23 bp, Homo sapiens
cgaggcctaccccgcagacacct

SEQ ID NO: 1476674 - DNA, 21 bp, Homo sapiens
cgaggctccccgcctccactc

SEQ ID NO: 1476675 - DNA, 17 bp, Homo sapiens
cgaggctgcagtcagcc

SEQ ID NO: 1476676 - DNA, 17 bp, Homo sapiens
cgaggctgccccaggcc

SEQ ID NO: 1476677 - DNA, 12 bp, Homo sapiens
cgaggctgctag

SEQ ID NO: 1476678 - DNA, 15 bp, Homo sapiens
cgaggctgcttccca

SEQ ID NO: 1476679 - DNA, 15 bp, Homo sapiens
cgagggatggtgccc

SEQ ID NO: 1476680 - DNA, 15 bp, Homo sapiens
cgagggcgtcagaga

SEQ ID NO: 1476681 - DNA, 16 bp, Homo sapiens
cgagggcgtcagagag

SEQ ID NO: 1476682 - DNA, 11 bp, Homo sapiens
cgagggctggc

SEQ ID NO: 1476683 - DNA, 17 bp, Homo sapiens
cgagggctggctggcct

SEQ ID NO: 1476684 - DNA, 14 bp, Homo sapiens
cgaggggagagagg

SEQ ID NO: 1476685 - DNA, 15 bp, Homo sapiens
cgaggggcagggaag

SEQ ID NO: 1476686 - DNA, 16 bp, Homo sapiens
cgagggtcctggctcc

SEQ ID NO: 1476687 - DNA, 23 bp, Homo sapiens
cgagggtcctggctcctgagggg

SEQ ID NO: 1476688 - DNA, 15 bp, Homo sapiens
cgaggtcaacagaga

SEQ ID NO: 1476689 - DNA, 13 bp, Homo sapiens
cgaggtcttgtga

SEQ ID NO: 1476690 - DNA, 14 bp, Homo sapiens
cgagtaagattaag

SEQ ID NO: 1476691 - DNA, 16 bp, Homo sapiens
cgagtagagaggcccg

SEQ ID NO: 1476692 - DNA, 17 bp, Homo sapiens
cgagtcccggagcccca

SEQ ID NO: 1476693 - DNA, 19 bp, Homo sapiens
cgagtcccggagccccacc

SEQ ID NO: 1476694 - DNA, 17 bp, Homo sapiens
cgagtctcttctccact

SEQ ID NO: 1476695 - DNA, 20 bp, Homo sapiens
cgagtctcttctccactgga

SEQ ID NO: 1476696 - DNA, 22 bp, Homo sapiens
cgagtgcactgcattcctgtgc

SEQ ID NO: 1476697 - DNA, 21 bp, Homo sapiens
cgagtggctgccggaggagca

SEQ ID NO: 1476698 - DNA, 13 bp, Homo sapiens
cgagtgggaagga

SEQ ID NO: 1476699 - DNA, 15 bp, Homo sapiens
cgagtgtagctgtga

SEQ ID NO: 1476700 - DNA, 16 bp, Homo sapiens
cgagtgtagctgtgaa

SEQ ID NO: 1476701 - DNA, 18 bp, Homo sapiens
cgatacaccgggcctgga

SEQ ID NO: 1476702 - DNA, 21 bp, Homo sapiens
cgatacaccgggcctggagaa

SEQ ID NO: 1476703 - DNA, 17 bp, Homo sapiens
cgatacctcagccctgg

SEQ ID NO: 1476704 - DNA, 22 bp, Homo sapiens
cgatactgcgactttctgcctg

SEQ ID NO: 1476705 - DNA, 13 bp, Homo sapiens
cgatattctccct

SEQ ID NO: 1476706 - DNA, 17 bp, Homo sapiens
cgatcaaaaccttcctt

SEQ ID NO: 1476707 - DNA, 18 bp, Homo sapiens
cgatcaaaaccttccttc

SEQ ID NO: 1476708 - DNA, 20 bp, Homo sapiens
cgatcaaaaccttccttccc

SEQ ID NO: 1476709 - DNA, 20 bp, Homo sapiens
cgatcaagttgttgactgtg

SEQ ID NO: 1476710 - DNA, 21 bp, Homo sapiens
cgatcctggattcactcactc

SEQ ID NO: 1476711 - DNA, 20 bp, Homo sapiens
cgatcctggggccctcagct

SEQ ID NO: 1476712 - DNA, 16 bp, Homo sapiens
cgatcgcccaggctgg

SEQ ID NO: 1476713 - DNA, 16 bp, Homo sapiens
cgatctcattcagtat

SEQ ID NO: 1476714 - DNA, 14 bp, Homo sapiens
cgatctcccacctt

SEQ ID NO: 1476715 - DNA, 11 bp, Homo sapiens
cgatctcctga

SEQ ID NO: 1476716 - DNA, 13 bp, Homo sapiens
cgatctctcctgg

SEQ ID NO: 1476717 - DNA, 16 bp, Homo sapiens
cgatgacagtgctcta

SEQ ID NO: 1476718 - DNA, 19 bp, Homo sapiens
cgatgagcgccacctcttt

SEQ ID NO: 1476719 - DNA, 12 bp, Homo sapiens
cgatgagggaag

SEQ ID NO: 1476720 - DNA, 10 bp, Homo sapiens
cgatgcattt

SEQ ID NO: 1476721 - DNA, 19 bp, Homo sapiens
cgatgccataatcagaaca

SEQ ID NO: 1476722 - DNA, 14 bp, Homo sapiens
cgatgcctgattcg

SEQ ID NO: 1476723 - DNA, 12 bp, Homo sapiens
cgatgcgtgtgt

SEQ ID NO: 1476724 - DNA, 14 bp, Homo sapiens
cgatgctgaggcca

SEQ ID NO: 1476725 - DNA, 18 bp, Homo sapiens
cgatgctgctttcccctg

SEQ ID NO: 1476726 - DNA, 21 bp, Homo sapiens
cgatgctgctttcccctgtgg

SEQ ID NO: 1476727 - DNA, 16 bp, Homo sapiens
cgatggactcctgacc

SEQ ID NO: 1476728 - DNA, 18 bp, Homo sapiens
cgatggactcctgaccat

SEQ ID NO: 1476729 - DNA, 21 bp, Homo sapiens
cgatggtgctgcccaggcctc

SEQ ID NO: 1476730 - DNA, 18 bp, Homo sapiens
cgatgtgcaggaagaaaa

SEQ ID NO: 1476731 - DNA, 13 bp, Homo sapiens
cgatgtggccctg

SEQ ID NO: 1476732 - DNA, 16 bp, Homo sapiens
cgatgtggccctggcc

SEQ ID NO: 1476733 - DNA, 17 bp, Homo sapiens
cgatgtggccctggcct

SEQ ID NO: 1476734 - DNA, 22 bp, Homo sapiens
cgatgtggccctggcctgctgg

SEQ ID NO: 1476735 - DNA, 20 bp, Homo sapiens
cgatgttgtcaaggatggtt

SEQ ID NO: 1476736 - DNA, 14 bp, Homo sapiens
cgatttaaggtatt

SEQ ID NO: 1476737 - DNA, 21 bp, Homo sapiens
cgatttcctcccacctccgtg

SEQ ID NO: 1476738 - DNA, 14 bp, Homo sapiens
cgatttgtcccagg

SEQ ID NO: 1476739 - DNA, 20 bp, Homo sapiens
cgattttcaagattctaaag

SEQ ID NO: 1476740 - DNA, 14 bp, Homo sapiens
cgattttgtctacc

SEQ ID NO: 1476741 - DNA, 16 bp, Homo sapiens
cgcaaaggtgcctcat

SEQ ID NO: 1476742 - DNA, 17 bp, Homo sapiens
cgcaaccaagtgtgcta

SEQ ID NO: 1476743 - DNA, 20 bp, Homo sapiens
cgcaagatagatttggaata

SEQ ID NO: 1476744 - DNA, 20 bp, Homo sapiens
cgcaagcctgtaatcccagc

SEQ ID NO: 1476745 - DNA, 12 bp, Homo sapiens
cgcaagctctca

SEQ ID NO: 1476746 - DNA, 18 bp, Homo sapiens
cgcaagctctcagcaagt

SEQ ID NO: 1476747 - DNA, 19 bp, Homo sapiens
cgcaaggcctgtgctgcat

SEQ ID NO: 1476748 - DNA, 16 bp, Homo sapiens
cgcaagggcatcaggc

SEQ ID NO: 1476749 - DNA, 19 bp, Homo sapiens
cgcaagggcatcaggcact

SEQ ID NO: 1476750 - DNA, 21 bp, Homo sapiens
cgcaagggcatcaggcactgg

SEQ ID NO: 1476751 - DNA, 14 bp, Homo sapiens
cgcaagtctgcagc

SEQ ID NO: 1476752 - DNA, 13 bp, Homo sapiens
cgcacacacacaa

SEQ ID NO: 1476753 - DNA, 18 bp, Homo sapiens
cgcaccactgcactccag

SEQ ID NO: 1476754 - DNA, 20 bp, Homo sapiens
cgcaccactgcactccagcc

SEQ ID NO: 1476755 - DNA, 18 bp, Homo sapiens
cgcaccagctgctctgcc

SEQ ID NO: 1476756 - DNA, 17 bp, Homo sapiens
cgcaccccggcctcagg

SEQ ID NO: 1476757 - DNA, 18 bp, Homo sapiens
cgcaccccggcctcaggg

SEQ ID NO: 1476758 - DNA, 19 bp, Homo sapiens
cgcaccccggcctcagggc

SEQ ID NO: 1476759 - DNA, 12 bp, Homo sapiens
cgcaccctggcc

SEQ ID NO: 1476760 - DNA, 14 bp, Homo sapiens
cgcaccctggcctg

SEQ ID NO: 1476761 - DNA, 16 bp, Homo sapiens
cgcacctgccccctgg

SEQ ID NO: 1476762 - DNA, 14 bp, Homo sapiens
cgcaccttcctcct

SEQ ID NO: 1476763 - DNA, 16 bp, Homo sapiens
cgcacgcacacacaca

SEQ ID NO: 1476764 - DNA, 16 bp, Homo sapiens
cgcactgggccacgga

SEQ ID NO: 1476765 - DNA, 18 bp, Homo sapiens
cgcactgggccacggagg

SEQ ID NO: 1476766 - DNA, 17 bp, Homo sapiens
cgcactgtcccagtagc

SEQ ID NO: 1476767 - DNA, 13 bp, Homo sapiens
cgcagaagccctg

SEQ ID NO: 1476768 - DNA, 17 bp, Homo sapiens
cgcagacctaagccctg

SEQ ID NO: 1476769 - DNA, 16 bp, Homo sapiens
cgcagacgggcacaga

SEQ ID NO: 1476770 - DNA, 18 bp, Homo sapiens
cgcagacgggcacagaca

SEQ ID NO: 1476771 - DNA, 21 bp, Homo sapiens
cgcagacgggcacagacacgc

SEQ ID NO: 1476772 - DNA, 15 bp, Homo sapiens
cgcagagccctccag

SEQ ID NO: 1476773 - DNA, 20 bp, Homo sapiens
cgcagagccctccaggcctg

SEQ ID NO: 1476774 - DNA, 22 bp, Homo sapiens
cgcagagccctccaggcctgca

SEQ ID NO: 1476775 - DNA, 23 bp, Homo sapiens
cgcagatttttatgttttgaaag

SEQ ID NO: 1476776 - DNA, 16 bp, Homo sapiens
cgcagcaccctgcaga

SEQ ID NO: 1476777 - DNA, 15 bp, Homo sapiens
cgcagcagggaagct

SEQ ID NO: 1476778 - DNA, 21 bp, Homo sapiens
cgcagccaaggccgaagctct

SEQ ID NO: 1476779 - DNA, 21 bp, Homo sapiens
cgcagccagccggtgcctggc

SEQ ID NO: 1476780 - DNA, 13 bp, Homo sapiens
cgcagccaggaca

SEQ ID NO: 1476781 - DNA, 13 bp, Homo sapiens
cgctctggtgcag

SEQ ID NO: 1476782 - DNA, 19 bp, Homo sapiens
cgctctgttgcccaggctg

SEQ ID NO: 1476783 - DNA, 22 bp, Homo sapiens
cgctctgttgcccaggctggag

SEQ ID NO: 1476784 - DNA, 16 bp, Homo sapiens
cgctcttggtccctgg

SEQ ID NO: 1476785 - DNA, 23 bp, Homo sapiens
cgctcttttctaagtggcgtgtg

SEQ ID NO: 1476786 - DNA, 12 bp, Homo sapiens
cgctgactgcac

SEQ ID NO: 1476787 - DNA, 21 bp, Homo sapiens
cgctgagcatggggcgctccc

SEQ ID NO: 1476788 - DNA, 22 bp, Homo sapiens
cgctgagcatggggcgctccca

SEQ ID NO: 1476789 - DNA, 14 bp, Homo sapiens
cgctgagtggcagg

SEQ ID NO: 1476790 - DNA, 16 bp, Homo sapiens
cgctgagtggcagggg

SEQ ID NO: 1476791 - DNA, 13 bp, Homo sapiens
cgctgatgatata

SEQ ID NO: 1476792 - DNA, 13 bp, Homo sapiens
cgctgatgcagac

SEQ ID NO: 1476793 - DNA, 15 bp, Homo sapiens
cgctgatgcagacac

SEQ ID NO: 1476794 - DNA, 15 bp, Homo sapiens
cgctgcagcctccct

SEQ ID NO: 1476795 - DNA, 19 bp, Homo sapiens
cgctgcagcctcccttcca

SEQ ID NO: 1476796 - DNA, 16 bp, Homo sapiens
cgctgcagggctccca

SEQ ID NO: 1476797 - DNA, 17 bp, Homo sapiens
cgctgccaccacgtctg

SEQ ID NO: 1476798 - DNA, 21 bp, Homo sapiens
cgctgccaccacgtctgccag

SEQ ID NO: 1476799 - DNA, 22 bp, Homo sapiens
cgctgccaccacgtctgccagg

SEQ ID NO: 1476800 - DNA, 13 bp, Homo sapiens
cgctgccctgcat

SEQ ID NO: 1476801 - DNA, 14 bp, Homo sapiens
cgctgccctgcatg

SEQ ID NO: 1476802 - DNA, 17 bp, Homo sapiens
cgctgccctgtggacag

SEQ ID NO: 1476803 - DNA, 18 bp, Homo sapiens
cgctgcccttgggtcccc

SEQ ID NO: 1476804 - DNA, 13 bp, Homo sapiens
cgctgcctggcca

SEQ ID NO: 1476805 - DNA, 15 bp, Homo sapiens
cgctgcgggcccagc

SEQ ID NO: 1476806 - DNA, 17 bp, Homo sapiens
cgctgcgtcctcatttc

SEQ ID NO: 1476807 - DNA, 23 bp, Homo sapiens
cgctgctacatcagactctagaa

SEQ ID NO: 1476808 - DNA, 17 bp, Homo sapiens
cgctgctctagctggca

SEQ ID NO: 1476809 - DNA, 20 bp, Homo sapiens
cgctgctctagctggcagga

SEQ ID NO: 1476810 - DNA, 11 bp, Homo sapiens
cgctgctgcta

SEQ ID NO: 1476811 - DNA, 20 bp, Homo sapiens
cgctgctgctgctgcgccct

SEQ ID NO: 1476812 - DNA, 10 bp, Homo sapiens
cgctggccca

SEQ ID NO: 1476813 - DNA, 12 bp, Homo sapiens
cgctggcccagc

SEQ ID NO: 1476814 - DNA, 23 bp, Homo sapiens
cgctggcccagccggcctctctg

SEQ ID NO: 1476815 - DNA, 14 bp, Homo sapiens
cgctggccctgccg

SEQ ID NO: 1476816 - DNA, 18 bp, Homo sapiens
cgctggctccctgggcag

SEQ ID NO: 1476817 - DNA, 14 bp, Homo sapiens
cgctggctttctct

SEQ ID NO: 1476818 - DNA, 12 bp, Homo sapiens
cgctgggctcaa

SEQ ID NO: 1476819 - DNA, 22 bp, Homo sapiens
cgctgggcttcattccggactg

SEQ ID NO: 1476820 - DNA, 15 bp, Homo sapiens
cgctggttccgccag

SEQ ID NO: 1476821 - DNA, 18 bp, Homo sapiens
cgctgtaccctttaagat

SEQ ID NO: 1476822 - DNA, 14 bp, Homo sapiens
cgctgtcccctcag

SEQ ID NO: 1476823 - DNA, 17 bp, Homo sapiens
cgctgtggactgtcctg

SEQ ID NO: 1476824 - DNA, 22 bp, Homo sapiens
cgcttaatccaatattttgcct

SEQ ID NO: 1476825 - DNA, 14 bp, Homo sapiens
cgcttccccacaga

SEQ ID NO: 1476826 - DNA, 15 bp, Homo sapiens
cgcttccccacagaa

SEQ ID NO: 1476827 - DNA, 14 bp, Homo sapiens
cgcttcctcagcct

SEQ ID NO: 1476828 - DNA, 15 bp, Homo sapiens
cgcttctgccttttc

SEQ ID NO: 1476829 - DNA, 16 bp, Homo sapiens
cgcttcttgcctctgt

SEQ ID NO: 1476830 - DNA, 22 bp, Homo sapiens
cgcttcttgcctctgtgctgtg

SEQ ID NO: 1476831 - DNA, 17 bp, Homo sapiens
cgcttgagcccaggagt

SEQ ID NO: 1476832 - DNA, 20 bp, Homo sapiens
cgcttgtagaactcactctg

SEQ ID NO: 1476833 - DNA, 23 bp, Homo sapiens
cgcttgtagaactcactctgggc

SEQ ID NO: 1476834 - DNA, 13 bp, Homo sapiens
cgcttgtgacagt

SEQ ID NO: 1476835 - DNA, 17 bp, Homo sapiens
cgcttgtgacagtgcct

SEQ ID NO: 1476836 - DNA, 19 bp, Homo sapiens
cgcttgtgacagtgcctct

SEQ ID NO: 1476837 - DNA, 17 bp, Homo sapiens
cgctttctaaagttacc

SEQ ID NO: 1476838 - DNA, 22 bp, Homo sapiens
cgctttctagctgttgagctgt

SEQ ID NO: 1476839 - DNA, 14 bp, Homo sapiens
cgctttgaaagaag

SEQ ID NO: 1476840 - DNA, 16 bp, Homo sapiens
cgctttgaaagaagca

SEQ ID NO: 1476841 - DNA, 17 bp, Homo sapiens
cgctttgtgattccatg

SEQ ID NO: 1476842 - DNA, 18 bp, Homo sapiens
cgctttgtgattccatgg

SEQ ID NO: 1476843 - DNA, 17 bp, Homo sapiens
cgcttttgttctcgcaa

SEQ ID NO: 1476844 - DNA, 16 bp, Homo sapiens
cgcttttgttcttccc

SEQ ID NO: 1476845 - DNA, 22 bp, Homo sapiens
cggaaacatacagaggatgcct

SEQ ID NO: 1476846 - DNA, 19 bp, Homo sapiens
cggaaactagtgtacattt

SEQ ID NO: 1476847 - DNA, 13 bp, Homo sapiens
cggaacagctcct

SEQ ID NO: 1476848 - DNA, 20 bp, Homo sapiens
cggaaccgtagactaggaag

SEQ ID NO: 1476849 - DNA, 16 bp, Homo sapiens
cggaacgttggacttt

SEQ ID NO: 1476850 - DNA, 22 bp, Homo sapiens
cggaagagcccgtcgcgctgga

SEQ ID NO: 1476851 - DNA, 15 bp, Homo sapiens
cggaagagttacaat

SEQ ID NO: 1476852 - DNA, 12 bp, Homo sapiens
cggaagccaaag

SEQ ID NO: 1476853 - DNA, 21 bp, Homo sapiens
cggaagccgtctgactccaga

SEQ ID NO: 1476854 - DNA, 20 bp, Homo sapiens
cggaaggaatgtcagggcca

SEQ ID NO: 1476855 - DNA, 12 bp, Homo sapiens
cggaaggaggcc

SEQ ID NO: 1476856 - DNA, 13 bp, Homo sapiens
cggacacggcttc

SEQ ID NO: 1476857 - DNA, 21 bp, Homo sapiens
cggacacggcttcactgacca

SEQ ID NO: 1476858 - DNA, 12 bp, Homo sapiens
cggacagagtgg

SEQ ID NO: 1476859 - DNA, 14 bp, Homo sapiens
cggacagctgccca

SEQ ID NO: 1476860 - DNA, 15 bp, Homo sapiens
cggacagctgcccag

SEQ ID NO: 1476861 - DNA, 16 bp, Homo sapiens
cggacagctgcccaga

SEQ ID NO: 1476862 - DNA, 21 bp, Homo sapiens
cggacatgcttttctgccact

SEQ ID NO: 1476863 - DNA, 16 bp, Homo sapiens
cggacccaccccaact

SEQ ID NO: 1476864 - DNA, 21 bp, Homo sapiens
cggacccaccccaactctccc

SEQ ID NO: 1476865 - DNA, 14 bp, Homo sapiens
cggacgctggctcc

SEQ ID NO: 1476866 - DNA, 18 bp, Homo sapiens
cggacgtttccatcaggt

SEQ ID NO: 1476867 - DNA, 20 bp, Homo sapiens
cggactcaccaacttgccac

SEQ ID NO: 1476868 - DNA, 17 bp, Homo sapiens
cggactctgatctctgt

SEQ ID NO: 1476869 - DNA, 12 bp, Homo sapiens
cggactgccaaa

SEQ ID NO: 1476870 - DNA, 14 bp, Homo sapiens
cggactggcagaag

SEQ ID NO: 1476871 - DNA, 16 bp, Homo sapiens
cggactggcagaagca

SEQ ID NO: 1476872 - DNA, 13 bp, Homo sapiens
cggagagaaaaaa

SEQ ID NO: 1476873 - DNA, 14 bp, Homo sapiens
cggagagaaaaaag

SEQ ID NO: 1476874 - DNA, 13 bp, Homo sapiens
cggagagagccaa

SEQ ID NO: 1476875 - DNA, 14 bp, Homo sapiens
cggagagcagcagc

SEQ ID NO: 1476876 - DNA, 17 bp, Homo sapiens
cggagagcagcagcacc

SEQ ID NO: 1476877 - DNA, 14 bp, Homo sapiens
cggagcacagccct

SEQ ID NO: 1476878 - DNA, 18 bp, Homo sapiens
cggagcacagccctggga

SEQ ID NO: 1476879 - DNA, 19 bp, Homo sapiens
cggagcacagccctgggag

SEQ ID NO: 1476880 - DNA, 19 bp, Homo sapiens
cggagcccagcctgggagc

SEQ ID NO: 1476881 - DNA, 21 bp, Homo sapiens
cggagcccagcctgggagccc

SEQ ID NO: 1476882 - DNA, 20 bp, Homo sapiens
cggagcccctgaaagcctca

SEQ ID NO: 1476883 - DNA, 22 bp, Homo sapiens
cggagcccctgaaagcctcacg

SEQ ID NO: 1476884 - DNA, 12 bp, Homo sapiens
cggagctcctgt

SEQ ID NO: 1476885 - DNA, 16 bp, Homo sapiens
cggagctgcctgcagc

SEQ ID NO: 1476886 - DNA, 13 bp, Homo sapiens
cggagctggccca

SEQ ID NO: 1476887 - DNA, 19 bp, Homo sapiens
cggagcttcggggcctcct

SEQ ID NO: 1476888 - DNA, 11 bp, Homo sapiens
cggaggaagcc

SEQ ID NO: 1476889 - DNA, 17 bp, Homo sapiens
cggaggagaccagctca

SEQ ID NO: 1476890 - DNA, 18 bp, Homo sapiens
cggaggagaccagctcag

SEQ ID NO: 1476891 - DNA, 20 bp, Homo sapiens
cggaggagaccagctcagag

SEQ ID NO: 1476892 - DNA, 14 bp, Homo sapiens
cggaggagctgcct

SEQ ID NO: 1476893 - DNA, 16 bp, Homo sapiens
cggaggagctgcctgc

SEQ ID NO: 1476894 - DNA, 20 bp, Homo sapiens
cggaggaggggaaggggctg

SEQ ID NO: 1476895 - DNA, 22 bp, Homo sapiens
cggaggaggggaaggggctgag

SEQ ID NO: 1476896 - DNA, 13 bp, Homo sapiens
cggagggatggag

SEQ ID NO: 1476897 - DNA, 14 bp, Homo sapiens
cggctggccgggaa

SEQ ID NO: 1476898 - DNA, 15 bp, Homo sapiens
cggctgggcctcctt

SEQ ID NO: 1476899 - DNA, 15 bp, Homo sapiens
cggctggggactgct

SEQ ID NO: 1476900 - DNA, 19 bp, Homo sapiens
cggctggggactgctacct

SEQ ID NO: 1476901 - DNA, 17 bp, Homo sapiens
cggctggtcactctgcc

SEQ ID NO: 1476902 - DNA, 18 bp, Homo sapiens
cggctggtcactctgccc

SEQ ID NO: 1476903 - DNA, 22 bp, Homo sapiens
cggctggtcactctgccctctg

SEQ ID NO: 1476904 - DNA, 17 bp, Homo sapiens
cggctggttttgtaaga

SEQ ID NO: 1476905 - DNA, 16 bp, Homo sapiens
cggctgtgattgctgc

SEQ ID NO: 1476906 - DNA, 21 bp, Homo sapiens
cggcttcactgaccagcggct

SEQ ID NO: 1476907 - DNA, 15 bp, Homo sapiens
cggcttcatgccagc

SEQ ID NO: 1476908 - DNA, 14 bp, Homo sapiens
cggcttcctgtcca

SEQ ID NO: 1476909 - DNA, 18 bp, Homo sapiens
cggcttcttggaccttgg

SEQ ID NO: 1476910 - DNA, 21 bp, Homo sapiens
cggcttgttcttgcagcattc

SEQ ID NO: 1476911 - DNA, 21 bp, Homo sapiens
cggctttcactgctgagtttc

SEQ ID NO: 1476912 - DNA, 22 bp, Homo sapiens
cgggaacagtgtttcccataat

SEQ ID NO: 1476913 - DNA, 21 bp, Homo sapiens
cgggaactttgcagcatacca

SEQ ID NO: 1476914 - DNA, 14 bp, Homo sapiens
cgggaagcagccag

SEQ ID NO: 1476915 - DNA, 16 bp, Homo sapiens
cgggaagcagccagct

SEQ ID NO: 1476916 - DNA, 12 bp, Homo sapiens
cgggaagcggag

SEQ ID NO: 1476917 - DNA, 14 bp, Homo sapiens
cgggaaggagggtt

SEQ ID NO: 1476918 - DNA, 19 bp, Homo sapiens
cgggacatcacagggtggg

SEQ ID NO: 1476919 - DNA, 21 bp, Homo sapiens
cgggacatcacagggtgggcc

SEQ ID NO: 1476920 - DNA, 16 bp, Homo sapiens
cgggaccacagctgct

SEQ ID NO: 1476921 - DNA, 16 bp, Homo sapiens
cgggaccaccctgagc

SEQ ID NO: 1476922 - DNA, 20 bp, Homo sapiens
cgggaccccctcaccatcca

SEQ ID NO: 1476923 - DNA, 16 bp, Homo sapiens
cgggagaagccacctt

SEQ ID NO: 1476924 - DNA, 13 bp, Homo sapiens
cgggagcacccag

SEQ ID NO: 1476925 - DNA, 15 bp, Homo sapiens
cgggagcagtgtctt

SEQ ID NO: 1476926 - DNA, 23 bp, Homo sapiens
cgggagcagtgtcttccataatg

SEQ ID NO: 1476927 - DNA, 14 bp, Homo sapiens
cgggagcatctctt

SEQ ID NO: 1476928 - DNA, 19 bp, Homo sapiens
cgggagcattggcccctga

SEQ ID NO: 1476929 - DNA, 13 bp, Homo sapiens
cgggagctctgta

SEQ ID NO: 1476930 - DNA, 16 bp, Homo sapiens
cgggagctttgggtga

SEQ ID NO: 1476931 - DNA, 21 bp, Homo sapiens
cgggaggaaaaggcccctgca

SEQ ID NO: 1476932 - DNA, 13 bp, Homo sapiens
cgggaggaggtgt

SEQ ID NO: 1476933 - DNA, 15 bp, Homo sapiens
cgggaggcaccagct

SEQ ID NO: 1476934 - DNA, 17 bp, Homo sapiens
cgggaggcaccagctct

SEQ ID NO: 1476935 - DNA, 23 bp, Homo sapiens
cgggaggcaccagctctgtggcc

SEQ ID NO: 1476936 - DNA, 22 bp, Homo sapiens
cgggaggcagaggttgcagtgt

SEQ ID NO: 1476937 - DNA, 21 bp, Homo sapiens
cgggaggcggaggttccagtg

SEQ ID NO: 1476938 - DNA, 17 bp, Homo sapiens
cgggaggctgaggcagg

SEQ ID NO: 1476939 - DNA, 17 bp, Homo sapiens
cgggataaactgagcct

SEQ ID NO: 1476940 - DNA, 19 bp, Homo sapiens
cgggatcctccacagagag

SEQ ID NO: 1476941 - DNA, 20 bp, Homo sapiens
cgggatcctccacagagagg

SEQ ID NO: 1476942 - DNA, 16 bp, Homo sapiens
cgggcaccagccagcg

SEQ ID NO: 1476943 - DNA, 21 bp, Homo sapiens
cgggcacctatagtcccagct

SEQ ID NO: 1476944 - DNA, 16 bp, Homo sapiens
cgggcagagggctgga

SEQ ID NO: 1476945 - DNA, 19 bp, Homo sapiens
cgggcagagggctggaggc

SEQ ID NO: 1476946 - DNA, 22 bp, Homo sapiens
cgggcagccacccaagcctgct

SEQ ID NO: 1476947 - DNA, 23 bp, Homo sapiens
cgggcagccacccaagcctgctg

SEQ ID NO: 1476948 - DNA, 13 bp, Homo sapiens
cgggcagcctggc

SEQ ID NO: 1476949 - DNA, 16 bp, Homo sapiens
cgggcagcgggccagg

SEQ ID NO: 1476950 - DNA, 15 bp, Homo sapiens
cgggcagggctccca

SEQ ID NO: 1476951 - DNA, 20 bp, Homo sapiens
cgggcagtggaggctgctgt

SEQ ID NO: 1476952 - DNA, 16 bp, Homo sapiens
cgggcatgatggtgca

SEQ ID NO: 1476953 - DNA, 21 bp, Homo sapiens
cgggcatggtggcgcaagcct

SEQ ID NO: 1476954 - DNA, 14 bp, Homo sapiens
cgggcattcacaac

SEQ ID NO: 1476955 - DNA, 17 bp, Homo sapiens
cgggccaagtgaagaat

SEQ ID NO: 1476956 - DNA, 18 bp, Homo sapiens
cgggccacacgtggctgg

SEQ ID NO: 1476957 - DNA, 20 bp, Homo sapiens
cgggccacacgtggctggcg

SEQ ID NO: 1476958 - DNA, 15 bp, Homo sapiens
cgggccagccaggcg

SEQ ID NO: 1476959 - DNA, 17 bp, Homo sapiens
cgggccagccaggcggg

SEQ ID NO: 1476960 - DNA, 18 bp, Homo sapiens
cgggccagccaggcgggc

SEQ ID NO: 1476961 - DNA, 13 bp, Homo sapiens
cgggccaggcact

SEQ ID NO: 1476962 - DNA, 13 bp, Homo sapiens
cgggccaggcccg

SEQ ID NO: 1476963 - DNA, 11 bp, Homo sapiens
cgggccagggt

SEQ ID NO: 1476964 - DNA, 11 bp, Homo sapiens
cgggcccacct

SEQ ID NO: 1476965 - DNA, 20 bp, Homo sapiens
cgggcccacctggccacctg

SEQ ID NO: 1476966 - DNA, 19 bp, Homo sapiens
cgggcccagaccggcttct

SEQ ID NO: 1476967 - DNA, 19 bp, Homo sapiens
cgggccccatcctcatccc

SEQ ID NO: 1476968 - DNA, 22 bp, Homo sapiens
cgggccccatcctcatccctga

SEQ ID NO: 1476969 - DNA, 15 bp, Homo sapiens
cgggccctctgtagc

SEQ ID NO: 1476970 - DNA, 23 bp, Homo sapiens
cgggccctgctgaggaggggcct

SEQ ID NO: 1476971 - DNA, 14 bp, Homo sapiens
cgggccgaggccca

SEQ ID NO: 1476972 - DNA, 16 bp, Homo sapiens
cgggccgaggcccagc

SEQ ID NO: 1476973 - DNA, 17 bp, Homo sapiens
cgggccgaggcccagcg

SEQ ID NO: 1476974 - DNA, 22 bp, Homo sapiens
cgggccgaggcccagcgggcag

SEQ ID NO: 1476975 - DNA, 23 bp, Homo sapiens
cgggccgaggcccagcgggcaga

SEQ ID NO: 1476976 - DNA, 16 bp, Homo sapiens
cgggcctggagaacta

SEQ ID NO: 1476977 - DNA, 20 bp, Homo sapiens
cgggcctggagaactagaga

SEQ ID NO: 1476978 - DNA, 13 bp, Homo sapiens
cgggcctggccct

SEQ ID NO: 1476979 - DNA, 20 bp, Homo sapiens
cgggcgcgatcccacacagg

SEQ ID NO: 1476980 - DNA, 16 bp, Homo sapiens
cgggcgcggtggctca

SEQ ID NO: 1476981 - DNA, 16 bp, Homo sapiens
cgggcgctgcagcctc

SEQ ID NO: 1476982 - DNA, 20 bp, Homo sapiens
cgggcgctgcagcctccctt

SEQ ID NO: 1476983 - DNA, 13 bp, Homo sapiens
cgggcggccaggc

SEQ ID NO: 1476984 - DNA, 13 bp, Homo sapiens
cgggctccttccc

SEQ ID NO: 1476985 - DNA, 15 bp, Homo sapiens
cgggctccttcccct

SEQ ID NO: 1476986 - DNA, 22 bp, Homo sapiens
cgggctccttcccctgcacctg

SEQ ID NO: 1476987 - DNA, 13 bp, Homo sapiens
cgggctctggcca

SEQ ID NO: 1476988 - DNA, 17 bp, Homo sapiens
cgggctctggccaccct

SEQ ID NO: 1476989 - DNA, 13 bp, Homo sapiens
cgggctgcctggg

SEQ ID NO: 1476990 - DNA, 15 bp, Homo sapiens
cgggctgcctgggct

SEQ ID NO: 1476991 - DNA, 12 bp, Homo sapiens
cgggctgctgct

SEQ ID NO: 1476992 - DNA, 15 bp, Homo sapiens
cgggctggagaaaga

SEQ ID NO: 1476993 - DNA, 16 bp, Homo sapiens
cgggctgtagatcagg

SEQ ID NO: 1476994 - DNA, 19 bp, Homo sapiens
cgggctgtagatcaggttt

SEQ ID NO: 1476995 - DNA, 20 bp, Homo sapiens
cgggctgtagatcaggtttg

SEQ ID NO: 1476996 - DNA, 14 bp, Homo sapiens
cgggcttcccttct

SEQ ID NO: 1476997 - DNA, 19 bp, Homo sapiens
cgggcttcccttctcccca

SEQ ID NO: 1476998 - DNA, 18 bp, Homo sapiens
cgggcttgggccctgcac

SEQ ID NO: 1476999 - DNA, 15 bp, Homo sapiens
cgggcttttccccgg

SEQ ID NO: 1477000 - DNA, 16 bp, Homo sapiens
cggggaactcctggaa

SEQ ID NO: 1477001 - DNA, 14 bp, Homo sapiens
cggggaccctgtga

SEQ ID NO: 1477002 - DNA, 16 bp, Homo sapiens
cggggcaaggtctcct

SEQ ID NO: 1477003 - DNA, 22 bp, Homo sapiens
cggggcccagcgctctcctgga

SEQ ID NO: 1477004 - DNA, 18 bp, Homo sapiens
cggggcccttggggcctg

SEQ ID NO: 1477005 - DNA, 16 bp, Homo sapiens
cggggctcttctcatt

SEQ ID NO: 1477006 - DNA, 14 bp, Homo sapiens
cgggggagagagtt

SEQ ID NO: 1477007 - DNA, 16 bp, Homo sapiens
cgggggagcccagtga

SEQ ID NO: 1477008 - DNA, 12 bp, Homo sapiens
cgggggcctgtg

SEQ ID NO: 1477009 - DNA, 22 bp, Homo sapiens
cgggggccttgaagactccctg

SEQ ID NO: 1477010 - DNA, 13 bp, Homo sapiens
cgggggctggcct

SEQ ID NO: 1477011 - DNA, 18 bp, Homo sapiens
cgggggctgtgactctgg

SEQ ID NO: 1477012 - DNA, 23 bp, Homo sapiens
cgtcagtagtttgagaccagcct

SEQ ID NO: 1477013 - DNA, 24 bp, Homo sapiens
cgtcagtagtttgagaccagcctg

SEQ ID NO: 1477014 - DNA, 16 bp, Homo sapiens
cgtcatctcagggtcc

SEQ ID NO: 1477015 - DNA, 19 bp, Homo sapiens
cgtccaagggacagcccac

SEQ ID NO: 1477016 - DNA, 20 bp, Homo sapiens
cgtccacaggggcaggcctg

SEQ ID NO: 1477017 - DNA, 21 bp, Homo sapiens
cgtccacaggggcaggcctgg

SEQ ID NO: 1477018 - DNA, 15 bp, Homo sapiens
cgtccacccaggctg

SEQ ID NO: 1477019 - DNA, 16 bp, Homo sapiens
cgtccacccaggctgc

SEQ ID NO: 1477020 - DNA, 19 bp, Homo sapiens
cgtccacccaggctgcact

SEQ ID NO: 1477021 - DNA, 20 bp, Homo sapiens
cgtccacccaggctgcactg

SEQ ID NO: 1477022 - DNA, 14 bp, Homo sapiens
cgtccacccttcca

SEQ ID NO: 1477023 - DNA, 19 bp, Homo sapiens
cgtccacccttccatcagc

SEQ ID NO: 1477024 - DNA, 22 bp, Homo sapiens
cgtccaggccgcgccctttccc

SEQ ID NO: 1477025 - DNA, 17 bp, Homo sapiens
cgtccatggcaccagcc

SEQ ID NO: 1477026 - DNA, 16 bp, Homo sapiens
cgtccatgtttctcac

SEQ ID NO: 1477027 - DNA, 15 bp, Homo sapiens
cgtcccaagatgttg

SEQ ID NO: 1477028 - DNA, 12 bp, Homo sapiens
cgtcccaggcca

SEQ ID NO: 1477029 - DNA, 13 bp, Homo sapiens
cgtcccaggccac

SEQ ID NO: 1477030 - DNA, 15 bp, Homo sapiens
cgtcccatatcctgc

SEQ ID NO: 1477031 - DNA, 17 bp, Homo sapiens
cgtcccatatcctgcct

SEQ ID NO: 1477032 - DNA, 21 bp, Homo sapiens
cgtcccccgccgcgccagtcc

SEQ ID NO: 1477033 - DNA, 13 bp, Homo sapiens
cgtcccctccgcc

SEQ ID NO: 1477034 - DNA, 18 bp, Homo sapiens
cgtcccctccgccgtgcc

SEQ ID NO: 1477035 - DNA, 17 bp, Homo sapiens
cgtcccgcgttcaagac

SEQ ID NO: 1477036 - DNA, 19 bp, Homo sapiens
cgtcccgcgttcaagactt

SEQ ID NO: 1477037 - DNA, 15 bp, Homo sapiens
cgtccctagcagtga

SEQ ID NO: 1477038 - DNA, 16 bp, Homo sapiens
cgtccctagcagtgaa

SEQ ID NO: 1477039 - DNA, 20 bp, Homo sapiens
cgtccgaggctgcttcccag

SEQ ID NO: 1477040 - DNA, 15 bp, Homo sapiens
cgtccgccctgctcc

SEQ ID NO: 1477041 - DNA, 15 bp, Homo sapiens
cgtccgcgcgccagc

SEQ ID NO: 1477042 - DNA, 16 bp, Homo sapiens
cgtccggggtggtgga

SEQ ID NO: 1477043 - DNA, 20 bp, Homo sapiens
cgtcctcatttcccctccca

SEQ ID NO: 1477044 - DNA, 13 bp, Homo sapiens
cgtcctccccctg

SEQ ID NO: 1477045 - DNA, 17 bp, Homo sapiens
cgtcctgacgccctgcg

SEQ ID NO: 1477046 - DNA, 20 bp, Homo sapiens
cgtcctgacgccctgcgttg

SEQ ID NO: 1477047 - DNA, 13 bp, Homo sapiens
cgtcctgagaaag

SEQ ID NO: 1477048 - DNA, 14 bp, Homo sapiens
cgtcctgccctgcc

SEQ ID NO: 1477049 - DNA, 15 bp, Homo sapiens
cgtcctgcctgtggc

SEQ ID NO: 1477050 - DNA, 16 bp, Homo sapiens
cgtcctgcctgtggcg

SEQ ID NO: 1477051 - DNA, 18 bp, Homo sapiens
cgtcctgctttggcagtg

SEQ ID NO: 1477052 - DNA, 16 bp, Homo sapiens
cgtcggagctgcctgc

SEQ ID NO: 1477053 - DNA, 17 bp, Homo sapiens
cgtcggagctgcctgca

SEQ ID NO: 1477054 - DNA, 16 bp, Homo sapiens
cgtcgtgtgctgaaga

SEQ ID NO: 1477055 - DNA, 20 bp, Homo sapiens
cgtcgtgtgctgaagacatg

SEQ ID NO: 1477056 - DNA, 15 bp, Homo sapiens
cgtctacccagactc

SEQ ID NO: 1477057 - DNA, 20 bp, Homo sapiens
cgtctacccagactcagaga

SEQ ID NO: 1477058 - DNA, 13 bp, Homo sapiens
cgtctactgcaag

SEQ ID NO: 1477059 - DNA, 14 bp, Homo sapiens
cgtctatcctgtgt

SEQ ID NO: 1477060 - DNA, 16 bp, Homo sapiens
cgtctcggccttcaca

SEQ ID NO: 1477061 - DNA, 13 bp, Homo sapiens
cgtctctcccacc

SEQ ID NO: 1477062 - DNA, 18 bp, Homo sapiens
cgtctctcccaccccctc

SEQ ID NO: 1477063 - DNA, 15 bp, Homo sapiens
cgtctctgccgcctg

SEQ ID NO: 1477064 - DNA, 16 bp, Homo sapiens
cgtctctgccgcctgc

SEQ ID NO: 1477065 - DNA, 19 bp, Homo sapiens
cgtctgactccagagtctg

SEQ ID NO: 1477066 - DNA, 14 bp, Homo sapiens
cgtctgagctgggg

SEQ ID NO: 1477067 - DNA, 12 bp, Homo sapiens
cgtctgccaggc

SEQ ID NO: 1477068 - DNA, 14 bp, Homo sapiens
cgtctgccaggccc

SEQ ID NO: 1477069 - DNA, 18 bp, Homo sapiens
cgtctgccaggcccatct

SEQ ID NO: 1477070 - DNA, 18 bp, Homo sapiens
cgtctgccttggcatcct

SEQ ID NO: 1477071 - DNA, 17 bp, Homo sapiens
cgtctgctcctgcgagg

SEQ ID NO: 1477072 - DNA, 18 bp, Homo sapiens
cgtctggggttcagcccc

SEQ ID NO: 1477073 - DNA, 15 bp, Homo sapiens
cgtctgtatattttg

SEQ ID NO: 1477074 - DNA, 11 bp, Homo sapiens
cgtctgtctcg

SEQ ID NO: 1477075 - DNA, 20 bp, Homo sapiens
cgtctgtgtggtggagccag

SEQ ID NO: 1477076 - DNA, 13 bp, Homo sapiens
cgtctgttttgtg

SEQ ID NO: 1477077 - DNA, 16 bp, Homo sapiens
cgtcttcaatctctgt

SEQ ID NO: 1477078 - DNA, 15 bp, Homo sapiens
cgtcttcagcctagc

SEQ ID NO: 1477079 - DNA, 22 bp, Homo sapiens
cgtcttgaacgagcagcccagg

SEQ ID NO: 1477080 - DNA, 20 bp, Homo sapiens
cgtgaaaaccaaccctgtgg

SEQ ID NO: 1477081 - DNA, 17 bp, Homo sapiens
cgtgaaaacggagctga

SEQ ID NO: 1477082 - DNA, 18 bp, Homo sapiens
cgtgaaaacggagctgaa

SEQ ID NO: 1477083 - DNA, 17 bp, Homo sapiens
cgtgaaaccccgtctct

SEQ ID NO: 1477084 - DNA, 15 bp, Homo sapiens
cgtgaagagcagtga

SEQ ID NO: 1477085 - DNA, 14 bp, Homo sapiens
cgtgaattgcttta

SEQ ID NO: 1477086 - DNA, 15 bp, Homo sapiens
cgtgaattgctttat

SEQ ID NO: 1477087 - DNA, 16 bp, Homo sapiens
cgtgaattgctttatg

SEQ ID NO: 1477088 - DNA, 13 bp, Homo sapiens
cgtgacagtggct

SEQ ID NO: 1477089 - DNA, 18 bp, Homo sapiens
cgtgacatccccaccctt

SEQ ID NO: 1477090 - DNA, 16 bp, Homo sapiens
cgtgacccttcagggc

SEQ ID NO: 1477091 - DNA, 18 bp, Homo sapiens
cgtgacccttcagggcca

SEQ ID NO: 1477092 - DNA, 19 bp, Homo sapiens
cgtgacccttcagggccag

SEQ ID NO: 1477093 - DNA, 19 bp, Homo sapiens
cgtgacctgagatgtgtga

SEQ ID NO: 1477094 - DNA, 13 bp, Homo sapiens
cgtgactcaccca

SEQ ID NO: 1477095 - DNA, 17 bp, Homo sapiens
cgtgactcacccaagca

SEQ ID NO: 1477096 - DNA, 21 bp, Homo sapiens
cgtgactgccccaactcctgg

SEQ ID NO: 1477097 - DNA, 14 bp, Homo sapiens
cgtgagagaaagag

SEQ ID NO: 1477098 - DNA, 18 bp, Homo sapiens
cgtgagagaaagagagaa

SEQ ID NO: 1477099 - DNA, 22 bp, Homo sapiens
cgtgagagaaagagagaagcca

SEQ ID NO: 1477100 - DNA, 13 bp, Homo sapiens
cgtgagcaggctt

SEQ ID NO: 1477101 - DNA, 22 bp, Homo sapiens
cgtgagccaccatgcctggccc

SEQ ID NO: 1477102 - DNA, 23 bp, Homo sapiens
cgtgagctggggactcagggacc

SEQ ID NO: 1477103 - DNA, 18 bp, Homo sapiens
cgtgaggctgctgccatc

SEQ ID NO: 1477104 - DNA, 19 bp, Homo sapiens
cgtgaggggcaagctaggc

SEQ ID NO: 1477105 - DNA, 17 bp, Homo sapiens
cgtgagtgacatagcct

SEQ ID NO: 1477106 - DNA, 15 bp, Homo sapiens
cgtgagtgcagaccc

SEQ ID NO: 1477107 - DNA, 18 bp, Homo sapiens
cgtgatccacccacctcg

SEQ ID NO: 1477108 - DNA, 24 bp, Homo sapiens
cgtgatccacccgcctcagcctcc

SEQ ID NO: 1477109 - DNA, 21 bp, Homo sapiens
cgtgatccatccatctccagg

SEQ ID NO: 1477110 - DNA, 21 bp, Homo sapiens
cgtgatctctgttacaaaaga

SEQ ID NO: 1477111 - DNA, 14 bp, Homo sapiens
cgtgatgtgccact

SEQ ID NO: 1477112 - DNA, 18 bp, Homo sapiens
cgtgatgtggaggaagag

SEQ ID NO: 1477113 - DNA, 21 bp, Homo sapiens
cgtgatgtggaggaagagcca

SEQ ID NO: 1477114 - DNA, 10 bp, Homo sapiens
cgtgcacagg

SEQ ID NO: 1477115 - DNA, 15 bp, Homo sapiens
cgtgcacctgtactc

SEQ ID NO: 1477116 - DNA, 22 bp, Homo sapiens
cgtgcacgtggagagctggtgc

SEQ ID NO: 1477117 - DNA, 13 bp, Homo sapiens
cgtgcactctgct

SEQ ID NO: 1477118 - DNA, 14 bp, Homo sapiens
cgtgcactctgcta

SEQ ID NO: 1477119 - DNA, 18 bp, Homo sapiens
cgtgcactctgctaatca

SEQ ID NO: 1477120 - DNA, 15 bp, Homo sapiens
cgtgcacttgtgatc

SEQ ID NO: 1477121 - DNA, 17 bp, Homo sapiens
cgtgcacttgtgatcct

SEQ ID NO: 1477122 - DNA, 17 bp, Homo sapiens
cgtgccagatataactg

SEQ ID NO: 1477123 - DNA, 14 bp, Homo sapiens
cgtgcccaggccct

SEQ ID NO: 1477124 - DNA, 15 bp, Homo sapiens
cgtgcccccctcctc

SEQ ID NO: 1477125 - DNA, 17 bp, Homo sapiens
cgtgcccccctcctcca

SEQ ID NO: 1477126 - DNA, 19 bp, Homo sapiens
cgtgcccccgcctgccacc

SEQ ID NO: 1477127 - DNA, 17 bp, Homo sapiens
ctaacaataatatttca

SEQ ID NO: 1477128 - DNA, 23 bp, Homo sapiens
ctaacaataatatttcaagtgcc

SEQ ID NO: 1477129 - DNA, 14 bp, Homo sapiens
ctaacacccagtct

SEQ ID NO: 1477130 - DNA, 17 bp, Homo sapiens
ctaacacctgcctaggt

SEQ ID NO: 1477131 - DNA, 19 bp, Homo sapiens
ctaacagggagaagtagct

SEQ ID NO: 1477132 - DNA, 23 bp, Homo sapiens
ctaacagggagaagtagctagta

SEQ ID NO: 1477133 - DNA, 15 bp, Homo sapiens
ctaacagtccttgct

SEQ ID NO: 1477134 - DNA, 20 bp, Homo sapiens
ctaacagtgaagttttactg

SEQ ID NO: 1477135 - DNA, 16 bp, Homo sapiens
ctaacataaaatctgt

SEQ ID NO: 1477136 - DNA, 18 bp, Homo sapiens
ctaacataaaatctgtga

SEQ ID NO: 1477137 - DNA, 14 bp, Homo sapiens
ctaacatcccactt

SEQ ID NO: 1477138 - DNA, 22 bp, Homo sapiens
ctaacatccttggactgagaaa

SEQ ID NO: 1477139 - DNA, 15 bp, Homo sapiens
ctaacatgttatcaa

SEQ ID NO: 1477140 - DNA, 21 bp, Homo sapiens
ctaacatttttgataaagcct

SEQ ID NO: 1477141 - DNA, 16 bp, Homo sapiens
ctaaccagcattccct

SEQ ID NO: 1477142 - DNA, 21 bp, Homo sapiens
ctaaccagggaagctgtccct

SEQ ID NO: 1477143 - DNA, 18 bp, Homo sapiens
ctaaccatccccaactcc

SEQ ID NO: 1477144 - DNA, 13 bp, Homo sapiens
ctaaccattcaaa

SEQ ID NO: 1477145 - DNA, 14 bp, Homo sapiens
ctaaccatttatat

SEQ ID NO: 1477146 - DNA, 17 bp, Homo sapiens
ctaaccccaacgcacag

SEQ ID NO: 1477147 - DNA, 19 bp, Homo sapiens
ctaaccccaacgcacagga

SEQ ID NO: 1477148 - DNA, 17 bp, Homo sapiens
ctaaccccttacccatc

SEQ ID NO: 1477149 - DNA, 22 bp, Homo sapiens
ctaaccccttacccatctctct

SEQ ID NO: 1477150 - DNA, 20 bp, Homo sapiens
ctaaccctcccatggcacct

SEQ ID NO: 1477151 - DNA, 17 bp, Homo sapiens
ctaacctcgggcctgct

SEQ ID NO: 1477152 - DNA, 17 bp, Homo sapiens
ctaacctgttacactgg

SEQ ID NO: 1477153 - DNA, 14 bp, Homo sapiens
ctaaccttgaatgc

SEQ ID NO: 1477154 - DNA, 16 bp, Homo sapiens
ctaaccttgaatgctg

SEQ ID NO: 1477155 - DNA, 17 bp, Homo sapiens
ctaaccttgaatgctgc

SEQ ID NO: 1477156 - DNA, 21 bp, Homo sapiens
ctaaccttgaatgctgccagt

SEQ ID NO: 1477157 - DNA, 20 bp, Homo sapiens
ctaacgacttcagggcaggg

SEQ ID NO: 1477158 - DNA, 22 bp, Homo sapiens
ctaacgttgagcccctggaggc

SEQ ID NO: 1477159 - DNA, 16 bp, Homo sapiens
ctaactaaataccatt

SEQ ID NO: 1477160 - DNA, 16 bp, Homo sapiens
ctaactagaattagta

SEQ ID NO: 1477161 - DNA, 22 bp, Homo sapiens
ctaactagacaccaaagttcta

SEQ ID NO: 1477162 - DNA, 16 bp, Homo sapiens
ctaactcactgcctag

SEQ ID NO: 1477163 - DNA, 16 bp, Homo sapiens
ctaactccgagagcag

SEQ ID NO: 1477164 - DNA, 19 bp, Homo sapiens
ctaactcttttctattttg

SEQ ID NO: 1477165 - DNA, 16 bp, Homo sapiens
ctaactgcaatgtgga

SEQ ID NO: 1477166 - DNA, 17 bp, Homo sapiens
ctaactgggttaaatat

SEQ ID NO: 1477167 - DNA, 13 bp, Homo sapiens
ctaactgtaaatc

SEQ ID NO: 1477168 - DNA, 14 bp, Homo sapiens
ctaactgtaaatca

SEQ ID NO: 1477169 - DNA, 14 bp, Homo sapiens
ctaacttgtaaaaa

SEQ ID NO: 1477170 - DNA, 13 bp, Homo sapiens
ctaacttgtttga

SEQ ID NO: 1477171 - DNA, 17 bp, Homo sapiens
ctaagaaaagcctaatc

SEQ ID NO: 1477172 - DNA, 22 bp, Homo sapiens
ctaagaaaagcctaatcacagt

SEQ ID NO: 1477173 - DNA, 13 bp, Homo sapiens
ctaagaaaatgta

SEQ ID NO: 1477174 - DNA, 23 bp, Homo sapiens
ctaagaaacacatcaaataaact

SEQ ID NO: 1477175 - DNA, 23 bp, Homo sapiens
ctaagaagaaaattgctgtgcct

SEQ ID NO: 1477176 - DNA, 12 bp, Homo sapiens
ctaagaagacat

SEQ ID NO: 1477177 - DNA, 13 bp, Homo sapiens
ctaagaagctctg

SEQ ID NO: 1477178 - DNA, 21 bp, Homo sapiens
ctaagaagctctggccccagg

SEQ ID NO: 1477179 - DNA, 22 bp, Homo sapiens
ctaagaagctctggccccaggc

SEQ ID NO: 1477180 - DNA, 22 bp, Homo sapiens
ctaagaataaataaagaagaaa

SEQ ID NO: 1477181 - DNA, 14 bp, Homo sapiens
ctaagaatgctttg

SEQ ID NO: 1477182 - DNA, 17 bp, Homo sapiens
ctaagaatgtccttatt

SEQ ID NO: 1477183 - DNA, 20 bp, Homo sapiens
ctaagaatgtccttattctt

SEQ ID NO: 1477184 - DNA, 13 bp, Homo sapiens
ctaagacatgtga

SEQ ID NO: 1477185 - DNA, 14 bp, Homo sapiens
ctaagaccctgtgt

SEQ ID NO: 1477186 - DNA, 22 bp, Homo sapiens
ctaagactatatatataaatgt

SEQ ID NO: 1477187 - DNA, 17 bp, Homo sapiens
ctaagactcaaatgttc

SEQ ID NO: 1477188 - DNA, 20 bp, Homo sapiens
ctaagactcaaatgttctaa

SEQ ID NO: 1477189 - DNA, 17 bp, Homo sapiens
ctaagacttactctaag

SEQ ID NO: 1477190 - DNA, 15 bp, Homo sapiens
ctaagagcagagtct

SEQ ID NO: 1477191 - DNA, 19 bp, Homo sapiens
ctaagagctagcgctgccg

SEQ ID NO: 1477192 - DNA, 17 bp, Homo sapiens
ctaagagtggaggagga

SEQ ID NO: 1477193 - DNA, 14 bp, Homo sapiens
ctaagatagaaagc

SEQ ID NO: 1477194 - DNA, 21 bp, Homo sapiens
ctaagatagaaagctggactg

SEQ ID NO: 1477195 - DNA, 23 bp, Homo sapiens
ctaagatagaaagctggactgac

SEQ ID NO: 1477196 - DNA, 23 bp, Homo sapiens
ctaagatgattttttaaggagct

SEQ ID NO: 1477197 - DNA, 18 bp, Homo sapiens
ctaagatgtgatattcta

SEQ ID NO: 1477198 - DNA, 21 bp, Homo sapiens
ctaagatgtgatattctaaga

SEQ ID NO: 1477199 - DNA, 23 bp, Homo sapiens
ctaagatgtgatattctaagact

SEQ ID NO: 1477200 - DNA, 18 bp, Homo sapiens
ctaagatgtgttcttatt

SEQ ID NO: 1477201 - DNA, 17 bp, Homo sapiens
ctaagatgttcactgtg

SEQ ID NO: 1477202 - DNA, 13 bp, Homo sapiens
ctaagattctaaa

SEQ ID NO: 1477203 - DNA, 14 bp, Homo sapiens
ctaagattctaaag

SEQ ID NO: 1477204 - DNA, 11 bp, Homo sapiens
ctaagattctg

SEQ ID NO: 1477205 - DNA, 19 bp, Homo sapiens
ctaagattctgattttagg

SEQ ID NO: 1477206 - DNA, 16 bp, Homo sapiens
ctaagatttggtttgg

SEQ ID NO: 1477207 - DNA, 12 bp, Homo sapiens
ctaagcaacaga

SEQ ID NO: 1477208 - DNA, 21 bp, Homo sapiens
ctaagcaatgcaaatgtctaa

SEQ ID NO: 1477209 - DNA, 17 bp, Homo sapiens
ctaagcagttttgtaaa

SEQ ID NO: 1477210 - DNA, 19 bp, Homo sapiens
ctaagcagttttgtaaatg

SEQ ID NO: 1477211 - DNA, 21 bp, Homo sapiens
ctaagcatacgtatacaataa

SEQ ID NO: 1477212 - DNA, 13 bp, Homo sapiens
ctaagcatctaag

SEQ ID NO: 1477213 - DNA, 15 bp, Homo sapiens
ctaagcatctaagtt

SEQ ID NO: 1477214 - DNA, 16 bp, Homo sapiens
ctaagcatggcctgga

SEQ ID NO: 1477215 - DNA, 19 bp, Homo sapiens
ctaagcatgtgtcccagga

SEQ ID NO: 1477216 - DNA, 12 bp, Homo sapiens
ctaagcccccag

SEQ ID NO: 1477217 - DNA, 20 bp, Homo sapiens
ctaagcccccagggcctcca

SEQ ID NO: 1477218 - DNA, 21 bp, Homo sapiens
ctaagccctcgaaccaaggca

SEQ ID NO: 1477219 - DNA, 20 bp, Homo sapiens
ctaagccctgtcgagacact

SEQ ID NO: 1477220 - DNA, 14 bp, Homo sapiens
ctaagccctgttct

SEQ ID NO: 1477221 - DNA, 15 bp, Homo sapiens
ctaagccctgttctc

SEQ ID NO: 1477222 - DNA, 18 bp, Homo sapiens
ctaagccctgttctcctg

SEQ ID NO: 1477223 - DNA, 22 bp, Homo sapiens
ctaagcgcacattcatgtgggc

SEQ ID NO: 1477224 - DNA, 18 bp, Homo sapiens
ctaagcggctgtttactg

SEQ ID NO: 1477225 - DNA, 21 bp, Homo sapiens
ctaagcggctgtttactgctt

SEQ ID NO: 1477226 - DNA, 15 bp, Homo sapiens
ctaagctaaccccct

SEQ ID NO: 1477227 - DNA, 17 bp, Homo sapiens
ctaagctctctgggcct

SEQ ID NO: 1477228 - DNA, 20 bp, Homo sapiens
ctaagctctctgggcctggg

SEQ ID NO: 1477229 - DNA, 21 bp, Homo sapiens
ctaagctgatattatttcttc

SEQ ID NO: 1477230 - DNA, 13 bp, Homo sapiens
ctaagctggagct

SEQ ID NO: 1477231 - DNA, 22 bp, Homo sapiens
ctaagctggagtgcttatccct

SEQ ID NO: 1477232 - DNA, 15 bp, Homo sapiens
ctaagcttatttcta

SEQ ID NO: 1477233 - DNA, 20 bp, Homo sapiens
ctaaggaagtatcagcacta

SEQ ID NO: 1477234 - DNA, 11 bp, Homo sapiens
ctaaggacaca

SEQ ID NO: 1477235 - DNA, 20 bp, Homo sapiens
ctaaggacctgaaattccaa

SEQ ID NO: 1477236 - DNA, 11 bp, Homo sapiens
ctaaggacctt

SEQ ID NO: 1477237 - DNA, 18 bp, Homo sapiens
ctaaggataatgaaataa

SEQ ID NO: 1477238 - DNA, 22 bp, Homo sapiens
ctaaggataatgaaataatcag

SEQ ID NO: 1477239 - DNA, 18 bp, Homo sapiens
ctaaggatctctcaggag

SEQ ID NO: 1477240 - DNA, 23 bp, Homo sapiens
ctaaggatctctcaggagcacag

SEQ ID NO: 1477241 - DNA, 20 bp, Homo sapiens
ctaccctgagatctgcacag

SEQ ID NO: 1477242 - DNA, 14 bp, Homo sapiens
ctaccctgattctt

SEQ ID NO: 1477243 - DNA, 23 bp, Homo sapiens
ctaccctgtctgtcccttttctt

SEQ ID NO: 1477244 - DNA, 19 bp, Homo sapiens
ctaccctttttctccagct

SEQ ID NO: 1477245 - DNA, 19 bp, Homo sapiens
ctaccgagtctcttctcca

SEQ ID NO: 1477246 - DNA, 22 bp, Homo sapiens
ctaccgagtctcttctccactg

SEQ ID NO: 1477247 - DNA, 13 bp, Homo sapiens
ctaccgcaggccc

SEQ ID NO: 1477248 - DNA, 21 bp, Homo sapiens
ctaccgtggatctccttccct

SEQ ID NO: 1477249 - DNA, 12 bp, Homo sapiens
ctacctagaagt

SEQ ID NO: 1477250 - DNA, 14 bp, Homo sapiens
ctacctagaagtaa

SEQ ID NO: 1477251 - DNA, 17 bp, Homo sapiens
ctacctcactggggtcc

SEQ ID NO: 1477252 - DNA, 18 bp, Homo sapiens
ctacctcaggcagctcaa

SEQ ID NO: 1477253 - DNA, 14 bp, Homo sapiens
ctacctcaggcagg

SEQ ID NO: 1477254 - DNA, 23 bp, Homo sapiens
ctacctcaggcaggaagggcagg

SEQ ID NO: 1477255 - DNA, 12 bp, Homo sapiens
ctacctccaccc

SEQ ID NO: 1477256 - DNA, 13 bp, Homo sapiens
ctacctccctccc

SEQ ID NO: 1477257 - DNA, 16 bp, Homo sapiens
ctacctctctgtccct

SEQ ID NO: 1477258 - DNA, 14 bp, Homo sapiens
ctacctgccctcaa

SEQ ID NO: 1477259 - DNA, 15 bp, Homo sapiens
ctacctgtctgctgc

SEQ ID NO: 1477260 - DNA, 16 bp, Homo sapiens
ctacctgtctgctgcc

SEQ ID NO: 1477261 - DNA, 17 bp, Homo sapiens
ctacctgtctgctgcca

SEQ ID NO: 1477262 - DNA, 21 bp, Homo sapiens
ctacctgtctgctgccagcac

SEQ ID NO: 1477263 - DNA, 13 bp, Homo sapiens
ctaccttccccag

SEQ ID NO: 1477264 - DNA, 20 bp, Homo sapiens
ctaccttccccagacttgca

SEQ ID NO: 1477265 - DNA, 15 bp, Homo sapiens
ctaccttctctaccc

SEQ ID NO: 1477266 - DNA, 22 bp, Homo sapiens
ctaccttctctacccatctccc

SEQ ID NO: 1477267 - DNA, 12 bp, Homo sapiens
ctaccttgcctc

SEQ ID NO: 1477268 - DNA, 13 bp, Homo sapiens
ctaccttgcctcc

SEQ ID NO: 1477269 - DNA, 14 bp, Homo sapiens
ctaccttgcctcct

SEQ ID NO: 1477270 - DNA, 16 bp, Homo sapiens
ctaccttgttgtgttt

SEQ ID NO: 1477271 - DNA, 23 bp, Homo sapiens
ctacctttatatttggggtcctt

SEQ ID NO: 1477272 - DNA, 20 bp, Homo sapiens
ctacggagggtgggctctga

SEQ ID NO: 1477273 - DNA, 20 bp, Homo sapiens
ctacgggcgctgcagcctcc

SEQ ID NO: 1477274 - DNA, 22 bp, Homo sapiens
ctacgtttgcaccgcctgccct

SEQ ID NO: 1477275 - DNA, 14 bp, Homo sapiens
ctacgttttggttc

SEQ ID NO: 1477276 - DNA, 15 bp, Homo sapiens
ctactaaaaatacaa

SEQ ID NO: 1477277 - DNA, 19 bp, Homo sapiens
ctactaaaaatacaaaaat

SEQ ID NO: 1477278 - DNA, 19 bp, Homo sapiens
ctactacccattgttccct

SEQ ID NO: 1477279 - DNA, 20 bp, Homo sapiens
ctactacccattgttccctt

SEQ ID NO: 1477280 - DNA, 17 bp, Homo sapiens
ctactataaagagaaga

SEQ ID NO: 1477281 - DNA, 18 bp, Homo sapiens
ctactatgccagatgcct

SEQ ID NO: 1477282 - DNA, 20 bp, Homo sapiens
ctactcaagaggctgaggca

SEQ ID NO: 1477283 - DNA, 18 bp, Homo sapiens
ctactcacacttcagctg

SEQ ID NO: 1477284 - DNA, 18 bp, Homo sapiens
ctactcacagtctcttta

SEQ ID NO: 1477285 - DNA, 21 bp, Homo sapiens
ctactcagaagcctgaggctg

SEQ ID NO: 1477286 - DNA, 18 bp, Homo sapiens
ctactcagcagccctcct

SEQ ID NO: 1477287 - DNA, 19 bp, Homo sapiens
ctactcagcagccctcctc

SEQ ID NO: 1477288 - DNA, 15 bp, Homo sapiens
ctactcagcatttga

SEQ ID NO: 1477289 - DNA, 23 bp, Homo sapiens
ctactcaggaggctgaggcagaa

SEQ ID NO: 1477290 - DNA, 23 bp, Homo sapiens
ctactcaggaggctgaggcagga

SEQ ID NO: 1477291 - DNA, 18 bp, Homo sapiens
ctactcagtggggctggc

SEQ ID NO: 1477292 - DNA, 20 bp, Homo sapiens
ctactcagtggggctggcat

SEQ ID NO: 1477293 - DNA, 21 bp, Homo sapiens
ctactcataagttggaccaga

SEQ ID NO: 1477294 - DNA, 20 bp, Homo sapiens
ctactcatacttaagcaaaa

SEQ ID NO: 1477295 - DNA, 14 bp, Homo sapiens
ctactcatccagac

SEQ ID NO: 1477296 - DNA, 14 bp, Homo sapiens
ctactcccctgggc

SEQ ID NO: 1477297 - DNA, 13 bp, Homo sapiens
ctactccctgcag

SEQ ID NO: 1477298 - DNA, 18 bp, Homo sapiens
ctactccctgcagatgcc

SEQ ID NO: 1477299 - DNA, 22 bp, Homo sapiens
ctactccctgcagatgccaccc

SEQ ID NO: 1477300 - DNA, 15 bp, Homo sapiens
ctactcctagaagaa

SEQ ID NO: 1477301 - DNA, 16 bp, Homo sapiens
ctactcctagaagaac

SEQ ID NO: 1477302 - DNA, 14 bp, Homo sapiens
ctactcctctgcag

SEQ ID NO: 1477303 - DNA, 18 bp, Homo sapiens
ctactcctgtaattccta

SEQ ID NO: 1477304 - DNA, 13 bp, Homo sapiens
ctactcctgtgct

SEQ ID NO: 1477305 - DNA, 22 bp, Homo sapiens
ctactcgggaggctgaggcagg

SEQ ID NO: 1477306 - DNA, 21 bp, Homo sapiens
ctactctaaagaaaaatgcct

SEQ ID NO: 1477307 - DNA, 23 bp, Homo sapiens
ctactctccccacgagggctggc

SEQ ID NO: 1477308 - DNA, 13 bp, Homo sapiens
ctactctgtccag

SEQ ID NO: 1477309 - DNA, 20 bp, Homo sapiens
ctactcttacagagccttga

SEQ ID NO: 1477310 - DNA, 14 bp, Homo sapiens
ctactcttgtcatt

SEQ ID NO: 1477311 - DNA, 22 bp, Homo sapiens
ctactgaaacagatttcatacc

SEQ ID NO: 1477312 - DNA, 16 bp, Homo sapiens
ctactgaacacatgtg

SEQ ID NO: 1477313 - DNA, 21 bp, Homo sapiens
ctactgaataatgctaccagg

SEQ ID NO: 1477314 - DNA, 15 bp, Homo sapiens
ctactgacagggagc

SEQ ID NO: 1477315 - DNA, 16 bp, Homo sapiens
ctactgattgtttcat

SEQ ID NO: 1477316 - DNA, 16 bp, Homo sapiens
ctactgcaagagccaa

SEQ ID NO: 1477317 - DNA, 19 bp, Homo sapiens
ctactgcactccagcctgg

SEQ ID NO: 1477318 - DNA, 20 bp, Homo sapiens
ctactgcactccagcctggg

SEQ ID NO: 1477319 - DNA, 23 bp, Homo sapiens
ctactgcactccagcctggggga

SEQ ID NO: 1477320 - DNA, 18 bp, Homo sapiens
ctactgcactttccccct

SEQ ID NO: 1477321 - DNA, 22 bp, Homo sapiens
ctactgcactttcccccttccc

SEQ ID NO: 1477322 - DNA, 19 bp, Homo sapiens
ctactgcagcacctccagg

SEQ ID NO: 1477323 - DNA, 21 bp, Homo sapiens
ctactgcagcacctccaggcc

SEQ ID NO: 1477324 - DNA, 12 bp, Homo sapiens
ctactgcccaca

SEQ ID NO: 1477325 - DNA, 17 bp, Homo sapiens
ctactgctcctgtggca

SEQ ID NO: 1477326 - DNA, 14 bp, Homo sapiens
ctactggcagctcc

SEQ ID NO: 1477327 - DNA, 22 bp, Homo sapiens
ctactggcagctcctctccttg

SEQ ID NO: 1477328 - DNA, 17 bp, Homo sapiens
ctactggggaggctgag

SEQ ID NO: 1477329 - DNA, 21 bp, Homo sapiens
ctactggggaggctgaggcag

SEQ ID NO: 1477330 - DNA, 12 bp, Homo sapiens
ctactgtacttt

SEQ ID NO: 1477331 - DNA, 17 bp, Homo sapiens
ctactgtactttgccat

SEQ ID NO: 1477332 - DNA, 19 bp, Homo sapiens
ctactgtccctctcagtgc

SEQ ID NO: 1477333 - DNA, 21 bp, Homo sapiens
ctactgtccctctcagtgcct

SEQ ID NO: 1477334 - DNA, 15 bp, Homo sapiens
ctactgtcctcagag

SEQ ID NO: 1477335 - DNA, 22 bp, Homo sapiens
ctactgttctaaagctctgaca

SEQ ID NO: 1477336 - DNA, 22 bp, Homo sapiens
ctactgttgtaagaattctgat

SEQ ID NO: 1477337 - DNA, 15 bp, Homo sapiens
ctacttaaaaaaaat

SEQ ID NO: 1477338 - DNA, 16 bp, Homo sapiens
ctacttaatgcacagt

SEQ ID NO: 1477339 - DNA, 18 bp, Homo sapiens
ctacttccccagctctca

SEQ ID NO: 1477340 - DNA, 18 bp, Homo sapiens
ctacttcccttcctcccg

SEQ ID NO: 1477341 - DNA, 17 bp, Homo sapiens
ctacttcctcctcccca

SEQ ID NO: 1477342 - DNA, 18 bp, Homo sapiens
ctacttctagctgtattt

SEQ ID NO: 1477343 - DNA, 20 bp, Homo sapiens
ctacttctgactttacttgt

SEQ ID NO: 1477344 - DNA, 18 bp, Homo sapiens
ctacttctgtaattgtgt

SEQ ID NO: 1477345 - DNA, 22 bp, Homo sapiens
ctacttcttttgctcttagctg

SEQ ID NO: 1477346 - DNA, 16 bp, Homo sapiens
ctacttgaccattctc

SEQ ID NO: 1477347 - DNA, 21 bp, Homo sapiens
ctacttgaccattctcaccct

SEQ ID NO: 1477348 - DNA, 15 bp, Homo sapiens
ctacttgagaggctg

SEQ ID NO: 1477349 - DNA, 13 bp, Homo sapiens
ctacttgggaggc

SEQ ID NO: 1477350 - DNA, 13 bp, Homo sapiens
ctacttggtttgt

SEQ ID NO: 1477351 - DNA, 18 bp, Homo sapiens
ctactttcatcttaaact

SEQ ID NO: 1477352 - DNA, 19 bp, Homo sapiens
ctactttcatcttaaacta

SEQ ID NO: 1477353 - DNA, 22 bp, Homo sapiens
ctactttctgtgtctatggatt

SEQ ID NO: 1477354 - DNA, 18 bp, Homo sapiens
ctactttgactttttgca

SEQ ID NO: 1477355 - DNA, 16 bp, Homo sapiens
ctaggtgtccccaacg

SEQ ID NO: 1477356 - DNA, 18 bp, Homo sapiens
ctaggtgtggctgtgaag

SEQ ID NO: 1477357 - DNA, 14 bp, Homo sapiens
ctaggttggacagc

SEQ ID NO: 1477358 - DNA, 20 bp, Homo sapiens
ctaggttggacagccccctt

SEQ ID NO: 1477359 - DNA, 13 bp, Homo sapiens
ctaggtttcaaag

SEQ ID NO: 1477360 - DNA, 14 bp, Homo sapiens
ctagtaaaggagga

SEQ ID NO: 1477361 - DNA, 14 bp, Homo sapiens
ctagtaattgccta

SEQ ID NO: 1477362 - DNA, 19 bp, Homo sapiens
ctagtacaagtggtaattt

SEQ ID NO: 1477363 - DNA, 19 bp, Homo sapiens
ctagtaccctatagagagg

SEQ ID NO: 1477364 - DNA, 19 bp, Homo sapiens
ctagtactctctgctctag

SEQ ID NO: 1477365 - DNA, 14 bp, Homo sapiens
ctagtagaactgga

SEQ ID NO: 1477366 - DNA, 14 bp, Homo sapiens
ctagtagcaatgtg

SEQ ID NO: 1477367 - DNA, 15 bp, Homo sapiens
ctagtaggaatgtac

SEQ ID NO: 1477368 - DNA, 21 bp, Homo sapiens
ctagtatcttcaaactttcac

SEQ ID NO: 1477369 - DNA, 22 bp, Homo sapiens
ctagtattcctaacctgtcaga

SEQ ID NO: 1477370 - DNA, 17 bp, Homo sapiens
ctagtatttttttctta

SEQ ID NO: 1477371 - DNA, 15 bp, Homo sapiens
ctagtcaactgctgt

SEQ ID NO: 1477372 - DNA, 17 bp, Homo sapiens
ctagtcaactgctgttt

SEQ ID NO: 1477373 - DNA, 18 bp, Homo sapiens
ctagtcaccgacagcggc

SEQ ID NO: 1477374 - DNA, 17 bp, Homo sapiens
ctagtcacgcatgcagt

SEQ ID NO: 1477375 - DNA, 18 bp, Homo sapiens
ctagtcagagagagtgtt

SEQ ID NO: 1477376 - DNA, 14 bp, Homo sapiens
ctagtcatatatta

SEQ ID NO: 1477377 - DNA, 23 bp, Homo sapiens
ctagtcccttcccctccctggct

SEQ ID NO: 1477378 - DNA, 18 bp, Homo sapiens
ctagtcctattctattgc

SEQ ID NO: 1477379 - DNA, 21 bp, Homo sapiens
ctagtctaaaaacttcttttt

SEQ ID NO: 1477380 - DNA, 15 bp, Homo sapiens
ctagtctcctttgca

SEQ ID NO: 1477381 - DNA, 19 bp, Homo sapiens
ctagtctcctttgcactga

SEQ ID NO: 1477382 - DNA, 13 bp, Homo sapiens
ctagtctctgatt

SEQ ID NO: 1477383 - DNA, 14 bp, Homo sapiens
ctagtctctgattt

SEQ ID NO: 1477384 - DNA, 18 bp, Homo sapiens
ctagtctctgatttgcaa

SEQ ID NO: 1477385 - DNA, 15 bp, Homo sapiens
ctagtcttcacaact

SEQ ID NO: 1477386 - DNA, 18 bp, Homo sapiens
ctagtgaaagaggcagct

SEQ ID NO: 1477387 - DNA, 18 bp, Homo sapiens
ctagtgaaatggctgggg

SEQ ID NO: 1477388 - DNA, 19 bp, Homo sapiens
ctagtgaaatggctggggc

SEQ ID NO: 1477389 - DNA, 14 bp, Homo sapiens
ctagtgaatgaatc

SEQ ID NO: 1477390 - DNA, 15 bp, Homo sapiens
ctagtgccccagact

SEQ ID NO: 1477391 - DNA, 20 bp, Homo sapiens
ctagtgccccagactgagct

SEQ ID NO: 1477392 - DNA, 21 bp, Homo sapiens
ctagtgccccagactgagctc

SEQ ID NO: 1477393 - DNA, 19 bp, Homo sapiens
ctagtgccctccacagccg

SEQ ID NO: 1477394 - DNA, 17 bp, Homo sapiens
ctagtgctgtaatattg

SEQ ID NO: 1477395 - DNA, 21 bp, Homo sapiens
ctagtgctgtaatattgtaaa

SEQ ID NO: 1477396 - DNA, 13 bp, Homo sapiens
ctagtgggacagc

SEQ ID NO: 1477397 - DNA, 18 bp, Homo sapiens
ctagtgggacagcccaga

SEQ ID NO: 1477398 - DNA, 23 bp, Homo sapiens
ctagtgggacagcccagagcctg

SEQ ID NO: 1477399 - DNA, 17 bp, Homo sapiens
ctagtggggtctccctc

SEQ ID NO: 1477400 - DNA, 19 bp, Homo sapiens
ctagtggggtctccctctc

SEQ ID NO: 1477401 - DNA, 21 bp, Homo sapiens
ctagtggggtctccctctcct

SEQ ID NO: 1477402 - DNA, 22 bp, Homo sapiens
ctagtggggtctccctctcctg

SEQ ID NO: 1477403 - DNA, 23 bp, Homo sapiens
ctagtggggtgaacagctggtgc

SEQ ID NO: 1477404 - DNA, 20 bp, Homo sapiens
ctagtggtagtatctcgtaa

SEQ ID NO: 1477405 - DNA, 19 bp, Homo sapiens
ctagtgtaacactgcaaga

SEQ ID NO: 1477406 - DNA, 19 bp, Homo sapiens
ctagtgtacctcctctcag

SEQ ID NO: 1477407 - DNA, 13 bp, Homo sapiens
ctagtgtagaatt

SEQ ID NO: 1477408 - DNA, 20 bp, Homo sapiens
ctagtgtagaattgtgcaac

SEQ ID NO: 1477409 - DNA, 20 bp, Homo sapiens
ctagtgtgagtggcagccat

SEQ ID NO: 1477410 - DNA, 16 bp, Homo sapiens
ctagtgtgtcctgtga

SEQ ID NO: 1477411 - DNA, 17 bp, Homo sapiens
ctagtgtgtgtgctttc

SEQ ID NO: 1477412 - DNA, 18 bp, Homo sapiens
ctagtgttctgtttgtta

SEQ ID NO: 1477413 - DNA, 23 bp, Homo sapiens
ctagttagcatccaggctggcca

SEQ ID NO: 1477414 - DNA, 16 bp, Homo sapiens
ctagttatacttattt

SEQ ID NO: 1477415 - DNA, 15 bp, Homo sapiens
ctagttcaagaagat

SEQ ID NO: 1477416 - DNA, 22 bp, Homo sapiens
ctagttcctgatgacccaggct

SEQ ID NO: 1477417 - DNA, 13 bp, Homo sapiens
ctagttctcagct

SEQ ID NO: 1477418 - DNA, 18 bp, Homo sapiens
ctagttctcttaacactg

SEQ ID NO: 1477419 - DNA, 13 bp, Homo sapiens
ctagttctgctgc

SEQ ID NO: 1477420 - DNA, 16 bp, Homo sapiens
ctagttctttcctccc

SEQ ID NO: 1477421 - DNA, 23 bp, Homo sapiens
ctagttctttcctccccctgcaa

SEQ ID NO: 1477422 - DNA, 21 bp, Homo sapiens
ctagtttacagaaaaatcttg

SEQ ID NO: 1477423 - DNA, 16 bp, Homo sapiens
ctagtttgattattat

SEQ ID NO: 1477424 - DNA, 17 bp, Homo sapiens
ctagtttgattattatg

SEQ ID NO: 1477425 - DNA, 15 bp, Homo sapiens
ctagtttgctttttg

SEQ ID NO: 1477426 - DNA, 13 bp, Homo sapiens
ctagttttacaga

SEQ ID NO: 1477427 - DNA, 21 bp, Homo sapiens
ctagttttacagattgcctcc

SEQ ID NO: 1477428 - DNA, 16 bp, Homo sapiens
ctagttttctcctccc

SEQ ID NO: 1477429 - DNA, 17 bp, Homo sapiens
ctagttttctcctccca

SEQ ID NO: 1477430 - DNA, 20 bp, Homo sapiens
ctagttttctcctcccagga

SEQ ID NO: 1477431 - DNA, 18 bp, Homo sapiens
ctataaaattaaatgcct

SEQ ID NO: 1477432 - DNA, 19 bp, Homo sapiens
ctataaacttaagggcaag

SEQ ID NO: 1477433 - DNA, 23 bp, Homo sapiens
ctataaagaagaacttgcatgga

SEQ ID NO: 1477434 - DNA, 18 bp, Homo sapiens
ctataaagcagtattttt

SEQ ID NO: 1477435 - DNA, 19 bp, Homo sapiens
ctataaagcagtatttttc

SEQ ID NO: 1477436 - DNA, 12 bp, Homo sapiens
ctataaagctgt

SEQ ID NO: 1477437 - DNA, 14 bp, Homo sapiens
ctataaatgccaga

SEQ ID NO: 1477438 - DNA, 16 bp, Homo sapiens
ctataaatgccagagc

SEQ ID NO: 1477439 - DNA, 19 bp, Homo sapiens
ctataaatgccagagccaa

SEQ ID NO: 1477440 - DNA, 23 bp, Homo sapiens
ctataaatggtgtttttttaata

SEQ ID NO: 1477441 - DNA, 17 bp, Homo sapiens
ctataacaactctattt

SEQ ID NO: 1477442 - DNA, 16 bp, Homo sapiens
ctataacaatcactgg

SEQ ID NO: 1477443 - DNA, 14 bp, Homo sapiens
ctataacatgtctt

SEQ ID NO: 1477444 - DNA, 17 bp, Homo sapiens
ctataagaagccttaat

SEQ ID NO: 1477445 - DNA, 18 bp, Homo sapiens
ctataagaataaggcttt

SEQ ID NO: 1477446 - DNA, 20 bp, Homo sapiens
ctataagaataaggcttttt

SEQ ID NO: 1477447 - DNA, 21 bp, Homo sapiens
ctataaggagagttcaagcct

SEQ ID NO: 1477448 - DNA, 22 bp, Homo sapiens
ctataagggagtaggctgtatt

SEQ ID NO: 1477449 - DNA, 13 bp, Homo sapiens
ctataaggtgcct

SEQ ID NO: 1477450 - DNA, 22 bp, Homo sapiens
ctataaggtgctctctttctgt

SEQ ID NO: 1477451 - DNA, 16 bp, Homo sapiens
ctataagtagttggtt

SEQ ID NO: 1477452 - DNA, 15 bp, Homo sapiens
ctataatattttatc

SEQ ID NO: 1477453 - DNA, 11 bp, Homo sapiens
ctataatcatt

SEQ ID NO: 1477454 - DNA, 14 bp, Homo sapiens
ctataatcccagct

SEQ ID NO: 1477455 - DNA, 20 bp, Homo sapiens
ctataatggaaacatttaca

SEQ ID NO: 1477456 - DNA, 20 bp, Homo sapiens
ctataattccctatctttta

SEQ ID NO: 1477457 - DNA, 19 bp, Homo sapiens
ctataattttgcctttaac

SEQ ID NO: 1477458 - DNA, 15 bp, Homo sapiens
ctatacaatgtatgt

SEQ ID NO: 1477459 - DNA, 14 bp, Homo sapiens
ctatacacacacac

SEQ ID NO: 1477460 - DNA, 14 bp, Homo sapiens
ctatacctgagcct

SEQ ID NO: 1477461 - DNA, 13 bp, Homo sapiens
ctatacctgggga

SEQ ID NO: 1477462 - DNA, 16 bp, Homo sapiens
ctatactggttatagt

SEQ ID NO: 1477463 - DNA, 16 bp, Homo sapiens
ctatactgtttgtaat

SEQ ID NO: 1477464 - DNA, 11 bp, Homo sapiens
ctatactttgt

SEQ ID NO: 1477465 - DNA, 18 bp, Homo sapiens
ctatactttgttctgttg

SEQ ID NO: 1477466 - DNA, 21 bp, Homo sapiens
ctatactttgttctgttgtct

SEQ ID NO: 1477467 - DNA, 23 bp, Homo sapiens
ctatactttgttctgttgtctgc

SEQ ID NO: 1477468 - DNA, 19 bp, Homo sapiens
ctatagaaaaagtaaaaga

SEQ ID NO: 1477469 - DNA, 19 bp, Homo sapiens
ctatggctgcctgcatcta

SEQ ID NO: 1477470 - DNA, 16 bp, Homo sapiens
ctatgggagccccagg

SEQ ID NO: 1477471 - DNA, 14 bp, Homo sapiens
ctatgggaggcagc

SEQ ID NO: 1477472 - DNA, 21 bp, Homo sapiens
ctatggggatagatgtgtgga

SEQ ID NO: 1477473 - DNA, 19 bp, Homo sapiens
ctatgggtctaggacacag

SEQ ID NO: 1477474 - DNA, 21 bp, Homo sapiens
ctatggtcgggagacagcatc

SEQ ID NO: 1477475 - DNA, 15 bp, Homo sapiens
ctatgtaagggtctt

SEQ ID NO: 1477476 - DNA, 15 bp, Homo sapiens
ctatgtagaactgtt

SEQ ID NO: 1477477 - DNA, 19 bp, Homo sapiens
ctatgtagtgtctttattt

SEQ ID NO: 1477478 - DNA, 13 bp, Homo sapiens
ctatgtataaaat

SEQ ID NO: 1477479 - DNA, 18 bp, Homo sapiens
ctatgtatattctatttt

SEQ ID NO: 1477480 - DNA, 13 bp, Homo sapiens
ctatgtatcaatg

SEQ ID NO: 1477481 - DNA, 13 bp, Homo sapiens
ctatgtatttgca

SEQ ID NO: 1477482 - DNA, 19 bp, Homo sapiens
ctatgtcaatttgtatatc

SEQ ID NO: 1477483 - DNA, 17 bp, Homo sapiens
ctatgtcatttttaatg

SEQ ID NO: 1477484 - DNA, 20 bp, Homo sapiens
ctatgtcatttttaatgtat

SEQ ID NO: 1477485 - DNA, 20 bp, Homo sapiens
ctatgtccaacagagtggac

SEQ ID NO: 1477486 - DNA, 13 bp, Homo sapiens
ctatgtcccttgc

SEQ ID NO: 1477487 - DNA, 16 bp, Homo sapiens
ctatgtcccttgctgt

SEQ ID NO: 1477488 - DNA, 21 bp, Homo sapiens
ctatgtcctaaggacacacta

SEQ ID NO: 1477489 - DNA, 23 bp, Homo sapiens
ctatgtcctaaggacacactaat

SEQ ID NO: 1477490 - DNA, 15 bp, Homo sapiens
ctatgtctgaacata

SEQ ID NO: 1477491 - DNA, 13 bp, Homo sapiens
ctatgtcttgttt

SEQ ID NO: 1477492 - DNA, 13 bp, Homo sapiens
ctatgtggcagct

SEQ ID NO: 1477493 - DNA, 16 bp, Homo sapiens
ctatgtggcagctggg

SEQ ID NO: 1477494 - DNA, 21 bp, Homo sapiens
ctatgtggctgaaaatgcaaa

SEQ ID NO: 1477495 - DNA, 17 bp, Homo sapiens
ctatgtggctgtatctt

SEQ ID NO: 1477496 - DNA, 14 bp, Homo sapiens
ctatgttccccagg

SEQ ID NO: 1477497 - DNA, 19 bp, Homo sapiens
ctatgttctgtcttcccaa

SEQ ID NO: 1477498 - DNA, 14 bp, Homo sapiens
ctatgtttgcactt

SEQ ID NO: 1477499 - DNA, 17 bp, Homo sapiens
ctatgtttgtgtgattt

SEQ ID NO: 1477500 - DNA, 21 bp, Homo sapiens
ctatgtttgtgtgatttccta

SEQ ID NO: 1477501 - DNA, 22 bp, Homo sapiens
ctattaaaattctgatgtttct

SEQ ID NO: 1477502 - DNA, 21 bp, Homo sapiens
ctattaaagtgctaaggttct

SEQ ID NO: 1477503 - DNA, 22 bp, Homo sapiens
ctattaaagtgctaaggttcta

SEQ ID NO: 1477504 - DNA, 23 bp, Homo sapiens
ctattaagaggcagaaaattgca

SEQ ID NO: 1477505 - DNA, 15 bp, Homo sapiens
ctattaatatatgta

SEQ ID NO: 1477506 - DNA, 20 bp, Homo sapiens
ctattaatatcaactctgaa

SEQ ID NO: 1477507 - DNA, 13 bp, Homo sapiens
ctattaatcaaga

SEQ ID NO: 1477508 - DNA, 14 bp, Homo sapiens
ctattaatcaagag

SEQ ID NO: 1477509 - DNA, 18 bp, Homo sapiens
ctattaatcaagagaaac

SEQ ID NO: 1477510 - DNA, 19 bp, Homo sapiens
ctattaattcttaatatta

SEQ ID NO: 1477511 - DNA, 18 bp, Homo sapiens
ctattagactttagaaat

SEQ ID NO: 1477512 - DNA, 19 bp, Homo sapiens
ctattagagtatttccctt

SEQ ID NO: 1477513 - DNA, 19 bp, Homo sapiens
ctattatctgtcagctgca

SEQ ID NO: 1477514 - DNA, 22 bp, Homo sapiens
ctattatttggagcctgccaag

SEQ ID NO: 1477515 - DNA, 16 bp, Homo sapiens
ctattatttttataat

SEQ ID NO: 1477516 - DNA, 18 bp, Homo sapiens
ctattatttttataattg

SEQ ID NO: 1477517 - DNA, 19 bp, Homo sapiens
ctattcacgccgtaattct

SEQ ID NO: 1477518 - DNA, 20 bp, Homo sapiens
ctattcacgccgtaattctt

SEQ ID NO: 1477519 - DNA, 13 bp, Homo sapiens
ctattcagacaag

SEQ ID NO: 1477520 - DNA, 17 bp, Homo sapiens
ctattcagacaagcaac

SEQ ID NO: 1477521 - DNA, 18 bp, Homo sapiens
ctattcctgtaaataaga

SEQ ID NO: 1477522 - DNA, 15 bp, Homo sapiens
ctattctagcctgca

SEQ ID NO: 1477523 - DNA, 17 bp, Homo sapiens
ctattctagcctgcatt

SEQ ID NO: 1477524 - DNA, 21 bp, Homo sapiens
ctattctatccatctcctggt

SEQ ID NO: 1477525 - DNA, 14 bp, Homo sapiens
ctattctattgcag

SEQ ID NO: 1477526 - DNA, 18 bp, Homo sapiens
ctattctctaaactggca

SEQ ID NO: 1477527 - DNA, 22 bp, Homo sapiens
ctattctctgcaatttgtttaa

SEQ ID NO: 1477528 - DNA, 15 bp, Homo sapiens
ctattctgagaaaac

SEQ ID NO: 1477529 - DNA, 14 bp, Homo sapiens
ctattctgagcctt

SEQ ID NO: 1477530 - DNA, 19 bp, Homo sapiens
ctattctgtagttgcagct

SEQ ID NO: 1477531 - DNA, 19 bp, Homo sapiens
ctattctgtcagtgttaaa

SEQ ID NO: 1477532 - DNA, 22 bp, Homo sapiens
ctattcttgatgtaaaatcttg

SEQ ID NO: 1477533 - DNA, 16 bp, Homo sapiens
ctattgaaaacagtgt

SEQ ID NO: 1477534 - DNA, 17 bp, Homo sapiens
ctattgaagatgctgcc

SEQ ID NO: 1477535 - DNA, 18 bp, Homo sapiens
ctattgaagatgctgcct

SEQ ID NO: 1477536 - DNA, 17 bp, Homo sapiens
ctattgatgtacagtct

SEQ ID NO: 1477537 - DNA, 19 bp, Homo sapiens
ctattgatgtacagtctgt

SEQ ID NO: 1477538 - DNA, 18 bp, Homo sapiens
ctattgatttttacttca

SEQ ID NO: 1477539 - DNA, 17 bp, Homo sapiens
ctattgcactccagtct

SEQ ID NO: 1477540 - DNA, 18 bp, Homo sapiens
ctattgcagttatagaaa

SEQ ID NO: 1477541 - DNA, 18 bp, Homo sapiens
ctattgctgctgcccctt

SEQ ID NO: 1477542 - DNA, 21 bp, Homo sapiens
ctattgcttcaccatggcctt

SEQ ID NO: 1477543 - DNA, 21 bp, Homo sapiens
ctattggaggatcagtttttt

SEQ ID NO: 1477544 - DNA, 14 bp, Homo sapiens
ctattgggagaggt

SEQ ID NO: 1477545 - DNA, 15 bp, Homo sapiens
ctattgtaatcattt

SEQ ID NO: 1477546 - DNA, 19 bp, Homo sapiens
ctattgtaatcgtgtgcca

SEQ ID NO: 1477547 - DNA, 21 bp, Homo sapiens
ctattgtaatcgtgtgccatg

SEQ ID NO: 1477548 - DNA, 16 bp, Homo sapiens
ctattgtgccaactgc

SEQ ID NO: 1477549 - DNA, 21 bp, Homo sapiens
ctattgtttctttaagaaagt

SEQ ID NO: 1477550 - DNA, 15 bp, Homo sapiens
ctatttaactgacta

SEQ ID NO: 1477551 - DNA, 10 bp, Homo sapiens
ctatttaaga

SEQ ID NO: 1477552 - DNA, 21 bp, Homo sapiens
ctatttaagttatcaacttta

SEQ ID NO: 1477553 - DNA, 20 bp, Homo sapiens
ctatttaatatctggcactg

SEQ ID NO: 1477554 - DNA, 20 bp, Homo sapiens
ctatttagtttttgtaattt

SEQ ID NO: 1477555 - DNA, 17 bp, Homo sapiens
ctatttataagtgactt

SEQ ID NO: 1477556 - DNA, 19 bp, Homo sapiens
ctatttatctgtgtttttg

SEQ ID NO: 1477557 - DNA, 13 bp, Homo sapiens
ctatttattaata

SEQ ID NO: 1477558 - DNA, 14 bp, Homo sapiens
ctatttattaatat

SEQ ID NO: 1477559 - DNA, 17 bp, Homo sapiens
ctatttattaatattta

SEQ ID NO: 1477560 - DNA, 17 bp, Homo sapiens
ctatttattgactttga

SEQ ID NO: 1477561 - DNA, 22 bp, Homo sapiens
ctatttattgactttgacaatt

SEQ ID NO: 1477562 - DNA, 13 bp, Homo sapiens
ctatttattttcc

SEQ ID NO: 1477563 - DNA, 17 bp, Homo sapiens
ctatttattttcctaaa

SEQ ID NO: 1477564 - DNA, 18 bp, Homo sapiens
ctatttattttcctaaag

SEQ ID NO: 1477565 - DNA, 19 bp, Homo sapiens
ctatttccaaaagcacatg

SEQ ID NO: 1477566 - DNA, 22 bp, Homo sapiens
ctatttccccaggggaaaatga

SEQ ID NO: 1477567 - DNA, 19 bp, Homo sapiens
ctatttcctgaacctggaa

SEQ ID NO: 1477568 - DNA, 15 bp, Homo sapiens
ctatttctatctgca

SEQ ID NO: 1477569 - DNA, 15 bp, Homo sapiens
ctatttctatgagaa

SEQ ID NO: 1477570 - DNA, 14 bp, Homo sapiens
ctatttctcttgct

SEQ ID NO: 1477571 - DNA, 22 bp, Homo sapiens
ctatttgaagcatgctctgtaa

SEQ ID NO: 1477572 - DNA, 20 bp, Homo sapiens
ctatttgagaagttctcaga

SEQ ID NO: 1477573 - DNA, 20 bp, Homo sapiens
ctatttgagagcagatgcca

SEQ ID NO: 1477574 - DNA, 18 bp, Homo sapiens
ctatttgtaaatctgcca

SEQ ID NO: 1477575 - DNA, 15 bp, Homo sapiens
ctatttgtacaaata

SEQ ID NO: 1477576 - DNA, 18 bp, Homo sapiens
ctatttgtacaaataaac

SEQ ID NO: 1477577 - DNA, 20 bp, Homo sapiens
ctatttgtacaaataaacct

SEQ ID NO: 1477578 - DNA, 16 bp, Homo sapiens
ctatttgtgtgtatgc

SEQ ID NO: 1477579 - DNA, 23 bp, Homo sapiens
ctatttgttttcttctgtatgtt

SEQ ID NO: 1477580 - DNA, 13 bp, Homo sapiens
ctattttaaaata

SEQ ID NO: 1477581 - DNA, 22 bp, Homo sapiens
ctattttaaaataaattagttg

SEQ ID NO: 1477582 - DNA, 23 bp, Homo sapiens
ctattttaagactgattttaata

SEQ ID NO: 1477583 - DNA, 17 bp, Homo sapiens
ctcactgttgcagtggc

SEQ ID NO: 1477584 - DNA, 19 bp, Homo sapiens
ctcactgttgcagtggcct

SEQ ID NO: 1477585 - DNA, 23 bp, Homo sapiens
ctcactgttgcagtggcctggcc

SEQ ID NO: 1477586 - DNA, 21 bp, Homo sapiens
ctcacttatcccaagagaatg

SEQ ID NO: 1477587 - DNA, 24 bp, Homo sapiens
ctcacttctagatctcagccattc

SEQ ID NO: 1477588 - DNA, 20 bp, Homo sapiens
ctcacttctgggcttcatct

SEQ ID NO: 1477589 - DNA, 21 bp, Homo sapiens
ctcacttctgtctcctgtctt

SEQ ID NO: 1477590 - DNA, 19 bp, Homo sapiens
ctcacttgatgtttcctgg

SEQ ID NO: 1477591 - DNA, 21 bp, Homo sapiens
ctcacttgatgtttcctggaa

SEQ ID NO: 1477592 - DNA, 19 bp, Homo sapiens
ctcacttggctgtctgacc

SEQ ID NO: 1477593 - DNA, 21 bp, Homo sapiens
ctcacttttcatccttcccca

SEQ ID NO: 1477594 - DNA, 16 bp, Homo sapiens
ctcagaaagtgcctga

SEQ ID NO: 1477595 - DNA, 18 bp, Homo sapiens
ctcagaaagtgcctgaca

SEQ ID NO: 1477596 - DNA, 22 bp, Homo sapiens
ctcagaaagtgcctgacacact

SEQ ID NO: 1477597 - DNA, 20 bp, Homo sapiens
ctcagaacaccccgctctgg

SEQ ID NO: 1477598 - DNA, 21 bp, Homo sapiens
ctcagaacaccccgctctggc

SEQ ID NO: 1477599 - DNA, 17 bp, Homo sapiens
ctcagaacatactgatt

SEQ ID NO: 1477600 - DNA, 15 bp, Homo sapiens
ctcagaactgttggc

SEQ ID NO: 1477601 - DNA, 20 bp, Homo sapiens
ctcagaactgttggctgctc

SEQ ID NO: 1477602 - DNA, 17 bp, Homo sapiens
ctcagaacttgctgctg

SEQ ID NO: 1477603 - DNA, 20 bp, Homo sapiens
ctcagaacttgctgctgtct

SEQ ID NO: 1477604 - DNA, 23 bp, Homo sapiens
ctcagaacttgctgctgtcttgt

SEQ ID NO: 1477605 - DNA, 17 bp, Homo sapiens
ctcagaaggaatggtgc

SEQ ID NO: 1477606 - DNA, 12 bp, Homo sapiens
ctcagaaggctt

SEQ ID NO: 1477607 - DNA, 13 bp, Homo sapiens
ctcagaaggtatt

SEQ ID NO: 1477608 - DNA, 21 bp, Homo sapiens
ctcagaataactacctcctca

SEQ ID NO: 1477609 - DNA, 14 bp, Homo sapiens
ctcagaatccaaag

SEQ ID NO: 1477610 - DNA, 20 bp, Homo sapiens
ctcagacatgttttccgtga

SEQ ID NO: 1477611 - DNA, 14 bp, Homo sapiens
ctcagacccaacag

SEQ ID NO: 1477612 - DNA, 12 bp, Homo sapiens
ctcagacctcca

SEQ ID NO: 1477613 - DNA, 22 bp, Homo sapiens
ctcagacggcggccaggcacag

SEQ ID NO: 1477614 - DNA, 16 bp, Homo sapiens
ctcagacgtgtgacct

SEQ ID NO: 1477615 - DNA, 23 bp, Homo sapiens
ctcagacgtgtgacctccatact

SEQ ID NO: 1477616 - DNA, 14 bp, Homo sapiens
ctcagactccattt

SEQ ID NO: 1477617 - DNA, 14 bp, Homo sapiens
ctcagactccgccc

SEQ ID NO: 1477618 - DNA, 20 bp, Homo sapiens
ctcagagaaaaatgctcccc

SEQ ID NO: 1477619 - DNA, 17 bp, Homo sapiens
ctcagagaaggaaaaga

SEQ ID NO: 1477620 - DNA, 23 bp, Homo sapiens
ctcagagaatttctaccatttca

SEQ ID NO: 1477621 - DNA, 20 bp, Homo sapiens
ctcagagacaccaaactgcc

SEQ ID NO: 1477622 - DNA, 16 bp, Homo sapiens
ctcagagacaggtggc

SEQ ID NO: 1477623 - DNA, 13 bp, Homo sapiens
ctcagagaccagc

SEQ ID NO: 1477624 - DNA, 15 bp, Homo sapiens
ctcagagaccagcac

SEQ ID NO: 1477625 - DNA, 19 bp, Homo sapiens
ctcagagaccagcactcag

SEQ ID NO: 1477626 - DNA, 21 bp, Homo sapiens
ctcagagaccagggctccagc

SEQ ID NO: 1477627 - DNA, 22 bp, Homo sapiens
ctcagagaccagggctccagcc

SEQ ID NO: 1477628 - DNA, 15 bp, Homo sapiens
ctcagagagcaccat

SEQ ID NO: 1477629 - DNA, 15 bp, Homo sapiens
ctcagagcacagagg

SEQ ID NO: 1477630 - DNA, 20 bp, Homo sapiens
ctcagaggaaaaatgggagc

SEQ ID NO: 1477631 - DNA, 23 bp, Homo sapiens
ctcagaggaaaaatgggagccag

SEQ ID NO: 1477632 - DNA, 18 bp, Homo sapiens
ctcagaggaccctttcca

SEQ ID NO: 1477633 - DNA, 13 bp, Homo sapiens
ctcagaggcccag

SEQ ID NO: 1477634 - DNA, 14 bp, Homo sapiens
ctcagaggcccagg

SEQ ID NO: 1477635 - DNA, 15 bp, Homo sapiens
ctcagaggcccagga

SEQ ID NO: 1477636 - DNA, 18 bp, Homo sapiens
ctcagaggcccaggaatc

SEQ ID NO: 1477637 - DNA, 13 bp, Homo sapiens
ctcagaggcctgc

SEQ ID NO: 1477638 - DNA, 15 bp, Homo sapiens
ctcagaggcctgctg

SEQ ID NO: 1477639 - DNA, 22 bp, Homo sapiens
ctcagaggcctgctgccagtgc

SEQ ID NO: 1477640 - DNA, 12 bp, Homo sapiens
ctcagagtggag

SEQ ID NO: 1477641 - DNA, 15 bp, Homo sapiens
ctcagagtgtttaat

SEQ ID NO: 1477642 - DNA, 12 bp, Homo sapiens
ctcagatataag

SEQ ID NO: 1477643 - DNA, 10 bp, Homo sapiens
ctcagatcca

SEQ ID NO: 1477644 - DNA, 13 bp, Homo sapiens
ctcagatccaggg

SEQ ID NO: 1477645 - DNA, 14 bp, Homo sapiens
ctcagatccaggga

SEQ ID NO: 1477646 - DNA, 20 bp, Homo sapiens
ctcagatccagggacagagg

SEQ ID NO: 1477647 - DNA, 22 bp, Homo sapiens
ctcagatccagggacagaggcc

SEQ ID NO: 1477648 - DNA, 17 bp, Homo sapiens
ctcagatccttgtttca

SEQ ID NO: 1477649 - DNA, 14 bp, Homo sapiens
ctcagatctgatca

SEQ ID NO: 1477650 - DNA, 17 bp, Homo sapiens
ctcagatctgatcaaga

SEQ ID NO: 1477651 - DNA, 16 bp, Homo sapiens
ctcagatcttgacagt

SEQ ID NO: 1477652 - DNA, 16 bp, Homo sapiens
ctcagatggggcacca

SEQ ID NO: 1477653 - DNA, 15 bp, Homo sapiens
ctcagattcctttgt

SEQ ID NO: 1477654 - DNA, 17 bp, Homo sapiens
ctcagatttaagcctta

SEQ ID NO: 1477655 - DNA, 18 bp, Homo sapiens
ctcagcaaggggctctgc

SEQ ID NO: 1477656 - DNA, 20 bp, Homo sapiens
ctcagcaaggggctctgccc

SEQ ID NO: 1477657 - DNA, 15 bp, Homo sapiens
ctcagcaagtgccca

SEQ ID NO: 1477658 - DNA, 18 bp, Homo sapiens
ctcagcaagtgcccagtg

SEQ ID NO: 1477659 - DNA, 12 bp, Homo sapiens
ctcagcacccct

SEQ ID NO: 1477660 - DNA, 13 bp, Homo sapiens
ctcagcacccctt

SEQ ID NO: 1477661 - DNA, 11 bp, Homo sapiens
ctcagcactgt

SEQ ID NO: 1477662 - DNA, 14 bp, Homo sapiens
ctcagcagccagtc

SEQ ID NO: 1477663 - DNA, 15 bp, Homo sapiens
ctcagcagccagtct

SEQ ID NO: 1477664 - DNA, 13 bp, Homo sapiens
ctcagcagccctc

SEQ ID NO: 1477665 - DNA, 17 bp, Homo sapiens
ctcagcagccctcctca

SEQ ID NO: 1477666 - DNA, 14 bp, Homo sapiens
ctcagcagtccaca

SEQ ID NO: 1477667 - DNA, 19 bp, Homo sapiens
ctcagcatagcctgcctga

SEQ ID NO: 1477668 - DNA, 20 bp, Homo sapiens
ctcagcatagggtcactttg

SEQ ID NO: 1477669 - DNA, 14 bp, Homo sapiens
ctcagcatatttgt

SEQ ID NO: 1477670 - DNA, 19 bp, Homo sapiens
ctcagcatatttgtatagt

SEQ ID NO: 1477671 - DNA, 22 bp, Homo sapiens
ctcagcatttgattaacatttg

SEQ ID NO: 1477672 - DNA, 23 bp, Homo sapiens
ctcagccagcccgtgtgtataat

SEQ ID NO: 1477673 - DNA, 11 bp, Homo sapiens
ctcagcccagc

SEQ ID NO: 1477674 - DNA, 13 bp, Homo sapiens
ctcagcccagctg

SEQ ID NO: 1477675 - DNA, 14 bp, Homo sapiens
ctcagcccagctgg

SEQ ID NO: 1477676 - DNA, 14 bp, Homo sapiens
ctcagccccaaaca

SEQ ID NO: 1477677 - DNA, 17 bp, Homo sapiens
ctcagccccaactcttt

SEQ ID NO: 1477678 - DNA, 14 bp, Homo sapiens
ctcagccccactga

SEQ ID NO: 1477679 - DNA, 16 bp, Homo sapiens
ctcagccccactgaca

SEQ ID NO: 1477680 - DNA, 17 bp, Homo sapiens
ctcagcccgcttggcca

SEQ ID NO: 1477681 - DNA, 21 bp, Homo sapiens
ctcagccctagaggcgagcca

SEQ ID NO: 1477682 - DNA, 23 bp, Homo sapiens
ctcagccctagaggcgagccagg

SEQ ID NO: 1477683 - DNA, 14 bp, Homo sapiens
ctcagccctgaggt

SEQ ID NO: 1477684 - DNA, 16 bp, Homo sapiens
ctcagccctgcaccat

SEQ ID NO: 1477685 - DNA, 17 bp, Homo sapiens
ctcagccctggccctgc

SEQ ID NO: 1477686 - DNA, 20 bp, Homo sapiens
ctcagccctggccctgccca

SEQ ID NO: 1477687 - DNA, 21 bp, Homo sapiens
ctcagccctgggccccaccac

SEQ ID NO: 1477688 - DNA, 14 bp, Homo sapiens
ctcagcccttgccc

SEQ ID NO: 1477689 - DNA, 19 bp, Homo sapiens
ctcagccgtagggtggcac

SEQ ID NO: 1477690 - DNA, 21 bp, Homo sapiens
ctcagccgtagggtggcactg

SEQ ID NO: 1477691 - DNA, 22 bp, Homo sapiens
ctcagcctaccgctggccctgc

SEQ ID NO: 1477692 - DNA, 18 bp, Homo sapiens
ctcagcctccagagtagc

SEQ ID NO: 1477693 - DNA, 22 bp, Homo sapiens
ctcagcctcccaaagtgctggg

SEQ ID NO: 1477694 - DNA, 13 bp, Homo sapiens
ctcagcctcccag

SEQ ID NO: 1477695 - DNA, 14 bp, Homo sapiens
ctcagcctcctgag

SEQ ID NO: 1477696 - DNA, 15 bp, Homo sapiens
ctcagcctcctgagt

SEQ ID NO: 1477697 - DNA, 22 bp, Homo sapiens
ctcagcctctcaagtagctggg

SEQ ID NO: 1477698 - DNA, 21 bp, Homo sapiens
ctcattacagttctttcctct

SEQ ID NO: 1477699 - DNA, 22 bp, Homo sapiens
ctcattacagttctttcctctt

SEQ ID NO: 1477700 - DNA, 14 bp, Homo sapiens
ctcattcagcatgg

SEQ ID NO: 1477701 - DNA, 17 bp, Homo sapiens
ctcattccagaggaagg

SEQ ID NO: 1477702 - DNA, 13 bp, Homo sapiens
ctcattcctgcct

SEQ ID NO: 1477703 - DNA, 20 bp, Homo sapiens
ctcattcctgcctgtctcct

SEQ ID NO: 1477704 - DNA, 13 bp, Homo sapiens
ctcattgaatcct

SEQ ID NO: 1477705 - DNA, 15 bp, Homo sapiens
ctcattgaatcctca

SEQ ID NO: 1477706 - DNA, 18 bp, Homo sapiens
ctcattgaccgtgctggc

SEQ ID NO: 1477707 - DNA, 14 bp, Homo sapiens
ctcattgactttta

SEQ ID NO: 1477708 - DNA, 21 bp, Homo sapiens
ctcattgacttttataaagca

SEQ ID NO: 1477709 - DNA, 22 bp, Homo sapiens
ctcattgacttttataaagcat

SEQ ID NO: 1477710 - DNA, 18 bp, Homo sapiens
ctcattgcctcctgttct

SEQ ID NO: 1477711 - DNA, 15 bp, Homo sapiens
ctcattgctgagcct

SEQ ID NO: 1477712 - DNA, 16 bp, Homo sapiens
ctcattgctgagcctc

SEQ ID NO: 1477713 - DNA, 13 bp, Homo sapiens
ctcatttaaaaca

SEQ ID NO: 1477714 - DNA, 17 bp, Homo sapiens
ctcatttcacagccttt

SEQ ID NO: 1477715 - DNA, 19 bp, Homo sapiens
ctcatttcacccctccctt

SEQ ID NO: 1477716 - DNA, 19 bp, Homo sapiens
ctcatttggtctgccagaa

SEQ ID NO: 1477717 - DNA, 21 bp, Homo sapiens
ctcatttgtattccattgatt

SEQ ID NO: 1477718 - DNA, 22 bp, Homo sapiens
ctcattttgtccatgtcccccg

SEQ ID NO: 1477719 - DNA, 22 bp, Homo sapiens
ctcatttttataacctggcaaa

SEQ ID NO: 1477720 - DNA, 18 bp, Homo sapiens
ctcatttttcattagata

SEQ ID NO: 1477721 - DNA, 19 bp, Homo sapiens
ctccaaaatattaacattc

SEQ ID NO: 1477722 - DNA, 21 bp, Homo sapiens
ctccaaaatattaacattctt

SEQ ID NO: 1477723 - DNA, 16 bp, Homo sapiens
ctccaaacctccagcc

SEQ ID NO: 1477724 - DNA, 12 bp, Homo sapiens
ctccaaagaaat

SEQ ID NO: 1477725 - DNA, 22 bp, Homo sapiens
ctccaaaggaagtctaggagct

SEQ ID NO: 1477726 - DNA, 18 bp, Homo sapiens
ctccaaaggcggggtggc

SEQ ID NO: 1477727 - DNA, 18 bp, Homo sapiens
ctccaaaggggctgctgg

SEQ ID NO: 1477728 - DNA, 17 bp, Homo sapiens
ctccaaagtggagctgg

SEQ ID NO: 1477729 - DNA, 18 bp, Homo sapiens
ctccaaagtggagctggg

SEQ ID NO: 1477730 - DNA, 19 bp, Homo sapiens
ctccaaagtggagctggga

SEQ ID NO: 1477731 - DNA, 23 bp, Homo sapiens
ctccaaatctcaatgaagccagc

SEQ ID NO: 1477732 - DNA, 14 bp, Homo sapiens
ctccaaatttttct

SEQ ID NO: 1477733 - DNA, 12 bp, Homo sapiens
ctccaaccactg

SEQ ID NO: 1477734 - DNA, 17 bp, Homo sapiens
ctccaaccactgtgcca

SEQ ID NO: 1477735 - DNA, 18 bp, Homo sapiens
ctccaaccactgtgccac

SEQ ID NO: 1477736 - DNA, 14 bp, Homo sapiens
ctccaaccccccag

SEQ ID NO: 1477737 - DNA, 19 bp, Homo sapiens
ctccaaccccccagcactg

SEQ ID NO: 1477738 - DNA, 21 bp, Homo sapiens
ctccaaccccccagcactgag

SEQ ID NO: 1477739 - DNA, 22 bp, Homo sapiens
ctccaaccccccagcactgagg

SEQ ID NO: 1477740 - DNA, 21 bp, Homo sapiens
ctccaacctgcaaagatctgt

SEQ ID NO: 1477741 - DNA, 18 bp, Homo sapiens
ctccaacctggggggcag

SEQ ID NO: 1477742 - DNA, 16 bp, Homo sapiens
ctccaacgcccctgtg

SEQ ID NO: 1477743 - DNA, 18 bp, Homo sapiens
ctccaacgcccctgtggc

SEQ ID NO: 1477744 - DNA, 22 bp, Homo sapiens
ctccaacgcccctgtggccaac

SEQ ID NO: 1477745 - DNA, 13 bp, Homo sapiens
ctccaagaaactg

SEQ ID NO: 1477746 - DNA, 21 bp, Homo sapiens
ctccaagaatggaagcctgaa

SEQ ID NO: 1477747 - DNA, 22 bp, Homo sapiens
ctccaagaatggaagcctgaac

SEQ ID NO: 1477748 - DNA, 20 bp, Homo sapiens
ctccaagccattcacttccc

SEQ ID NO: 1477749 - DNA, 14 bp, Homo sapiens
ctccaagcctgcct

SEQ ID NO: 1477750 - DNA, 15 bp, Homo sapiens
ctccaagcctgcctc

SEQ ID NO: 1477751 - DNA, 20 bp, Homo sapiens
ctccaaggaggggctgtaaa

SEQ ID NO: 1477752 - DNA, 16 bp, Homo sapiens
ctccaaggcagggacc

SEQ ID NO: 1477753 - DNA, 22 bp, Homo sapiens
ctccaagggagggtgcagccct

SEQ ID NO: 1477754 - DNA, 23 bp, Homo sapiens
ctccaagggagggtgcagccctc

SEQ ID NO: 1477755 - DNA, 18 bp, Homo sapiens
ctccaagggcttctgcac

SEQ ID NO: 1477756 - DNA, 22 bp, Homo sapiens
ctccaagggcttctgcaccctc

SEQ ID NO: 1477757 - DNA, 15 bp, Homo sapiens
ctccaaggtggggtc

SEQ ID NO: 1477758 - DNA, 19 bp, Homo sapiens
ctccaagtgccagaggtgg

SEQ ID NO: 1477759 - DNA, 17 bp, Homo sapiens
ctccaatatcagtgctc

SEQ ID NO: 1477760 - DNA, 19 bp, Homo sapiens
ctccaatatcagtgctcga

SEQ ID NO: 1477761 - DNA, 21 bp, Homo sapiens
ctccaatgcattggcctctgt

SEQ ID NO: 1477762 - DNA, 20 bp, Homo sapiens
ctccaatggggccagcactg

SEQ ID NO: 1477763 - DNA, 17 bp, Homo sapiens
ctccacaccagctgctg

SEQ ID NO: 1477764 - DNA, 13 bp, Homo sapiens
ctccacactccac

SEQ ID NO: 1477765 - DNA, 20 bp, Homo sapiens
ctccacactgaccaagtgct

SEQ ID NO: 1477766 - DNA, 22 bp, Homo sapiens
ctccacactgaccaagtgctgg

SEQ ID NO: 1477767 - DNA, 13 bp, Homo sapiens
ctccacagagagg

SEQ ID NO: 1477768 - DNA, 20 bp, Homo sapiens
ctccacagagaggaggggac

SEQ ID NO: 1477769 - DNA, 14 bp, Homo sapiens
ctccacagcgaggg

SEQ ID NO: 1477770 - DNA, 21 bp, Homo sapiens
ctccacagcgagggcagctgc

SEQ ID NO: 1477771 - DNA, 13 bp, Homo sapiens
ctccacagctgca

SEQ ID NO: 1477772 - DNA, 12 bp, Homo sapiens
ctccacagggcc

SEQ ID NO: 1477773 - DNA, 15 bp, Homo sapiens
ctccacagtgctgct

SEQ ID NO: 1477774 - DNA, 14 bp, Homo sapiens
ctccacagtgttgt

SEQ ID NO: 1477775 - DNA, 18 bp, Homo sapiens
ctccacagtgttgtgccc

SEQ ID NO: 1477776 - DNA, 20 bp, Homo sapiens
ctccacatctgcatcactca

SEQ ID NO: 1477777 - DNA, 13 bp, Homo sapiens
ctccacatctgcc

SEQ ID NO: 1477778 - DNA, 14 bp, Homo sapiens
ctccacatctgcct

SEQ ID NO: 1477779 - DNA, 17 bp, Homo sapiens
ctccacatctgccttaa

SEQ ID NO: 1477780 - DNA, 12 bp, Homo sapiens
ctccaccaccca

SEQ ID NO: 1477781 - DNA, 13 bp, Homo sapiens
ctccaccacccaa

SEQ ID NO: 1477782 - DNA, 14 bp, Homo sapiens
ctccaccacccaaa

SEQ ID NO: 1477783 - DNA, 16 bp, Homo sapiens
ctccaccacccaaaag

SEQ ID NO: 1477784 - DNA, 14 bp, Homo sapiens
ctccaccagcaagg

SEQ ID NO: 1477785 - DNA, 14 bp, Homo sapiens
ctccaccagcctgc

SEQ ID NO: 1477786 - DNA, 17 bp, Homo sapiens
ctccaccccacagaacc

SEQ ID NO: 1477787 - DNA, 19 bp, Homo sapiens
ctccacccccgccacggcc

SEQ ID NO: 1477788 - DNA, 14 bp, Homo sapiens
ctccaccctccacc

SEQ ID NO: 1477789 - DNA, 15 bp, Homo sapiens
ctccaccctccacct

SEQ ID NO: 1477790 - DNA, 22 bp, Homo sapiens
ctccaccctccggccagcgagt

SEQ ID NO: 1477791 - DNA, 19 bp, Homo sapiens
ctccaccctgcattttcct

SEQ ID NO: 1477792 - DNA, 22 bp, Homo sapiens
ctccaccctgcattttcctctt

SEQ ID NO: 1477793 - DNA, 13 bp, Homo sapiens
ctccaccctgtcc

SEQ ID NO: 1477794 - DNA, 18 bp, Homo sapiens
ctccaccctgtcccccag

SEQ ID NO: 1477795 - DNA, 20 bp, Homo sapiens
ctccaccctgtcccccagct

SEQ ID NO: 1477796 - DNA, 16 bp, Homo sapiens
ctccaccgaccaactg

SEQ ID NO: 1477797 - DNA, 14 bp, Homo sapiens
ctccacctcagcct

SEQ ID NO: 1477798 - DNA, 21 bp, Homo sapiens
ctccacctcccccaaaccctg

SEQ ID NO: 1477799 - DNA, 12 bp, Homo sapiens
ctccacctctgg

SEQ ID NO: 1477800 - DNA, 16 bp, Homo sapiens
ctccaccttgctcttc

SEQ ID NO: 1477801 - DNA, 20 bp, Homo sapiens
ctccacggtgcgtggctgtg

SEQ ID NO: 1477802 - DNA, 16 bp, Homo sapiens
ctccacgtgtccgtcc

SEQ ID NO: 1477803 - DNA, 17 bp, Homo sapiens
ctccactaaatgagctc

SEQ ID NO: 1477804 - DNA, 22 bp, Homo sapiens
ctccactaaatgagctcctgcg

SEQ ID NO: 1477805 - DNA, 22 bp, Homo sapiens
ctccactattttattaaaaata

SEQ ID NO: 1477806 - DNA, 13 bp, Homo sapiens
ctccactcaatgt

SEQ ID NO: 1477807 - DNA, 15 bp, Homo sapiens
ctccactcagctgtc

SEQ ID NO: 1477808 - DNA, 16 bp, Homo sapiens
ctccactccactgcct

SEQ ID NO: 1477809 - DNA, 17 bp, Homo sapiens
ctccactcccagcagct

SEQ ID NO: 1477810 - DNA, 18 bp, Homo sapiens
ctccactcccccacctga

SEQ ID NO: 1477811 - DNA, 18 bp, Homo sapiens
ctccactcctcatcccca

SEQ ID NO: 1477812 - DNA, 12 bp, Homo sapiens
ctccagggtgct

SEQ ID NO: 1477813 - DNA, 14 bp, Homo sapiens
ctccaggtcagcct

SEQ ID NO: 1477814 - DNA, 20 bp, Homo sapiens
ctccaggtcggagtgcctgg

SEQ ID NO: 1477815 - DNA, 22 bp, Homo sapiens
ctccaggtcggagtgcctggag

SEQ ID NO: 1477816 - DNA, 15 bp, Homo sapiens
ctccaggtgcagagg

SEQ ID NO: 1477817 - DNA, 18 bp, Homo sapiens
ctccaggtgcagaggtac

SEQ ID NO: 1477818 - DNA, 16 bp, Homo sapiens
ctccagtagtggacaa

SEQ ID NO: 1477819 - DNA, 23 bp, Homo sapiens
ctccagtagtggacaacaggttt

SEQ ID NO: 1477820 - DNA, 16 bp, Homo sapiens
ctccagtcaacagatt

SEQ ID NO: 1477821 - DNA, 19 bp, Homo sapiens
ctccagtctgatctgtgaa

SEQ ID NO: 1477822 - DNA, 20 bp, Homo sapiens
ctccagtgagtacctgcaaa

SEQ ID NO: 1477823 - DNA, 16 bp, Homo sapiens
ctccagtgctcagctg

SEQ ID NO: 1477824 - DNA, 16 bp, Homo sapiens
ctccagtgctggattt

SEQ ID NO: 1477825 - DNA, 17 bp, Homo sapiens
ctccagtgctggatttg

SEQ ID NO: 1477826 - DNA, 21 bp, Homo sapiens
ctccagttagaatgcaccatg

SEQ ID NO: 1477827 - DNA, 18 bp, Homo sapiens
ctccagttgggactcagg

SEQ ID NO: 1477828 - DNA, 15 bp, Homo sapiens
ctccagtttccccat

SEQ ID NO: 1477829 - DNA, 16 bp, Homo sapiens
ctccagtttgcacctg

SEQ ID NO: 1477830 - DNA, 20 bp, Homo sapiens
ctccagtttgcacctgtccc

SEQ ID NO: 1477831 - DNA, 17 bp, Homo sapiens
ctccagttttcagttga

SEQ ID NO: 1477832 - DNA, 14 bp, Homo sapiens
ctccagtttttgtt

SEQ ID NO: 1477833 - DNA, 14 bp, Homo sapiens
ctccataccttttc

SEQ ID NO: 1477834 - DNA, 18 bp, Homo sapiens
ctccataccttttctctt

SEQ ID NO: 1477835 - DNA, 21 bp, Homo sapiens
ctccataccttttctcttttc

SEQ ID NO: 1477836 - DNA, 23 bp, Homo sapiens
ctccataccttttctcttttctt

SEQ ID NO: 1477837 - DNA, 19 bp, Homo sapiens
ctccatactgggctaagga

SEQ ID NO: 1477838 - DNA, 17 bp, Homo sapiens
ctccatatcagctctct

SEQ ID NO: 1477839 - DNA, 19 bp, Homo sapiens
ctccatatcagctctctgc

SEQ ID NO: 1477840 - DNA, 14 bp, Homo sapiens
ctccatatctcctt

SEQ ID NO: 1477841 - DNA, 23 bp, Homo sapiens
ctccatattaaaacatatgacca

SEQ ID NO: 1477842 - DNA, 20 bp, Homo sapiens
ctccatatttgatttctaat

SEQ ID NO: 1477843 - DNA, 15 bp, Homo sapiens
ctccatcaccctctt

SEQ ID NO: 1477844 - DNA, 12 bp, Homo sapiens
ctccatccaagg

SEQ ID NO: 1477845 - DNA, 16 bp, Homo sapiens
ctccatccatccttcc

SEQ ID NO: 1477846 - DNA, 20 bp, Homo sapiens
ctccatccctccctcccgtc

SEQ ID NO: 1477847 - DNA, 13 bp, Homo sapiens
ctccatccctcta

SEQ ID NO: 1477848 - DNA, 22 bp, Homo sapiens
ctccatccctctaatgagactg

SEQ ID NO: 1477849 - DNA, 17 bp, Homo sapiens
ctccatctccgcctcca

SEQ ID NO: 1477850 - DNA, 18 bp, Homo sapiens
ctccatctccgcctccac

SEQ ID NO: 1477851 - DNA, 12 bp, Homo sapiens
ctccatctcttc

SEQ ID NO: 1477852 - DNA, 23 bp, Homo sapiens
ctccatctcttctgcaagcctca

SEQ ID NO: 1477853 - DNA, 16 bp, Homo sapiens
ctccatctggcagggt

SEQ ID NO: 1477854 - DNA, 23 bp, Homo sapiens
ctccatcttggtagttctgtgcc

SEQ ID NO: 1477855 - DNA, 13 bp, Homo sapiens
ctccatctttata

SEQ ID NO: 1477856 - DNA, 21 bp, Homo sapiens
ctccatgactggctgtctgcc

SEQ ID NO: 1477857 - DNA, 21 bp, Homo sapiens
ctccatgaggtactggtccct

SEQ ID NO: 1477858 - DNA, 20 bp, Homo sapiens
ctccatgcacctcccttccc

SEQ ID NO: 1477859 - DNA, 18 bp, Homo sapiens
ctccatgccccagctctg

SEQ ID NO: 1477860 - DNA, 23 bp, Homo sapiens
ctccatgccccagctctggatga

SEQ ID NO: 1477861 - DNA, 17 bp, Homo sapiens
ctccatgctcctcacct

SEQ ID NO: 1477862 - DNA, 16 bp, Homo sapiens
ctccatgctccttgag

SEQ ID NO: 1477863 - DNA, 18 bp, Homo sapiens
ctccatgctgcaaaggag

SEQ ID NO: 1477864 - DNA, 20 bp, Homo sapiens
ctccatgcttagtcactgcc

SEQ ID NO: 1477865 - DNA, 17 bp, Homo sapiens
ctccatggcagcagcca

SEQ ID NO: 1477866 - DNA, 19 bp, Homo sapiens
ctccatggcagcagccagg

SEQ ID NO: 1477867 - DNA, 23 bp, Homo sapiens
ctccatggcagcagccagggacc

SEQ ID NO: 1477868 - DNA, 22 bp, Homo sapiens
ctccatggccaccccgtgccac

SEQ ID NO: 1477869 - DNA, 20 bp, Homo sapiens
ctccatggctaagaccacag

SEQ ID NO: 1477870 - DNA, 16 bp, Homo sapiens
ctccattagaaaattt

SEQ ID NO: 1477871 - DNA, 22 bp, Homo sapiens
ctccattagaaaattttgtaaa

SEQ ID NO: 1477872 - DNA, 22 bp, Homo sapiens
ctccattaggatttgccccttc

SEQ ID NO: 1477873 - DNA, 16 bp, Homo sapiens
ctccattcctggagcc

SEQ ID NO: 1477874 - DNA, 17 bp, Homo sapiens
ctccattcctggagccc

SEQ ID NO: 1477875 - DNA, 19 bp, Homo sapiens
ctccattcctggagcccga

SEQ ID NO: 1477876 - DNA, 20 bp, Homo sapiens
ctccattcctggagcccgag

SEQ ID NO: 1477877 - DNA, 15 bp, Homo sapiens
ctccatttagttctt

SEQ ID NO: 1477878 - DNA, 21 bp, Homo sapiens
ctccattttagcccagtgttt

SEQ ID NO: 1477879 - DNA, 17 bp, Homo sapiens
ctccatttttatttctt

SEQ ID NO: 1477880 - DNA, 16 bp, Homo sapiens
ctccatttttctccca

SEQ ID NO: 1477881 - DNA, 14 bp, Homo sapiens
ctcccaaaggaaag

SEQ ID NO: 1477882 - DNA, 20 bp, Homo sapiens
ctcccaaagtgctgagatta

SEQ ID NO: 1477883 - DNA, 20 bp, Homo sapiens
ctcccaaagtgctgggatga

SEQ ID NO: 1477884 - DNA, 21 bp, Homo sapiens
ctcccaaagtgctgggattaa

SEQ ID NO: 1477885 - DNA, 22 bp, Homo sapiens
ctcccaaagtgctgggattaca

SEQ ID NO: 1477886 - DNA, 14 bp, Homo sapiens
ctcccaacccccct

SEQ ID NO: 1477887 - DNA, 19 bp, Homo sapiens
ctcccaacccccctcctgc

SEQ ID NO: 1477888 - DNA, 12 bp, Homo sapiens
ctcccaaccctg

SEQ ID NO: 1477889 - DNA, 24 bp, Homo sapiens
ctcccaacctcaatgccctgccat

SEQ ID NO: 1477890 - DNA, 19 bp, Homo sapiens
ctcccaagcgttcctggcc

SEQ ID NO: 1477891 - DNA, 20 bp, Homo sapiens
ctcccaagcgttcctggcct

SEQ ID NO: 1477892 - DNA, 22 bp, Homo sapiens
ctcccaagcgttcctggccttc

SEQ ID NO: 1477893 - DNA, 14 bp, Homo sapiens
ctcccaaggagcca

SEQ ID NO: 1477894 - DNA, 18 bp, Homo sapiens
ctcccaaggttggagccc

SEQ ID NO: 1477895 - DNA, 21 bp, Homo sapiens
ctcccaaggttggagcccagg

SEQ ID NO: 1477896 - DNA, 16 bp, Homo sapiens
ctcccaagtagctggg

SEQ ID NO: 1477897 - DNA, 22 bp, Homo sapiens
ctcccaagtcccaccctcttcc

SEQ ID NO: 1477898 - DNA, 17 bp, Homo sapiens
ctcccaatcctctctcc

SEQ ID NO: 1477899 - DNA, 20 bp, Homo sapiens
ctcccaatcctctctcccct

SEQ ID NO: 1477900 - DNA, 20 bp, Homo sapiens
ctcccacagcctccttctgt

SEQ ID NO: 1477901 - DNA, 16 bp, Homo sapiens
ctcccacaggcccttc

SEQ ID NO: 1477902 - DNA, 14 bp, Homo sapiens
ctcccaccagagcc

SEQ ID NO: 1477903 - DNA, 15 bp, Homo sapiens
ctcccacccacagcc

SEQ ID NO: 1477904 - DNA, 17 bp, Homo sapiens
ctcccaccccactccag

SEQ ID NO: 1477905 - DNA, 20 bp, Homo sapiens
ctcccaccccactccagccc

SEQ ID NO: 1477906 - DNA, 23 bp, Homo sapiens
ctcccaccccactccagccctgt

SEQ ID NO: 1477907 - DNA, 20 bp, Homo sapiens
ctcccacccccatctctccc

SEQ ID NO: 1477908 - DNA, 23 bp, Homo sapiens
ctcccacccccttctctgctcca

SEQ ID NO: 1477909 - DNA, 20 bp, Homo sapiens
ctcccaccccggcctccact

SEQ ID NO: 1477910 - DNA, 13 bp, Homo sapiens
ctcccaccgcccc

SEQ ID NO: 1477911 - DNA, 16 bp, Homo sapiens
ctcccaccgcccccac

SEQ ID NO: 1477912 - DNA, 14 bp, Homo sapiens
ctcccacctagtgc

SEQ ID NO: 1477913 - DNA, 18 bp, Homo sapiens
ctcccacctcagcctcct

SEQ ID NO: 1477914 - DNA, 17 bp, Homo sapiens
ctcccacctcccttccc

SEQ ID NO: 1477915 - DNA, 15 bp, Homo sapiens
ctcccacctctcctt

SEQ ID NO: 1477916 - DNA, 23 bp, Homo sapiens
ctcccacctctccttttgaggct

SEQ ID NO: 1477917 - DNA, 21 bp, Homo sapiens
ctcccacctgacacaccaggc

SEQ ID NO: 1477918 - DNA, 16 bp, Homo sapiens
ctcccaccttggcctc

SEQ ID NO: 1477919 - DNA, 21 bp, Homo sapiens
ctcccacgcctcaccagcccc

SEQ ID NO: 1477920 - DNA, 13 bp, Homo sapiens
ctcccactcctgc

SEQ ID NO: 1477921 - DNA, 16 bp, Homo sapiens
ctcccactcctgctgc

SEQ ID NO: 1477922 - DNA, 14 bp, Homo sapiens
ctcccactctttga

SEQ ID NO: 1477923 - DNA, 18 bp, Homo sapiens
ctcccagaaacatctctg

SEQ ID NO: 1477924 - DNA, 16 bp, Homo sapiens
ctcccagaatgctggg

SEQ ID NO: 1477925 - DNA, 11 bp, Homo sapiens
ctcccttctct

SEQ ID NO: 1477926 - DNA, 12 bp, Homo sapiens
ctcccttctctc

SEQ ID NO: 1477927 - DNA, 14 bp, Homo sapiens
ctcccttgctggcc

SEQ ID NO: 1477928 - DNA, 20 bp, Homo sapiens
ctcccttggaaacctgccct

SEQ ID NO: 1477929 - DNA, 21 bp, Homo sapiens
ctcccttggaaacctgccctg

SEQ ID NO: 1477930 - DNA, 19 bp, Homo sapiens
ctcccttggcccagagacg

SEQ ID NO: 1477931 - DNA, 14 bp, Homo sapiens
ctccctttctcccc

SEQ ID NO: 1477932 - DNA, 23 bp, Homo sapiens
ctccctttctcccctgcccccag

SEQ ID NO: 1477933 - DNA, 16 bp, Homo sapiens
ctccctttctcttctt

SEQ ID NO: 1477934 - DNA, 18 bp, Homo sapiens
ctccgactctgcacccgc

SEQ ID NO: 1477935 - DNA, 16 bp, Homo sapiens
ctccgacttcccctgg

SEQ ID NO: 1477936 - DNA, 17 bp, Homo sapiens
ctccgacttcccctggg

SEQ ID NO: 1477937 - DNA, 18 bp, Homo sapiens
ctccgacttcccctgggc

SEQ ID NO: 1477938 - DNA, 20 bp, Homo sapiens
ctccgacttcccctgggcaa

SEQ ID NO: 1477939 - DNA, 16 bp, Homo sapiens
ctccgagagggagaga

SEQ ID NO: 1477940 - DNA, 13 bp, Homo sapiens
ctccgagaggtgg

SEQ ID NO: 1477941 - DNA, 18 bp, Homo sapiens
ctccgagaggtgggccag

SEQ ID NO: 1477942 - DNA, 13 bp, Homo sapiens
ctccgagctctgg

SEQ ID NO: 1477943 - DNA, 15 bp, Homo sapiens
ctccgagctctggtg

SEQ ID NO: 1477944 - DNA, 19 bp, Homo sapiens
ctccgagctctggtgcttt

SEQ ID NO: 1477945 - DNA, 13 bp, Homo sapiens
ctccgagctgtag

SEQ ID NO: 1477946 - DNA, 15 bp, Homo sapiens
ctccgaggacccagg

SEQ ID NO: 1477947 - DNA, 13 bp, Homo sapiens
ctccgaggctccc

SEQ ID NO: 1477948 - DNA, 16 bp, Homo sapiens
ctccgaggctccccgc

SEQ ID NO: 1477949 - DNA, 21 bp, Homo sapiens
ctccgaggctccccgcctcca

SEQ ID NO: 1477950 - DNA, 16 bp, Homo sapiens
ctccgcagtgtctcca

SEQ ID NO: 1477951 - DNA, 13 bp, Homo sapiens
ctccgccagcctc

SEQ ID NO: 1477952 - DNA, 14 bp, Homo sapiens
ctccgccagcctcc

SEQ ID NO: 1477953 - DNA, 15 bp, Homo sapiens
ctccgccagcctcct

SEQ ID NO: 1477954 - DNA, 20 bp, Homo sapiens
ctccgccagcctcctctgga

SEQ ID NO: 1477955 - DNA, 15 bp, Homo sapiens
ctccgccgtgccggc

SEQ ID NO: 1477956 - DNA, 13 bp, Homo sapiens
ctccgcctccaca

SEQ ID NO: 1477957 - DNA, 14 bp, Homo sapiens
ctccgcctccacac

SEQ ID NO: 1477958 - DNA, 16 bp, Homo sapiens
ctccgcctccacactg

SEQ ID NO: 1477959 - DNA, 15 bp, Homo sapiens
ctccgctgcctggaa

SEQ ID NO: 1477960 - DNA, 12 bp, Homo sapiens
ctccgctgggct

SEQ ID NO: 1477961 - DNA, 14 bp, Homo sapiens
ctccggactggtgc

SEQ ID NO: 1477962 - DNA, 15 bp, Homo sapiens
ctccggactggtgcc

SEQ ID NO: 1477963 - DNA, 16 bp, Homo sapiens
ctccggatcgaggcct

SEQ ID NO: 1477964 - DNA, 20 bp, Homo sapiens
ctccggccagcgagtggtca

SEQ ID NO: 1477965 - DNA, 15 bp, Homo sapiens
ctccggcctcccctc

SEQ ID NO: 1477966 - DNA, 18 bp, Homo sapiens
ctccggcgtcttgcccag

SEQ ID NO: 1477967 - DNA, 20 bp, Homo sapiens
ctccgggaccattgacctca

SEQ ID NO: 1477968 - DNA, 15 bp, Homo sapiens
ctccgggactgccct

SEQ ID NO: 1477969 - DNA, 18 bp, Homo sapiens
ctccgggcaaatggctga

SEQ ID NO: 1477970 - DNA, 13 bp, Homo sapiens
ctccggggtctgt

SEQ ID NO: 1477971 - DNA, 17 bp, Homo sapiens
ctccggggtctgtgctg

SEQ ID NO: 1477972 - DNA, 18 bp, Homo sapiens
ctccggggtctgtgctgt

SEQ ID NO: 1477973 - DNA, 21 bp, Homo sapiens
ctccggggtctgtgctgtgcc

SEQ ID NO: 1477974 - DNA, 22 bp, Homo sapiens
ctccggggtctgtgctgtgcct

SEQ ID NO: 1477975 - DNA, 23 bp, Homo sapiens
ctccggtgtgcctgcagccccgc

SEQ ID NO: 1477976 - DNA, 22 bp, Homo sapiens
ctccgtagggtctttcttggga

SEQ ID NO: 1477977 - DNA, 14 bp, Homo sapiens
ctccgtccacccag

SEQ ID NO: 1477978 - DNA, 15 bp, Homo sapiens
ctccgtccagccgcc

SEQ ID NO: 1477979 - DNA, 19 bp, Homo sapiens
ctccgtccaggagcctggc

SEQ ID NO: 1477980 - DNA, 12 bp, Homo sapiens
ctccgtctctgt

SEQ ID NO: 1477981 - DNA, 14 bp, Homo sapiens
ctccgtgcctccac

SEQ ID NO: 1477982 - DNA, 22 bp, Homo sapiens
ctccgtgcctccaccaccactg

SEQ ID NO: 1477983 - DNA, 15 bp, Homo sapiens
ctccgttagctcctg

SEQ ID NO: 1477984 - DNA, 14 bp, Homo sapiens
ctccgttccatctg

SEQ ID NO: 1477985 - DNA, 17 bp, Homo sapiens
ctccgtttatgggcctt

SEQ ID NO: 1477986 - DNA, 13 bp, Homo sapiens
ctcctaaaactgg

SEQ ID NO: 1477987 - DNA, 17 bp, Homo sapiens
ctcctaaaactgggatt

SEQ ID NO: 1477988 - DNA, 21 bp, Homo sapiens
ctcctaaagctgaatcccggc

SEQ ID NO: 1477989 - DNA, 11 bp, Homo sapiens
ctcctaacaaa

SEQ ID NO: 1477990 - DNA, 14 bp, Homo sapiens
ctcctaatagcttt

SEQ ID NO: 1477991 - DNA, 19 bp, Homo sapiens
ctcctaatagcttttcctg

SEQ ID NO: 1477992 - DNA, 21 bp, Homo sapiens
ctcctacatatcccttccaga

SEQ ID NO: 1477993 - DNA, 20 bp, Homo sapiens
ctcctacccactggtctgct

SEQ ID NO: 1477994 - DNA, 13 bp, Homo sapiens
ctcctacctggta

SEQ ID NO: 1477995 - DNA, 12 bp, Homo sapiens
ctcctactgagg

SEQ ID NO: 1477996 - DNA, 13 bp, Homo sapiens
ctcctagaagaac

SEQ ID NO: 1477997 - DNA, 19 bp, Homo sapiens
ctcctagaagaaccaaata

SEQ ID NO: 1477998 - DNA, 13 bp, Homo sapiens
ctcctagacccag

SEQ ID NO: 1477999 - DNA, 17 bp, Homo sapiens
ctcctagacccaggtgg

SEQ ID NO: 1478000 - DNA, 13 bp, Homo sapiens
ctcctagaggtgg

SEQ ID NO: 1478001 - DNA, 16 bp, Homo sapiens
ctcctagaggtgggca

SEQ ID NO: 1478002 - DNA, 17 bp, Homo sapiens
ctcctagaggtgggcag

SEQ ID NO: 1478003 - DNA, 23 bp, Homo sapiens
ctcctagtttgacctcacagtga

SEQ ID NO: 1478004 - DNA, 22 bp, Homo sapiens
ctcctataaagggcccacacct

SEQ ID NO: 1478005 - DNA, 14 bp, Homo sapiens
ctcctatatatttc

SEQ ID NO: 1478006 - DNA, 14 bp, Homo sapiens
ctcctatccccagg

SEQ ID NO: 1478007 - DNA, 16 bp, Homo sapiens
ctcctatctccctggc

SEQ ID NO: 1478008 - DNA, 18 bp, Homo sapiens
ctcctatctgtgttttga

SEQ ID NO: 1478009 - DNA, 15 bp, Homo sapiens
ctcctatgtggcagc

SEQ ID NO: 1478010 - DNA, 17 bp, Homo sapiens
ctcctatgtggcagctg

SEQ ID NO: 1478011 - DNA, 15 bp, Homo sapiens
ctcctattctataaa

SEQ ID NO: 1478012 - DNA, 16 bp, Homo sapiens
ctcctattctataaaa

SEQ ID NO: 1478013 - DNA, 22 bp, Homo sapiens
ctcctattctcttaatttttct

SEQ ID NO: 1478014 - DNA, 20 bp, Homo sapiens
ctcctcacccaccctgtggc

SEQ ID NO: 1478015 - DNA, 17 bp, Homo sapiens
ctcctcacccctgtagg

SEQ ID NO: 1478016 - DNA, 19 bp, Homo sapiens
ctcctcacctcatgcccac

SEQ ID NO: 1478017 - DNA, 12 bp, Homo sapiens
ctcctcacctgt

SEQ ID NO: 1478018 - DNA, 16 bp, Homo sapiens
ctcctcactgtatcca

SEQ ID NO: 1478019 - DNA, 19 bp, Homo sapiens
ctcctcactgtatccaggt

SEQ ID NO: 1478020 - DNA, 15 bp, Homo sapiens
ctcctcagatggggc

SEQ ID NO: 1478021 - DNA, 16 bp, Homo sapiens
ctcctcagatggggca

SEQ ID NO: 1478022 - DNA, 18 bp, Homo sapiens
ctcctcaggcacacagct

SEQ ID NO: 1478023 - DNA, 19 bp, Homo sapiens
ctcctcaggcacacagcta

SEQ ID NO: 1478024 - DNA, 23 bp, Homo sapiens
ctcctcaggcacacagctactct

SEQ ID NO: 1478025 - DNA, 16 bp, Homo sapiens
ctcctcagtgacatca

SEQ ID NO: 1478026 - DNA, 21 bp, Homo sapiens
ctcctcatccccacaatctgg

SEQ ID NO: 1478027 - DNA, 20 bp, Homo sapiens
ctcctcatgtacataccctg

SEQ ID NO: 1478028 - DNA, 16 bp, Homo sapiens
ctcctccacagtgctg

SEQ ID NO: 1478029 - DNA, 16 bp, Homo sapiens
ctcctccacccacccc

SEQ ID NO: 1478030 - DNA, 19 bp, Homo sapiens
ctcctccactcactccagc

SEQ ID NO: 1478031 - DNA, 16 bp, Homo sapiens
ctcctccactctcccc

SEQ ID NO: 1478032 - DNA, 13 bp, Homo sapiens
ctcctccaggcct

SEQ ID NO: 1478033 - DNA, 18 bp, Homo sapiens
ctcctccaggcctgcctc

SEQ ID NO: 1478034 - DNA, 23 bp, Homo sapiens
ctcctccaggcctgcctcccact

SEQ ID NO: 1478035 - DNA, 11 bp, Homo sapiens
ctcctccaggg

SEQ ID NO: 1478036 - DNA, 13 bp, Homo sapiens
ctcctccagggcc

SEQ ID NO: 1478037 - DNA, 22 bp, Homo sapiens
ctcctccaggtcggagtgcctg

SEQ ID NO: 1478038 - DNA, 23 bp, Homo sapiens
ctcctccagtacgtcccgctgct

SEQ ID NO: 1478039 - DNA, 17 bp, Homo sapiens
ctcctccagtgtgggct

SEQ ID NO: 1478040 - DNA, 20 bp, Homo sapiens
ctcctcccacccggctgcag

SEQ ID NO: 1478041 - DNA, 14 bp, Homo sapiens
ctcctggtctgtga

SEQ ID NO: 1478042 - DNA, 23 bp, Homo sapiens
ctcctggtcttgagatgtcttct

SEQ ID NO: 1478043 - DNA, 20 bp, Homo sapiens
ctcctgtaacatactggcct

SEQ ID NO: 1478044 - DNA, 14 bp, Homo sapiens
ctcctgtaattcct

SEQ ID NO: 1478045 - DNA, 18 bp, Homo sapiens
ctcctgtaattcctacct

SEQ ID NO: 1478046 - DNA, 20 bp, Homo sapiens
ctcctgtagccactggcata

SEQ ID NO: 1478047 - DNA, 13 bp, Homo sapiens
ctcctgtcccgcc

SEQ ID NO: 1478048 - DNA, 14 bp, Homo sapiens
ctcctgtccctgta

SEQ ID NO: 1478049 - DNA, 14 bp, Homo sapiens
ctcctgtccctttt

SEQ ID NO: 1478050 - DNA, 15 bp, Homo sapiens
ctcctgtcccttttc

SEQ ID NO: 1478051 - DNA, 18 bp, Homo sapiens
ctcctgtcccttttccct

SEQ ID NO: 1478052 - DNA, 19 bp, Homo sapiens
ctcctgtcccttttccctt

SEQ ID NO: 1478053 - DNA, 20 bp, Homo sapiens
ctcctgtcccttttccctta

SEQ ID NO: 1478054 - DNA, 20 bp, Homo sapiens
ctcctgtctcagcctcctga

SEQ ID NO: 1478055 - DNA, 14 bp, Homo sapiens
ctcctgtctgccag

SEQ ID NO: 1478056 - DNA, 15 bp, Homo sapiens
ctcctgtctgccagc

SEQ ID NO: 1478057 - DNA, 14 bp, Homo sapiens
ctcctgtctgccct

SEQ ID NO: 1478058 - DNA, 12 bp, Homo sapiens
ctcctgtctggc

SEQ ID NO: 1478059 - DNA, 13 bp, Homo sapiens
ctcctgtctggct

SEQ ID NO: 1478060 - DNA, 18 bp, Homo sapiens
ctcctgtcttatggtcca

SEQ ID NO: 1478061 - DNA, 11 bp, Homo sapiens
ctcctgtgccc

SEQ ID NO: 1478062 - DNA, 22 bp, Homo sapiens
ctcctgtgcccacatcccaggc

SEQ ID NO: 1478063 - DNA, 17 bp, Homo sapiens
ctcctgtgctatttgta

SEQ ID NO: 1478064 - DNA, 14 bp, Homo sapiens
ctcctgtgctctgg

SEQ ID NO: 1478065 - DNA, 22 bp, Homo sapiens
ctcctgtggaaggcagagaaat

SEQ ID NO: 1478066 - DNA, 21 bp, Homo sapiens
ctcctgtggccccaccctggg

SEQ ID NO: 1478067 - DNA, 14 bp, Homo sapiens
ctcctgtgtgtgga

SEQ ID NO: 1478068 - DNA, 15 bp, Homo sapiens
ctcctgttctgccca

SEQ ID NO: 1478069 - DNA, 14 bp, Homo sapiens
ctcctgtttctcct

SEQ ID NO: 1478070 - DNA, 15 bp, Homo sapiens
ctcctgtttgcaggc

SEQ ID NO: 1478071 - DNA, 15 bp, Homo sapiens
ctccttactctgagc

SEQ ID NO: 1478072 - DNA, 19 bp, Homo sapiens
ctccttactctgagcccag

SEQ ID NO: 1478073 - DNA, 20 bp, Homo sapiens
ctccttactctgagcccagg

SEQ ID NO: 1478074 - DNA, 22 bp, Homo sapiens
ctccttactctgagcccaggcc

SEQ ID NO: 1478075 - DNA, 19 bp, Homo sapiens
ctccttagacctgagggac

SEQ ID NO: 1478076 - DNA, 21 bp, Homo sapiens
ctccttatagacacttgctcc

SEQ ID NO: 1478077 - DNA, 17 bp, Homo sapiens
ctccttcactgttccct

SEQ ID NO: 1478078 - DNA, 13 bp, Homo sapiens
ctccttcagacac

SEQ ID NO: 1478079 - DNA, 14 bp, Homo sapiens
ctccttcagacacc

SEQ ID NO: 1478080 - DNA, 19 bp, Homo sapiens
ctccttcagacaccctcaa

SEQ ID NO: 1478081 - DNA, 14 bp, Homo sapiens
ctccttcagccctc

SEQ ID NO: 1478082 - DNA, 15 bp, Homo sapiens
ctccttcagccctca

SEQ ID NO: 1478083 - DNA, 17 bp, Homo sapiens
ctccttcagccctcacc

SEQ ID NO: 1478084 - DNA, 20 bp, Homo sapiens
ctccttcagccctcacccct

SEQ ID NO: 1478085 - DNA, 16 bp, Homo sapiens
ctccttcccatcgctg

SEQ ID NO: 1478086 - DNA, 16 bp, Homo sapiens
ctccttcccatgcctg

SEQ ID NO: 1478087 - DNA, 15 bp, Homo sapiens
ctccttccccacttc

SEQ ID NO: 1478088 - DNA, 21 bp, Homo sapiens
ctccttcccgccgcccgaccc

SEQ ID NO: 1478089 - DNA, 16 bp, Homo sapiens
ctccttcctcttggct

SEQ ID NO: 1478090 - DNA, 19 bp, Homo sapiens
ctccttcctcttggctgag

SEQ ID NO: 1478091 - DNA, 17 bp, Homo sapiens
ctccttcctggcctgag

SEQ ID NO: 1478092 - DNA, 18 bp, Homo sapiens
ctccttcctggcctgaga

SEQ ID NO: 1478093 - DNA, 13 bp, Homo sapiens
ctccttcctgtct

SEQ ID NO: 1478094 - DNA, 16 bp, Homo sapiens
ctccttcctgtcttcc

SEQ ID NO: 1478095 - DNA, 14 bp, Homo sapiens
ctccttccttaccc

SEQ ID NO: 1478096 - DNA, 17 bp, Homo sapiens
ctccttccttgaccagc

SEQ ID NO: 1478097 - DNA, 18 bp, Homo sapiens
ctccttccttgaccagca

SEQ ID NO: 1478098 - DNA, 19 bp, Homo sapiens
ctccttcgcaggcatgtcc

SEQ ID NO: 1478099 - DNA, 13 bp, Homo sapiens
ctccttctcccct

SEQ ID NO: 1478100 - DNA, 13 bp, Homo sapiens
ctccttctccctt

SEQ ID NO: 1478101 - DNA, 12 bp, Homo sapiens
ctccttctcctt

SEQ ID NO: 1478102 - DNA, 17 bp, Homo sapiens
ctccttcttccacttct

SEQ ID NO: 1478103 - DNA, 19 bp, Homo sapiens
ctccttgagtgtatgagta

SEQ ID NO: 1478104 - DNA, 15 bp, Homo sapiens
ctccttgatatttgt

SEQ ID NO: 1478105 - DNA, 14 bp, Homo sapiens
ctccttggccacag

SEQ ID NO: 1478106 - DNA, 20 bp, Homo sapiens
ctccttggctttatgcaaat

SEQ ID NO: 1478107 - DNA, 12 bp, Homo sapiens
ctccttgggccc

SEQ ID NO: 1478108 - DNA, 14 bp, Homo sapiens
ctccttgggctcct

SEQ ID NO: 1478109 - DNA, 16 bp, Homo sapiens
ctccttgggctcctgg

SEQ ID NO: 1478110 - DNA, 19 bp, Homo sapiens
ctccttgggctcctggctg

SEQ ID NO: 1478111 - DNA, 20 bp, Homo sapiens
ctccttgggctcctggctgc

SEQ ID NO: 1478112 - DNA, 22 bp, Homo sapiens
ctccttggggcagggcctgggc

SEQ ID NO: 1478113 - DNA, 15 bp, Homo sapiens
ctccttggtgcctgg

SEQ ID NO: 1478114 - DNA, 14 bp, Homo sapiens
ctcctttaccctct

SEQ ID NO: 1478115 - DNA, 15 bp, Homo sapiens
ctcctttaccctctt

SEQ ID NO: 1478116 - DNA, 15 bp, Homo sapiens
ctcctttattgcagt

SEQ ID NO: 1478117 - DNA, 13 bp, Homo sapiens
ctcctttcacaac

SEQ ID NO: 1478118 - DNA, 20 bp, Homo sapiens
ctcctttcacaaccttctgt

SEQ ID NO: 1478119 - DNA, 16 bp, Homo sapiens
ctcctttcagccacat

SEQ ID NO: 1478120 - DNA, 18 bp, Homo sapiens
ctcctttcatcacactgg

SEQ ID NO: 1478121 - DNA, 18 bp, Homo sapiens
ctcctttccttcccaggc

SEQ ID NO: 1478122 - DNA, 21 bp, Homo sapiens
ctcctttccttcccaggccct

SEQ ID NO: 1478123 - DNA, 18 bp, Homo sapiens
ctcctttctaagccctgt

SEQ ID NO: 1478124 - DNA, 18 bp, Homo sapiens
ctcctttctccagccagc

SEQ ID NO: 1478125 - DNA, 21 bp, Homo sapiens
ctcctttctttttcttcttcc

SEQ ID NO: 1478126 - DNA, 15 bp, Homo sapiens
ctcctttgcactgag

SEQ ID NO: 1478127 - DNA, 21 bp, Homo sapiens
ctcctttgcactgagggccac

SEQ ID NO: 1478128 - DNA, 16 bp, Homo sapiens
ctcctttgctcttgcc

SEQ ID NO: 1478129 - DNA, 23 bp, Homo sapiens
ctcctttgctgaggcctccagct

SEQ ID NO: 1478130 - DNA, 20 bp, Homo sapiens
ctcctttgtgtgtattcaga

SEQ ID NO: 1478131 - DNA, 13 bp, Homo sapiens
ctccttttcactt

SEQ ID NO: 1478132 - DNA, 15 bp, Homo sapiens
ctccttttgctcttt

SEQ ID NO: 1478133 - DNA, 13 bp, Homo sapiens
ctccttttgctgt

SEQ ID NO: 1478134 - DNA, 16 bp, Homo sapiens
ctccttttgctgtctt

SEQ ID NO: 1478135 - DNA, 19 bp, Homo sapiens
ctccttttgtccccagggc

SEQ ID NO: 1478136 - DNA, 22 bp, Homo sapiens
ctcgaacatggaactcattcct

SEQ ID NO: 1478137 - DNA, 14 bp, Homo sapiens
ctcgaaccaaggca

SEQ ID NO: 1478138 - DNA, 15 bp, Homo sapiens
ctcgaaccaaggcag

SEQ ID NO: 1478139 - DNA, 16 bp, Homo sapiens
ctcgaaccaaggcagc

SEQ ID NO: 1478140 - DNA, 18 bp, Homo sapiens
ctcgaaccaaggcagcct

SEQ ID NO: 1478141 - DNA, 14 bp, Homo sapiens
ctcgaactgctttc

SEQ ID NO: 1478142 - DNA, 20 bp, Homo sapiens
ctcgaataaaatctgctgca

SEQ ID NO: 1478143 - DNA, 23 bp, Homo sapiens
ctcgaataaaatctgctgcacct

SEQ ID NO: 1478144 - DNA, 17 bp, Homo sapiens
ctcgaatctctgtgcct

SEQ ID NO: 1478145 - DNA, 18 bp, Homo sapiens
ctcgaatctctgtgcctt

SEQ ID NO: 1478146 - DNA, 14 bp, Homo sapiens
ctcgaatgtaattg

SEQ ID NO: 1478147 - DNA, 20 bp, Homo sapiens
ctcgaatgtaattggaatct

SEQ ID NO: 1478148 - DNA, 21 bp, Homo sapiens
ctcgaatgtaattggaatctt

SEQ ID NO: 1478149 - DNA, 13 bp, Homo sapiens
ctcgacccagaat

SEQ ID NO: 1478150 - DNA, 16 bp, Homo sapiens
ctcgacggcacgcact

SEQ ID NO: 1478151 - DNA, 13 bp, Homo sapiens
ctcgactctgtgc

SEQ ID NO: 1478152 - DNA, 19 bp, Homo sapiens
ctcgagaactttcattttt

SEQ ID NO: 1478153 - DNA, 15 bp, Homo sapiens
ctcgagaccatcctg

SEQ ID NO: 1478154 - DNA, 16 bp, Homo sapiens
ctcgagaccatcctgg

SEQ ID NO: 1478155 - DNA, 13 bp, Homo sapiens
ctcgagcccaccc

SEQ ID NO: 1478156 - DNA, 18 bp, Homo sapiens
ctcgagcccacccagcat

SEQ ID NO: 1478157 - DNA, 13 bp, Homo sapiens
ctctcaggatcca

SEQ ID NO: 1478158 - DNA, 14 bp, Homo sapiens
ctctcagtgccttc

SEQ ID NO: 1478159 - DNA, 15 bp, Homo sapiens
ctctcagtgccttct

SEQ ID NO: 1478160 - DNA, 12 bp, Homo sapiens
ctctcagtgttt

SEQ ID NO: 1478161 - DNA, 13 bp, Homo sapiens
ctctcagtgtttt

SEQ ID NO: 1478162 - DNA, 21 bp, Homo sapiens
ctctcagttctctcccttcct

SEQ ID NO: 1478163 - DNA, 15 bp, Homo sapiens
ctctcataccctccc

SEQ ID NO: 1478164 - DNA, 20 bp, Homo sapiens
ctctcatcggaggcccatgc

SEQ ID NO: 1478165 - DNA, 11 bp, Homo sapiens
ctctcattccc

SEQ ID NO: 1478166 - DNA, 14 bp, Homo sapiens
ctctcattccccag

SEQ ID NO: 1478167 - DNA, 21 bp, Homo sapiens
ctctcattccccaggtggctg

SEQ ID NO: 1478168 - DNA, 19 bp, Homo sapiens
ctctcattctttgaacatg

SEQ ID NO: 1478169 - DNA, 19 bp, Homo sapiens
ctctccaaaggggctgctg

SEQ ID NO: 1478170 - DNA, 17 bp, Homo sapiens
ctctccaaccactgtgc

SEQ ID NO: 1478171 - DNA, 16 bp, Homo sapiens
ctctccaacctggaca

SEQ ID NO: 1478172 - DNA, 22 bp, Homo sapiens
ctctccaagggcttctgcaccc

SEQ ID NO: 1478173 - DNA, 19 bp, Homo sapiens
ctctccaagtgccagaggt

SEQ ID NO: 1478174 - DNA, 21 bp, Homo sapiens
ctctccacagtgttgtgcccc

SEQ ID NO: 1478175 - DNA, 22 bp, Homo sapiens
ctctccacagtgttgtgcccct

SEQ ID NO: 1478176 - DNA, 10 bp, Homo sapiens
ctctccacct

SEQ ID NO: 1478177 - DNA, 15 bp, Homo sapiens
ctctccacctcagcc

SEQ ID NO: 1478178 - DNA, 20 bp, Homo sapiens
ctctccacctcagccttgga

SEQ ID NO: 1478179 - DNA, 11 bp, Homo sapiens
ctctccactgc

SEQ ID NO: 1478180 - DNA, 12 bp, Homo sapiens
ctctccactgcc

SEQ ID NO: 1478181 - DNA, 15 bp, Homo sapiens
ctctccactgccttc

SEQ ID NO: 1478182 - DNA, 19 bp, Homo sapiens
ctctccactgctctcagcc

SEQ ID NO: 1478183 - DNA, 18 bp, Homo sapiens
ctctccactgctggacat

SEQ ID NO: 1478184 - DNA, 22 bp, Homo sapiens
ctctccactgctggacatgaga

SEQ ID NO: 1478185 - DNA, 14 bp, Homo sapiens
ctctccagctgact

SEQ ID NO: 1478186 - DNA, 12 bp, Homo sapiens
ctctccaggcca

SEQ ID NO: 1478187 - DNA, 17 bp, Homo sapiens
ctctccaggccaggtgg

SEQ ID NO: 1478188 - DNA, 14 bp, Homo sapiens
ctctccaggcccca

SEQ ID NO: 1478189 - DNA, 17 bp, Homo sapiens
ctctccaggccccacca

SEQ ID NO: 1478190 - DNA, 15 bp, Homo sapiens
ctctccagggtgctt

SEQ ID NO: 1478191 - DNA, 19 bp, Homo sapiens
ctctccaggtcagcctgga

SEQ ID NO: 1478192 - DNA, 19 bp, Homo sapiens
ctctccagtttgcacctgt

SEQ ID NO: 1478193 - DNA, 20 bp, Homo sapiens
ctctccatatcccttcctct

SEQ ID NO: 1478194 - DNA, 13 bp, Homo sapiens
ctctcccaaaaaa

SEQ ID NO: 1478195 - DNA, 13 bp, Homo sapiens
ctctcccaactct

SEQ ID NO: 1478196 - DNA, 14 bp, Homo sapiens
ctctcccaactctt

SEQ ID NO: 1478197 - DNA, 14 bp, Homo sapiens
ctctcccacccggc

SEQ ID NO: 1478198 - DNA, 22 bp, Homo sapiens
ctctcccacccggccacagctg

SEQ ID NO: 1478199 - DNA, 13 bp, Homo sapiens
ctctcccaggccc

SEQ ID NO: 1478200 - DNA, 14 bp, Homo sapiens
ctctcccaggcccg

SEQ ID NO: 1478201 - DNA, 18 bp, Homo sapiens
ctctcccatcacttccct

SEQ ID NO: 1478202 - DNA, 20 bp, Homo sapiens
ctctcccatcacttccctac

SEQ ID NO: 1478203 - DNA, 20 bp, Homo sapiens
ctctcccatccccctgccct

SEQ ID NO: 1478204 - DNA, 15 bp, Homo sapiens
ctctccccacactaa

SEQ ID NO: 1478205 - DNA, 18 bp, Homo sapiens
ctctccccacgagggctg

SEQ ID NO: 1478206 - DNA, 20 bp, Homo sapiens
ctctccccagcccagagaca

SEQ ID NO: 1478207 - DNA, 11 bp, Homo sapiens
ctctccccagt

SEQ ID NO: 1478208 - DNA, 14 bp, Homo sapiens
ctctccccagtgcc

SEQ ID NO: 1478209 - DNA, 15 bp, Homo sapiens
ctctccccagtgcct

SEQ ID NO: 1478210 - DNA, 18 bp, Homo sapiens
ctctccccagtgcctgcc

SEQ ID NO: 1478211 - DNA, 20 bp, Homo sapiens
ctctccccctatttattgac

SEQ ID NO: 1478212 - DNA, 23 bp, Homo sapiens
ctctccccgctcaggggcctgga

SEQ ID NO: 1478213 - DNA, 13 bp, Homo sapiens
ctctcccctcctg

SEQ ID NO: 1478214 - DNA, 17 bp, Homo sapiens
ctctcccctcctgctgg

SEQ ID NO: 1478215 - DNA, 16 bp, Homo sapiens
ctctcccgcaccaggc

SEQ ID NO: 1478216 - DNA, 19 bp, Homo sapiens
ctctcccggctgcctgccg

SEQ ID NO: 1478217 - DNA, 21 bp, Homo sapiens
ctctcccgtcagggcccaagt

SEQ ID NO: 1478218 - DNA, 23 bp, Homo sapiens
ctctccctccctctctcatgaga

SEQ ID NO: 1478219 - DNA, 20 bp, Homo sapiens
ctctccctcgatcatatttc

SEQ ID NO: 1478220 - DNA, 15 bp, Homo sapiens
ctctccctctctctg

SEQ ID NO: 1478221 - DNA, 13 bp, Homo sapiens
ctctccctctggc

SEQ ID NO: 1478222 - DNA, 13 bp, Homo sapiens
ctctccctgccaa

SEQ ID NO: 1478223 - DNA, 13 bp, Homo sapiens
ctctccctggccc

SEQ ID NO: 1478224 - DNA, 12 bp, Homo sapiens
ctctccctgttg

SEQ ID NO: 1478225 - DNA, 21 bp, Homo sapiens
ctctccgacttcccctgggca

SEQ ID NO: 1478226 - DNA, 18 bp, Homo sapiens
ctctccgagctctggtgc

SEQ ID NO: 1478227 - DNA, 19 bp, Homo sapiens
ctctccgagctctggtgct

SEQ ID NO: 1478228 - DNA, 15 bp, Homo sapiens
ctctccgcgcctacc

SEQ ID NO: 1478229 - DNA, 18 bp, Homo sapiens
ctctcctcatctccaagg

SEQ ID NO: 1478230 - DNA, 15 bp, Homo sapiens
ctctcctccccaaat

SEQ ID NO: 1478231 - DNA, 16 bp, Homo sapiens
ctctcctgacccctgc

SEQ ID NO: 1478232 - DNA, 21 bp, Homo sapiens
ctctcctgatagtctttcagt

SEQ ID NO: 1478233 - DNA, 14 bp, Homo sapiens
ctctcctgccctct

SEQ ID NO: 1478234 - DNA, 15 bp, Homo sapiens
ctctcctgccctctg

SEQ ID NO: 1478235 - DNA, 14 bp, Homo sapiens
ctctcctgccctgt

SEQ ID NO: 1478236 - DNA, 13 bp, Homo sapiens
ctctcctggccta

SEQ ID NO: 1478237 - DNA, 14 bp, Homo sapiens
ctctcctgtagcca

SEQ ID NO: 1478238 - DNA, 12 bp, Homo sapiens
ctctcctgtcca

SEQ ID NO: 1478239 - DNA, 21 bp, Homo sapiens
ctctcctgtccaacctaaccc

SEQ ID NO: 1478240 - DNA, 12 bp, Homo sapiens
ctctccttcctt

SEQ ID NO: 1478241 - DNA, 17 bp, Homo sapiens
ctctccttcgtgtctct

SEQ ID NO: 1478242 - DNA, 21 bp, Homo sapiens
ctctccttcgtgtctctccca

SEQ ID NO: 1478243 - DNA, 22 bp, Homo sapiens
ctctccttcgtgtctctcccac

SEQ ID NO: 1478244 - DNA, 14 bp, Homo sapiens
ctctccttgagtgt

SEQ ID NO: 1478245 - DNA, 17 bp, Homo sapiens
ctctccttgggctcctg

SEQ ID NO: 1478246 - DNA, 21 bp, Homo sapiens
ctctcctttctttttcttctt

SEQ ID NO: 1478247 - DNA, 23 bp, Homo sapiens
ctctcctttctttttcttcttcc

SEQ ID NO: 1478248 - DNA, 19 bp, Homo sapiens
ctctcctttgtgtggctgc

SEQ ID NO: 1478249 - DNA, 16 bp, Homo sapiens
ctctccttttgaggct

SEQ ID NO: 1478250 - DNA, 22 bp, Homo sapiens
ctctccttttgaggcttctcct

SEQ ID NO: 1478251 - DNA, 18 bp, Homo sapiens
ctctcgacggcacgcact

SEQ ID NO: 1478252 - DNA, 23 bp, Homo sapiens
ctctcgacggcacgcacttgcct

SEQ ID NO: 1478253 - DNA, 17 bp, Homo sapiens
ctctcgcacctttccaa

SEQ ID NO: 1478254 - DNA, 18 bp, Homo sapiens
ctctcgcacctttccaaa

SEQ ID NO: 1478255 - DNA, 16 bp, Homo sapiens
ctctcgctcccctctg

SEQ ID NO: 1478256 - DNA, 19 bp, Homo sapiens
ctctcgctcgctcgctctc

SEQ ID NO: 1478257 - DNA, 12 bp, Homo sapiens
ctctcgctctct

SEQ ID NO: 1478258 - DNA, 14 bp, Homo sapiens
ctctcgctctctct

SEQ ID NO: 1478259 - DNA, 18 bp, Homo sapiens
ctctcgctgccctgtgga

SEQ ID NO: 1478260 - DNA, 15 bp, Homo sapiens
ctctcgctgcgtcct

SEQ ID NO: 1478261 - DNA, 19 bp, Homo sapiens
ctctcgctgcgtcctcatt

SEQ ID NO: 1478262 - DNA, 21 bp, Homo sapiens
ctctcgcttcctcagcctcca

SEQ ID NO: 1478263 - DNA, 16 bp, Homo sapiens
ctctcggaaggctggc

SEQ ID NO: 1478264 - DNA, 18 bp, Homo sapiens
ctctcggaaggctggctg

SEQ ID NO: 1478265 - DNA, 22 bp, Homo sapiens
ctctcggaaggctggctgggca

SEQ ID NO: 1478266 - DNA, 14 bp, Homo sapiens
ctctcggctcccca

SEQ ID NO: 1478267 - DNA, 15 bp, Homo sapiens
ctctcggctccccat

SEQ ID NO: 1478268 - DNA, 16 bp, Homo sapiens
ctctcggctccccatg

SEQ ID NO: 1478269 - DNA, 21 bp, Homo sapiens
ctctcggggcccttggggcct

SEQ ID NO: 1478270 - DNA, 20 bp, Homo sapiens
ctctcggtgctccatctccg

SEQ ID NO: 1478271 - DNA, 21 bp, Homo sapiens
ctctcggttccacgtccccct

SEQ ID NO: 1478272 - DNA, 19 bp, Homo sapiens
ctctctacaaactcccact

SEQ ID NO: 1478273 - DNA, 15 bp, Homo sapiens
ctctctacctccacc

SEQ ID NO: 1478274 - DNA, 20 bp, Homo sapiens
ctctctactcctacctcagc

SEQ ID NO: 1478275 - DNA, 17 bp, Homo sapiens
ctctctactgctggact

SEQ ID NO: 1478276 - DNA, 13 bp, Homo sapiens
ctctctagcacaa

SEQ ID NO: 1478277 - DNA, 22 bp, Homo sapiens
ctctctagcacaatttgcacta

SEQ ID NO: 1478278 - DNA, 19 bp, Homo sapiens
ctctctaggcctctccagt

SEQ ID NO: 1478279 - DNA, 13 bp, Homo sapiens
ctctctattgtca

SEQ ID NO: 1478280 - DNA, 14 bp, Homo sapiens
ctctctcacacaca

SEQ ID NO: 1478281 - DNA, 20 bp, Homo sapiens
ctctctcatgagaagccaag

SEQ ID NO: 1478282 - DNA, 12 bp, Homo sapiens
ctctctccaccc

SEQ ID NO: 1478283 - DNA, 13 bp, Homo sapiens
ctctctccacccc

SEQ ID NO: 1478284 - DNA, 16 bp, Homo sapiens
ctctctccacccccca

SEQ ID NO: 1478285 - DNA, 21 bp, Homo sapiens
ctctctccaccccccacgtct

SEQ ID NO: 1478286 - DNA, 14 bp, Homo sapiens
ctctctccacccta

SEQ ID NO: 1478287 - DNA, 17 bp, Homo sapiens
ctctctccagatgtttc

SEQ ID NO: 1478288 - DNA, 17 bp, Homo sapiens
ctctctcccatttcagg

SEQ ID NO: 1478289 - DNA, 10 bp, Homo sapiens
ctctctcccc

SEQ ID NO: 1478290 - DNA, 20 bp, Homo sapiens
ctctctcctgtactttttcc

SEQ ID NO: 1478291 - DNA, 14 bp, Homo sapiens
ctctctcctgtcca

SEQ ID NO: 1478292 - DNA, 15 bp, Homo sapiens
ctctctcctgtccaa

SEQ ID NO: 1478293 - DNA, 16 bp, Homo sapiens
ctctctcctttttgct

SEQ ID NO: 1478294 - DNA, 15 bp, Homo sapiens
ctctctctcacacac

SEQ ID NO: 1478295 - DNA, 15 bp, Homo sapiens
ctctctctccctccc

SEQ ID NO: 1478296 - DNA, 14 bp, Homo sapiens
ctctctctctctct

SEQ ID NO: 1478297 - DNA, 10 bp, Homo sapiens
ctctctctgg

SEQ ID NO: 1478298 - DNA, 15 bp, Homo sapiens
ctctctgagactgct

SEQ ID NO: 1478299 - DNA, 15 bp, Homo sapiens
ctctctgagtcaaat

SEQ ID NO: 1478300 - DNA, 16 bp, Homo sapiens
ctctctgagtcaaatc

SEQ ID NO: 1478301 - DNA, 21 bp, Homo sapiens
ctctctgcagccagcccagcc

SEQ ID NO: 1478302 - DNA, 14 bp, Homo sapiens
ctctctgcagctgc

SEQ ID NO: 1478303 - DNA, 16 bp, Homo sapiens
ctctctgcagctgccg

SEQ ID NO: 1478304 - DNA, 12 bp, Homo sapiens
ctctctgccact

SEQ ID NO: 1478305 - DNA, 14 bp, Homo sapiens
ctctctgccctgtg

SEQ ID NO: 1478306 - DNA, 17 bp, Homo sapiens
ctctctgccctgtgtac

SEQ ID NO: 1478307 - DNA, 19 bp, Homo sapiens
ctctctgcggcagagtcct

SEQ ID NO: 1478308 - DNA, 18 bp, Homo sapiens
ctctctgctctagccagg

SEQ ID NO: 1478309 - DNA, 12 bp, Homo sapiens
ctctctgctggc

SEQ ID NO: 1478310 - DNA, 13 bp, Homo sapiens
ctctctggagccc

SEQ ID NO: 1478311 - DNA, 14 bp, Homo sapiens
ctctctggcctccc

SEQ ID NO: 1478312 - DNA, 15 bp, Homo sapiens
ctctctggcctccca

SEQ ID NO: 1478313 - DNA, 18 bp, Homo sapiens
ctctctggcctcccaccc

SEQ ID NO: 1478314 - DNA, 17 bp, Homo sapiens
ctctctggcttctctct

SEQ ID NO: 1478315 - DNA, 19 bp, Homo sapiens
ctctctggcttctctcttt

SEQ ID NO: 1478316 - DNA, 22 bp, Homo sapiens
ctctctggcttctctcttttcc

SEQ ID NO: 1478317 - DNA, 16 bp, Homo sapiens
ctctctgggacctcct

SEQ ID NO: 1478318 - DNA, 12 bp, Homo sapiens
ctctctgggact

SEQ ID NO: 1478319 - DNA, 20 bp, Homo sapiens
ctctctgggcccaggggctg

SEQ ID NO: 1478320 - DNA, 21 bp, Homo sapiens
ctctctgggcctgggttccag

SEQ ID NO: 1478321 - DNA, 19 bp, Homo sapiens
ctctctgtgggctggcagt

SEQ ID NO: 1478322 - DNA, 17 bp, Homo sapiens
ctctctgtggggctgaa

SEQ ID NO: 1478323 - DNA, 16 bp, Homo sapiens
ctctcttaaatgcaag

SEQ ID NO: 1478324 - DNA, 21 bp, Homo sapiens
ctctcttatagaatatttatt

SEQ ID NO: 1478325 - DNA, 9 bp, Homo sapiens
ctctcttca

SEQ ID NO: 1478326 - DNA, 17 bp, Homo sapiens
ctctcttcaatctctgg

SEQ ID NO: 1478327 - DNA, 11 bp, Homo sapiens
ctctcttcagc

SEQ ID NO: 1478328 - DNA, 16 bp, Homo sapiens
ctctcttctaggccca

SEQ ID NO: 1478329 - DNA, 15 bp, Homo sapiens
ctctcttctgctcca

SEQ ID NO: 1478330 - DNA, 16 bp, Homo sapiens
ctctcttgcttgagga

SEQ ID NO: 1478331 - DNA, 14 bp, Homo sapiens
ctctcttggctatt

SEQ ID NO: 1478332 - DNA, 19 bp, Homo sapiens
ctctcttggctattgacca

SEQ ID NO: 1478333 - DNA, 15 bp, Homo sapiens
ctctcttggtttcct

SEQ ID NO: 1478334 - DNA, 18 bp, Homo sapiens
ctctcttgtcctcttctg

SEQ ID NO: 1478335 - DNA, 23 bp, Homo sapiens
ctctcttgtcctcttctgctctt

SEQ ID NO: 1478336 - DNA, 17 bp, Homo sapiens
ctctctttatacagctg

SEQ ID NO: 1478337 - DNA, 19 bp, Homo sapiens
ctctctttcctccacccat

SEQ ID NO: 1478338 - DNA, 21 bp, Homo sapiens
ctctctttccttgagctgttg

SEQ ID NO: 1478339 - DNA, 14 bp, Homo sapiens
ctctctttctctgg

SEQ ID NO: 1478340 - DNA, 21 bp, Homo sapiens
ctctcttttcctcctccaccc

SEQ ID NO: 1478341 - DNA, 14 bp, Homo sapiens
ctctcttttgttta

SEQ ID NO: 1478342 - DNA, 15 bp, Homo sapiens
ctctgaaaatatttt

SEQ ID NO: 1478343 - DNA, 22 bp, Homo sapiens
ctctgaaaatatttttttctag

SEQ ID NO: 1478344 - DNA, 24 bp, Homo sapiens
ctctgaaaatatttttttctagct

SEQ ID NO: 1478345 - DNA, 19 bp, Homo sapiens
ctctgaagaactctctgga

SEQ ID NO: 1478346 - DNA, 19 bp, Homo sapiens
ctctgaagctaattgtact

SEQ ID NO: 1478347 - DNA, 19 bp, Homo sapiens
ctctgaaggagttacaggg

SEQ ID NO: 1478348 - DNA, 22 bp, Homo sapiens
ctctgaaggagttacagggaag

SEQ ID NO: 1478349 - DNA, 17 bp, Homo sapiens
ctctgaagggcatcatg

SEQ ID NO: 1478350 - DNA, 22 bp, Homo sapiens
ctctgaagggcatcatgcatct

SEQ ID NO: 1478351 - DNA, 23 bp, Homo sapiens
ctctgaagggcatcatgcatctt

SEQ ID NO: 1478352 - DNA, 13 bp, Homo sapiens
ctctgaagtcaca

SEQ ID NO: 1478353 - DNA, 23 bp, Homo sapiens
ctctgaagtcacatcacaggaca

SEQ ID NO: 1478354 - DNA, 21 bp, Homo sapiens
ctctgaatttacttccttgca

SEQ ID NO: 1478355 - DNA, 15 bp, Homo sapiens
ctctgaattttcaga

SEQ ID NO: 1478356 - DNA, 14 bp, Homo sapiens
ctctgacaagggct

SEQ ID NO: 1478357 - DNA, 19 bp, Homo sapiens
ctctgacaagggctgacct

SEQ ID NO: 1478358 - DNA, 20 bp, Homo sapiens
ctctgacaagggctgacctg

SEQ ID NO: 1478359 - DNA, 23 bp, Homo sapiens
ctctgacagattgacagggactt

SEQ ID NO: 1478360 - DNA, 14 bp, Homo sapiens
ctctgacagtccac

SEQ ID NO: 1478361 - DNA, 18 bp, Homo sapiens
ctctgacagtccacaggg

SEQ ID NO: 1478362 - DNA, 20 bp, Homo sapiens
ctctgacagtccacaggggc

SEQ ID NO: 1478363 - DNA, 13 bp, Homo sapiens
ctctgacatccct

SEQ ID NO: 1478364 - DNA, 14 bp, Homo sapiens
ctctgacatccctt

SEQ ID NO: 1478365 - DNA, 18 bp, Homo sapiens
ctctgacatcccttcctg

SEQ ID NO: 1478366 - DNA, 16 bp, Homo sapiens
ctctgaccaacaggct

SEQ ID NO: 1478367 - DNA, 16 bp, Homo sapiens
ctctgaccacagcccg

SEQ ID NO: 1478368 - DNA, 13 bp, Homo sapiens
ctctgaccacttg

SEQ ID NO: 1478369 - DNA, 12 bp, Homo sapiens
ctctgacctgca

SEQ ID NO: 1478370 - DNA, 15 bp, Homo sapiens
ctctgacctgcactg

SEQ ID NO: 1478371 - DNA, 13 bp, Homo sapiens
ctctgacctgcag

SEQ ID NO: 1478372 - DNA, 14 bp, Homo sapiens
ctctgacctgcagg

SEQ ID NO: 1478373 - DNA, 15 bp, Homo sapiens
ctctgacctgcaggc

SEQ ID NO: 1478374 - DNA, 13 bp, Homo sapiens
ctctgacctgcct

SEQ ID NO: 1478375 - DNA, 15 bp, Homo sapiens
ctctgacgcttgtga

SEQ ID NO: 1478376 - DNA, 17 bp, Homo sapiens
ctctgacgcttgtgaca

SEQ ID NO: 1478377 - DNA, 16 bp, Homo sapiens
ctctgacgtagaaaga

SEQ ID NO: 1478378 - DNA, 21 bp, Homo sapiens
ctctgacgtagaaagatcctt

SEQ ID NO: 1478379 - DNA, 23 bp, Homo sapiens
ctctgactcatccccacagctgg

SEQ ID NO: 1478380 - DNA, 22 bp, Homo sapiens
ctctgacttaagcaaaagaaaa

SEQ ID NO: 1478381 - DNA, 16 bp, Homo sapiens
ctctgacttctgcctg

SEQ ID NO: 1478382 - DNA, 18 bp, Homo sapiens
ctctgacttctgcctgga

SEQ ID NO: 1478383 - DNA, 20 bp, Homo sapiens
ctctgagaattgttgagata

SEQ ID NO: 1478384 - DNA, 14 bp, Homo sapiens
ctctgagacagcag

SEQ ID NO: 1478385 - DNA, 17 bp, Homo sapiens
ctctgagagtctagatt

SEQ ID NO: 1478386 - DNA, 18 bp, Homo sapiens
ctctgagagtctagattc

SEQ ID NO: 1478387 - DNA, 19 bp, Homo sapiens
ctctgagagtctagattct

SEQ ID NO: 1478388 - DNA, 23 bp, Homo sapiens
ctctgtcttctttgcccacaatg

SEQ ID NO: 1478389 - DNA, 18 bp, Homo sapiens
ctctgtgaacgatttaga

SEQ ID NO: 1478390 - DNA, 14 bp, Homo sapiens
ctctgtgaatcttg

SEQ ID NO: 1478391 - DNA, 17 bp, Homo sapiens
ctctgtgagggtgctga

SEQ ID NO: 1478392 - DNA, 19 bp, Homo sapiens
ctctgtgcaggtgctgcct

SEQ ID NO: 1478393 - DNA, 15 bp, Homo sapiens
ctctgtgcctccctc

SEQ ID NO: 1478394 - DNA, 14 bp, Homo sapiens
ctctgtgccttggt

SEQ ID NO: 1478395 - DNA, 15 bp, Homo sapiens
ctctgtgctctgaat

SEQ ID NO: 1478396 - DNA, 12 bp, Homo sapiens
ctctgtgcttcg

SEQ ID NO: 1478397 - DNA, 13 bp, Homo sapiens
ctctgtgcttcga

SEQ ID NO: 1478398 - DNA, 13 bp, Homo sapiens
ctctgtggcctgt

SEQ ID NO: 1478399 - DNA, 14 bp, Homo sapiens
ctctgtggcctgtg

SEQ ID NO: 1478400 - DNA, 16 bp, Homo sapiens
ctctgtggcctgtgtc

SEQ ID NO: 1478401 - DNA, 15 bp, Homo sapiens
ctctgtgtctaagat

SEQ ID NO: 1478402 - DNA, 21 bp, Homo sapiens
ctctgtgtctaagattctaga

SEQ ID NO: 1478403 - DNA, 22 bp, Homo sapiens
ctctgtgtctaagattctagat

SEQ ID NO: 1478404 - DNA, 15 bp, Homo sapiens
ctctgttaacatcta

SEQ ID NO: 1478405 - DNA, 16 bp, Homo sapiens
ctctgttacactaatt

SEQ ID NO: 1478406 - DNA, 19 bp, Homo sapiens
ctctgttacccaggctgga

SEQ ID NO: 1478407 - DNA, 15 bp, Homo sapiens
ctctgttcaaagctg

SEQ ID NO: 1478408 - DNA, 22 bp, Homo sapiens
ctctgttcaaagctgcctgtcc

SEQ ID NO: 1478409 - DNA, 11 bp, Homo sapiens
ctctgttcaca

SEQ ID NO: 1478410 - DNA, 15 bp, Homo sapiens
ctctgttcacagtct

SEQ ID NO: 1478411 - DNA, 21 bp, Homo sapiens
ctctgttcacagtctctggaa

SEQ ID NO: 1478412 - DNA, 20 bp, Homo sapiens
ctctgttcagatgtgcattt

SEQ ID NO: 1478413 - DNA, 13 bp, Homo sapiens
ctctgttccccca

SEQ ID NO: 1478414 - DNA, 16 bp, Homo sapiens
ctctgttcccccaccc

SEQ ID NO: 1478415 - DNA, 21 bp, Homo sapiens
ctctgttcctttctctgggct

SEQ ID NO: 1478416 - DNA, 20 bp, Homo sapiens
ctctgttgcaagtgcaataa

SEQ ID NO: 1478417 - DNA, 20 bp, Homo sapiens
ctctgttgtcctccccttgg

SEQ ID NO: 1478418 - DNA, 20 bp, Homo sapiens
ctctgtttcttcctttctgt

SEQ ID NO: 1478419 - DNA, 23 bp, Homo sapiens
ctctgtttgatgctatttatgca

SEQ ID NO: 1478420 - DNA, 18 bp, Homo sapiens
ctctgtttgtgggactgg

SEQ ID NO: 1478421 - DNA, 18 bp, Homo sapiens
ctcttaaattatatattt

SEQ ID NO: 1478422 - DNA, 21 bp, Homo sapiens
ctcttaacactggttaaatta

SEQ ID NO: 1478423 - DNA, 14 bp, Homo sapiens
ctcttaatgtgcag

SEQ ID NO: 1478424 - DNA, 17 bp, Homo sapiens
ctcttaattgttcattt

SEQ ID NO: 1478425 - DNA, 20 bp, Homo sapiens
ctcttactctttcctatttc

SEQ ID NO: 1478426 - DNA, 23 bp, Homo sapiens
ctcttactttgcttgagaatcct

SEQ ID NO: 1478427 - DNA, 22 bp, Homo sapiens
ctcttagaaaaggtgataaaat

SEQ ID NO: 1478428 - DNA, 13 bp, Homo sapiens
ctcttagaaatac

SEQ ID NO: 1478429 - DNA, 15 bp, Homo sapiens
ctcttagaacattgt

SEQ ID NO: 1478430 - DNA, 16 bp, Homo sapiens
ctcttagctactgtat

SEQ ID NO: 1478431 - DNA, 15 bp, Homo sapiens
ctcttagctcccctc

SEQ ID NO: 1478432 - DNA, 19 bp, Homo sapiens
ctcttagctcccctccaac

SEQ ID NO: 1478433 - DNA, 19 bp, Homo sapiens
ctcttagcttacaggaagc

SEQ ID NO: 1478434 - DNA, 18 bp, Homo sapiens
ctcttagctttctcaggg

SEQ ID NO: 1478435 - DNA, 16 bp, Homo sapiens
ctcttatagaatattt

SEQ ID NO: 1478436 - DNA, 15 bp, Homo sapiens
ctcttatcctctctc

SEQ ID NO: 1478437 - DNA, 22 bp, Homo sapiens
ctcttatcctctctctcttcta

SEQ ID NO: 1478438 - DNA, 17 bp, Homo sapiens
ctcttatgcacacctcc

SEQ ID NO: 1478439 - DNA, 12 bp, Homo sapiens
ctcttattctaa

SEQ ID NO: 1478440 - DNA, 15 bp, Homo sapiens
ctcttattttacaat

SEQ ID NO: 1478441 - DNA, 21 bp, Homo sapiens
ctcttattttttaaaaaattt

SEQ ID NO: 1478442 - DNA, 15 bp, Homo sapiens
ctcttcaatctctgg

SEQ ID NO: 1478443 - DNA, 14 bp, Homo sapiens
ctcttcaatctctt

SEQ ID NO: 1478444 - DNA, 17 bp, Homo sapiens
ctcttcactaccctgat

SEQ ID NO: 1478445 - DNA, 11 bp, Homo sapiens
ctcttcagaaa

SEQ ID NO: 1478446 - DNA, 13 bp, Homo sapiens
ctcttcagaacac

SEQ ID NO: 1478447 - DNA, 14 bp, Homo sapiens
ctcttcagatgcca

SEQ ID NO: 1478448 - DNA, 23 bp, Homo sapiens
ctcttcagcccctagtgctattc

SEQ ID NO: 1478449 - DNA, 19 bp, Homo sapiens
ctcttcaggaggccctggt

SEQ ID NO: 1478450 - DNA, 15 bp, Homo sapiens
ctcttcaggcctccc

SEQ ID NO: 1478451 - DNA, 16 bp, Homo sapiens
ctcttcaggcctccct

SEQ ID NO: 1478452 - DNA, 20 bp, Homo sapiens
ctcttcaggcctccctctct

SEQ ID NO: 1478453 - DNA, 15 bp, Homo sapiens
ctcttcaggttctca

SEQ ID NO: 1478454 - DNA, 22 bp, Homo sapiens
ctcttcaggttcttagtgtcac

SEQ ID NO: 1478455 - DNA, 18 bp, Homo sapiens
ctcttcagttaattctta

SEQ ID NO: 1478456 - DNA, 17 bp, Homo sapiens
ctcttcatgcttgacat

SEQ ID NO: 1478457 - DNA, 17 bp, Homo sapiens
ctcttccactccttctc

SEQ ID NO: 1478458 - DNA, 19 bp, Homo sapiens
ctcttccagtcttcctgac

SEQ ID NO: 1478459 - DNA, 15 bp, Homo sapiens
ctcttccatgctgtg

SEQ ID NO: 1478460 - DNA, 14 bp, Homo sapiens
ctcttcccccaaga

SEQ ID NO: 1478461 - DNA, 19 bp, Homo sapiens
ctcttcccccatgtgcctg

SEQ ID NO: 1478462 - DNA, 13 bp, Homo sapiens
ctcttccccttcc

SEQ ID NO: 1478463 - DNA, 15 bp, Homo sapiens
ctcttccccttcctg

SEQ ID NO: 1478464 - DNA, 16 bp, Homo sapiens
ctcttccccttcctgt

SEQ ID NO: 1478465 - DNA, 16 bp, Homo sapiens
ctcttccctctccctc

SEQ ID NO: 1478466 - DNA, 19 bp, Homo sapiens
ctcttccctctcgctcccc

SEQ ID NO: 1478467 - DNA, 13 bp, Homo sapiens
ctcttccctctgg

SEQ ID NO: 1478468 - DNA, 14 bp, Homo sapiens
ctcttccctctggg

SEQ ID NO: 1478469 - DNA, 15 bp, Homo sapiens
ctcttccctgaacgt

SEQ ID NO: 1478470 - DNA, 20 bp, Homo sapiens
ctcttccctgaacgttttct

SEQ ID NO: 1478471 - DNA, 20 bp, Homo sapiens
ctcttccctgaacttcctgc

SEQ ID NO: 1478472 - DNA, 17 bp, Homo sapiens
ctcttcccttcccagac

SEQ ID NO: 1478473 - DNA, 14 bp, Homo sapiens
ctcttcccttctcc

SEQ ID NO: 1478474 - DNA, 22 bp, Homo sapiens
ctcttcctacccaaccactcaa

SEQ ID NO: 1478475 - DNA, 19 bp, Homo sapiens
ctcttcctagatctgcagg

SEQ ID NO: 1478476 - DNA, 20 bp, Homo sapiens
ctcttcctatccctctccta

SEQ ID NO: 1478477 - DNA, 15 bp, Homo sapiens
ctcttcctccctggg

SEQ ID NO: 1478478 - DNA, 13 bp, Homo sapiens
ctcttcctctggt

SEQ ID NO: 1478479 - DNA, 13 bp, Homo sapiens
ctcttcctggacc

SEQ ID NO: 1478480 - DNA, 12 bp, Homo sapiens
ctcttcctgtct

SEQ ID NO: 1478481 - DNA, 17 bp, Homo sapiens
ctcttcctgtgatccac

SEQ ID NO: 1478482 - DNA, 17 bp, Homo sapiens
ctcttcggtttctgagc

SEQ ID NO: 1478483 - DNA, 23 bp, Homo sapiens
ctcttctagatggaccccagcat

SEQ ID NO: 1478484 - DNA, 12 bp, Homo sapiens
ctcttctcattt

SEQ ID NO: 1478485 - DNA, 15 bp, Homo sapiens
ctcttctcatttcac

SEQ ID NO: 1478486 - DNA, 14 bp, Homo sapiens
ctcttctccactgg

SEQ ID NO: 1478487 - DNA, 13 bp, Homo sapiens
ctcttctctccag

SEQ ID NO: 1478488 - DNA, 17 bp, Homo sapiens
ctcttctgacgtgcctt

SEQ ID NO: 1478489 - DNA, 22 bp, Homo sapiens
ctcttctgagctatttcatcta

SEQ ID NO: 1478490 - DNA, 13 bp, Homo sapiens
ctcttctgctcca

SEQ ID NO: 1478491 - DNA, 15 bp, Homo sapiens
ctcttctgctccacc

SEQ ID NO: 1478492 - DNA, 16 bp, Homo sapiens
ctcttctgctccaccc

SEQ ID NO: 1478493 - DNA, 19 bp, Homo sapiens
ctcttctgctccacccttg

SEQ ID NO: 1478494 - DNA, 12 bp, Homo sapiens
ctcttctgctct

SEQ ID NO: 1478495 - DNA, 19 bp, Homo sapiens
ctcttctggggcaggctgg

SEQ ID NO: 1478496 - DNA, 14 bp, Homo sapiens
ctcttcttctgaag

SEQ ID NO: 1478497 - DNA, 16 bp, Homo sapiens
ctcttcttctgaagat

SEQ ID NO: 1478498 - DNA, 22 bp, Homo sapiens
ctcttcttggggcccagtgcat

SEQ ID NO: 1478499 - DNA, 17 bp, Homo sapiens
ctcttctttagaacagg

SEQ ID NO: 1478500 - DNA, 16 bp, Homo sapiens
ctcttcttttggcttc

SEQ ID NO: 1478501 - DNA, 14 bp, Homo sapiens
ctcttgaaaagttc

SEQ ID NO: 1478502 - DNA, 20 bp, Homo sapiens
ctcttgaagtccaggactgg

SEQ ID NO: 1478503 - DNA, 14 bp, Homo sapiens
ctcttgaccaggct

SEQ ID NO: 1478504 - DNA, 19 bp, Homo sapiens
ctgaagtcacatcacagga

SEQ ID NO: 1478505 - DNA, 17 bp, Homo sapiens
ctgaagtcactgcacag

SEQ ID NO: 1478506 - DNA, 16 bp, Homo sapiens
ctgaagtgcttagtgt

SEQ ID NO: 1478507 - DNA, 22 bp, Homo sapiens
ctgaagtggtttgcaggtcagc

SEQ ID NO: 1478508 - DNA, 23 bp, Homo sapiens
ctgaagtggtttgcaggtcagcc

SEQ ID NO: 1478509 - DNA, 12 bp, Homo sapiens
ctgaagtgttct

SEQ ID NO: 1478510 - DNA, 17 bp, Homo sapiens
ctgaagtgttctctaga

SEQ ID NO: 1478511 - DNA, 18 bp, Homo sapiens
ctgaagtgttctctagaa

SEQ ID NO: 1478512 - DNA, 19 bp, Homo sapiens
ctgaagttcagccaccctg

SEQ ID NO: 1478513 - DNA, 15 bp, Homo sapiens
ctgaagttctgagcc

SEQ ID NO: 1478514 - DNA, 15 bp, Homo sapiens
ctgaagttgaacatg

SEQ ID NO: 1478515 - DNA, 17 bp, Homo sapiens
ctgaagttgcagatgtt

SEQ ID NO: 1478516 - DNA, 18 bp, Homo sapiens
ctgaagttgcagatgtta

SEQ ID NO: 1478517 - DNA, 17 bp, Homo sapiens
ctgaagtttttttgctg

SEQ ID NO: 1478518 - DNA, 18 bp, Homo sapiens
ctgaataaagtgtaacaa

SEQ ID NO: 1478519 - DNA, 22 bp, Homo sapiens
ctgaataaatacccattgaact

SEQ ID NO: 1478520 - DNA, 12 bp, Homo sapiens
ctgaataaatgg

SEQ ID NO: 1478521 - DNA, 21 bp, Homo sapiens
ctgaataatatcaaataaaat

SEQ ID NO: 1478522 - DNA, 14 bp, Homo sapiens
ctgaataatgctac

SEQ ID NO: 1478523 - DNA, 15 bp, Homo sapiens
ctgaataatttctta

SEQ ID NO: 1478524 - DNA, 15 bp, Homo sapiens
ctgaatattctagaa

SEQ ID NO: 1478525 - DNA, 20 bp, Homo sapiens
ctgaatatttatatttcact

SEQ ID NO: 1478526 - DNA, 11 bp, Homo sapiens
ctgaatatttt

SEQ ID NO: 1478527 - DNA, 20 bp, Homo sapiens
ctgaatcagccagtctcaga

SEQ ID NO: 1478528 - DNA, 13 bp, Homo sapiens
ctgaatcatgagc

SEQ ID NO: 1478529 - DNA, 18 bp, Homo sapiens
ctgaatcatgagcctgct

SEQ ID NO: 1478530 - DNA, 20 bp, Homo sapiens
ctgaatccaaactaatccat

SEQ ID NO: 1478531 - DNA, 22 bp, Homo sapiens
ctgaatctgctaccaaaacagt

SEQ ID NO: 1478532 - DNA, 13 bp, Homo sapiens
ctgaatcttcacg

SEQ ID NO: 1478533 - DNA, 23 bp, Homo sapiens
ctgaatcttcacgacaatgttga

SEQ ID NO: 1478534 - DNA, 12 bp, Homo sapiens
ctgaatcttctg

SEQ ID NO: 1478535 - DNA, 20 bp, Homo sapiens
ctgaatgaggtcagcatgtc

SEQ ID NO: 1478536 - DNA, 18 bp, Homo sapiens
ctgaatgatcctgtctct

SEQ ID NO: 1478537 - DNA, 19 bp, Homo sapiens
ctgaatgcctcgctccctt

SEQ ID NO: 1478538 - DNA, 21 bp, Homo sapiens
ctgaatgcctcgctcccttca

SEQ ID NO: 1478539 - DNA, 17 bp, Homo sapiens
ctgaatgctctgtgcga

SEQ ID NO: 1478540 - DNA, 15 bp, Homo sapiens
ctgaatgcttctgag

SEQ ID NO: 1478541 - DNA, 18 bp, Homo sapiens
ctgaatgcttctgagagc

SEQ ID NO: 1478542 - DNA, 20 bp, Homo sapiens
ctgaatggttttcaaaataa

SEQ ID NO: 1478543 - DNA, 21 bp, Homo sapiens
ctgaatgtatcctagctgaca

SEQ ID NO: 1478544 - DNA, 12 bp, Homo sapiens
ctgaatgtatgt

SEQ ID NO: 1478545 - DNA, 18 bp, Homo sapiens
ctgaatgtatgtcagtgc

SEQ ID NO: 1478546 - DNA, 16 bp, Homo sapiens
ctgaatgtcaagaaaa

SEQ ID NO: 1478547 - DNA, 17 bp, Homo sapiens
ctgaattaatcatctat

SEQ ID NO: 1478548 - DNA, 21 bp, Homo sapiens
ctgaattaatgacagagccag

SEQ ID NO: 1478549 - DNA, 22 bp, Homo sapiens
ctgaattacagtgaaattttgg

SEQ ID NO: 1478550 - DNA, 19 bp, Homo sapiens
ctgaattcactccagtcaa

SEQ ID NO: 1478551 - DNA, 23 bp, Homo sapiens
ctgaattcactccagtcaacaga

SEQ ID NO: 1478552 - DNA, 19 bp, Homo sapiens
ctgaattcacttaagtttt

SEQ ID NO: 1478553 - DNA, 19 bp, Homo sapiens
ctgaattggcttccagatt

SEQ ID NO: 1478554 - DNA, 20 bp, Homo sapiens
ctgaattggcttccagattt

SEQ ID NO: 1478555 - DNA, 20 bp, Homo sapiens
ctgaatttcaggcattttgt

SEQ ID NO: 1478556 - DNA, 22 bp, Homo sapiens
ctgaatttcaggcattttgttc

SEQ ID NO: 1478557 - DNA, 12 bp, Homo sapiens
ctgaatttggag

SEQ ID NO: 1478558 - DNA, 21 bp, Homo sapiens
ctgaatttggcctgcactaat

SEQ ID NO: 1478559 - DNA, 15 bp, Homo sapiens
ctgaatttttttgta

SEQ ID NO: 1478560 - DNA, 16 bp, Homo sapiens
ctgaatttttttgtaa

SEQ ID NO: 1478561 - DNA, 17 bp, Homo sapiens
ctgaatttttttgtaat

SEQ ID NO: 1478562 - DNA, 18 bp, Homo sapiens
ctgacaaaaatattttcc

SEQ ID NO: 1478563 - DNA, 17 bp, Homo sapiens
ctgacaaacgtccccag

SEQ ID NO: 1478564 - DNA, 18 bp, Homo sapiens
ctgacaaacgtccccagc

SEQ ID NO: 1478565 - DNA, 20 bp, Homo sapiens
ctgacaaacgtccccagcgg

SEQ ID NO: 1478566 - DNA, 18 bp, Homo sapiens
ctgacaaccactggtctg

SEQ ID NO: 1478567 - DNA, 19 bp, Homo sapiens
ctgacaaccattaaagtca

SEQ ID NO: 1478568 - DNA, 20 bp, Homo sapiens
ctgacaaccattaaagtcag

SEQ ID NO: 1478569 - DNA, 22 bp, Homo sapiens
ctgacaaccattaaagtcagaa

SEQ ID NO: 1478570 - DNA, 22 bp, Homo sapiens
ctgacaacttagctcaggtgcc

SEQ ID NO: 1478571 - DNA, 14 bp, Homo sapiens
ctgacaagggctga

SEQ ID NO: 1478572 - DNA, 12 bp, Homo sapiens
ctgacaataaag

SEQ ID NO: 1478573 - DNA, 21 bp, Homo sapiens
ctgacaataaagatatttcca

SEQ ID NO: 1478574 - DNA, 13 bp, Homo sapiens
ctgacaatcaact

SEQ ID NO: 1478575 - DNA, 21 bp, Homo sapiens
ctgacaatcaactctaatagt

SEQ ID NO: 1478576 - DNA, 17 bp, Homo sapiens
ctgacaatggcagctag

SEQ ID NO: 1478577 - DNA, 19 bp, Homo sapiens
ctgacacactaaccaagct

SEQ ID NO: 1478578 - DNA, 20 bp, Homo sapiens
ctgacacactaaccaagctg

SEQ ID NO: 1478579 - DNA, 22 bp, Homo sapiens
ctgacacactaaccaagctgag

SEQ ID NO: 1478580 - DNA, 13 bp, Homo sapiens
ctgacacaggaaa

SEQ ID NO: 1478581 - DNA, 22 bp, Homo sapiens
ctgacacagtgctcgaccttga

SEQ ID NO: 1478582 - DNA, 17 bp, Homo sapiens
ctgacaccccctccccg

SEQ ID NO: 1478583 - DNA, 17 bp, Homo sapiens
ctgacaccgtccctcag

SEQ ID NO: 1478584 - DNA, 19 bp, Homo sapiens
ctgacaccgtccctcagtg

SEQ ID NO: 1478585 - DNA, 20 bp, Homo sapiens
ctgacaccgtccctcagtga

SEQ ID NO: 1478586 - DNA, 20 bp, Homo sapiens
ctgacacgaagccagcagag

SEQ ID NO: 1478587 - DNA, 18 bp, Homo sapiens
ctgacacgcagcctgctc

SEQ ID NO: 1478588 - DNA, 20 bp, Homo sapiens
ctgacacgcagcctgctctg

SEQ ID NO: 1478589 - DNA, 20 bp, Homo sapiens
ctgacactgtgtaagaagct

SEQ ID NO: 1478590 - DNA, 21 bp, Homo sapiens
ctgacagaaggtgccacttta

SEQ ID NO: 1478591 - DNA, 16 bp, Homo sapiens
ctgacagagctctggg

SEQ ID NO: 1478592 - DNA, 15 bp, Homo sapiens
ctgacagatttccat

SEQ ID NO: 1478593 - DNA, 14 bp, Homo sapiens
ctgacagcctccca

SEQ ID NO: 1478594 - DNA, 20 bp, Homo sapiens
ctgacagcctcccaccccca

SEQ ID NO: 1478595 - DNA, 14 bp, Homo sapiens
ctgacagggagcag

SEQ ID NO: 1478596 - DNA, 15 bp, Homo sapiens
ctgacagtcagctgt

SEQ ID NO: 1478597 - DNA, 18 bp, Homo sapiens
ctgacagtcagctgtggg

SEQ ID NO: 1478598 - DNA, 14 bp, Homo sapiens
ctgacagtccacag

SEQ ID NO: 1478599 - DNA, 17 bp, Homo sapiens
ctgacagtccacagggg

SEQ ID NO: 1478600 - DNA, 19 bp, Homo sapiens
ctgacagtttacagacgct

SEQ ID NO: 1478601 - DNA, 20 bp, Homo sapiens
ctgacatcatcattcttgtg

SEQ ID NO: 1478602 - DNA, 23 bp, Homo sapiens
ctgacatcatcattcttgtggga

SEQ ID NO: 1478603 - DNA, 16 bp, Homo sapiens
ctgacatcccttcctg

SEQ ID NO: 1478604 - DNA, 17 bp, Homo sapiens
ctgacatcccttcctgg

SEQ ID NO: 1478605 - DNA, 21 bp, Homo sapiens
ctgacatcccttcctggaaac

SEQ ID NO: 1478606 - DNA, 16 bp, Homo sapiens
ctgacatctggaatct

SEQ ID NO: 1478607 - DNA, 13 bp, Homo sapiens
ctgacatcttgaa

SEQ ID NO: 1478608 - DNA, 21 bp, Homo sapiens
ctgacatcttgaatccttcca

SEQ ID NO: 1478609 - DNA, 13 bp, Homo sapiens
ctgacatgctcac

SEQ ID NO: 1478610 - DNA, 17 bp, Homo sapiens
ctgacatgctcacacat

SEQ ID NO: 1478611 - DNA, 19 bp, Homo sapiens
ctgacatggacccactacc

SEQ ID NO: 1478612 - DNA, 23 bp, Homo sapiens
ctgaccaaatggccagttttctg

SEQ ID NO: 1478613 - DNA, 12 bp, Homo sapiens
ctgaccaacagg

SEQ ID NO: 1478614 - DNA, 14 bp, Homo sapiens
ctgaccaacaggct

SEQ ID NO: 1478615 - DNA, 14 bp, Homo sapiens
ctgaccaagtttct

SEQ ID NO: 1478616 - DNA, 20 bp, Homo sapiens
ctgaccaattgtgctgccat

SEQ ID NO: 1478617 - DNA, 20 bp, Homo sapiens
ctgaccacaccaaccaggcc

SEQ ID NO: 1478618 - DNA, 19 bp, Homo sapiens
ctgagaaggccagccctcc

SEQ ID NO: 1478619 - DNA, 22 bp, Homo sapiens
ctgagaaggccagccctccctg

SEQ ID NO: 1478620 - DNA, 17 bp, Homo sapiens
ctgagaaggccctgtgc

SEQ ID NO: 1478621 - DNA, 23 bp, Homo sapiens
ctgagaaggtccttaatgatccg

SEQ ID NO: 1478622 - DNA, 16 bp, Homo sapiens
ctgagaatgagtggga

SEQ ID NO: 1478623 - DNA, 22 bp, Homo sapiens
ctgagaatgagtgggaatccgg

SEQ ID NO: 1478624 - DNA, 19 bp, Homo sapiens
ctgagaatgtaagaactac

SEQ ID NO: 1478625 - DNA, 14 bp, Homo sapiens
ctgagacactgaag

SEQ ID NO: 1478626 - DNA, 23 bp, Homo sapiens
ctgagaccagttgggagcactgg

SEQ ID NO: 1478627 - DNA, 22 bp, Homo sapiens
ctgagaccctactgaagtggct

SEQ ID NO: 1478628 - DNA, 23 bp, Homo sapiens
ctgagaccctactgaagtggctg

SEQ ID NO: 1478629 - DNA, 15 bp, Homo sapiens
ctgagacccttttct

SEQ ID NO: 1478630 - DNA, 18 bp, Homo sapiens
ctgagacccttttctcag

SEQ ID NO: 1478631 - DNA, 19 bp, Homo sapiens
ctgagacctgggatttgag

SEQ ID NO: 1478632 - DNA, 12 bp, Homo sapiens
ctgagactccag

SEQ ID NO: 1478633 - DNA, 13 bp, Homo sapiens
ctgagactccaga

SEQ ID NO: 1478634 - DNA, 17 bp, Homo sapiens
ctgagactccagaatct

SEQ ID NO: 1478635 - DNA, 20 bp, Homo sapiens
ctgagactccagaatctgct

SEQ ID NO: 1478636 - DNA, 23 bp, Homo sapiens
ctgagactccggggagcgcccgc

SEQ ID NO: 1478637 - DNA, 14 bp, Homo sapiens
ctgagactgcggga

SEQ ID NO: 1478638 - DNA, 21 bp, Homo sapiens
ctgagactttcagtgcactgt

SEQ ID NO: 1478639 - DNA, 18 bp, Homo sapiens
ctgagactttcccctctc

SEQ ID NO: 1478640 - DNA, 18 bp, Homo sapiens
ctgagagacctgccctct

SEQ ID NO: 1478641 - DNA, 12 bp, Homo sapiens
ctgagagccagg

SEQ ID NO: 1478642 - DNA, 14 bp, Homo sapiens
ctgagagccctgct

SEQ ID NO: 1478643 - DNA, 20 bp, Homo sapiens
ctgagagccctgctgtggga

SEQ ID NO: 1478644 - DNA, 21 bp, Homo sapiens
ctgagagccctgctgtgggag

SEQ ID NO: 1478645 - DNA, 22 bp, Homo sapiens
ctgagaggctctccgtgcaggc

SEQ ID NO: 1478646 - DNA, 16 bp, Homo sapiens
ctgagagggcaaggaa

SEQ ID NO: 1478647 - DNA, 18 bp, Homo sapiens
ctgagagggcaaggaagt

SEQ ID NO: 1478648 - DNA, 20 bp, Homo sapiens
ctgagagtatttaggcagat

SEQ ID NO: 1478649 - DNA, 22 bp, Homo sapiens
ctgagagtcagctctctgccct

SEQ ID NO: 1478650 - DNA, 22 bp, Homo sapiens
ctgagagtctagattctctggc

SEQ ID NO: 1478651 - DNA, 18 bp, Homo sapiens
ctgagagttggctcaggc

SEQ ID NO: 1478652 - DNA, 19 bp, Homo sapiens
ctgagagttggctcaggca

SEQ ID NO: 1478653 - DNA, 20 bp, Homo sapiens
ctgagagttggctcaggcag

SEQ ID NO: 1478654 - DNA, 22 bp, Homo sapiens
ctgagagttggctcaggcagac

SEQ ID NO: 1478655 - DNA, 17 bp, Homo sapiens
ctgagatacttcccaaa

SEQ ID NO: 1478656 - DNA, 16 bp, Homo sapiens
ctgagatatgaacata

SEQ ID NO: 1478657 - DNA, 23 bp, Homo sapiens
ctgagatatgaacatattgttga

SEQ ID NO: 1478658 - DNA, 15 bp, Homo sapiens
ctgagatgcaggtga

SEQ ID NO: 1478659 - DNA, 16 bp, Homo sapiens
ctgagatgcaggtgat

SEQ ID NO: 1478660 - DNA, 23 bp, Homo sapiens
ctgagatggaggtttccttttgg

SEQ ID NO: 1478661 - DNA, 18 bp, Homo sapiens
ctgagatggagtgagctg

SEQ ID NO: 1478662 - DNA, 21 bp, Homo sapiens
ctgagatgtgaacacatcagc

SEQ ID NO: 1478663 - DNA, 18 bp, Homo sapiens
ctgagattctttaaggag

SEQ ID NO: 1478664 - DNA, 22 bp, Homo sapiens
ctgagattctttaaggagatag

SEQ ID NO: 1478665 - DNA, 14 bp, Homo sapiens
ctgagattgtgttt

SEQ ID NO: 1478666 - DNA, 16 bp, Homo sapiens
ctgagatttcatctgc

SEQ ID NO: 1478667 - DNA, 19 bp, Homo sapiens
ctgagatttcatctgctct

SEQ ID NO: 1478668 - DNA, 21 bp, Homo sapiens
ctgagatttcatctgctctcc

SEQ ID NO: 1478669 - DNA, 22 bp, Homo sapiens
ctgagatttcatctgctctcct

SEQ ID NO: 1478670 - DNA, 20 bp, Homo sapiens
ctgagcaaatattaaaattg

SEQ ID NO: 1478671 - DNA, 21 bp, Homo sapiens
ctgagcaaatattaaaattgt

SEQ ID NO: 1478672 - DNA, 20 bp, Homo sapiens
ctgagcaagaccctgtctct

SEQ ID NO: 1478673 - DNA, 15 bp, Homo sapiens
ctgagcaagatcttg

SEQ ID NO: 1478674 - DNA, 16 bp, Homo sapiens
ctgagcaagatcttgt

SEQ ID NO: 1478675 - DNA, 20 bp, Homo sapiens
ctgagcaagatcttgtctcc

SEQ ID NO: 1478676 - DNA, 22 bp, Homo sapiens
ctgagcaagatcttgtctccac

SEQ ID NO: 1478677 - DNA, 24 bp, Homo sapiens
ctgagcaaggagtttaaatgagac

SEQ ID NO: 1478678 - DNA, 17 bp, Homo sapiens
ctgagcaatctgaccct

SEQ ID NO: 1478679 - DNA, 19 bp, Homo sapiens
ctgagcaatgtctgtgcta

SEQ ID NO: 1478680 - DNA, 18 bp, Homo sapiens
ctgagcacccgctgacat

SEQ ID NO: 1478681 - DNA, 17 bp, Homo sapiens
ctgagcaccctctggat

SEQ ID NO: 1478682 - DNA, 17 bp, Homo sapiens
ctgagcaccgtgtcaag

SEQ ID NO: 1478683 - DNA, 15 bp, Homo sapiens
ctgagcacctcccag

SEQ ID NO: 1478684 - DNA, 17 bp, Homo sapiens
ctgagcacctcccagcc

SEQ ID NO: 1478685 - DNA, 21 bp, Homo sapiens
ctgagcacctcccagcccctg

SEQ ID NO: 1478686 - DNA, 22 bp, Homo sapiens
ctgagcacctcccagcccctgc

SEQ ID NO: 1478687 - DNA, 20 bp, Homo sapiens
ctgagcacttagcaggcacc

SEQ ID NO: 1478688 - DNA, 16 bp, Homo sapiens
ctgagcagaatactgg

SEQ ID NO: 1478689 - DNA, 17 bp, Homo sapiens
ctgagcagaatactggt

SEQ ID NO: 1478690 - DNA, 18 bp, Homo sapiens
ctgagcagcctctgccag

SEQ ID NO: 1478691 - DNA, 13 bp, Homo sapiens
ctgagcagggtcc

SEQ ID NO: 1478692 - DNA, 16 bp, Homo sapiens
ctgagcagggtccaca

SEQ ID NO: 1478693 - DNA, 21 bp, Homo sapiens
ctgagcagggtccacagctgg

SEQ ID NO: 1478694 - DNA, 12 bp, Homo sapiens
ctgagcaggtgt

SEQ ID NO: 1478695 - DNA, 17 bp, Homo sapiens
ctgagcatggggcgctc

SEQ ID NO: 1478696 - DNA, 23 bp, Homo sapiens
ctgagcatggggcgctcccactc

SEQ ID NO: 1478697 - DNA, 13 bp, Homo sapiens
ctgagccacagtg

SEQ ID NO: 1478698 - DNA, 11 bp, Homo sapiens
ctgagccaggg

SEQ ID NO: 1478699 - DNA, 14 bp, Homo sapiens
ctgagccagggaac

SEQ ID NO: 1478700 - DNA, 16 bp, Homo sapiens
ctgagccagggaacag

SEQ ID NO: 1478701 - DNA, 18 bp, Homo sapiens
ctgagccagtcccagggg

SEQ ID NO: 1478702 - DNA, 19 bp, Homo sapiens
ctgagccagtcccaggggc

SEQ ID NO: 1478703 - DNA, 22 bp, Homo sapiens
ctgagccatgaggagcgtggac

SEQ ID NO: 1478704 - DNA, 16 bp, Homo sapiens
ctgagcccagagaagc

SEQ ID NO: 1478705 - DNA, 11 bp, Homo sapiens
ctgagcccagg

SEQ ID NO: 1478706 - DNA, 15 bp, Homo sapiens
ctgagcccaggccgt

SEQ ID NO: 1478707 - DNA, 23 bp, Homo sapiens
ctgagcccatacttttggctcct

SEQ ID NO: 1478708 - DNA, 21 bp, Homo sapiens
ctgagccccccatgcccctcc

SEQ ID NO: 1478709 - DNA, 22 bp, Homo sapiens
ctgagcccccggctagtaccct

SEQ ID NO: 1478710 - DNA, 15 bp, Homo sapiens
ctgagccccctgcac

SEQ ID NO: 1478711 - DNA, 17 bp, Homo sapiens
ctgagccccctgcaccc

SEQ ID NO: 1478712 - DNA, 13 bp, Homo sapiens
ctgagcccctacc

SEQ ID NO: 1478713 - DNA, 19 bp, Homo sapiens
ctgagcccctaccccacac

SEQ ID NO: 1478714 - DNA, 22 bp, Homo sapiens
ctgagcccctaccccacaccag

SEQ ID NO: 1478715 - DNA, 13 bp, Homo sapiens
ctgagcccctggg

SEQ ID NO: 1478716 - DNA, 15 bp, Homo sapiens
ctgagcccctgggga

SEQ ID NO: 1478717 - DNA, 16 bp, Homo sapiens
ctgagcccctggggaa

SEQ ID NO: 1478718 - DNA, 14 bp, Homo sapiens
ctgagcccgggctg

SEQ ID NO: 1478719 - DNA, 15 bp, Homo sapiens
ctgagcccgggctgc

SEQ ID NO: 1478720 - DNA, 17 bp, Homo sapiens
ctgagcccgggctgcct

SEQ ID NO: 1478721 - DNA, 18 bp, Homo sapiens
ctgagcccgggctgcctg

SEQ ID NO: 1478722 - DNA, 21 bp, Homo sapiens
ctgagcccgggctgcctgggc

SEQ ID NO: 1478723 - DNA, 20 bp, Homo sapiens
ctgagccctactccctgcag

SEQ ID NO: 1478724 - DNA, 23 bp, Homo sapiens
ctgagccctactccctgcagatg

SEQ ID NO: 1478725 - DNA, 11 bp, Homo sapiens
ctgagccctgg

SEQ ID NO: 1478726 - DNA, 12 bp, Homo sapiens
ctgagccctggc

SEQ ID NO: 1478727 - DNA, 16 bp, Homo sapiens
ctgagccggccccagg

SEQ ID NO: 1478728 - DNA, 19 bp, Homo sapiens
ctgagccggccccaggctc

SEQ ID NO: 1478729 - DNA, 17 bp, Homo sapiens
ctgagcctacagatgaa

SEQ ID NO: 1478730 - DNA, 18 bp, Homo sapiens
ctgagcctacagatgaac

SEQ ID NO: 1478731 - DNA, 13 bp, Homo sapiens
ctgagcctgaggc

SEQ ID NO: 1478732 - DNA, 14 bp, Homo sapiens
ctgatgcccgttgt

SEQ ID NO: 1478733 - DNA, 23 bp, Homo sapiens
ctgatgctccctcccctgccctg

SEQ ID NO: 1478734 - DNA, 13 bp, Homo sapiens
ctgatgctgcccc

SEQ ID NO: 1478735 - DNA, 14 bp, Homo sapiens
ctgatgctgccccg

SEQ ID NO: 1478736 - DNA, 20 bp, Homo sapiens
ctgatggaccgggtgggcct

SEQ ID NO: 1478737 - DNA, 22 bp, Homo sapiens
ctgatggaccgggtgggcctgg

SEQ ID NO: 1478738 - DNA, 18 bp, Homo sapiens
ctgatggagccccacctt

SEQ ID NO: 1478739 - DNA, 15 bp, Homo sapiens
ctgatggagccttcc

SEQ ID NO: 1478740 - DNA, 14 bp, Homo sapiens
ctgatggaggaaaa

SEQ ID NO: 1478741 - DNA, 16 bp, Homo sapiens
ctgatggaggaaaaag

SEQ ID NO: 1478742 - DNA, 18 bp, Homo sapiens
ctgatggaggctgcagcg

SEQ ID NO: 1478743 - DNA, 21 bp, Homo sapiens
ctgatggattccaaaccagga

SEQ ID NO: 1478744 - DNA, 23 bp, Homo sapiens
ctgatggattccaaaccaggaca

SEQ ID NO: 1478745 - DNA, 13 bp, Homo sapiens
ctgatggccaaga

SEQ ID NO: 1478746 - DNA, 15 bp, Homo sapiens
ctgatggccaagggg

SEQ ID NO: 1478747 - DNA, 18 bp, Homo sapiens
ctgatggccaagggggtg

SEQ ID NO: 1478748 - DNA, 21 bp, Homo sapiens
ctgatggccaagggggtggac

SEQ ID NO: 1478749 - DNA, 16 bp, Homo sapiens
ctgatggcccctccag

SEQ ID NO: 1478750 - DNA, 18 bp, Homo sapiens
ctgatggcccctccagca

SEQ ID NO: 1478751 - DNA, 19 bp, Homo sapiens
ctgatggcccctccagcac

SEQ ID NO: 1478752 - DNA, 14 bp, Homo sapiens
ctgatggctcaaga

SEQ ID NO: 1478753 - DNA, 22 bp, Homo sapiens
ctgatggggaagggacttttat

SEQ ID NO: 1478754 - DNA, 17 bp, Homo sapiens
ctgatggtgagctggga

SEQ ID NO: 1478755 - DNA, 19 bp, Homo sapiens
ctgatggtgagctgggaag

SEQ ID NO: 1478756 - DNA, 19 bp, Homo sapiens
ctgatggtgctgctcaggc

SEQ ID NO: 1478757 - DNA, 20 bp, Homo sapiens
ctgatgtacaattaaaaacc

SEQ ID NO: 1478758 - DNA, 20 bp, Homo sapiens
ctgatgtactgaattccata

SEQ ID NO: 1478759 - DNA, 22 bp, Homo sapiens
ctgatgtcaatttctgtgttgc

SEQ ID NO: 1478760 - DNA, 15 bp, Homo sapiens
ctgatgttggaagag

SEQ ID NO: 1478761 - DNA, 12 bp, Homo sapiens
ctgatgttgtgt

SEQ ID NO: 1478762 - DNA, 13 bp, Homo sapiens
ctgatgtttctgt

SEQ ID NO: 1478763 - DNA, 20 bp, Homo sapiens
ctgattaaatatttgaagag

SEQ ID NO: 1478764 - DNA, 16 bp, Homo sapiens
ctgattacctgccaat

SEQ ID NO: 1478765 - DNA, 16 bp, Homo sapiens
ctgattactgtcaata

SEQ ID NO: 1478766 - DNA, 20 bp, Homo sapiens
ctgattactgtcaataaaca

SEQ ID NO: 1478767 - DNA, 17 bp, Homo sapiens
ctgattattttcttcat

SEQ ID NO: 1478768 - DNA, 17 bp, Homo sapiens
ctgattcacctcttcct

SEQ ID NO: 1478769 - DNA, 15 bp, Homo sapiens
ctgattcactgcatg

SEQ ID NO: 1478770 - DNA, 12 bp, Homo sapiens
ctgattccaaat

SEQ ID NO: 1478771 - DNA, 13 bp, Homo sapiens
ctgattccaaata

SEQ ID NO: 1478772 - DNA, 14 bp, Homo sapiens
ctgattctggcttt

SEQ ID NO: 1478773 - DNA, 22 bp, Homo sapiens
ctgattctggctttaagccttc

SEQ ID NO: 1478774 - DNA, 19 bp, Homo sapiens
ctgattctgggatgctcct

SEQ ID NO: 1478775 - DNA, 16 bp, Homo sapiens
ctgattcttgattcct

SEQ ID NO: 1478776 - DNA, 18 bp, Homo sapiens
ctgattcttgattcctgg

SEQ ID NO: 1478777 - DNA, 20 bp, Homo sapiens
ctgattcttgattcctggct

SEQ ID NO: 1478778 - DNA, 15 bp, Homo sapiens
ctgattcttgtaaat

SEQ ID NO: 1478779 - DNA, 13 bp, Homo sapiens
ctgattgatcaca

SEQ ID NO: 1478780 - DNA, 23 bp, Homo sapiens
ctgattggaattctttctgttga

SEQ ID NO: 1478781 - DNA, 15 bp, Homo sapiens
ctgattggacatttt

SEQ ID NO: 1478782 - DNA, 16 bp, Homo sapiens
ctgattggcatgtctg

SEQ ID NO: 1478783 - DNA, 17 bp, Homo sapiens
ctgattgggaggtgcgt

SEQ ID NO: 1478784 - DNA, 17 bp, Homo sapiens
ctgattggtgcaaccct

SEQ ID NO: 1478785 - DNA, 13 bp, Homo sapiens
ctgattgtattta

SEQ ID NO: 1478786 - DNA, 17 bp, Homo sapiens
ctgattgtgccagtgca

SEQ ID NO: 1478787 - DNA, 18 bp, Homo sapiens
ctgatttaggagaagcca

SEQ ID NO: 1478788 - DNA, 20 bp, Homo sapiens
ctgatttaggagaagccagg

SEQ ID NO: 1478789 - DNA, 16 bp, Homo sapiens
ctgatttattgaaatt

SEQ ID NO: 1478790 - DNA, 21 bp, Homo sapiens
ctgatttattgaaatttttct

SEQ ID NO: 1478791 - DNA, 13 bp, Homo sapiens
ctgatttcacaac

SEQ ID NO: 1478792 - DNA, 15 bp, Homo sapiens
ctgatttcagttttt

SEQ ID NO: 1478793 - DNA, 19 bp, Homo sapiens
ctgatttcagtttttcatt

SEQ ID NO: 1478794 - DNA, 15 bp, Homo sapiens
ctgatttccaggccc

SEQ ID NO: 1478795 - DNA, 16 bp, Homo sapiens
ctgatttccaggcccc

SEQ ID NO: 1478796 - DNA, 17 bp, Homo sapiens
ctgatttccaggcccct

SEQ ID NO: 1478797 - DNA, 19 bp, Homo sapiens
ctgatttccaggcccctga

SEQ ID NO: 1478798 - DNA, 13 bp, Homo sapiens
ctgatttcccctc

SEQ ID NO: 1478799 - DNA, 20 bp, Homo sapiens
ctgatttctacaactggagt

SEQ ID NO: 1478800 - DNA, 14 bp, Homo sapiens
ctgatttctctgaa

SEQ ID NO: 1478801 - DNA, 23 bp, Homo sapiens
ctgatttctctgaacagaaaaca

SEQ ID NO: 1478802 - DNA, 16 bp, Homo sapiens
ctgatttgctgctctt

SEQ ID NO: 1478803 - DNA, 17 bp, Homo sapiens
ctgatttgctgctcttc

SEQ ID NO: 1478804 - DNA, 14 bp, Homo sapiens
ctgatttggaaaaa

SEQ ID NO: 1478805 - DNA, 23 bp, Homo sapiens
ctgatttggtacttttgagtgtg

SEQ ID NO: 1478806 - DNA, 13 bp, Homo sapiens
ctgatttgtggaa

SEQ ID NO: 1478807 - DNA, 10 bp, Homo sapiens
ctgattttat

SEQ ID NO: 1478808 - DNA, 12 bp, Homo sapiens
ctgattttattc

SEQ ID NO: 1478809 - DNA, 16 bp, Homo sapiens
ctgattttattcttga

SEQ ID NO: 1478810 - DNA, 18 bp, Homo sapiens
ctgattttattcttgatc

SEQ ID NO: 1478811 - DNA, 20 bp, Homo sapiens
ctgattttctcactgaactc

SEQ ID NO: 1478812 - DNA, 18 bp, Homo sapiens
ctgattttgtagttaatt

SEQ ID NO: 1478813 - DNA, 14 bp, Homo sapiens
ctgatttttctctt

SEQ ID NO: 1478814 - DNA, 17 bp, Homo sapiens
ctgcaaaaaaagcctcc

SEQ ID NO: 1478815 - DNA, 19 bp, Homo sapiens
ctgcaaaaaaagcctccaa

SEQ ID NO: 1478816 - DNA, 22 bp, Homo sapiens
ctgcaaaaaaagcctccaaggg

SEQ ID NO: 1478817 - DNA, 16 bp, Homo sapiens
ctgcaaaaatgagttg

SEQ ID NO: 1478818 - DNA, 14 bp, Homo sapiens
ctgcaaaatgagac

SEQ ID NO: 1478819 - DNA, 18 bp, Homo sapiens
ctgcaaacctgacccctg

SEQ ID NO: 1478820 - DNA, 12 bp, Homo sapiens
ctgcaaagaaag

SEQ ID NO: 1478821 - DNA, 23 bp, Homo sapiens
ctgcaaagatctgtcctcagcct

SEQ ID NO: 1478822 - DNA, 20 bp, Homo sapiens
ctgcaaagctttggctgaga

SEQ ID NO: 1478823 - DNA, 22 bp, Homo sapiens
ctgcaaagctttggctgagacc

SEQ ID NO: 1478824 - DNA, 15 bp, Homo sapiens
ctgcaaatcaggctt

SEQ ID NO: 1478825 - DNA, 17 bp, Homo sapiens
ctgcaacatttgacaaa

SEQ ID NO: 1478826 - DNA, 16 bp, Homo sapiens
ctgcaaccccccagct

SEQ ID NO: 1478827 - DNA, 16 bp, Homo sapiens
ctgcaactagccaagg

SEQ ID NO: 1478828 - DNA, 17 bp, Homo sapiens
ctgcaactgctcagctc

SEQ ID NO: 1478829 - DNA, 22 bp, Homo sapiens
ctgcaacttccgcctcctgtgt

SEQ ID NO: 1478830 - DNA, 15 bp, Homo sapiens
ctgcaacttctgcct

SEQ ID NO: 1478831 - DNA, 22 bp, Homo sapiens
ctgcaagaacactggacctttg

SEQ ID NO: 1478832 - DNA, 13 bp, Homo sapiens
ctgcaagaagtct

SEQ ID NO: 1478833 - DNA, 21 bp, Homo sapiens
ctgcaagaccacggagggagc

SEQ ID NO: 1478834 - DNA, 21 bp, Homo sapiens
ctgcaagatggacacgagcca

SEQ ID NO: 1478835 - DNA, 22 bp, Homo sapiens
ctgcaagatggacacgagccac

SEQ ID NO: 1478836 - DNA, 23 bp, Homo sapiens
ctgcaagatggacacgagccaca

SEQ ID NO: 1478837 - DNA, 14 bp, Homo sapiens
ctgcaagcacagcc

SEQ ID NO: 1478838 - DNA, 17 bp, Homo sapiens
ctgcaagcacagccctt

SEQ ID NO: 1478839 - DNA, 17 bp, Homo sapiens
ctgcaagggcccagagt

SEQ ID NO: 1478840 - DNA, 19 bp, Homo sapiens
ctgcaaggtggcctctgcc

SEQ ID NO: 1478841 - DNA, 18 bp, Homo sapiens
ctgcaatagagactgtag

SEQ ID NO: 1478842 - DNA, 16 bp, Homo sapiens
ctgcaatatttgaatt

SEQ ID NO: 1478843 - DNA, 14 bp, Homo sapiens
ctgcaattcaaaag

SEQ ID NO: 1478844 - DNA, 15 bp, Homo sapiens
ctgcaattcccctct

SEQ ID NO: 1478845 - DNA, 16 bp, Homo sapiens
ctgcaattctacagtt

SEQ ID NO: 1478846 - DNA, 18 bp, Homo sapiens
ctgcaatttcatatgctg

SEQ ID NO: 1478847 - DNA, 14 bp, Homo sapiens
ctgcattttttact

SEQ ID NO: 1478848 - DNA, 17 bp, Homo sapiens
ctgcattttttactttt

SEQ ID NO: 1478849 - DNA, 16 bp, Homo sapiens
ctgccaaataaatcat

SEQ ID NO: 1478850 - DNA, 16 bp, Homo sapiens
ctgccaacatgaggac

SEQ ID NO: 1478851 - DNA, 19 bp, Homo sapiens
ctgccaacatgaggacaga

SEQ ID NO: 1478852 - DNA, 22 bp, Homo sapiens
ctgccaaccataccttccttcc

SEQ ID NO: 1478853 - DNA, 22 bp, Homo sapiens
ctgccaacctaaaactctttcg

SEQ ID NO: 1478854 - DNA, 16 bp, Homo sapiens
ctgccaagactcctca

SEQ ID NO: 1478855 - DNA, 18 bp, Homo sapiens
ctgccaagactcctcagg

SEQ ID NO: 1478856 - DNA, 19 bp, Homo sapiens
ctgccaagcactcgagacc

SEQ ID NO: 1478857 - DNA, 24 bp, Homo sapiens
ctgccaagcactcgagaccatcct

SEQ ID NO: 1478858 - DNA, 13 bp, Homo sapiens
ctgccaagccaga

SEQ ID NO: 1478859 - DNA, 14 bp, Homo sapiens
ctgccaagccagat

SEQ ID NO: 1478860 - DNA, 22 bp, Homo sapiens
ctgccaaggccagagtggcctg

SEQ ID NO: 1478861 - DNA, 15 bp, Homo sapiens
ctgccaagtgctctt

SEQ ID NO: 1478862 - DNA, 16 bp, Homo sapiens
ctgccaagtgctcttt

SEQ ID NO: 1478863 - DNA, 17 bp, Homo sapiens
ctgccaataacattctt

SEQ ID NO: 1478864 - DNA, 23 bp, Homo sapiens
ctgccaatccttaaatatgtgaa

SEQ ID NO: 1478865 - DNA, 23 bp, Homo sapiens
ctgccaattgctaccgagaaggt

SEQ ID NO: 1478866 - DNA, 14 bp, Homo sapiens
ctgccacaccctcc

SEQ ID NO: 1478867 - DNA, 21 bp, Homo sapiens
ctgccacactctccatcaccc

SEQ ID NO: 1478868 - DNA, 13 bp, Homo sapiens
ctgccacacttca

SEQ ID NO: 1478869 - DNA, 17 bp, Homo sapiens
ctgccacacttcaggct

SEQ ID NO: 1478870 - DNA, 17 bp, Homo sapiens
ctgccaccaggccacct

SEQ ID NO: 1478871 - DNA, 23 bp, Homo sapiens
ctgccaccaggccacctccccag

SEQ ID NO: 1478872 - DNA, 19 bp, Homo sapiens
ctgccacccccttccctgg

SEQ ID NO: 1478873 - DNA, 16 bp, Homo sapiens
ctgccaccccttcctc

SEQ ID NO: 1478874 - DNA, 18 bp, Homo sapiens
ctgccaccccttcctccc

SEQ ID NO: 1478875 - DNA, 21 bp, Homo sapiens
ctgccaccctgccccttgcca

SEQ ID NO: 1478876 - DNA, 12 bp, Homo sapiens
ctgccacctccc

SEQ ID NO: 1478877 - DNA, 12 bp, Homo sapiens
ctgccaccttca

SEQ ID NO: 1478878 - DNA, 19 bp, Homo sapiens
ctgccactcactaggcccc

SEQ ID NO: 1478879 - DNA, 19 bp, Homo sapiens
ctgccactctctgggactc

SEQ ID NO: 1478880 - DNA, 19 bp, Homo sapiens
ctgccactgactgcaggga

SEQ ID NO: 1478881 - DNA, 17 bp, Homo sapiens
ctgccactgaggagaca

SEQ ID NO: 1478882 - DNA, 19 bp, Homo sapiens
ctgccactgaggagacaga

SEQ ID NO: 1478883 - DNA, 13 bp, Homo sapiens
ctgccactgggca

SEQ ID NO: 1478884 - DNA, 24 bp, Homo sapiens
ctgccactgggcacctgcgcacag

SEQ ID NO: 1478885 - DNA, 19 bp, Homo sapiens
ctgccactttggtacatgg

SEQ ID NO: 1478886 - DNA, 15 bp, Homo sapiens
ctgccagcaacgcag

SEQ ID NO: 1478887 - DNA, 16 bp, Homo sapiens
ctgccagcacgcctgg

SEQ ID NO: 1478888 - DNA, 17 bp, Homo sapiens
ctgccagcacgcctggc

SEQ ID NO: 1478889 - DNA, 13 bp, Homo sapiens
ctgccagcagcag

SEQ ID NO: 1478890 - DNA, 16 bp, Homo sapiens
ctgccagccagcagcc

SEQ ID NO: 1478891 - DNA, 18 bp, Homo sapiens
ctgccagccagcagccag

SEQ ID NO: 1478892 - DNA, 15 bp, Homo sapiens
ctgccagcctggctt

SEQ ID NO: 1478893 - DNA, 22 bp, Homo sapiens
ctgccagcctggcttctggagc

SEQ ID NO: 1478894 - DNA, 13 bp, Homo sapiens
ctgccagccttga

SEQ ID NO: 1478895 - DNA, 20 bp, Homo sapiens
ctgccagccttgagccctgg

SEQ ID NO: 1478896 - DNA, 19 bp, Homo sapiens
ctgccagcgcatgtgtcct

SEQ ID NO: 1478897 - DNA, 17 bp, Homo sapiens
ctgccagctgcactgat

SEQ ID NO: 1478898 - DNA, 17 bp, Homo sapiens
ctgccagctgggcccag

SEQ ID NO: 1478899 - DNA, 15 bp, Homo sapiens
ctgccaggagctttg

SEQ ID NO: 1478900 - DNA, 13 bp, Homo sapiens
ctgccaggcacct

SEQ ID NO: 1478901 - DNA, 14 bp, Homo sapiens
ctgccaggcacctg

SEQ ID NO: 1478902 - DNA, 15 bp, Homo sapiens
ctgccaggcacctgg

SEQ ID NO: 1478903 - DNA, 17 bp, Homo sapiens
ctgccaggcacctggcc

SEQ ID NO: 1478904 - DNA, 18 bp, Homo sapiens
ctgccaggcacctggcct

SEQ ID NO: 1478905 - DNA, 21 bp, Homo sapiens
ctgccaggcacctggcctgct

SEQ ID NO: 1478906 - DNA, 18 bp, Homo sapiens
ctgccaggccagcctccg

SEQ ID NO: 1478907 - DNA, 19 bp, Homo sapiens
ctgccaggccagcctccga

SEQ ID NO: 1478908 - DNA, 22 bp, Homo sapiens
ctgccaggccagcctccgagag

SEQ ID NO: 1478909 - DNA, 20 bp, Homo sapiens
ctgccaggcccatctcaggt

SEQ ID NO: 1478910 - DNA, 23 bp, Homo sapiens
ctgccaggcccatctcaggtgcc

SEQ ID NO: 1478911 - DNA, 22 bp, Homo sapiens
ctgccaggcgttggtgccactt

SEQ ID NO: 1478912 - DNA, 16 bp, Homo sapiens
ctgccagggtgagcag

SEQ ID NO: 1478913 - DNA, 14 bp, Homo sapiens
ctgccagtgcagcc

SEQ ID NO: 1478914 - DNA, 15 bp, Homo sapiens
ctgccagtgtggagt

SEQ ID NO: 1478915 - DNA, 21 bp, Homo sapiens
ctgccatattgtgtaatttaa

SEQ ID NO: 1478916 - DNA, 14 bp, Homo sapiens
ctgccatctagcca

SEQ ID NO: 1478917 - DNA, 17 bp, Homo sapiens
ctgccatctagccagcc

SEQ ID NO: 1478918 - DNA, 22 bp, Homo sapiens
ctgccatcttagtttggattct

SEQ ID NO: 1478919 - DNA, 14 bp, Homo sapiens
ctgccatcttccca

SEQ ID NO: 1478920 - DNA, 16 bp, Homo sapiens
ctgccatcttcccagc

SEQ ID NO: 1478921 - DNA, 18 bp, Homo sapiens
ctgccatcttctccccga

SEQ ID NO: 1478922 - DNA, 18 bp, Homo sapiens
ctgccatgatagctgggg

SEQ ID NO: 1478923 - DNA, 23 bp, Homo sapiens
ctgccatgatagctggggcttca

SEQ ID NO: 1478924 - DNA, 17 bp, Homo sapiens
ctgccatgccactgcca

SEQ ID NO: 1478925 - DNA, 18 bp, Homo sapiens
ctgccatgccactgccag

SEQ ID NO: 1478926 - DNA, 21 bp, Homo sapiens
ctgccatggcgtgtccctctc

SEQ ID NO: 1478927 - DNA, 23 bp, Homo sapiens
ctgccatggctaggtagaagtga

SEQ ID NO: 1478928 - DNA, 19 bp, Homo sapiens
ctgccatgtactagtttta

SEQ ID NO: 1478929 - DNA, 16 bp, Homo sapiens
ctgccatgttgcccct

SEQ ID NO: 1478930 - DNA, 22 bp, Homo sapiens
ctgccatgttgcccctttctct

SEQ ID NO: 1478931 - DNA, 23 bp, Homo sapiens
ctgccattacagaggtattaaaa

SEQ ID NO: 1478932 - DNA, 15 bp, Homo sapiens
ctgccattacccagt

SEQ ID NO: 1478933 - DNA, 17 bp, Homo sapiens
ctgccattacccagtgc

SEQ ID NO: 1478934 - DNA, 14 bp, Homo sapiens
ctgccattgggacc

SEQ ID NO: 1478935 - DNA, 15 bp, Homo sapiens
ctgccatttcccttc

SEQ ID NO: 1478936 - DNA, 21 bp, Homo sapiens
ctgccatttgatttttctaac

SEQ ID NO: 1478937 - DNA, 21 bp, Homo sapiens
ctgcccaatgctttgggaggc

SEQ ID NO: 1478938 - DNA, 17 bp, Homo sapiens
ctgcccacattggaccc

SEQ ID NO: 1478939 - DNA, 16 bp, Homo sapiens
ctgcccacatttgggc

SEQ ID NO: 1478940 - DNA, 22 bp, Homo sapiens
ctgcccacatttgggctcaggg

SEQ ID NO: 1478941 - DNA, 23 bp, Homo sapiens
ctgcccacatttgggctcagggt

SEQ ID NO: 1478942 - DNA, 14 bp, Homo sapiens
ctgcccaccccctc

SEQ ID NO: 1478943 - DNA, 19 bp, Homo sapiens
ctgcccaccccctcaagcc

SEQ ID NO: 1478944 - DNA, 22 bp, Homo sapiens
ctgcccacctcagcctcccaaa

SEQ ID NO: 1478945 - DNA, 20 bp, Homo sapiens
ctgcccacgatcccctcccc

SEQ ID NO: 1478946 - DNA, 13 bp, Homo sapiens
ctgcccactgttt

SEQ ID NO: 1478947 - DNA, 22 bp, Homo sapiens
ctgcccactgtttctcttgagc

SEQ ID NO: 1478948 - DNA, 23 bp, Homo sapiens
ctgcccacttagccgtccatggc

SEQ ID NO: 1478949 - DNA, 18 bp, Homo sapiens
ctgcccagacccctctgg

SEQ ID NO: 1478950 - DNA, 22 bp, Homo sapiens
ctgcccagagttgctgggagct

SEQ ID NO: 1478951 - DNA, 13 bp, Homo sapiens
ctgcccagcttgg

SEQ ID NO: 1478952 - DNA, 14 bp, Homo sapiens
ctgcccagcttggg

SEQ ID NO: 1478953 - DNA, 17 bp, Homo sapiens
ctgcccagcttgggccc

SEQ ID NO: 1478954 - DNA, 20 bp, Homo sapiens
ctgcccagcttgggcccagc

SEQ ID NO: 1478955 - DNA, 11 bp, Homo sapiens
ctgcccaggag

SEQ ID NO: 1478956 - DNA, 19 bp, Homo sapiens
ctgcccaggagacagacca

SEQ ID NO: 1478957 - DNA, 21 bp, Homo sapiens
ctgcccaggagacagaccact

SEQ ID NO: 1478958 - DNA, 18 bp, Homo sapiens
ctgcccaggagagccagc

SEQ ID NO: 1478959 - DNA, 23 bp, Homo sapiens
ctgcccaggagagccagccctcc

SEQ ID NO: 1478960 - DNA, 16 bp, Homo sapiens
ctgcccaggagcagct

SEQ ID NO: 1478961 - DNA, 12 bp, Homo sapiens
ctgcctggcctg

SEQ ID NO: 1478962 - DNA, 13 bp, Homo sapiens
ctgcctggcctgg

SEQ ID NO: 1478963 - DNA, 17 bp, Homo sapiens
ctgcctgggatgggctc

SEQ ID NO: 1478964 - DNA, 13 bp, Homo sapiens
ctgcctgggcctg

SEQ ID NO: 1478965 - DNA, 17 bp, Homo sapiens
ctgcctgggcctgtgca

SEQ ID NO: 1478966 - DNA, 18 bp, Homo sapiens
ctgcctgggcctgtgcag

SEQ ID NO: 1478967 - DNA, 19 bp, Homo sapiens
ctgcctgggcctgtgcagc

SEQ ID NO: 1478968 - DNA, 20 bp, Homo sapiens
ctgcctgggcctgtgcagca

SEQ ID NO: 1478969 - DNA, 21 bp, Homo sapiens
ctgcctgggcctgtgcagcag

SEQ ID NO: 1478970 - DNA, 15 bp, Homo sapiens
ctgcctgggctgttg

SEQ ID NO: 1478971 - DNA, 16 bp, Homo sapiens
ctgcctgggctgttgg

SEQ ID NO: 1478972 - DNA, 17 bp, Homo sapiens
ctgcctgggctgttggc

SEQ ID NO: 1478973 - DNA, 24 bp, Homo sapiens
ctgcctgggctgttggcactcaca

SEQ ID NO: 1478974 - DNA, 22 bp, Homo sapiens
ctgcctggtcctccctcccaag

SEQ ID NO: 1478975 - DNA, 20 bp, Homo sapiens
ctgcctggtctgtctggatc

SEQ ID NO: 1478976 - DNA, 19 bp, Homo sapiens
ctgcctgtaacttgagagt

SEQ ID NO: 1478977 - DNA, 16 bp, Homo sapiens
ctgcctgtatttgaga

SEQ ID NO: 1478978 - DNA, 22 bp, Homo sapiens
ctgcctgtattttcgggattct

SEQ ID NO: 1478979 - DNA, 24 bp, Homo sapiens
ctgcctgtccctaccccatggtgc

SEQ ID NO: 1478980 - DNA, 11 bp, Homo sapiens
ctgcctgtctg

SEQ ID NO: 1478981 - DNA, 12 bp, Homo sapiens
ctgcctgtctgc

SEQ ID NO: 1478982 - DNA, 15 bp, Homo sapiens
ctgcctgtctgcccc

SEQ ID NO: 1478983 - DNA, 12 bp, Homo sapiens
ctgcctgtgctg

SEQ ID NO: 1478984 - DNA, 23 bp, Homo sapiens
ctgcctgtggcgccgtctccagg

SEQ ID NO: 1478985 - DNA, 13 bp, Homo sapiens
ctgcctgtgtgct

SEQ ID NO: 1478986 - DNA, 21 bp, Homo sapiens
ctgcctgttataactctgcac

SEQ ID NO: 1478987 - DNA, 16 bp, Homo sapiens
ctgcctgttggcaggc

SEQ ID NO: 1478988 - DNA, 18 bp, Homo sapiens
ctgcctgttggcaggccc

SEQ ID NO: 1478989 - DNA, 16 bp, Homo sapiens
ctgccttactggtttc

SEQ ID NO: 1478990 - DNA, 23 bp, Homo sapiens
ctgccttactggtttccccaggg

SEQ ID NO: 1478991 - DNA, 22 bp, Homo sapiens
ctgccttagggtttgcagagtg

SEQ ID NO: 1478992 - DNA, 23 bp, Homo sapiens
ctgccttagggtttgcagagtgg

SEQ ID NO: 1478993 - DNA, 20 bp, Homo sapiens
ctgccttagtctcagtttgt

SEQ ID NO: 1478994 - DNA, 23 bp, Homo sapiens
ctgccttagtctcagtttgtgtg

SEQ ID NO: 1478995 - DNA, 15 bp, Homo sapiens
ctgccttatcttgca

SEQ ID NO: 1478996 - DNA, 21 bp, Homo sapiens
ctgccttcaaggactgtttca

SEQ ID NO: 1478997 - DNA, 21 bp, Homo sapiens
ctgccttcactgtgctccaac

SEQ ID NO: 1478998 - DNA, 17 bp, Homo sapiens
ctgccttccctagcttt

SEQ ID NO: 1478999 - DNA, 13 bp, Homo sapiens
ctgccttcgcttc

SEQ ID NO: 1479000 - DNA, 14 bp, Homo sapiens
ctgccttcgcttct

SEQ ID NO: 1479001 - DNA, 22 bp, Homo sapiens
ctgccttctcaggccccgggct

SEQ ID NO: 1479002 - DNA, 13 bp, Homo sapiens
ctgccttgagcta

SEQ ID NO: 1479003 - DNA, 21 bp, Homo sapiens
ctgccttgagctaaccccaag

SEQ ID NO: 1479004 - DNA, 19 bp, Homo sapiens
ctgccttgctgacaataaa

SEQ ID NO: 1479005 - DNA, 16 bp, Homo sapiens
ctgccttgcttctgta

SEQ ID NO: 1479006 - DNA, 17 bp, Homo sapiens
ctgccttggcctcccaa

SEQ ID NO: 1479007 - DNA, 14 bp, Homo sapiens
ctgccttggctcag

SEQ ID NO: 1479008 - DNA, 17 bp, Homo sapiens
ctgccttggctcagaca

SEQ ID NO: 1479009 - DNA, 18 bp, Homo sapiens
ctgccttggctcagacat

SEQ ID NO: 1479010 - DNA, 19 bp, Homo sapiens
ctgcctttaagccaaagaa

SEQ ID NO: 1479011 - DNA, 17 bp, Homo sapiens
ctgcctttagcctggac

SEQ ID NO: 1479012 - DNA, 20 bp, Homo sapiens
ctgcctttatgatgctaagc

SEQ ID NO: 1479013 - DNA, 20 bp, Homo sapiens
ctgcctttgcaccacgggac

SEQ ID NO: 1479014 - DNA, 13 bp, Homo sapiens
ctgccttttctgg

SEQ ID NO: 1479015 - DNA, 14 bp, Homo sapiens
ctgccttttctgga

SEQ ID NO: 1479016 - DNA, 17 bp, Homo sapiens
ctgccttttctggagtt

SEQ ID NO: 1479017 - DNA, 13 bp, Homo sapiens
ctgcgaccctggg

SEQ ID NO: 1479018 - DNA, 15 bp, Homo sapiens
ctgcgaccctggggg

SEQ ID NO: 1479019 - DNA, 21 bp, Homo sapiens
ctgcgaccctgggggcacagg

SEQ ID NO: 1479020 - DNA, 16 bp, Homo sapiens
ctgcgactttctgcct

SEQ ID NO: 1479021 - DNA, 21 bp, Homo sapiens
ctgcgagggccgcccgctccc

SEQ ID NO: 1479022 - DNA, 12 bp, Homo sapiens
ctgcgcactgtg

SEQ ID NO: 1479023 - DNA, 13 bp, Homo sapiens
ctgcgcaggtctc

SEQ ID NO: 1479024 - DNA, 14 bp, Homo sapiens
ctgcgcaggtctct

SEQ ID NO: 1479025 - DNA, 12 bp, Homo sapiens
ctgcgccaggca

SEQ ID NO: 1479026 - DNA, 17 bp, Homo sapiens
ctgcgccaggcagagct

SEQ ID NO: 1479027 - DNA, 20 bp, Homo sapiens
ctgcgccaggcagagctgag

SEQ ID NO: 1479028 - DNA, 20 bp, Homo sapiens
ctgcgccagtcctgctacct

SEQ ID NO: 1479029 - DNA, 17 bp, Homo sapiens
ctgcgcccttaccttcc

SEQ ID NO: 1479030 - DNA, 18 bp, Homo sapiens
ctgcgcccttgtgccctg

SEQ ID NO: 1479031 - DNA, 19 bp, Homo sapiens
ctgcgccggacagagtggg

SEQ ID NO: 1479032 - DNA, 15 bp, Homo sapiens
ctgcgcctccagagg

SEQ ID NO: 1479033 - DNA, 20 bp, Homo sapiens
ctgcgcctgaaaagggcgga

SEQ ID NO: 1479034 - DNA, 20 bp, Homo sapiens
ctgcgcgtgtgggtctctgg

SEQ ID NO: 1479035 - DNA, 17 bp, Homo sapiens
ctgcgcttgcttttctg

SEQ ID NO: 1479036 - DNA, 20 bp, Homo sapiens
ctgcggagtgaagaggggca

SEQ ID NO: 1479037 - DNA, 13 bp, Homo sapiens
ctgcggctgtggg

SEQ ID NO: 1479038 - DNA, 16 bp, Homo sapiens
ctgcggctgtgggcga

SEQ ID NO: 1479039 - DNA, 20 bp, Homo sapiens
ctgcgggatggtcctggggc

SEQ ID NO: 1479040 - DNA, 22 bp, Homo sapiens
ctgcgggatggtcctggggctc

SEQ ID NO: 1479041 - DNA, 14 bp, Homo sapiens
ctgcgggcccagct

SEQ ID NO: 1479042 - DNA, 22 bp, Homo sapiens
ctgcgggcgcgggcagccaccc

SEQ ID NO: 1479043 - DNA, 15 bp, Homo sapiens
ctgcgggtctgaagg

SEQ ID NO: 1479044 - DNA, 16 bp, Homo sapiens
ctgcgggtctgaagga

SEQ ID NO: 1479045 - DNA, 13 bp, Homo sapiens
ctgcgggtggggc

SEQ ID NO: 1479046 - DNA, 20 bp, Homo sapiens
ctgcgtcctgacgccctgcg

SEQ ID NO: 1479047 - DNA, 13 bp, Homo sapiens
ctgcgtctgtgtt

SEQ ID NO: 1479048 - DNA, 20 bp, Homo sapiens
ctgcgtcttttttctcttcc

SEQ ID NO: 1479049 - DNA, 21 bp, Homo sapiens
ctgcgtcttttttctcttccc

SEQ ID NO: 1479050 - DNA, 24 bp, Homo sapiens
ctgcgtcttttttctcttcccttc

SEQ ID NO: 1479051 - DNA, 15 bp, Homo sapiens
ctgcgttctgcaagc

SEQ ID NO: 1479052 - DNA, 19 bp, Homo sapiens
ctgcgttggagccactcct

SEQ ID NO: 1479053 - DNA, 18 bp, Homo sapiens
ctgcgtttggaggcccct

SEQ ID NO: 1479054 - DNA, 22 bp, Homo sapiens
ctgcgtttggaggcccctgggc

SEQ ID NO: 1479055 - DNA, 23 bp, Homo sapiens
ctgcgtttggaggcccctgggct

SEQ ID NO: 1479056 - DNA, 15 bp, Homo sapiens
ctgctaaataaacat

SEQ ID NO: 1479057 - DNA, 21 bp, Homo sapiens
ctgctaacttggagccccagt

SEQ ID NO: 1479058 - DNA, 18 bp, Homo sapiens
ctgctaagtatttcccag

SEQ ID NO: 1479059 - DNA, 19 bp, Homo sapiens
ctgctaagtatttcccagc

SEQ ID NO: 1479060 - DNA, 17 bp, Homo sapiens
ctgctaagttctcccaa

SEQ ID NO: 1479061 - DNA, 21 bp, Homo sapiens
ctgctaatacctcttactttg

SEQ ID NO: 1479062 - DNA, 23 bp, Homo sapiens
ctgctaatacctcttactttgct

SEQ ID NO: 1479063 - DNA, 23 bp, Homo sapiens
ctgctaattctttgcaaaaatcc

SEQ ID NO: 1479064 - DNA, 15 bp, Homo sapiens
ctgctacaatgtcct

SEQ ID NO: 1479065 - DNA, 20 bp, Homo sapiens
ctgctacagcaatttctaat

SEQ ID NO: 1479066 - DNA, 21 bp, Homo sapiens
ctgctaccgttgacttccagg

SEQ ID NO: 1479067 - DNA, 13 bp, Homo sapiens
ctgctacctcact

SEQ ID NO: 1479068 - DNA, 18 bp, Homo sapiens
ctgctacctcccttgcct

SEQ ID NO: 1479069 - DNA, 19 bp, Homo sapiens
ctgctacctcccttgcctt

SEQ ID NO: 1479070 - DNA, 14 bp, Homo sapiens
ctgctacctgttct

SEQ ID NO: 1479071 - DNA, 15 bp, Homo sapiens
ctgctacctgttctt

SEQ ID NO: 1479072 - DNA, 19 bp, Homo sapiens
ctgctacctttcaaagctt

SEQ ID NO: 1479073 - DNA, 20 bp, Homo sapiens
ctgctacctttcaaagcttg

SEQ ID NO: 1479074 - DNA, 23 bp, Homo sapiens
ctgctactacccgagcccagcta

SEQ ID NO: 1479075 - DNA, 16 bp, Homo sapiens
ctgcttctgctgccct

SEQ ID NO: 1479076 - DNA, 18 bp, Homo sapiens
ctgcttcttcccctctgc

SEQ ID NO: 1479077 - DNA, 18 bp, Homo sapiens
ctgcttgcacacttcccc

SEQ ID NO: 1479078 - DNA, 19 bp, Homo sapiens
ctgcttgcacacttcccca

SEQ ID NO: 1479079 - DNA, 21 bp, Homo sapiens
ctgcttgccaaggcagaggcc

SEQ ID NO: 1479080 - DNA, 18 bp, Homo sapiens
ctgcttgccgactggctg

SEQ ID NO: 1479081 - DNA, 13 bp, Homo sapiens
ctgcttggatcca

SEQ ID NO: 1479082 - DNA, 18 bp, Homo sapiens
ctgcttggatccatacaa

SEQ ID NO: 1479083 - DNA, 22 bp, Homo sapiens
ctgcttggatccatacaaaact

SEQ ID NO: 1479084 - DNA, 22 bp, Homo sapiens
ctgcttggcccggccggcctgg

SEQ ID NO: 1479085 - DNA, 16 bp, Homo sapiens
ctgcttgtcctgctct

SEQ ID NO: 1479086 - DNA, 22 bp, Homo sapiens
ctgcttgtcctgggcctgcccc

SEQ ID NO: 1479087 - DNA, 14 bp, Homo sapiens
ctgctttcccctgt

SEQ ID NO: 1479088 - DNA, 16 bp, Homo sapiens
ctgctttcccctgtgg

SEQ ID NO: 1479089 - DNA, 17 bp, Homo sapiens
ctgctttcccctgtggg

SEQ ID NO: 1479090 - DNA, 15 bp, Homo sapiens
ctgctttctgcctct

SEQ ID NO: 1479091 - DNA, 23 bp, Homo sapiens
ctgctttctgcctctcctccaca

SEQ ID NO: 1479092 - DNA, 14 bp, Homo sapiens
ctgctttgcatctt

SEQ ID NO: 1479093 - DNA, 15 bp, Homo sapiens
ctgctttgcatcttt

SEQ ID NO: 1479094 - DNA, 19 bp, Homo sapiens
ctgctttgcatctttgtta

SEQ ID NO: 1479095 - DNA, 16 bp, Homo sapiens
ctgctttggcagtgcc

SEQ ID NO: 1479096 - DNA, 19 bp, Homo sapiens
ctgctttgggctgccctgg

SEQ ID NO: 1479097 - DNA, 21 bp, Homo sapiens
ctgctttgggctgccctggtg

SEQ ID NO: 1479098 - DNA, 24 bp, Homo sapiens
ctgcttttccaggatcctgcagga

SEQ ID NO: 1479099 - DNA, 19 bp, Homo sapiens
ctgcttttccctttgtgag

SEQ ID NO: 1479100 - DNA, 22 bp, Homo sapiens
ctgcttttccctttgtgagtca

SEQ ID NO: 1479101 - DNA, 14 bp, Homo sapiens
ctgcttttctgccc

SEQ ID NO: 1479102 - DNA, 22 bp, Homo sapiens
ctgcttttctgccctggctgct

SEQ ID NO: 1479103 - DNA, 13 bp, Homo sapiens
ctgcttttctgtc

SEQ ID NO: 1479104 - DNA, 16 bp, Homo sapiens
ctgcttttctgtcctg

SEQ ID NO: 1479105 - DNA, 17 bp, Homo sapiens
ctgcttttctgtcctgg

SEQ ID NO: 1479106 - DNA, 13 bp, Homo sapiens
ctgcttttcttaa

SEQ ID NO: 1479107 - DNA, 16 bp, Homo sapiens
ctgctttttggaaagt

SEQ ID NO: 1479108 - DNA, 23 bp, Homo sapiens
ctgctttttttcttaaaagtact

SEQ ID NO: 1479109 - DNA, 22 bp, Homo sapiens
ctgcttttttttttccagcaag

SEQ ID NO: 1479110 - DNA, 21 bp, Homo sapiens
ctggaaaaaaatacaaaaagc

SEQ ID NO: 1479111 - DNA, 18 bp, Homo sapiens
ctggaaaacagaacactt

SEQ ID NO: 1479112 - DNA, 19 bp, Homo sapiens
ctggaaaacagaacactta

SEQ ID NO: 1479113 - DNA, 14 bp, Homo sapiens
ctggaaaacctcct

SEQ ID NO: 1479114 - DNA, 18 bp, Homo sapiens
ctggaaaagaagaaactt

SEQ ID NO: 1479115 - DNA, 23 bp, Homo sapiens
ctggaaaagaagaaactttgcct

SEQ ID NO: 1479116 - DNA, 23 bp, Homo sapiens
ctggaaaagttagtattaaaatc

SEQ ID NO: 1479117 - DNA, 23 bp, Homo sapiens
ctggaaacagcatgaataaaaca

SEQ ID NO: 1479118 - DNA, 16 bp, Homo sapiens
ctggaaacctctggag

SEQ ID NO: 1479119 - DNA, 13 bp, Homo sapiens
ctggaaaggggag

SEQ ID NO: 1479120 - DNA, 19 bp, Homo sapiens
ctggaaaggggagagcctg

SEQ ID NO: 1479121 - DNA, 21 bp, Homo sapiens
ctggaaaggggagagcctgct

SEQ ID NO: 1479122 - DNA, 23 bp, Homo sapiens
ctggaaaggggagagcctgctgg

SEQ ID NO: 1479123 - DNA, 17 bp, Homo sapiens
ctggaacaacttgtagc

SEQ ID NO: 1479124 - DNA, 21 bp, Homo sapiens
ctggaacaccagcagcactgg

SEQ ID NO: 1479125 - DNA, 16 bp, Homo sapiens
ctggaacatttgatat

SEQ ID NO: 1479126 - DNA, 19 bp, Homo sapiens
ctggaacatttgatatttt

SEQ ID NO: 1479127 - DNA, 22 bp, Homo sapiens
ctggaaccaatcccgtgaaaga

SEQ ID NO: 1479128 - DNA, 23 bp, Homo sapiens
ctggaaccagggaggagaggaaa

SEQ ID NO: 1479129 - DNA, 14 bp, Homo sapiens
ctggaacccagact

SEQ ID NO: 1479130 - DNA, 22 bp, Homo sapiens
ctggaacccagactcagacatt

SEQ ID NO: 1479131 - DNA, 13 bp, Homo sapiens
ctggaacccatgt

SEQ ID NO: 1479132 - DNA, 18 bp, Homo sapiens
ctggaacctcagcctggc

SEQ ID NO: 1479133 - DNA, 20 bp, Homo sapiens
ctggaacctcagcctggcca

SEQ ID NO: 1479134 - DNA, 22 bp, Homo sapiens
ctggaacctcagcctggccaga

SEQ ID NO: 1479135 - DNA, 18 bp, Homo sapiens
ctggaacgtgaactcagt

SEQ ID NO: 1479136 - DNA, 14 bp, Homo sapiens
ctggaagaaccact

SEQ ID NO: 1479137 - DNA, 15 bp, Homo sapiens
ctggaagacacttca

SEQ ID NO: 1479138 - DNA, 16 bp, Homo sapiens
ctggaagacacttcag

SEQ ID NO: 1479139 - DNA, 18 bp, Homo sapiens
ctggaagacacttcagat

SEQ ID NO: 1479140 - DNA, 11 bp, Homo sapiens
ctggaagagcc

SEQ ID NO: 1479141 - DNA, 21 bp, Homo sapiens
ctggaagagccaaagaatatt

SEQ ID NO: 1479142 - DNA, 22 bp, Homo sapiens
ctggaagatataacattcagtt

SEQ ID NO: 1479143 - DNA, 14 bp, Homo sapiens
ctggaagatcctgc

SEQ ID NO: 1479144 - DNA, 18 bp, Homo sapiens
ctggaagatcctgcgggt

SEQ ID NO: 1479145 - DNA, 18 bp, Homo sapiens
ctggaagcagagcaaaat

SEQ ID NO: 1479146 - DNA, 17 bp, Homo sapiens
ctggaagccagctttcc

SEQ ID NO: 1479147 - DNA, 14 bp, Homo sapiens
ctggaagcccagcc

SEQ ID NO: 1479148 - DNA, 17 bp, Homo sapiens
ctggaagcccagcccct

SEQ ID NO: 1479149 - DNA, 17 bp, Homo sapiens
ctggaagcccctgggcc

SEQ ID NO: 1479150 - DNA, 18 bp, Homo sapiens
ctggaagccggcggccca

SEQ ID NO: 1479151 - DNA, 13 bp, Homo sapiens
ctggaagcctgcc

SEQ ID NO: 1479152 - DNA, 22 bp, Homo sapiens
ctggaagctctccgagctctgg

SEQ ID NO: 1479153 - DNA, 14 bp, Homo sapiens
ctggaaggacacag

SEQ ID NO: 1479154 - DNA, 13 bp, Homo sapiens
ctggaaggcaggg

SEQ ID NO: 1479155 - DNA, 14 bp, Homo sapiens
ctggaaggcagggc

SEQ ID NO: 1479156 - DNA, 16 bp, Homo sapiens
ctggaaggcagggcag

SEQ ID NO: 1479157 - DNA, 17 bp, Homo sapiens
ctggaaggcagggcaga

SEQ ID NO: 1479158 - DNA, 18 bp, Homo sapiens
ctggaaggcagggcagag

SEQ ID NO: 1479159 - DNA, 20 bp, Homo sapiens
ctggaaggcagggcagaggg

SEQ ID NO: 1479160 - DNA, 17 bp, Homo sapiens
ctggaaggccccttccc

SEQ ID NO: 1479161 - DNA, 23 bp, Homo sapiens
ctggaaggccccttccctggcag

SEQ ID NO: 1479162 - DNA, 14 bp, Homo sapiens
ctggaaggctggct

SEQ ID NO: 1479163 - DNA, 15 bp, Homo sapiens
ctggaaggctggctg

SEQ ID NO: 1479164 - DNA, 16 bp, Homo sapiens
ctggaaggctggctga

SEQ ID NO: 1479165 - DNA, 18 bp, Homo sapiens
ctggaaggctggctgagt

SEQ ID NO: 1479166 - DNA, 14 bp, Homo sapiens
ctggaagggacagt

SEQ ID NO: 1479167 - DNA, 16 bp, Homo sapiens
ctggaagggcagagta

SEQ ID NO: 1479168 - DNA, 19 bp, Homo sapiens
ctggaaggggaagggacac

SEQ ID NO: 1479169 - DNA, 15 bp, Homo sapiens
ctggaaggggcagca

SEQ ID NO: 1479170 - DNA, 18 bp, Homo sapiens
ctggaaggggcagcagga

SEQ ID NO: 1479171 - DNA, 13 bp, Homo sapiens
ctggaaggggcca

SEQ ID NO: 1479172 - DNA, 18 bp, Homo sapiens
ctggaaggttcaggggcc

SEQ ID NO: 1479173 - DNA, 23 bp, Homo sapiens
ctggaagtcatctcattccactg

SEQ ID NO: 1479174 - DNA, 17 bp, Homo sapiens
ctggaagttgtggatat

SEQ ID NO: 1479175 - DNA, 19 bp, Homo sapiens
ctggaagttgtggatatca

SEQ ID NO: 1479176 - DNA, 15 bp, Homo sapiens
ctggaagtttctggt

SEQ ID NO: 1479177 - DNA, 23 bp, Homo sapiens
ctggaagtttctggtgccatttc

SEQ ID NO: 1479178 - DNA, 17 bp, Homo sapiens
ctggaagttttgcattt

SEQ ID NO: 1479179 - DNA, 20 bp, Homo sapiens
ctggaagttttgcatttatg

SEQ ID NO: 1479180 - DNA, 14 bp, Homo sapiens
ctggaataagttca

SEQ ID NO: 1479181 - DNA, 15 bp, Homo sapiens
ctggaatacatgaaa

SEQ ID NO: 1479182 - DNA, 23 bp, Homo sapiens
ctggaatcaagatgtcagactgg

SEQ ID NO: 1479183 - DNA, 23 bp, Homo sapiens
ctggaatcaggaatattttccaa

SEQ ID NO: 1479184 - DNA, 20 bp, Homo sapiens
ctggaatggaagggttctgg

SEQ ID NO: 1479185 - DNA, 22 bp, Homo sapiens
ctggaatggtacatgtcttcca

SEQ ID NO: 1479186 - DNA, 17 bp, Homo sapiens
ctggaattcagcaccct

SEQ ID NO: 1479187 - DNA, 21 bp, Homo sapiens
ctggaattcagcaccctgggt

SEQ ID NO: 1479188 - DNA, 15 bp, Homo sapiens
ctggaattccacagg

SEQ ID NO: 1479189 - DNA, 16 bp, Homo sapiens
ctggccccagtgccta

SEQ ID NO: 1479190 - DNA, 22 bp, Homo sapiens
ctggccccagtgcggttcctca

SEQ ID NO: 1479191 - DNA, 19 bp, Homo sapiens
ctggccccatgtctctcag

SEQ ID NO: 1479192 - DNA, 21 bp, Homo sapiens
ctggccccatgtctctcagaa

SEQ ID NO: 1479193 - DNA, 17 bp, Homo sapiens
ctggcccccaacctcag

SEQ ID NO: 1479194 - DNA, 22 bp, Homo sapiens
ctggcccccaacctcagggctc

SEQ ID NO: 1479195 - DNA, 22 bp, Homo sapiens
ctggcccccaggattcccccag

SEQ ID NO: 1479196 - DNA, 23 bp, Homo sapiens
ctggcccccaggattcccccagc

SEQ ID NO: 1479197 - DNA, 14 bp, Homo sapiens
ctggccccgcctgc

SEQ ID NO: 1479198 - DNA, 15 bp, Homo sapiens
ctggccccgcctgcc

SEQ ID NO: 1479199 - DNA, 20 bp, Homo sapiens
ctggccccgggctctggcca

SEQ ID NO: 1479200 - DNA, 21 bp, Homo sapiens
ctggcccctccagaccctgcc

SEQ ID NO: 1479201 - DNA, 22 bp, Homo sapiens
ctggcccctccagaccctgcct

SEQ ID NO: 1479202 - DNA, 21 bp, Homo sapiens
ctggcccgtcatgttcctcaa

SEQ ID NO: 1479203 - DNA, 21 bp, Homo sapiens
ctggccctcacccctgccctg

SEQ ID NO: 1479204 - DNA, 22 bp, Homo sapiens
ctggccctcactcaagaccagg

SEQ ID NO: 1479205 - DNA, 14 bp, Homo sapiens
ctggccctgaggtg

SEQ ID NO: 1479206 - DNA, 19 bp, Homo sapiens
ctggccctgaggtgtgggg

SEQ ID NO: 1479207 - DNA, 12 bp, Homo sapiens
ctggccctgccc

SEQ ID NO: 1479208 - DNA, 14 bp, Homo sapiens
ctggccctgcccag

SEQ ID NO: 1479209 - DNA, 23 bp, Homo sapiens
ctggccctgcttcctgcttgcca

SEQ ID NO: 1479210 - DNA, 13 bp, Homo sapiens
ctggccctgtgcc

SEQ ID NO: 1479211 - DNA, 19 bp, Homo sapiens
ctggccgagggtcctggct

SEQ ID NO: 1479212 - DNA, 20 bp, Homo sapiens
ctggccgagggtcctggctc

SEQ ID NO: 1479213 - DNA, 19 bp, Homo sapiens
ctggccgccacccccatct

SEQ ID NO: 1479214 - DNA, 22 bp, Homo sapiens
ctggccgccccctgccccccag

SEQ ID NO: 1479215 - DNA, 15 bp, Homo sapiens
ctggccgcctccagg

SEQ ID NO: 1479216 - DNA, 19 bp, Homo sapiens
ctggccgcctccaggagcc

SEQ ID NO: 1479217 - DNA, 19 bp, Homo sapiens
ctggccggctccagtttcc

SEQ ID NO: 1479218 - DNA, 15 bp, Homo sapiens
ctggccgtcacacgt

SEQ ID NO: 1479219 - DNA, 17 bp, Homo sapiens
ctggccgttcagcctgt

SEQ ID NO: 1479220 - DNA, 21 bp, Homo sapiens
ctggcctaggagatatctgag

SEQ ID NO: 1479221 - DNA, 19 bp, Homo sapiens
ctggcctcactggctgggg

SEQ ID NO: 1479222 - DNA, 20 bp, Homo sapiens
ctggcctcactggctggggc

SEQ ID NO: 1479223 - DNA, 12 bp, Homo sapiens
ctggcctccagc

SEQ ID NO: 1479224 - DNA, 13 bp, Homo sapiens
ctggcctccagct

SEQ ID NO: 1479225 - DNA, 15 bp, Homo sapiens
ctggcctccagctcc

SEQ ID NO: 1479226 - DNA, 17 bp, Homo sapiens
ctggcctccagctccca

SEQ ID NO: 1479227 - DNA, 13 bp, Homo sapiens
ctggcctcccacc

SEQ ID NO: 1479228 - DNA, 22 bp, Homo sapiens
ctggcctcccacccgatgctgc

SEQ ID NO: 1479229 - DNA, 17 bp, Homo sapiens
ctggcctcccctgccac

SEQ ID NO: 1479230 - DNA, 18 bp, Homo sapiens
ctggcctcccttctcctt

SEQ ID NO: 1479231 - DNA, 14 bp, Homo sapiens
ctggcctctctagc

SEQ ID NO: 1479232 - DNA, 13 bp, Homo sapiens
ctggcctctgggc

SEQ ID NO: 1479233 - DNA, 14 bp, Homo sapiens
ctggcctctgggca

SEQ ID NO: 1479234 - DNA, 18 bp, Homo sapiens
ctggcctctgggcagtgt

SEQ ID NO: 1479235 - DNA, 19 bp, Homo sapiens
ctggcctctgggcagtgtg

SEQ ID NO: 1479236 - DNA, 15 bp, Homo sapiens
ctggcctctgtgcct

SEQ ID NO: 1479237 - DNA, 16 bp, Homo sapiens
ctggcctctgtgcctt

SEQ ID NO: 1479238 - DNA, 17 bp, Homo sapiens
ctggcctgaactgagga

SEQ ID NO: 1479239 - DNA, 15 bp, Homo sapiens
ctggcctgagagtca

SEQ ID NO: 1479240 - DNA, 19 bp, Homo sapiens
ctggcctgagagtcagctc

SEQ ID NO: 1479241 - DNA, 12 bp, Homo sapiens
ctggcctgagca

SEQ ID NO: 1479242 - DNA, 13 bp, Homo sapiens
ctggcctgagcaa

SEQ ID NO: 1479243 - DNA, 13 bp, Homo sapiens
ctggcctgagctg

SEQ ID NO: 1479244 - DNA, 17 bp, Homo sapiens
ctggcctgagctggggc

SEQ ID NO: 1479245 - DNA, 18 bp, Homo sapiens
ctggcctgagctggggcc

SEQ ID NO: 1479246 - DNA, 21 bp, Homo sapiens
ctggcctgagctggggccaca

SEQ ID NO: 1479247 - DNA, 18 bp, Homo sapiens
ctggcctggactgttttc

SEQ ID NO: 1479248 - DNA, 15 bp, Homo sapiens
ctggcctggatctcc

SEQ ID NO: 1479249 - DNA, 14 bp, Homo sapiens
ctggcctggcacac

SEQ ID NO: 1479250 - DNA, 17 bp, Homo sapiens
ctggcctggcacacatc

SEQ ID NO: 1479251 - DNA, 17 bp, Homo sapiens
ctggcctggctccccac

SEQ ID NO: 1479252 - DNA, 14 bp, Homo sapiens
ctggcctgggccac

SEQ ID NO: 1479253 - DNA, 18 bp, Homo sapiens
ctggcctgggccacacct

SEQ ID NO: 1479254 - DNA, 23 bp, Homo sapiens
ctggcctgggccacacctgagcg

SEQ ID NO: 1479255 - DNA, 15 bp, Homo sapiens
ctggcctggtccctg

SEQ ID NO: 1479256 - DNA, 20 bp, Homo sapiens
ctggcctggtccctggtcct

SEQ ID NO: 1479257 - DNA, 12 bp, Homo sapiens
ctggcctgtggc

SEQ ID NO: 1479258 - DNA, 20 bp, Homo sapiens
ctggcctgtggcacagccct

SEQ ID NO: 1479259 - DNA, 20 bp, Homo sapiens
ctggccttaaagagggacag

SEQ ID NO: 1479260 - DNA, 22 bp, Homo sapiens
ctggccttaaagagggacaggc

SEQ ID NO: 1479261 - DNA, 22 bp, Homo sapiens
ctggccttgcccgtcgtgtgct

SEQ ID NO: 1479262 - DNA, 20 bp, Homo sapiens
ctggcctttttcatttatct

SEQ ID NO: 1479263 - DNA, 19 bp, Homo sapiens
ctggcgaagatggtctcca

SEQ ID NO: 1479264 - DNA, 17 bp, Homo sapiens
ctggcgacaagagtgag

SEQ ID NO: 1479265 - DNA, 22 bp, Homo sapiens
ctggcgagttctctttggaaat

SEQ ID NO: 1479266 - DNA, 12 bp, Homo sapiens
ctggcgcagcca

SEQ ID NO: 1479267 - DNA, 15 bp, Homo sapiens
ctggcgcagccaagg

SEQ ID NO: 1479268 - DNA, 16 bp, Homo sapiens
ctggcgcaggtgggct

SEQ ID NO: 1479269 - DNA, 13 bp, Homo sapiens
ctggcgcccatcc

SEQ ID NO: 1479270 - DNA, 14 bp, Homo sapiens
ctggcgcccatcct

SEQ ID NO: 1479271 - DNA, 23 bp, Homo sapiens
ctggcgcccatcctagtgggcac

SEQ ID NO: 1479272 - DNA, 12 bp, Homo sapiens
ctggcgccttct

SEQ ID NO: 1479273 - DNA, 18 bp, Homo sapiens
ctggcgccttctcggagc

SEQ ID NO: 1479274 - DNA, 17 bp, Homo sapiens
ctggcggaggtctctgg

SEQ ID NO: 1479275 - DNA, 18 bp, Homo sapiens
ctggcggggaaccctggg

SEQ ID NO: 1479276 - DNA, 20 bp, Homo sapiens
ctggcgttctcaagaatcta

SEQ ID NO: 1479277 - DNA, 16 bp, Homo sapiens
ctggctaactggaagc

SEQ ID NO: 1479278 - DNA, 17 bp, Homo sapiens
ctggctaactggaagca

SEQ ID NO: 1479279 - DNA, 13 bp, Homo sapiens
ctggctacagtac

SEQ ID NO: 1479280 - DNA, 19 bp, Homo sapiens
ctggctacatcccagcctg

SEQ ID NO: 1479281 - DNA, 22 bp, Homo sapiens
ctggctacttcccttcctcccg

SEQ ID NO: 1479282 - DNA, 13 bp, Homo sapiens
ctggctagagccg

SEQ ID NO: 1479283 - DNA, 16 bp, Homo sapiens
ctggctagagccgagg

SEQ ID NO: 1479284 - DNA, 20 bp, Homo sapiens
ctggctagaggccagcccca

SEQ ID NO: 1479285 - DNA, 13 bp, Homo sapiens
ctggctcaggccc

SEQ ID NO: 1479286 - DNA, 14 bp, Homo sapiens
ctggctcaggccca

SEQ ID NO: 1479287 - DNA, 16 bp, Homo sapiens
ctggctccaggcagaa

SEQ ID NO: 1479288 - DNA, 15 bp, Homo sapiens
ctggctcccacaggc

SEQ ID NO: 1479289 - DNA, 19 bp, Homo sapiens
ctggctcccacaggccctt

SEQ ID NO: 1479290 - DNA, 22 bp, Homo sapiens
ctggctcccacaggcccttcct

SEQ ID NO: 1479291 - DNA, 15 bp, Homo sapiens
ctggctccccaaagg

SEQ ID NO: 1479292 - DNA, 16 bp, Homo sapiens
ctggctccccacgagt

SEQ ID NO: 1479293 - DNA, 14 bp, Homo sapiens
ctggctcctgaggg

SEQ ID NO: 1479294 - DNA, 17 bp, Homo sapiens
ctggctcctgaggggca

SEQ ID NO: 1479295 - DNA, 19 bp, Homo sapiens
ctggctcggacccacccca

SEQ ID NO: 1479296 - DNA, 22 bp, Homo sapiens
ctggctctaattcacagtgctc

SEQ ID NO: 1479297 - DNA, 23 bp, Homo sapiens
ctggctctaattcacagtgctct

SEQ ID NO: 1479298 - DNA, 15 bp, Homo sapiens
ctggctctaccctgt

SEQ ID NO: 1479299 - DNA, 16 bp, Homo sapiens
ctggctctccaagtgc

SEQ ID NO: 1479300 - DNA, 17 bp, Homo sapiens
ctggctctccaagtgcc

SEQ ID NO: 1479301 - DNA, 18 bp, Homo sapiens
ctggctctgttcggcctt

SEQ ID NO: 1479302 - DNA, 21 bp, Homo sapiens
ctggctctgttcggcctttgg

SEQ ID NO: 1479303 - DNA, 23 bp, Homo sapiens
ctggctctgttcggcctttgggt

SEQ ID NO: 1479304 - DNA, 16 bp, Homo sapiens
ctggggaaggagccag

SEQ ID NO: 1479305 - DNA, 18 bp, Homo sapiens
ctggggaaggagccagtt

SEQ ID NO: 1479306 - DNA, 22 bp, Homo sapiens
ctggggaagggttttcttttct

SEQ ID NO: 1479307 - DNA, 14 bp, Homo sapiens
ctggggacagcttc

SEQ ID NO: 1479308 - DNA, 15 bp, Homo sapiens
ctggggacagcttcc

SEQ ID NO: 1479309 - DNA, 19 bp, Homo sapiens
ctggggacagcttcctcac

SEQ ID NO: 1479310 - DNA, 15 bp, Homo sapiens
ctggggaccaggagc

SEQ ID NO: 1479311 - DNA, 13 bp, Homo sapiens
ctggggactcagg

SEQ ID NO: 1479312 - DNA, 17 bp, Homo sapiens
ctggggactcagggacc

SEQ ID NO: 1479313 - DNA, 19 bp, Homo sapiens
ctggggagagcggctggag

SEQ ID NO: 1479314 - DNA, 20 bp, Homo sapiens
ctggggagagcggctggaga

SEQ ID NO: 1479315 - DNA, 12 bp, Homo sapiens
ctggggagcccg

SEQ ID NO: 1479316 - DNA, 15 bp, Homo sapiens
ctggggagcccgtct

SEQ ID NO: 1479317 - DNA, 20 bp, Homo sapiens
ctggggagcccgtctcagtg

SEQ ID NO: 1479318 - DNA, 18 bp, Homo sapiens
ctggggaggctgaggcag

SEQ ID NO: 1479319 - DNA, 23 bp, Homo sapiens
ctggggagtcctcattgaatcct

SEQ ID NO: 1479320 - DNA, 14 bp, Homo sapiens
ctggggatccccgc

SEQ ID NO: 1479321 - DNA, 17 bp, Homo sapiens
ctggggatcttcccaca

SEQ ID NO: 1479322 - DNA, 23 bp, Homo sapiens
ctggggatcttcccacaggaggg

SEQ ID NO: 1479323 - DNA, 20 bp, Homo sapiens
ctggggatgtcatagccaaa

SEQ ID NO: 1479324 - DNA, 16 bp, Homo sapiens
ctggggatgtctctca

SEQ ID NO: 1479325 - DNA, 14 bp, Homo sapiens
ctggggcaagtccc

SEQ ID NO: 1479326 - DNA, 21 bp, Homo sapiens
ctggggcacttggcagcgcgg

SEQ ID NO: 1479327 - DNA, 18 bp, Homo sapiens
ctggggcagcactcccca

SEQ ID NO: 1479328 - DNA, 21 bp, Homo sapiens
ctggggcagcactccccagag

SEQ ID NO: 1479329 - DNA, 17 bp, Homo sapiens
ctggggcatgtgtgcct

SEQ ID NO: 1479330 - DNA, 19 bp, Homo sapiens
ctggggcatgtgtgcctgt

SEQ ID NO: 1479331 - DNA, 21 bp, Homo sapiens
ctggggcatgtgtgcctgtgg

SEQ ID NO: 1479332 - DNA, 22 bp, Homo sapiens
ctggggcatgtgtgcctgtggc

SEQ ID NO: 1479333 - DNA, 17 bp, Homo sapiens
ctggggccgctggggtc

SEQ ID NO: 1479334 - DNA, 19 bp, Homo sapiens
ctggggccggcggggccca

SEQ ID NO: 1479335 - DNA, 21 bp, Homo sapiens
ctggggcctccagaagctgct

SEQ ID NO: 1479336 - DNA, 23 bp, Homo sapiens
ctggggcctcggagcctcatccg

SEQ ID NO: 1479337 - DNA, 20 bp, Homo sapiens
ctggggcctgactgctcaga

SEQ ID NO: 1479338 - DNA, 18 bp, Homo sapiens
ctggggcctggacctgcc

SEQ ID NO: 1479339 - DNA, 18 bp, Homo sapiens
ctggggctccctctctgg

SEQ ID NO: 1479340 - DNA, 14 bp, Homo sapiens
ctggggctcccttc

SEQ ID NO: 1479341 - DNA, 20 bp, Homo sapiens
ctggggctcctttctccagc

SEQ ID NO: 1479342 - DNA, 17 bp, Homo sapiens
ctggggctctgtgcagg

SEQ ID NO: 1479343 - DNA, 19 bp, Homo sapiens
ctggggctctgtgcaggga

SEQ ID NO: 1479344 - DNA, 20 bp, Homo sapiens
ctggggctgagtctccaggg

SEQ ID NO: 1479345 - DNA, 20 bp, Homo sapiens
ctggggctgatctcagggaa

SEQ ID NO: 1479346 - DNA, 23 bp, Homo sapiens
ctggggctgatctcagggaagcc

SEQ ID NO: 1479347 - DNA, 14 bp, Homo sapiens
ctggggctgctccc

SEQ ID NO: 1479348 - DNA, 15 bp, Homo sapiens
ctggggctgctcccc

SEQ ID NO: 1479349 - DNA, 15 bp, Homo sapiens
ctggggcttctcctg

SEQ ID NO: 1479350 - DNA, 20 bp, Homo sapiens
ctggggcttctcctgaccca

SEQ ID NO: 1479351 - DNA, 16 bp, Homo sapiens
ctgggggaaagggaac

SEQ ID NO: 1479352 - DNA, 17 bp, Homo sapiens
ctgggggaagccctgga

SEQ ID NO: 1479353 - DNA, 20 bp, Homo sapiens
ctgggggacccaatgtagga

SEQ ID NO: 1479354 - DNA, 19 bp, Homo sapiens
ctgggggacccctggctct

SEQ ID NO: 1479355 - DNA, 21 bp, Homo sapiens
ctgggggacccctggctctgg

SEQ ID NO: 1479356 - DNA, 19 bp, Homo sapiens
ctgggggagagaggcagca

SEQ ID NO: 1479357 - DNA, 19 bp, Homo sapiens
ctgggggaggtccaagcag

SEQ ID NO: 1479358 - DNA, 13 bp, Homo sapiens
ctgggggcacagg

SEQ ID NO: 1479359 - DNA, 12 bp, Homo sapiens
ctgggggcagga

SEQ ID NO: 1479360 - DNA, 19 bp, Homo sapiens
ctgggggccttgggtgagt

SEQ ID NO: 1479361 - DNA, 22 bp, Homo sapiens
ctgggggctctgttacactaat

SEQ ID NO: 1479362 - DNA, 17 bp, Homo sapiens
ctggggggacccagtgc

SEQ ID NO: 1479363 - DNA, 16 bp, Homo sapiens
ctggggggcagtggtg

SEQ ID NO: 1479364 - DNA, 17 bp, Homo sapiens
ctggggggctgtcctga

SEQ ID NO: 1479365 - DNA, 21 bp, Homo sapiens
ctggggggctgtcctgagccc

SEQ ID NO: 1479366 - DNA, 12 bp, Homo sapiens
ctggggtacagg

SEQ ID NO: 1479367 - DNA, 23 bp, Homo sapiens
ctggggtccgtcttcacactgcg

SEQ ID NO: 1479368 - DNA, 15 bp, Homo sapiens
ctggggtcctggggc

SEQ ID NO: 1479369 - DNA, 13 bp, Homo sapiens
ctggggtctgagc

SEQ ID NO: 1479370 - DNA, 18 bp, Homo sapiens
ctggggtctgagcatgat

SEQ ID NO: 1479371 - DNA, 13 bp, Homo sapiens
ctggggtctggag

SEQ ID NO: 1479372 - DNA, 16 bp, Homo sapiens
ctggggtgagggagtt

SEQ ID NO: 1479373 - DNA, 20 bp, Homo sapiens
ctggggtgagggagttaggg

SEQ ID NO: 1479374 - DNA, 20 bp, Homo sapiens
ctggggttcagcccctcctc

SEQ ID NO: 1479375 - DNA, 21 bp, Homo sapiens
ctggggttcagcccctcctct

SEQ ID NO: 1479376 - DNA, 19 bp, Homo sapiens
ctggggtttactgaggtga

SEQ ID NO: 1479377 - DNA, 16 bp, Homo sapiens
ctgggtaataaaagtg

SEQ ID NO: 1479378 - DNA, 21 bp, Homo sapiens
ctgggtacaagagatgggatg

SEQ ID NO: 1479379 - DNA, 21 bp, Homo sapiens
ctgggtacctgcaagcagaac

SEQ ID NO: 1479380 - DNA, 15 bp, Homo sapiens
ctgggtacttcttga

SEQ ID NO: 1479381 - DNA, 20 bp, Homo sapiens
ctgggtacttcttgaaggtg

SEQ ID NO: 1479382 - DNA, 16 bp, Homo sapiens
ctgggtatcccctgcc

SEQ ID NO: 1479383 - DNA, 21 bp, Homo sapiens
ctgggtatcccctgcctcctg

SEQ ID NO: 1479384 - DNA, 22 bp, Homo sapiens
ctgggtatcccctgcctcctgc

SEQ ID NO: 1479385 - DNA, 17 bp, Homo sapiens
ctgggtcacatccatcc

SEQ ID NO: 1479386 - DNA, 18 bp, Homo sapiens
ctgggtccgtctgagtgg

SEQ ID NO: 1479387 - DNA, 15 bp, Homo sapiens
ctgggtcctgcctgg

SEQ ID NO: 1479388 - DNA, 16 bp, Homo sapiens
ctgggtctcactcctg

SEQ ID NO: 1479389 - DNA, 14 bp, Homo sapiens
ctgggtctccctgg

SEQ ID NO: 1479390 - DNA, 22 bp, Homo sapiens
ctgggtctcgctttgttgccca

SEQ ID NO: 1479391 - DNA, 14 bp, Homo sapiens
ctgggtctgacctg

SEQ ID NO: 1479392 - DNA, 17 bp, Homo sapiens
ctgggtctgacctggtg

SEQ ID NO: 1479393 - DNA, 21 bp, Homo sapiens
ctgggtctgacctggtgggag

SEQ ID NO: 1479394 - DNA, 14 bp, Homo sapiens
ctgggtcttgccat

SEQ ID NO: 1479395 - DNA, 23 bp, Homo sapiens
ctgggtgacagagcaagactctg

SEQ ID NO: 1479396 - DNA, 19 bp, Homo sapiens
ctgggtgacagagtgagtg

SEQ ID NO: 1479397 - DNA, 14 bp, Homo sapiens
ctgggtgacagtga

SEQ ID NO: 1479398 - DNA, 19 bp, Homo sapiens
ctgggtgaccgactacccc

SEQ ID NO: 1479399 - DNA, 22 bp, Homo sapiens
ctgggtgaccgactaccccagt

SEQ ID NO: 1479400 - DNA, 16 bp, Homo sapiens
ctgggtgactggaggc

SEQ ID NO: 1479401 - DNA, 18 bp, Homo sapiens
ctgggtgagagaggaata

SEQ ID NO: 1479402 - DNA, 16 bp, Homo sapiens
ctgggtgagccaagga

SEQ ID NO: 1479403 - DNA, 19 bp, Homo sapiens
ctgggtgccaagtcctagc

SEQ ID NO: 1479404 - DNA, 12 bp, Homo sapiens
ctgggtgccctg

SEQ ID NO: 1479405 - DNA, 13 bp, Homo sapiens
ctgggtgccctga

SEQ ID NO: 1479406 - DNA, 14 bp, Homo sapiens
ctgggtgccctgaa

SEQ ID NO: 1479407 - DNA, 22 bp, Homo sapiens
ctgggtgccctgaaagggccct

SEQ ID NO: 1479408 - DNA, 16 bp, Homo sapiens
ctgggtgcgtctccag

SEQ ID NO: 1479409 - DNA, 21 bp, Homo sapiens
ctgggtggggctgctcctcca

SEQ ID NO: 1479410 - DNA, 22 bp, Homo sapiens
ctgggtgggtggtggggagggg

SEQ ID NO: 1479411 - DNA, 19 bp, Homo sapiens
ctgggtggtaccctctgga

SEQ ID NO: 1479412 - DNA, 21 bp, Homo sapiens
ctgggtggtagatttcctcct

SEQ ID NO: 1479413 - DNA, 20 bp, Homo sapiens
ctgggtgtccccgctgctgt

SEQ ID NO: 1479414 - DNA, 22 bp, Homo sapiens
ctgggttaaatattttgctaac

SEQ ID NO: 1479415 - DNA, 23 bp, Homo sapiens
ctgggttaaatattttgctaact

SEQ ID NO: 1479416 - DNA, 14 bp, Homo sapiens
ctgggttaacaaat

SEQ ID NO: 1479417 - DNA, 19 bp, Homo sapiens
ctgggttacagtgttttat

SEQ ID NO: 1479418 - DNA, 15 bp, Homo sapiens
ctgtacttcaagtta

SEQ ID NO: 1479419 - DNA, 20 bp, Homo sapiens
ctgtacttcaagttaaagtg

SEQ ID NO: 1479420 - DNA, 16 bp, Homo sapiens
ctgtacttcttgaata

SEQ ID NO: 1479421 - DNA, 15 bp, Homo sapiens
ctgtactttgccatt

SEQ ID NO: 1479422 - DNA, 19 bp, Homo sapiens
ctgtacttttcccatttgt

SEQ ID NO: 1479423 - DNA, 20 bp, Homo sapiens
ctgtagaaacacataacaaa

SEQ ID NO: 1479424 - DNA, 21 bp, Homo sapiens
ctgtagaaagatcgtttaaaa

SEQ ID NO: 1479425 - DNA, 13 bp, Homo sapiens
ctgtagagttgct

SEQ ID NO: 1479426 - DNA, 16 bp, Homo sapiens
ctgtagagttgctgag

SEQ ID NO: 1479427 - DNA, 14 bp, Homo sapiens
ctgtagatatgtat

SEQ ID NO: 1479428 - DNA, 20 bp, Homo sapiens
ctgtagatatgtattctttt

SEQ ID NO: 1479429 - DNA, 13 bp, Homo sapiens
ctgtagattctgt

SEQ ID NO: 1479430 - DNA, 20 bp, Homo sapiens
ctgtagattctgtggaacaa

SEQ ID NO: 1479431 - DNA, 21 bp, Homo sapiens
ctgtagattgcttctgtagta

SEQ ID NO: 1479432 - DNA, 17 bp, Homo sapiens
ctgtagcattacagtgg

SEQ ID NO: 1479433 - DNA, 18 bp, Homo sapiens
ctgtagccatggctcagg

SEQ ID NO: 1479434 - DNA, 15 bp, Homo sapiens
ctgtagcccaggcca

SEQ ID NO: 1479435 - DNA, 18 bp, Homo sapiens
ctgtagcctaaaacgaat

SEQ ID NO: 1479436 - DNA, 12 bp, Homo sapiens
ctgtagctcagt

SEQ ID NO: 1479437 - DNA, 13 bp, Homo sapiens
ctgtagctcagtc

SEQ ID NO: 1479438 - DNA, 16 bp, Homo sapiens
ctgtagctcagtcatc

SEQ ID NO: 1479439 - DNA, 13 bp, Homo sapiens
ctgtagctccctc

SEQ ID NO: 1479440 - DNA, 15 bp, Homo sapiens
ctgtagctccctcct

SEQ ID NO: 1479441 - DNA, 16 bp, Homo sapiens
ctgtagctccctcctc

SEQ ID NO: 1479442 - DNA, 18 bp, Homo sapiens
ctgtagctccctcctccc

SEQ ID NO: 1479443 - DNA, 19 bp, Homo sapiens
ctgtagctccctcctccca

SEQ ID NO: 1479444 - DNA, 21 bp, Homo sapiens
ctgtagctccctcctcccatc

SEQ ID NO: 1479445 - DNA, 15 bp, Homo sapiens
ctgtagctttcctgg

SEQ ID NO: 1479446 - DNA, 18 bp, Homo sapiens
ctgtaggaaggttaatgt

SEQ ID NO: 1479447 - DNA, 18 bp, Homo sapiens
ctgtaggagttctatttt

SEQ ID NO: 1479448 - DNA, 18 bp, Homo sapiens
ctgtagggaaaccttgga

SEQ ID NO: 1479449 - DNA, 14 bp, Homo sapiens
ctgtagggctggac

SEQ ID NO: 1479450 - DNA, 17 bp, Homo sapiens
ctgtagggtccaaccag

SEQ ID NO: 1479451 - DNA, 23 bp, Homo sapiens
ctgtagggtccaaccagacctgg

SEQ ID NO: 1479452 - DNA, 20 bp, Homo sapiens
ctgtaggttcatgcccaagc

SEQ ID NO: 1479453 - DNA, 19 bp, Homo sapiens
ctgtagtaaactatttatc

SEQ ID NO: 1479454 - DNA, 23 bp, Homo sapiens
ctgtagtactccttaagaacaca

SEQ ID NO: 1479455 - DNA, 14 bp, Homo sapiens
ctgtagtcccagct

SEQ ID NO: 1479456 - DNA, 18 bp, Homo sapiens
ctgtagtcccagctactc

SEQ ID NO: 1479457 - DNA, 20 bp, Homo sapiens
ctgtagtcctagccactcag

SEQ ID NO: 1479458 - DNA, 15 bp, Homo sapiens
ctgtagtctcagcta

SEQ ID NO: 1479459 - DNA, 19 bp, Homo sapiens
ctgtagtgagaaactgatt

SEQ ID NO: 1479460 - DNA, 16 bp, Homo sapiens
ctgtagttctaagact

SEQ ID NO: 1479461 - DNA, 20 bp, Homo sapiens
ctgtagttgcgtggactctg

SEQ ID NO: 1479462 - DNA, 15 bp, Homo sapiens
ctgtagtttagttct

SEQ ID NO: 1479463 - DNA, 17 bp, Homo sapiens
ctgtagtttagttctgt

SEQ ID NO: 1479464 - DNA, 19 bp, Homo sapiens
ctgtagtttagttctgttg

SEQ ID NO: 1479465 - DNA, 19 bp, Homo sapiens
ctgtagtttttgaaaatta

SEQ ID NO: 1479466 - DNA, 21 bp, Homo sapiens
ctgtataagttgaaggaaaat

SEQ ID NO: 1479467 - DNA, 22 bp, Homo sapiens
ctgtatacagtgcagagccttc

SEQ ID NO: 1479468 - DNA, 16 bp, Homo sapiens
ctgtatactcctgtca

SEQ ID NO: 1479469 - DNA, 18 bp, Homo sapiens
ctgtatatacaataacat

SEQ ID NO: 1479470 - DNA, 19 bp, Homo sapiens
ctgtatatacaataacata

SEQ ID NO: 1479471 - DNA, 23 bp, Homo sapiens
ctgtatatacaataacataattt

SEQ ID NO: 1479472 - DNA, 22 bp, Homo sapiens
ctgtatatgattctctgtggtt

SEQ ID NO: 1479473 - DNA, 13 bp, Homo sapiens
ctgtatatgtatt

SEQ ID NO: 1479474 - DNA, 15 bp, Homo sapiens
ctgtatcaaatctgt

SEQ ID NO: 1479475 - DNA, 16 bp, Homo sapiens
ctgtatcattttcttt

SEQ ID NO: 1479476 - DNA, 23 bp, Homo sapiens
ctgtatccaggttccctcccaga

SEQ ID NO: 1479477 - DNA, 21 bp, Homo sapiens
ctgtatccgtgaattgcttta

SEQ ID NO: 1479478 - DNA, 17 bp, Homo sapiens
ctgtatcggagacagtg

SEQ ID NO: 1479479 - DNA, 18 bp, Homo sapiens
ctgtatctaaaaaataac

SEQ ID NO: 1479480 - DNA, 13 bp, Homo sapiens
ctgtatctgtgta

SEQ ID NO: 1479481 - DNA, 18 bp, Homo sapiens
ctgtatcttgtttttcca

SEQ ID NO: 1479482 - DNA, 20 bp, Homo sapiens
ctgtatgaaaaattggggag

SEQ ID NO: 1479483 - DNA, 21 bp, Homo sapiens
ctgtatgaaaaattggggagg

SEQ ID NO: 1479484 - DNA, 12 bp, Homo sapiens
ctgtatgattta

SEQ ID NO: 1479485 - DNA, 23 bp, Homo sapiens
ctgtatgatttgttttgaatttt

SEQ ID NO: 1479486 - DNA, 14 bp, Homo sapiens
ctgtatgcaaagtc

SEQ ID NO: 1479487 - DNA, 17 bp, Homo sapiens
ctgtatgcagtactaaa

SEQ ID NO: 1479488 - DNA, 15 bp, Homo sapiens
ctgtatgctgatcat

SEQ ID NO: 1479489 - DNA, 20 bp, Homo sapiens
ctgtatggctgtatttgctg

SEQ ID NO: 1479490 - DNA, 19 bp, Homo sapiens
ctgtattaagagtgaaaat

SEQ ID NO: 1479491 - DNA, 13 bp, Homo sapiens
ctgtattctcaaa

SEQ ID NO: 1479492 - DNA, 18 bp, Homo sapiens
ctgtattctcaaacacag

SEQ ID NO: 1479493 - DNA, 17 bp, Homo sapiens
ctgtattcttgtttgaa

SEQ ID NO: 1479494 - DNA, 13 bp, Homo sapiens
ctgtattgccccc

SEQ ID NO: 1479495 - DNA, 15 bp, Homo sapiens
ctgtatttaattttg

SEQ ID NO: 1479496 - DNA, 17 bp, Homo sapiens
ctgtatttatgtgtgag

SEQ ID NO: 1479497 - DNA, 18 bp, Homo sapiens
ctgtatttgaaataagaa

SEQ ID NO: 1479498 - DNA, 14 bp, Homo sapiens
ctgtatttgagaga

SEQ ID NO: 1479499 - DNA, 17 bp, Homo sapiens
ctgtatttgagagactg

SEQ ID NO: 1479500 - DNA, 22 bp, Homo sapiens
ctgtattttaacactttgtatt

SEQ ID NO: 1479501 - DNA, 21 bp, Homo sapiens
ctgtattttcttttatatctg

SEQ ID NO: 1479502 - DNA, 18 bp, Homo sapiens
ctgtatttttttttctaa

SEQ ID NO: 1479503 - DNA, 16 bp, Homo sapiens
ctgtcaaaataatttt

SEQ ID NO: 1479504 - DNA, 14 bp, Homo sapiens
ctgtcaagtacaag

SEQ ID NO: 1479505 - DNA, 14 bp, Homo sapiens
ctgtcaagttaaca

SEQ ID NO: 1479506 - DNA, 20 bp, Homo sapiens
ctgtcaagttaacaaggaat

SEQ ID NO: 1479507 - DNA, 21 bp, Homo sapiens
ctgtcaagttaacaaggaatg

SEQ ID NO: 1479508 - DNA, 15 bp, Homo sapiens
ctgtcacaaccaaga

SEQ ID NO: 1479509 - DNA, 14 bp, Homo sapiens
ctgtcaccaagctc

SEQ ID NO: 1479510 - DNA, 15 bp, Homo sapiens
ctgtcaccaaggaaa

SEQ ID NO: 1479511 - DNA, 15 bp, Homo sapiens
ctgtcaccagagctt

SEQ ID NO: 1479512 - DNA, 19 bp, Homo sapiens
ctgtcacctagaacgtgca

SEQ ID NO: 1479513 - DNA, 19 bp, Homo sapiens
ctgtcacgctcatgtcctg

SEQ ID NO: 1479514 - DNA, 24 bp, Homo sapiens
ctgtcacgctcatgtcctgtcctg

SEQ ID NO: 1479515 - DNA, 13 bp, Homo sapiens
ctgtcactcagct

SEQ ID NO: 1479516 - DNA, 18 bp, Homo sapiens
ctgtcactcagctgagaa

SEQ ID NO: 1479517 - DNA, 19 bp, Homo sapiens
ctgtcactcagctgagaag

SEQ ID NO: 1479518 - DNA, 22 bp, Homo sapiens
ctgtcactcattgctgagcctc

SEQ ID NO: 1479519 - DNA, 12 bp, Homo sapiens
ctgtcactgccg

SEQ ID NO: 1479520 - DNA, 15 bp, Homo sapiens
ctgtcactgctgctt

SEQ ID NO: 1479521 - DNA, 18 bp, Homo sapiens
ctgtcacttcttcacctc

SEQ ID NO: 1479522 - DNA, 21 bp, Homo sapiens
ctgtcactttttttctttttc

SEQ ID NO: 1479523 - DNA, 14 bp, Homo sapiens
ctgtcagaataata

SEQ ID NO: 1479524 - DNA, 20 bp, Homo sapiens
ctgtcagagaatatgaccta

SEQ ID NO: 1479525 - DNA, 15 bp, Homo sapiens
ctgtcagaggctaag

SEQ ID NO: 1479526 - DNA, 21 bp, Homo sapiens
ctgtcagataccctgtttctg

SEQ ID NO: 1479527 - DNA, 18 bp, Homo sapiens
ctgtcagccgggccctga

SEQ ID NO: 1479528 - DNA, 15 bp, Homo sapiens
ctgtcagtggggcag

SEQ ID NO: 1479529 - DNA, 19 bp, Homo sapiens
ctgtcagtggggcagcctc

SEQ ID NO: 1479530 - DNA, 19 bp, Homo sapiens
ctgtcagttctaacctcct

SEQ ID NO: 1479531 - DNA, 14 bp, Homo sapiens
ctgtcatagaaagt

SEQ ID NO: 1479532 - DNA, 16 bp, Homo sapiens
ctgtcatagaaattac

SEQ ID NO: 1479533 - DNA, 18 bp, Homo sapiens
ctgtgagacccccacacc

SEQ ID NO: 1479534 - DNA, 20 bp, Homo sapiens
ctgtgagacccccacacctc

SEQ ID NO: 1479535 - DNA, 23 bp, Homo sapiens
ctgtgagacccccacacctcagt

SEQ ID NO: 1479536 - DNA, 14 bp, Homo sapiens
ctgtgagcagcctc

SEQ ID NO: 1479537 - DNA, 17 bp, Homo sapiens
ctgtgagcagcctccac

SEQ ID NO: 1479538 - DNA, 20 bp, Homo sapiens
ctgtgagcagcctccactgt

SEQ ID NO: 1479539 - DNA, 21 bp, Homo sapiens
ctgtgagcagcctccactgtg

SEQ ID NO: 1479540 - DNA, 18 bp, Homo sapiens
ctgtgagcatcctggcag

SEQ ID NO: 1479541 - DNA, 18 bp, Homo sapiens
ctgtgagcatccttccca

SEQ ID NO: 1479542 - DNA, 13 bp, Homo sapiens
ctgtgagccagtc

SEQ ID NO: 1479543 - DNA, 14 bp, Homo sapiens
ctgtgagccagtct

SEQ ID NO: 1479544 - DNA, 15 bp, Homo sapiens
ctgtgaggctgtcct

SEQ ID NO: 1479545 - DNA, 16 bp, Homo sapiens
ctgtgaggctgtcctg

SEQ ID NO: 1479546 - DNA, 14 bp, Homo sapiens
ctgtgagggagggg

SEQ ID NO: 1479547 - DNA, 15 bp, Homo sapiens
ctgtgaggggaaggc

SEQ ID NO: 1479548 - DNA, 17 bp, Homo sapiens
ctgtgaggggaaggcct

SEQ ID NO: 1479549 - DNA, 22 bp, Homo sapiens
ctgtgaggtgcagagtgcccag

SEQ ID NO: 1479550 - DNA, 19 bp, Homo sapiens
ctgtgaggtgctgatgagt

SEQ ID NO: 1479551 - DNA, 22 bp, Homo sapiens
ctgtgagtctttggttctaagg

SEQ ID NO: 1479552 - DNA, 17 bp, Homo sapiens
ctgtgagtttaaagcaa

SEQ ID NO: 1479553 - DNA, 22 bp, Homo sapiens
ctgtgatcccagtagaaaatat

SEQ ID NO: 1479554 - DNA, 19 bp, Homo sapiens
ctgtgatccttggtgctgt

SEQ ID NO: 1479555 - DNA, 18 bp, Homo sapiens
ctgtgatcttttaaagtg

SEQ ID NO: 1479556 - DNA, 14 bp, Homo sapiens
ctgtgatgagctga

SEQ ID NO: 1479557 - DNA, 15 bp, Homo sapiens
ctgtgatgcatgagc

SEQ ID NO: 1479558 - DNA, 17 bp, Homo sapiens
ctgtgatgccacacaga

SEQ ID NO: 1479559 - DNA, 19 bp, Homo sapiens
ctgtgatggccaggccagg

SEQ ID NO: 1479560 - DNA, 13 bp, Homo sapiens
ctgtgattaactt

SEQ ID NO: 1479561 - DNA, 12 bp, Homo sapiens
ctgtgattagat

SEQ ID NO: 1479562 - DNA, 22 bp, Homo sapiens
ctgtgattccactacacctggc

SEQ ID NO: 1479563 - DNA, 14 bp, Homo sapiens
ctgtgattggctgg

SEQ ID NO: 1479564 - DNA, 22 bp, Homo sapiens
ctgtgattgggcgtagaagtgg

SEQ ID NO: 1479565 - DNA, 23 bp, Homo sapiens
ctgtgattgggtgggattttttc

SEQ ID NO: 1479566 - DNA, 18 bp, Homo sapiens
ctgtgatttatttggagt

SEQ ID NO: 1479567 - DNA, 23 bp, Homo sapiens
ctgtgatttatttggagtggagg

SEQ ID NO: 1479568 - DNA, 21 bp, Homo sapiens
ctgtgcaacgccgtgggctgc

SEQ ID NO: 1479569 - DNA, 19 bp, Homo sapiens
ctgtgcaacggtctcctga

SEQ ID NO: 1479570 - DNA, 17 bp, Homo sapiens
ctgtgcacacccacctt

SEQ ID NO: 1479571 - DNA, 20 bp, Homo sapiens
ctgtgcacctattctgtagt

SEQ ID NO: 1479572 - DNA, 17 bp, Homo sapiens
ctgtgcagatgagcagt

SEQ ID NO: 1479573 - DNA, 14 bp, Homo sapiens
ctgtgcagcagccc

SEQ ID NO: 1479574 - DNA, 16 bp, Homo sapiens
ctgtgcagcagcccag

SEQ ID NO: 1479575 - DNA, 18 bp, Homo sapiens
ctgtgcagcagcccagct

SEQ ID NO: 1479576 - DNA, 19 bp, Homo sapiens
ctgtgcagcagcccagctt

SEQ ID NO: 1479577 - DNA, 24 bp, Homo sapiens
ctgtgcagcagcccagcttcctgg

SEQ ID NO: 1479578 - DNA, 15 bp, Homo sapiens
ctgtgcaggagctag

SEQ ID NO: 1479579 - DNA, 15 bp, Homo sapiens
ctgtgcaggatattt

SEQ ID NO: 1479580 - DNA, 19 bp, Homo sapiens
ctgtgcaggtgctgccttg

SEQ ID NO: 1479581 - DNA, 14 bp, Homo sapiens
ctgtgcatgggtga

SEQ ID NO: 1479582 - DNA, 22 bp, Homo sapiens
ctgtgcatgggtgaagggagag

SEQ ID NO: 1479583 - DNA, 17 bp, Homo sapiens
ctgtgcatgtatgtctt

SEQ ID NO: 1479584 - DNA, 15 bp, Homo sapiens
ctgtgcattagatat

SEQ ID NO: 1479585 - DNA, 17 bp, Homo sapiens
ctgtgcatttctggttg

SEQ ID NO: 1479586 - DNA, 22 bp, Homo sapiens
ctgtgccagaggaaggaaaagg

SEQ ID NO: 1479587 - DNA, 22 bp, Homo sapiens
ctgtgcccacatcccaggcttc

SEQ ID NO: 1479588 - DNA, 12 bp, Homo sapiens
ctgtgcccagca

SEQ ID NO: 1479589 - DNA, 17 bp, Homo sapiens
ctgtgcccagcaggccc

SEQ ID NO: 1479590 - DNA, 20 bp, Homo sapiens
ctgtgcccagcaggcccagc

SEQ ID NO: 1479591 - DNA, 17 bp, Homo sapiens
ctgtgccccatgcctgt

SEQ ID NO: 1479592 - DNA, 14 bp, Homo sapiens
ctgtgccctcacca

SEQ ID NO: 1479593 - DNA, 19 bp, Homo sapiens
ctgtgccctcaccaccaca

SEQ ID NO: 1479594 - DNA, 16 bp, Homo sapiens
ctgtgccctccaaaga

SEQ ID NO: 1479595 - DNA, 17 bp, Homo sapiens
ctgtgccctccaaagag

SEQ ID NO: 1479596 - DNA, 12 bp, Homo sapiens
ctgtgccctggt

SEQ ID NO: 1479597 - DNA, 13 bp, Homo sapiens
ctgtgccctggtg

SEQ ID NO: 1479598 - DNA, 15 bp, Homo sapiens
ctgtgccctggtgga

SEQ ID NO: 1479599 - DNA, 14 bp, Homo sapiens
ctgtgcctcaggcc

SEQ ID NO: 1479600 - DNA, 14 bp, Homo sapiens
ctgtgcctctggga

SEQ ID NO: 1479601 - DNA, 17 bp, Homo sapiens
ctgtgcctctgggactg

SEQ ID NO: 1479602 - DNA, 16 bp, Homo sapiens
ctgtgcctgctagagc

SEQ ID NO: 1479603 - DNA, 18 bp, Homo sapiens
ctgtgcctgctagagcaa

SEQ ID NO: 1479604 - DNA, 13 bp, Homo sapiens
ctgtgcctgctca

SEQ ID NO: 1479605 - DNA, 19 bp, Homo sapiens
ctgtgcctgctcagcagcc

SEQ ID NO: 1479606 - DNA, 23 bp, Homo sapiens
ctgtgcctgctcagcagccagtc

SEQ ID NO: 1479607 - DNA, 20 bp, Homo sapiens
ctgtgccttggtctctcctt

SEQ ID NO: 1479608 - DNA, 16 bp, Homo sapiens
ctgtgccttttgccat

SEQ ID NO: 1479609 - DNA, 14 bp, Homo sapiens
ctgtgcgcccaggg

SEQ ID NO: 1479610 - DNA, 16 bp, Homo sapiens
ctgtgcgccttgtaga

SEQ ID NO: 1479611 - DNA, 14 bp, Homo sapiens
ctgtgcgtcccagc

SEQ ID NO: 1479612 - DNA, 19 bp, Homo sapiens
ctgtgcgtcccagctgaag

SEQ ID NO: 1479613 - DNA, 19 bp, Homo sapiens
ctgtgctatttgtacaaat

SEQ ID NO: 1479614 - DNA, 21 bp, Homo sapiens
ctgtgctatttgtacaaataa

SEQ ID NO: 1479615 - DNA, 22 bp, Homo sapiens
ctgtgctatttgtacaaataaa

SEQ ID NO: 1479616 - DNA, 13 bp, Homo sapiens
ctgtgctcagaag

SEQ ID NO: 1479617 - DNA, 19 bp, Homo sapiens
ctgtgctcatcggagactg

SEQ ID NO: 1479618 - DNA, 16 bp, Homo sapiens
ctgtgctccaacctga

SEQ ID NO: 1479619 - DNA, 23 bp, Homo sapiens
ctgtgctccatatttgatttcta

SEQ ID NO: 1479620 - DNA, 17 bp, Homo sapiens
ctgtgctcccctgccac

SEQ ID NO: 1479621 - DNA, 10 bp, Homo sapiens
ctgtgctccg

SEQ ID NO: 1479622 - DNA, 15 bp, Homo sapiens
ctgtgctccgtgcct

SEQ ID NO: 1479623 - DNA, 17 bp, Homo sapiens
ctgtgctccgtgcctcc

SEQ ID NO: 1479624 - DNA, 18 bp, Homo sapiens
ctgtgctccgtgcctcca

SEQ ID NO: 1479625 - DNA, 21 bp, Homo sapiens
ctgtgctccgtgcctccacca

SEQ ID NO: 1479626 - DNA, 12 bp, Homo sapiens
ctgtgctctgaa

SEQ ID NO: 1479627 - DNA, 15 bp, Homo sapiens
ctgtgctctggggat

SEQ ID NO: 1479628 - DNA, 20 bp, Homo sapiens
ctgtgctctggggatttctg

SEQ ID NO: 1479629 - DNA, 22 bp, Homo sapiens
ctgtgctctggggatttctggg

SEQ ID NO: 1479630 - DNA, 18 bp, Homo sapiens
ctgtgctctttgaagaga

SEQ ID NO: 1479631 - DNA, 13 bp, Homo sapiens
ctgtgctgaggcc

SEQ ID NO: 1479632 - DNA, 14 bp, Homo sapiens
ctgtgctgatcctg

SEQ ID NO: 1479633 - DNA, 23 bp, Homo sapiens
ctgtgctgatcctgctgacctca

SEQ ID NO: 1479634 - DNA, 19 bp, Homo sapiens
ctgtgctggaattccacag

SEQ ID NO: 1479635 - DNA, 22 bp, Homo sapiens
ctgtgctgggccagtggctggg

SEQ ID NO: 1479636 - DNA, 12 bp, Homo sapiens
ctgtgctgtgcc

SEQ ID NO: 1479637 - DNA, 16 bp, Homo sapiens
ctgtgctgtgcctgct

SEQ ID NO: 1479638 - DNA, 19 bp, Homo sapiens
ctgtgctgtgcctgctaga

SEQ ID NO: 1479639 - DNA, 13 bp, Homo sapiens
ctgtgctgtgtgt

SEQ ID NO: 1479640 - DNA, 21 bp, Homo sapiens
ctgtgctttcccagaggacac

SEQ ID NO: 1479641 - DNA, 23 bp, Homo sapiens
ctgtggaagcaaggctggggtct

SEQ ID NO: 1479642 - DNA, 18 bp, Homo sapiens
ctgtggaaggcagagaaa

SEQ ID NO: 1479643 - DNA, 22 bp, Homo sapiens
ctgtggacaggatgaggacaga

SEQ ID NO: 1479644 - DNA, 19 bp, Homo sapiens
ctgtggaccgtggacaggc

SEQ ID NO: 1479645 - DNA, 21 bp, Homo sapiens
ctgtggaccgtggacaggccc

SEQ ID NO: 1479646 - DNA, 22 bp, Homo sapiens
ctgtggaccgtggacaggccca

SEQ ID NO: 1479647 - DNA, 15 bp, Homo sapiens
ctgttgattgcagga

SEQ ID NO: 1479648 - DNA, 19 bp, Homo sapiens
ctgttgcagtggcctggcc

SEQ ID NO: 1479649 - DNA, 20 bp, Homo sapiens
ctgttgcagtggcctggccg

SEQ ID NO: 1479650 - DNA, 13 bp, Homo sapiens
ctgttgccacaac

SEQ ID NO: 1479651 - DNA, 15 bp, Homo sapiens
ctgttgccatagccc

SEQ ID NO: 1479652 - DNA, 22 bp, Homo sapiens
ctgttgctcaaatctattcaga

SEQ ID NO: 1479653 - DNA, 14 bp, Homo sapiens
ctgttgctttacag

SEQ ID NO: 1479654 - DNA, 15 bp, Homo sapiens
ctgttggagaaagaa

SEQ ID NO: 1479655 - DNA, 18 bp, Homo sapiens
ctgttggcactcacagac

SEQ ID NO: 1479656 - DNA, 16 bp, Homo sapiens
ctgttggcaggcccac

SEQ ID NO: 1479657 - DNA, 15 bp, Homo sapiens
ctgttggcaggctgg

SEQ ID NO: 1479658 - DNA, 16 bp, Homo sapiens
ctgttggctgctcccc

SEQ ID NO: 1479659 - DNA, 14 bp, Homo sapiens
ctgttggggagggg

SEQ ID NO: 1479660 - DNA, 18 bp, Homo sapiens
ctgttggtcctctctctg

SEQ ID NO: 1479661 - DNA, 19 bp, Homo sapiens
ctgttggtcctctctctgt

SEQ ID NO: 1479662 - DNA, 15 bp, Homo sapiens
ctgttggttcaaact

SEQ ID NO: 1479663 - DNA, 23 bp, Homo sapiens
ctgttgtaaacaacgtgtatagt

SEQ ID NO: 1479664 - DNA, 17 bp, Homo sapiens
ctgttgtaagaattctg

SEQ ID NO: 1479665 - DNA, 22 bp, Homo sapiens
ctgttgtctgcgcctgaaaagg

SEQ ID NO: 1479666 - DNA, 21 bp, Homo sapiens
ctgttgtggaaagtagctgct

SEQ ID NO: 1479667 - DNA, 22 bp, Homo sapiens
ctgttgtggaaagtagctgcta

SEQ ID NO: 1479668 - DNA, 21 bp, Homo sapiens
ctgttgtgtatagatgcaaga

SEQ ID NO: 1479669 - DNA, 12 bp, Homo sapiens
ctgttgttccat

SEQ ID NO: 1479670 - DNA, 16 bp, Homo sapiens
ctgttgttccatttta

SEQ ID NO: 1479671 - DNA, 12 bp, Homo sapiens
ctgttgttcccg

SEQ ID NO: 1479672 - DNA, 22 bp, Homo sapiens
ctgtttaaagtcacatccctgt

SEQ ID NO: 1479673 - DNA, 14 bp, Homo sapiens
ctgtttactgcttt

SEQ ID NO: 1479674 - DNA, 19 bp, Homo sapiens
ctgtttagcgaacttgtat

SEQ ID NO: 1479675 - DNA, 19 bp, Homo sapiens
ctgtttaggttcccctgtc

SEQ ID NO: 1479676 - DNA, 21 bp, Homo sapiens
ctgtttaggttcccctgtcaa

SEQ ID NO: 1479677 - DNA, 13 bp, Homo sapiens
ctgtttatggcct

SEQ ID NO: 1479678 - DNA, 16 bp, Homo sapiens
ctgtttatggcctcag

SEQ ID NO: 1479679 - DNA, 22 bp, Homo sapiens
ctgtttatggcctcagctgcct

SEQ ID NO: 1479680 - DNA, 18 bp, Homo sapiens
ctgtttattcttccagaa

SEQ ID NO: 1479681 - DNA, 15 bp, Homo sapiens
ctgtttatttaagga

SEQ ID NO: 1479682 - DNA, 21 bp, Homo sapiens
ctgtttatttaaggatggatg

SEQ ID NO: 1479683 - DNA, 17 bp, Homo sapiens
ctgtttatttattcact

SEQ ID NO: 1479684 - DNA, 18 bp, Homo sapiens
ctgtttattttttttggc

SEQ ID NO: 1479685 - DNA, 22 bp, Homo sapiens
ctgtttattttttttggcctgt

SEQ ID NO: 1479686 - DNA, 18 bp, Homo sapiens
ctgtttcaaactgaattt

SEQ ID NO: 1479687 - DNA, 22 bp, Homo sapiens
ctgtttcaaggcactctagatt

SEQ ID NO: 1479688 - DNA, 14 bp, Homo sapiens
ctgtttcagtgtga

SEQ ID NO: 1479689 - DNA, 16 bp, Homo sapiens
ctgtttcccaggccca

SEQ ID NO: 1479690 - DNA, 13 bp, Homo sapiens
ctgtttccctgct

SEQ ID NO: 1479691 - DNA, 16 bp, Homo sapiens
ctgtttcctagctgtg

SEQ ID NO: 1479692 - DNA, 17 bp, Homo sapiens
ctgtttcctagctgtgt

SEQ ID NO: 1479693 - DNA, 18 bp, Homo sapiens
ctgtttctaagaaaatgt

SEQ ID NO: 1479694 - DNA, 17 bp, Homo sapiens
ctgtttctctgctgtca

SEQ ID NO: 1479695 - DNA, 21 bp, Homo sapiens
ctgtttctcttgagctggcct

SEQ ID NO: 1479696 - DNA, 20 bp, Homo sapiens
ctgtttctctttccttggct

SEQ ID NO: 1479697 - DNA, 23 bp, Homo sapiens
ctgtttctggacccttataaaat

SEQ ID NO: 1479698 - DNA, 22 bp, Homo sapiens
ctgtttgaggatatattttcac

SEQ ID NO: 1479699 - DNA, 10 bp, Homo sapiens
ctgtttgatg

SEQ ID NO: 1479700 - DNA, 20 bp, Homo sapiens
ctgtttgatgtatgtgtgaa

SEQ ID NO: 1479701 - DNA, 20 bp, Homo sapiens
ctgtttgcaggcccagagga

SEQ ID NO: 1479702 - DNA, 20 bp, Homo sapiens
ctgtttgctcaaaattgctt

SEQ ID NO: 1479703 - DNA, 17 bp, Homo sapiens
ctgtttggcacttgtat

SEQ ID NO: 1479704 - DNA, 20 bp, Homo sapiens
ctgtttgggaagagcttaga

SEQ ID NO: 1479705 - DNA, 22 bp, Homo sapiens
ctgtttgggaagagcttagaaa

SEQ ID NO: 1479706 - DNA, 20 bp, Homo sapiens
ctgtttggtttgtttataat

SEQ ID NO: 1479707 - DNA, 21 bp, Homo sapiens
ctgtttggtttgtttataatg

SEQ ID NO: 1479708 - DNA, 15 bp, Homo sapiens
ctgtttgtatgaaat

SEQ ID NO: 1479709 - DNA, 11 bp, Homo sapiens
ctgtttgtcat

SEQ ID NO: 1479710 - DNA, 16 bp, Homo sapiens
ctgtttgtcctgagat

SEQ ID NO: 1479711 - DNA, 17 bp, Homo sapiens
ctgtttgtctgaacaaa

SEQ ID NO: 1479712 - DNA, 13 bp, Homo sapiens
ctgtttgttattg

SEQ ID NO: 1479713 - DNA, 15 bp, Homo sapiens
ctgtttgtttcaaga

SEQ ID NO: 1479714 - DNA, 20 bp, Homo sapiens
ctgtttgtttgacaaagaaa

SEQ ID NO: 1479715 - DNA, 22 bp, Homo sapiens
ctgttttaagaaatctggccca

SEQ ID NO: 1479716 - DNA, 14 bp, Homo sapiens
ctgttttaattgta

SEQ ID NO: 1479717 - DNA, 21 bp, Homo sapiens
ctgttttagtgtttatgttta

SEQ ID NO: 1479718 - DNA, 16 bp, Homo sapiens
ctgttttagtttctga

SEQ ID NO: 1479719 - DNA, 18 bp, Homo sapiens
ctgttttagtttctgaac

SEQ ID NO: 1479720 - DNA, 14 bp, Homo sapiens
ctgttttatctctg

SEQ ID NO: 1479721 - DNA, 15 bp, Homo sapiens
ctgttttatgtcata

SEQ ID NO: 1479722 - DNA, 22 bp, Homo sapiens
ctgttttatgtcatactctgtg

SEQ ID NO: 1479723 - DNA, 17 bp, Homo sapiens
ctgttttcccccagcaa

SEQ ID NO: 1479724 - DNA, 20 bp, Homo sapiens
ctgttttctgaaacacacga

SEQ ID NO: 1479725 - DNA, 19 bp, Homo sapiens
ctgttttctgagcccgggc

SEQ ID NO: 1479726 - DNA, 16 bp, Homo sapiens
ctgttttgcacagtta

SEQ ID NO: 1479727 - DNA, 15 bp, Homo sapiens
ctgttttgccaagaa

SEQ ID NO: 1479728 - DNA, 16 bp, Homo sapiens
ctgtttttaaaaatta

SEQ ID NO: 1479729 - DNA, 16 bp, Homo sapiens
ctgtttttaagctgtt

SEQ ID NO: 1479730 - DNA, 23 bp, Homo sapiens
ctgtttttaagctgtttccatag

SEQ ID NO: 1479731 - DNA, 13 bp, Homo sapiens
ctgtttttcacat

SEQ ID NO: 1479732 - DNA, 17 bp, Homo sapiens
ctgtttttcagggaggt

SEQ ID NO: 1479733 - DNA, 14 bp, Homo sapiens
ctgtttttgtatct

SEQ ID NO: 1479734 - DNA, 22 bp, Homo sapiens
ctgtttttgtatctttatgctg

SEQ ID NO: 1479735 - DNA, 16 bp, Homo sapiens
cttaaaaaataataca

SEQ ID NO: 1479736 - DNA, 15 bp, Homo sapiens
cttaaaaaattgaaa

SEQ ID NO: 1479737 - DNA, 12 bp, Homo sapiens
cttaaaaaggaa

SEQ ID NO: 1479738 - DNA, 21 bp, Homo sapiens
cttaaaaatcacactgtaaat

SEQ ID NO: 1479739 - DNA, 20 bp, Homo sapiens
cttaaaaatcattgattgtc

SEQ ID NO: 1479740 - DNA, 17 bp, Homo sapiens
cttaaaaatgtaaatat

SEQ ID NO: 1479741 - DNA, 13 bp, Homo sapiens
cttaaaaattaat

SEQ ID NO: 1479742 - DNA, 19 bp, Homo sapiens
cttaaaacatggtgcctat

SEQ ID NO: 1479743 - DNA, 21 bp, Homo sapiens
cttaaaaccaaagagggcttc

SEQ ID NO: 1479744 - DNA, 22 bp, Homo sapiens
cttaaaaggagagaagaaagtg

SEQ ID NO: 1479745 - DNA, 16 bp, Homo sapiens
cttaaaagtactttaa

SEQ ID NO: 1479746 - DNA, 17 bp, Homo sapiens
cttaaaagtactttaaa

SEQ ID NO: 1479747 - DNA, 13 bp, Homo sapiens
cttaaaataagca

SEQ ID NO: 1479748 - DNA, 15 bp, Homo sapiens
cttaaaataagcagg

SEQ ID NO: 1479749 - DNA, 23 bp, Homo sapiens
cttaaaatatctctaaaataggt

SEQ ID NO: 1479750 - DNA, 14 bp, Homo sapiens
cttaaacaaaaaac

SEQ ID NO: 1479751 - DNA, 13 bp, Homo sapiens
cttaaacaatgta

SEQ ID NO: 1479752 - DNA, 16 bp, Homo sapiens
cttaaacaatgtataa

SEQ ID NO: 1479753 - DNA, 16 bp, Homo sapiens
cttaaacacaggctgt

SEQ ID NO: 1479754 - DNA, 17 bp, Homo sapiens
cttaaacacaggctgtc

SEQ ID NO: 1479755 - DNA, 17 bp, Homo sapiens
cttaaaccaacaataaa

SEQ ID NO: 1479756 - DNA, 23 bp, Homo sapiens
cttaaacccatacaatgtatgta

SEQ ID NO: 1479757 - DNA, 15 bp, Homo sapiens
cttaaaccttcagtt

SEQ ID NO: 1479758 - DNA, 23 bp, Homo sapiens
cttaaaccttcagttatgatttt

SEQ ID NO: 1479759 - DNA, 15 bp, Homo sapiens
cttaaactaaatgtg

SEQ ID NO: 1479760 - DNA, 13 bp, Homo sapiens
cttaaactggaaa

SEQ ID NO: 1479761 - DNA, 23 bp, Homo sapiens
cttatcctctctctcttctaggc

SEQ ID NO: 1479762 - DNA, 18 bp, Homo sapiens
cttatcgggctccagcca

SEQ ID NO: 1479763 - DNA, 22 bp, Homo sapiens
cttatctagcaagaagattcta

SEQ ID NO: 1479764 - DNA, 15 bp, Homo sapiens
cttatctataaaagg

SEQ ID NO: 1479765 - DNA, 12 bp, Homo sapiens
cttatctctttt

SEQ ID NO: 1479766 - DNA, 21 bp, Homo sapiens
cttatctcttttatatttgta

SEQ ID NO: 1479767 - DNA, 20 bp, Homo sapiens
cttatcttacaatattgatt

SEQ ID NO: 1479768 - DNA, 22 bp, Homo sapiens
cttatctttctaaaactgcctt

SEQ ID NO: 1479769 - DNA, 21 bp, Homo sapiens
cttatgacatcacttgtacaa

SEQ ID NO: 1479770 - DNA, 22 bp, Homo sapiens
cttatgacatcacttgtacaaa

SEQ ID NO: 1479771 - DNA, 23 bp, Homo sapiens
cttatgacgcggctcaaaaggaa

SEQ ID NO: 1479772 - DNA, 23 bp, Homo sapiens
cttatgattcagattgttatcta

SEQ ID NO: 1479773 - DNA, 15 bp, Homo sapiens
cttatgattgcagat

SEQ ID NO: 1479774 - DNA, 16 bp, Homo sapiens
cttatgcggttaattt

SEQ ID NO: 1479775 - DNA, 17 bp, Homo sapiens
cttatgcggttaatttt

SEQ ID NO: 1479776 - DNA, 18 bp, Homo sapiens
cttatgcggttaattttg

SEQ ID NO: 1479777 - DNA, 14 bp, Homo sapiens
cttatgggctgaag

SEQ ID NO: 1479778 - DNA, 12 bp, Homo sapiens
cttatggtccag

SEQ ID NO: 1479779 - DNA, 15 bp, Homo sapiens
cttatggtccagaaa

SEQ ID NO: 1479780 - DNA, 13 bp, Homo sapiens
cttatgtctctgc

SEQ ID NO: 1479781 - DNA, 14 bp, Homo sapiens
cttatgtgaaaaat

SEQ ID NO: 1479782 - DNA, 16 bp, Homo sapiens
cttatgtgaaaaatta

SEQ ID NO: 1479783 - DNA, 19 bp, Homo sapiens
cttatgtgaaaaattaact

SEQ ID NO: 1479784 - DNA, 13 bp, Homo sapiens
cttatgtgacatt

SEQ ID NO: 1479785 - DNA, 23 bp, Homo sapiens
cttatgtgacattaacaaataaa

SEQ ID NO: 1479786 - DNA, 13 bp, Homo sapiens
cttattaaagttc

SEQ ID NO: 1479787 - DNA, 20 bp, Homo sapiens
cttattatgtaggtaagact

SEQ ID NO: 1479788 - DNA, 20 bp, Homo sapiens
cttattcccaaactacagaa

SEQ ID NO: 1479789 - DNA, 23 bp, Homo sapiens
cttattctaataaatatactatg

SEQ ID NO: 1479790 - DNA, 12 bp, Homo sapiens
cttattctgtat

SEQ ID NO: 1479791 - DNA, 20 bp, Homo sapiens
cttattcttgtggttaaaaa

SEQ ID NO: 1479792 - DNA, 16 bp, Homo sapiens
cttattctttgagtaa

SEQ ID NO: 1479793 - DNA, 14 bp, Homo sapiens
cttattgaccattt

SEQ ID NO: 1479794 - DNA, 16 bp, Homo sapiens
cttattgcctcccagg

SEQ ID NO: 1479795 - DNA, 18 bp, Homo sapiens
cttattgcctcccaggca

SEQ ID NO: 1479796 - DNA, 19 bp, Homo sapiens
cttattgcctcccaggcaa

SEQ ID NO: 1479797 - DNA, 17 bp, Homo sapiens
cttattgcttcatctgt

SEQ ID NO: 1479798 - DNA, 16 bp, Homo sapiens
cttattggaaggtatt

SEQ ID NO: 1479799 - DNA, 13 bp, Homo sapiens
cttattgtacctc

SEQ ID NO: 1479800 - DNA, 14 bp, Homo sapiens
cttattgtacctct

SEQ ID NO: 1479801 - DNA, 23 bp, Homo sapiens
cttattgtgtgcgctgcctggcc

SEQ ID NO: 1479802 - DNA, 15 bp, Homo sapiens
cttatttaaaaatat

SEQ ID NO: 1479803 - DNA, 19 bp, Homo sapiens
cttatttaaaaatatttca

SEQ ID NO: 1479804 - DNA, 15 bp, Homo sapiens
cttatttaatctttt

SEQ ID NO: 1479805 - DNA, 18 bp, Homo sapiens
cttatttaatgaaagact

SEQ ID NO: 1479806 - DNA, 16 bp, Homo sapiens
cttatttacccttttc

SEQ ID NO: 1479807 - DNA, 19 bp, Homo sapiens
cttatttacccttttcccc

SEQ ID NO: 1479808 - DNA, 14 bp, Homo sapiens
cttatttatatctt

SEQ ID NO: 1479809 - DNA, 19 bp, Homo sapiens
cttatttatcctagtattc

SEQ ID NO: 1479810 - DNA, 18 bp, Homo sapiens
cttatttctatgacaaat

SEQ ID NO: 1479811 - DNA, 18 bp, Homo sapiens
cttatttctgctctggaa

SEQ ID NO: 1479812 - DNA, 19 bp, Homo sapiens
cttatttctgctctggaat

SEQ ID NO: 1479813 - DNA, 21 bp, Homo sapiens
cttatttgccttctactcccc

SEQ ID NO: 1479814 - DNA, 22 bp, Homo sapiens
cttatttgtctgtaaaaaatgg

SEQ ID NO: 1479815 - DNA, 13 bp, Homo sapiens
cttattttagtat

SEQ ID NO: 1479816 - DNA, 15 bp, Homo sapiens
cttattttcaagaaa

SEQ ID NO: 1479817 - DNA, 16 bp, Homo sapiens
cttattttcatgtata

SEQ ID NO: 1479818 - DNA, 18 bp, Homo sapiens
cttattttgcattccaga

SEQ ID NO: 1479819 - DNA, 15 bp, Homo sapiens
cttatttttctgtga

SEQ ID NO: 1479820 - DNA, 22 bp, Homo sapiens
cttatttttcttaccaattgtg

SEQ ID NO: 1479821 - DNA, 15 bp, Homo sapiens
cttattttttcccaa

SEQ ID NO: 1479822 - DNA, 20 bp, Homo sapiens
cttcaaaatgttatcttctc

SEQ ID NO: 1479823 - DNA, 22 bp, Homo sapiens
cttcaaaatgttatcttctcaa

SEQ ID NO: 1479824 - DNA, 23 bp, Homo sapiens
cttcaaaatgttatcttctcaag

SEQ ID NO: 1479825 - DNA, 14 bp, Homo sapiens
cttcaaactttcac

SEQ ID NO: 1479826 - DNA, 13 bp, Homo sapiens
cttcaaattagaa

SEQ ID NO: 1479827 - DNA, 24 bp, Homo sapiens
cttcaacagaccccctctagaaat

SEQ ID NO: 1479828 - DNA, 16 bp, Homo sapiens
cttcaaccattcccca

SEQ ID NO: 1479829 - DNA, 15 bp, Homo sapiens
cttcaaccctcagcc

SEQ ID NO: 1479830 - DNA, 18 bp, Homo sapiens
cttcaacttttctcttta

SEQ ID NO: 1479831 - DNA, 18 bp, Homo sapiens
cttcaagaatcagaagaa

SEQ ID NO: 1479832 - DNA, 14 bp, Homo sapiens
cttcaagctgtccc

SEQ ID NO: 1479833 - DNA, 21 bp, Homo sapiens
cttcaaggactgtttcagtgt

SEQ ID NO: 1479834 - DNA, 20 bp, Homo sapiens
cttcaaggtggcagctgtta

SEQ ID NO: 1479835 - DNA, 22 bp, Homo sapiens
cttcaagtgcatgctctctgca

SEQ ID NO: 1479836 - DNA, 20 bp, Homo sapiens
cttcaagttagctcaggagg

SEQ ID NO: 1479837 - DNA, 20 bp, Homo sapiens
cttcaataaatctttggaaa

SEQ ID NO: 1479838 - DNA, 16 bp, Homo sapiens
cttcaatataagaagc

SEQ ID NO: 1479839 - DNA, 17 bp, Homo sapiens
cttcaatcggcttgtgg

SEQ ID NO: 1479840 - DNA, 17 bp, Homo sapiens
cttcaatctctgttctg

SEQ ID NO: 1479841 - DNA, 20 bp, Homo sapiens
cttcacaaatgtcattgtct

SEQ ID NO: 1479842 - DNA, 14 bp, Homo sapiens
cttcacaacagatt

SEQ ID NO: 1479843 - DNA, 13 bp, Homo sapiens
cttcacaactttg

SEQ ID NO: 1479844 - DNA, 21 bp, Homo sapiens
cttcacacacaggcaactgag

SEQ ID NO: 1479845 - DNA, 12 bp, Homo sapiens
cttcacactgca

SEQ ID NO: 1479846 - DNA, 13 bp, Homo sapiens
cttcacactgcaa

SEQ ID NO: 1479847 - DNA, 19 bp, Homo sapiens
cttcacactgcgcaggtct

SEQ ID NO: 1479848 - DNA, 19 bp, Homo sapiens
cttcacagcgtctgctcat

SEQ ID NO: 1479849 - DNA, 15 bp, Homo sapiens
cttcacagtagagcc

SEQ ID NO: 1479850 - DNA, 20 bp, Homo sapiens
cttcacagtagagccagctt

SEQ ID NO: 1479851 - DNA, 20 bp, Homo sapiens
cttcacagtgacactggacc

SEQ ID NO: 1479852 - DNA, 22 bp, Homo sapiens
cttcacagtgacactggaccag

SEQ ID NO: 1479853 - DNA, 23 bp, Homo sapiens
cttcacagtgacactggaccagg

SEQ ID NO: 1479854 - DNA, 20 bp, Homo sapiens
cttcacataagctcagaatc

SEQ ID NO: 1479855 - DNA, 21 bp, Homo sapiens
cttcacatcctgtgtttctag

SEQ ID NO: 1479856 - DNA, 23 bp, Homo sapiens
cttcaccaatagtctctctgcaa

SEQ ID NO: 1479857 - DNA, 13 bp, Homo sapiens
cttcaccaccccc

SEQ ID NO: 1479858 - DNA, 19 bp, Homo sapiens
cttcaccaccccctgtccc

SEQ ID NO: 1479859 - DNA, 20 bp, Homo sapiens
cttcaccaccccctgtccca

SEQ ID NO: 1479860 - DNA, 19 bp, Homo sapiens
cttcaccatggccttatga

SEQ ID NO: 1479861 - DNA, 15 bp, Homo sapiens
cttcacccccaactt

SEQ ID NO: 1479862 - DNA, 21 bp, Homo sapiens
cttcacccctacactgtgaag

SEQ ID NO: 1479863 - DNA, 13 bp, Homo sapiens
cttcacccctgca

SEQ ID NO: 1479864 - DNA, 22 bp, Homo sapiens
cttcacccgagttcctctgggt

SEQ ID NO: 1479865 - DNA, 21 bp, Homo sapiens
cttcaccctgaatggttccat

SEQ ID NO: 1479866 - DNA, 13 bp, Homo sapiens
cttcaccctgtca

SEQ ID NO: 1479867 - DNA, 21 bp, Homo sapiens
cttcaccctgtcaagttaaca

SEQ ID NO: 1479868 - DNA, 18 bp, Homo sapiens
cttcacctaagtctctgt

SEQ ID NO: 1479869 - DNA, 20 bp, Homo sapiens
cttcacctaagtctctgtga

SEQ ID NO: 1479870 - DNA, 19 bp, Homo sapiens
cttcacctcttccactcct

SEQ ID NO: 1479871 - DNA, 22 bp, Homo sapiens
cttcacgacaatgttgagaagt

SEQ ID NO: 1479872 - DNA, 14 bp, Homo sapiens
cttcactaccctga

SEQ ID NO: 1479873 - DNA, 16 bp, Homo sapiens
cttcactattcctagg

SEQ ID NO: 1479874 - DNA, 24 bp, Homo sapiens
cttcactccggtgtgcctgcagcc

SEQ ID NO: 1479875 - DNA, 12 bp, Homo sapiens
cttccacaaaat

SEQ ID NO: 1479876 - DNA, 22 bp, Homo sapiens
cttccacagcacaaacacacct

SEQ ID NO: 1479877 - DNA, 13 bp, Homo sapiens
cttccaccacaga

SEQ ID NO: 1479878 - DNA, 12 bp, Homo sapiens
cttccaccagcc

SEQ ID NO: 1479879 - DNA, 13 bp, Homo sapiens
cttccaccagcct

SEQ ID NO: 1479880 - DNA, 21 bp, Homo sapiens
cttccacccattcccccatgt

SEQ ID NO: 1479881 - DNA, 20 bp, Homo sapiens
cttccacccttttttctaag

SEQ ID NO: 1479882 - DNA, 16 bp, Homo sapiens
cttccacctcctagag

SEQ ID NO: 1479883 - DNA, 22 bp, Homo sapiens
cttccacctcctagaggtgggc

SEQ ID NO: 1479884 - DNA, 17 bp, Homo sapiens
cttccactctggaacct

SEQ ID NO: 1479885 - DNA, 13 bp, Homo sapiens
cttccagaatgct

SEQ ID NO: 1479886 - DNA, 12 bp, Homo sapiens
cttccagacata

SEQ ID NO: 1479887 - DNA, 13 bp, Homo sapiens
cttccagatcact

SEQ ID NO: 1479888 - DNA, 12 bp, Homo sapiens
cttccagatcct

SEQ ID NO: 1479889 - DNA, 18 bp, Homo sapiens
cttccagccacctagtcc

SEQ ID NO: 1479890 - DNA, 12 bp, Homo sapiens
cttccagctcct

SEQ ID NO: 1479891 - DNA, 13 bp, Homo sapiens
cttccagctcctg

SEQ ID NO: 1479892 - DNA, 14 bp, Homo sapiens
cttccagctcctgt

SEQ ID NO: 1479893 - DNA, 21 bp, Homo sapiens
cttccagctgctgtcttctgg

SEQ ID NO: 1479894 - DNA, 19 bp, Homo sapiens
cttccaggaaactccacat

SEQ ID NO: 1479895 - DNA, 23 bp, Homo sapiens
cttccaggaaactccacatctgc

SEQ ID NO: 1479896 - DNA, 16 bp, Homo sapiens
cttccaggcccccacc

SEQ ID NO: 1479897 - DNA, 19 bp, Homo sapiens
cttccaggcccccaccact

SEQ ID NO: 1479898 - DNA, 17 bp, Homo sapiens
cttccaggctcttcctg

SEQ ID NO: 1479899 - DNA, 13 bp, Homo sapiens
cttccagggccct

SEQ ID NO: 1479900 - DNA, 15 bp, Homo sapiens
cttccaggggaacct

SEQ ID NO: 1479901 - DNA, 16 bp, Homo sapiens
cttccaggggaacctg

SEQ ID NO: 1479902 - DNA, 23 bp, Homo sapiens
cttccaggtggcgtgagaggcaa

SEQ ID NO: 1479903 - DNA, 16 bp, Homo sapiens
cttccagtataaccag

SEQ ID NO: 1479904 - DNA, 20 bp, Homo sapiens
cttccagtcttcctgacact

SEQ ID NO: 1479905 - DNA, 20 bp, Homo sapiens
cttccagtgaacattcccag

SEQ ID NO: 1479906 - DNA, 21 bp, Homo sapiens
cttccagtgaacattcccagc

SEQ ID NO: 1479907 - DNA, 12 bp, Homo sapiens
cttccagtgttg

SEQ ID NO: 1479908 - DNA, 21 bp, Homo sapiens
cttccagtgttggctgtgtga

SEQ ID NO: 1479909 - DNA, 18 bp, Homo sapiens
cttccataatgctactgt

SEQ ID NO: 1479910 - DNA, 23 bp, Homo sapiens
cttccataatgtataaagaacaa

SEQ ID NO: 1479911 - DNA, 18 bp, Homo sapiens
cttccataggacatactg

SEQ ID NO: 1479912 - DNA, 19 bp, Homo sapiens
cttccatcatcactgtaaa

SEQ ID NO: 1479913 - DNA, 14 bp, Homo sapiens
cttccatccctacc

SEQ ID NO: 1479914 - DNA, 16 bp, Homo sapiens
cttccatccctacccc

SEQ ID NO: 1479915 - DNA, 21 bp, Homo sapiens
cttccatcttgtggggccagg

SEQ ID NO: 1479916 - DNA, 17 bp, Homo sapiens
cttccatgagaacagca

SEQ ID NO: 1479917 - DNA, 16 bp, Homo sapiens
cttccatgccccagga

SEQ ID NO: 1479918 - DNA, 14 bp, Homo sapiens
cttccatgtggaga

SEQ ID NO: 1479919 - DNA, 18 bp, Homo sapiens
cttccatgtggagaaagg

SEQ ID NO: 1479920 - DNA, 12 bp, Homo sapiens
cttccattccac

SEQ ID NO: 1479921 - DNA, 16 bp, Homo sapiens
cttccattttaatttt

SEQ ID NO: 1479922 - DNA, 19 bp, Homo sapiens
cttccattttcccccacta

SEQ ID NO: 1479923 - DNA, 22 bp, Homo sapiens
cttccattttcccccactactg

SEQ ID NO: 1479924 - DNA, 14 bp, Homo sapiens
cttcccaaacccag

SEQ ID NO: 1479925 - DNA, 17 bp, Homo sapiens
cttcccaaacccagtct

SEQ ID NO: 1479926 - DNA, 20 bp, Homo sapiens
cttcccaaacccagtctcct

SEQ ID NO: 1479927 - DNA, 19 bp, Homo sapiens
cttcccaataggtgatctt

SEQ ID NO: 1479928 - DNA, 15 bp, Homo sapiens
cttcccaatcagcac

SEQ ID NO: 1479929 - DNA, 18 bp, Homo sapiens
cttcccaatcagcactga

SEQ ID NO: 1479930 - DNA, 17 bp, Homo sapiens
cttcccacccatcgctg

SEQ ID NO: 1479931 - DNA, 15 bp, Homo sapiens
cttcccacctactgc

SEQ ID NO: 1479932 - DNA, 12 bp, Homo sapiens
cttcccactggg

SEQ ID NO: 1479933 - DNA, 15 bp, Homo sapiens
cttcccagaggcaga

SEQ ID NO: 1479934 - DNA, 21 bp, Homo sapiens
cttcccagcagggccactccc

SEQ ID NO: 1479935 - DNA, 15 bp, Homo sapiens
cttcccagctctgac

SEQ ID NO: 1479936 - DNA, 11 bp, Homo sapiens
cttcccagctt

SEQ ID NO: 1479937 - DNA, 19 bp, Homo sapiens
cttcccaggatctgctcca

SEQ ID NO: 1479938 - DNA, 11 bp, Homo sapiens
cttcccaggcc

SEQ ID NO: 1479939 - DNA, 21 bp, Homo sapiens
cttcccaggccctttggcttc

SEQ ID NO: 1479940 - DNA, 15 bp, Homo sapiens
cttcccagtgaatcc

SEQ ID NO: 1479941 - DNA, 23 bp, Homo sapiens
cttcccagttcaggagtcccaag

SEQ ID NO: 1479942 - DNA, 17 bp, Homo sapiens
cttcccatagtggggcc

SEQ ID NO: 1479943 - DNA, 22 bp, Homo sapiens
cttcccatagtggggcctggga

SEQ ID NO: 1479944 - DNA, 12 bp, Homo sapiens
cttcccatccta

SEQ ID NO: 1479945 - DNA, 15 bp, Homo sapiens
cttcccatcctaccc

SEQ ID NO: 1479946 - DNA, 18 bp, Homo sapiens
cttcccatgcattctggt

SEQ ID NO: 1479947 - DNA, 14 bp, Homo sapiens
cttcccatgcctgt

SEQ ID NO: 1479948 - DNA, 24 bp, Homo sapiens
cttcccattgagtaatcatactca

SEQ ID NO: 1479949 - DNA, 15 bp, Homo sapiens
cttcccattgtggct

SEQ ID NO: 1479950 - DNA, 12 bp, Homo sapiens
cttcccatttct

SEQ ID NO: 1479951 - DNA, 15 bp, Homo sapiens
cttcccatttctcta

SEQ ID NO: 1479952 - DNA, 13 bp, Homo sapiens
cttcccatttctt

SEQ ID NO: 1479953 - DNA, 14 bp, Homo sapiens
cttcccatttcttc

SEQ ID NO: 1479954 - DNA, 16 bp, Homo sapiens
cttccccaacttccct

SEQ ID NO: 1479955 - DNA, 18 bp, Homo sapiens
cttccccaacttccctag

SEQ ID NO: 1479956 - DNA, 17 bp, Homo sapiens
cttccccacagaactgc

SEQ ID NO: 1479957 - DNA, 19 bp, Homo sapiens
cttccccagacttgcactg

SEQ ID NO: 1479958 - DNA, 17 bp, Homo sapiens
cttccccagctctcagt

SEQ ID NO: 1479959 - DNA, 13 bp, Homo sapiens
cttccccaggccc

SEQ ID NO: 1479960 - DNA, 16 bp, Homo sapiens
cttccccaggcccacc

SEQ ID NO: 1479961 - DNA, 14 bp, Homo sapiens
cttccccatcccga

SEQ ID NO: 1479962 - DNA, 22 bp, Homo sapiens
cttccccatctttgatccttct

SEQ ID NO: 1479963 - DNA, 17 bp, Homo sapiens
cttcccccagcccaata

SEQ ID NO: 1479964 - DNA, 18 bp, Homo sapiens
cttcccccagcccaataa

SEQ ID NO: 1479965 - DNA, 20 bp, Homo sapiens
cttcccccagcccaataaag

SEQ ID NO: 1479966 - DNA, 16 bp, Homo sapiens
cttcccccagcccatc

SEQ ID NO: 1479967 - DNA, 16 bp, Homo sapiens
cttcccccttttttgt

SEQ ID NO: 1479968 - DNA, 18 bp, Homo sapiens
cttcccctacacctccct

SEQ ID NO: 1479969 - DNA, 19 bp, Homo sapiens
cttcccctcccccactcct

SEQ ID NO: 1479970 - DNA, 13 bp, Homo sapiens
cttcccctgggca

SEQ ID NO: 1479971 - DNA, 15 bp, Homo sapiens
cttccccttccctta

SEQ ID NO: 1479972 - DNA, 23 bp, Homo sapiens
cttccccttgcccagggctcagc

SEQ ID NO: 1479973 - DNA, 20 bp, Homo sapiens
cttcccctttactcagccca

SEQ ID NO: 1479974 - DNA, 18 bp, Homo sapiens
cttccccttttgcctggc

SEQ ID NO: 1479975 - DNA, 21 bp, Homo sapiens
cttccccttttgcctggctgt

SEQ ID NO: 1479976 - DNA, 23 bp, Homo sapiens
cttcccgaggaactcgcctcagc

SEQ ID NO: 1479977 - DNA, 13 bp, Homo sapiens
cttcccgcctcgg

SEQ ID NO: 1479978 - DNA, 16 bp, Homo sapiens
cttcccgctcagccct

SEQ ID NO: 1479979 - DNA, 17 bp, Homo sapiens
cttcccgctcagccctc

SEQ ID NO: 1479980 - DNA, 13 bp, Homo sapiens
cttcccgctcccc

SEQ ID NO: 1479981 - DNA, 17 bp, Homo sapiens
cttcccgctccccacct

SEQ ID NO: 1479982 - DNA, 18 bp, Homo sapiens
cttcccgctgcacatgga

SEQ ID NO: 1479983 - DNA, 21 bp, Homo sapiens
cttcccgggataaactgagcc

SEQ ID NO: 1479984 - DNA, 17 bp, Homo sapiens
cttcccgtagctgccag

SEQ ID NO: 1479985 - DNA, 14 bp, Homo sapiens
cttcccgtcccata

SEQ ID NO: 1479986 - DNA, 20 bp, Homo sapiens
cttcccgtcccatatcctgc

SEQ ID NO: 1479987 - DNA, 23 bp, Homo sapiens
cttcccgtcccatatcctgcctc

SEQ ID NO: 1479988 - DNA, 12 bp, Homo sapiens
cttccctaatct

SEQ ID NO: 1479989 - DNA, 17 bp, Homo sapiens
cttccctacctcaggca

SEQ ID NO: 1479990 - DNA, 21 bp, Homo sapiens
cttctcccccacggtatccta

SEQ ID NO: 1479991 - DNA, 16 bp, Homo sapiens
cttctccccgaggctg

SEQ ID NO: 1479992 - DNA, 21 bp, Homo sapiens
cttctccccgaggctgcccca

SEQ ID NO: 1479993 - DNA, 14 bp, Homo sapiens
cttctcccctgcac

SEQ ID NO: 1479994 - DNA, 18 bp, Homo sapiens
cttctcccctgcactgta

SEQ ID NO: 1479995 - DNA, 21 bp, Homo sapiens
cttctcccctgcactgtaaaa

SEQ ID NO: 1479996 - DNA, 15 bp, Homo sapiens
cttctcccctgccct

SEQ ID NO: 1479997 - DNA, 17 bp, Homo sapiens
cttctcccctgcccttc

SEQ ID NO: 1479998 - DNA, 19 bp, Homo sapiens
cttctcccctgggtcctcc

SEQ ID NO: 1479999 - DNA, 15 bp, Homo sapiens
cttctcccttgccct

SEQ ID NO: 1480000 - DNA, 23 bp, Homo sapiens
cttctccgccagcctcctctgga

SEQ ID NO: 1480001 - DNA, 23 bp, Homo sapiens
cttctcctacatatcccttccag

SEQ ID NO: 1480002 - DNA, 20 bp, Homo sapiens
cttctcctgaagttcagcca

SEQ ID NO: 1480003 - DNA, 19 bp, Homo sapiens
cttctcctgacccagtccc

SEQ ID NO: 1480004 - DNA, 18 bp, Homo sapiens
cttctcctttccttccca

SEQ ID NO: 1480005 - DNA, 19 bp, Homo sapiens
cttctcctttccttcccag

SEQ ID NO: 1480006 - DNA, 21 bp, Homo sapiens
cttctcctttccttcccaggc

SEQ ID NO: 1480007 - DNA, 19 bp, Homo sapiens
cttctcggggtccagtgca

SEQ ID NO: 1480008 - DNA, 15 bp, Homo sapiens
cttctctacagactt

SEQ ID NO: 1480009 - DNA, 19 bp, Homo sapiens
cttctctacagaggtgaaa

SEQ ID NO: 1480010 - DNA, 12 bp, Homo sapiens
cttctctaccca

SEQ ID NO: 1480011 - DNA, 17 bp, Homo sapiens
cttctctcagctcccag

SEQ ID NO: 1480012 - DNA, 21 bp, Homo sapiens
cttctctcagctcccaggcca

SEQ ID NO: 1480013 - DNA, 14 bp, Homo sapiens
cttctctccagctg

SEQ ID NO: 1480014 - DNA, 17 bp, Homo sapiens
cttctctccagctgact

SEQ ID NO: 1480015 - DNA, 13 bp, Homo sapiens
cttctctctccag

SEQ ID NO: 1480016 - DNA, 15 bp, Homo sapiens
cttctctgacttctg

SEQ ID NO: 1480017 - DNA, 17 bp, Homo sapiens
cttctctgacttctgcc

SEQ ID NO: 1480018 - DNA, 11 bp, Homo sapiens
cttctctgctc

SEQ ID NO: 1480019 - DNA, 15 bp, Homo sapiens
cttctctggtctcct

SEQ ID NO: 1480020 - DNA, 22 bp, Homo sapiens
cttctctgtgaacgatttagaa

SEQ ID NO: 1480021 - DNA, 15 bp, Homo sapiens
cttctctgtgagaag

SEQ ID NO: 1480022 - DNA, 14 bp, Homo sapiens
cttctcttcactag

SEQ ID NO: 1480023 - DNA, 20 bp, Homo sapiens
cttctcttgggaactccact

SEQ ID NO: 1480024 - DNA, 12 bp, Homo sapiens
cttctgaactca

SEQ ID NO: 1480025 - DNA, 22 bp, Homo sapiens
cttctgaactcaaactgaggaa

SEQ ID NO: 1480026 - DNA, 19 bp, Homo sapiens
cttctgaactccatacagc

SEQ ID NO: 1480027 - DNA, 15 bp, Homo sapiens
cttctgaagaggaaa

SEQ ID NO: 1480028 - DNA, 19 bp, Homo sapiens
cttctgaagatcagaacat

SEQ ID NO: 1480029 - DNA, 14 bp, Homo sapiens
cttctgaagatgga

SEQ ID NO: 1480030 - DNA, 21 bp, Homo sapiens
cttctgaagatggaaggcctt

SEQ ID NO: 1480031 - DNA, 16 bp, Homo sapiens
cttctgaataaagcaa

SEQ ID NO: 1480032 - DNA, 22 bp, Homo sapiens
cttctgaataaagcaattagca

SEQ ID NO: 1480033 - DNA, 20 bp, Homo sapiens
cttctgacaaaggtggtaaa

SEQ ID NO: 1480034 - DNA, 21 bp, Homo sapiens
cttctgactgctgattctccc

SEQ ID NO: 1480035 - DNA, 14 bp, Homo sapiens
cttctgactgttta

SEQ ID NO: 1480036 - DNA, 15 bp, Homo sapiens
cttctgactgtttat

SEQ ID NO: 1480037 - DNA, 16 bp, Homo sapiens
cttctgactgtttatt

SEQ ID NO: 1480038 - DNA, 20 bp, Homo sapiens
cttctgactgtttatttaag

SEQ ID NO: 1480039 - DNA, 15 bp, Homo sapiens
cttctgactttactt

SEQ ID NO: 1480040 - DNA, 17 bp, Homo sapiens
cttctgagcaaactatt

SEQ ID NO: 1480041 - DNA, 15 bp, Homo sapiens
cttctgagcactgtt

SEQ ID NO: 1480042 - DNA, 16 bp, Homo sapiens
cttctgagctatttca

SEQ ID NO: 1480043 - DNA, 13 bp, Homo sapiens
cttctgagctcca

SEQ ID NO: 1480044 - DNA, 19 bp, Homo sapiens
cttctgagctccacctctg

SEQ ID NO: 1480045 - DNA, 22 bp, Homo sapiens
cttctgcacataaactctttta

SEQ ID NO: 1480046 - DNA, 14 bp, Homo sapiens
cttctgcaccctcc

SEQ ID NO: 1480047 - DNA, 18 bp, Homo sapiens
cttctgcaccctccaccc

SEQ ID NO: 1480048 - DNA, 19 bp, Homo sapiens
cttctgcaccctccaccct

SEQ ID NO: 1480049 - DNA, 22 bp, Homo sapiens
cttctgcaccctccaccctgtc

SEQ ID NO: 1480050 - DNA, 18 bp, Homo sapiens
cttctgcctaacttgtaa

SEQ ID NO: 1480051 - DNA, 12 bp, Homo sapiens
cttctgcctggg

SEQ ID NO: 1480052 - DNA, 20 bp, Homo sapiens
cttctgcctggggtgcattt

SEQ ID NO: 1480053 - DNA, 20 bp, Homo sapiens
cttctgccttagtctcagtt

SEQ ID NO: 1480054 - DNA, 21 bp, Homo sapiens
cttctgccttagtctcagttt

SEQ ID NO: 1480055 - DNA, 21 bp, Homo sapiens
cttctgctccacccttggcct

SEQ ID NO: 1480056 - DNA, 14 bp, Homo sapiens
cttctgctcttttc

SEQ ID NO: 1480057 - DNA, 11 bp, Homo sapiens
cttctgctgaa

SEQ ID NO: 1480058 - DNA, 17 bp, Homo sapiens
cttctgctggataaaat

SEQ ID NO: 1480059 - DNA, 18 bp, Homo sapiens
cttctgcttttctgccct

SEQ ID NO: 1480060 - DNA, 21 bp, Homo sapiens
cttctgcttttctgccctggc

SEQ ID NO: 1480061 - DNA, 16 bp, Homo sapiens
cttctggaaggctggc

SEQ ID NO: 1480062 - DNA, 22 bp, Homo sapiens
cttctggaaggctggctgagtg

SEQ ID NO: 1480063 - DNA, 18 bp, Homo sapiens
cttctggaatttgttcaa

SEQ ID NO: 1480064 - DNA, 18 bp, Homo sapiens
cttctggacaggctctgc

SEQ ID NO: 1480065 - DNA, 17 bp, Homo sapiens
cttctggagcagaactt

SEQ ID NO: 1480066 - DNA, 18 bp, Homo sapiens
cttctggagcagaacttt

SEQ ID NO: 1480067 - DNA, 22 bp, Homo sapiens
cttctggagcagaactttccag

SEQ ID NO: 1480068 - DNA, 15 bp, Homo sapiens
cttctggagctggga

SEQ ID NO: 1480069 - DNA, 14 bp, Homo sapiens
cttctggccggtgc

SEQ ID NO: 1480070 - DNA, 15 bp, Homo sapiens
cttctggcctctgct

SEQ ID NO: 1480071 - DNA, 19 bp, Homo sapiens
cttctgggactggacagct

SEQ ID NO: 1480072 - DNA, 16 bp, Homo sapiens
cttctgggcctgacca

SEQ ID NO: 1480073 - DNA, 19 bp, Homo sapiens
cttctgggcgtctgagctg

SEQ ID NO: 1480074 - DNA, 21 bp, Homo sapiens
cttctgggcttcatctggcaa

SEQ ID NO: 1480075 - DNA, 20 bp, Homo sapiens
cttctgggcttcattctgga

SEQ ID NO: 1480076 - DNA, 21 bp, Homo sapiens
cttctgtagtactccttaaga

SEQ ID NO: 1480077 - DNA, 15 bp, Homo sapiens
cttctgtatttcctt

SEQ ID NO: 1480078 - DNA, 22 bp, Homo sapiens
cttctgtatttttttttctaag

SEQ ID NO: 1480079 - DNA, 14 bp, Homo sapiens
cttctgtctcctgt

SEQ ID NO: 1480080 - DNA, 18 bp, Homo sapiens
cttctgtcttcacaacag

SEQ ID NO: 1480081 - DNA, 20 bp, Homo sapiens
cttctgtgagacccccacac

SEQ ID NO: 1480082 - DNA, 16 bp, Homo sapiens
cttctgtgatgagctg

SEQ ID NO: 1480083 - DNA, 14 bp, Homo sapiens
cttctgttgaaaca

SEQ ID NO: 1480084 - DNA, 16 bp, Homo sapiens
cttcttaaaaggagct

SEQ ID NO: 1480085 - DNA, 13 bp, Homo sapiens
cttcttaaagagt

SEQ ID NO: 1480086 - DNA, 14 bp, Homo sapiens
cttcttaaaggcct

SEQ ID NO: 1480087 - DNA, 16 bp, Homo sapiens
cttcttaaaggcctgg

SEQ ID NO: 1480088 - DNA, 19 bp, Homo sapiens
cttcttaaaggcctggaac

SEQ ID NO: 1480089 - DNA, 13 bp, Homo sapiens
cttcttaagtgtt

SEQ ID NO: 1480090 - DNA, 14 bp, Homo sapiens
cttcttattctcac

SEQ ID NO: 1480091 - DNA, 13 bp, Homo sapiens
cttcttattttgg

SEQ ID NO: 1480092 - DNA, 15 bp, Homo sapiens
cttcttcacccagct

SEQ ID NO: 1480093 - DNA, 23 bp, Homo sapiens
cttcttcacccagctaatctgta

SEQ ID NO: 1480094 - DNA, 13 bp, Homo sapiens
cttcttcacctct

SEQ ID NO: 1480095 - DNA, 14 bp, Homo sapiens
cttcttcacctctt

SEQ ID NO: 1480096 - DNA, 16 bp, Homo sapiens
cttcttcacctcttcc

SEQ ID NO: 1480097 - DNA, 18 bp, Homo sapiens
cttcttcacctcttccac

SEQ ID NO: 1480098 - DNA, 20 bp, Homo sapiens
cttcttcagaagacactgca

SEQ ID NO: 1480099 - DNA, 16 bp, Homo sapiens
cttcttcatattctaa

SEQ ID NO: 1480100 - DNA, 14 bp, Homo sapiens
cttcttccctccct

SEQ ID NO: 1480101 - DNA, 13 bp, Homo sapiens
cttcttcctattg

SEQ ID NO: 1480102 - DNA, 13 bp, Homo sapiens
cttcttcctgtga

SEQ ID NO: 1480103 - DNA, 20 bp, Homo sapiens
cttcttcggggaactcctgg

SEQ ID NO: 1480104 - DNA, 21 bp, Homo sapiens
cttcttcggggaactcctgga

SEQ ID NO: 1480105 - DNA, 18 bp, Homo sapiens
cttgcctcaatgccagta

SEQ ID NO: 1480106 - DNA, 13 bp, Homo sapiens
cttgcctccaggt

SEQ ID NO: 1480107 - DNA, 14 bp, Homo sapiens
cttgcctccaggtg

SEQ ID NO: 1480108 - DNA, 23 bp, Homo sapiens
cttgcctccaggtgcagaggtac

SEQ ID NO: 1480109 - DNA, 14 bp, Homo sapiens
cttgcctctgcaca

SEQ ID NO: 1480110 - DNA, 19 bp, Homo sapiens
cttgcctctgtccccttct

SEQ ID NO: 1480111 - DNA, 13 bp, Homo sapiens
cttgcctctgtgc

SEQ ID NO: 1480112 - DNA, 16 bp, Homo sapiens
cttgcctctgtgctgt

SEQ ID NO: 1480113 - DNA, 20 bp, Homo sapiens
cttgcctctgtgctgtgtgt

SEQ ID NO: 1480114 - DNA, 13 bp, Homo sapiens
cttgcctcttcct

SEQ ID NO: 1480115 - DNA, 17 bp, Homo sapiens
cttgcctgaacatcctt

SEQ ID NO: 1480116 - DNA, 13 bp, Homo sapiens
cttgcctgcaggg

SEQ ID NO: 1480117 - DNA, 20 bp, Homo sapiens
cttgcctgcagggccatggc

SEQ ID NO: 1480118 - DNA, 17 bp, Homo sapiens
cttgcctggggtctgag

SEQ ID NO: 1480119 - DNA, 21 bp, Homo sapiens
cttgcctggggtctgagcatg

SEQ ID NO: 1480120 - DNA, 16 bp, Homo sapiens
cttgcctgggtcacac

SEQ ID NO: 1480121 - DNA, 16 bp, Homo sapiens
cttgccttaataaata

SEQ ID NO: 1480122 - DNA, 19 bp, Homo sapiens
cttgccttcttcacccagc

SEQ ID NO: 1480123 - DNA, 20 bp, Homo sapiens
cttgccttcttcacccagct

SEQ ID NO: 1480124 - DNA, 19 bp, Homo sapiens
cttgcctttcgaggcctga

SEQ ID NO: 1480125 - DNA, 20 bp, Homo sapiens
cttgcctttcgaggcctgaa

SEQ ID NO: 1480126 - DNA, 20 bp, Homo sapiens
cttgctaaagctaggggccc

SEQ ID NO: 1480127 - DNA, 16 bp, Homo sapiens
cttgctagtgatacac

SEQ ID NO: 1480128 - DNA, 16 bp, Homo sapiens
cttgctcagagctagg

SEQ ID NO: 1480129 - DNA, 12 bp, Homo sapiens
cttgctccagat

SEQ ID NO: 1480130 - DNA, 16 bp, Homo sapiens
cttgctccagattctg

SEQ ID NO: 1480131 - DNA, 20 bp, Homo sapiens
cttgctccagattctgatgc

SEQ ID NO: 1480132 - DNA, 13 bp, Homo sapiens
cttgctccagggt

SEQ ID NO: 1480133 - DNA, 21 bp, Homo sapiens
cttgctccagggtcttgggct

SEQ ID NO: 1480134 - DNA, 16 bp, Homo sapiens
cttgctcccaacccat

SEQ ID NO: 1480135 - DNA, 20 bp, Homo sapiens
cttgctcgctgtaaaatctt

SEQ ID NO: 1480136 - DNA, 14 bp, Homo sapiens
cttgctctcctcat

SEQ ID NO: 1480137 - DNA, 14 bp, Homo sapiens
cttgctctcttgtg

SEQ ID NO: 1480138 - DNA, 15 bp, Homo sapiens
cttgctgacaataaa

SEQ ID NO: 1480139 - DNA, 18 bp, Homo sapiens
cttgctgacaataaagat

SEQ ID NO: 1480140 - DNA, 20 bp, Homo sapiens
cttgctgcaagcacagccct

SEQ ID NO: 1480141 - DNA, 21 bp, Homo sapiens
cttgctgcaagcacagccctt

SEQ ID NO: 1480142 - DNA, 18 bp, Homo sapiens
cttgctgctctgcgtggc

SEQ ID NO: 1480143 - DNA, 12 bp, Homo sapiens
cttgctgcttta

SEQ ID NO: 1480144 - DNA, 22 bp, Homo sapiens
cttgctggccacaaggaaaagg

SEQ ID NO: 1480145 - DNA, 15 bp, Homo sapiens
cttgctggccccagc

SEQ ID NO: 1480146 - DNA, 18 bp, Homo sapiens
cttgctggccccagccct

SEQ ID NO: 1480147 - DNA, 20 bp, Homo sapiens
cttgctggccccagccctgc

SEQ ID NO: 1480148 - DNA, 22 bp, Homo sapiens
cttgctggccccagccctgctg

SEQ ID NO: 1480149 - DNA, 16 bp, Homo sapiens
cttgctggctctgaga

SEQ ID NO: 1480150 - DNA, 17 bp, Homo sapiens
cttgctggctctgagaa

SEQ ID NO: 1480151 - DNA, 12 bp, Homo sapiens
cttgctgggcca

SEQ ID NO: 1480152 - DNA, 22 bp, Homo sapiens
cttgctgggccagggaaacaaa

SEQ ID NO: 1480153 - DNA, 13 bp, Homo sapiens
cttgctggtgcct

SEQ ID NO: 1480154 - DNA, 20 bp, Homo sapiens
cttgctggtgcctgccacct

SEQ ID NO: 1480155 - DNA, 17 bp, Homo sapiens
cttgctgtaccatattc

SEQ ID NO: 1480156 - DNA, 12 bp, Homo sapiens
cttgctgtcact

SEQ ID NO: 1480157 - DNA, 18 bp, Homo sapiens
cttgctgtccaggcagct

SEQ ID NO: 1480158 - DNA, 22 bp, Homo sapiens
cttgctgtccaggcagctccct

SEQ ID NO: 1480159 - DNA, 14 bp, Homo sapiens
cttgctgtcctagg

SEQ ID NO: 1480160 - DNA, 17 bp, Homo sapiens
cttgctgtcctaggcca

SEQ ID NO: 1480161 - DNA, 22 bp, Homo sapiens
cttgctgtctacagtagctgct

SEQ ID NO: 1480162 - DNA, 19 bp, Homo sapiens
cttgctgtggggctacagg

SEQ ID NO: 1480163 - DNA, 19 bp, Homo sapiens
cttgctgtttgtcctgaga

SEQ ID NO: 1480164 - DNA, 16 bp, Homo sapiens
cttgcttaaatttctt

SEQ ID NO: 1480165 - DNA, 17 bp, Homo sapiens
cttgcttaaatttctta

SEQ ID NO: 1480166 - DNA, 23 bp, Homo sapiens
cttgcttaaatttcttatgtgac

SEQ ID NO: 1480167 - DNA, 15 bp, Homo sapiens
cttgcttacctctca

SEQ ID NO: 1480168 - DNA, 23 bp, Homo sapiens
cttgcttagtatggttctcagat

SEQ ID NO: 1480169 - DNA, 13 bp, Homo sapiens
cttgcttcagtgg

SEQ ID NO: 1480170 - DNA, 15 bp, Homo sapiens
cttgcttcctgcatg

SEQ ID NO: 1480171 - DNA, 19 bp, Homo sapiens
cttgcttgccgagcctaat

SEQ ID NO: 1480172 - DNA, 19 bp, Homo sapiens
cttgcttgcctgcagggcc

SEQ ID NO: 1480173 - DNA, 14 bp, Homo sapiens
cttgcttgtatgat

SEQ ID NO: 1480174 - DNA, 21 bp, Homo sapiens
cttgcttgttgggattcctga

SEQ ID NO: 1480175 - DNA, 17 bp, Homo sapiens
cttgctttcacaaatat

SEQ ID NO: 1480176 - DNA, 19 bp, Homo sapiens
cttgctttcctgggccttt

SEQ ID NO: 1480177 - DNA, 15 bp, Homo sapiens
cttgctttcggagct

SEQ ID NO: 1480178 - DNA, 11 bp, Homo sapiens
cttgctttctt

SEQ ID NO: 1480179 - DNA, 13 bp, Homo sapiens
cttgctttcttta

SEQ ID NO: 1480180 - DNA, 22 bp, Homo sapiens
cttgctttcttttttaaaatca

SEQ ID NO: 1480181 - DNA, 12 bp, Homo sapiens
cttgctttgggc

SEQ ID NO: 1480182 - DNA, 18 bp, Homo sapiens
cttggaaaaacagcgtct

SEQ ID NO: 1480183 - DNA, 14 bp, Homo sapiens
cttggaaacctgcc

SEQ ID NO: 1480184 - DNA, 15 bp, Homo sapiens
cttggaaacctgccc

SEQ ID NO: 1480185 - DNA, 22 bp, Homo sapiens
cttggaaacctgccctgcctga

SEQ ID NO: 1480186 - DNA, 23 bp, Homo sapiens
cttggaaacctgccctgcctgag

SEQ ID NO: 1480187 - DNA, 20 bp, Homo sapiens
cttggaaagcatcacctcag

SEQ ID NO: 1480188 - DNA, 21 bp, Homo sapiens
cttggaaagcatcacctcagg

SEQ ID NO: 1480189 - DNA, 15 bp, Homo sapiens
cttggaaaggaccag

SEQ ID NO: 1480190 - DNA, 18 bp, Homo sapiens
cttggaaatgtctgctgg

SEQ ID NO: 1480191 - DNA, 16 bp, Homo sapiens
cttggaaattcctgta

SEQ ID NO: 1480192 - DNA, 17 bp, Homo sapiens
cttggaacaccctggat

SEQ ID NO: 1480193 - DNA, 21 bp, Homo sapiens
cttggaacaccctggatgctg

SEQ ID NO: 1480194 - DNA, 13 bp, Homo sapiens
cttggaactgcat

SEQ ID NO: 1480195 - DNA, 13 bp, Homo sapiens
cttggaagagctc

SEQ ID NO: 1480196 - DNA, 12 bp, Homo sapiens
cttggaagccag

SEQ ID NO: 1480197 - DNA, 20 bp, Homo sapiens
cttggaagctgtttggaaaa

SEQ ID NO: 1480198 - DNA, 23 bp, Homo sapiens
cttggaagggggagacaggaagt

SEQ ID NO: 1480199 - DNA, 13 bp, Homo sapiens
cttggacacttgg

SEQ ID NO: 1480200 - DNA, 19 bp, Homo sapiens
cttggacatcctcctccca

SEQ ID NO: 1480201 - DNA, 16 bp, Homo sapiens
cttggaccactcctgt

SEQ ID NO: 1480202 - DNA, 20 bp, Homo sapiens
cttggaccactcctgtccct

SEQ ID NO: 1480203 - DNA, 14 bp, Homo sapiens
cttggactacacaa

SEQ ID NO: 1480204 - DNA, 16 bp, Homo sapiens
cttggactacacaata

SEQ ID NO: 1480205 - DNA, 21 bp, Homo sapiens
cttggactacacaatacagta

SEQ ID NO: 1480206 - DNA, 16 bp, Homo sapiens
cttggacttcctgggg

SEQ ID NO: 1480207 - DNA, 23 bp, Homo sapiens
cttggacttcctggggccccgct

SEQ ID NO: 1480208 - DNA, 22 bp, Homo sapiens
cttggacttttttttttctttt

SEQ ID NO: 1480209 - DNA, 19 bp, Homo sapiens
cttggagaagtctcagcta

SEQ ID NO: 1480210 - DNA, 16 bp, Homo sapiens
cttggagactcctggt

SEQ ID NO: 1480211 - DNA, 19 bp, Homo sapiens
cttggagactcctggtctg

SEQ ID NO: 1480212 - DNA, 20 bp, Homo sapiens
cttggagagagaggctgcct

SEQ ID NO: 1480213 - DNA, 24 bp, Homo sapiens
cttggagagagaggctgcctcagc

SEQ ID NO: 1480214 - DNA, 14 bp, Homo sapiens
cttggagaggagag

SEQ ID NO: 1480215 - DNA, 18 bp, Homo sapiens
cttggagaggagagtggc

SEQ ID NO: 1480216 - DNA, 15 bp, Homo sapiens
cttggagcccgtgca

SEQ ID NO: 1480217 - DNA, 18 bp, Homo sapiens
cttggagcccgtgcagta

SEQ ID NO: 1480218 - DNA, 19 bp, Homo sapiens
cttggagctttttcaaaag

SEQ ID NO: 1480219 - DNA, 14 bp, Homo sapiens
cttggaggagagag

SEQ ID NO: 1480220 - DNA, 16 bp, Homo sapiens
cttgttgtttcttgcc

SEQ ID NO: 1480221 - DNA, 21 bp, Homo sapiens
cttgttgtttgttgacagctt

SEQ ID NO: 1480222 - DNA, 21 bp, Homo sapiens
cttgttgttttactaaagaaa

SEQ ID NO: 1480223 - DNA, 22 bp, Homo sapiens
cttgtttacagcactactctgt

SEQ ID NO: 1480224 - DNA, 18 bp, Homo sapiens
cttgtttagagagcctgt

SEQ ID NO: 1480225 - DNA, 16 bp, Homo sapiens
cttgtttatgatattt

SEQ ID NO: 1480226 - DNA, 18 bp, Homo sapiens
cttgtttctatactgttt

SEQ ID NO: 1480227 - DNA, 22 bp, Homo sapiens
cttgtttgattttagctgcaga

SEQ ID NO: 1480228 - DNA, 15 bp, Homo sapiens
cttgtttgcactgtg

SEQ ID NO: 1480229 - DNA, 12 bp, Homo sapiens
cttgtttgtcag

SEQ ID NO: 1480230 - DNA, 18 bp, Homo sapiens
cttgtttgtcagcatctg

SEQ ID NO: 1480231 - DNA, 22 bp, Homo sapiens
cttgtttgtcagcatctgacca

SEQ ID NO: 1480232 - DNA, 15 bp, Homo sapiens
cttgttttaatttta

SEQ ID NO: 1480233 - DNA, 14 bp, Homo sapiens
cttgttttcttgcc

SEQ ID NO: 1480234 - DNA, 17 bp, Homo sapiens
cttgttttcttgccaat

SEQ ID NO: 1480235 - DNA, 17 bp, Homo sapiens
cttgttttggatggctt

SEQ ID NO: 1480236 - DNA, 16 bp, Homo sapiens
cttgtttttaagtttg

SEQ ID NO: 1480237 - DNA, 20 bp, Homo sapiens
cttgtttttaagtttgcact

SEQ ID NO: 1480238 - DNA, 23 bp, Homo sapiens
cttgtttttgtaaagaaaaatat

SEQ ID NO: 1480239 - DNA, 16 bp, Homo sapiens
ctttaaaaagcagtcc

SEQ ID NO: 1480240 - DNA, 18 bp, Homo sapiens
ctttaaaaagcagtcctc

SEQ ID NO: 1480241 - DNA, 12 bp, Homo sapiens
ctttaaaaagga

SEQ ID NO: 1480242 - DNA, 15 bp, Homo sapiens
ctttaaaaatttact

SEQ ID NO: 1480243 - DNA, 19 bp, Homo sapiens
ctttaaaacaagtgtgatg

SEQ ID NO: 1480244 - DNA, 18 bp, Homo sapiens
ctttaaaaccacagctgg

SEQ ID NO: 1480245 - DNA, 15 bp, Homo sapiens
ctttaaaagagagag

SEQ ID NO: 1480246 - DNA, 22 bp, Homo sapiens
ctttaaacctgtttttttttca

SEQ ID NO: 1480247 - DNA, 16 bp, Homo sapiens
ctttaaactttccctt

SEQ ID NO: 1480248 - DNA, 18 bp, Homo sapiens
ctttaaagctcaggaggg

SEQ ID NO: 1480249 - DNA, 17 bp, Homo sapiens
ctttaaagtaaaggcct

SEQ ID NO: 1480250 - DNA, 15 bp, Homo sapiens
ctttaaatctgtgat

SEQ ID NO: 1480251 - DNA, 17 bp, Homo sapiens
ctttaaatcttaagcaa

SEQ ID NO: 1480252 - DNA, 21 bp, Homo sapiens
ctttaaatgcaacagttttta

SEQ ID NO: 1480253 - DNA, 18 bp, Homo sapiens
ctttaacaacctctgagc

SEQ ID NO: 1480254 - DNA, 19 bp, Homo sapiens
ctttaaccaggaatattaa

SEQ ID NO: 1480255 - DNA, 18 bp, Homo sapiens
ctttaacttagttttgca

SEQ ID NO: 1480256 - DNA, 17 bp, Homo sapiens
ctttaagatatccatct

SEQ ID NO: 1480257 - DNA, 23 bp, Homo sapiens
ctttaagcaaggtgtccctgcct

SEQ ID NO: 1480258 - DNA, 17 bp, Homo sapiens
ctttaagccaaagaaac

SEQ ID NO: 1480259 - DNA, 19 bp, Homo sapiens
ctttaagccaaagaaacaa

SEQ ID NO: 1480260 - DNA, 19 bp, Homo sapiens
ctttaagcctgcattctta

SEQ ID NO: 1480261 - DNA, 17 bp, Homo sapiens
ctttaagccttcaaaac

SEQ ID NO: 1480262 - DNA, 17 bp, Homo sapiens
ctttaataaatttaata

SEQ ID NO: 1480263 - DNA, 21 bp, Homo sapiens
ctttaatcttcagttttatct

SEQ ID NO: 1480264 - DNA, 22 bp, Homo sapiens
ctttaatgagaatagaaacgta

SEQ ID NO: 1480265 - DNA, 17 bp, Homo sapiens
ctttaatgttttttgcc

SEQ ID NO: 1480266 - DNA, 17 bp, Homo sapiens
ctttaattactggaatt

SEQ ID NO: 1480267 - DNA, 15 bp, Homo sapiens
ctttaattccatgaa

SEQ ID NO: 1480268 - DNA, 16 bp, Homo sapiens
ctttaattccatgaat

SEQ ID NO: 1480269 - DNA, 13 bp, Homo sapiens
ctttaattgtata

SEQ ID NO: 1480270 - DNA, 15 bp, Homo sapiens
ctttaattgtataag

SEQ ID NO: 1480271 - DNA, 16 bp, Homo sapiens
ctttaattgtataagt

SEQ ID NO: 1480272 - DNA, 19 bp, Homo sapiens
ctttaattgtataagtcaa

SEQ ID NO: 1480273 - DNA, 13 bp, Homo sapiens
ctttaattttagc

SEQ ID NO: 1480274 - DNA, 21 bp, Homo sapiens
ctttacaagggagaagacaac

SEQ ID NO: 1480275 - DNA, 19 bp, Homo sapiens
ctttacaggaaaaaaaatt

SEQ ID NO: 1480276 - DNA, 16 bp, Homo sapiens
ctttacatgctgtgct

SEQ ID NO: 1480277 - DNA, 18 bp, Homo sapiens
ctttaccaaaaaccatgt

SEQ ID NO: 1480278 - DNA, 19 bp, Homo sapiens
ctttaccctctttgctgca

SEQ ID NO: 1480279 - DNA, 22 bp, Homo sapiens
ctttacctatggaagtggttct

SEQ ID NO: 1480280 - DNA, 13 bp, Homo sapiens
ctttacctgagac

SEQ ID NO: 1480281 - DNA, 13 bp, Homo sapiens
ctttacctgcagg

SEQ ID NO: 1480282 - DNA, 14 bp, Homo sapiens
ctttacctgtatac

SEQ ID NO: 1480283 - DNA, 15 bp, Homo sapiens
ctttaccttctaaaa

SEQ ID NO: 1480284 - DNA, 12 bp, Homo sapiens
ctttactactgt

SEQ ID NO: 1480285 - DNA, 15 bp, Homo sapiens
ctttactactgtgga

SEQ ID NO: 1480286 - DNA, 16 bp, Homo sapiens
ctttactactgtggaa

SEQ ID NO: 1480287 - DNA, 19 bp, Homo sapiens
ctttactactgtggaaaga

SEQ ID NO: 1480288 - DNA, 15 bp, Homo sapiens
ctttactcagcccag

SEQ ID NO: 1480289 - DNA, 22 bp, Homo sapiens
ctttactcagcccagctggcca

SEQ ID NO: 1480290 - DNA, 16 bp, Homo sapiens
ctttactcccttcctg

SEQ ID NO: 1480291 - DNA, 19 bp, Homo sapiens
ctttactcggcgtgctcct

SEQ ID NO: 1480292 - DNA, 21 bp, Homo sapiens
ctttactcggcgtgctccttt

SEQ ID NO: 1480293 - DNA, 21 bp, Homo sapiens
ctttactgtaatataaagtat

SEQ ID NO: 1480294 - DNA, 15 bp, Homo sapiens
ctttactgtcaaaat

SEQ ID NO: 1480295 - DNA, 20 bp, Homo sapiens
ctttactgtgcttatttttt

SEQ ID NO: 1480296 - DNA, 14 bp, Homo sapiens
ctttactgtttgtt

SEQ ID NO: 1480297 - DNA, 14 bp, Homo sapiens
ctttacttatctct

SEQ ID NO: 1480298 - DNA, 20 bp, Homo sapiens
ctttagaaacacataattaa

SEQ ID NO: 1480299 - DNA, 14 bp, Homo sapiens
ctttagaagcctgc

SEQ ID NO: 1480300 - DNA, 22 bp, Homo sapiens
ctttagaatgagagtgtgaaat

SEQ ID NO: 1480301 - DNA, 23 bp, Homo sapiens
ctttagaccctgggtgggctctg

SEQ ID NO: 1480302 - DNA, 22 bp, Homo sapiens
ctttagactaattgtgtttgtc

SEQ ID NO: 1480303 - DNA, 16 bp, Homo sapiens
ctttagatatttgcct

SEQ ID NO: 1480304 - DNA, 12 bp, Homo sapiens
ctttagatgcca

SEQ ID NO: 1480305 - DNA, 12 bp, Homo sapiens
ctttagattaaa

SEQ ID NO: 1480306 - DNA, 22 bp, Homo sapiens
ctttagccactggtttctcaga

SEQ ID NO: 1480307 - DNA, 16 bp, Homo sapiens
ctttagccatcataac

SEQ ID NO: 1480308 - DNA, 18 bp, Homo sapiens
ctttaggcagcagctttt

SEQ ID NO: 1480309 - DNA, 22 bp, Homo sapiens
ctttaggccatgggtggaaagt

SEQ ID NO: 1480310 - DNA, 13 bp, Homo sapiens
ctttagggcagct

SEQ ID NO: 1480311 - DNA, 14 bp, Homo sapiens
ctttagggcagctt

SEQ ID NO: 1480312 - DNA, 15 bp, Homo sapiens
ctttagggcagcttg

SEQ ID NO: 1480313 - DNA, 14 bp, Homo sapiens
ctttaggtctggtt

SEQ ID NO: 1480314 - DNA, 16 bp, Homo sapiens
ctttagtggagccagg

SEQ ID NO: 1480315 - DNA, 22 bp, Homo sapiens
ctttagttcctactttagccac

SEQ ID NO: 1480316 - DNA, 16 bp, Homo sapiens
ctttagttctgctttc

SEQ ID NO: 1480317 - DNA, 17 bp, Homo sapiens
ctttataaatccagtga

SEQ ID NO: 1480318 - DNA, 13 bp, Homo sapiens
ctttataaatgta

SEQ ID NO: 1480319 - DNA, 20 bp, Homo sapiens
ctttataagtcattgtatgt

SEQ ID NO: 1480320 - DNA, 15 bp, Homo sapiens
ctttatacacagtgg

SEQ ID NO: 1480321 - DNA, 14 bp, Homo sapiens
ctttatacagctgt

SEQ ID NO: 1480322 - DNA, 18 bp, Homo sapiens
ctttatacagttgaattt

SEQ ID NO: 1480323 - DNA, 20 bp, Homo sapiens
ctttatagaaggaatttgta

SEQ ID NO: 1480324 - DNA, 13 bp, Homo sapiens
ctttatatgaaga

SEQ ID NO: 1480325 - DNA, 15 bp, Homo sapiens
ctttatatttgctcc

SEQ ID NO: 1480326 - DNA, 19 bp, Homo sapiens
ctttatcacattatttgca

SEQ ID NO: 1480327 - DNA, 15 bp, Homo sapiens
ctttatcattgctaa

SEQ ID NO: 1480328 - DNA, 16 bp, Homo sapiens
ctttatcttgaagtca

SEQ ID NO: 1480329 - DNA, 19 bp, Homo sapiens
ctttatgataatagattct

SEQ ID NO: 1480330 - DNA, 17 bp, Homo sapiens
ctttatgatgctaagct

SEQ ID NO: 1480331 - DNA, 14 bp, Homo sapiens
ctttatgcaaatac

SEQ ID NO: 1480332 - DNA, 15 bp, Homo sapiens
ctttatgcacaaaat

SEQ ID NO: 1480333 - DNA, 19 bp, Homo sapiens
ctttatgctgtattttaac

SEQ ID NO: 1480334 - DNA, 19 bp, Homo sapiens
ctttatgtagtttttatat

SEQ ID NO: 1480335 - DNA, 15 bp, Homo sapiens
ctttctctctggctt

SEQ ID NO: 1480336 - DNA, 16 bp, Homo sapiens
ctttctctctggcttc

SEQ ID NO: 1480337 - DNA, 17 bp, Homo sapiens
ctttctctctggcttct

SEQ ID NO: 1480338 - DNA, 19 bp, Homo sapiens
ctttctctctggcttctct

SEQ ID NO: 1480339 - DNA, 14 bp, Homo sapiens
ctttctctgccagt

SEQ ID NO: 1480340 - DNA, 9 bp, Homo sapiens
ctttctctt

SEQ ID NO: 1480341 - DNA, 13 bp, Homo sapiens
ctttctcttacct

SEQ ID NO: 1480342 - DNA, 21 bp, Homo sapiens
ctttctcttcatattcagctt

SEQ ID NO: 1480343 - DNA, 15 bp, Homo sapiens
ctttctcttccctga

SEQ ID NO: 1480344 - DNA, 22 bp, Homo sapiens
ctttctcttttcccctttcctg

SEQ ID NO: 1480345 - DNA, 14 bp, Homo sapiens
ctttctgaattgca

SEQ ID NO: 1480346 - DNA, 21 bp, Homo sapiens
ctttctgccatctagccagcc

SEQ ID NO: 1480347 - DNA, 22 bp, Homo sapiens
ctttctgccatctagccagccc

SEQ ID NO: 1480348 - DNA, 13 bp, Homo sapiens
ctttctgcccggc

SEQ ID NO: 1480349 - DNA, 12 bp, Homo sapiens
ctttctgcctct

SEQ ID NO: 1480350 - DNA, 15 bp, Homo sapiens
ctttctgcctctcct

SEQ ID NO: 1480351 - DNA, 17 bp, Homo sapiens
ctttctgcctctcctcc

SEQ ID NO: 1480352 - DNA, 19 bp, Homo sapiens
ctttctgctgggatccttg

SEQ ID NO: 1480353 - DNA, 16 bp, Homo sapiens
ctttctgcttgtgtta

SEQ ID NO: 1480354 - DNA, 22 bp, Homo sapiens
ctttctggactcccactctttg

SEQ ID NO: 1480355 - DNA, 18 bp, Homo sapiens
ctttctgggatgtcacag

SEQ ID NO: 1480356 - DNA, 16 bp, Homo sapiens
ctttctgggtgtgtcc

SEQ ID NO: 1480357 - DNA, 17 bp, Homo sapiens
ctttctgggtgtgtcca

SEQ ID NO: 1480358 - DNA, 14 bp, Homo sapiens
ctttctgtctccct

SEQ ID NO: 1480359 - DNA, 16 bp, Homo sapiens
ctttctgtctcccttc

SEQ ID NO: 1480360 - DNA, 22 bp, Homo sapiens
ctttctgtctcccttctctctc

SEQ ID NO: 1480361 - DNA, 14 bp, Homo sapiens
ctttctgtctgctt

SEQ ID NO: 1480362 - DNA, 13 bp, Homo sapiens
ctttctgtgttta

SEQ ID NO: 1480363 - DNA, 14 bp, Homo sapiens
ctttctgttaaaat

SEQ ID NO: 1480364 - DNA, 15 bp, Homo sapiens
ctttctgttaaaatg

SEQ ID NO: 1480365 - DNA, 16 bp, Homo sapiens
ctttctgttgagagaa

SEQ ID NO: 1480366 - DNA, 23 bp, Homo sapiens
ctttcttaagccctttgctctgg

SEQ ID NO: 1480367 - DNA, 22 bp, Homo sapiens
ctttcttacctactattggccc

SEQ ID NO: 1480368 - DNA, 23 bp, Homo sapiens
ctttcttacctactattggccct

SEQ ID NO: 1480369 - DNA, 16 bp, Homo sapiens
ctttcttattctgtat

SEQ ID NO: 1480370 - DNA, 11 bp, Homo sapiens
ctttcttctgt

SEQ ID NO: 1480371 - DNA, 13 bp, Homo sapiens
ctttcttctgtgt

SEQ ID NO: 1480372 - DNA, 14 bp, Homo sapiens
ctttcttctgtgtt

SEQ ID NO: 1480373 - DNA, 20 bp, Homo sapiens
ctttcttgacaaaacctaac

SEQ ID NO: 1480374 - DNA, 13 bp, Homo sapiens
ctttcttgcagat

SEQ ID NO: 1480375 - DNA, 20 bp, Homo sapiens
ctttcttgctggctctgaga

SEQ ID NO: 1480376 - DNA, 21 bp, Homo sapiens
ctttcttgtttgtcagcatct

SEQ ID NO: 1480377 - DNA, 17 bp, Homo sapiens
ctttctttaaagttctt

SEQ ID NO: 1480378 - DNA, 18 bp, Homo sapiens
ctttctttacctgagacc

SEQ ID NO: 1480379 - DNA, 13 bp, Homo sapiens
ctttctttctcta

SEQ ID NO: 1480380 - DNA, 15 bp, Homo sapiens
ctttctttgcctctg

SEQ ID NO: 1480381 - DNA, 22 bp, Homo sapiens
ctttctttgtttctttcttcct

SEQ ID NO: 1480382 - DNA, 21 bp, Homo sapiens
ctttctttgttttattttaat

SEQ ID NO: 1480383 - DNA, 14 bp, Homo sapiens
ctttctttttcttc

SEQ ID NO: 1480384 - DNA, 16 bp, Homo sapiens
ctttctttttcttctt

SEQ ID NO: 1480385 - DNA, 20 bp, Homo sapiens
ctttctttttcttcttccct

SEQ ID NO: 1480386 - DNA, 18 bp, Homo sapiens
ctttgaaaagttggaagg

SEQ ID NO: 1480387 - DNA, 14 bp, Homo sapiens
ctttgaaataaaaa

SEQ ID NO: 1480388 - DNA, 14 bp, Homo sapiens
ctttgaaatgtgtt

SEQ ID NO: 1480389 - DNA, 18 bp, Homo sapiens
ctttgaaatgtgtttctg

SEQ ID NO: 1480390 - DNA, 21 bp, Homo sapiens
ctttgaaatgtgtttctgtat

SEQ ID NO: 1480391 - DNA, 22 bp, Homo sapiens
ctttgaaatgtgtttctgtata

SEQ ID NO: 1480392 - DNA, 13 bp, Homo sapiens
ctttgaacatgaa

SEQ ID NO: 1480393 - DNA, 17 bp, Homo sapiens
ctttgaacgtgcttctt

SEQ ID NO: 1480394 - DNA, 21 bp, Homo sapiens
ctttgaacgtgcttctttgta

SEQ ID NO: 1480395 - DNA, 19 bp, Homo sapiens
ctttgaagcaaatacaatt

SEQ ID NO: 1480396 - DNA, 16 bp, Homo sapiens
ctttgaaggggcctca

SEQ ID NO: 1480397 - DNA, 17 bp, Homo sapiens
ctttgaagtagctcttt

SEQ ID NO: 1480398 - DNA, 21 bp, Homo sapiens
ctttgaatgcagaagcaaaca

SEQ ID NO: 1480399 - DNA, 18 bp, Homo sapiens
ctttgacaattgggagct

SEQ ID NO: 1480400 - DNA, 18 bp, Homo sapiens
ctttgaccagatctttct

SEQ ID NO: 1480401 - DNA, 20 bp, Homo sapiens
ctttgaccagatctttctct

SEQ ID NO: 1480402 - DNA, 21 bp, Homo sapiens
ctttgaccagatctttctctt

SEQ ID NO: 1480403 - DNA, 21 bp, Homo sapiens
ctttgacctaaattatttact

SEQ ID NO: 1480404 - DNA, 14 bp, Homo sapiens
ctttgacctgttgg

SEQ ID NO: 1480405 - DNA, 21 bp, Homo sapiens
ctttgactcttttgccattaa

SEQ ID NO: 1480406 - DNA, 16 bp, Homo sapiens
ctttgagatctgggga

SEQ ID NO: 1480407 - DNA, 18 bp, Homo sapiens
ctttgagatctggggagg

SEQ ID NO: 1480408 - DNA, 23 bp, Homo sapiens
ctttgaggttattttccgccaga

SEQ ID NO: 1480409 - DNA, 20 bp, Homo sapiens
ctttgagtgccaatttctta

SEQ ID NO: 1480410 - DNA, 18 bp, Homo sapiens
ctttgataaaataaatga

SEQ ID NO: 1480411 - DNA, 13 bp, Homo sapiens
ctttgataacaaa

SEQ ID NO: 1480412 - DNA, 14 bp, Homo sapiens
ctttgataacaaaa

SEQ ID NO: 1480413 - DNA, 22 bp, Homo sapiens
ctttgatattttcaacgcagcc

SEQ ID NO: 1480414 - DNA, 18 bp, Homo sapiens
ctttgattctccttcagc

SEQ ID NO: 1480415 - DNA, 15 bp, Homo sapiens
ctttgcaaagacccg

SEQ ID NO: 1480416 - DNA, 22 bp, Homo sapiens
ctttgcaaattcaagagcctcc

SEQ ID NO: 1480417 - DNA, 17 bp, Homo sapiens
ctttgcaagatgcttgg

SEQ ID NO: 1480418 - DNA, 17 bp, Homo sapiens
ctttgcaccaaagacat

SEQ ID NO: 1480419 - DNA, 18 bp, Homo sapiens
ctttgcaccaaagacatc

SEQ ID NO: 1480420 - DNA, 22 bp, Homo sapiens
ctttgcacgtgctgtttgctgt

SEQ ID NO: 1480421 - DNA, 18 bp, Homo sapiens
ctttgcactgagggccac

SEQ ID NO: 1480422 - DNA, 22 bp, Homo sapiens
ctttgcactgagggccacacta

SEQ ID NO: 1480423 - DNA, 16 bp, Homo sapiens
ctttgcactgtaatga

SEQ ID NO: 1480424 - DNA, 12 bp, Homo sapiens
ctttgcacttaa

SEQ ID NO: 1480425 - DNA, 16 bp, Homo sapiens
ctttgcacttaaaaat

SEQ ID NO: 1480426 - DNA, 21 bp, Homo sapiens
ctttgcagttggactctcagg

SEQ ID NO: 1480427 - DNA, 22 bp, Homo sapiens
ctttgcagttggactctcaggg

SEQ ID NO: 1480428 - DNA, 14 bp, Homo sapiens
ctttgcatgtatta

SEQ ID NO: 1480429 - DNA, 14 bp, Homo sapiens
ctttgcattttgga

SEQ ID NO: 1480430 - DNA, 22 bp, Homo sapiens
ctttgccaaaataccagagcct

SEQ ID NO: 1480431 - DNA, 22 bp, Homo sapiens
ctttgccacaagacctagccta

SEQ ID NO: 1480432 - DNA, 13 bp, Homo sapiens
ctttgccagagca

SEQ ID NO: 1480433 - DNA, 18 bp, Homo sapiens
ctttgccagagcaggagc

SEQ ID NO: 1480434 - DNA, 22 bp, Homo sapiens
ctttgcccacccctcactcccc

SEQ ID NO: 1480435 - DNA, 16 bp, Homo sapiens
ctttgcccaggcatga

SEQ ID NO: 1480436 - DNA, 21 bp, Homo sapiens
ctttgcccagggtcctgtgcc

SEQ ID NO: 1480437 - DNA, 23 bp, Homo sapiens
ctttgccccacctttattaaaat

SEQ ID NO: 1480438 - DNA, 12 bp, Homo sapiens
ctttgcctctgc

SEQ ID NO: 1480439 - DNA, 23 bp, Homo sapiens
ctttgcctctgcagtctcatttc

SEQ ID NO: 1480440 - DNA, 19 bp, Homo sapiens
ctttgccttgggctgctcc

SEQ ID NO: 1480441 - DNA, 15 bp, Homo sapiens
ctttgcggacgggct

SEQ ID NO: 1480442 - DNA, 14 bp, Homo sapiens
ctttgctacaaatt

SEQ ID NO: 1480443 - DNA, 18 bp, Homo sapiens
ctttgctacaaatttatg

SEQ ID NO: 1480444 - DNA, 13 bp, Homo sapiens
ctttgctatgtaa

SEQ ID NO: 1480445 - DNA, 21 bp, Homo sapiens
ctttgctcagtggatcacaca

SEQ ID NO: 1480446 - DNA, 12 bp, Homo sapiens
ctttgctccaga

SEQ ID NO: 1480447 - DNA, 11 bp, Homo sapiens
ctttgctcccg

SEQ ID NO: 1480448 - DNA, 20 bp, Homo sapiens
ctttgctcccggcaagcgct

SEQ ID NO: 1480449 - DNA, 18 bp, Homo sapiens
ctttgctccgctcccacc

SEQ ID NO: 1480450 - DNA, 23 bp, Homo sapiens
cttttaattgaaattaactttta

SEQ ID NO: 1480451 - DNA, 14 bp, Homo sapiens
cttttaattttcct

SEQ ID NO: 1480452 - DNA, 13 bp, Homo sapiens
cttttacatactg

SEQ ID NO: 1480453 - DNA, 17 bp, Homo sapiens
cttttacatactgctgt

SEQ ID NO: 1480454 - DNA, 13 bp, Homo sapiens
cttttacattgtg

SEQ ID NO: 1480455 - DNA, 19 bp, Homo sapiens
cttttaccactatttaagt

SEQ ID NO: 1480456 - DNA, 16 bp, Homo sapiens
cttttaccagtttctt

SEQ ID NO: 1480457 - DNA, 14 bp, Homo sapiens
cttttaccatgccc

SEQ ID NO: 1480458 - DNA, 15 bp, Homo sapiens
cttttaccctttttc

SEQ ID NO: 1480459 - DNA, 13 bp, Homo sapiens
cttttactttatt

SEQ ID NO: 1480460 - DNA, 18 bp, Homo sapiens
cttttacttttttatagc

SEQ ID NO: 1480461 - DNA, 15 bp, Homo sapiens
cttttagaaatgcat

SEQ ID NO: 1480462 - DNA, 16 bp, Homo sapiens
cttttagacaactaga

SEQ ID NO: 1480463 - DNA, 19 bp, Homo sapiens
cttttagacaactagattt

SEQ ID NO: 1480464 - DNA, 15 bp, Homo sapiens
cttttagagagggga

SEQ ID NO: 1480465 - DNA, 21 bp, Homo sapiens
cttttaggaaaatcactttgt

SEQ ID NO: 1480466 - DNA, 22 bp, Homo sapiens
cttttaggaatatgttcaatgc

SEQ ID NO: 1480467 - DNA, 20 bp, Homo sapiens
cttttaggatgggggagagg

SEQ ID NO: 1480468 - DNA, 18 bp, Homo sapiens
cttttaggccaaaaaaat

SEQ ID NO: 1480469 - DNA, 20 bp, Homo sapiens
cttttagttgtatctctttt

SEQ ID NO: 1480470 - DNA, 19 bp, Homo sapiens
cttttatagagcatatttg

SEQ ID NO: 1480471 - DNA, 20 bp, Homo sapiens
cttttataggtgagaaaaaa

SEQ ID NO: 1480472 - DNA, 19 bp, Homo sapiens
cttttatgattttgtttat

SEQ ID NO: 1480473 - DNA, 14 bp, Homo sapiens
cttttattaataaa

SEQ ID NO: 1480474 - DNA, 13 bp, Homo sapiens
cttttatttctcc

SEQ ID NO: 1480475 - DNA, 18 bp, Homo sapiens
cttttatttctccatctt

SEQ ID NO: 1480476 - DNA, 22 bp, Homo sapiens
cttttattttggaactatgaag

SEQ ID NO: 1480477 - DNA, 23 bp, Homo sapiens
cttttattttggaactatgaaga

SEQ ID NO: 1480478 - DNA, 13 bp, Homo sapiens
cttttattttttc

SEQ ID NO: 1480479 - DNA, 12 bp, Homo sapiens
cttttcaaaatc

SEQ ID NO: 1480480 - DNA, 22 bp, Homo sapiens
cttttcaaatagggtctaactc

SEQ ID NO: 1480481 - DNA, 14 bp, Homo sapiens
cttttcaagtattt

SEQ ID NO: 1480482 - DNA, 14 bp, Homo sapiens
cttttcaatcttct

SEQ ID NO: 1480483 - DNA, 18 bp, Homo sapiens
cttttcaatcttctactt

SEQ ID NO: 1480484 - DNA, 17 bp, Homo sapiens
cttttcaattatattgt

SEQ ID NO: 1480485 - DNA, 19 bp, Homo sapiens
cttttcaattatattgtta

SEQ ID NO: 1480486 - DNA, 12 bp, Homo sapiens
cttttcactgct

SEQ ID NO: 1480487 - DNA, 17 bp, Homo sapiens
cttttcactgctggctg

SEQ ID NO: 1480488 - DNA, 21 bp, Homo sapiens
cttttcagaagtgagctttgc

SEQ ID NO: 1480489 - DNA, 17 bp, Homo sapiens
cttttcagcttgtttct

SEQ ID NO: 1480490 - DNA, 18 bp, Homo sapiens
cttttcagcttgtttcta

SEQ ID NO: 1480491 - DNA, 18 bp, Homo sapiens
cttttcaggaagctctct

SEQ ID NO: 1480492 - DNA, 19 bp, Homo sapiens
cttttcatgtagaactcag

SEQ ID NO: 1480493 - DNA, 14 bp, Homo sapiens
cttttccaaataaa

SEQ ID NO: 1480494 - DNA, 19 bp, Homo sapiens
cttttccactccattgtcg

SEQ ID NO: 1480495 - DNA, 17 bp, Homo sapiens
cttttccagtctgtaca

SEQ ID NO: 1480496 - DNA, 17 bp, Homo sapiens
cttttccattgaccagc

SEQ ID NO: 1480497 - DNA, 12 bp, Homo sapiens
cttttccccagg

SEQ ID NO: 1480498 - DNA, 14 bp, Homo sapiens
cttttccccaggag

SEQ ID NO: 1480499 - DNA, 23 bp, Homo sapiens
cttttcccccattaatcagttca

SEQ ID NO: 1480500 - DNA, 16 bp, Homo sapiens
cttttcccctttcctg

SEQ ID NO: 1480501 - DNA, 20 bp, Homo sapiens
cttttcccctttcctgtccc

SEQ ID NO: 1480502 - DNA, 21 bp, Homo sapiens
cttttcccctttcctgtccca

SEQ ID NO: 1480503 - DNA, 20 bp, Homo sapiens
cttttccctctttggctccc

SEQ ID NO: 1480504 - DNA, 13 bp, Homo sapiens
cttttccctgctt

SEQ ID NO: 1480505 - DNA, 17 bp, Homo sapiens
cttttcccttaaataca

SEQ ID NO: 1480506 - DNA, 15 bp, Homo sapiens
cttttcccttgctgt

SEQ ID NO: 1480507 - DNA, 16 bp, Homo sapiens
cttttcctcaagcaat

SEQ ID NO: 1480508 - DNA, 19 bp, Homo sapiens
cttttcctgataaagcaca

SEQ ID NO: 1480509 - DNA, 13 bp, Homo sapiens
cttttcgccccct

SEQ ID NO: 1480510 - DNA, 18 bp, Homo sapiens
cttttcgccccctgcctg

SEQ ID NO: 1480511 - DNA, 20 bp, Homo sapiens
cttttcgccccctgcctgcc

SEQ ID NO: 1480512 - DNA, 11 bp, Homo sapiens
cttttcgttaa

SEQ ID NO: 1480513 - DNA, 15 bp, Homo sapiens
cttttcgttaacatt

SEQ ID NO: 1480514 - DNA, 16 bp, Homo sapiens
cttttcgttaacattg

SEQ ID NO: 1480515 - DNA, 20 bp, Homo sapiens
cttttcgttaacattgacca

SEQ ID NO: 1480516 - DNA, 16 bp, Homo sapiens
cttttctaacagaaag

SEQ ID NO: 1480517 - DNA, 19 bp, Homo sapiens
cttttctaagtggcgtgtg

SEQ ID NO: 1480518 - DNA, 20 bp, Homo sapiens
cttttctaagtggcgtgtgc

SEQ ID NO: 1480519 - DNA, 21 bp, Homo sapiens
cttttctaagtggcgtgtgca

SEQ ID NO: 1480520 - DNA, 15 bp, Homo sapiens
cttttctagagacac

SEQ ID NO: 1480521 - DNA, 16 bp, Homo sapiens
cttttctagagacaca

SEQ ID NO: 1480522 - DNA, 17 bp, Homo sapiens
cttttctagagacacat

SEQ ID NO: 1480523 - DNA, 13 bp, Homo sapiens
cttttctatttat

SEQ ID NO: 1480524 - DNA, 20 bp, Homo sapiens
cttttctcaactgggtccag

SEQ ID NO: 1480525 - DNA, 17 bp, Homo sapiens
cttttctcagtgttggt

SEQ ID NO: 1480526 - DNA, 17 bp, Homo sapiens
cttttctccaatatcag

SEQ ID NO: 1480527 - DNA, 21 bp, Homo sapiens
cttttctccaatatcagtgct

SEQ ID NO: 1480528 - DNA, 17 bp, Homo sapiens
cttttctcctcactgta

SEQ ID NO: 1480529 - DNA, 15 bp, Homo sapiens
cttttctcctgcaga

SEQ ID NO: 1480530 - DNA, 17 bp, Homo sapiens
cttttctcttttgcttt

SEQ ID NO: 1480531 - DNA, 19 bp, Homo sapiens
cttttctgccctggctgct

SEQ ID NO: 1480532 - DNA, 14 bp, Homo sapiens
cttttctggcaccg

SEQ ID NO: 1480533 - DNA, 19 bp, Homo sapiens
cttttctggccaaaagcag

SEQ ID NO: 1480534 - DNA, 23 bp, Homo sapiens
cttttctggggaaagacactgcc

SEQ ID NO: 1480535 - DNA, 13 bp, Homo sapiens
cttttctgtcctg

SEQ ID NO: 1480536 - DNA, 17 bp, Homo sapiens
cttttctgtcctgggca

SEQ ID NO: 1480537 - DNA, 15 bp, Homo sapiens
cttttctgttattgt

SEQ ID NO: 1480538 - DNA, 15 bp, Homo sapiens
cttttcttaaacctt

SEQ ID NO: 1480539 - DNA, 22 bp, Homo sapiens
cttttcttacccagattgtgta

SEQ ID NO: 1480540 - DNA, 11 bp, Homo sapiens
cttttcttatt

SEQ ID NO: 1480541 - DNA, 18 bp, Homo sapiens
cttttctttaaagaagtt

SEQ ID NO: 1480542 - DNA, 19 bp, Homo sapiens
cttttctttgggcttgaca

SEQ ID NO: 1480543 - DNA, 22 bp, Homo sapiens
cttttctttttttctttaataa

SEQ ID NO: 1480544 - DNA, 22 bp, Homo sapiens
cttttgaactggcaattgtcta

SEQ ID NO: 1480545 - DNA, 15 bp, Homo sapiens
cttttgaacttgtca

SEQ ID NO: 1480546 - DNA, 21 bp, Homo sapiens
cttttgaagcatagataatat

SEQ ID NO: 1480547 - DNA, 18 bp, Homo sapiens
cttttgaatacatttgta

SEQ ID NO: 1480548 - DNA, 19 bp, Homo sapiens
cttttgaatccatgcttgg

SEQ ID NO: 1480549 - DNA, 18 bp, Homo sapiens
cttttgacactgctctaa

SEQ ID NO: 1480550 - DNA, 20 bp, Homo sapiens
cttttgacataactatcttt

SEQ ID NO: 1480551 - DNA, 15 bp, Homo sapiens
cttttgacattttat

SEQ ID NO: 1480552 - DNA, 18 bp, Homo sapiens
cttttgacttaaagcaga

SEQ ID NO: 1480553 - DNA, 14 bp, Homo sapiens
cttttgagaggggt

SEQ ID NO: 1480554 - DNA, 15 bp, Homo sapiens
cttttgaggagctgg

SEQ ID NO: 1480555 - DNA, 17 bp, Homo sapiens
cttttgatggggagaaa

SEQ ID NO: 1480556 - DNA, 18 bp, Homo sapiens
cttttgatggggagaaag

SEQ ID NO: 1480557 - DNA, 14 bp, Homo sapiens
cttttgatgtgaaa

SEQ ID NO: 1480558 - DNA, 17 bp, Homo sapiens
cttttgcaaccaggaac

SEQ ID NO: 1480559 - DNA, 23 bp, Homo sapiens
cttttgcacaaggaaataaagcg

SEQ ID NO: 1480560 - DNA, 18 bp, Homo sapiens
cttttgcacccctcccat

SEQ ID NO: 1480561 - DNA, 19 bp, Homo sapiens
cttttgcacccctcccatt

SEQ ID NO: 1480562 - DNA, 20 bp, Homo sapiens
cttttgcacccctcccatta

SEQ ID NO: 1480563 - DNA, 18 bp, Homo sapiens
cttttgcagaagagggtg

SEQ ID NO: 1480564 - DNA, 19 bp, Homo sapiens
cttttgccagtattatgca

SEQ ID NO: 1480565 - DNA, 12 bp, Homo sapiens
gaaaatgcaaag

SEQ ID NO: 1480566 - DNA, 22 bp, Homo sapiens
gaaaatgcagtcctgaggagag

SEQ ID NO: 1480567 - DNA, 15 bp, Homo sapiens
gaaaatggccatgca

SEQ ID NO: 1480568 - DNA, 18 bp, Homo sapiens
gaaaatggccatgcagga

SEQ ID NO: 1480569 - DNA, 22 bp, Homo sapiens
gaaaatggccatgcaggaggtg

SEQ ID NO: 1480570 - DNA, 20 bp, Homo sapiens
gaaaatggctaataaactgt

SEQ ID NO: 1480571 - DNA, 15 bp, Homo sapiens
gaaaatgtaaaggag

SEQ ID NO: 1480572 - DNA, 17 bp, Homo sapiens
gaaaatgtaaaggaggg

SEQ ID NO: 1480573 - DNA, 21 bp, Homo sapiens
gaaaatgtcagaaaccagtta

SEQ ID NO: 1480574 - DNA, 23 bp, Homo sapiens
gaaaatgtctattcaaaatatca

SEQ ID NO: 1480575 - DNA, 19 bp, Homo sapiens
gaaaatgtgtcctatctat

SEQ ID NO: 1480576 - DNA, 19 bp, Homo sapiens
gaaaatgttcatgttcata

SEQ ID NO: 1480577 - DNA, 20 bp, Homo sapiens
gaaaatgtttttctgccagg

SEQ ID NO: 1480578 - DNA, 23 bp, Homo sapiens
gaaaattaaaccaatgaagaaga

SEQ ID NO: 1480579 - DNA, 19 bp, Homo sapiens
gaaaattatgcaaaagcag

SEQ ID NO: 1480580 - DNA, 20 bp, Homo sapiens
gaaaattattttgttcatac

SEQ ID NO: 1480581 - DNA, 21 bp, Homo sapiens
gaaaattattttgttcataca

SEQ ID NO: 1480582 - DNA, 22 bp, Homo sapiens
gaaaattctaacccaggtatcc

SEQ ID NO: 1480583 - DNA, 16 bp, Homo sapiens
gaaaattcttaaaagg

SEQ ID NO: 1480584 - DNA, 12 bp, Homo sapiens
gaaaattgagtt

SEQ ID NO: 1480585 - DNA, 15 bp, Homo sapiens
gaaaattgatatttt

SEQ ID NO: 1480586 - DNA, 19 bp, Homo sapiens
gaaaattgcctttctgtgt

SEQ ID NO: 1480587 - DNA, 14 bp, Homo sapiens
gaaaattttacttc

SEQ ID NO: 1480588 - DNA, 14 bp, Homo sapiens
gaaacaaaaacact

SEQ ID NO: 1480589 - DNA, 12 bp, Homo sapiens
gaaacaaagatg

SEQ ID NO: 1480590 - DNA, 17 bp, Homo sapiens
gaaacaaataatcacat

SEQ ID NO: 1480591 - DNA, 14 bp, Homo sapiens
gaaacaagctgtgc

SEQ ID NO: 1480592 - DNA, 10 bp, Homo sapiens
gaaacaatgt

SEQ ID NO: 1480593 - DNA, 21 bp, Homo sapiens
gaaacacataacaaagggcag

SEQ ID NO: 1480594 - DNA, 15 bp, Homo sapiens
gaaacacataattaa

SEQ ID NO: 1480595 - DNA, 19 bp, Homo sapiens
gaaacacataattaacact

SEQ ID NO: 1480596 - DNA, 20 bp, Homo sapiens
gaaacacataattaacactt

SEQ ID NO: 1480597 - DNA, 16 bp, Homo sapiens
gaaacactgccttttt

SEQ ID NO: 1480598 - DNA, 22 bp, Homo sapiens
gaaacagaaacaaaaacactaa

SEQ ID NO: 1480599 - DNA, 12 bp, Homo sapiens
gaaacagagaac

SEQ ID NO: 1480600 - DNA, 14 bp, Homo sapiens
gaaacagagacagg

SEQ ID NO: 1480601 - DNA, 17 bp, Homo sapiens
gaaacagagacaggccc

SEQ ID NO: 1480602 - DNA, 21 bp, Homo sapiens
gaaacagattcaggccagccc

SEQ ID NO: 1480603 - DNA, 12 bp, Homo sapiens
gaaacagcatga

SEQ ID NO: 1480604 - DNA, 13 bp, Homo sapiens
gaaacagcatgaa

SEQ ID NO: 1480605 - DNA, 12 bp, Homo sapiens
gaaacagctcag

SEQ ID NO: 1480606 - DNA, 15 bp, Homo sapiens
gaaacagctcagcca

SEQ ID NO: 1480607 - DNA, 18 bp, Homo sapiens
gaaacagctttcaagtgc

SEQ ID NO: 1480608 - DNA, 17 bp, Homo sapiens
gaaacagttgcatgtag

SEQ ID NO: 1480609 - DNA, 19 bp, Homo sapiens
gaaacagttggtaactttt

SEQ ID NO: 1480610 - DNA, 14 bp, Homo sapiens
gaaacatctctggc

SEQ ID NO: 1480611 - DNA, 13 bp, Homo sapiens
gaaacatgacact

SEQ ID NO: 1480612 - DNA, 22 bp, Homo sapiens
gaaacatttacaataaatattc

SEQ ID NO: 1480613 - DNA, 19 bp, Homo sapiens
gaaaccacagtcagtggag

SEQ ID NO: 1480614 - DNA, 18 bp, Homo sapiens
gaaaccacagtgagcctg

SEQ ID NO: 1480615 - DNA, 16 bp, Homo sapiens
gaaacccacctctctg

SEQ ID NO: 1480616 - DNA, 16 bp, Homo sapiens
gaaaccctggagccat

SEQ ID NO: 1480617 - DNA, 23 bp, Homo sapiens
gaaacccttcagtgctacatttt

SEQ ID NO: 1480618 - DNA, 21 bp, Homo sapiens
gaaaccgcctagtttactgtt

SEQ ID NO: 1480619 - DNA, 14 bp, Homo sapiens
gaaaccgggagaag

SEQ ID NO: 1480620 - DNA, 17 bp, Homo sapiens
gaaacctagtactgccc

SEQ ID NO: 1480621 - DNA, 12 bp, Homo sapiens
gaaacctgccct

SEQ ID NO: 1480622 - DNA, 19 bp, Homo sapiens
gaaaccttagtttcaagag

SEQ ID NO: 1480623 - DNA, 17 bp, Homo sapiens
gaaaccttattgtacct

SEQ ID NO: 1480624 - DNA, 20 bp, Homo sapiens
gaaaccttattgtacctctc

SEQ ID NO: 1480625 - DNA, 13 bp, Homo sapiens
gaaaccttatttt

SEQ ID NO: 1480626 - DNA, 17 bp, Homo sapiens
gaaaccttccacccagt

SEQ ID NO: 1480627 - DNA, 19 bp, Homo sapiens
gaaaccttgctctcctcat

SEQ ID NO: 1480628 - DNA, 12 bp, Homo sapiens
gaaaccttggag

SEQ ID NO: 1480629 - DNA, 18 bp, Homo sapiens
gaaaccttggagaggaga

SEQ ID NO: 1480630 - DNA, 19 bp, Homo sapiens
gaaaccttggagaggagag

SEQ ID NO: 1480631 - DNA, 19 bp, Homo sapiens
gaaacctttagggcagctt

SEQ ID NO: 1480632 - DNA, 15 bp, Homo sapiens
gaaaccttttatttt

SEQ ID NO: 1480633 - DNA, 18 bp, Homo sapiens
gaaaccttttatttttat

SEQ ID NO: 1480634 - DNA, 13 bp, Homo sapiens
gaaacgctacctc

SEQ ID NO: 1480635 - DNA, 23 bp, Homo sapiens
gaaacgctacctctctgtccctt

SEQ ID NO: 1480636 - DNA, 12 bp, Homo sapiens
gaaactaacaga

SEQ ID NO: 1480637 - DNA, 15 bp, Homo sapiens
gaaactaacagataa

SEQ ID NO: 1480638 - DNA, 17 bp, Homo sapiens
gaaactataaagtttta

SEQ ID NO: 1480639 - DNA, 16 bp, Homo sapiens
gaaactccacatctgc

SEQ ID NO: 1480640 - DNA, 18 bp, Homo sapiens
gaaactccacatctgcct

SEQ ID NO: 1480641 - DNA, 19 bp, Homo sapiens
gaaactccacatctgcctt

SEQ ID NO: 1480642 - DNA, 18 bp, Homo sapiens
gaaactccgtcttagaag

SEQ ID NO: 1480643 - DNA, 17 bp, Homo sapiens
gaaactcctgtttctcc

SEQ ID NO: 1480644 - DNA, 13 bp, Homo sapiens
gaaactgccagca

SEQ ID NO: 1480645 - DNA, 13 bp, Homo sapiens
gaaactgctttga

SEQ ID NO: 1480646 - DNA, 15 bp, Homo sapiens
gaaactgggaaactg

SEQ ID NO: 1480647 - DNA, 18 bp, Homo sapiens
gaaactgtagtctcagga

SEQ ID NO: 1480648 - DNA, 15 bp, Homo sapiens
gaaactgtgtatagc

SEQ ID NO: 1480649 - DNA, 16 bp, Homo sapiens
gaaacttagaggaaaa

SEQ ID NO: 1480650 - DNA, 17 bp, Homo sapiens
gaaacttgtttcactga

SEQ ID NO: 1480651 - DNA, 19 bp, Homo sapiens
gaaactttgagatctaaaa

SEQ ID NO: 1480652 - DNA, 19 bp, Homo sapiens
gaaactttgagtacagata

SEQ ID NO: 1480653 - DNA, 16 bp, Homo sapiens
gaaacttttttatttt

SEQ ID NO: 1480654 - DNA, 16 bp, Homo sapiens
gaaagaaaagaccctg

SEQ ID NO: 1480655 - DNA, 21 bp, Homo sapiens
gaaagaaaagaccctgagact

SEQ ID NO: 1480656 - DNA, 16 bp, Homo sapiens
gaaagaaatggctttt

SEQ ID NO: 1480657 - DNA, 11 bp, Homo sapiens
gaaagaactta

SEQ ID NO: 1480658 - DNA, 14 bp, Homo sapiens
gaaagaagagaagt

SEQ ID NO: 1480659 - DNA, 15 bp, Homo sapiens
gaaagaagcaagaca

SEQ ID NO: 1480660 - DNA, 19 bp, Homo sapiens
gaaagaagggggccctgct

SEQ ID NO: 1480661 - DNA, 22 bp, Homo sapiens
gaaagactattcaaacagtctc

SEQ ID NO: 1480662 - DNA, 23 bp, Homo sapiens
gaaagactattcaaacagtctca

SEQ ID NO: 1480663 - DNA, 19 bp, Homo sapiens
gaaagagagaagccagcca

SEQ ID NO: 1480664 - DNA, 16 bp, Homo sapiens
gaaagagatttaaact

SEQ ID NO: 1480665 - DNA, 15 bp, Homo sapiens
gaaagagctgcctgg

SEQ ID NO: 1480666 - DNA, 16 bp, Homo sapiens
gaaagagctgcctgga

SEQ ID NO: 1480667 - DNA, 17 bp, Homo sapiens
gaaagaggcaccaggaa

SEQ ID NO: 1480668 - DNA, 20 bp, Homo sapiens
gaaagaggcaccaggaagcc

SEQ ID NO: 1480669 - DNA, 17 bp, Homo sapiens
gaaagagttaagaatgt

SEQ ID NO: 1480670 - DNA, 18 bp, Homo sapiens
gaaagagttaagaatgtc

SEQ ID NO: 1480671 - DNA, 15 bp, Homo sapiens
gaaagatacagggga

SEQ ID NO: 1480672 - DNA, 18 bp, Homo sapiens
gaaagatacaggggatca

SEQ ID NO: 1480673 - DNA, 20 bp, Homo sapiens
gaaagatgcagtcctcagga

SEQ ID NO: 1480674 - DNA, 19 bp, Homo sapiens
gaaagatgttaagcattta

SEQ ID NO: 1480675 - DNA, 18 bp, Homo sapiens
gaaagatgttccagtgag

SEQ ID NO: 1480676 - DNA, 19 bp, Homo sapiens
gaaagatttgttactgtat

SEQ ID NO: 1480677 - DNA, 23 bp, Homo sapiens
gaaagatttgttactgtattttt

SEQ ID NO: 1480678 - DNA, 16 bp, Homo sapiens
gaaagcaaaatacatc

SEQ ID NO: 1480679 - DNA, 14 bp, Homo sapiens
gaaagcaataaatg

SEQ ID NO: 1480680 - DNA, 22 bp, Homo sapiens
gaacaggaatccttactgatat

SEQ ID NO: 1480681 - DNA, 23 bp, Homo sapiens
gaacaggaatccttactgatatt

SEQ ID NO: 1480682 - DNA, 23 bp, Homo sapiens
gaacagggaacattggagctgac

SEQ ID NO: 1480683 - DNA, 16 bp, Homo sapiens
gaacaggtggttttta

SEQ ID NO: 1480684 - DNA, 13 bp, Homo sapiens
gaacagtaaacat

SEQ ID NO: 1480685 - DNA, 20 bp, Homo sapiens
gaacagtaaagaaagcagaa

SEQ ID NO: 1480686 - DNA, 21 bp, Homo sapiens
gaacagtggtggcaacattca

SEQ ID NO: 1480687 - DNA, 15 bp, Homo sapiens
gaacagtggttgcct

SEQ ID NO: 1480688 - DNA, 18 bp, Homo sapiens
gaacagtgtttcccataa

SEQ ID NO: 1480689 - DNA, 15 bp, Homo sapiens
gaacataaagcaaat

SEQ ID NO: 1480690 - DNA, 18 bp, Homo sapiens
gaacatacactgtgaact

SEQ ID NO: 1480691 - DNA, 15 bp, Homo sapiens
gaacatcattagaac

SEQ ID NO: 1480692 - DNA, 18 bp, Homo sapiens
gaacatccaaccttccca

SEQ ID NO: 1480693 - DNA, 20 bp, Homo sapiens
gaacatccaaggagaaacag

SEQ ID NO: 1480694 - DNA, 23 bp, Homo sapiens
gaacatccaaggagaaacagaga

SEQ ID NO: 1480695 - DNA, 13 bp, Homo sapiens
gaacatccttcct

SEQ ID NO: 1480696 - DNA, 14 bp, Homo sapiens
gaacatgacccagc

SEQ ID NO: 1480697 - DNA, 17 bp, Homo sapiens
gaacatgacccagcctg

SEQ ID NO: 1480698 - DNA, 19 bp, Homo sapiens
gaacatgacccagcctgaa

SEQ ID NO: 1480699 - DNA, 14 bp, Homo sapiens
gaacatgccccctg

SEQ ID NO: 1480700 - DNA, 21 bp, Homo sapiens
gaacatgctggaaataaaaca

SEQ ID NO: 1480701 - DNA, 23 bp, Homo sapiens
gaacatgctggaaataaaacagc

SEQ ID NO: 1480702 - DNA, 17 bp, Homo sapiens
gaacatgcttttacttt

SEQ ID NO: 1480703 - DNA, 22 bp, Homo sapiens
gaacatggactttcttgcatga

SEQ ID NO: 1480704 - DNA, 22 bp, Homo sapiens
gaacatggctagcctttcttgt

SEQ ID NO: 1480705 - DNA, 14 bp, Homo sapiens
gaacatggctggcc

SEQ ID NO: 1480706 - DNA, 15 bp, Homo sapiens
gaacatggctggcct

SEQ ID NO: 1480707 - DNA, 16 bp, Homo sapiens
gaacatggctggcctg

SEQ ID NO: 1480708 - DNA, 22 bp, Homo sapiens
gaacatgtcctaattcttctgt

SEQ ID NO: 1480709 - DNA, 20 bp, Homo sapiens
gaacatgtttacaggtttga

SEQ ID NO: 1480710 - DNA, 22 bp, Homo sapiens
gaacattaaaatatagagacag

SEQ ID NO: 1480711 - DNA, 17 bp, Homo sapiens
gaacattagttgcacta

SEQ ID NO: 1480712 - DNA, 17 bp, Homo sapiens
gaacattcagctctgga

SEQ ID NO: 1480713 - DNA, 19 bp, Homo sapiens
gaacattcagctctggaga

SEQ ID NO: 1480714 - DNA, 21 bp, Homo sapiens
gaacattggaatgttctcaga

SEQ ID NO: 1480715 - DNA, 14 bp, Homo sapiens
gaacattgtactgt

SEQ ID NO: 1480716 - DNA, 15 bp, Homo sapiens
gaacattttgtggag

SEQ ID NO: 1480717 - DNA, 19 bp, Homo sapiens
gaaccaaaaatagaaatta

SEQ ID NO: 1480718 - DNA, 23 bp, Homo sapiens
gaaccaaaaatcccaccttccca

SEQ ID NO: 1480719 - DNA, 14 bp, Homo sapiens
gaaccaacatcttt

SEQ ID NO: 1480720 - DNA, 20 bp, Homo sapiens
gaaccaagcttcagagccta

SEQ ID NO: 1480721 - DNA, 15 bp, Homo sapiens
gaaccaaggcagcct

SEQ ID NO: 1480722 - DNA, 15 bp, Homo sapiens
gaaccaccactgcct

SEQ ID NO: 1480723 - DNA, 19 bp, Homo sapiens
gaaccactacatgcagccc

SEQ ID NO: 1480724 - DNA, 23 bp, Homo sapiens
gaaccactgtctagagcaacttt

SEQ ID NO: 1480725 - DNA, 11 bp, Homo sapiens
gaaccagactc

SEQ ID NO: 1480726 - DNA, 17 bp, Homo sapiens
gaaccagactcttgcct

SEQ ID NO: 1480727 - DNA, 12 bp, Homo sapiens
gaaccagagcca

SEQ ID NO: 1480728 - DNA, 18 bp, Homo sapiens
gaaccagccggggcctta

SEQ ID NO: 1480729 - DNA, 20 bp, Homo sapiens
gaaccagccgtattttacat

SEQ ID NO: 1480730 - DNA, 22 bp, Homo sapiens
gaaccaggagaagggctggggc

SEQ ID NO: 1480731 - DNA, 16 bp, Homo sapiens
gaaccagggaggagag

SEQ ID NO: 1480732 - DNA, 12 bp, Homo sapiens
gaacccacctgc

SEQ ID NO: 1480733 - DNA, 13 bp, Homo sapiens
gaacccacctgct

SEQ ID NO: 1480734 - DNA, 15 bp, Homo sapiens
gaacccacctgctga

SEQ ID NO: 1480735 - DNA, 16 bp, Homo sapiens
gaacccaggaggtgga

SEQ ID NO: 1480736 - DNA, 17 bp, Homo sapiens
gaaccccagaggcagag

SEQ ID NO: 1480737 - DNA, 15 bp, Homo sapiens
gaaccccatgggctt

SEQ ID NO: 1480738 - DNA, 16 bp, Homo sapiens
gaaccccatgggcttg

SEQ ID NO: 1480739 - DNA, 19 bp, Homo sapiens
gaaccccatgggcttggac

SEQ ID NO: 1480740 - DNA, 22 bp, Homo sapiens
gaacccccaggtggcctgcgtc

SEQ ID NO: 1480741 - DNA, 21 bp, Homo sapiens
gaaccccctccctgtcccagg

SEQ ID NO: 1480742 - DNA, 10 bp, Homo sapiens
gaacccctgt

SEQ ID NO: 1480743 - DNA, 12 bp, Homo sapiens
gaacccctgtgt

SEQ ID NO: 1480744 - DNA, 20 bp, Homo sapiens
gaacccgggagcggaggttg

SEQ ID NO: 1480745 - DNA, 15 bp, Homo sapiens
gaacccgggggacag

SEQ ID NO: 1480746 - DNA, 16 bp, Homo sapiens
gaacccgggggacaga

SEQ ID NO: 1480747 - DNA, 16 bp, Homo sapiens
gaaccctggggcctga

SEQ ID NO: 1480748 - DNA, 15 bp, Homo sapiens
gaacccttgtgcttg

SEQ ID NO: 1480749 - DNA, 17 bp, Homo sapiens
gaacccttgtgcttggt

SEQ ID NO: 1480750 - DNA, 18 bp, Homo sapiens
gaacccttgtgcttggtg

SEQ ID NO: 1480751 - DNA, 19 bp, Homo sapiens
gaaccgagcaaagatcaaa

SEQ ID NO: 1480752 - DNA, 23 bp, Homo sapiens
gaaccgagcaaagatcaaaataa

SEQ ID NO: 1480753 - DNA, 14 bp, Homo sapiens
gaaccgcacagctc

SEQ ID NO: 1480754 - DNA, 15 bp, Homo sapiens
gaaccgcacagctca

SEQ ID NO: 1480755 - DNA, 16 bp, Homo sapiens
gaaccgcacagctcag

SEQ ID NO: 1480756 - DNA, 19 bp, Homo sapiens
gaaccgtggtatgtctgcc

SEQ ID NO: 1480757 - DNA, 16 bp, Homo sapiens
gaacctattttcattt

SEQ ID NO: 1480758 - DNA, 17 bp, Homo sapiens
gaacctattttcatttg

SEQ ID NO: 1480759 - DNA, 22 bp, Homo sapiens
gaacctattttcatttgtacaa

SEQ ID NO: 1480760 - DNA, 15 bp, Homo sapiens
gaacctcagattctt

SEQ ID NO: 1480761 - DNA, 14 bp, Homo sapiens
gaacctcagcctgg

SEQ ID NO: 1480762 - DNA, 15 bp, Homo sapiens
gaacctcagcctggc

SEQ ID NO: 1480763 - DNA, 21 bp, Homo sapiens
gaacctcagcctggccagaca

SEQ ID NO: 1480764 - DNA, 17 bp, Homo sapiens
gaacctcattgctacca

SEQ ID NO: 1480765 - DNA, 16 bp, Homo sapiens
gaacctctcgccatga

SEQ ID NO: 1480766 - DNA, 17 bp, Homo sapiens
gaacctcttccccagaa

SEQ ID NO: 1480767 - DNA, 16 bp, Homo sapiens
gaacctgcacacagga

SEQ ID NO: 1480768 - DNA, 18 bp, Homo sapiens
gaacctgcacacaggaca

SEQ ID NO: 1480769 - DNA, 12 bp, Homo sapiens
gaacctggaact

SEQ ID NO: 1480770 - DNA, 18 bp, Homo sapiens
gaacctggatccagcact

SEQ ID NO: 1480771 - DNA, 17 bp, Homo sapiens
gaacctgggcactccgc

SEQ ID NO: 1480772 - DNA, 15 bp, Homo sapiens
gaaccttccttcctg

SEQ ID NO: 1480773 - DNA, 18 bp, Homo sapiens
gaacgatatgtagcagaa

SEQ ID NO: 1480774 - DNA, 21 bp, Homo sapiens
gaacgccagtctcccaggccc

SEQ ID NO: 1480775 - DNA, 14 bp, Homo sapiens
gaacggggagaaaa

SEQ ID NO: 1480776 - DNA, 19 bp, Homo sapiens
gaacggggctcttctcatt

SEQ ID NO: 1480777 - DNA, 17 bp, Homo sapiens
gaacggtaaatttctgt

SEQ ID NO: 1480778 - DNA, 18 bp, Homo sapiens
gaacggtgaaggtgacag

SEQ ID NO: 1480779 - DNA, 13 bp, Homo sapiens
gaacgtggtttgc

SEQ ID NO: 1480780 - DNA, 13 bp, Homo sapiens
gaacgtttctgaa

SEQ ID NO: 1480781 - DNA, 23 bp, Homo sapiens
gaacgttttcttctttccctgga

SEQ ID NO: 1480782 - DNA, 13 bp, Homo sapiens
gaactaaagcaaa

SEQ ID NO: 1480783 - DNA, 23 bp, Homo sapiens
gaactacaaacaaaatttctatt

SEQ ID NO: 1480784 - DNA, 14 bp, Homo sapiens
gaactatacctgct

SEQ ID NO: 1480785 - DNA, 14 bp, Homo sapiens
gaactatgaaatca

SEQ ID NO: 1480786 - DNA, 15 bp, Homo sapiens
gaactatgaactaca

SEQ ID NO: 1480787 - DNA, 22 bp, Homo sapiens
gaactattggagggtgggagag

SEQ ID NO: 1480788 - DNA, 21 bp, Homo sapiens
gaactatttattaaaaacatg

SEQ ID NO: 1480789 - DNA, 16 bp, Homo sapiens
gaactattttaaataa

SEQ ID NO: 1480790 - DNA, 17 bp, Homo sapiens
gaactattttaaataaa

SEQ ID NO: 1480791 - DNA, 22 bp, Homo sapiens
gaactattttcaaagacttaag

SEQ ID NO: 1480792 - DNA, 19 bp, Homo sapiens
gaactcaaatggggccaga

SEQ ID NO: 1480793 - DNA, 17 bp, Homo sapiens
gaactcaagctgcgttt

SEQ ID NO: 1480794 - DNA, 15 bp, Homo sapiens
gaactcactctgggc

SEQ ID NO: 1480795 - DNA, 20 bp, Homo sapiens
gaagactcaggagtctgcca

SEQ ID NO: 1480796 - DNA, 22 bp, Homo sapiens
gaagactcaggagtctgccact

SEQ ID NO: 1480797 - DNA, 22 bp, Homo sapiens
gaagactccctgatcccagacc

SEQ ID NO: 1480798 - DNA, 20 bp, Homo sapiens
gaagactgtcagcttccaaa

SEQ ID NO: 1480799 - DNA, 19 bp, Homo sapiens
gaagacttaaaagagctca

SEQ ID NO: 1480800 - DNA, 17 bp, Homo sapiens
gaagagaaaaaggctga

SEQ ID NO: 1480801 - DNA, 22 bp, Homo sapiens
gaagagaaaatgtaaaggaggg

SEQ ID NO: 1480802 - DNA, 12 bp, Homo sapiens
gaagagaaattt

SEQ ID NO: 1480803 - DNA, 17 bp, Homo sapiens
gaagagaagctgctgac

SEQ ID NO: 1480804 - DNA, 15 bp, Homo sapiens
gaagagaaggcacac

SEQ ID NO: 1480805 - DNA, 19 bp, Homo sapiens
gaagagacaaagatttctt

SEQ ID NO: 1480806 - DNA, 23 bp, Homo sapiens
gaagagacagagacaagtaattt

SEQ ID NO: 1480807 - DNA, 14 bp, Homo sapiens
gaagagagagaccc

SEQ ID NO: 1480808 - DNA, 15 bp, Homo sapiens
gaagagagggacagg

SEQ ID NO: 1480809 - DNA, 22 bp, Homo sapiens
gaagagatgtggcaaagtgctg

SEQ ID NO: 1480810 - DNA, 13 bp, Homo sapiens
gaagagcagcctg

SEQ ID NO: 1480811 - DNA, 14 bp, Homo sapiens
gaagagcagcctga

SEQ ID NO: 1480812 - DNA, 18 bp, Homo sapiens
gaagagcagcctgatggc

SEQ ID NO: 1480813 - DNA, 18 bp, Homo sapiens
gaagagcaggcacatgga

SEQ ID NO: 1480814 - DNA, 16 bp, Homo sapiens
gaagagccacctgcaa

SEQ ID NO: 1480815 - DNA, 17 bp, Homo sapiens
gaagagccacctgcaag

SEQ ID NO: 1480816 - DNA, 18 bp, Homo sapiens
gaagagccatcttggcag

SEQ ID NO: 1480817 - DNA, 16 bp, Homo sapiens
gaagagcccagtctgt

SEQ ID NO: 1480818 - DNA, 19 bp, Homo sapiens
gaagagctatggcccagaa

SEQ ID NO: 1480819 - DNA, 20 bp, Homo sapiens
gaagagctatggcccagaaa

SEQ ID NO: 1480820 - DNA, 21 bp, Homo sapiens
gaagagctcttcggtttctga

SEQ ID NO: 1480821 - DNA, 17 bp, Homo sapiens
gaagagcttagaaactg

SEQ ID NO: 1480822 - DNA, 14 bp, Homo sapiens
gaagagcttgcaca

SEQ ID NO: 1480823 - DNA, 16 bp, Homo sapiens
gaagaggaacagtgtg

SEQ ID NO: 1480824 - DNA, 19 bp, Homo sapiens
gaagaggagcctcagaaga

SEQ ID NO: 1480825 - DNA, 17 bp, Homo sapiens
gaagaggatgagcagag

SEQ ID NO: 1480826 - DNA, 20 bp, Homo sapiens
gaagaggatgagcagaggga

SEQ ID NO: 1480827 - DNA, 20 bp, Homo sapiens
gaagaggcccactagagggc

SEQ ID NO: 1480828 - DNA, 16 bp, Homo sapiens
gaagaggcgggccagc

SEQ ID NO: 1480829 - DNA, 17 bp, Homo sapiens
gaagaggcgggccagcc

SEQ ID NO: 1480830 - DNA, 11 bp, Homo sapiens
gaagaggcttc

SEQ ID NO: 1480831 - DNA, 20 bp, Homo sapiens
gaagagggagaagcatgaaa

SEQ ID NO: 1480832 - DNA, 19 bp, Homo sapiens
gaagagggcccagcccaga

SEQ ID NO: 1480833 - DNA, 22 bp, Homo sapiens
gaagagggcccagcccagagcc

SEQ ID NO: 1480834 - DNA, 20 bp, Homo sapiens
gaagagggcctgtgggagcc

SEQ ID NO: 1480835 - DNA, 17 bp, Homo sapiens
gaagaggggaggggcct

SEQ ID NO: 1480836 - DNA, 14 bp, Homo sapiens
gaagaggggcagcc

SEQ ID NO: 1480837 - DNA, 17 bp, Homo sapiens
gaagaggggctggggca

SEQ ID NO: 1480838 - DNA, 20 bp, Homo sapiens
gaagaggtctgattggctgc

SEQ ID NO: 1480839 - DNA, 22 bp, Homo sapiens
gaagaggtctgattggctgctt

SEQ ID NO: 1480840 - DNA, 16 bp, Homo sapiens
gaagagtctggaggga

SEQ ID NO: 1480841 - DNA, 16 bp, Homo sapiens
gaagagtgaaatacca

SEQ ID NO: 1480842 - DNA, 17 bp, Homo sapiens
gaagagtgggtttcaca

SEQ ID NO: 1480843 - DNA, 16 bp, Homo sapiens
gaagagttacaataaa

SEQ ID NO: 1480844 - DNA, 22 bp, Homo sapiens
gaagagttccaagttgaaggga

SEQ ID NO: 1480845 - DNA, 20 bp, Homo sapiens
gaagagttcccttgaaactt

SEQ ID NO: 1480846 - DNA, 23 bp, Homo sapiens
gaagagtttttgtgatgggggag

SEQ ID NO: 1480847 - DNA, 19 bp, Homo sapiens
gaagataggacgtatttat

SEQ ID NO: 1480848 - DNA, 15 bp, Homo sapiens
gaagataggctctgc

SEQ ID NO: 1480849 - DNA, 17 bp, Homo sapiens
gaagataggctctgcac

SEQ ID NO: 1480850 - DNA, 21 bp, Homo sapiens
gaagatagtcttggaagctgt

SEQ ID NO: 1480851 - DNA, 14 bp, Homo sapiens
gaagatcagatgca

SEQ ID NO: 1480852 - DNA, 21 bp, Homo sapiens
gaagatcagcaccctaagaga

SEQ ID NO: 1480853 - DNA, 15 bp, Homo sapiens
gaagatcctgaagca

SEQ ID NO: 1480854 - DNA, 16 bp, Homo sapiens
gaagatcctgaagcag

SEQ ID NO: 1480855 - DNA, 22 bp, Homo sapiens
gaagatcctgcgggtggggctt

SEQ ID NO: 1480856 - DNA, 18 bp, Homo sapiens
gaagatcggaacagctcc

SEQ ID NO: 1480857 - DNA, 16 bp, Homo sapiens
gaagatcttatgcctt

SEQ ID NO: 1480858 - DNA, 16 bp, Homo sapiens
gaagatcttgagagct

SEQ ID NO: 1480859 - DNA, 19 bp, Homo sapiens
gaagatcttgagagctgct

SEQ ID NO: 1480860 - DNA, 20 bp, Homo sapiens
gaagatcttgagagctgctg

SEQ ID NO: 1480861 - DNA, 17 bp, Homo sapiens
gaagatgatttcagttc

SEQ ID NO: 1480862 - DNA, 17 bp, Homo sapiens
gaagatgccagcttctc

SEQ ID NO: 1480863 - DNA, 19 bp, Homo sapiens
gaagatgccagcttctctc

SEQ ID NO: 1480864 - DNA, 16 bp, Homo sapiens
gaagatgctgtaaata

SEQ ID NO: 1480865 - DNA, 21 bp, Homo sapiens
gaagatggctcccaaggttcc

SEQ ID NO: 1480866 - DNA, 19 bp, Homo sapiens
gaagatggtccgtgcccag

SEQ ID NO: 1480867 - DNA, 21 bp, Homo sapiens
gaagatgtgtaaacaggtatt

SEQ ID NO: 1480868 - DNA, 15 bp, Homo sapiens
gaagattctaaaaca

SEQ ID NO: 1480869 - DNA, 21 bp, Homo sapiens
gaagattctaaaacattcttt

SEQ ID NO: 1480870 - DNA, 22 bp, Homo sapiens
gaagattctaaaacattcttta

SEQ ID NO: 1480871 - DNA, 22 bp, Homo sapiens
gaagatttatgaacagaaatat

SEQ ID NO: 1480872 - DNA, 23 bp, Homo sapiens
gaagatttatgaacagaaatatt

SEQ ID NO: 1480873 - DNA, 23 bp, Homo sapiens
gaagattttgaaatttttattaa

SEQ ID NO: 1480874 - DNA, 20 bp, Homo sapiens
gaagcaaatacaattcacag

SEQ ID NO: 1480875 - DNA, 15 bp, Homo sapiens
gaagcaacagcttca

SEQ ID NO: 1480876 - DNA, 23 bp, Homo sapiens
gaagcaacagcttcagaaagagc

SEQ ID NO: 1480877 - DNA, 17 bp, Homo sapiens
gaagcaagacacgtggc

SEQ ID NO: 1480878 - DNA, 13 bp, Homo sapiens
gaagcaagacgta

SEQ ID NO: 1480879 - DNA, 23 bp, Homo sapiens
gaagcaagaggcaagctgaaatt

SEQ ID NO: 1480880 - DNA, 18 bp, Homo sapiens
gaagcaatctttgaaata

SEQ ID NO: 1480881 - DNA, 20 bp, Homo sapiens
gaagcacagagggctaggga

SEQ ID NO: 1480882 - DNA, 22 bp, Homo sapiens
gaagcacagcaccgggggagag

SEQ ID NO: 1480883 - DNA, 20 bp, Homo sapiens
gaagcacagctcctgccagg

SEQ ID NO: 1480884 - DNA, 19 bp, Homo sapiens
gaagcacatacggcagacc

SEQ ID NO: 1480885 - DNA, 16 bp, Homo sapiens
gaagcaccccatgcca

SEQ ID NO: 1480886 - DNA, 21 bp, Homo sapiens
gaagcaccccatgccaaagct

SEQ ID NO: 1480887 - DNA, 14 bp, Homo sapiens
gaagcagagcaaaa

SEQ ID NO: 1480888 - DNA, 13 bp, Homo sapiens
gaagcagccagct

SEQ ID NO: 1480889 - DNA, 23 bp, Homo sapiens
gaagcaggttgaggggctcctgg

SEQ ID NO: 1480890 - DNA, 13 bp, Homo sapiens
gaagcagtatttt

SEQ ID NO: 1480891 - DNA, 23 bp, Homo sapiens
gaagcagtcgtggctttggcagt

SEQ ID NO: 1480892 - DNA, 15 bp, Homo sapiens
gaagcagtgagccgc

SEQ ID NO: 1480893 - DNA, 16 bp, Homo sapiens
gaagcagtgcctcgag

SEQ ID NO: 1480894 - DNA, 18 bp, Homo sapiens
gaagcagtgccttccata

SEQ ID NO: 1480895 - DNA, 17 bp, Homo sapiens
gaagcatgtaggagaat

SEQ ID NO: 1480896 - DNA, 19 bp, Homo sapiens
gaagcattctccccagtgt

SEQ ID NO: 1480897 - DNA, 22 bp, Homo sapiens
gaagcattggtttttttttgat

SEQ ID NO: 1480898 - DNA, 13 bp, Homo sapiens
gaagcattgtaaa

SEQ ID NO: 1480899 - DNA, 17 bp, Homo sapiens
gaagcattgtaaaataa

SEQ ID NO: 1480900 - DNA, 19 bp, Homo sapiens
gaagcatttcaaagccctg

SEQ ID NO: 1480901 - DNA, 12 bp, Homo sapiens
gaagccaaagaa

SEQ ID NO: 1480902 - DNA, 13 bp, Homo sapiens
gaagccaaagaaa

SEQ ID NO: 1480903 - DNA, 20 bp, Homo sapiens
gaagccaaaggcagctaaga

SEQ ID NO: 1480904 - DNA, 14 bp, Homo sapiens
gaagccaagggaaa

SEQ ID NO: 1480905 - DNA, 15 bp, Homo sapiens
gaagccaagggaaag

SEQ ID NO: 1480906 - DNA, 16 bp, Homo sapiens
gaagccaagggaaagg

SEQ ID NO: 1480907 - DNA, 21 bp, Homo sapiens
gaagccaagggaaaggggtgc

SEQ ID NO: 1480908 - DNA, 13 bp, Homo sapiens
gaagccaagtggg

SEQ ID NO: 1480909 - DNA, 20 bp, Homo sapiens
gaaggaggccaaccagcccg

SEQ ID NO: 1480910 - DNA, 16 bp, Homo sapiens
gaaggagggagctgct

SEQ ID NO: 1480911 - DNA, 18 bp, Homo sapiens
gaaggagttacagggaag

SEQ ID NO: 1480912 - DNA, 16 bp, Homo sapiens
gaaggatccaggaata

SEQ ID NO: 1480913 - DNA, 15 bp, Homo sapiens
gaaggatctgctgag

SEQ ID NO: 1480914 - DNA, 23 bp, Homo sapiens
gaaggatgggatgggttccagag

SEQ ID NO: 1480915 - DNA, 12 bp, Homo sapiens
gaaggcaaaaaa

SEQ ID NO: 1480916 - DNA, 15 bp, Homo sapiens
gaaggcaaagcacga

SEQ ID NO: 1480917 - DNA, 20 bp, Homo sapiens
gaaggcaaagtttacagatg

SEQ ID NO: 1480918 - DNA, 18 bp, Homo sapiens
gaaggcaaatataagctg

SEQ ID NO: 1480919 - DNA, 22 bp, Homo sapiens
gaaggcacacagagattctgga

SEQ ID NO: 1480920 - DNA, 13 bp, Homo sapiens
gaaggcagggcag

SEQ ID NO: 1480921 - DNA, 14 bp, Homo sapiens
gaaggcagggcaga

SEQ ID NO: 1480922 - DNA, 21 bp, Homo sapiens
gaaggcagtagttttcaaaac

SEQ ID NO: 1480923 - DNA, 22 bp, Homo sapiens
gaaggccccagagagaccctgc

SEQ ID NO: 1480924 - DNA, 13 bp, Homo sapiens
gaaggccctgtgc

SEQ ID NO: 1480925 - DNA, 18 bp, Homo sapiens
gaaggcctcttgtgctca

SEQ ID NO: 1480926 - DNA, 19 bp, Homo sapiens
gaaggcctcttgtgctcac

SEQ ID NO: 1480927 - DNA, 20 bp, Homo sapiens
gaaggcctgacttctgctgg

SEQ ID NO: 1480928 - DNA, 15 bp, Homo sapiens
gaaggccttccactg

SEQ ID NO: 1480929 - DNA, 13 bp, Homo sapiens
gaaggcctttctt

SEQ ID NO: 1480930 - DNA, 16 bp, Homo sapiens
gaaggcctttcttctg

SEQ ID NO: 1480931 - DNA, 14 bp, Homo sapiens
gaaggcgaggagag

SEQ ID NO: 1480932 - DNA, 22 bp, Homo sapiens
gaaggcggggtattcccactca

SEQ ID NO: 1480933 - DNA, 15 bp, Homo sapiens
gaaggctatggggat

SEQ ID NO: 1480934 - DNA, 17 bp, Homo sapiens
gaaggctctcaccccca

SEQ ID NO: 1480935 - DNA, 20 bp, Homo sapiens
gaaggctctcgggtggggga

SEQ ID NO: 1480936 - DNA, 22 bp, Homo sapiens
gaaggctctcgggtgggggagc

SEQ ID NO: 1480937 - DNA, 13 bp, Homo sapiens
gaaggctggctga

SEQ ID NO: 1480938 - DNA, 17 bp, Homo sapiens
gaaggcttttggtctcc

SEQ ID NO: 1480939 - DNA, 14 bp, Homo sapiens
gaagggaaagtttt

SEQ ID NO: 1480940 - DNA, 23 bp, Homo sapiens
gaagggaaattgtttatgtgtta

SEQ ID NO: 1480941 - DNA, 16 bp, Homo sapiens
gaagggaagtggggag

SEQ ID NO: 1480942 - DNA, 23 bp, Homo sapiens
gaagggaatttggctcaacttca

SEQ ID NO: 1480943 - DNA, 20 bp, Homo sapiens
gaagggacagctgctgggac

SEQ ID NO: 1480944 - DNA, 18 bp, Homo sapiens
gaagggagagggcctctg

SEQ ID NO: 1480945 - DNA, 16 bp, Homo sapiens
gaagggaggggctgtg

SEQ ID NO: 1480946 - DNA, 12 bp, Homo sapiens
gaagggagggtg

SEQ ID NO: 1480947 - DNA, 17 bp, Homo sapiens
gaagggagggtggccag

SEQ ID NO: 1480948 - DNA, 17 bp, Homo sapiens
gaagggcatgcacgggc

SEQ ID NO: 1480949 - DNA, 15 bp, Homo sapiens
gaagggccagagcca

SEQ ID NO: 1480950 - DNA, 11 bp, Homo sapiens
gaagggccagt

SEQ ID NO: 1480951 - DNA, 22 bp, Homo sapiens
gaagggccagtcctgcctggcc

SEQ ID NO: 1480952 - DNA, 13 bp, Homo sapiens
gaagggctgcatg

SEQ ID NO: 1480953 - DNA, 14 bp, Homo sapiens
gaagggctgcatga

SEQ ID NO: 1480954 - DNA, 23 bp, Homo sapiens
gaagggctttgagggtggaagga

SEQ ID NO: 1480955 - DNA, 21 bp, Homo sapiens
gaagggctttggttccttctc

SEQ ID NO: 1480956 - DNA, 19 bp, Homo sapiens
gaaggggaagcactcgtgt

SEQ ID NO: 1480957 - DNA, 13 bp, Homo sapiens
gaaggggaggaag

SEQ ID NO: 1480958 - DNA, 18 bp, Homo sapiens
gaaggggaggacactggt

SEQ ID NO: 1480959 - DNA, 15 bp, Homo sapiens
gaaggggcagcagga

SEQ ID NO: 1480960 - DNA, 19 bp, Homo sapiens
gaaggggccccggggctgg

SEQ ID NO: 1480961 - DNA, 21 bp, Homo sapiens
gaaggggccccggggctggca

SEQ ID NO: 1480962 - DNA, 15 bp, Homo sapiens
gaaggggctgaggac

SEQ ID NO: 1480963 - DNA, 21 bp, Homo sapiens
gaaggggctgaggacgagacc

SEQ ID NO: 1480964 - DNA, 20 bp, Homo sapiens
gaagggggaaaaggtgggat

SEQ ID NO: 1480965 - DNA, 16 bp, Homo sapiens
gaagggggccctgcta

SEQ ID NO: 1480966 - DNA, 15 bp, Homo sapiens
gaagggggctctgcc

SEQ ID NO: 1480967 - DNA, 17 bp, Homo sapiens
gaagggggctctgcccc

SEQ ID NO: 1480968 - DNA, 19 bp, Homo sapiens
gaagggggctctgccccag

SEQ ID NO: 1480969 - DNA, 15 bp, Homo sapiens
gaagggggtctctgt

SEQ ID NO: 1480970 - DNA, 18 bp, Homo sapiens
gaagggggtctctgttaa

SEQ ID NO: 1480971 - DNA, 16 bp, Homo sapiens
gaagggggtgggggga

SEQ ID NO: 1480972 - DNA, 16 bp, Homo sapiens
gaagggggtgtgcgtg

SEQ ID NO: 1480973 - DNA, 14 bp, Homo sapiens
gaaggggttcctca

SEQ ID NO: 1480974 - DNA, 15 bp, Homo sapiens
gaagggtcctgccgg

SEQ ID NO: 1480975 - DNA, 22 bp, Homo sapiens
gaagggtctctctccaggtcag

SEQ ID NO: 1480976 - DNA, 14 bp, Homo sapiens
gaagggtggcctgt

SEQ ID NO: 1480977 - DNA, 17 bp, Homo sapiens
gaagggtggcctgttcc

SEQ ID NO: 1480978 - DNA, 13 bp, Homo sapiens
gaagggttctgcc

SEQ ID NO: 1480979 - DNA, 16 bp, Homo sapiens
gaagggttctgccctg

SEQ ID NO: 1480980 - DNA, 22 bp, Homo sapiens
gaagggttctgccctgcctgag

SEQ ID NO: 1480981 - DNA, 13 bp, Homo sapiens
gaagggtttctct

SEQ ID NO: 1480982 - DNA, 16 bp, Homo sapiens
gaagggtttctctatt

SEQ ID NO: 1480983 - DNA, 20 bp, Homo sapiens
gaagggttttccaccctgga

SEQ ID NO: 1480984 - DNA, 13 bp, Homo sapiens
gaaggtaaataaa

SEQ ID NO: 1480985 - DNA, 22 bp, Homo sapiens
gaaggtaaataaaaagaaaggc

SEQ ID NO: 1480986 - DNA, 18 bp, Homo sapiens
gaaggtattaagattata

SEQ ID NO: 1480987 - DNA, 15 bp, Homo sapiens
gaaggtcaataaatt

SEQ ID NO: 1480988 - DNA, 23 bp, Homo sapiens
gaaggtcaataaattattagaga

SEQ ID NO: 1480989 - DNA, 17 bp, Homo sapiens
gaaggtcccctggcagt

SEQ ID NO: 1480990 - DNA, 20 bp, Homo sapiens
gaaggtcccctggcagtgct

SEQ ID NO: 1480991 - DNA, 22 bp, Homo sapiens
gaaggtgccccaaaatgcaaga

SEQ ID NO: 1480992 - DNA, 19 bp, Homo sapiens
gaaggtgccgtgagcaggc

SEQ ID NO: 1480993 - DNA, 20 bp, Homo sapiens
gaaggtgccgtgagcaggct

SEQ ID NO: 1480994 - DNA, 15 bp, Homo sapiens
gaaggtgcctcagac

SEQ ID NO: 1480995 - DNA, 21 bp, Homo sapiens
gaaggtgctgacggccaggga

SEQ ID NO: 1480996 - DNA, 15 bp, Homo sapiens
gaaggtgctgagctt

SEQ ID NO: 1480997 - DNA, 18 bp, Homo sapiens
gaaggtggacctggcagt

SEQ ID NO: 1480998 - DNA, 14 bp, Homo sapiens
gaaggtggggccct

SEQ ID NO: 1480999 - DNA, 18 bp, Homo sapiens
gaaggttagaaaggcagc

SEQ ID NO: 1481000 - DNA, 16 bp, Homo sapiens
gaaggttcttcatgat

SEQ ID NO: 1481001 - DNA, 12 bp, Homo sapiens
gaaggttgtaag

SEQ ID NO: 1481002 - DNA, 13 bp, Homo sapiens
gaaggtttattgt

SEQ ID NO: 1481003 - DNA, 13 bp, Homo sapiens
gaagtaaactttt

SEQ ID NO: 1481004 - DNA, 15 bp, Homo sapiens
gaagtaacagacaca

SEQ ID NO: 1481005 - DNA, 19 bp, Homo sapiens
gaagtaaccatttgcactg

SEQ ID NO: 1481006 - DNA, 20 bp, Homo sapiens
gaagtaacccctcctggctg

SEQ ID NO: 1481007 - DNA, 20 bp, Homo sapiens
gaagtaagaagaggagcctc

SEQ ID NO: 1481008 - DNA, 21 bp, Homo sapiens
gaagtaagagctaagttctaa

SEQ ID NO: 1481009 - DNA, 13 bp, Homo sapiens
gaagtaatgaatt

SEQ ID NO: 1481010 - DNA, 22 bp, Homo sapiens
gaagtagcaataggctgtaatc

SEQ ID NO: 1481011 - DNA, 22 bp, Homo sapiens
gaagtagcctgatctttctaga

SEQ ID NO: 1481012 - DNA, 14 bp, Homo sapiens
gaagtagctagtag

SEQ ID NO: 1481013 - DNA, 14 bp, Homo sapiens
gaagtaggtggctt

SEQ ID NO: 1481014 - DNA, 17 bp, Homo sapiens
gaagtaggttctgtttt

SEQ ID NO: 1481015 - DNA, 14 bp, Homo sapiens
gaagtatacctgat

SEQ ID NO: 1481016 - DNA, 14 bp, Homo sapiens
gaagtattcacaaa

SEQ ID NO: 1481017 - DNA, 13 bp, Homo sapiens
gaagtattcctgt

SEQ ID NO: 1481018 - DNA, 19 bp, Homo sapiens
gaagtattttgctggaata

SEQ ID NO: 1481019 - DNA, 22 bp, Homo sapiens
gaagtcaataggcctatttatt

SEQ ID NO: 1481020 - DNA, 21 bp, Homo sapiens
gaagtcacattccacatctgt

SEQ ID NO: 1481021 - DNA, 12 bp, Homo sapiens
gaagtcatatgt

SEQ ID NO: 1481022 - DNA, 15 bp, Homo sapiens
gaagtcatcttgcta

SEQ ID NO: 1481023 - DNA, 19 bp, Homo sapiens
gaagtcatgaagcccaagt

SEQ ID NO: 1481024 - DNA, 13 bp, Homo sapiens
gaatgcagcagga

SEQ ID NO: 1481025 - DNA, 22 bp, Homo sapiens
gaatgcagggaatgcaatcctt

SEQ ID NO: 1481026 - DNA, 15 bp, Homo sapiens
gaatgcattccctga

SEQ ID NO: 1481027 - DNA, 24 bp, Homo sapiens
gaatgccactttggctgaactaca

SEQ ID NO: 1481028 - DNA, 21 bp, Homo sapiens
gaatgccatttagaatctaga

SEQ ID NO: 1481029 - DNA, 20 bp, Homo sapiens
gaatgccgcgaactgggttc

SEQ ID NO: 1481030 - DNA, 16 bp, Homo sapiens
gaatgccgctgtctct

SEQ ID NO: 1481031 - DNA, 13 bp, Homo sapiens
gaatgctgccagt

SEQ ID NO: 1481032 - DNA, 18 bp, Homo sapiens
gaatgctggactggaggc

SEQ ID NO: 1481033 - DNA, 17 bp, Homo sapiens
gaatgctgggactcagc

SEQ ID NO: 1481034 - DNA, 18 bp, Homo sapiens
gaatgctgggactcagcc

SEQ ID NO: 1481035 - DNA, 18 bp, Homo sapiens
gaatgctggttttcctaa

SEQ ID NO: 1481036 - DNA, 22 bp, Homo sapiens
gaatgctggttttcctaaatgc

SEQ ID NO: 1481037 - DNA, 14 bp, Homo sapiens
gaatgctgtgttaa

SEQ ID NO: 1481038 - DNA, 16 bp, Homo sapiens
gaatggaaagcggagt

SEQ ID NO: 1481039 - DNA, 19 bp, Homo sapiens
gaatggaactactgtactt

SEQ ID NO: 1481040 - DNA, 21 bp, Homo sapiens
gaatggaagggttctggctgc

SEQ ID NO: 1481041 - DNA, 15 bp, Homo sapiens
gaatggacatttcta

SEQ ID NO: 1481042 - DNA, 21 bp, Homo sapiens
gaatggagggcaacattccac

SEQ ID NO: 1481043 - DNA, 22 bp, Homo sapiens
gaatggcaatagggtagaatga

SEQ ID NO: 1481044 - DNA, 16 bp, Homo sapiens
gaatggcagtcctgga

SEQ ID NO: 1481045 - DNA, 17 bp, Homo sapiens
gaatggcagtcctggag

SEQ ID NO: 1481046 - DNA, 18 bp, Homo sapiens
gaatggcagtcctggagg

SEQ ID NO: 1481047 - DNA, 17 bp, Homo sapiens
gaatggcctgccttgaa

SEQ ID NO: 1481048 - DNA, 14 bp, Homo sapiens
gaatgggagccaga

SEQ ID NO: 1481049 - DNA, 20 bp, Homo sapiens
gaatggggggcgggccaggg

SEQ ID NO: 1481050 - DNA, 17 bp, Homo sapiens
gaatgggttttctattt

SEQ ID NO: 1481051 - DNA, 22 bp, Homo sapiens
gaatggtctggcaatattctgt

SEQ ID NO: 1481052 - DNA, 16 bp, Homo sapiens
gaatggtgcgtggctt

SEQ ID NO: 1481053 - DNA, 20 bp, Homo sapiens
gaatggtgttttgtcagact

SEQ ID NO: 1481054 - DNA, 22 bp, Homo sapiens
gaatggttttcaaaataaaaat

SEQ ID NO: 1481055 - DNA, 14 bp, Homo sapiens
gaatgtaaatttgt

SEQ ID NO: 1481056 - DNA, 17 bp, Homo sapiens
gaatgtaaatttgtact

SEQ ID NO: 1481057 - DNA, 20 bp, Homo sapiens
gaatgtaaggatgagggaag

SEQ ID NO: 1481058 - DNA, 11 bp, Homo sapiens
gaatgtaatca

SEQ ID NO: 1481059 - DNA, 19 bp, Homo sapiens
gaatgtaatcaatgtttct

SEQ ID NO: 1481060 - DNA, 20 bp, Homo sapiens
gaatgtacatgaagcaatta

SEQ ID NO: 1481061 - DNA, 14 bp, Homo sapiens
gaatgtacgtccag

SEQ ID NO: 1481062 - DNA, 15 bp, Homo sapiens
gaatgtagctggttt

SEQ ID NO: 1481063 - DNA, 20 bp, Homo sapiens
gaatgtagctggtttcctca

SEQ ID NO: 1481064 - DNA, 14 bp, Homo sapiens
gaatgtagtttgag

SEQ ID NO: 1481065 - DNA, 17 bp, Homo sapiens
gaatgtattattctgca

SEQ ID NO: 1481066 - DNA, 21 bp, Homo sapiens
gaatgtattattctgcagcat

SEQ ID NO: 1481067 - DNA, 23 bp, Homo sapiens
gaatgtatttatttgggagaccg

SEQ ID NO: 1481068 - DNA, 13 bp, Homo sapiens
gaatgtatttgat

SEQ ID NO: 1481069 - DNA, 16 bp, Homo sapiens
gaatgtcaagaaaagg

SEQ ID NO: 1481070 - DNA, 17 bp, Homo sapiens
gaatgtcaagaaaagga

SEQ ID NO: 1481071 - DNA, 16 bp, Homo sapiens
gaatgtcacaaattga

SEQ ID NO: 1481072 - DNA, 19 bp, Homo sapiens
gaatgtcagatttctggtt

SEQ ID NO: 1481073 - DNA, 15 bp, Homo sapiens
gaatgtcagggccag

SEQ ID NO: 1481074 - DNA, 22 bp, Homo sapiens
gaatgtcatagtcttgaaatga

SEQ ID NO: 1481075 - DNA, 19 bp, Homo sapiens
gaatgtccccattctataa

SEQ ID NO: 1481076 - DNA, 20 bp, Homo sapiens
gaatgtccccattctataaa

SEQ ID NO: 1481077 - DNA, 22 bp, Homo sapiens
gaatgtccttattcttgtggtt

SEQ ID NO: 1481078 - DNA, 12 bp, Homo sapiens
gaatgtctgaga

SEQ ID NO: 1481079 - DNA, 22 bp, Homo sapiens
gaatgtctttgttggaaaagaa

SEQ ID NO: 1481080 - DNA, 17 bp, Homo sapiens
gaatgtgcttttccatc

SEQ ID NO: 1481081 - DNA, 22 bp, Homo sapiens
gaatgtgcttttccatctaaaa

SEQ ID NO: 1481082 - DNA, 20 bp, Homo sapiens
gaatgtggatttgattcatt

SEQ ID NO: 1481083 - DNA, 12 bp, Homo sapiens
gaatgtgtcagg

SEQ ID NO: 1481084 - DNA, 13 bp, Homo sapiens
gaatgtgttcttt

SEQ ID NO: 1481085 - DNA, 17 bp, Homo sapiens
gaatgttacattgtttg

SEQ ID NO: 1481086 - DNA, 22 bp, Homo sapiens
gaatgttatgggatgtaaacaa

SEQ ID NO: 1481087 - DNA, 14 bp, Homo sapiens
gaatgttccctgca

SEQ ID NO: 1481088 - DNA, 20 bp, Homo sapiens
gaatgtttacactctttgta

SEQ ID NO: 1481089 - DNA, 14 bp, Homo sapiens
gaattaaaaaagca

SEQ ID NO: 1481090 - DNA, 13 bp, Homo sapiens
gaattaaactttt

SEQ ID NO: 1481091 - DNA, 16 bp, Homo sapiens
gaattaactataacaa

SEQ ID NO: 1481092 - DNA, 15 bp, Homo sapiens
gaattaagttatctt

SEQ ID NO: 1481093 - DNA, 21 bp, Homo sapiens
gaattacatgtaaaacattat

SEQ ID NO: 1481094 - DNA, 19 bp, Homo sapiens
gaattaccattaattacat

SEQ ID NO: 1481095 - DNA, 19 bp, Homo sapiens
gaattagagaagctgaaag

SEQ ID NO: 1481096 - DNA, 14 bp, Homo sapiens
gaattagtatttca

SEQ ID NO: 1481097 - DNA, 14 bp, Homo sapiens
gaattataacagtt

SEQ ID NO: 1481098 - DNA, 20 bp, Homo sapiens
gaattataacagttatattt

SEQ ID NO: 1481099 - DNA, 13 bp, Homo sapiens
gaattataactgt

SEQ ID NO: 1481100 - DNA, 21 bp, Homo sapiens
gaattataactgtaaagatgt

SEQ ID NO: 1481101 - DNA, 15 bp, Homo sapiens
gaattatcagcaaag

SEQ ID NO: 1481102 - DNA, 17 bp, Homo sapiens
gaattatcagcaaagaa

SEQ ID NO: 1481103 - DNA, 22 bp, Homo sapiens
gaattatcatcccaacagccaa

SEQ ID NO: 1481104 - DNA, 20 bp, Homo sapiens
gaattatcttggttgaaaat

SEQ ID NO: 1481105 - DNA, 21 bp, Homo sapiens
gaattatgtaatatattgtac

SEQ ID NO: 1481106 - DNA, 12 bp, Homo sapiens
gaattattgaca

SEQ ID NO: 1481107 - DNA, 16 bp, Homo sapiens
gaattattgacactga

SEQ ID NO: 1481108 - DNA, 20 bp, Homo sapiens
gaattattttgaatgtcaca

SEQ ID NO: 1481109 - DNA, 20 bp, Homo sapiens
gaattatttttgtgtttcta

SEQ ID NO: 1481110 - DNA, 19 bp, Homo sapiens
gaattcaaaagtgattatc

SEQ ID NO: 1481111 - DNA, 23 bp, Homo sapiens
gaattcaaactggggcctccaga

SEQ ID NO: 1481112 - DNA, 16 bp, Homo sapiens
gaattcactccagtca

SEQ ID NO: 1481113 - DNA, 23 bp, Homo sapiens
gaattcactccagtcaacagatt

SEQ ID NO: 1481114 - DNA, 23 bp, Homo sapiens
gaattcacttaagtttttccaaa

SEQ ID NO: 1481115 - DNA, 17 bp, Homo sapiens
gaattcagcaccctggg

SEQ ID NO: 1481116 - DNA, 14 bp, Homo sapiens
gaattcagtgcctt

SEQ ID NO: 1481117 - DNA, 12 bp, Homo sapiens
gaattcctcttt

SEQ ID NO: 1481118 - DNA, 17 bp, Homo sapiens
gaattcctctttaacaa

SEQ ID NO: 1481119 - DNA, 18 bp, Homo sapiens
gaattcctctttaacaag

SEQ ID NO: 1481120 - DNA, 23 bp, Homo sapiens
gaattcctcttttgcttaaatca

SEQ ID NO: 1481121 - DNA, 19 bp, Homo sapiens
gaattcggtgtgctgccaa

SEQ ID NO: 1481122 - DNA, 17 bp, Homo sapiens
gaattctagtgctgctg

SEQ ID NO: 1481123 - DNA, 15 bp, Homo sapiens
gaattctatttgctg

SEQ ID NO: 1481124 - DNA, 20 bp, Homo sapiens
gaattctcaggtaggaagca

SEQ ID NO: 1481125 - DNA, 18 bp, Homo sapiens
gaattctgcaactagcca

SEQ ID NO: 1481126 - DNA, 11 bp, Homo sapiens
gaattcttcct

SEQ ID NO: 1481127 - DNA, 13 bp, Homo sapiens
gaattcttctgca

SEQ ID NO: 1481128 - DNA, 18 bp, Homo sapiens
gaattgaacccaggaggt

SEQ ID NO: 1481129 - DNA, 20 bp, Homo sapiens
gaattgatcattttcccccc

SEQ ID NO: 1481130 - DNA, 17 bp, Homo sapiens
gaattgcttgaacctgg

SEQ ID NO: 1481131 - DNA, 11 bp, Homo sapiens
gaattgcttta

SEQ ID NO: 1481132 - DNA, 21 bp, Homo sapiens
gaattggaagttacatgctgt

SEQ ID NO: 1481133 - DNA, 21 bp, Homo sapiens
gaattggaggtaggaagggga

SEQ ID NO: 1481134 - DNA, 20 bp, Homo sapiens
gaattggcttccagatttta

SEQ ID NO: 1481135 - DNA, 16 bp, Homo sapiens
gaattgggagcttggg

SEQ ID NO: 1481136 - DNA, 14 bp, Homo sapiens
gaattggtgaataa

SEQ ID NO: 1481137 - DNA, 15 bp, Homo sapiens
gaattggtgaataaa

SEQ ID NO: 1481138 - DNA, 13 bp, Homo sapiens
gacagcagctggt

SEQ ID NO: 1481139 - DNA, 18 bp, Homo sapiens
gacagccaagcacctcca

SEQ ID NO: 1481140 - DNA, 14 bp, Homo sapiens
gacagcccacggtc

SEQ ID NO: 1481141 - DNA, 17 bp, Homo sapiens
gacagcccagagcctgg

SEQ ID NO: 1481142 - DNA, 23 bp, Homo sapiens
gacagcccaggatactggcacag

SEQ ID NO: 1481143 - DNA, 11 bp, Homo sapiens
gacagcctccc

SEQ ID NO: 1481144 - DNA, 13 bp, Homo sapiens
gacagcctggcac

SEQ ID NO: 1481145 - DNA, 19 bp, Homo sapiens
gacagcctggcacagggca

SEQ ID NO: 1481146 - DNA, 19 bp, Homo sapiens
gacagctacttctgggaaa

SEQ ID NO: 1481147 - DNA, 18 bp, Homo sapiens
gacagctccctctgcctg

SEQ ID NO: 1481148 - DNA, 12 bp, Homo sapiens
gacagctcttga

SEQ ID NO: 1481149 - DNA, 14 bp, Homo sapiens
gacagctgcccaga

SEQ ID NO: 1481150 - DNA, 15 bp, Homo sapiens
gacagctgcccagac

SEQ ID NO: 1481151 - DNA, 12 bp, Homo sapiens
gacagctgctgg

SEQ ID NO: 1481152 - DNA, 15 bp, Homo sapiens
gacagctgcttgtgg

SEQ ID NO: 1481153 - DNA, 13 bp, Homo sapiens
gacagctggctgg

SEQ ID NO: 1481154 - DNA, 14 bp, Homo sapiens
gacagctggctggg

SEQ ID NO: 1481155 - DNA, 16 bp, Homo sapiens
gacagctggctgggcc

SEQ ID NO: 1481156 - DNA, 17 bp, Homo sapiens
gacagctggctgggcct

SEQ ID NO: 1481157 - DNA, 15 bp, Homo sapiens
gacagctgtccctgt

SEQ ID NO: 1481158 - DNA, 16 bp, Homo sapiens
gacagctgtccctgtc

SEQ ID NO: 1481159 - DNA, 19 bp, Homo sapiens
gacagctgtccctgtcacc

SEQ ID NO: 1481160 - DNA, 21 bp, Homo sapiens
gacagcttacctagtcttgta

SEQ ID NO: 1481161 - DNA, 12 bp, Homo sapiens
gacagcttcctc

SEQ ID NO: 1481162 - DNA, 13 bp, Homo sapiens
gacagcttggaaa

SEQ ID NO: 1481163 - DNA, 13 bp, Homo sapiens
gacagctttctgg

SEQ ID NO: 1481164 - DNA, 15 bp, Homo sapiens
gacagctttctggga

SEQ ID NO: 1481165 - DNA, 23 bp, Homo sapiens
gacagctttctgggatgtcacag

SEQ ID NO: 1481166 - DNA, 16 bp, Homo sapiens
gacagctttgctccgc

SEQ ID NO: 1481167 - DNA, 19 bp, Homo sapiens
gacagctttgctccgctcc

SEQ ID NO: 1481168 - DNA, 15 bp, Homo sapiens
gacagcttttctcaa

SEQ ID NO: 1481169 - DNA, 17 bp, Homo sapiens
gacaggaagctggcaga

SEQ ID NO: 1481170 - DNA, 11 bp, Homo sapiens
gacaggaccct

SEQ ID NO: 1481171 - DNA, 18 bp, Homo sapiens
gacaggaccctcaggaat

SEQ ID NO: 1481172 - DNA, 24 bp, Homo sapiens
gacaggagaaatgcatccattcct

SEQ ID NO: 1481173 - DNA, 17 bp, Homo sapiens
gacaggagaagagagga

SEQ ID NO: 1481174 - DNA, 17 bp, Homo sapiens
gacaggagatcagcagc

SEQ ID NO: 1481175 - DNA, 15 bp, Homo sapiens
gacaggaggcggccc

SEQ ID NO: 1481176 - DNA, 23 bp, Homo sapiens
gacaggaggcggcccggccagcg

SEQ ID NO: 1481177 - DNA, 21 bp, Homo sapiens
gacaggatgaggacagagggc

SEQ ID NO: 1481178 - DNA, 17 bp, Homo sapiens
gacaggcagcctccttt

SEQ ID NO: 1481179 - DNA, 20 bp, Homo sapiens
gacaggccatgtgagccacc

SEQ ID NO: 1481180 - DNA, 20 bp, Homo sapiens
gacaggcccagcgcggccag

SEQ ID NO: 1481181 - DNA, 18 bp, Homo sapiens
gacaggctcttagcagct

SEQ ID NO: 1481182 - DNA, 23 bp, Homo sapiens
gacaggctgaagagagggacagg

SEQ ID NO: 1481183 - DNA, 13 bp, Homo sapiens
gacaggctggtgc

SEQ ID NO: 1481184 - DNA, 13 bp, Homo sapiens
gacagggacccac

SEQ ID NO: 1481185 - DNA, 13 bp, Homo sapiens
gacagggctggct

SEQ ID NO: 1481186 - DNA, 19 bp, Homo sapiens
gacagggctggctcctctg

SEQ ID NO: 1481187 - DNA, 16 bp, Homo sapiens
gacaggtccctcccct

SEQ ID NO: 1481188 - DNA, 19 bp, Homo sapiens
gacaggttacgaagacaaa

SEQ ID NO: 1481189 - DNA, 15 bp, Homo sapiens
gacagtatcccacat

SEQ ID NO: 1481190 - DNA, 16 bp, Homo sapiens
gacagtatcccacatc

SEQ ID NO: 1481191 - DNA, 20 bp, Homo sapiens
gacagtcagctgtggggaac

SEQ ID NO: 1481192 - DNA, 21 bp, Homo sapiens
gacagtcataaatactgtcaa

SEQ ID NO: 1481193 - DNA, 14 bp, Homo sapiens
gacagtccacaggg

SEQ ID NO: 1481194 - DNA, 18 bp, Homo sapiens
gacagtccacaggggcca

SEQ ID NO: 1481195 - DNA, 18 bp, Homo sapiens
gacagtcctgggagaacc

SEQ ID NO: 1481196 - DNA, 20 bp, Homo sapiens
gacagtctgttatgcactgt

SEQ ID NO: 1481197 - DNA, 21 bp, Homo sapiens
gacagtgaagcagcactgtga

SEQ ID NO: 1481198 - DNA, 21 bp, Homo sapiens
gacagtgatctccatatgtta

SEQ ID NO: 1481199 - DNA, 16 bp, Homo sapiens
gacagtgatgcctgcc

SEQ ID NO: 1481200 - DNA, 12 bp, Homo sapiens
gacagtgccatc

SEQ ID NO: 1481201 - DNA, 14 bp, Homo sapiens
gacagtgccatccc

SEQ ID NO: 1481202 - DNA, 15 bp, Homo sapiens
gacagtgccatcccc

SEQ ID NO: 1481203 - DNA, 14 bp, Homo sapiens
gacagtgcccatgc

SEQ ID NO: 1481204 - DNA, 17 bp, Homo sapiens
gacagtgcctcttccag

SEQ ID NO: 1481205 - DNA, 13 bp, Homo sapiens
gacagtgccttct

SEQ ID NO: 1481206 - DNA, 21 bp, Homo sapiens
gacagtgctctaggctgcccc

SEQ ID NO: 1481207 - DNA, 18 bp, Homo sapiens
gacagtgcttcagcctga

SEQ ID NO: 1481208 - DNA, 19 bp, Homo sapiens
gacagtgcttcagcctgag

SEQ ID NO: 1481209 - DNA, 12 bp, Homo sapiens
gacagtgggcag

SEQ ID NO: 1481210 - DNA, 22 bp, Homo sapiens
gacagtgtatggggctgcagtt

SEQ ID NO: 1481211 - DNA, 20 bp, Homo sapiens
gacagtgttccccgatacca

SEQ ID NO: 1481212 - DNA, 23 bp, Homo sapiens
gacagtgttgaaaatgttcagaa

SEQ ID NO: 1481213 - DNA, 15 bp, Homo sapiens
gacagttcatatgta

SEQ ID NO: 1481214 - DNA, 15 bp, Homo sapiens
gacagttctgaagaa

SEQ ID NO: 1481215 - DNA, 14 bp, Homo sapiens
gacagttggcagag

SEQ ID NO: 1481216 - DNA, 23 bp, Homo sapiens
gacagttggcagagaaggcctct

SEQ ID NO: 1481217 - DNA, 24 bp, Homo sapiens
gacagttggcagagaaggcctctt

SEQ ID NO: 1481218 - DNA, 14 bp, Homo sapiens
gacagttgtgcagg

SEQ ID NO: 1481219 - DNA, 19 bp, Homo sapiens
gacagtttaccagttgcct

SEQ ID NO: 1481220 - DNA, 13 bp, Homo sapiens
gacagtttccaaa

SEQ ID NO: 1481221 - DNA, 22 bp, Homo sapiens
gacagttttccttctcatctgt

SEQ ID NO: 1481222 - DNA, 14 bp, Homo sapiens
gacagtttttctgt

SEQ ID NO: 1481223 - DNA, 17 bp, Homo sapiens
gacataaaaacaacttt

SEQ ID NO: 1481224 - DNA, 20 bp, Homo sapiens
gacatacatattatctcatt

SEQ ID NO: 1481225 - DNA, 19 bp, Homo sapiens
gacatacctaccagtatta

SEQ ID NO: 1481226 - DNA, 14 bp, Homo sapiens
gacatacttgaagg

SEQ ID NO: 1481227 - DNA, 15 bp, Homo sapiens
gacatacttgaaggg

SEQ ID NO: 1481228 - DNA, 20 bp, Homo sapiens
gacatacttgaagggccaga

SEQ ID NO: 1481229 - DNA, 22 bp, Homo sapiens
gacatagccagcatttttgcat

SEQ ID NO: 1481230 - DNA, 22 bp, Homo sapiens
gacatagcctcatgttctgtgg

SEQ ID NO: 1481231 - DNA, 15 bp, Homo sapiens
gacatcacttgtaca

SEQ ID NO: 1481232 - DNA, 21 bp, Homo sapiens
gacatcatcattcttgtggga

SEQ ID NO: 1481233 - DNA, 12 bp, Homo sapiens
gacatcccttcc

SEQ ID NO: 1481234 - DNA, 16 bp, Homo sapiens
gacatcccttcctgga

SEQ ID NO: 1481235 - DNA, 23 bp, Homo sapiens
gacatcccttcctggaaacagca

SEQ ID NO: 1481236 - DNA, 21 bp, Homo sapiens
gacatcctagaggtagagaaa

SEQ ID NO: 1481237 - DNA, 15 bp, Homo sapiens
gacatcggaaaaata

SEQ ID NO: 1481238 - DNA, 19 bp, Homo sapiens
gacatcgtaggcagccacg

SEQ ID NO: 1481239 - DNA, 17 bp, Homo sapiens
gacatctctgcaccctg

SEQ ID NO: 1481240 - DNA, 18 bp, Homo sapiens
gacatctggaatctggag

SEQ ID NO: 1481241 - DNA, 21 bp, Homo sapiens
gacatctgtttctaaatgttt

SEQ ID NO: 1481242 - DNA, 21 bp, Homo sapiens
gacatcttcaaagcttgaaga

SEQ ID NO: 1481243 - DNA, 16 bp, Homo sapiens
gacatgaaatgaaaat

SEQ ID NO: 1481244 - DNA, 22 bp, Homo sapiens
gacatgatatagtcagctgcct

SEQ ID NO: 1481245 - DNA, 15 bp, Homo sapiens
gacatgcactgaccc

SEQ ID NO: 1481246 - DNA, 16 bp, Homo sapiens
gacatgcactgaccct

SEQ ID NO: 1481247 - DNA, 14 bp, Homo sapiens
gacatgctttccat

SEQ ID NO: 1481248 - DNA, 23 bp, Homo sapiens
gacatgctttccatttttttctt

SEQ ID NO: 1481249 - DNA, 22 bp, Homo sapiens
gacatggagactcctgccctgt

SEQ ID NO: 1481250 - DNA, 15 bp, Homo sapiens
gacatggaggttcta

SEQ ID NO: 1481251 - DNA, 16 bp, Homo sapiens
gacatggaggttctaa

SEQ ID NO: 1481252 - DNA, 19 bp, Homo sapiens
gacatggaggttctaaggc

SEQ ID NO: 1481253 - DNA, 23 bp, Homo sapiens
gaccagctggggcgtggggaggg

SEQ ID NO: 1481254 - DNA, 22 bp, Homo sapiens
gaccaggagctagcccagtccc

SEQ ID NO: 1481255 - DNA, 21 bp, Homo sapiens
gaccaggatcccaagcctcct

SEQ ID NO: 1481256 - DNA, 15 bp, Homo sapiens
gaccaggctgcagcc

SEQ ID NO: 1481257 - DNA, 16 bp, Homo sapiens
gaccaggctgcagcct

SEQ ID NO: 1481258 - DNA, 21 bp, Homo sapiens
gaccaggctggacaccctctg

SEQ ID NO: 1481259 - DNA, 14 bp, Homo sapiens
gaccaggctgtgtc

SEQ ID NO: 1481260 - DNA, 21 bp, Homo sapiens
gaccagggatgctgggctggg

SEQ ID NO: 1481261 - DNA, 15 bp, Homo sapiens
gaccagggccaccgc

SEQ ID NO: 1481262 - DNA, 11 bp, Homo sapiens
gaccagggctc

SEQ ID NO: 1481263 - DNA, 23 bp, Homo sapiens
gaccaggtcctgctccgctgcct

SEQ ID NO: 1481264 - DNA, 18 bp, Homo sapiens
gaccagtggctggtctca

SEQ ID NO: 1481265 - DNA, 23 bp, Homo sapiens
gaccagttgaataaaagtgcaca

SEQ ID NO: 1481266 - DNA, 14 bp, Homo sapiens
gaccagttgggagc

SEQ ID NO: 1481267 - DNA, 19 bp, Homo sapiens
gaccatccactctaccctc

SEQ ID NO: 1481268 - DNA, 17 bp, Homo sapiens
gaccatcctggagggct

SEQ ID NO: 1481269 - DNA, 14 bp, Homo sapiens
gaccatcctggccc

SEQ ID NO: 1481270 - DNA, 18 bp, Homo sapiens
gaccatcctggcccctcc

SEQ ID NO: 1481271 - DNA, 13 bp, Homo sapiens
gaccatctgtgac

SEQ ID NO: 1481272 - DNA, 23 bp, Homo sapiens
gaccatctgtgactataaagctg

SEQ ID NO: 1481273 - DNA, 17 bp, Homo sapiens
gaccatgccagacccac

SEQ ID NO: 1481274 - DNA, 21 bp, Homo sapiens
gaccatgctcatctgctggtc

SEQ ID NO: 1481275 - DNA, 15 bp, Homo sapiens
gaccattcaattagt

SEQ ID NO: 1481276 - DNA, 19 bp, Homo sapiens
gaccattttttaatttact

SEQ ID NO: 1481277 - DNA, 23 bp, Homo sapiens
gaccattttttaatttacttgtt

SEQ ID NO: 1481278 - DNA, 13 bp, Homo sapiens
gacccaaggagga

SEQ ID NO: 1481279 - DNA, 19 bp, Homo sapiens
gacccaccaaactgcacac

SEQ ID NO: 1481280 - DNA, 15 bp, Homo sapiens
gacccaccagtgcct

SEQ ID NO: 1481281 - DNA, 23 bp, Homo sapiens
gacccacccatcttcctgctgct

SEQ ID NO: 1481282 - DNA, 15 bp, Homo sapiens
gacccaccccaactc

SEQ ID NO: 1481283 - DNA, 20 bp, Homo sapiens
gacccaccccaactctcccc

SEQ ID NO: 1481284 - DNA, 12 bp, Homo sapiens
gacccacccctg

SEQ ID NO: 1481285 - DNA, 14 bp, Homo sapiens
gacccacccctgtg

SEQ ID NO: 1481286 - DNA, 19 bp, Homo sapiens
gacccagaatggagcctgc

SEQ ID NO: 1481287 - DNA, 22 bp, Homo sapiens
gacccagagaaggacggtgcca

SEQ ID NO: 1481288 - DNA, 15 bp, Homo sapiens
gacccagatctcatg

SEQ ID NO: 1481289 - DNA, 12 bp, Homo sapiens
gacccagcatct

SEQ ID NO: 1481290 - DNA, 19 bp, Homo sapiens
gacccagcatctcccagca

SEQ ID NO: 1481291 - DNA, 22 bp, Homo sapiens
gacccagcatctcccagcaaga

SEQ ID NO: 1481292 - DNA, 16 bp, Homo sapiens
gacccagctactctgt

SEQ ID NO: 1481293 - DNA, 20 bp, Homo sapiens
gacccagctactctgtccag

SEQ ID NO: 1481294 - DNA, 21 bp, Homo sapiens
gacccagctactctgtccagg

SEQ ID NO: 1481295 - DNA, 19 bp, Homo sapiens
gacccagctgcagaccatg

SEQ ID NO: 1481296 - DNA, 19 bp, Homo sapiens
gacccagcttagagttctt

SEQ ID NO: 1481297 - DNA, 21 bp, Homo sapiens
gacccaggaaaggcaggattg

SEQ ID NO: 1481298 - DNA, 18 bp, Homo sapiens
gacccaggccctccatgg

SEQ ID NO: 1481299 - DNA, 13 bp, Homo sapiens
gacccaggccgca

SEQ ID NO: 1481300 - DNA, 18 bp, Homo sapiens
gacccaggctgcctgagc

SEQ ID NO: 1481301 - DNA, 17 bp, Homo sapiens
gacccaggtgtgcctgt

SEQ ID NO: 1481302 - DNA, 16 bp, Homo sapiens
gacccagtccctgggg

SEQ ID NO: 1481303 - DNA, 16 bp, Homo sapiens
gacccagtgcccccac

SEQ ID NO: 1481304 - DNA, 20 bp, Homo sapiens
gacccagtgcccccactgac

SEQ ID NO: 1481305 - DNA, 17 bp, Homo sapiens
gacccatcacgcctgtg

SEQ ID NO: 1481306 - DNA, 11 bp, Homo sapiens
gacccatctgt

SEQ ID NO: 1481307 - DNA, 17 bp, Homo sapiens
gaccccaaagactctgg

SEQ ID NO: 1481308 - DNA, 12 bp, Homo sapiens
gaccccacccaa

SEQ ID NO: 1481309 - DNA, 22 bp, Homo sapiens
gaccccacccaagcttggcagc

SEQ ID NO: 1481310 - DNA, 11 bp, Homo sapiens
gaccccagcat

SEQ ID NO: 1481311 - DNA, 14 bp, Homo sapiens
gaccccagctggga

SEQ ID NO: 1481312 - DNA, 15 bp, Homo sapiens
gaccccagctgggag

SEQ ID NO: 1481313 - DNA, 21 bp, Homo sapiens
gaccccagctgggaggcaaga

SEQ ID NO: 1481314 - DNA, 18 bp, Homo sapiens
gaccccatcttccagcca

SEQ ID NO: 1481315 - DNA, 14 bp, Homo sapiens
gacccccacaacaa

SEQ ID NO: 1481316 - DNA, 13 bp, Homo sapiens
gacccccacacct

SEQ ID NO: 1481317 - DNA, 24 bp, Homo sapiens
gacccccaggcctgtccaccctgc

SEQ ID NO: 1481318 - DNA, 16 bp, Homo sapiens
gacccccatccagcct

SEQ ID NO: 1481319 - DNA, 18 bp, Homo sapiens
gacccccatccagcctcc

SEQ ID NO: 1481320 - DNA, 19 bp, Homo sapiens
gacccccatccagcctcca

SEQ ID NO: 1481321 - DNA, 23 bp, Homo sapiens
gacccccatccagcctccagggc

SEQ ID NO: 1481322 - DNA, 13 bp, Homo sapiens
gaccccccacccc

SEQ ID NO: 1481323 - DNA, 21 bp, Homo sapiens
gaccccctcaccatccagtgg

SEQ ID NO: 1481324 - DNA, 14 bp, Homo sapiens
gaccccctcccctg

SEQ ID NO: 1481325 - DNA, 13 bp, Homo sapiens
gaccccctgagtc

SEQ ID NO: 1481326 - DNA, 17 bp, Homo sapiens
gaccccgacgccacagc

SEQ ID NO: 1481327 - DNA, 21 bp, Homo sapiens
gaccccgacgccacagcccag

SEQ ID NO: 1481328 - DNA, 16 bp, Homo sapiens
gaccccgagaaccctg

SEQ ID NO: 1481329 - DNA, 19 bp, Homo sapiens
gaccccggcttcctttccc

SEQ ID NO: 1481330 - DNA, 15 bp, Homo sapiens
gacccctctggccag

SEQ ID NO: 1481331 - DNA, 16 bp, Homo sapiens
gacccctggctctggg

SEQ ID NO: 1481332 - DNA, 12 bp, Homo sapiens
gacccctgtctt

SEQ ID NO: 1481333 - DNA, 16 bp, Homo sapiens
gacccgccagccccgc

SEQ ID NO: 1481334 - DNA, 17 bp, Homo sapiens
gacccgccagccccgct

SEQ ID NO: 1481335 - DNA, 13 bp, Homo sapiens
gacccgccaggtc

SEQ ID NO: 1481336 - DNA, 14 bp, Homo sapiens
gacccgccaggtca

SEQ ID NO: 1481337 - DNA, 12 bp, Homo sapiens
gacccggcggcc

SEQ ID NO: 1481338 - DNA, 15 bp, Homo sapiens
gacccgggaaggaag

SEQ ID NO: 1481339 - DNA, 22 bp, Homo sapiens
gacccgggaccacagctgctgg

SEQ ID NO: 1481340 - DNA, 15 bp, Homo sapiens
gacccggggtctcct

SEQ ID NO: 1481341 - DNA, 19 bp, Homo sapiens
gacccggggtctcctggac

SEQ ID NO: 1481342 - DNA, 20 bp, Homo sapiens
gacccggggtctcctggacc

SEQ ID NO: 1481343 - DNA, 20 bp, Homo sapiens
gacccggtcacgttcttgga

SEQ ID NO: 1481344 - DNA, 14 bp, Homo sapiens
gacccgtccatttg

SEQ ID NO: 1481345 - DNA, 14 bp, Homo sapiens
gaccctacaggaga

SEQ ID NO: 1481346 - DNA, 14 bp, Homo sapiens
gaccctaccccacc

SEQ ID NO: 1481347 - DNA, 20 bp, Homo sapiens
gaccctactgaagtggctgg

SEQ ID NO: 1481348 - DNA, 10 bp, Homo sapiens
gaccctcact

SEQ ID NO: 1481349 - DNA, 19 bp, Homo sapiens
gaccctcactgctggggag

SEQ ID NO: 1481350 - DNA, 23 bp, Homo sapiens
gaccctcatggcccccaggggca

SEQ ID NO: 1481351 - DNA, 21 bp, Homo sapiens
gaccctccccacagtgccacc

SEQ ID NO: 1481352 - DNA, 15 bp, Homo sapiens
gaccctcgcagacct

SEQ ID NO: 1481353 - DNA, 20 bp, Homo sapiens
gaccctcgggccccatcctc

SEQ ID NO: 1481354 - DNA, 13 bp, Homo sapiens
gaccctcttgccc

SEQ ID NO: 1481355 - DNA, 16 bp, Homo sapiens
gaccctgacctccgcc

SEQ ID NO: 1481356 - DNA, 13 bp, Homo sapiens
gaccctgagactc

SEQ ID NO: 1481357 - DNA, 15 bp, Homo sapiens
gaccctgcaagacca

SEQ ID NO: 1481358 - DNA, 12 bp, Homo sapiens
gaccctgccctg

SEQ ID NO: 1481359 - DNA, 19 bp, Homo sapiens
gaccctgccctgggcgagc

SEQ ID NO: 1481360 - DNA, 20 bp, Homo sapiens
gaccctgccctgggcgagcc

SEQ ID NO: 1481361 - DNA, 15 bp, Homo sapiens
gaccctgcctgagcc

SEQ ID NO: 1481362 - DNA, 21 bp, Homo sapiens
gaccctgcctgagcccaggag

SEQ ID NO: 1481363 - DNA, 23 bp, Homo sapiens
gaccctgcctgagcccaggagct

SEQ ID NO: 1481364 - DNA, 18 bp, Homo sapiens
gaccctgggggcacagga

SEQ ID NO: 1481365 - DNA, 21 bp, Homo sapiens
gaccctgggtgggctctgtgc

SEQ ID NO: 1481366 - DNA, 22 bp, Homo sapiens
gaccctgggtgggctctgtgca

SEQ ID NO: 1481367 - DNA, 17 bp, Homo sapiens
gaccctgtccggcccag

SEQ ID NO: 1481368 - DNA, 21 bp, Homo sapiens
gacctttgtcatctttcttct

SEQ ID NO: 1481369 - DNA, 12 bp, Homo sapiens
gacgaactggct

SEQ ID NO: 1481370 - DNA, 15 bp, Homo sapiens
gacgaagagcaggcc

SEQ ID NO: 1481371 - DNA, 20 bp, Homo sapiens
gacgaagcggagagagccaa

SEQ ID NO: 1481372 - DNA, 16 bp, Homo sapiens
gacgaattccactcgt

SEQ ID NO: 1481373 - DNA, 17 bp, Homo sapiens
gacgaattccactcgtc

SEQ ID NO: 1481374 - DNA, 12 bp, Homo sapiens
gacgaggggcag

SEQ ID NO: 1481375 - DNA, 16 bp, Homo sapiens
gacgcacacagctgag

SEQ ID NO: 1481376 - DNA, 20 bp, Homo sapiens
gacgcagccggagggaggca

SEQ ID NO: 1481377 - DNA, 16 bp, Homo sapiens
gacgcaggaatggaaa

SEQ ID NO: 1481378 - DNA, 16 bp, Homo sapiens
gacgcagtccgcccag

SEQ ID NO: 1481379 - DNA, 15 bp, Homo sapiens
gacgccacagcccag

SEQ ID NO: 1481380 - DNA, 22 bp, Homo sapiens
gacgccttccaggtcaggatgc

SEQ ID NO: 1481381 - DNA, 15 bp, Homo sapiens
gacggacatccaggc

SEQ ID NO: 1481382 - DNA, 17 bp, Homo sapiens
gacggaggaggggaagg

SEQ ID NO: 1481383 - DNA, 19 bp, Homo sapiens
gacggaggaggggaagggg

SEQ ID NO: 1481384 - DNA, 21 bp, Homo sapiens
gacggaggaggggaaggggct

SEQ ID NO: 1481385 - DNA, 17 bp, Homo sapiens
gacggccaatggtgctt

SEQ ID NO: 1481386 - DNA, 22 bp, Homo sapiens
gacggcctgatgctccctcccc

SEQ ID NO: 1481387 - DNA, 16 bp, Homo sapiens
gacggcggccaggcac

SEQ ID NO: 1481388 - DNA, 19 bp, Homo sapiens
gacggctgtgacgcagccg

SEQ ID NO: 1481389 - DNA, 22 bp, Homo sapiens
gacggctgtggaccgtggacag

SEQ ID NO: 1481390 - DNA, 12 bp, Homo sapiens
gacgggcacaga

SEQ ID NO: 1481391 - DNA, 16 bp, Homo sapiens
gacgggggctgcttct

SEQ ID NO: 1481392 - DNA, 17 bp, Homo sapiens
gacgggggctgcttctc

SEQ ID NO: 1481393 - DNA, 23 bp, Homo sapiens
gacgggtgcccgtaatcccagct

SEQ ID NO: 1481394 - DNA, 15 bp, Homo sapiens
gacgggttcaccatg

SEQ ID NO: 1481395 - DNA, 21 bp, Homo sapiens
gacgggttgaaagacatcaat

SEQ ID NO: 1481396 - DNA, 16 bp, Homo sapiens
gacgggtttcaccatg

SEQ ID NO: 1481397 - DNA, 12 bp, Homo sapiens
gacggtgccaag

SEQ ID NO: 1481398 - DNA, 17 bp, Homo sapiens
gacggtgccaagggccc

SEQ ID NO: 1481399 - DNA, 20 bp, Homo sapiens
gacggtgccaagggccccag

SEQ ID NO: 1481400 - DNA, 18 bp, Homo sapiens
gacggttcaccagcctct

SEQ ID NO: 1481401 - DNA, 19 bp, Homo sapiens
gacggttcaccagcctctc

SEQ ID NO: 1481402 - DNA, 18 bp, Homo sapiens
gacggtttccagggaggg

SEQ ID NO: 1481403 - DNA, 20 bp, Homo sapiens
gacgtaggaacggtaaattt

SEQ ID NO: 1481404 - DNA, 18 bp, Homo sapiens
gacgtcaagtctccttcc

SEQ ID NO: 1481405 - DNA, 13 bp, Homo sapiens
gacgtcagcctct

SEQ ID NO: 1481406 - DNA, 15 bp, Homo sapiens
gacgtcagcctctta

SEQ ID NO: 1481407 - DNA, 22 bp, Homo sapiens
gacgtcagcctcttaccttccc

SEQ ID NO: 1481408 - DNA, 17 bp, Homo sapiens
gacgtctggggtgtggg

SEQ ID NO: 1481409 - DNA, 22 bp, Homo sapiens
gacgtgaccggacttttctgca

SEQ ID NO: 1481410 - DNA, 21 bp, Homo sapiens
gacgtggtcagggcagggctc

SEQ ID NO: 1481411 - DNA, 14 bp, Homo sapiens
gacgtgtgtggctg

SEQ ID NO: 1481412 - DNA, 17 bp, Homo sapiens
gacgtgtgtggctggga

SEQ ID NO: 1481413 - DNA, 20 bp, Homo sapiens
gacgtgttacccactgccat

SEQ ID NO: 1481414 - DNA, 21 bp, Homo sapiens
gacgttcggggcatgctgggg

SEQ ID NO: 1481415 - DNA, 16 bp, Homo sapiens
gacgtttcttctttct

SEQ ID NO: 1481416 - DNA, 18 bp, Homo sapiens
gactaaaaatattataac

SEQ ID NO: 1481417 - DNA, 10 bp, Homo sapiens
gactaaagag

SEQ ID NO: 1481418 - DNA, 13 bp, Homo sapiens
gactaaagagaga

SEQ ID NO: 1481419 - DNA, 17 bp, Homo sapiens
gactaaagagagaatgt

SEQ ID NO: 1481420 - DNA, 22 bp, Homo sapiens
gactaaaggcatccttgtcttt

SEQ ID NO: 1481421 - DNA, 12 bp, Homo sapiens
gactaaatgaaa

SEQ ID NO: 1481422 - DNA, 13 bp, Homo sapiens
gactaacaagaat

SEQ ID NO: 1481423 - DNA, 23 bp, Homo sapiens
gactaagagaagttgtaaagtat

SEQ ID NO: 1481424 - DNA, 18 bp, Homo sapiens
gactaattttacatgttt

SEQ ID NO: 1481425 - DNA, 17 bp, Homo sapiens
gactacacaatacagta

SEQ ID NO: 1481426 - DNA, 12 bp, Homo sapiens
gactacaggtgc

SEQ ID NO: 1481427 - DNA, 14 bp, Homo sapiens
gactacatttagag

SEQ ID NO: 1481428 - DNA, 15 bp, Homo sapiens
gactaccccagtccc

SEQ ID NO: 1481429 - DNA, 19 bp, Homo sapiens
gactaccccagtcccaggg

SEQ ID NO: 1481430 - DNA, 16 bp, Homo sapiens
gactaccgcaggcccg

SEQ ID NO: 1481431 - DNA, 17 bp, Homo sapiens
gactaccgcaggcccgg

SEQ ID NO: 1481432 - DNA, 19 bp, Homo sapiens
gactaccgcaggcccggac

SEQ ID NO: 1481433 - DNA, 14 bp, Homo sapiens
gactactgctcctg

SEQ ID NO: 1481434 - DNA, 19 bp, Homo sapiens
gactactgctcctgtggca

SEQ ID NO: 1481435 - DNA, 19 bp, Homo sapiens
gactacttggaactaggct

SEQ ID NO: 1481436 - DNA, 22 bp, Homo sapiens
gactacttgttgtatctgctgg

SEQ ID NO: 1481437 - DNA, 16 bp, Homo sapiens
gactagaattctagtg

SEQ ID NO: 1481438 - DNA, 18 bp, Homo sapiens
gactagaattctagtgct

SEQ ID NO: 1481439 - DNA, 22 bp, Homo sapiens
gactagaggcagggaggggact

SEQ ID NO: 1481440 - DNA, 14 bp, Homo sapiens
gactagaggccagg

SEQ ID NO: 1481441 - DNA, 18 bp, Homo sapiens
gactagatgtagtatttt

SEQ ID NO: 1481442 - DNA, 19 bp, Homo sapiens
gactagggattcaggctgc

SEQ ID NO: 1481443 - DNA, 21 bp, Homo sapiens
gactagggattcaggctgctt

SEQ ID NO: 1481444 - DNA, 19 bp, Homo sapiens
gactagtgccgtagggagt

SEQ ID NO: 1481445 - DNA, 14 bp, Homo sapiens
gactataaagctgt

SEQ ID NO: 1481446 - DNA, 21 bp, Homo sapiens
gactatatttgggcctgctcc

SEQ ID NO: 1481447 - DNA, 22 bp, Homo sapiens
gactatcaaactgaagccagaa

SEQ ID NO: 1481448 - DNA, 20 bp, Homo sapiens
gactatgatgagaggccagc

SEQ ID NO: 1481449 - DNA, 18 bp, Homo sapiens
gactatgcagaggcctgg

SEQ ID NO: 1481450 - DNA, 22 bp, Homo sapiens
gactatgcagaggcctggggga

SEQ ID NO: 1481451 - DNA, 23 bp, Homo sapiens
gactatggtgctgccttgcttct

SEQ ID NO: 1481452 - DNA, 19 bp, Homo sapiens
gactattctgtatctttca

SEQ ID NO: 1481453 - DNA, 13 bp, Homo sapiens
gactatttgctaa

SEQ ID NO: 1481454 - DNA, 14 bp, Homo sapiens
gactcaaaacctgg

SEQ ID NO: 1481455 - DNA, 18 bp, Homo sapiens
gactcaaaacctggagat

SEQ ID NO: 1481456 - DNA, 22 bp, Homo sapiens
gactcaacatgttactgaccag

SEQ ID NO: 1481457 - DNA, 19 bp, Homo sapiens
gactcaagaagtgaagaat

SEQ ID NO: 1481458 - DNA, 14 bp, Homo sapiens
gactcaagagaatt

SEQ ID NO: 1481459 - DNA, 22 bp, Homo sapiens
gactcaagagacaccccttcct

SEQ ID NO: 1481460 - DNA, 12 bp, Homo sapiens
gactcacccaag

SEQ ID NO: 1481461 - DNA, 15 bp, Homo sapiens
gactcagagcaattt

SEQ ID NO: 1481462 - DNA, 18 bp, Homo sapiens
gactcagagctctctcta

SEQ ID NO: 1481463 - DNA, 13 bp, Homo sapiens
gactcagcagtga

SEQ ID NO: 1481464 - DNA, 13 bp, Homo sapiens
gactcagccctga

SEQ ID NO: 1481465 - DNA, 14 bp, Homo sapiens
gactcagccttcag

SEQ ID NO: 1481466 - DNA, 15 bp, Homo sapiens
gactcagccttcaga

SEQ ID NO: 1481467 - DNA, 19 bp, Homo sapiens
gactcagccttcagacaga

SEQ ID NO: 1481468 - DNA, 20 bp, Homo sapiens
gactcagccttcagacagag

SEQ ID NO: 1481469 - DNA, 14 bp, Homo sapiens
gactcaggaacttt

SEQ ID NO: 1481470 - DNA, 19 bp, Homo sapiens
gactcaggaccagatgtcc

SEQ ID NO: 1481471 - DNA, 18 bp, Homo sapiens
gactcaggagtctgccac

SEQ ID NO: 1481472 - DNA, 17 bp, Homo sapiens
gactcaggatccagtcc

SEQ ID NO: 1481473 - DNA, 20 bp, Homo sapiens
gactcagggaccggtgctgc

SEQ ID NO: 1481474 - DNA, 23 bp, Homo sapiens
gactcagggaccggtgctgcagg

SEQ ID NO: 1481475 - DNA, 22 bp, Homo sapiens
gactcagggccatgcctgcccc

SEQ ID NO: 1481476 - DNA, 17 bp, Homo sapiens
gactcaggttccagaac

SEQ ID NO: 1481477 - DNA, 24 bp, Homo sapiens
gactcagtatgctttccctgagga

SEQ ID NO: 1481478 - DNA, 14 bp, Homo sapiens
gactcagtgcagat

SEQ ID NO: 1481479 - DNA, 22 bp, Homo sapiens
gactcatcaatcaaataagtat

SEQ ID NO: 1481480 - DNA, 15 bp, Homo sapiens
gactcatggcagctg

SEQ ID NO: 1481481 - DNA, 16 bp, Homo sapiens
gactcatggcagctgt

SEQ ID NO: 1481482 - DNA, 19 bp, Homo sapiens
gactttgtgttcatttcat

SEQ ID NO: 1481483 - DNA, 18 bp, Homo sapiens
gacttttaatcagtgaag

SEQ ID NO: 1481484 - DNA, 17 bp, Homo sapiens
gacttttattaataaaa

SEQ ID NO: 1481485 - DNA, 19 bp, Homo sapiens
gacttttccattgaccagc

SEQ ID NO: 1481486 - DNA, 14 bp, Homo sapiens
gacttttctgcaaa

SEQ ID NO: 1481487 - DNA, 14 bp, Homo sapiens
gacttttcttaagt

SEQ ID NO: 1481488 - DNA, 17 bp, Homo sapiens
gacttttggtagagaag

SEQ ID NO: 1481489 - DNA, 18 bp, Homo sapiens
gacttttggtagagaagg

SEQ ID NO: 1481490 - DNA, 20 bp, Homo sapiens
gacttttgtctgatcaagtg

SEQ ID NO: 1481491 - DNA, 14 bp, Homo sapiens
gacttttttataca

SEQ ID NO: 1481492 - DNA, 13 bp, Homo sapiens
gactttttttgta

SEQ ID NO: 1481493 - DNA, 15 bp, Homo sapiens
gagaaaaagaaatgc

SEQ ID NO: 1481494 - DNA, 17 bp, Homo sapiens
gagaaaaaggaaaaaaa

SEQ ID NO: 1481495 - DNA, 18 bp, Homo sapiens
gagaaaaggctggagaga

SEQ ID NO: 1481496 - DNA, 11 bp, Homo sapiens
gagaaaatcat

SEQ ID NO: 1481497 - DNA, 23 bp, Homo sapiens
gagaaaatcatcaagaagggctg

SEQ ID NO: 1481498 - DNA, 19 bp, Homo sapiens
gagaaacactgaaaagaag

SEQ ID NO: 1481499 - DNA, 13 bp, Homo sapiens
gagaaacagagac

SEQ ID NO: 1481500 - DNA, 15 bp, Homo sapiens
gagaaacagctcagc

SEQ ID NO: 1481501 - DNA, 16 bp, Homo sapiens
gagaaacagctcagcc

SEQ ID NO: 1481502 - DNA, 19 bp, Homo sapiens
gagaaacagttggtaactt

SEQ ID NO: 1481503 - DNA, 17 bp, Homo sapiens
gagaaacccaccagcct

SEQ ID NO: 1481504 - DNA, 18 bp, Homo sapiens
gagaaacccaccagccta

SEQ ID NO: 1481505 - DNA, 17 bp, Homo sapiens
gagaaaccctaaaaaga

SEQ ID NO: 1481506 - DNA, 22 bp, Homo sapiens
gagaaaccctaaaaagagaaga

SEQ ID NO: 1481507 - DNA, 12 bp, Homo sapiens
gagaaaccctgt

SEQ ID NO: 1481508 - DNA, 21 bp, Homo sapiens
gagaaaccttattgtacctct

SEQ ID NO: 1481509 - DNA, 15 bp, Homo sapiens
gagaaactgctgcag

SEQ ID NO: 1481510 - DNA, 24 bp, Homo sapiens
gagaaacttaaatgttattatctg

SEQ ID NO: 1481511 - DNA, 18 bp, Homo sapiens
gagaaagactattcaaac

SEQ ID NO: 1481512 - DNA, 15 bp, Homo sapiens
gagaaagagagaagc

SEQ ID NO: 1481513 - DNA, 17 bp, Homo sapiens
gagaaagagagaagcca

SEQ ID NO: 1481514 - DNA, 18 bp, Homo sapiens
gagaaagagagaagccag

SEQ ID NO: 1481515 - DNA, 23 bp, Homo sapiens
gagaaagagagaagccagccaca

SEQ ID NO: 1481516 - DNA, 14 bp, Homo sapiens
gagaaagaggccag

SEQ ID NO: 1481517 - DNA, 21 bp, Homo sapiens
gagaaagatgttccagtgagg

SEQ ID NO: 1481518 - DNA, 14 bp, Homo sapiens
gagaaagcaaaata

SEQ ID NO: 1481519 - DNA, 16 bp, Homo sapiens
gagaaagtaacacaaa

SEQ ID NO: 1481520 - DNA, 23 bp, Homo sapiens
gagaaataaagtttgcttagaaa

SEQ ID NO: 1481521 - DNA, 17 bp, Homo sapiens
gagaaatcacaggggcg

SEQ ID NO: 1481522 - DNA, 13 bp, Homo sapiens
gagaaatgcaata

SEQ ID NO: 1481523 - DNA, 16 bp, Homo sapiens
gagaaatgtcataaat

SEQ ID NO: 1481524 - DNA, 22 bp, Homo sapiens
gagaacaagtcacagctgcagc

SEQ ID NO: 1481525 - DNA, 17 bp, Homo sapiens
gagaacagataaagatt

SEQ ID NO: 1481526 - DNA, 13 bp, Homo sapiens
gagaacagtggtt

SEQ ID NO: 1481527 - DNA, 19 bp, Homo sapiens
gagaacagtggttgcctgg

SEQ ID NO: 1481528 - DNA, 14 bp, Homo sapiens
gagaaccaaagcaa

SEQ ID NO: 1481529 - DNA, 14 bp, Homo sapiens
gagaaccctgagca

SEQ ID NO: 1481530 - DNA, 16 bp, Homo sapiens
gagaaccctgagcagg

SEQ ID NO: 1481531 - DNA, 23 bp, Homo sapiens
gagaaccgagcaaagatcaaaat

SEQ ID NO: 1481532 - DNA, 21 bp, Homo sapiens
gagaacctcaggtacggagaa

SEQ ID NO: 1481533 - DNA, 15 bp, Homo sapiens
gagaaccttttcaaa

SEQ ID NO: 1481534 - DNA, 19 bp, Homo sapiens
gagaactgcatatgtttcg

SEQ ID NO: 1481535 - DNA, 23 bp, Homo sapiens
gagaactgcatatgtttcgctga

SEQ ID NO: 1481536 - DNA, 17 bp, Homo sapiens
gagaactgcttctaaga

SEQ ID NO: 1481537 - DNA, 15 bp, Homo sapiens
gagaactgtggccgt

SEQ ID NO: 1481538 - DNA, 20 bp, Homo sapiens
gagaagaaaggtgagtttga

SEQ ID NO: 1481539 - DNA, 18 bp, Homo sapiens
gagaagaacaagaaatgg

SEQ ID NO: 1481540 - DNA, 19 bp, Homo sapiens
gagaagaatccacaaggac

SEQ ID NO: 1481541 - DNA, 18 bp, Homo sapiens
gagaagacaacagaaaga

SEQ ID NO: 1481542 - DNA, 19 bp, Homo sapiens
gagaagagggcccagccca

SEQ ID NO: 1481543 - DNA, 20 bp, Homo sapiens
gagaagagggcccagcccag

SEQ ID NO: 1481544 - DNA, 14 bp, Homo sapiens
gagaagagggcctg

SEQ ID NO: 1481545 - DNA, 15 bp, Homo sapiens
gagaagagggcctgt

SEQ ID NO: 1481546 - DNA, 19 bp, Homo sapiens
gagaagagggcctgtggga

SEQ ID NO: 1481547 - DNA, 13 bp, Homo sapiens
gagaagagtattt

SEQ ID NO: 1481548 - DNA, 21 bp, Homo sapiens
gagaagatcggaacagctcct

SEQ ID NO: 1481549 - DNA, 14 bp, Homo sapiens
gagaagattttata

SEQ ID NO: 1481550 - DNA, 14 bp, Homo sapiens
gagaagcaggcaga

SEQ ID NO: 1481551 - DNA, 14 bp, Homo sapiens
gagaagcagtgagc

SEQ ID NO: 1481552 - DNA, 13 bp, Homo sapiens
gagaagcatgaaa

SEQ ID NO: 1481553 - DNA, 12 bp, Homo sapiens
gagaagccaagc

SEQ ID NO: 1481554 - DNA, 20 bp, Homo sapiens
gagaagccacaggcctgaga

SEQ ID NO: 1481555 - DNA, 15 bp, Homo sapiens
gagaagccaccttcc

SEQ ID NO: 1481556 - DNA, 16 bp, Homo sapiens
gagaagccagccacag

SEQ ID NO: 1481557 - DNA, 19 bp, Homo sapiens
gagaagccagccacagacc

SEQ ID NO: 1481558 - DNA, 22 bp, Homo sapiens
gagaagccagctttcctcatca

SEQ ID NO: 1481559 - DNA, 12 bp, Homo sapiens
gagaagccagga

SEQ ID NO: 1481560 - DNA, 15 bp, Homo sapiens
gagaagccatgtact

SEQ ID NO: 1481561 - DNA, 21 bp, Homo sapiens
gagaagccatgtactcaagta

SEQ ID NO: 1481562 - DNA, 19 bp, Homo sapiens
gagaagctagatgcccctg

SEQ ID NO: 1481563 - DNA, 20 bp, Homo sapiens
gagaagctagatgcccctgc

SEQ ID NO: 1481564 - DNA, 19 bp, Homo sapiens
gagaagctcctctccccag

SEQ ID NO: 1481565 - DNA, 21 bp, Homo sapiens
gagaagctgatccagtttccg

SEQ ID NO: 1481566 - DNA, 11 bp, Homo sapiens
gagaagctgct

SEQ ID NO: 1481567 - DNA, 12 bp, Homo sapiens
gagaagctgctg

SEQ ID NO: 1481568 - DNA, 18 bp, Homo sapiens
gagaagctgctgaccaat

SEQ ID NO: 1481569 - DNA, 21 bp, Homo sapiens
gagaaggaaggagactcacct

SEQ ID NO: 1481570 - DNA, 14 bp, Homo sapiens
gagaaggaagggca

SEQ ID NO: 1481571 - DNA, 17 bp, Homo sapiens
gagaaggaagggcagag

SEQ ID NO: 1481572 - DNA, 22 bp, Homo sapiens
gagaaggacccggaggggcctg

SEQ ID NO: 1481573 - DNA, 21 bp, Homo sapiens
gagaaggacggtgccaagggc

SEQ ID NO: 1481574 - DNA, 17 bp, Homo sapiens
gagaaggccctgtgccc

SEQ ID NO: 1481575 - DNA, 14 bp, Homo sapiens
gagaaggccgctgc

SEQ ID NO: 1481576 - DNA, 15 bp, Homo sapiens
gagaaggcgaggaga

SEQ ID NO: 1481577 - DNA, 15 bp, Homo sapiens
gagaagggatggagg

SEQ ID NO: 1481578 - DNA, 17 bp, Homo sapiens
gagaaggggaagcactc

SEQ ID NO: 1481579 - DNA, 17 bp, Homo sapiens
gagaagggggtctctgt

SEQ ID NO: 1481580 - DNA, 22 bp, Homo sapiens
gagaagggttctgccctgcctg

SEQ ID NO: 1481581 - DNA, 16 bp, Homo sapiens
gagaaggtctccaagg

SEQ ID NO: 1481582 - DNA, 17 bp, Homo sapiens
gagaaggttggaggtgg

SEQ ID NO: 1481583 - DNA, 13 bp, Homo sapiens
gagaaggtttatt

SEQ ID NO: 1481584 - DNA, 16 bp, Homo sapiens
gagaaggtttattgtt

SEQ ID NO: 1481585 - DNA, 14 bp, Homo sapiens
gagaagtacttggt

SEQ ID NO: 1481586 - DNA, 22 bp, Homo sapiens
gagaagtagctagtagcaatgt

SEQ ID NO: 1481587 - DNA, 19 bp, Homo sapiens
gagaagtattcctgttgct

SEQ ID NO: 1481588 - DNA, 13 bp, Homo sapiens
gagaagtctcagc

SEQ ID NO: 1481589 - DNA, 14 bp, Homo sapiens
gagaagtctcagct

SEQ ID NO: 1481590 - DNA, 22 bp, Homo sapiens
gagaagtgatatggtgaaggga

SEQ ID NO: 1481591 - DNA, 16 bp, Homo sapiens
gagaagtgctccctgg

SEQ ID NO: 1481592 - DNA, 18 bp, Homo sapiens
gagaagttcatatttctt

SEQ ID NO: 1481593 - DNA, 20 bp, Homo sapiens
gagaagttcccattattatt

SEQ ID NO: 1481594 - DNA, 19 bp, Homo sapiens
gagaagtttgtagccaggt

SEQ ID NO: 1481595 - DNA, 20 bp, Homo sapiens
gagaagtttgtagccaggta

SEQ ID NO: 1481596 - DNA, 23 bp, Homo sapiens
gagaagtttgtagccaggtactg

SEQ ID NO: 1481597 - DNA, 20 bp, Homo sapiens
gagagttaataggagtattt

SEQ ID NO: 1481598 - DNA, 22 bp, Homo sapiens
gagagttagcatgtatgaatgt

SEQ ID NO: 1481599 - DNA, 23 bp, Homo sapiens
gagagttagcatgtatgaatgta

SEQ ID NO: 1481600 - DNA, 16 bp, Homo sapiens
gagagttcaagcctgt

SEQ ID NO: 1481601 - DNA, 20 bp, Homo sapiens
gagagttcaagcctgtggga

SEQ ID NO: 1481602 - DNA, 13 bp, Homo sapiens
gagagttggctca

SEQ ID NO: 1481603 - DNA, 16 bp, Homo sapiens
gagagttggctcaggc

SEQ ID NO: 1481604 - DNA, 19 bp, Homo sapiens
gagagttggctcaggcaga

SEQ ID NO: 1481605 - DNA, 12 bp, Homo sapiens
gagagtttcaaa

SEQ ID NO: 1481606 - DNA, 15 bp, Homo sapiens
gagagttttgtcttg

SEQ ID NO: 1481607 - DNA, 17 bp, Homo sapiens
gagagttttgtcttgaa

SEQ ID NO: 1481608 - DNA, 22 bp, Homo sapiens
gagagttttgtcttgaatgtct

SEQ ID NO: 1481609 - DNA, 22 bp, Homo sapiens
gagataagaaaagcctgaacta

SEQ ID NO: 1481610 - DNA, 13 bp, Homo sapiens
gagataaggtttt

SEQ ID NO: 1481611 - DNA, 15 bp, Homo sapiens
gagataatatgagaa

SEQ ID NO: 1481612 - DNA, 19 bp, Homo sapiens
gagataattactgccttga

SEQ ID NO: 1481613 - DNA, 18 bp, Homo sapiens
gagatacgtctgtgactt

SEQ ID NO: 1481614 - DNA, 20 bp, Homo sapiens
gagatagacgggttgaaaga

SEQ ID NO: 1481615 - DNA, 23 bp, Homo sapiens
gagatagacgggttgaaagacat

SEQ ID NO: 1481616 - DNA, 21 bp, Homo sapiens
gagatatctgagggaggaggc

SEQ ID NO: 1481617 - DNA, 22 bp, Homo sapiens
gagatatttatggggggagaac

SEQ ID NO: 1481618 - DNA, 20 bp, Homo sapiens
gagatcaaagatgaaaagta

SEQ ID NO: 1481619 - DNA, 16 bp, Homo sapiens
gagatcacgccactgc

SEQ ID NO: 1481620 - DNA, 14 bp, Homo sapiens
gagatcagcattca

SEQ ID NO: 1481621 - DNA, 18 bp, Homo sapiens
gagatcagcattcaaaat

SEQ ID NO: 1481622 - DNA, 19 bp, Homo sapiens
gagatcatgaattatataa

SEQ ID NO: 1481623 - DNA, 22 bp, Homo sapiens
gagatccaaaagaagcccccag

SEQ ID NO: 1481624 - DNA, 14 bp, Homo sapiens
gagatccccagggc

SEQ ID NO: 1481625 - DNA, 16 bp, Homo sapiens
gagatccccagggcag

SEQ ID NO: 1481626 - DNA, 14 bp, Homo sapiens
gagatcctcctgca

SEQ ID NO: 1481627 - DNA, 18 bp, Homo sapiens
gagatcgaagaggccagt

SEQ ID NO: 1481628 - DNA, 19 bp, Homo sapiens
gagatcgagaccatcctgg

SEQ ID NO: 1481629 - DNA, 21 bp, Homo sapiens
gagatcgcgccactgcactcc

SEQ ID NO: 1481630 - DNA, 21 bp, Homo sapiens
gagatcgtgctactgcactcc

SEQ ID NO: 1481631 - DNA, 19 bp, Homo sapiens
gagatctaagcctttccat

SEQ ID NO: 1481632 - DNA, 21 bp, Homo sapiens
gagatctaagcctttccataa

SEQ ID NO: 1481633 - DNA, 12 bp, Homo sapiens
gagatctacaca

SEQ ID NO: 1481634 - DNA, 13 bp, Homo sapiens
gagatctacacat

SEQ ID NO: 1481635 - DNA, 18 bp, Homo sapiens
gagatctgcacagtcaga

SEQ ID NO: 1481636 - DNA, 17 bp, Homo sapiens
gagatctttctttccaa

SEQ ID NO: 1481637 - DNA, 21 bp, Homo sapiens
gagatgaagagtgagagggca

SEQ ID NO: 1481638 - DNA, 16 bp, Homo sapiens
gagatgaccagggatg

SEQ ID NO: 1481639 - DNA, 14 bp, Homo sapiens
gagatgagaaatga

SEQ ID NO: 1481640 - DNA, 22 bp, Homo sapiens
gagatgagaaatgatgaaaagg

SEQ ID NO: 1481641 - DNA, 17 bp, Homo sapiens
gagatgagtgtctggag

SEQ ID NO: 1481642 - DNA, 20 bp, Homo sapiens
gagatgcctccaccgctgcc

SEQ ID NO: 1481643 - DNA, 18 bp, Homo sapiens
gagatggaagcttgttga

SEQ ID NO: 1481644 - DNA, 20 bp, Homo sapiens
gagatggaagttgcagtgag

SEQ ID NO: 1481645 - DNA, 23 bp, Homo sapiens
gagatggaggtttccttttggaa

SEQ ID NO: 1481646 - DNA, 19 bp, Homo sapiens
gagatggcagattcccact

SEQ ID NO: 1481647 - DNA, 23 bp, Homo sapiens
gagatggtcagtgtggagagggg

SEQ ID NO: 1481648 - DNA, 15 bp, Homo sapiens
gagatgtagaaagtt

SEQ ID NO: 1481649 - DNA, 18 bp, Homo sapiens
gagatgtatgaaggcttt

SEQ ID NO: 1481650 - DNA, 20 bp, Homo sapiens
gagatgtatgtttggctctg

SEQ ID NO: 1481651 - DNA, 20 bp, Homo sapiens
gagatgtgtccatgtgaaat

SEQ ID NO: 1481652 - DNA, 18 bp, Homo sapiens
gagattctttaaggagat

SEQ ID NO: 1481653 - DNA, 16 bp, Homo sapiens
gagattggcatggctt

SEQ ID NO: 1481654 - DNA, 15 bp, Homo sapiens
gagatttcaagagat

SEQ ID NO: 1481655 - DNA, 19 bp, Homo sapiens
gagatttcatctgctctcc

SEQ ID NO: 1481656 - DNA, 15 bp, Homo sapiens
gagatttgggagctg

SEQ ID NO: 1481657 - DNA, 16 bp, Homo sapiens
gagatttgggagctga

SEQ ID NO: 1481658 - DNA, 20 bp, Homo sapiens
gagatttggggctaaagact

SEQ ID NO: 1481659 - DNA, 12 bp, Homo sapiens
gagatttgtcta

SEQ ID NO: 1481660 - DNA, 14 bp, Homo sapiens
gagattttctcttc

SEQ ID NO: 1481661 - DNA, 19 bp, Homo sapiens
gagatttttaaaaaatatt

SEQ ID NO: 1481662 - DNA, 23 bp, Homo sapiens
gagcaaaagacttgagccatcca

SEQ ID NO: 1481663 - DNA, 18 bp, Homo sapiens
gagcaaacccagaggtgg

SEQ ID NO: 1481664 - DNA, 14 bp, Homo sapiens
gagcaaagatcaaa

SEQ ID NO: 1481665 - DNA, 18 bp, Homo sapiens
gagcaaagatcaaaataa

SEQ ID NO: 1481666 - DNA, 19 bp, Homo sapiens
gagcaaagcgcccacccag

SEQ ID NO: 1481667 - DNA, 17 bp, Homo sapiens
gagcaaatgagggaggg

SEQ ID NO: 1481668 - DNA, 13 bp, Homo sapiens
gagcaacccctgt

SEQ ID NO: 1481669 - DNA, 15 bp, Homo sapiens
gagcaacctactgtc

SEQ ID NO: 1481670 - DNA, 18 bp, Homo sapiens
gagcaacctactgtctaa

SEQ ID NO: 1481671 - DNA, 19 bp, Homo sapiens
gagcaactgcgacaaaaca

SEQ ID NO: 1481672 - DNA, 23 bp, Homo sapiens
gagcaagaaggaaggaggcagac

SEQ ID NO: 1481673 - DNA, 18 bp, Homo sapiens
gagcaagaccctgtctct

SEQ ID NO: 1481674 - DNA, 12 bp, Homo sapiens
gagcaagactct

SEQ ID NO: 1481675 - DNA, 14 bp, Homo sapiens
gagcaagactctgt

SEQ ID NO: 1481676 - DNA, 20 bp, Homo sapiens
gagcaagcatttatgtttat

SEQ ID NO: 1481677 - DNA, 12 bp, Homo sapiens
gagcaagcctag

SEQ ID NO: 1481678 - DNA, 17 bp, Homo sapiens
gagcaatgtctgtgcta

SEQ ID NO: 1481679 - DNA, 19 bp, Homo sapiens
gagcaatgttggtttttta

SEQ ID NO: 1481680 - DNA, 15 bp, Homo sapiens
gagcaattccaggct

SEQ ID NO: 1481681 - DNA, 17 bp, Homo sapiens
gagcaattccaggctga

SEQ ID NO: 1481682 - DNA, 24 bp, Homo sapiens
gagcaattccaggctgagccatga

SEQ ID NO: 1481683 - DNA, 21 bp, Homo sapiens
gagcacaaaattcaaagcatg

SEQ ID NO: 1481684 - DNA, 21 bp, Homo sapiens
gagcacacaggtacagcaaca

SEQ ID NO: 1481685 - DNA, 14 bp, Homo sapiens
gagcacaggcagct

SEQ ID NO: 1481686 - DNA, 20 bp, Homo sapiens
gagcacatactacctagaag

SEQ ID NO: 1481687 - DNA, 23 bp, Homo sapiens
gagcacatagagctttttaatag

SEQ ID NO: 1481688 - DNA, 21 bp, Homo sapiens
gagcaccagatgacacataaa

SEQ ID NO: 1481689 - DNA, 13 bp, Homo sapiens
gagcaccaggcac

SEQ ID NO: 1481690 - DNA, 23 bp, Homo sapiens
gagcaccaggcacgaacccacct

SEQ ID NO: 1481691 - DNA, 16 bp, Homo sapiens
gagcaccccctgctcc

SEQ ID NO: 1481692 - DNA, 20 bp, Homo sapiens
gagcaccccctgctccacca

SEQ ID NO: 1481693 - DNA, 22 bp, Homo sapiens
gagcaccccctgctccaccagc

SEQ ID NO: 1481694 - DNA, 21 bp, Homo sapiens
gagcaccgtgtcaagctgctc

SEQ ID NO: 1481695 - DNA, 12 bp, Homo sapiens
gagcacctcacc

SEQ ID NO: 1481696 - DNA, 13 bp, Homo sapiens
gagcacctcacct

SEQ ID NO: 1481697 - DNA, 12 bp, Homo sapiens
gagcacctccca

SEQ ID NO: 1481698 - DNA, 15 bp, Homo sapiens
gagcacctcccagcc

SEQ ID NO: 1481699 - DNA, 15 bp, Homo sapiens
gagcacctgtctgga

SEQ ID NO: 1481700 - DNA, 13 bp, Homo sapiens
gagcacgcctgcc

SEQ ID NO: 1481701 - DNA, 14 bp, Homo sapiens
gagcacgcctgcca

SEQ ID NO: 1481702 - DNA, 22 bp, Homo sapiens
gagcacgcctgccatcttctcc

SEQ ID NO: 1481703 - DNA, 13 bp, Homo sapiens
gagcacggactct

SEQ ID NO: 1481704 - DNA, 21 bp, Homo sapiens
gagcactctgagtttaccatt

SEQ ID NO: 1481705 - DNA, 16 bp, Homo sapiens
gagcactggccagaga

SEQ ID NO: 1481706 - DNA, 23 bp, Homo sapiens
gagcactggccagagagggccca

SEQ ID NO: 1481707 - DNA, 17 bp, Homo sapiens
gagcactggggtggggg

SEQ ID NO: 1481708 - DNA, 22 bp, Homo sapiens
gagcagaatgttgtacttgaaa

SEQ ID NO: 1481709 - DNA, 12 bp, Homo sapiens
gagcagagacac

SEQ ID NO: 1481710 - DNA, 13 bp, Homo sapiens
gagcagagacact

SEQ ID NO: 1481711 - DNA, 24 bp, Homo sapiens
gagcagagacatgactcagcctgt

SEQ ID NO: 1481712 - DNA, 15 bp, Homo sapiens
gagcagatggacagc

SEQ ID NO: 1481713 - DNA, 21 bp, Homo sapiens
gagcagcagcaccaaccacag

SEQ ID NO: 1481714 - DNA, 13 bp, Homo sapiens
gagcagcagccag

SEQ ID NO: 1481715 - DNA, 15 bp, Homo sapiens
gagcagcaggtgctg

SEQ ID NO: 1481716 - DNA, 22 bp, Homo sapiens
gagcagccaaggccgccagcgt

SEQ ID NO: 1481717 - DNA, 21 bp, Homo sapiens
gagcagccgccagctgggagc

SEQ ID NO: 1481718 - DNA, 15 bp, Homo sapiens
gagcagcctctgcca

SEQ ID NO: 1481719 - DNA, 16 bp, Homo sapiens
gagcagcctctgccag

SEQ ID NO: 1481720 - DNA, 18 bp, Homo sapiens
gagcagcctctgccaggc

SEQ ID NO: 1481721 - DNA, 14 bp, Homo sapiens
gagcagcctgtggc

SEQ ID NO: 1481722 - DNA, 18 bp, Homo sapiens
gagcagcctgtggcatct

SEQ ID NO: 1481723 - DNA, 18 bp, Homo sapiens
gagcagcggtttggggag

SEQ ID NO: 1481724 - DNA, 22 bp, Homo sapiens
gagcagctaactccgagagcag

SEQ ID NO: 1481725 - DNA, 16 bp, Homo sapiens
gagcagcttccttctg

SEQ ID NO: 1481726 - DNA, 17 bp, Homo sapiens
gagcagcttccttctgg

SEQ ID NO: 1481727 - DNA, 19 bp, Homo sapiens
gagcagcttccttctggga

SEQ ID NO: 1481728 - DNA, 17 bp, Homo sapiens
gagcagcttttggtctc

SEQ ID NO: 1481729 - DNA, 22 bp, Homo sapiens
gagcagcttttggtctccttgg

SEQ ID NO: 1481730 - DNA, 11 bp, Homo sapiens
gagcaggaagc

SEQ ID NO: 1481731 - DNA, 16 bp, Homo sapiens
gagcaggaaggacagg

SEQ ID NO: 1481732 - DNA, 16 bp, Homo sapiens
gagcaggactccaggc

SEQ ID NO: 1481733 - DNA, 20 bp, Homo sapiens
gagcaggactccaggcccaa

SEQ ID NO: 1481734 - DNA, 11 bp, Homo sapiens
gagcaggagcc

SEQ ID NO: 1481735 - DNA, 16 bp, Homo sapiens
gagcaggaggcccctg

SEQ ID NO: 1481736 - DNA, 22 bp, Homo sapiens
gagcaggcacgggtggtccccg

SEQ ID NO: 1481737 - DNA, 20 bp, Homo sapiens
gagcaggcagggctgggcca

SEQ ID NO: 1481738 - DNA, 16 bp, Homo sapiens
gagcaggccagcccgg

SEQ ID NO: 1481739 - DNA, 21 bp, Homo sapiens
gagcaggctactgtcagctcc

SEQ ID NO: 1481740 - DNA, 17 bp, Homo sapiens
gagcaggctttgggaac

SEQ ID NO: 1481741 - DNA, 14 bp, Homo sapiens
gagcagggaaggcc

SEQ ID NO: 1481742 - DNA, 16 bp, Homo sapiens
gagcagggaaggcctg

SEQ ID NO: 1481743 - DNA, 17 bp, Homo sapiens
gagcagggaaggcctga

SEQ ID NO: 1481744 - DNA, 20 bp, Homo sapiens
gagcagggattaacctctgc

SEQ ID NO: 1481745 - DNA, 15 bp, Homo sapiens
gagcagggccaaagc

SEQ ID NO: 1481746 - DNA, 16 bp, Homo sapiens
gagcaggggcagggtg

SEQ ID NO: 1481747 - DNA, 14 bp, Homo sapiens
gagcaggggttggt

SEQ ID NO: 1481748 - DNA, 20 bp, Homo sapiens
gagcagggtccacagctgga

SEQ ID NO: 1481749 - DNA, 21 bp, Homo sapiens
gagcaggtgactgtgctgtgc

SEQ ID NO: 1481750 - DNA, 16 bp, Homo sapiens
gagcagtcacactgtt

SEQ ID NO: 1481751 - DNA, 17 bp, Homo sapiens
gagcagtcagggtggga

SEQ ID NO: 1481752 - DNA, 14 bp, Homo sapiens
gagcagtggctggt

SEQ ID NO: 1481753 - DNA, 13 bp, Homo sapiens
gagcagtgggcag

SEQ ID NO: 1481754 - DNA, 14 bp, Homo sapiens
gagcagtgggcagg

SEQ ID NO: 1481755 - DNA, 19 bp, Homo sapiens
gagcagtgggcaggtggcc

SEQ ID NO: 1481756 - DNA, 17 bp, Homo sapiens
gagcagtgtcttccata

SEQ ID NO: 1481757 - DNA, 20 bp, Homo sapiens
gagcagttggccaagcagaa

SEQ ID NO: 1481758 - DNA, 16 bp, Homo sapiens
gagcagttttcccctg

SEQ ID NO: 1481759 - DNA, 19 bp, Homo sapiens
gagcagttttcccctggcc

SEQ ID NO: 1481760 - DNA, 21 bp, Homo sapiens
gagcatacatcttaaatcttt

SEQ ID NO: 1481761 - DNA, 21 bp, Homo sapiens
gagcatatttgccaataaagc

SEQ ID NO: 1481762 - DNA, 23 bp, Homo sapiens
gagcatcaaaaacatcactccct

SEQ ID NO: 1481763 - DNA, 13 bp, Homo sapiens
gagcatcaatctt

SEQ ID NO: 1481764 - DNA, 19 bp, Homo sapiens
gagcatcccccaaagttca

SEQ ID NO: 1481765 - DNA, 19 bp, Homo sapiens
gagcatccttcccagcaga

SEQ ID NO: 1481766 - DNA, 13 bp, Homo sapiens
gagcatctcagga

SEQ ID NO: 1481767 - DNA, 19 bp, Homo sapiens
gagcatctcttgaggccag

SEQ ID NO: 1481768 - DNA, 22 bp, Homo sapiens
gagcatctcttgaggccaggag

SEQ ID NO: 1481769 - DNA, 20 bp, Homo sapiens
gagcatgcacagctgcttgt

SEQ ID NO: 1481770 - DNA, 16 bp, Homo sapiens
gagcatgcacatgctg

SEQ ID NO: 1481771 - DNA, 14 bp, Homo sapiens
gagcatggggcgct

SEQ ID NO: 1481772 - DNA, 17 bp, Homo sapiens
gagcatggggcgctccc

SEQ ID NO: 1481773 - DNA, 20 bp, Homo sapiens
gagcatggggcgctcccact

SEQ ID NO: 1481774 - DNA, 13 bp, Homo sapiens
gagcattccagta

SEQ ID NO: 1481775 - DNA, 17 bp, Homo sapiens
gagcatttaatggcagc

SEQ ID NO: 1481776 - DNA, 20 bp, Homo sapiens
gagccaaaggcatccaggcc

SEQ ID NO: 1481777 - DNA, 21 bp, Homo sapiens
gagccaacaagaccgccccag

SEQ ID NO: 1481778 - DNA, 16 bp, Homo sapiens
gagccaacctggactt

SEQ ID NO: 1481779 - DNA, 18 bp, Homo sapiens
gagccaacctggacttcc

SEQ ID NO: 1481780 - DNA, 23 bp, Homo sapiens
gagccaacctggacttcctgtca

SEQ ID NO: 1481781 - DNA, 22 bp, Homo sapiens
gagccaaccttaaacctcttct

SEQ ID NO: 1481782 - DNA, 11 bp, Homo sapiens
gagccaagacg

SEQ ID NO: 1481783 - DNA, 13 bp, Homo sapiens
gagccaagcactg

SEQ ID NO: 1481784 - DNA, 16 bp, Homo sapiens
gagccaagcactgctc

SEQ ID NO: 1481785 - DNA, 17 bp, Homo sapiens
gagccaagcactgctca

SEQ ID NO: 1481786 - DNA, 14 bp, Homo sapiens
gagccaaggacagg

SEQ ID NO: 1481787 - DNA, 15 bp, Homo sapiens
gagccaaggacaggg

SEQ ID NO: 1481788 - DNA, 24 bp, Homo sapiens
gagccaaggacagggctggctcct

SEQ ID NO: 1481789 - DNA, 21 bp, Homo sapiens
gagccaagtggtccagcgtca

SEQ ID NO: 1481790 - DNA, 17 bp, Homo sapiens
gagccacaagctgcact

SEQ ID NO: 1481791 - DNA, 18 bp, Homo sapiens
gagccacaagctgcactg

SEQ ID NO: 1481792 - DNA, 20 bp, Homo sapiens
gagccacaagctgcactgtg

SEQ ID NO: 1481793 - DNA, 12 bp, Homo sapiens
gagccacctcac

SEQ ID NO: 1481794 - DNA, 12 bp, Homo sapiens
gagccactcctg

SEQ ID NO: 1481795 - DNA, 16 bp, Homo sapiens
gagccactgagcctgg

SEQ ID NO: 1481796 - DNA, 11 bp, Homo sapiens
gagccagcagg

SEQ ID NO: 1481797 - DNA, 14 bp, Homo sapiens
gagccagccaggcc

SEQ ID NO: 1481798 - DNA, 12 bp, Homo sapiens
gagccagccctc

SEQ ID NO: 1481799 - DNA, 13 bp, Homo sapiens
gagccagccctcc

SEQ ID NO: 1481800 - DNA, 15 bp, Homo sapiens
gagccagccctccct

SEQ ID NO: 1481801 - DNA, 19 bp, Homo sapiens
gagccagccctccctgtcc

SEQ ID NO: 1481802 - DNA, 11 bp, Homo sapiens
gagccagcctg

SEQ ID NO: 1481803 - DNA, 12 bp, Homo sapiens
gagccagcctgg

SEQ ID NO: 1481804 - DNA, 14 bp, Homo sapiens
gagccagcctggct

SEQ ID NO: 1481805 - DNA, 20 bp, Homo sapiens
gagccagcctggctctgccc

SEQ ID NO: 1481806 - DNA, 17 bp, Homo sapiens
gagccagcggctccaac

SEQ ID NO: 1481807 - DNA, 18 bp, Homo sapiens
gagccagctccctctatt

SEQ ID NO: 1481808 - DNA, 11 bp, Homo sapiens
gagccagctgc

SEQ ID NO: 1481809 - DNA, 12 bp, Homo sapiens
gagccaggagaa

SEQ ID NO: 1481810 - DNA, 15 bp, Homo sapiens
gagccaggagaagct

SEQ ID NO: 1481811 - DNA, 23 bp, Homo sapiens
gagccaggagacctgctctccgg

SEQ ID NO: 1481812 - DNA, 11 bp, Homo sapiens
gagccaggagt

SEQ ID NO: 1481813 - DNA, 17 bp, Homo sapiens
gagccaggatgcccaga

SEQ ID NO: 1481814 - DNA, 17 bp, Homo sapiens
gagccagggaacagccc

SEQ ID NO: 1481815 - DNA, 18 bp, Homo sapiens
gagccagggaacagcccc

SEQ ID NO: 1481816 - DNA, 14 bp, Homo sapiens
gagccagggcagag

SEQ ID NO: 1481817 - DNA, 17 bp, Homo sapiens
gagccagggcagaggaa

SEQ ID NO: 1481818 - DNA, 19 bp, Homo sapiens
gagccaggttgtcgggccc

SEQ ID NO: 1481819 - DNA, 23 bp, Homo sapiens
gagccagtgagggcagtcctgca

SEQ ID NO: 1481820 - DNA, 23 bp, Homo sapiens
gagccagtggaacagcgggagac

SEQ ID NO: 1481821 - DNA, 19 bp, Homo sapiens
gagccagttgtcctatgga

SEQ ID NO: 1481822 - DNA, 22 bp, Homo sapiens
gagccagttgtcctatggacaa

SEQ ID NO: 1481823 - DNA, 11 bp, Homo sapiens
gagccataatg

SEQ ID NO: 1481824 - DNA, 23 bp, Homo sapiens
gagccatataagtttgaaggaaa

SEQ ID NO: 1481825 - DNA, 22 bp, Homo sapiens
gagccatcactagaagaaaagc

SEQ ID NO: 1481826 - DNA, 21 bp, Homo sapiens
gagctgggggaaggcaggagc

SEQ ID NO: 1481827 - DNA, 15 bp, Homo sapiens
gagctggggtacagg

SEQ ID NO: 1481828 - DNA, 19 bp, Homo sapiens
gagctggggtacaggtttg

SEQ ID NO: 1481829 - DNA, 15 bp, Homo sapiens
gagctggtgcccgga

SEQ ID NO: 1481830 - DNA, 16 bp, Homo sapiens
gagctgtcgctgcctc

SEQ ID NO: 1481831 - DNA, 18 bp, Homo sapiens
gagctgtcgctgcctcca

SEQ ID NO: 1481832 - DNA, 20 bp, Homo sapiens
gagctgtcttcctgtgtacc

SEQ ID NO: 1481833 - DNA, 12 bp, Homo sapiens
gagctgtgccag

SEQ ID NO: 1481834 - DNA, 16 bp, Homo sapiens
gagctgtgcctgctca

SEQ ID NO: 1481835 - DNA, 21 bp, Homo sapiens
gagctgtgcctgctcagcagc

SEQ ID NO: 1481836 - DNA, 19 bp, Homo sapiens
gagctgtggaggattgcta

SEQ ID NO: 1481837 - DNA, 22 bp, Homo sapiens
gagctgtggaggattgctatct

SEQ ID NO: 1481838 - DNA, 19 bp, Homo sapiens
gagctgtgttttgtctgag

SEQ ID NO: 1481839 - DNA, 16 bp, Homo sapiens
gagctgttaccattca

SEQ ID NO: 1481840 - DNA, 17 bp, Homo sapiens
gagctgttcacagccag

SEQ ID NO: 1481841 - DNA, 20 bp, Homo sapiens
gagctgtttatggcctcagc

SEQ ID NO: 1481842 - DNA, 22 bp, Homo sapiens
gagcttaatctttgaaaggtta

SEQ ID NO: 1481843 - DNA, 21 bp, Homo sapiens
gagcttaatgctacatgtgag

SEQ ID NO: 1481844 - DNA, 23 bp, Homo sapiens
gagcttacattgaaaacagatat

SEQ ID NO: 1481845 - DNA, 17 bp, Homo sapiens
gagcttagccaatgtgg

SEQ ID NO: 1481846 - DNA, 18 bp, Homo sapiens
gagcttattggccactgg

SEQ ID NO: 1481847 - DNA, 16 bp, Homo sapiens
gagcttcaatataaga

SEQ ID NO: 1481848 - DNA, 20 bp, Homo sapiens
gagcttcccacacctgcctg

SEQ ID NO: 1481849 - DNA, 22 bp, Homo sapiens
gagcttcccacacctgcctgcg

SEQ ID NO: 1481850 - DNA, 16 bp, Homo sapiens
gagcttctcccagtgt

SEQ ID NO: 1481851 - DNA, 14 bp, Homo sapiens
gagcttgcaagaag

SEQ ID NO: 1481852 - DNA, 12 bp, Homo sapiens
gagcttggcctt

SEQ ID NO: 1481853 - DNA, 24 bp, Homo sapiens
gagcttgtgctcctcttgattcct

SEQ ID NO: 1481854 - DNA, 22 bp, Homo sapiens
gagcttgtgtcctgtcctttct

SEQ ID NO: 1481855 - DNA, 15 bp, Homo sapiens
gagctttcaaagaag

SEQ ID NO: 1481856 - DNA, 18 bp, Homo sapiens
gagctttcaaagaaggaa

SEQ ID NO: 1481857 - DNA, 17 bp, Homo sapiens
gagctttccatgttgct

SEQ ID NO: 1481858 - DNA, 17 bp, Homo sapiens
gagctttctcaatgtct

SEQ ID NO: 1481859 - DNA, 20 bp, Homo sapiens
gagctttctcaatgtcttcc

SEQ ID NO: 1481860 - DNA, 22 bp, Homo sapiens
gagctttctcaatgtcttccca

SEQ ID NO: 1481861 - DNA, 14 bp, Homo sapiens
gagctttggaatat

SEQ ID NO: 1481862 - DNA, 17 bp, Homo sapiens
gagctttgggtgaccag

SEQ ID NO: 1481863 - DNA, 13 bp, Homo sapiens
gagcttttgatgc

SEQ ID NO: 1481864 - DNA, 16 bp, Homo sapiens
gagcttttgcccacac

SEQ ID NO: 1481865 - DNA, 21 bp, Homo sapiens
gaggaaaaatgggagccagga

SEQ ID NO: 1481866 - DNA, 22 bp, Homo sapiens
gaggaaaacactatttccaaaa

SEQ ID NO: 1481867 - DNA, 22 bp, Homo sapiens
gaggaaaagtaaccatcactgg

SEQ ID NO: 1481868 - DNA, 16 bp, Homo sapiens
gaggaaaatgagtatt

SEQ ID NO: 1481869 - DNA, 21 bp, Homo sapiens
gaggaaacagttctcactggg

SEQ ID NO: 1481870 - DNA, 15 bp, Homo sapiens
gaggaaagcaagtgt

SEQ ID NO: 1481871 - DNA, 13 bp, Homo sapiens
gaggaaaggattt

SEQ ID NO: 1481872 - DNA, 22 bp, Homo sapiens
gaggaaaggattttaccaaagc

SEQ ID NO: 1481873 - DNA, 16 bp, Homo sapiens
gaggaaagggcctggc

SEQ ID NO: 1481874 - DNA, 20 bp, Homo sapiens
gaggaaagtacattttttga

SEQ ID NO: 1481875 - DNA, 23 bp, Homo sapiens
gaggaacagtgtggtttgggaaa

SEQ ID NO: 1481876 - DNA, 18 bp, Homo sapiens
gaggaaccagaggcactt

SEQ ID NO: 1481877 - DNA, 20 bp, Homo sapiens
gaggaaccctgatctctcag

SEQ ID NO: 1481878 - DNA, 13 bp, Homo sapiens
gaggaagagcagg

SEQ ID NO: 1481879 - DNA, 17 bp, Homo sapiens
gaggaagagcaggcaca

SEQ ID NO: 1481880 - DNA, 13 bp, Homo sapiens
gaggaagagccac

SEQ ID NO: 1481881 - DNA, 16 bp, Homo sapiens
gaggaagagccacctg

SEQ ID NO: 1481882 - DNA, 13 bp, Homo sapiens
gaggaagcccaca

SEQ ID NO: 1481883 - DNA, 15 bp, Homo sapiens
gaggaagcccaggct

SEQ ID NO: 1481884 - DNA, 16 bp, Homo sapiens
gaggaaggacttccct

SEQ ID NO: 1481885 - DNA, 13 bp, Homo sapiens
gaggaaggcaaga

SEQ ID NO: 1481886 - DNA, 16 bp, Homo sapiens
gaggaaggcctttctt

SEQ ID NO: 1481887 - DNA, 14 bp, Homo sapiens
gaggaaggctgaac

SEQ ID NO: 1481888 - DNA, 21 bp, Homo sapiens
gaggaaggggggccgccgctg

SEQ ID NO: 1481889 - DNA, 18 bp, Homo sapiens
gaggaatagtgcttgctg

SEQ ID NO: 1481890 - DNA, 16 bp, Homo sapiens
gaggaatcctggcagc

SEQ ID NO: 1481891 - DNA, 17 bp, Homo sapiens
gaggaatcctggcagcc

SEQ ID NO: 1481892 - DNA, 20 bp, Homo sapiens
gaggaatcctggcagcccag

SEQ ID NO: 1481893 - DNA, 20 bp, Homo sapiens
gaggaatctgtgggtctggg

SEQ ID NO: 1481894 - DNA, 17 bp, Homo sapiens
gaggaatgctggactgg

SEQ ID NO: 1481895 - DNA, 18 bp, Homo sapiens
gaggaatggacatttcta

SEQ ID NO: 1481896 - DNA, 14 bp, Homo sapiens
gaggaatgtagggc

SEQ ID NO: 1481897 - DNA, 21 bp, Homo sapiens
gaggacacagcacaagggcac

SEQ ID NO: 1481898 - DNA, 22 bp, Homo sapiens
gaggacacagcacaagggcaca

SEQ ID NO: 1481899 - DNA, 20 bp, Homo sapiens
gaggacaccagtgaaagaag

SEQ ID NO: 1481900 - DNA, 16 bp, Homo sapiens
gaggacagagggcaca

SEQ ID NO: 1481901 - DNA, 15 bp, Homo sapiens
gaggacagcttgagc

SEQ ID NO: 1481902 - DNA, 22 bp, Homo sapiens
gaggacagtatttgtggggagg

SEQ ID NO: 1481903 - DNA, 19 bp, Homo sapiens
gaggacatcaaagtggtaa

SEQ ID NO: 1481904 - DNA, 22 bp, Homo sapiens
gaggaccactcctgtacactga

SEQ ID NO: 1481905 - DNA, 14 bp, Homo sapiens
gaggaccccttaat

SEQ ID NO: 1481906 - DNA, 21 bp, Homo sapiens
gaggaccccttaatcttgctt

SEQ ID NO: 1481907 - DNA, 12 bp, Homo sapiens
gaggacctccct

SEQ ID NO: 1481908 - DNA, 19 bp, Homo sapiens
gaggacctggcgtgctcag

SEQ ID NO: 1481909 - DNA, 22 bp, Homo sapiens
gaggacctggcgtgctcagacc

SEQ ID NO: 1481910 - DNA, 13 bp, Homo sapiens
gaggacgagaccc

SEQ ID NO: 1481911 - DNA, 18 bp, Homo sapiens
gaggactcccaaccctgg

SEQ ID NO: 1481912 - DNA, 20 bp, Homo sapiens
gaggactcccaaccctggct

SEQ ID NO: 1481913 - DNA, 16 bp, Homo sapiens
gaggactccgggacca

SEQ ID NO: 1481914 - DNA, 23 bp, Homo sapiens
gaggactccgggaccattgacct

SEQ ID NO: 1481915 - DNA, 22 bp, Homo sapiens
gaggacttgtgtctctgtgctt

SEQ ID NO: 1481916 - DNA, 19 bp, Homo sapiens
gaggagaaatgcaataact

SEQ ID NO: 1481917 - DNA, 20 bp, Homo sapiens
gaggagaaatgcaataactc

SEQ ID NO: 1481918 - DNA, 20 bp, Homo sapiens
gaggagaagaattttcagac

SEQ ID NO: 1481919 - DNA, 22 bp, Homo sapiens
gaggagaagtattcctgttgct

SEQ ID NO: 1481920 - DNA, 13 bp, Homo sapiens
gaggagaccagct

SEQ ID NO: 1481921 - DNA, 23 bp, Homo sapiens
gaggagacggaggggagtagaga

SEQ ID NO: 1481922 - DNA, 12 bp, Homo sapiens
gaggagagagac

SEQ ID NO: 1481923 - DNA, 13 bp, Homo sapiens
gaggagagagacc

SEQ ID NO: 1481924 - DNA, 14 bp, Homo sapiens
gaggagagagaccc

SEQ ID NO: 1481925 - DNA, 15 bp, Homo sapiens
gaggagagtcccaga

SEQ ID NO: 1481926 - DNA, 18 bp, Homo sapiens
gaggagatgaccagggat

SEQ ID NO: 1481927 - DNA, 20 bp, Homo sapiens
gaggagcagcttccttctgg

SEQ ID NO: 1481928 - DNA, 22 bp, Homo sapiens
gaggagcatgcgcagaggccag

SEQ ID NO: 1481929 - DNA, 14 bp, Homo sapiens
gaggagccccagct

SEQ ID NO: 1481930 - DNA, 12 bp, Homo sapiens
gaggagccctga

SEQ ID NO: 1481931 - DNA, 13 bp, Homo sapiens
gaggagcctcaga

SEQ ID NO: 1481932 - DNA, 22 bp, Homo sapiens
gaggagcctgtgcgtcccagct

SEQ ID NO: 1481933 - DNA, 16 bp, Homo sapiens
gaggagccttgctggg

SEQ ID NO: 1481934 - DNA, 19 bp, Homo sapiens
gaggagccttgctgggcca

SEQ ID NO: 1481935 - DNA, 20 bp, Homo sapiens
gaggagccttgctgggccag

SEQ ID NO: 1481936 - DNA, 15 bp, Homo sapiens
gaggagctgctggct

SEQ ID NO: 1481937 - DNA, 16 bp, Homo sapiens
gaggagctggaggggt

SEQ ID NO: 1481938 - DNA, 14 bp, Homo sapiens
gaggagctggcctg

SEQ ID NO: 1481939 - DNA, 22 bp, Homo sapiens
gaggagctggcctgtggcacag

SEQ ID NO: 1481940 - DNA, 18 bp, Homo sapiens
gagggcaggcttggggaa

SEQ ID NO: 1481941 - DNA, 15 bp, Homo sapiens
gagggcaggggtgct

SEQ ID NO: 1481942 - DNA, 20 bp, Homo sapiens
gagggcagggtccacgcctc

SEQ ID NO: 1481943 - DNA, 17 bp, Homo sapiens
gagggcagtacctggga

SEQ ID NO: 1481944 - DNA, 16 bp, Homo sapiens
gagggcagtgtttcct

SEQ ID NO: 1481945 - DNA, 18 bp, Homo sapiens
gagggcatgcgcacaagg

SEQ ID NO: 1481946 - DNA, 22 bp, Homo sapiens
gagggcatgcgcacaaggctga

SEQ ID NO: 1481947 - DNA, 13 bp, Homo sapiens
gagggccagcagg

SEQ ID NO: 1481948 - DNA, 21 bp, Homo sapiens
gagggcccagccaggagcaga

SEQ ID NO: 1481949 - DNA, 13 bp, Homo sapiens
gagggcccagccc

SEQ ID NO: 1481950 - DNA, 16 bp, Homo sapiens
gagggcccagcccaga

SEQ ID NO: 1481951 - DNA, 23 bp, Homo sapiens
gagggcccagcccagagccacct

SEQ ID NO: 1481952 - DNA, 13 bp, Homo sapiens
gagggcccagctg

SEQ ID NO: 1481953 - DNA, 22 bp, Homo sapiens
gagggcccagctgtagccatgg

SEQ ID NO: 1481954 - DNA, 18 bp, Homo sapiens
gagggcccatcaggcagt

SEQ ID NO: 1481955 - DNA, 20 bp, Homo sapiens
gagggcccctctgcccagct

SEQ ID NO: 1481956 - DNA, 20 bp, Homo sapiens
gagggcccctgcgtgggggc

SEQ ID NO: 1481957 - DNA, 15 bp, Homo sapiens
gagggccctacctga

SEQ ID NO: 1481958 - DNA, 17 bp, Homo sapiens
gagggccgcccgctccc

SEQ ID NO: 1481959 - DNA, 16 bp, Homo sapiens
gagggcctctgcctgg

SEQ ID NO: 1481960 - DNA, 16 bp, Homo sapiens
gagggcggagccggcc

SEQ ID NO: 1481961 - DNA, 13 bp, Homo sapiens
gagggcggcaggg

SEQ ID NO: 1481962 - DNA, 19 bp, Homo sapiens
gagggctcgaggggtgggc

SEQ ID NO: 1481963 - DNA, 22 bp, Homo sapiens
gagggctctgatctaacaaaat

SEQ ID NO: 1481964 - DNA, 20 bp, Homo sapiens
gagggctctgtttgtgggac

SEQ ID NO: 1481965 - DNA, 20 bp, Homo sapiens
gagggctgatggaggaaaaa

SEQ ID NO: 1481966 - DNA, 23 bp, Homo sapiens
gagggctggaggcccaggctggg

SEQ ID NO: 1481967 - DNA, 14 bp, Homo sapiens
gagggctggctggc

SEQ ID NO: 1481968 - DNA, 19 bp, Homo sapiens
gagggcttcctctagaagc

SEQ ID NO: 1481969 - DNA, 21 bp, Homo sapiens
gagggcttcctctagaagcca

SEQ ID NO: 1481970 - DNA, 14 bp, Homo sapiens
gaggggaagggcca

SEQ ID NO: 1481971 - DNA, 15 bp, Homo sapiens
gaggggaagggccag

SEQ ID NO: 1481972 - DNA, 16 bp, Homo sapiens
gaggggaaggggcggt

SEQ ID NO: 1481973 - DNA, 12 bp, Homo sapiens
gaggggagggta

SEQ ID NO: 1481974 - DNA, 15 bp, Homo sapiens
gaggggatccagcca

SEQ ID NO: 1481975 - DNA, 18 bp, Homo sapiens
gaggggcaacgaagaaaa

SEQ ID NO: 1481976 - DNA, 20 bp, Homo sapiens
gaggggcaacgaagaaaaaa

SEQ ID NO: 1481977 - DNA, 16 bp, Homo sapiens
gaggggcaagctaggc

SEQ ID NO: 1481978 - DNA, 17 bp, Homo sapiens
gaggggcaagctaggcc

SEQ ID NO: 1481979 - DNA, 13 bp, Homo sapiens
gaggggcagccct

SEQ ID NO: 1481980 - DNA, 16 bp, Homo sapiens
gaggggcagcccttgc

SEQ ID NO: 1481981 - DNA, 12 bp, Homo sapiens
gaggggcagcct

SEQ ID NO: 1481982 - DNA, 16 bp, Homo sapiens
gaggggcagcctgtgc

SEQ ID NO: 1481983 - DNA, 23 bp, Homo sapiens
gaggggcagcgcatgtgtgcatg

SEQ ID NO: 1481984 - DNA, 13 bp, Homo sapiens
gaggggcaggctg

SEQ ID NO: 1481985 - DNA, 14 bp, Homo sapiens
gaggggcaggctga

SEQ ID NO: 1481986 - DNA, 15 bp, Homo sapiens
gaggggcccacagga

SEQ ID NO: 1481987 - DNA, 13 bp, Homo sapiens
gaggggccctggc

SEQ ID NO: 1481988 - DNA, 18 bp, Homo sapiens
gaggggccctggccagga

SEQ ID NO: 1481989 - DNA, 19 bp, Homo sapiens
gaggggccctggccaggac

SEQ ID NO: 1481990 - DNA, 13 bp, Homo sapiens
gaggggcctaggg

SEQ ID NO: 1481991 - DNA, 16 bp, Homo sapiens
gaggggcctagggagc

SEQ ID NO: 1481992 - DNA, 20 bp, Homo sapiens
gaggggcctggcagccgtgc

SEQ ID NO: 1481993 - DNA, 16 bp, Homo sapiens
gaggggcgctggccca

SEQ ID NO: 1481994 - DNA, 18 bp, Homo sapiens
gaggggcgctggcccagc

SEQ ID NO: 1481995 - DNA, 22 bp, Homo sapiens
gaggggcgctggcccagccggc

SEQ ID NO: 1481996 - DNA, 21 bp, Homo sapiens
gaggggctccccgggtctctc

SEQ ID NO: 1481997 - DNA, 20 bp, Homo sapiens
gagggggcgctcaggaccca

SEQ ID NO: 1481998 - DNA, 17 bp, Homo sapiens
gaggggggtgctggccc

SEQ ID NO: 1481999 - DNA, 22 bp, Homo sapiens
gagggggtcatttcagagccct

SEQ ID NO: 1482000 - DNA, 15 bp, Homo sapiens
gagggggttacaaac

SEQ ID NO: 1482001 - DNA, 19 bp, Homo sapiens
gagggggttacaaactgca

SEQ ID NO: 1482002 - DNA, 20 bp, Homo sapiens
gaggggtccctagcagccca

SEQ ID NO: 1482003 - DNA, 16 bp, Homo sapiens
gaggggtctcggatga

SEQ ID NO: 1482004 - DNA, 23 bp, Homo sapiens
gaggggtctcggatgacaccctg

SEQ ID NO: 1482005 - DNA, 15 bp, Homo sapiens
gaggggtgcacccac

SEQ ID NO: 1482006 - DNA, 15 bp, Homo sapiens
gaggggtgggctggt

SEQ ID NO: 1482007 - DNA, 21 bp, Homo sapiens
gaggggtgggggtgccgctct

SEQ ID NO: 1482008 - DNA, 17 bp, Homo sapiens
gaggggtgtggcagtgg

SEQ ID NO: 1482009 - DNA, 21 bp, Homo sapiens
gaggggttacttctcccctgg

SEQ ID NO: 1482010 - DNA, 21 bp, Homo sapiens
gagggtaggagggtgggaagg

SEQ ID NO: 1482011 - DNA, 14 bp, Homo sapiens
gagggtccacctgg

SEQ ID NO: 1482012 - DNA, 18 bp, Homo sapiens
gagggtccacctggagag

SEQ ID NO: 1482013 - DNA, 21 bp, Homo sapiens
gagggtcctggctcctgaggg

SEQ ID NO: 1482014 - DNA, 11 bp, Homo sapiens
gagggtgactg

SEQ ID NO: 1482015 - DNA, 14 bp, Homo sapiens
gagggtggaggaag

SEQ ID NO: 1482016 - DNA, 14 bp, Homo sapiens
gagggtgggggagg

SEQ ID NO: 1482017 - DNA, 15 bp, Homo sapiens
gagggtgggggaggg

SEQ ID NO: 1482018 - DNA, 19 bp, Homo sapiens
gagggtgggttggggaggg

SEQ ID NO: 1482019 - DNA, 19 bp, Homo sapiens
gagggttcacacagcccag

SEQ ID NO: 1482020 - DNA, 18 bp, Homo sapiens
gagggttcccctggcctt

SEQ ID NO: 1482021 - DNA, 14 bp, Homo sapiens
gagggttggggagg

SEQ ID NO: 1482022 - DNA, 13 bp, Homo sapiens
gaggtaccctggg

SEQ ID NO: 1482023 - DNA, 14 bp, Homo sapiens
gaggtactggtccc

SEQ ID NO: 1482024 - DNA, 16 bp, Homo sapiens
gaggtagttaagggat

SEQ ID NO: 1482025 - DNA, 19 bp, Homo sapiens
gaggtcaaggctgcagtga

SEQ ID NO: 1482026 - DNA, 16 bp, Homo sapiens
gaggtcaagtaagaag

SEQ ID NO: 1482027 - DNA, 12 bp, Homo sapiens
gaggtcactgct

SEQ ID NO: 1482028 - DNA, 22 bp, Homo sapiens
gaggtcatctggcggaggtctc

SEQ ID NO: 1482029 - DNA, 14 bp, Homo sapiens
gaggtccaagcaga

SEQ ID NO: 1482030 - DNA, 21 bp, Homo sapiens
gaggtccagctgggcctcctg

SEQ ID NO: 1482031 - DNA, 16 bp, Homo sapiens
gaggtcctctggagcc

SEQ ID NO: 1482032 - DNA, 19 bp, Homo sapiens
gaggtccttaggcctctga

SEQ ID NO: 1482033 - DNA, 21 bp, Homo sapiens
gaggtcggtaggttcagccaa

SEQ ID NO: 1482034 - DNA, 22 bp, Homo sapiens
gaggtcggtaggttcagccaag

SEQ ID NO: 1482035 - DNA, 23 bp, Homo sapiens
gaggtcggtaggttcagccaagg

SEQ ID NO: 1482036 - DNA, 12 bp, Homo sapiens
gaggtctccagg

SEQ ID NO: 1482037 - DNA, 14 bp, Homo sapiens
gaggtctctgggag

SEQ ID NO: 1482038 - DNA, 15 bp, Homo sapiens
gaggtctcttgaggg

SEQ ID NO: 1482039 - DNA, 18 bp, Homo sapiens
gaggtctcttgagggagc

SEQ ID NO: 1482040 - DNA, 12 bp, Homo sapiens
gaggtctgagcc

SEQ ID NO: 1482041 - DNA, 15 bp, Homo sapiens
gaggtctgagccctg

SEQ ID NO: 1482042 - DNA, 15 bp, Homo sapiens
gaggtctgattggct

SEQ ID NO: 1482043 - DNA, 16 bp, Homo sapiens
gaggtctgattggctg

SEQ ID NO: 1482044 - DNA, 21 bp, Homo sapiens
gaggtctgattggctgcttaa

SEQ ID NO: 1482045 - DNA, 13 bp, Homo sapiens
gaggtctggctga

SEQ ID NO: 1482046 - DNA, 19 bp, Homo sapiens
gaggtgcaagacctagtcc

SEQ ID NO: 1482047 - DNA, 21 bp, Homo sapiens
gaggtgcaagacctagtcccc

SEQ ID NO: 1482048 - DNA, 22 bp, Homo sapiens
gaggtgcaggggaagaccaaag

SEQ ID NO: 1482049 - DNA, 21 bp, Homo sapiens
gaggtgcctgtcccaccccca

SEQ ID NO: 1482050 - DNA, 16 bp, Homo sapiens
gaggtgcgctcacctc

SEQ ID NO: 1482051 - DNA, 22 bp, Homo sapiens
gaggtgcgctcacctcagagca

SEQ ID NO: 1482052 - DNA, 13 bp, Homo sapiens
gaggtgctgatga

SEQ ID NO: 1482053 - DNA, 15 bp, Homo sapiens
gaggtggaagaaggg

SEQ ID NO: 1482054 - DNA, 18 bp, Homo sapiens
gaggtggaagaagggaga

SEQ ID NO: 1482055 - DNA, 16 bp, Homo sapiens
gagttgttttcagact

SEQ ID NO: 1482056 - DNA, 19 bp, Homo sapiens
gagtttaaaaaaataacat

SEQ ID NO: 1482057 - DNA, 17 bp, Homo sapiens
gagtttaagaccagcct

SEQ ID NO: 1482058 - DNA, 17 bp, Homo sapiens
gagtttaccatttgtaa

SEQ ID NO: 1482059 - DNA, 22 bp, Homo sapiens
gagtttaccatttgtaataaag

SEQ ID NO: 1482060 - DNA, 13 bp, Homo sapiens
gagtttattacaa

SEQ ID NO: 1482061 - DNA, 17 bp, Homo sapiens
gagtttcctatgggaac

SEQ ID NO: 1482062 - DNA, 17 bp, Homo sapiens
gagtttgagacaagccc

SEQ ID NO: 1482063 - DNA, 22 bp, Homo sapiens
gagtttgagacaagccctggca

SEQ ID NO: 1482064 - DNA, 21 bp, Homo sapiens
gagtttgtaaaattgttcctg

SEQ ID NO: 1482065 - DNA, 17 bp, Homo sapiens
gagtttgtcgctcatgt

SEQ ID NO: 1482066 - DNA, 15 bp, Homo sapiens
gagtttgtgtctgtt

SEQ ID NO: 1482067 - DNA, 18 bp, Homo sapiens
gagtttgtgtgttgtctt

SEQ ID NO: 1482068 - DNA, 23 bp, Homo sapiens
gagtttgtgttgttgttgctgct

SEQ ID NO: 1482069 - DNA, 13 bp, Homo sapiens
gagttttgatttg

SEQ ID NO: 1482070 - DNA, 18 bp, Homo sapiens
gagttttgtgtttgttgt

SEQ ID NO: 1482071 - DNA, 22 bp, Homo sapiens
gagttttgtgtttgttgtagat

SEQ ID NO: 1482072 - DNA, 18 bp, Homo sapiens
gagtttttaaagccttct

SEQ ID NO: 1482073 - DNA, 18 bp, Homo sapiens
gagtttttatggggctga

SEQ ID NO: 1482074 - DNA, 23 bp, Homo sapiens
gataaaagaatggccaaaccctc

SEQ ID NO: 1482075 - DNA, 16 bp, Homo sapiens
gataaaagatggccat

SEQ ID NO: 1482076 - DNA, 19 bp, Homo sapiens
gataaaatcataagtattt

SEQ ID NO: 1482077 - DNA, 23 bp, Homo sapiens
gataaaatcataagtatttggaa

SEQ ID NO: 1482078 - DNA, 13 bp, Homo sapiens
gataaacattaaa

SEQ ID NO: 1482079 - DNA, 18 bp, Homo sapiens
gataaacattaaacactg

SEQ ID NO: 1482080 - DNA, 18 bp, Homo sapiens
gataaacctagataaaga

SEQ ID NO: 1482081 - DNA, 22 bp, Homo sapiens
gataaactgagcctcacttgcc

SEQ ID NO: 1482082 - DNA, 15 bp, Homo sapiens
gataaagcacagctg

SEQ ID NO: 1482083 - DNA, 15 bp, Homo sapiens
gataaagttccttaa

SEQ ID NO: 1482084 - DNA, 18 bp, Homo sapiens
gataaatcataaagtcag

SEQ ID NO: 1482085 - DNA, 21 bp, Homo sapiens
gataaatccttaacatttctc

SEQ ID NO: 1482086 - DNA, 18 bp, Homo sapiens
gataaattactataaaga

SEQ ID NO: 1482087 - DNA, 22 bp, Homo sapiens
gataacaaaaaataaattttaa

SEQ ID NO: 1482088 - DNA, 22 bp, Homo sapiens
gataacaaccttttacattgtg

SEQ ID NO: 1482089 - DNA, 12 bp, Homo sapiens
gataacaccttg

SEQ ID NO: 1482090 - DNA, 22 bp, Homo sapiens
gataacagggattgattttaaa

SEQ ID NO: 1482091 - DNA, 16 bp, Homo sapiens
gataactctctttcct

SEQ ID NO: 1482092 - DNA, 20 bp, Homo sapiens
gataagaaaagcctgaacta

SEQ ID NO: 1482093 - DNA, 22 bp, Homo sapiens
gataagaatgctggttttccta

SEQ ID NO: 1482094 - DNA, 16 bp, Homo sapiens
gataagcttcaaagct

SEQ ID NO: 1482095 - DNA, 15 bp, Homo sapiens
gataaggcctgtggg

SEQ ID NO: 1482096 - DNA, 15 bp, Homo sapiens
gataagttggagcag

SEQ ID NO: 1482097 - DNA, 17 bp, Homo sapiens
gataagttggagcaggg

SEQ ID NO: 1482098 - DNA, 22 bp, Homo sapiens
gataagtttctattctgtcagt

SEQ ID NO: 1482099 - DNA, 15 bp, Homo sapiens
gataataataataat

SEQ ID NO: 1482100 - DNA, 14 bp, Homo sapiens
gataatagattctc

SEQ ID NO: 1482101 - DNA, 17 bp, Homo sapiens
gataatatataaacaat

SEQ ID NO: 1482102 - DNA, 14 bp, Homo sapiens
gataatatctgtga

SEQ ID NO: 1482103 - DNA, 15 bp, Homo sapiens
gataatattagtgat

SEQ ID NO: 1482104 - DNA, 21 bp, Homo sapiens
gataatattagtgattctgat

SEQ ID NO: 1482105 - DNA, 14 bp, Homo sapiens
gataatattgtctg

SEQ ID NO: 1482106 - DNA, 15 bp, Homo sapiens
gataatattgtttgg

SEQ ID NO: 1482107 - DNA, 22 bp, Homo sapiens
gataatgttctttaatgttgtc

SEQ ID NO: 1482108 - DNA, 15 bp, Homo sapiens
gataattcaacattt

SEQ ID NO: 1482109 - DNA, 13 bp, Homo sapiens
gataattcatttg

SEQ ID NO: 1482110 - DNA, 15 bp, Homo sapiens
gataattcatttgta

SEQ ID NO: 1482111 - DNA, 19 bp, Homo sapiens
gataattcatttgtattgc

SEQ ID NO: 1482112 - DNA, 20 bp, Homo sapiens
gataattcatttgtattgct

SEQ ID NO: 1482113 - DNA, 22 bp, Homo sapiens
gataattttatttataaactag

SEQ ID NO: 1482114 - DNA, 18 bp, Homo sapiens
gatacaaaagctttttaa

SEQ ID NO: 1482115 - DNA, 23 bp, Homo sapiens
gatacaaaagctttttaaaattt

SEQ ID NO: 1482116 - DNA, 16 bp, Homo sapiens
gatacaaatgtctatc

SEQ ID NO: 1482117 - DNA, 22 bp, Homo sapiens
gatacaagtttcagacagggtc

SEQ ID NO: 1482118 - DNA, 19 bp, Homo sapiens
gatacacccaaagtatcag

SEQ ID NO: 1482119 - DNA, 16 bp, Homo sapiens
gatacagatctcaggg

SEQ ID NO: 1482120 - DNA, 12 bp, Homo sapiens
gatacatttaat

SEQ ID NO: 1482121 - DNA, 18 bp, Homo sapiens
gataccaaggtacaactg

SEQ ID NO: 1482122 - DNA, 20 bp, Homo sapiens
gataccacaaaccctgctga

SEQ ID NO: 1482123 - DNA, 18 bp, Homo sapiens
gatacccaggaccaagcc

SEQ ID NO: 1482124 - DNA, 23 bp, Homo sapiens
gatacctcagccctggccctgcc

SEQ ID NO: 1482125 - DNA, 18 bp, Homo sapiens
gataccttcttatttaat

SEQ ID NO: 1482126 - DNA, 14 bp, Homo sapiens
gatacgaaatcagt

SEQ ID NO: 1482127 - DNA, 16 bp, Homo sapiens
gatacgcatcagacag

SEQ ID NO: 1482128 - DNA, 16 bp, Homo sapiens
gatactcacatgagtt

SEQ ID NO: 1482129 - DNA, 13 bp, Homo sapiens
gatactctgtcag

SEQ ID NO: 1482130 - DNA, 18 bp, Homo sapiens
gatactgcgactttctgc

SEQ ID NO: 1482131 - DNA, 21 bp, Homo sapiens
gatactgcgactttctgcctg

SEQ ID NO: 1482132 - DNA, 16 bp, Homo sapiens
gatactggaagttttg

SEQ ID NO: 1482133 - DNA, 13 bp, Homo sapiens
gatactggcacag

SEQ ID NO: 1482134 - DNA, 22 bp, Homo sapiens
gatactgtgagcttacattgaa

SEQ ID NO: 1482135 - DNA, 21 bp, Homo sapiens
gatacttagtggtatgtctct

SEQ ID NO: 1482136 - DNA, 22 bp, Homo sapiens
gatacttctgaaataaatgttc

SEQ ID NO: 1482137 - DNA, 17 bp, Homo sapiens
gatactttagccatcat

SEQ ID NO: 1482138 - DNA, 23 bp, Homo sapiens
gatagaacacaaaacttgaaaga

SEQ ID NO: 1482139 - DNA, 13 bp, Homo sapiens
gatagaactgtac

SEQ ID NO: 1482140 - DNA, 21 bp, Homo sapiens
gatagacgggttgaaagacat

SEQ ID NO: 1482141 - DNA, 15 bp, Homo sapiens
gatagaggaaaggga

SEQ ID NO: 1482142 - DNA, 20 bp, Homo sapiens
gatagagtaaaaagaaaaca

SEQ ID NO: 1482143 - DNA, 13 bp, Homo sapiens
gatagagttccat

SEQ ID NO: 1482144 - DNA, 12 bp, Homo sapiens
gatagatgctgg

SEQ ID NO: 1482145 - DNA, 16 bp, Homo sapiens
gatagatgctggccca

SEQ ID NO: 1482146 - DNA, 17 bp, Homo sapiens
gatagatgctggcccag

SEQ ID NO: 1482147 - DNA, 21 bp, Homo sapiens
gatagatgctggcccagggcc

SEQ ID NO: 1482148 - DNA, 13 bp, Homo sapiens
gatagatgtgtgg

SEQ ID NO: 1482149 - DNA, 14 bp, Homo sapiens
gatagatgtgtgga

SEQ ID NO: 1482150 - DNA, 15 bp, Homo sapiens
gatagatttggaata

SEQ ID NO: 1482151 - DNA, 20 bp, Homo sapiens
gatagcaagtgaatttttct

SEQ ID NO: 1482152 - DNA, 20 bp, Homo sapiens
gatagcatggggcccctggc

SEQ ID NO: 1482153 - DNA, 23 bp, Homo sapiens
gatagcatggggcccctggccca

SEQ ID NO: 1482154 - DNA, 13 bp, Homo sapiens
gatagcattgctt

SEQ ID NO: 1482155 - DNA, 16 bp, Homo sapiens
gatagctaactgtaaa

SEQ ID NO: 1482156 - DNA, 15 bp, Homo sapiens
gatagcttacactga

SEQ ID NO: 1482157 - DNA, 16 bp, Homo sapiens
gatagcttacactgag

SEQ ID NO: 1482158 - DNA, 19 bp, Homo sapiens
gatagcttacactgaggac

SEQ ID NO: 1482159 - DNA, 13 bp, Homo sapiens
gataggaaactga

SEQ ID NO: 1482160 - DNA, 14 bp, Homo sapiens
gataggaaactgaa

SEQ ID NO: 1482161 - DNA, 17 bp, Homo sapiens
gataggaactgtctcaa

SEQ ID NO: 1482162 - DNA, 22 bp, Homo sapiens
gataggaactgtctcaaaagga

SEQ ID NO: 1482163 - DNA, 23 bp, Homo sapiens
gataggcctgtgggccagattgc

SEQ ID NO: 1482164 - DNA, 13 bp, Homo sapiens
gatagtaagcata

SEQ ID NO: 1482165 - DNA, 13 bp, Homo sapiens
gatagtcacctgc

SEQ ID NO: 1482166 - DNA, 23 bp, Homo sapiens
gatagtcttggaagctgtttgga

SEQ ID NO: 1482167 - DNA, 14 bp, Homo sapiens
gatagtctttcagt

SEQ ID NO: 1482168 - DNA, 19 bp, Homo sapiens
gatagtgggatttccagaa

SEQ ID NO: 1482169 - DNA, 20 bp, Homo sapiens
gatagtgttctgctcctgct

SEQ ID NO: 1482170 - DNA, 14 bp, Homo sapiens
gatagttttctcct

SEQ ID NO: 1482171 - DNA, 16 bp, Homo sapiens
gatataaaatgaaaga

SEQ ID NO: 1482172 - DNA, 15 bp, Homo sapiens
gatataaatggctgg

SEQ ID NO: 1482173 - DNA, 14 bp, Homo sapiens
gatataaattttta

SEQ ID NO: 1482174 - DNA, 12 bp, Homo sapiens
gatataagagaa

SEQ ID NO: 1482175 - DNA, 15 bp, Homo sapiens
gatataagagaagtc

SEQ ID NO: 1482176 - DNA, 20 bp, Homo sapiens
gatataagagaagtctcatt

SEQ ID NO: 1482177 - DNA, 22 bp, Homo sapiens
gatataatagtagatttgaaca

SEQ ID NO: 1482178 - DNA, 16 bp, Homo sapiens
gatatacaaagtgtac

SEQ ID NO: 1482179 - DNA, 18 bp, Homo sapiens
gatatacacggatgactt

SEQ ID NO: 1482180 - DNA, 15 bp, Homo sapiens
gatatactgtgtgct

SEQ ID NO: 1482181 - DNA, 13 bp, Homo sapiens
gatatacttgttt

SEQ ID NO: 1482182 - DNA, 17 bp, Homo sapiens
gatatacttgtttttgt

SEQ ID NO: 1482183 - DNA, 15 bp, Homo sapiens
gatatagaaagctgt

SEQ ID NO: 1482184 - DNA, 21 bp, Homo sapiens
gatatagagtcattgtaatgt

SEQ ID NO: 1482185 - DNA, 21 bp, Homo sapiens
gatatagttttacttttaaac

SEQ ID NO: 1482186 - DNA, 21 bp, Homo sapiens
gatatataatggtaatagaat

SEQ ID NO: 1482187 - DNA, 15 bp, Homo sapiens
gatatatacaaggtg

SEQ ID NO: 1482188 - DNA, 20 bp, Homo sapiens
gatatatgtgtttttcacat

SEQ ID NO: 1482189 - DNA, 13 bp, Homo sapiens
gatatatttgaaa

SEQ ID NO: 1482190 - DNA, 18 bp, Homo sapiens
gatatatttgaaatagta

SEQ ID NO: 1482191 - DNA, 20 bp, Homo sapiens
gatatatttgaaatagtata

SEQ ID NO: 1482192 - DNA, 14 bp, Homo sapiens
gatatattttacaa

SEQ ID NO: 1482193 - DNA, 15 bp, Homo sapiens
gatatatttttcaca

SEQ ID NO: 1482194 - DNA, 18 bp, Homo sapiens
gatatcagggtataaatt

SEQ ID NO: 1482195 - DNA, 16 bp, Homo sapiens
gatatcatgcaaattt

SEQ ID NO: 1482196 - DNA, 17 bp, Homo sapiens
gatatctataaaataga

SEQ ID NO: 1482197 - DNA, 15 bp, Homo sapiens
gatatctgagggagg

SEQ ID NO: 1482198 - DNA, 20 bp, Homo sapiens
gatatctgagggaggaggcc

SEQ ID NO: 1482199 - DNA, 13 bp, Homo sapiens
gatatctgcatgt

SEQ ID NO: 1482200 - DNA, 15 bp, Homo sapiens
gatatgaaagctgat

SEQ ID NO: 1482201 - DNA, 14 bp, Homo sapiens
gatatgatttaaaa

SEQ ID NO: 1482202 - DNA, 20 bp, Homo sapiens
gatatgatttaaaacatgta

SEQ ID NO: 1482203 - DNA, 15 bp, Homo sapiens
gatatgcaaaagctg

SEQ ID NO: 1482204 - DNA, 11 bp, Homo sapiens
gatatgctgct

SEQ ID NO: 1482205 - DNA, 21 bp, Homo sapiens
gatatggagtgagtcacctgc

SEQ ID NO: 1482206 - DNA, 13 bp, Homo sapiens
gatatgggactga

SEQ ID NO: 1482207 - DNA, 22 bp, Homo sapiens
gatatgggactgagcctggccc

SEQ ID NO: 1482208 - DNA, 18 bp, Homo sapiens
gatatggtgaagggaagt

SEQ ID NO: 1482209 - DNA, 18 bp, Homo sapiens
gatatgtatgggtagggt

SEQ ID NO: 1482210 - DNA, 20 bp, Homo sapiens
gatatgtattcttttctcag

SEQ ID NO: 1482211 - DNA, 16 bp, Homo sapiens
gatatgttgatcagcc

SEQ ID NO: 1482212 - DNA, 17 bp, Homo sapiens
gatatgttgttaaacac

SEQ ID NO: 1482213 - DNA, 18 bp, Homo sapiens
gatattaaaacacaaagt

SEQ ID NO: 1482214 - DNA, 20 bp, Homo sapiens
gatattagttaatgagccat

SEQ ID NO: 1482215 - DNA, 14 bp, Homo sapiens
gatattatttcttc

SEQ ID NO: 1482216 - DNA, 21 bp, Homo sapiens
gatattccatgaatgtatcag

SEQ ID NO: 1482217 - DNA, 13 bp, Homo sapiens
gatattgaatgtt

SEQ ID NO: 1482218 - DNA, 19 bp, Homo sapiens
gatattgccttatttgtct

SEQ ID NO: 1482219 - DNA, 22 bp, Homo sapiens
gatattgccttatttgtctgta

SEQ ID NO: 1482220 - DNA, 16 bp, Homo sapiens
gatattgctaattgtg

SEQ ID NO: 1482221 - DNA, 17 bp, Homo sapiens
gatattgctaattgtgt

SEQ ID NO: 1482222 - DNA, 15 bp, Homo sapiens
gatattgtacataaa

SEQ ID NO: 1482223 - DNA, 16 bp, Homo sapiens
gatattgttttctgta

SEQ ID NO: 1482224 - DNA, 20 bp, Homo sapiens
gatatttaagaaaatacaat

SEQ ID NO: 1482225 - DNA, 13 bp, Homo sapiens
gatatttcaatct

SEQ ID NO: 1482226 - DNA, 17 bp, Homo sapiens
gatatttcttgctttca

SEQ ID NO: 1482227 - DNA, 19 bp, Homo sapiens
gatatttgcctgtctgttt

SEQ ID NO: 1482228 - DNA, 11 bp, Homo sapiens
gatatttttat

SEQ ID NO: 1482229 - DNA, 17 bp, Homo sapiens
gatatttttatctttat

SEQ ID NO: 1482230 - DNA, 17 bp, Homo sapiens
gatatttttcataaaca

SEQ ID NO: 1482231 - DNA, 18 bp, Homo sapiens
gatatttttccatttatt

SEQ ID NO: 1482232 - DNA, 14 bp, Homo sapiens
gatcaaaaataaac

SEQ ID NO: 1482233 - DNA, 23 bp, Homo sapiens
gatcaaaaataaactagtttcca

SEQ ID NO: 1482234 - DNA, 22 bp, Homo sapiens
gatcaaaacctgtgccaggctg

SEQ ID NO: 1482235 - DNA, 20 bp, Homo sapiens
gatcaaaaccttccttccct

SEQ ID NO: 1482236 - DNA, 20 bp, Homo sapiens
gatcaaaataaaaagtgaca

SEQ ID NO: 1482237 - DNA, 22 bp, Homo sapiens
gatcaaaataaaaagtgacaca

SEQ ID NO: 1482238 - DNA, 15 bp, Homo sapiens
gatcaaagatgaaaa

SEQ ID NO: 1482239 - DNA, 14 bp, Homo sapiens
gatcaacatctttt

SEQ ID NO: 1482240 - DNA, 20 bp, Homo sapiens
gatcaacatcttttcttgcc

SEQ ID NO: 1482241 - DNA, 18 bp, Homo sapiens
gatcaacgcctcactgaa

SEQ ID NO: 1482242 - DNA, 22 bp, Homo sapiens
gatcaagagtccggatttctaa

SEQ ID NO: 1482243 - DNA, 23 bp, Homo sapiens
gatcaagtcggatctagtccagc

SEQ ID NO: 1482244 - DNA, 19 bp, Homo sapiens
gatcaataaaatgtgattt

SEQ ID NO: 1482245 - DNA, 21 bp, Homo sapiens
gatcacacagtgttagtgctg

SEQ ID NO: 1482246 - DNA, 13 bp, Homo sapiens
gatcacaggcctt

SEQ ID NO: 1482247 - DNA, 22 bp, Homo sapiens
gatcacagtgactttacaggag

SEQ ID NO: 1482248 - DNA, 17 bp, Homo sapiens
gatcacatcttaaattc

SEQ ID NO: 1482249 - DNA, 19 bp, Homo sapiens
gatcacatcttaaattcat

SEQ ID NO: 1482250 - DNA, 18 bp, Homo sapiens
gatcaccagcccggcctg

SEQ ID NO: 1482251 - DNA, 22 bp, Homo sapiens
gatcaccagcccggcctgctcc

SEQ ID NO: 1482252 - DNA, 13 bp, Homo sapiens
gatcacctgaggt

SEQ ID NO: 1482253 - DNA, 14 bp, Homo sapiens
gatcacctgaggtt

SEQ ID NO: 1482254 - DNA, 24 bp, Homo sapiens
gatcacgccactgcactccagcct

SEQ ID NO: 1482255 - DNA, 22 bp, Homo sapiens
gatcacgccattgtactccagc

SEQ ID NO: 1482256 - DNA, 23 bp, Homo sapiens
gatcacgccattgtactccagcc

SEQ ID NO: 1482257 - DNA, 16 bp, Homo sapiens
gatcactgaatttata

SEQ ID NO: 1482258 - DNA, 17 bp, Homo sapiens
gatcactgaatttataa

SEQ ID NO: 1482259 - DNA, 13 bp, Homo sapiens
gatcactgccaca

SEQ ID NO: 1482260 - DNA, 18 bp, Homo sapiens
gatcactggctggcctga

SEQ ID NO: 1482261 - DNA, 19 bp, Homo sapiens
gatcacttgagttcaggag

SEQ ID NO: 1482262 - DNA, 15 bp, Homo sapiens
gatcacttgttgttt

SEQ ID NO: 1482263 - DNA, 22 bp, Homo sapiens
gatcactttctcagttttcata

SEQ ID NO: 1482264 - DNA, 16 bp, Homo sapiens
gatcagaaagtgacat

SEQ ID NO: 1482265 - DNA, 15 bp, Homo sapiens
gatcagaacagcaga

SEQ ID NO: 1482266 - DNA, 16 bp, Homo sapiens
gatcagaacattcagc

SEQ ID NO: 1482267 - DNA, 16 bp, Homo sapiens
gatcagagttcctcct

SEQ ID NO: 1482268 - DNA, 17 bp, Homo sapiens
gatcagatgctccaaga

SEQ ID NO: 1482269 - DNA, 21 bp, Homo sapiens
gatcagatgctccaagattct

SEQ ID NO: 1482270 - DNA, 19 bp, Homo sapiens
gatcagcaaaccggggcct

SEQ ID NO: 1482271 - DNA, 17 bp, Homo sapiens
gatcagcattcaaaata

SEQ ID NO: 1482272 - DNA, 24 bp, Homo sapiens
gatcagcattcaaaatagttctat

SEQ ID NO: 1482273 - DNA, 17 bp, Homo sapiens
gatcagctgtttgtcat

SEQ ID NO: 1482274 - DNA, 13 bp, Homo sapiens
gatcaggcttcct

SEQ ID NO: 1482275 - DNA, 20 bp, Homo sapiens
gatcaggttatactttaggt

SEQ ID NO: 1482276 - DNA, 23 bp, Homo sapiens
gatcagtcctttgatcagtataa

SEQ ID NO: 1482277 - DNA, 13 bp, Homo sapiens
gatcataaggctt

SEQ ID NO: 1482278 - DNA, 21 bp, Homo sapiens
gatcatgaattatataatttt

SEQ ID NO: 1482279 - DNA, 21 bp, Homo sapiens
gatcatgtgtggaagttatta

SEQ ID NO: 1482280 - DNA, 13 bp, Homo sapiens
gatcattaaaaaa

SEQ ID NO: 1482281 - DNA, 18 bp, Homo sapiens
gatcatttgttggaatga

SEQ ID NO: 1482282 - DNA, 19 bp, Homo sapiens
gatcattttccccccactc

SEQ ID NO: 1482283 - DNA, 18 bp, Homo sapiens
gatgccacgcctggaagg

SEQ ID NO: 1482284 - DNA, 19 bp, Homo sapiens
gatgccactcctccctccg

SEQ ID NO: 1482285 - DNA, 18 bp, Homo sapiens
gatgccacttctcactca

SEQ ID NO: 1482286 - DNA, 17 bp, Homo sapiens
gatgccagagggccagc

SEQ ID NO: 1482287 - DNA, 21 bp, Homo sapiens
gatgccagagggccagcaggc

SEQ ID NO: 1482288 - DNA, 12 bp, Homo sapiens
gatgccagcttc

SEQ ID NO: 1482289 - DNA, 14 bp, Homo sapiens
gatgccagcttctc

SEQ ID NO: 1482290 - DNA, 13 bp, Homo sapiens
gatgccaggtgca

SEQ ID NO: 1482291 - DNA, 13 bp, Homo sapiens
gatgccatggcct

SEQ ID NO: 1482292 - DNA, 21 bp, Homo sapiens
gatgccattacagaaccaaat

SEQ ID NO: 1482293 - DNA, 20 bp, Homo sapiens
gatgccattcttccttgcaa

SEQ ID NO: 1482294 - DNA, 22 bp, Homo sapiens
gatgcccagagggcccaggcag

SEQ ID NO: 1482295 - DNA, 23 bp, Homo sapiens
gatgcccagagggcccaggcagg

SEQ ID NO: 1482296 - DNA, 21 bp, Homo sapiens
gatgcccagggccactctgcc

SEQ ID NO: 1482297 - DNA, 16 bp, Homo sapiens
gatgccccagagctgt

SEQ ID NO: 1482298 - DNA, 22 bp, Homo sapiens
gatgcccctgcagtttggccct

SEQ ID NO: 1482299 - DNA, 23 bp, Homo sapiens
gatgcccctgcagtttggccctg

SEQ ID NO: 1482300 - DNA, 21 bp, Homo sapiens
gatgccgttctgttccaacct

SEQ ID NO: 1482301 - DNA, 20 bp, Homo sapiens
gatgcctccaccgctgccta

SEQ ID NO: 1482302 - DNA, 12 bp, Homo sapiens
gatgcctcccca

SEQ ID NO: 1482303 - DNA, 13 bp, Homo sapiens
gatgcctccccaa

SEQ ID NO: 1482304 - DNA, 14 bp, Homo sapiens
gatgcctccccaag

SEQ ID NO: 1482305 - DNA, 12 bp, Homo sapiens
gatgcctccttg

SEQ ID NO: 1482306 - DNA, 16 bp, Homo sapiens
gatgcctgcatgctga

SEQ ID NO: 1482307 - DNA, 22 bp, Homo sapiens
gatgcggccattcaaggggagc

SEQ ID NO: 1482308 - DNA, 19 bp, Homo sapiens
gatgcgttcagcagactgg

SEQ ID NO: 1482309 - DNA, 20 bp, Homo sapiens
gatgctagaaaaatgttctt

SEQ ID NO: 1482310 - DNA, 18 bp, Homo sapiens
gatgctatggaacataaa

SEQ ID NO: 1482311 - DNA, 22 bp, Homo sapiens
gatgctccaagattctagatga

SEQ ID NO: 1482312 - DNA, 16 bp, Homo sapiens
gatgctccagggcagc

SEQ ID NO: 1482313 - DNA, 15 bp, Homo sapiens
gatgctccctcccct

SEQ ID NO: 1482314 - DNA, 20 bp, Homo sapiens
gatgctccctcccctgccct

SEQ ID NO: 1482315 - DNA, 18 bp, Homo sapiens
gatgctctttcccaggac

SEQ ID NO: 1482316 - DNA, 19 bp, Homo sapiens
gatgctgacctcacctggt

SEQ ID NO: 1482317 - DNA, 17 bp, Homo sapiens
gatgctgactgtactcc

SEQ ID NO: 1482318 - DNA, 20 bp, Homo sapiens
gatgctgactgtactcctcc

SEQ ID NO: 1482319 - DNA, 12 bp, Homo sapiens
gatgctgaggcc

SEQ ID NO: 1482320 - DNA, 13 bp, Homo sapiens
gatgctgaggcca

SEQ ID NO: 1482321 - DNA, 17 bp, Homo sapiens
gatgctgaggccaccca

SEQ ID NO: 1482322 - DNA, 14 bp, Homo sapiens
gatgctgatggagc

SEQ ID NO: 1482323 - DNA, 14 bp, Homo sapiens
gatgctgcagcaga

SEQ ID NO: 1482324 - DNA, 13 bp, Homo sapiens
gatgctgcccctc

SEQ ID NO: 1482325 - DNA, 14 bp, Homo sapiens
gatgctgctccgcc

SEQ ID NO: 1482326 - DNA, 12 bp, Homo sapiens
gatgctgctttc

SEQ ID NO: 1482327 - DNA, 15 bp, Homo sapiens
gatgctgctttcccc

SEQ ID NO: 1482328 - DNA, 12 bp, Homo sapiens
gatgctggccca

SEQ ID NO: 1482329 - DNA, 16 bp, Homo sapiens
gatgctggcccagggc

SEQ ID NO: 1482330 - DNA, 21 bp, Homo sapiens
gatgctggcccagggcccaga

SEQ ID NO: 1482331 - DNA, 17 bp, Homo sapiens
gatgctgggcaatgagg

SEQ ID NO: 1482332 - DNA, 19 bp, Homo sapiens
gatgctgggttggtgcaca

SEQ ID NO: 1482333 - DNA, 17 bp, Homo sapiens
gatgctgtaaataggtt

SEQ ID NO: 1482334 - DNA, 16 bp, Homo sapiens
gatgctgtgctatgaa

SEQ ID NO: 1482335 - DNA, 17 bp, Homo sapiens
gatgctgtgtatatggt

SEQ ID NO: 1482336 - DNA, 20 bp, Homo sapiens
gatgcttggagcaatcagaa

SEQ ID NO: 1482337 - DNA, 20 bp, Homo sapiens
gatgcttgtaacaagaaaac

SEQ ID NO: 1482338 - DNA, 22 bp, Homo sapiens
gatggaaaaaccacccccaaat

SEQ ID NO: 1482339 - DNA, 18 bp, Homo sapiens
gatggaaaaactgaggct

SEQ ID NO: 1482340 - DNA, 15 bp, Homo sapiens
gatggaaaaggaaga

SEQ ID NO: 1482341 - DNA, 17 bp, Homo sapiens
gatggaaaaggaagact

SEQ ID NO: 1482342 - DNA, 16 bp, Homo sapiens
gatggaaaataaacat

SEQ ID NO: 1482343 - DNA, 17 bp, Homo sapiens
gatggaaaataaacatc

SEQ ID NO: 1482344 - DNA, 17 bp, Homo sapiens
gatggaaaattcatttt

SEQ ID NO: 1482345 - DNA, 21 bp, Homo sapiens
gatggaaattctgaaaactga

SEQ ID NO: 1482346 - DNA, 13 bp, Homo sapiens
gatggaatgatgg

SEQ ID NO: 1482347 - DNA, 14 bp, Homo sapiens
gatggaatggaaaa

SEQ ID NO: 1482348 - DNA, 15 bp, Homo sapiens
gatggaattcttcct

SEQ ID NO: 1482349 - DNA, 18 bp, Homo sapiens
gatggacacgagccacaa

SEQ ID NO: 1482350 - DNA, 13 bp, Homo sapiens
gatggaccccagc

SEQ ID NO: 1482351 - DNA, 14 bp, Homo sapiens
gatggaccccagca

SEQ ID NO: 1482352 - DNA, 21 bp, Homo sapiens
gatggaccgggtgggcctggc

SEQ ID NO: 1482353 - DNA, 22 bp, Homo sapiens
gatggaccgggtgggcctggcc

SEQ ID NO: 1482354 - DNA, 16 bp, Homo sapiens
gatggagaaagaagtg

SEQ ID NO: 1482355 - DNA, 19 bp, Homo sapiens
gatggagaaagaagtggag

SEQ ID NO: 1482356 - DNA, 15 bp, Homo sapiens
gatggaggaaaaagg

SEQ ID NO: 1482357 - DNA, 13 bp, Homo sapiens
gatggaggagaag

SEQ ID NO: 1482358 - DNA, 14 bp, Homo sapiens
gatggagtgtgcag

SEQ ID NO: 1482359 - DNA, 18 bp, Homo sapiens
gatggagtgtgcagacag

SEQ ID NO: 1482360 - DNA, 16 bp, Homo sapiens
gatggagttcttgtgc

SEQ ID NO: 1482361 - DNA, 19 bp, Homo sapiens
gatggagttcttgtgccat

SEQ ID NO: 1482362 - DNA, 13 bp, Homo sapiens
gatggagtttcta

SEQ ID NO: 1482363 - DNA, 15 bp, Homo sapiens
gatggagtttctaag

SEQ ID NO: 1482364 - DNA, 18 bp, Homo sapiens
gatggataaactgagcct

SEQ ID NO: 1482365 - DNA, 17 bp, Homo sapiens
gatggattctccactca

SEQ ID NO: 1482366 - DNA, 14 bp, Homo sapiens
gatggatttgcctg

SEQ ID NO: 1482367 - DNA, 15 bp, Homo sapiens
gatggatttgtatca

SEQ ID NO: 1482368 - DNA, 15 bp, Homo sapiens
gatggcaacagatct

SEQ ID NO: 1482369 - DNA, 16 bp, Homo sapiens
gatggcaacagatctg

SEQ ID NO: 1482370 - DNA, 17 bp, Homo sapiens
gatggcaacagatctgg

SEQ ID NO: 1482371 - DNA, 12 bp, Homo sapiens
gatggcaccctg

SEQ ID NO: 1482372 - DNA, 14 bp, Homo sapiens
gatggcagagccag

SEQ ID NO: 1482373 - DNA, 16 bp, Homo sapiens
gatggcagagccaggc

SEQ ID NO: 1482374 - DNA, 22 bp, Homo sapiens
gatggcatttggtctcaggcag

SEQ ID NO: 1482375 - DNA, 23 bp, Homo sapiens
gatggcatttggtctcaggcagc

SEQ ID NO: 1482376 - DNA, 18 bp, Homo sapiens
gatggccaagggggtgga

SEQ ID NO: 1482377 - DNA, 15 bp, Homo sapiens
gatggccaggccagg

SEQ ID NO: 1482378 - DNA, 12 bp, Homo sapiens
gatggccccagc

SEQ ID NO: 1482379 - DNA, 14 bp, Homo sapiens
gatggccccagcac

SEQ ID NO: 1482380 - DNA, 15 bp, Homo sapiens
gatggcccctccagc

SEQ ID NO: 1482381 - DNA, 16 bp, Homo sapiens
gatggcccctccagca

SEQ ID NO: 1482382 - DNA, 18 bp, Homo sapiens
gatggccgggctgctgct

SEQ ID NO: 1482383 - DNA, 17 bp, Homo sapiens
gatggccttaatttcct

SEQ ID NO: 1482384 - DNA, 21 bp, Homo sapiens
gatggcgattccctctcaccc

SEQ ID NO: 1482385 - DNA, 14 bp, Homo sapiens
gatggctgctgcct

SEQ ID NO: 1482386 - DNA, 19 bp, Homo sapiens
gatggctggaaggggtcca

SEQ ID NO: 1482387 - DNA, 23 bp, Homo sapiens
gatggctgggtccttgggcctgg

SEQ ID NO: 1482388 - DNA, 20 bp, Homo sapiens
gatggctgtggcatttccaa

SEQ ID NO: 1482389 - DNA, 21 bp, Homo sapiens
gatggctgtggcatttccaaa

SEQ ID NO: 1482390 - DNA, 15 bp, Homo sapiens
gatggcttgtctata

SEQ ID NO: 1482391 - DNA, 14 bp, Homo sapiens
gatgggaaaatatt

SEQ ID NO: 1482392 - DNA, 18 bp, Homo sapiens
gatgggaaaatatttcct

SEQ ID NO: 1482393 - DNA, 16 bp, Homo sapiens
gatgggaaagcattgt

SEQ ID NO: 1482394 - DNA, 17 bp, Homo sapiens
gatgggaacagtaaaga

SEQ ID NO: 1482395 - DNA, 23 bp, Homo sapiens
gatgggaaggttagaaaggcagc

SEQ ID NO: 1482396 - DNA, 23 bp, Homo sapiens
gatgggactagagctttctttca

SEQ ID NO: 1482397 - DNA, 15 bp, Homo sapiens
gatgggagtgagaca

SEQ ID NO: 1482398 - DNA, 13 bp, Homo sapiens
gatgtttgtgtca

SEQ ID NO: 1482399 - DNA, 23 bp, Homo sapiens
gatgttttgccgtggcttgggga

SEQ ID NO: 1482400 - DNA, 16 bp, Homo sapiens
gatgttttgtataaaa

SEQ ID NO: 1482401 - DNA, 21 bp, Homo sapiens
gatgttttgtataaaatctga

SEQ ID NO: 1482402 - DNA, 21 bp, Homo sapiens
gatgttttgtcccatttcctt

SEQ ID NO: 1482403 - DNA, 16 bp, Homo sapiens
gattaaaaatgctttt

SEQ ID NO: 1482404 - DNA, 12 bp, Homo sapiens
gattaaaggaag

SEQ ID NO: 1482405 - DNA, 14 bp, Homo sapiens
gattaaaggaagga

SEQ ID NO: 1482406 - DNA, 17 bp, Homo sapiens
gattaaataagattcta

SEQ ID NO: 1482407 - DNA, 20 bp, Homo sapiens
gattaaatgtgtcattggaa

SEQ ID NO: 1482408 - DNA, 16 bp, Homo sapiens
gattaacaatgtattt

SEQ ID NO: 1482409 - DNA, 19 bp, Homo sapiens
gattaacaatgtattttaa

SEQ ID NO: 1482410 - DNA, 21 bp, Homo sapiens
gattaacaggtatgaaccacc

SEQ ID NO: 1482411 - DNA, 19 bp, Homo sapiens
gattaactcttagaagtgt

SEQ ID NO: 1482412 - DNA, 18 bp, Homo sapiens
gattaacttggatgagtt

SEQ ID NO: 1482413 - DNA, 13 bp, Homo sapiens
gattaagagccat

SEQ ID NO: 1482414 - DNA, 20 bp, Homo sapiens
gattaatctctaaaattcta

SEQ ID NO: 1482415 - DNA, 22 bp, Homo sapiens
gattaatctctaaaattctagt

SEQ ID NO: 1482416 - DNA, 21 bp, Homo sapiens
gattaatgtcaatgttaatca

SEQ ID NO: 1482417 - DNA, 13 bp, Homo sapiens
gattaatgtttct

SEQ ID NO: 1482418 - DNA, 16 bp, Homo sapiens
gattaatgttttgtac

SEQ ID NO: 1482419 - DNA, 16 bp, Homo sapiens
gattacaaatcagaag

SEQ ID NO: 1482420 - DNA, 14 bp, Homo sapiens
gattacacacgtga

SEQ ID NO: 1482421 - DNA, 15 bp, Homo sapiens
gattacaccactgca

SEQ ID NO: 1482422 - DNA, 20 bp, Homo sapiens
gattacagggatgagccacc

SEQ ID NO: 1482423 - DNA, 14 bp, Homo sapiens
gattacatgcatgt

SEQ ID NO: 1482424 - DNA, 14 bp, Homo sapiens
gattagaaggcaag

SEQ ID NO: 1482425 - DNA, 15 bp, Homo sapiens
gattagattgcaaag

SEQ ID NO: 1482426 - DNA, 14 bp, Homo sapiens
gattaggcacacag

SEQ ID NO: 1482427 - DNA, 22 bp, Homo sapiens
gattagttgaaaggcctcaaga

SEQ ID NO: 1482428 - DNA, 16 bp, Homo sapiens
gattataaaaaatgta

SEQ ID NO: 1482429 - DNA, 20 bp, Homo sapiens
gattataaaaaatgtaacat

SEQ ID NO: 1482430 - DNA, 14 bp, Homo sapiens
gattataatatgtg

SEQ ID NO: 1482431 - DNA, 13 bp, Homo sapiens
gattataattgtt

SEQ ID NO: 1482432 - DNA, 15 bp, Homo sapiens
gattatagattctaa

SEQ ID NO: 1482433 - DNA, 14 bp, Homo sapiens
gattatataaaata

SEQ ID NO: 1482434 - DNA, 23 bp, Homo sapiens
gattatcagtatcacgatttgca

SEQ ID NO: 1482435 - DNA, 21 bp, Homo sapiens
gattatctctttgatctactt

SEQ ID NO: 1482436 - DNA, 22 bp, Homo sapiens
gattatctctttgatctacttg

SEQ ID NO: 1482437 - DNA, 12 bp, Homo sapiens
gattatcttcag

SEQ ID NO: 1482438 - DNA, 17 bp, Homo sapiens
gattatgggtcacagga

SEQ ID NO: 1482439 - DNA, 17 bp, Homo sapiens
gattatgggtcctgcaa

SEQ ID NO: 1482440 - DNA, 19 bp, Homo sapiens
gattatgggtcctgcaatt

SEQ ID NO: 1482441 - DNA, 15 bp, Homo sapiens
gattatggttttgtg

SEQ ID NO: 1482442 - DNA, 16 bp, Homo sapiens
gattatgttcctgctg

SEQ ID NO: 1482443 - DNA, 21 bp, Homo sapiens
gattatgttcctgctgtattt

SEQ ID NO: 1482444 - DNA, 13 bp, Homo sapiens
gattattataaac

SEQ ID NO: 1482445 - DNA, 14 bp, Homo sapiens
gattattataaact

SEQ ID NO: 1482446 - DNA, 13 bp, Homo sapiens
gattattcattta

SEQ ID NO: 1482447 - DNA, 15 bp, Homo sapiens
gattattcatttaaa

SEQ ID NO: 1482448 - DNA, 21 bp, Homo sapiens
gattattgagttccagttgaa

SEQ ID NO: 1482449 - DNA, 18 bp, Homo sapiens
gattattttttatactgt

SEQ ID NO: 1482450 - DNA, 17 bp, Homo sapiens
gattattttttttttct

SEQ ID NO: 1482451 - DNA, 16 bp, Homo sapiens
gattcaaactgctcca

SEQ ID NO: 1482452 - DNA, 18 bp, Homo sapiens
gattcaaaggttctaggt

SEQ ID NO: 1482453 - DNA, 23 bp, Homo sapiens
gattcaaagtgttgtgttcctgg

SEQ ID NO: 1482454 - DNA, 22 bp, Homo sapiens
gattcaatctgtaaactgtgta

SEQ ID NO: 1482455 - DNA, 18 bp, Homo sapiens
gattcaattataattgta

SEQ ID NO: 1482456 - DNA, 20 bp, Homo sapiens
gattcacccccctctgctgc

SEQ ID NO: 1482457 - DNA, 21 bp, Homo sapiens
gattcacccccctctgctgcc

SEQ ID NO: 1482458 - DNA, 21 bp, Homo sapiens
gattcaccctgtccaaactgc

SEQ ID NO: 1482459 - DNA, 17 bp, Homo sapiens
gattcacctcttcctct

SEQ ID NO: 1482460 - DNA, 17 bp, Homo sapiens
gattcactgtcttttga

SEQ ID NO: 1482461 - DNA, 12 bp, Homo sapiens
gattcagaaatt

SEQ ID NO: 1482462 - DNA, 15 bp, Homo sapiens
gattcagaatgagaa

SEQ ID NO: 1482463 - DNA, 15 bp, Homo sapiens
gattcagatcgaaat

SEQ ID NO: 1482464 - DNA, 15 bp, Homo sapiens
gattcagccctcaga

SEQ ID NO: 1482465 - DNA, 14 bp, Homo sapiens
gattcagtcacatg

SEQ ID NO: 1482466 - DNA, 22 bp, Homo sapiens
gattcagtcacatggcatggtt

SEQ ID NO: 1482467 - DNA, 15 bp, Homo sapiens
gattcagtcttctgg

SEQ ID NO: 1482468 - DNA, 17 bp, Homo sapiens
gattcagtcttctggat

SEQ ID NO: 1482469 - DNA, 13 bp, Homo sapiens
gattcatcctggg

SEQ ID NO: 1482470 - DNA, 23 bp, Homo sapiens
gattcatttcctgcccttcctca

SEQ ID NO: 1482471 - DNA, 17 bp, Homo sapiens
gattccactacacctgg

SEQ ID NO: 1482472 - DNA, 19 bp, Homo sapiens
gattccagagagtggctcc

SEQ ID NO: 1482473 - DNA, 22 bp, Homo sapiens
gattccagagagtggctcctcc

SEQ ID NO: 1482474 - DNA, 19 bp, Homo sapiens
gattcccagagacaggaaa

SEQ ID NO: 1482475 - DNA, 21 bp, Homo sapiens
gattcccagagacaggaaaat

SEQ ID NO: 1482476 - DNA, 21 bp, Homo sapiens
gattcccctaacctcattccc

SEQ ID NO: 1482477 - DNA, 14 bp, Homo sapiens
gattcccctgtgtc

SEQ ID NO: 1482478 - DNA, 17 bp, Homo sapiens
gattcctgacccaggcc

SEQ ID NO: 1482479 - DNA, 12 bp, Homo sapiens
gattcctggctc

SEQ ID NO: 1482480 - DNA, 12 bp, Homo sapiens
gattcctgggcc

SEQ ID NO: 1482481 - DNA, 14 bp, Homo sapiens
gattcctgggcctg

SEQ ID NO: 1482482 - DNA, 15 bp, Homo sapiens
gattcctgggcctgt

SEQ ID NO: 1482483 - DNA, 13 bp, Homo sapiens
gattcctggtttg

SEQ ID NO: 1482484 - DNA, 20 bp, Homo sapiens
gattcctggtttgactcagt

SEQ ID NO: 1482485 - DNA, 20 bp, Homo sapiens
gattccttttgatggggaga

SEQ ID NO: 1482486 - DNA, 16 bp, Homo sapiens
gattccttttttcaaa

SEQ ID NO: 1482487 - DNA, 18 bp, Homo sapiens
gattcgctgtcccctcag

SEQ ID NO: 1482488 - DNA, 16 bp, Homo sapiens
gattctaaaacattct

SEQ ID NO: 1482489 - DNA, 15 bp, Homo sapiens
gattctaaagattct

SEQ ID NO: 1482490 - DNA, 17 bp, Homo sapiens
gattctaaagattctat

SEQ ID NO: 1482491 - DNA, 20 bp, Homo sapiens
gattctaaagattctatagt

SEQ ID NO: 1482492 - DNA, 13 bp, Homo sapiens
gattctaaagctc

SEQ ID NO: 1482493 - DNA, 14 bp, Homo sapiens
gattctaaatacat

SEQ ID NO: 1482494 - DNA, 19 bp, Homo sapiens
gattctaatttttaagcaa

SEQ ID NO: 1482495 - DNA, 17 bp, Homo sapiens
gattctactcttgtcat

SEQ ID NO: 1482496 - DNA, 18 bp, Homo sapiens
gattctactcttgtcatt

SEQ ID NO: 1482497 - DNA, 18 bp, Homo sapiens
gattctagatcagatgct

SEQ ID NO: 1482498 - DNA, 19 bp, Homo sapiens
gattctagatcagatgctc

SEQ ID NO: 1482499 - DNA, 21 bp, Homo sapiens
gattctagatcagatgctcca

SEQ ID NO: 1482500 - DNA, 15 bp, Homo sapiens
gattctatagttcta

SEQ ID NO: 1482501 - DNA, 18 bp, Homo sapiens
gattctatagttctagac

SEQ ID NO: 1482502 - DNA, 19 bp, Homo sapiens
gattctatagttctagaca

SEQ ID NO: 1482503 - DNA, 21 bp, Homo sapiens
gattctatgcctgtatttcca

SEQ ID NO: 1482504 - DNA, 18 bp, Homo sapiens
gattctcaaaggagcgag

SEQ ID NO: 1482505 - DNA, 18 bp, Homo sapiens
gattctcccgcctcagcc

SEQ ID NO: 1482506 - DNA, 17 bp, Homo sapiens
gattctccttcagccct

SEQ ID NO: 1482507 - DNA, 18 bp, Homo sapiens
gattctccttcagccctc

SEQ ID NO: 1482508 - DNA, 16 bp, Homo sapiens
gattctctgcccagcc

SEQ ID NO: 1482509 - DNA, 22 bp, Homo sapiens
gattctctgtgtctaagattct

SEQ ID NO: 1482510 - DNA, 22 bp, Homo sapiens
gattctgatttcagtttttcat

SEQ ID NO: 1482511 - DNA, 17 bp, Homo sapiens
gattctggataaagcca

SEQ ID NO: 1482512 - DNA, 22 bp, Homo sapiens
gattctggataaagccactgaa

SEQ ID NO: 1482513 - DNA, 19 bp, Homo sapiens
gatttgtagcactgagggt

SEQ ID NO: 1482514 - DNA, 14 bp, Homo sapiens
gatttgtcccagcc

SEQ ID NO: 1482515 - DNA, 20 bp, Homo sapiens
gatttgtcccagcctggggc

SEQ ID NO: 1482516 - DNA, 21 bp, Homo sapiens
gatttgtcccagcctggggct

SEQ ID NO: 1482517 - DNA, 16 bp, Homo sapiens
gatttgttttgaattt

SEQ ID NO: 1482518 - DNA, 12 bp, Homo sapiens
gattttaaaatg

SEQ ID NO: 1482519 - DNA, 21 bp, Homo sapiens
gattttaagtttctctgcaga

SEQ ID NO: 1482520 - DNA, 22 bp, Homo sapiens
gattttaatagggaatatatct

SEQ ID NO: 1482521 - DNA, 23 bp, Homo sapiens
gattttaatagggaatatatctc

SEQ ID NO: 1482522 - DNA, 19 bp, Homo sapiens
gattttaatttatttgttt

SEQ ID NO: 1482523 - DNA, 18 bp, Homo sapiens
gattttacatgtggccca

SEQ ID NO: 1482524 - DNA, 22 bp, Homo sapiens
gattttagatttctttgattgt

SEQ ID NO: 1482525 - DNA, 19 bp, Homo sapiens
gattttaggagctaaggct

SEQ ID NO: 1482526 - DNA, 19 bp, Homo sapiens
gattttatgatcagtgttg

SEQ ID NO: 1482527 - DNA, 13 bp, Homo sapiens
gattttatgttta

SEQ ID NO: 1482528 - DNA, 18 bp, Homo sapiens
gattttattcttatttca

SEQ ID NO: 1482529 - DNA, 13 bp, Homo sapiens
gattttattcttg

SEQ ID NO: 1482530 - DNA, 15 bp, Homo sapiens
gattttatttgacaa

SEQ ID NO: 1482531 - DNA, 21 bp, Homo sapiens
gattttcaagattctaaagct

SEQ ID NO: 1482532 - DNA, 21 bp, Homo sapiens
gattttcctgaaacactaaag

SEQ ID NO: 1482533 - DNA, 15 bp, Homo sapiens
gattttctggttcta

SEQ ID NO: 1482534 - DNA, 15 bp, Homo sapiens
gattttctttctatg

SEQ ID NO: 1482535 - DNA, 16 bp, Homo sapiens
gattttctttctatgt

SEQ ID NO: 1482536 - DNA, 15 bp, Homo sapiens
gattttcttttgcct

SEQ ID NO: 1482537 - DNA, 12 bp, Homo sapiens
gattttgatctc

SEQ ID NO: 1482538 - DNA, 21 bp, Homo sapiens
gattttggggttgtgttgtca

SEQ ID NO: 1482539 - DNA, 22 bp, Homo sapiens
gattttggttttgttcccctcc

SEQ ID NO: 1482540 - DNA, 21 bp, Homo sapiens
gattttgtgtttattcttgat

SEQ ID NO: 1482541 - DNA, 21 bp, Homo sapiens
gatttttaaaatgtcaagaca

SEQ ID NO: 1482542 - DNA, 18 bp, Homo sapiens
gatttttactgtgtttta

SEQ ID NO: 1482543 - DNA, 22 bp, Homo sapiens
gatttttctaaccttgaatgct

SEQ ID NO: 1482544 - DNA, 14 bp, Homo sapiens
gatttttctcttca

SEQ ID NO: 1482545 - DNA, 21 bp, Homo sapiens
gatttttgagcccttgtttca

SEQ ID NO: 1482546 - DNA, 16 bp, Homo sapiens
gattttttaagcagac

SEQ ID NO: 1482547 - DNA, 22 bp, Homo sapiens
gattttttccattatgttcatc

SEQ ID NO: 1482548 - DNA, 13 bp, Homo sapiens
gattttttccctt

SEQ ID NO: 1482549 - DNA, 20 bp, Homo sapiens
gattttttccctttttatgt

SEQ ID NO: 1482550 - DNA, 19 bp, Homo sapiens
gatttttttaatagtgctt

SEQ ID NO: 1482551 - DNA, 14 bp, Homo sapiens
gcaaaaaaagcctc

SEQ ID NO: 1482552 - DNA, 22 bp, Homo sapiens
gcaaaaaaagcctccaagggtt

SEQ ID NO: 1482553 - DNA, 12 bp, Homo sapiens
gcaaaaaatctt

SEQ ID NO: 1482554 - DNA, 22 bp, Homo sapiens
gcaaaaacatgtatgtgcattt

SEQ ID NO: 1482555 - DNA, 20 bp, Homo sapiens
gcaaaaaggagccttttgct

SEQ ID NO: 1482556 - DNA, 18 bp, Homo sapiens
gcaaaacactatgtatag

SEQ ID NO: 1482557 - DNA, 16 bp, Homo sapiens
gcaaaacatctctgca

SEQ ID NO: 1482558 - DNA, 22 bp, Homo sapiens
gcaaaactctacttaatccaat

SEQ ID NO: 1482559 - DNA, 13 bp, Homo sapiens
gcaaaagagaaat

SEQ ID NO: 1482560 - DNA, 18 bp, Homo sapiens
gcaaaagagaaatacata

SEQ ID NO: 1482561 - DNA, 18 bp, Homo sapiens
gcaaaagcagctaaatgt

SEQ ID NO: 1482562 - DNA, 16 bp, Homo sapiens
gcaaaagcctcagaaa

SEQ ID NO: 1482563 - DNA, 18 bp, Homo sapiens
gcaaaagcctcagaaagg

SEQ ID NO: 1482564 - DNA, 15 bp, Homo sapiens
gcaaaaggctgagaa

SEQ ID NO: 1482565 - DNA, 21 bp, Homo sapiens
gcaaaaggttcactaaagcag

SEQ ID NO: 1482566 - DNA, 15 bp, Homo sapiens
gcaaaagtgagaaaa

SEQ ID NO: 1482567 - DNA, 13 bp, Homo sapiens
gcaaaataatttt

SEQ ID NO: 1482568 - DNA, 15 bp, Homo sapiens
gcaaaataattttaa

SEQ ID NO: 1482569 - DNA, 20 bp, Homo sapiens
gcaaaataattttaaacaaa

SEQ ID NO: 1482570 - DNA, 17 bp, Homo sapiens
gcaaaatagacatcttt

SEQ ID NO: 1482571 - DNA, 15 bp, Homo sapiens
gcaaaatcaagagat

SEQ ID NO: 1482572 - DNA, 21 bp, Homo sapiens
gcaaaatcttgttaatgtcat

SEQ ID NO: 1482573 - DNA, 13 bp, Homo sapiens
gcaaaatgctctt

SEQ ID NO: 1482574 - DNA, 20 bp, Homo sapiens
gcaaaatgctcttgtccctg

SEQ ID NO: 1482575 - DNA, 21 bp, Homo sapiens
gcaaaattgttttcacttgta

SEQ ID NO: 1482576 - DNA, 22 bp, Homo sapiens
gcaaaattgttttcacttgtat

SEQ ID NO: 1482577 - DNA, 24 bp, Homo sapiens
gcaaacaatgaagaattatgtaat

SEQ ID NO: 1482578 - DNA, 20 bp, Homo sapiens
gcaaacaggttgttttctac

SEQ ID NO: 1482579 - DNA, 20 bp, Homo sapiens
gcaaaccctcccagaaacat

SEQ ID NO: 1482580 - DNA, 22 bp, Homo sapiens
gcaaacggcaacgtagcctggg

SEQ ID NO: 1482581 - DNA, 14 bp, Homo sapiens
gcaaacgtgaaatt

SEQ ID NO: 1482582 - DNA, 22 bp, Homo sapiens
gcaaactaaccagcattcccta

SEQ ID NO: 1482583 - DNA, 18 bp, Homo sapiens
gcaaactatttgcgactc

SEQ ID NO: 1482584 - DNA, 19 bp, Homo sapiens
gcaaactcactgctcaaga

SEQ ID NO: 1482585 - DNA, 21 bp, Homo sapiens
gcaaactgtcctctacatcaa

SEQ ID NO: 1482586 - DNA, 23 bp, Homo sapiens
gcaaagaaaaaaaaaaaagccag

SEQ ID NO: 1482587 - DNA, 22 bp, Homo sapiens
gcaaagaaagtgggaggtcagg

SEQ ID NO: 1482588 - DNA, 12 bp, Homo sapiens
gcaaagatcaaa

SEQ ID NO: 1482589 - DNA, 15 bp, Homo sapiens
gcaaagatcaaaata

SEQ ID NO: 1482590 - DNA, 22 bp, Homo sapiens
gcaaagatctgtcctcagcctt

SEQ ID NO: 1482591 - DNA, 12 bp, Homo sapiens
gcaaagatgcat

SEQ ID NO: 1482592 - DNA, 18 bp, Homo sapiens
gcaaagatggtaaaaaga

SEQ ID NO: 1482593 - DNA, 16 bp, Homo sapiens
gcaaagatttaatctg

SEQ ID NO: 1482594 - DNA, 20 bp, Homo sapiens
gcaaagcatgttttgcatgt

SEQ ID NO: 1482595 - DNA, 22 bp, Homo sapiens
gcaaagcccttggaacaccctg

SEQ ID NO: 1482596 - DNA, 17 bp, Homo sapiens
gcaaagcgcccacccag

SEQ ID NO: 1482597 - DNA, 21 bp, Homo sapiens
gcaaagctgatgacaacttcc

SEQ ID NO: 1482598 - DNA, 12 bp, Homo sapiens
gcaaaggctccc

SEQ ID NO: 1482599 - DNA, 17 bp, Homo sapiens
gcaaaggctccctcgcc

SEQ ID NO: 1482600 - DNA, 19 bp, Homo sapiens
gcaaaggggacagctgtgt

SEQ ID NO: 1482601 - DNA, 15 bp, Homo sapiens
gcaaaggtgcctcat

SEQ ID NO: 1482602 - DNA, 20 bp, Homo sapiens
gcaaagtaaaaaaatatgaa

SEQ ID NO: 1482603 - DNA, 17 bp, Homo sapiens
gcaaagtttacagatgt

SEQ ID NO: 1482604 - DNA, 18 bp, Homo sapiens
gcaaataatggaaaaata

SEQ ID NO: 1482605 - DNA, 16 bp, Homo sapiens
gcaaatacaatcagcc

SEQ ID NO: 1482606 - DNA, 20 bp, Homo sapiens
gcaaatacaattcacagcac

SEQ ID NO: 1482607 - DNA, 15 bp, Homo sapiens
gcaaatagtttcaaa

SEQ ID NO: 1482608 - DNA, 12 bp, Homo sapiens
gcaaatatatga

SEQ ID NO: 1482609 - DNA, 22 bp, Homo sapiens
gcaaatcagaaacttgtgaagt

SEQ ID NO: 1482610 - DNA, 22 bp, Homo sapiens
gcaaatcatctgcattcctgat

SEQ ID NO: 1482611 - DNA, 14 bp, Homo sapiens
gcaaatcatttgtt

SEQ ID NO: 1482612 - DNA, 18 bp, Homo sapiens
gcaaatctattacttttg

SEQ ID NO: 1482613 - DNA, 18 bp, Homo sapiens
gcaaatggaggcttttca

SEQ ID NO: 1482614 - DNA, 20 bp, Homo sapiens
gcaaatggaggcttttcact

SEQ ID NO: 1482615 - DNA, 21 bp, Homo sapiens
gcaaatggaggcttttcactg

SEQ ID NO: 1482616 - DNA, 22 bp, Homo sapiens
gcaaatggaggcttttcactgc

SEQ ID NO: 1482617 - DNA, 21 bp, Homo sapiens
gcaaatgtccccttgatgggg

SEQ ID NO: 1482618 - DNA, 15 bp, Homo sapiens
gcaaatgtctaattg

SEQ ID NO: 1482619 - DNA, 16 bp, Homo sapiens
gcaaatgtgacctgtg

SEQ ID NO: 1482620 - DNA, 12 bp, Homo sapiens
gcaaatgtgtac

SEQ ID NO: 1482621 - DNA, 12 bp, Homo sapiens
gcaaatgttaaa

SEQ ID NO: 1482622 - DNA, 12 bp, Homo sapiens
gcaaatgttttg

SEQ ID NO: 1482623 - DNA, 15 bp, Homo sapiens
gcaaattattctagt

SEQ ID NO: 1482624 - DNA, 16 bp, Homo sapiens
gcaaattattctagtc

SEQ ID NO: 1482625 - DNA, 16 bp, Homo sapiens
gcaaattgctagtcag

SEQ ID NO: 1482626 - DNA, 21 bp, Homo sapiens
gcaaattgctagtcagggtga

SEQ ID NO: 1482627 - DNA, 14 bp, Homo sapiens
gcacaggccctagc

SEQ ID NO: 1482628 - DNA, 15 bp, Homo sapiens
gcacaggcctctgcc

SEQ ID NO: 1482629 - DNA, 22 bp, Homo sapiens
gcacagggagtgcacatatcca

SEQ ID NO: 1482630 - DNA, 17 bp, Homo sapiens
gcacagggcaccagagg

SEQ ID NO: 1482631 - DNA, 18 bp, Homo sapiens
gcacagggcaccagaggc

SEQ ID NO: 1482632 - DNA, 20 bp, Homo sapiens
gcacagggcaccagaggccg

SEQ ID NO: 1482633 - DNA, 15 bp, Homo sapiens
gcacagggcccgcag

SEQ ID NO: 1482634 - DNA, 20 bp, Homo sapiens
gcacagggcccgcagtgctg

SEQ ID NO: 1482635 - DNA, 23 bp, Homo sapiens
gcacagggcccgcagtgctggga

SEQ ID NO: 1482636 - DNA, 12 bp, Homo sapiens
gcacaggggccc

SEQ ID NO: 1482637 - DNA, 23 bp, Homo sapiens
gcacagggtctgctctttctctg

SEQ ID NO: 1482638 - DNA, 20 bp, Homo sapiens
gcacagggtgtggtatgagg

SEQ ID NO: 1482639 - DNA, 20 bp, Homo sapiens
gcacagtaggtcccggccag

SEQ ID NO: 1482640 - DNA, 19 bp, Homo sapiens
gcacagtgacttctgagat

SEQ ID NO: 1482641 - DNA, 12 bp, Homo sapiens
gcacagtgattt

SEQ ID NO: 1482642 - DNA, 18 bp, Homo sapiens
gcacagtgcatctcagcc

SEQ ID NO: 1482643 - DNA, 13 bp, Homo sapiens
gcacagtggcaca

SEQ ID NO: 1482644 - DNA, 14 bp, Homo sapiens
gcacagtgggagct

SEQ ID NO: 1482645 - DNA, 19 bp, Homo sapiens
gcacagtgggagctgagct

SEQ ID NO: 1482646 - DNA, 18 bp, Homo sapiens
gcacagtgtaatccaggg

SEQ ID NO: 1482647 - DNA, 16 bp, Homo sapiens
gcacagtgtcccccag

SEQ ID NO: 1482648 - DNA, 21 bp, Homo sapiens
gcacagttgtctattctgagc

SEQ ID NO: 1482649 - DNA, 17 bp, Homo sapiens
gcacagttttctgagaa

SEQ ID NO: 1482650 - DNA, 23 bp, Homo sapiens
gcacatacacctcgtcaagagca

SEQ ID NO: 1482651 - DNA, 18 bp, Homo sapiens
gcacatacggcagacctc

SEQ ID NO: 1482652 - DNA, 16 bp, Homo sapiens
gcacatactacctaga

SEQ ID NO: 1482653 - DNA, 23 bp, Homo sapiens
gcacatactacctagaagtaaga

SEQ ID NO: 1482654 - DNA, 22 bp, Homo sapiens
gcacataggctggtggccttgg

SEQ ID NO: 1482655 - DNA, 13 bp, Homo sapiens
gcacatatggact

SEQ ID NO: 1482656 - DNA, 18 bp, Homo sapiens
gcacatatggactctgca

SEQ ID NO: 1482657 - DNA, 17 bp, Homo sapiens
gcacatgccacctggca

SEQ ID NO: 1482658 - DNA, 22 bp, Homo sapiens
gcacatgccgcgggcggccagg

SEQ ID NO: 1482659 - DNA, 16 bp, Homo sapiens
gcacatgctgtctggc

SEQ ID NO: 1482660 - DNA, 15 bp, Homo sapiens
gcacatggccataga

SEQ ID NO: 1482661 - DNA, 19 bp, Homo sapiens
gcacatggccatagaggcc

SEQ ID NO: 1482662 - DNA, 21 bp, Homo sapiens
gcacatgtcttgtacatgtgt

SEQ ID NO: 1482663 - DNA, 20 bp, Homo sapiens
gcacatgttgttctcattga

SEQ ID NO: 1482664 - DNA, 21 bp, Homo sapiens
gcacattaactccctccacca

SEQ ID NO: 1482665 - DNA, 15 bp, Homo sapiens
gcacattcctggccc

SEQ ID NO: 1482666 - DNA, 18 bp, Homo sapiens
gcacattcctggccccgg

SEQ ID NO: 1482667 - DNA, 18 bp, Homo sapiens
gcacattgagctgtgcaa

SEQ ID NO: 1482668 - DNA, 18 bp, Homo sapiens
gcacattgcctgttctgc

SEQ ID NO: 1482669 - DNA, 18 bp, Homo sapiens
gcacattgttgttttttt

SEQ ID NO: 1482670 - DNA, 20 bp, Homo sapiens
gcacatttatatatatatgt

SEQ ID NO: 1482671 - DNA, 10 bp, Homo sapiens
gcaccaaaga

SEQ ID NO: 1482672 - DNA, 22 bp, Homo sapiens
gcaccaaagacatcagtctcca

SEQ ID NO: 1482673 - DNA, 20 bp, Homo sapiens
gcaccaagggacaggagaag

SEQ ID NO: 1482674 - DNA, 22 bp, Homo sapiens
gcaccaagggacaggagaagag

SEQ ID NO: 1482675 - DNA, 23 bp, Homo sapiens
gcaccacactgggtgcgtctcca

SEQ ID NO: 1482676 - DNA, 13 bp, Homo sapiens
gcaccaccaagcc

SEQ ID NO: 1482677 - DNA, 14 bp, Homo sapiens
gcaccaccaggagc

SEQ ID NO: 1482678 - DNA, 15 bp, Homo sapiens
gcaccaccaggagca

SEQ ID NO: 1482679 - DNA, 22 bp, Homo sapiens
gcaccaccctagtcccttcccc

SEQ ID NO: 1482680 - DNA, 17 bp, Homo sapiens
gcaccacctctgtgggc

SEQ ID NO: 1482681 - DNA, 14 bp, Homo sapiens
gcaccactctcctt

SEQ ID NO: 1482682 - DNA, 14 bp, Homo sapiens
gcaccactgcactc

SEQ ID NO: 1482683 - DNA, 18 bp, Homo sapiens
gcaccactgcactccagc

SEQ ID NO: 1482684 - DNA, 23 bp, Homo sapiens
gcaccactgcactccagcctggg

SEQ ID NO: 1482685 - DNA, 17 bp, Homo sapiens
gcaccactgcttcccac

SEQ ID NO: 1482686 - DNA, 11 bp, Homo sapiens
gcaccagccag

SEQ ID NO: 1482687 - DNA, 12 bp, Homo sapiens
gcaccagccagc

SEQ ID NO: 1482688 - DNA, 14 bp, Homo sapiens
gcaccagccccctg

SEQ ID NO: 1482689 - DNA, 15 bp, Homo sapiens
gcaccagcgccccca

SEQ ID NO: 1482690 - DNA, 12 bp, Homo sapiens
gcaccagctctg

SEQ ID NO: 1482691 - DNA, 13 bp, Homo sapiens
gcaccagctctgt

SEQ ID NO: 1482692 - DNA, 17 bp, Homo sapiens
gcaccagctctgtggcc

SEQ ID NO: 1482693 - DNA, 18 bp, Homo sapiens
gcaccagctctgtggcct

SEQ ID NO: 1482694 - DNA, 14 bp, Homo sapiens
gcaccagctgctct

SEQ ID NO: 1482695 - DNA, 17 bp, Homo sapiens
gcaccagctgctctgcc

SEQ ID NO: 1482696 - DNA, 20 bp, Homo sapiens
gcaccagctgctctgcccct

SEQ ID NO: 1482697 - DNA, 22 bp, Homo sapiens
gcaccaggcaaacgaataaaga

SEQ ID NO: 1482698 - DNA, 21 bp, Homo sapiens
gcaccaggcacgaacccacct

SEQ ID NO: 1482699 - DNA, 20 bp, Homo sapiens
gcaccaggccgggcttgggc

SEQ ID NO: 1482700 - DNA, 18 bp, Homo sapiens
gcaccaggggtttctcgc

SEQ ID NO: 1482701 - DNA, 20 bp, Homo sapiens
gcaccatactccttgcttcc

SEQ ID NO: 1482702 - DNA, 23 bp, Homo sapiens
gcaccatactccttgcttcctga

SEQ ID NO: 1482703 - DNA, 20 bp, Homo sapiens
gcaccatctctgattttcaa

SEQ ID NO: 1482704 - DNA, 16 bp, Homo sapiens
gcaccatgctgctggg

SEQ ID NO: 1482705 - DNA, 18 bp, Homo sapiens
gcaccatgctgctgggga

SEQ ID NO: 1482706 - DNA, 20 bp, Homo sapiens
gcaccatggtatcatatatt

SEQ ID NO: 1482707 - DNA, 22 bp, Homo sapiens
gcaccatggtatcatatattaa

SEQ ID NO: 1482708 - DNA, 16 bp, Homo sapiens
gcaccattctcctgcc

SEQ ID NO: 1482709 - DNA, 23 bp, Homo sapiens
gcaccattctgactcggtttctc

SEQ ID NO: 1482710 - DNA, 22 bp, Homo sapiens
gcacccacaaataaatgacaag

SEQ ID NO: 1482711 - DNA, 14 bp, Homo sapiens
gcacccacccctgc

SEQ ID NO: 1482712 - DNA, 18 bp, Homo sapiens
gcacccaccgtggaggag

SEQ ID NO: 1482713 - DNA, 23 bp, Homo sapiens
gcacccacctgttttctgaaaca

SEQ ID NO: 1482714 - DNA, 15 bp, Homo sapiens
gcacccactcaccag

SEQ ID NO: 1482715 - DNA, 19 bp, Homo sapiens
gcacccactcaccagggtc

SEQ ID NO: 1482716 - DNA, 14 bp, Homo sapiens
gcacccagaacagt

SEQ ID NO: 1482717 - DNA, 15 bp, Homo sapiens
gcacccagagcaccc

SEQ ID NO: 1482718 - DNA, 15 bp, Homo sapiens
gcacccaggcctccc

SEQ ID NO: 1482719 - DNA, 18 bp, Homo sapiens
gcacccaggcctccctgc

SEQ ID NO: 1482720 - DNA, 21 bp, Homo sapiens
gcacccatctgtctgccaacc

SEQ ID NO: 1482721 - DNA, 20 bp, Homo sapiens
gcacccatgacaatcacctt

SEQ ID NO: 1482722 - DNA, 22 bp, Homo sapiens
gcaccccctcccttctgggaaa

SEQ ID NO: 1482723 - DNA, 14 bp, Homo sapiens
gcaccccgctgcgg

SEQ ID NO: 1482724 - DNA, 13 bp, Homo sapiens
gcacccctccctg

SEQ ID NO: 1482725 - DNA, 14 bp, Homo sapiens
gcacccctccctgc

SEQ ID NO: 1482726 - DNA, 16 bp, Homo sapiens
gcaccccttccatgtg

SEQ ID NO: 1482727 - DNA, 13 bp, Homo sapiens
gcaccccttctct

SEQ ID NO: 1482728 - DNA, 15 bp, Homo sapiens
gcacccgcctctccc

SEQ ID NO: 1482729 - DNA, 13 bp, Homo sapiens
gcaccctccaccc

SEQ ID NO: 1482730 - DNA, 19 bp, Homo sapiens
gcaccctccaccctgtccc

SEQ ID NO: 1482731 - DNA, 13 bp, Homo sapiens
gcaccctgcacct

SEQ ID NO: 1482732 - DNA, 16 bp, Homo sapiens
gcaccctgcacctgct

SEQ ID NO: 1482733 - DNA, 20 bp, Homo sapiens
gcaccctgcagagcacacag

SEQ ID NO: 1482734 - DNA, 24 bp, Homo sapiens
gcaccctgcagagcacacaggtac

SEQ ID NO: 1482735 - DNA, 18 bp, Homo sapiens
gcaccctgcgcctccaga

SEQ ID NO: 1482736 - DNA, 23 bp, Homo sapiens
gcaccctggaaaggggagttgag

SEQ ID NO: 1482737 - DNA, 13 bp, Homo sapiens
gcaccctggcctg

SEQ ID NO: 1482738 - DNA, 14 bp, Homo sapiens
gcaccctggggcct

SEQ ID NO: 1482739 - DNA, 15 bp, Homo sapiens
gcaccctggggcctg

SEQ ID NO: 1482740 - DNA, 13 bp, Homo sapiens
gcacccttccctc

SEQ ID NO: 1482741 - DNA, 19 bp, Homo sapiens
gcacccttctcggagaccc

SEQ ID NO: 1482742 - DNA, 18 bp, Homo sapiens
gcaccgccacgtcccagc

SEQ ID NO: 1482743 - DNA, 15 bp, Homo sapiens
gcaccgcctgccctc

SEQ ID NO: 1482744 - DNA, 21 bp, Homo sapiens
gcaccgcctgccctcccgcac

SEQ ID NO: 1482745 - DNA, 15 bp, Homo sapiens
gcaccggcgctgcag

SEQ ID NO: 1482746 - DNA, 16 bp, Homo sapiens
gcaccggcgctgcagg

SEQ ID NO: 1482747 - DNA, 17 bp, Homo sapiens
gcaccggcgctgcaggt

SEQ ID NO: 1482748 - DNA, 18 bp, Homo sapiens
gcaccggcgctgcaggta

SEQ ID NO: 1482749 - DNA, 15 bp, Homo sapiens
gcaccgggaccccct

SEQ ID NO: 1482750 - DNA, 23 bp, Homo sapiens
gcaccgggaccccctcaccatcc

SEQ ID NO: 1482751 - DNA, 15 bp, Homo sapiens
gcaccgggggagagg

SEQ ID NO: 1482752 - DNA, 20 bp, Homo sapiens
gcaccgggggagagggacac

SEQ ID NO: 1482753 - DNA, 17 bp, Homo sapiens
gcaccgtcatggcttaa

SEQ ID NO: 1482754 - DNA, 16 bp, Homo sapiens
gcaccgtccaggcccc

SEQ ID NO: 1482755 - DNA, 17 bp, Homo sapiens
gcaccgtccaggcccca

SEQ ID NO: 1482756 - DNA, 21 bp, Homo sapiens
gcaccgtggtcagagggactg

SEQ ID NO: 1482757 - DNA, 19 bp, Homo sapiens
gcaccgtgtcaagctgctc

SEQ ID NO: 1482758 - DNA, 21 bp, Homo sapiens
gcaccgtgtcaagctgctctg

SEQ ID NO: 1482759 - DNA, 18 bp, Homo sapiens
gcacctaaagcagccagc

SEQ ID NO: 1482760 - DNA, 16 bp, Homo sapiens
gcacctaatccaggca

SEQ ID NO: 1482761 - DNA, 17 bp, Homo sapiens
gcacctaatccaggcag

SEQ ID NO: 1482762 - DNA, 18 bp, Homo sapiens
gcacctacatccccaggt

SEQ ID NO: 1482763 - DNA, 20 bp, Homo sapiens
gcacctacatccccaggtct

SEQ ID NO: 1482764 - DNA, 18 bp, Homo sapiens
gcacctatagtcccagct

SEQ ID NO: 1482765 - DNA, 23 bp, Homo sapiens
gcacctcaaggtcatcaaacatt

SEQ ID NO: 1482766 - DNA, 21 bp, Homo sapiens
gcacctcacctgagacctcca

SEQ ID NO: 1482767 - DNA, 14 bp, Homo sapiens
gcacctcaggctga

SEQ ID NO: 1482768 - DNA, 15 bp, Homo sapiens
gcacctccagcctga

SEQ ID NO: 1482769 - DNA, 19 bp, Homo sapiens
gcacctccaggcaggccag

SEQ ID NO: 1482770 - DNA, 20 bp, Homo sapiens
gcacctccaggcaggccagg

SEQ ID NO: 1482771 - DNA, 12 bp, Homo sapiens
gcacctcccagc

SEQ ID NO: 1482772 - DNA, 14 bp, Homo sapiens
gcacctcccagccc

SEQ ID NO: 1482773 - DNA, 17 bp, Homo sapiens
gcacctccccccactgc

SEQ ID NO: 1482774 - DNA, 21 bp, Homo sapiens
gcacctccccccactgcaggc

SEQ ID NO: 1482775 - DNA, 16 bp, Homo sapiens
gcacctccccgctctc

SEQ ID NO: 1482776 - DNA, 20 bp, Homo sapiens
gcacctccccgctctccctg

SEQ ID NO: 1482777 - DNA, 14 bp, Homo sapiens
gcacctccccgctg

SEQ ID NO: 1482778 - DNA, 13 bp, Homo sapiens
gcacctcctgaga

SEQ ID NO: 1482779 - DNA, 14 bp, Homo sapiens
gcacctcggggaca

SEQ ID NO: 1482780 - DNA, 16 bp, Homo sapiens
gcacctctggctagag

SEQ ID NO: 1482781 - DNA, 22 bp, Homo sapiens
gcacctctggctagagccgagg

SEQ ID NO: 1482782 - DNA, 20 bp, Homo sapiens
gcacctcttccttgatgttt

SEQ ID NO: 1482783 - DNA, 14 bp, Homo sapiens
gcacctgcaggctt

SEQ ID NO: 1482784 - DNA, 23 bp, Homo sapiens
gcacctgcatccgtagttccctg

SEQ ID NO: 1482785 - DNA, 16 bp, Homo sapiens
gcacctgccagaggat

SEQ ID NO: 1482786 - DNA, 18 bp, Homo sapiens
gcacctgccagaggatgc

SEQ ID NO: 1482787 - DNA, 17 bp, Homo sapiens
gcacctgccagcctggc

SEQ ID NO: 1482788 - DNA, 15 bp, Homo sapiens
gcacctgccccctgg

SEQ ID NO: 1482789 - DNA, 17 bp, Homo sapiens
gcacctgccccctggtg

SEQ ID NO: 1482790 - DNA, 21 bp, Homo sapiens
gcacctgcctccaccagcaag

SEQ ID NO: 1482791 - DNA, 16 bp, Homo sapiens
gcacctgcgcacaggt

SEQ ID NO: 1482792 - DNA, 12 bp, Homo sapiens
gcacctgctgcg

SEQ ID NO: 1482793 - DNA, 14 bp, Homo sapiens
gcacctgctgcgtc

SEQ ID NO: 1482794 - DNA, 17 bp, Homo sapiens
gcacctgctgcgtcccc

SEQ ID NO: 1482795 - DNA, 11 bp, Homo sapiens
gcacctggcct

SEQ ID NO: 1482796 - DNA, 13 bp, Homo sapiens
gcacctggcctgg

SEQ ID NO: 1482797 - DNA, 19 bp, Homo sapiens
gcacctgtactcaggaggc

SEQ ID NO: 1482798 - DNA, 21 bp, Homo sapiens
gcacctgtactcaggaggctg

SEQ ID NO: 1482799 - DNA, 17 bp, Homo sapiens
gcacctgtagtcccagc

SEQ ID NO: 1482800 - DNA, 23 bp, Homo sapiens
gcacctgtccccaccctccactc

SEQ ID NO: 1482801 - DNA, 11 bp, Homo sapiens
gcacctgtctg

SEQ ID NO: 1482802 - DNA, 14 bp, Homo sapiens
gcaccttcagactt

SEQ ID NO: 1482803 - DNA, 21 bp, Homo sapiens
gcaccttcctcctccccgctc

SEQ ID NO: 1482804 - DNA, 22 bp, Homo sapiens
gcaccttggcccaggagctctg

SEQ ID NO: 1482805 - DNA, 14 bp, Homo sapiens
gcaccttgtgcctg

SEQ ID NO: 1482806 - DNA, 15 bp, Homo sapiens
gcaccttgtgcctgg

SEQ ID NO: 1482807 - DNA, 18 bp, Homo sapiens
gcaccttgtgcctggggt

SEQ ID NO: 1482808 - DNA, 15 bp, Homo sapiens
gcacgaacccacctg

SEQ ID NO: 1482809 - DNA, 23 bp, Homo sapiens
gcacgaacccacctgctgagaga

SEQ ID NO: 1482810 - DNA, 15 bp, Homo sapiens
gcacgagctggaacc

SEQ ID NO: 1482811 - DNA, 15 bp, Homo sapiens
gcacgcacacacaca

SEQ ID NO: 1482812 - DNA, 15 bp, Homo sapiens
gcacgcacttgcctg

SEQ ID NO: 1482813 - DNA, 19 bp, Homo sapiens
gcacgcacttgcctgttgg

SEQ ID NO: 1482814 - DNA, 14 bp, Homo sapiens
gcacgcaggaccag

SEQ ID NO: 1482815 - DNA, 16 bp, Homo sapiens
gcacgcctgccatctt

SEQ ID NO: 1482816 - DNA, 21 bp, Homo sapiens
gcacgcctgccatcttctccc

SEQ ID NO: 1482817 - DNA, 23 bp, Homo sapiens
gcacggcgtggtgtgtccctgga

SEQ ID NO: 1482818 - DNA, 14 bp, Homo sapiens
gcacgggtggtccc

SEQ ID NO: 1482819 - DNA, 24 bp, Homo sapiens
gcacggtctggggaagaggatgag

SEQ ID NO: 1482820 - DNA, 14 bp, Homo sapiens
gcacgtattgctgt

SEQ ID NO: 1482821 - DNA, 15 bp, Homo sapiens
gcacgtattgctgtg

SEQ ID NO: 1482822 - DNA, 16 bp, Homo sapiens
gcacgtcttgctattt

SEQ ID NO: 1482823 - DNA, 17 bp, Homo sapiens
gcacgtcttgctatttg

SEQ ID NO: 1482824 - DNA, 15 bp, Homo sapiens
gcacgtggagagctg

SEQ ID NO: 1482825 - DNA, 17 bp, Homo sapiens
gcacgtggcctcttgag

SEQ ID NO: 1482826 - DNA, 14 bp, Homo sapiens
gcacgtggggccca

SEQ ID NO: 1482827 - DNA, 17 bp, Homo sapiens
gcacgtggggcccactg

SEQ ID NO: 1482828 - DNA, 18 bp, Homo sapiens
gcacgtggggcccactgc

SEQ ID NO: 1482829 - DNA, 20 bp, Homo sapiens
gcactaaagcagtggacacc

SEQ ID NO: 1482830 - DNA, 19 bp, Homo sapiens
gcactaaccaatgcctttt

SEQ ID NO: 1482831 - DNA, 20 bp, Homo sapiens
gcactaacgttgagcccctg

SEQ ID NO: 1482832 - DNA, 16 bp, Homo sapiens
gcactacaatcatggt

SEQ ID NO: 1482833 - DNA, 17 bp, Homo sapiens
gcactacaccttgcctt

SEQ ID NO: 1482834 - DNA, 17 bp, Homo sapiens
gcactactctgtgccag

SEQ ID NO: 1482835 - DNA, 18 bp, Homo sapiens
gcactactgacatgtggg

SEQ ID NO: 1482836 - DNA, 22 bp, Homo sapiens
gcactagtcaccgacagcggcc

SEQ ID NO: 1482837 - DNA, 23 bp, Homo sapiens
gcactagtcaccgacagcggcct

SEQ ID NO: 1482838 - DNA, 21 bp, Homo sapiens
gcactagtttgattattatgt

SEQ ID NO: 1482839 - DNA, 22 bp, Homo sapiens
gcactataatgtaagctctact

SEQ ID NO: 1482840 - DNA, 23 bp, Homo sapiens
gcactatgcccttttatataagt

SEQ ID NO: 1482841 - DNA, 12 bp, Homo sapiens
gcactattttat

SEQ ID NO: 1482842 - DNA, 19 bp, Homo sapiens
gcactattttatatttaaa

SEQ ID NO: 1482843 - DNA, 19 bp, Homo sapiens
gcactcacccctagccctg

SEQ ID NO: 1482844 - DNA, 20 bp, Homo sapiens
gcactcacccctagccctgg

SEQ ID NO: 1482845 - DNA, 14 bp, Homo sapiens
gcactccaaacctg

SEQ ID NO: 1482846 - DNA, 21 bp, Homo sapiens
gcactccacacatctttcttg

SEQ ID NO: 1482847 - DNA, 22 bp, Homo sapiens
gcactccacacatctttcttga

SEQ ID NO: 1482848 - DNA, 13 bp, Homo sapiens
gcactccagcctg

SEQ ID NO: 1482849 - DNA, 14 bp, Homo sapiens
gcactccagcctgg

SEQ ID NO: 1482850 - DNA, 15 bp, Homo sapiens
gcactccagcctggg

SEQ ID NO: 1482851 - DNA, 17 bp, Homo sapiens
gcactccagcctgggca

SEQ ID NO: 1482852 - DNA, 21 bp, Homo sapiens
gcactccagcctgggcgacag

SEQ ID NO: 1482853 - DNA, 17 bp, Homo sapiens
gcactccagcctgggtc

SEQ ID NO: 1482854 - DNA, 20 bp, Homo sapiens
gcactccagggaagatttta

SEQ ID NO: 1482855 - DNA, 15 bp, Homo sapiens
gcagcaaagcagctg

SEQ ID NO: 1482856 - DNA, 11 bp, Homo sapiens
gcagcaaggcc

SEQ ID NO: 1482857 - DNA, 16 bp, Homo sapiens
gcagcaaggccttggt

SEQ ID NO: 1482858 - DNA, 13 bp, Homo sapiens
gcagcaaggctgc

SEQ ID NO: 1482859 - DNA, 15 bp, Homo sapiens
gcagcaagggacctg

SEQ ID NO: 1482860 - DNA, 15 bp, Homo sapiens
gcagcaccctgcaga

SEQ ID NO: 1482861 - DNA, 20 bp, Homo sapiens
gcagcaccgaggggcctttg

SEQ ID NO: 1482862 - DNA, 23 bp, Homo sapiens
gcagcacctcacctgagacctcc

SEQ ID NO: 1482863 - DNA, 14 bp, Homo sapiens
gcagcacctccagg

SEQ ID NO: 1482864 - DNA, 15 bp, Homo sapiens
gcagcacctccaggc

SEQ ID NO: 1482865 - DNA, 20 bp, Homo sapiens
gcagcactccccagagctgt

SEQ ID NO: 1482866 - DNA, 23 bp, Homo sapiens
gcagcactccccagagctgtgcc

SEQ ID NO: 1482867 - DNA, 22 bp, Homo sapiens
gcagcagaagggggtggtgtct

SEQ ID NO: 1482868 - DNA, 15 bp, Homo sapiens
gcagcagagaaccat

SEQ ID NO: 1482869 - DNA, 13 bp, Homo sapiens
gcagcagcaccaa

SEQ ID NO: 1482870 - DNA, 15 bp, Homo sapiens
gcagcagccagcacc

SEQ ID NO: 1482871 - DNA, 16 bp, Homo sapiens
gcagcagccagcacca

SEQ ID NO: 1482872 - DNA, 19 bp, Homo sapiens
gcagcagccagcaccacct

SEQ ID NO: 1482873 - DNA, 12 bp, Homo sapiens
gcagcagccagg

SEQ ID NO: 1482874 - DNA, 22 bp, Homo sapiens
gcagcagccatcataggaaggg

SEQ ID NO: 1482875 - DNA, 21 bp, Homo sapiens
gcagcagcccaagcttccctc

SEQ ID NO: 1482876 - DNA, 16 bp, Homo sapiens
gcagcagctaggactg

SEQ ID NO: 1482877 - DNA, 17 bp, Homo sapiens
gcagcaggagcggtaga

SEQ ID NO: 1482878 - DNA, 17 bp, Homo sapiens
gcagcaggctcaggcac

SEQ ID NO: 1482879 - DNA, 13 bp, Homo sapiens
gcagcaggtgctg

SEQ ID NO: 1482880 - DNA, 16 bp, Homo sapiens
gcagcaggtgctgggc

SEQ ID NO: 1482881 - DNA, 19 bp, Homo sapiens
gcagcatagaacaggacct

SEQ ID NO: 1482882 - DNA, 21 bp, Homo sapiens
gcagcatcttcaaacatgtac

SEQ ID NO: 1482883 - DNA, 13 bp, Homo sapiens
gcagcatgagact

SEQ ID NO: 1482884 - DNA, 22 bp, Homo sapiens
gcagcatgttgctgaggagtga

SEQ ID NO: 1482885 - DNA, 19 bp, Homo sapiens
gcagccaaggccgccagcg

SEQ ID NO: 1482886 - DNA, 22 bp, Homo sapiens
gcagccacccaagcctgctggc

SEQ ID NO: 1482887 - DNA, 23 bp, Homo sapiens
gcagccacccaagcctgctggct

SEQ ID NO: 1482888 - DNA, 17 bp, Homo sapiens
gcagccacggccccggg

SEQ ID NO: 1482889 - DNA, 23 bp, Homo sapiens
gcagccacggccccgggtccagg

SEQ ID NO: 1482890 - DNA, 16 bp, Homo sapiens
gcagccagagctgtgc

SEQ ID NO: 1482891 - DNA, 15 bp, Homo sapiens
gcagccagcaccacc

SEQ ID NO: 1482892 - DNA, 15 bp, Homo sapiens
gcagccagcagaggg

SEQ ID NO: 1482893 - DNA, 20 bp, Homo sapiens
gcagccagccggtgcctggc

SEQ ID NO: 1482894 - DNA, 19 bp, Homo sapiens
gcagccagctccccacacc

SEQ ID NO: 1482895 - DNA, 13 bp, Homo sapiens
gcagccagctctc

SEQ ID NO: 1482896 - DNA, 16 bp, Homo sapiens
gcagccagctctcagc

SEQ ID NO: 1482897 - DNA, 12 bp, Homo sapiens
gcagccaggaca

SEQ ID NO: 1482898 - DNA, 12 bp, Homo sapiens
gcagccaggctg

SEQ ID NO: 1482899 - DNA, 13 bp, Homo sapiens
gcagccagggacc

SEQ ID NO: 1482900 - DNA, 23 bp, Homo sapiens
gcagccagggcttacctgtacac

SEQ ID NO: 1482901 - DNA, 22 bp, Homo sapiens
gcagccagtctcagagaccagc

SEQ ID NO: 1482902 - DNA, 11 bp, Homo sapiens
gcagccatgcc

SEQ ID NO: 1482903 - DNA, 19 bp, Homo sapiens
gcagcccaaaacccagggc

SEQ ID NO: 1482904 - DNA, 17 bp, Homo sapiens
gcagcccaacagcactt

SEQ ID NO: 1482905 - DNA, 14 bp, Homo sapiens
gcagcccagagact

SEQ ID NO: 1482906 - DNA, 18 bp, Homo sapiens
gcagcccagagactttgt

SEQ ID NO: 1482907 - DNA, 16 bp, Homo sapiens
gcagcccagcttcctg

SEQ ID NO: 1482908 - DNA, 20 bp, Homo sapiens
gcagcccagcttcctggtgt

SEQ ID NO: 1482909 - DNA, 17 bp, Homo sapiens
gcagcccaggccggggt

SEQ ID NO: 1482910 - DNA, 19 bp, Homo sapiens
gcagcccagggcctagagg

SEQ ID NO: 1482911 - DNA, 17 bp, Homo sapiens
gcagcccatgcccacct

SEQ ID NO: 1482912 - DNA, 22 bp, Homo sapiens
gcagcccatgcccacctgccca

SEQ ID NO: 1482913 - DNA, 22 bp, Homo sapiens
gcagcccatggcctctggccag

SEQ ID NO: 1482914 - DNA, 20 bp, Homo sapiens
gcagccccacttcaccccca

SEQ ID NO: 1482915 - DNA, 13 bp, Homo sapiens
gcagccccttctg

SEQ ID NO: 1482916 - DNA, 16 bp, Homo sapiens
gcagccccttctggcc

SEQ ID NO: 1482917 - DNA, 21 bp, Homo sapiens
gcagccccttctggccggtgc

SEQ ID NO: 1482918 - DNA, 19 bp, Homo sapiens
gcagcccgcctgccgtgca

SEQ ID NO: 1482919 - DNA, 21 bp, Homo sapiens
gcagcccgtgaagcagtgcct

SEQ ID NO: 1482920 - DNA, 21 bp, Homo sapiens
gcagccctcacctctgaggac

SEQ ID NO: 1482921 - DNA, 13 bp, Homo sapiens
gcagccctcctca

SEQ ID NO: 1482922 - DNA, 12 bp, Homo sapiens
gcagcccttgct

SEQ ID NO: 1482923 - DNA, 23 bp, Homo sapiens
gcagcccttgctttcggagctcc

SEQ ID NO: 1482924 - DNA, 17 bp, Homo sapiens
gcagccgccagctggga

SEQ ID NO: 1482925 - DNA, 16 bp, Homo sapiens
gcagccgctaggagag

SEQ ID NO: 1482926 - DNA, 15 bp, Homo sapiens
gcagccggagggagg

SEQ ID NO: 1482927 - DNA, 16 bp, Homo sapiens
gcagccgtccatagca

SEQ ID NO: 1482928 - DNA, 16 bp, Homo sapiens
gcagccgtcccaggcc

SEQ ID NO: 1482929 - DNA, 15 bp, Homo sapiens
gcagccgtgatcaag

SEQ ID NO: 1482930 - DNA, 13 bp, Homo sapiens
gcagcctccagag

SEQ ID NO: 1482931 - DNA, 14 bp, Homo sapiens
gcagcctccagagc

SEQ ID NO: 1482932 - DNA, 16 bp, Homo sapiens
gcagcctccagagcca

SEQ ID NO: 1482933 - DNA, 17 bp, Homo sapiens
gcagcctccagagccag

SEQ ID NO: 1482934 - DNA, 18 bp, Homo sapiens
gcagcctccagagccagc

SEQ ID NO: 1482935 - DNA, 14 bp, Homo sapiens
gcagcctccctctg

SEQ ID NO: 1482936 - DNA, 16 bp, Homo sapiens
gcagcctccctctgac

SEQ ID NO: 1482937 - DNA, 23 bp, Homo sapiens
gcagcctccctctgacctgcagg

SEQ ID NO: 1482938 - DNA, 15 bp, Homo sapiens
gcagcctcccttcca

SEQ ID NO: 1482939 - DNA, 23 bp, Homo sapiens
gcagcctcccttccatgccccag

SEQ ID NO: 1482940 - DNA, 20 bp, Homo sapiens
gcagcctccgcctcccgggt

SEQ ID NO: 1482941 - DNA, 18 bp, Homo sapiens
gcagcctcctcctgacca

SEQ ID NO: 1482942 - DNA, 14 bp, Homo sapiens
gcagcctcgcacag

SEQ ID NO: 1482943 - DNA, 21 bp, Homo sapiens
gcagcctcgcacaggccctag

SEQ ID NO: 1482944 - DNA, 16 bp, Homo sapiens
gcagcctctgccaggc

SEQ ID NO: 1482945 - DNA, 13 bp, Homo sapiens
gcagcctgaagcc

SEQ ID NO: 1482946 - DNA, 17 bp, Homo sapiens
gcagcctgatggccaag

SEQ ID NO: 1482947 - DNA, 16 bp, Homo sapiens
gcagcctgctctagtg

SEQ ID NO: 1482948 - DNA, 16 bp, Homo sapiens
gcagcctgctgcgcgt

SEQ ID NO: 1482949 - DNA, 17 bp, Homo sapiens
gcagcctgtatgtggtg

SEQ ID NO: 1482950 - DNA, 20 bp, Homo sapiens
gcagcctgtatgtggtgtgg

SEQ ID NO: 1482951 - DNA, 21 bp, Homo sapiens
gcagcctgtatgtggtgtggg

SEQ ID NO: 1482952 - DNA, 14 bp, Homo sapiens
gcagcctgtgcctg

SEQ ID NO: 1482953 - DNA, 22 bp, Homo sapiens
gcagcctgtggcatctttgcct

SEQ ID NO: 1482954 - DNA, 17 bp, Homo sapiens
gcagcctttgcctcccc

SEQ ID NO: 1482955 - DNA, 15 bp, Homo sapiens
gcagcgaccccagga

SEQ ID NO: 1482956 - DNA, 17 bp, Homo sapiens
gcagcgaccgccccctc

SEQ ID NO: 1482957 - DNA, 23 bp, Homo sapiens
gcagcgcacggtctggggaagag

SEQ ID NO: 1482958 - DNA, 16 bp, Homo sapiens
gcagcgcatgtgtgca

SEQ ID NO: 1482959 - DNA, 13 bp, Homo sapiens
gcagcggcagagc

SEQ ID NO: 1482960 - DNA, 21 bp, Homo sapiens
gcagcggcagagcaattccag

SEQ ID NO: 1482961 - DNA, 14 bp, Homo sapiens
gcagcggcaggacc

SEQ ID NO: 1482962 - DNA, 22 bp, Homo sapiens
gcagcgggcggaggggatccag

SEQ ID NO: 1482963 - DNA, 17 bp, Homo sapiens
gcagcgtcccccgccgc

SEQ ID NO: 1482964 - DNA, 21 bp, Homo sapiens
gcagcgtcccccgccgcgcca

SEQ ID NO: 1482965 - DNA, 16 bp, Homo sapiens
gcagcgttagggctgc

SEQ ID NO: 1482966 - DNA, 21 bp, Homo sapiens
gcagcgtttatggtgcttcct

SEQ ID NO: 1482967 - DNA, 22 bp, Homo sapiens
gcagctaagatagaaagctgga

SEQ ID NO: 1482968 - DNA, 24 bp, Homo sapiens
gcagctaagatagaaagctggact

SEQ ID NO: 1482969 - DNA, 17 bp, Homo sapiens
gcagctaccctcagcct

SEQ ID NO: 1482970 - DNA, 19 bp, Homo sapiens
gcagtccccagcccttctg

SEQ ID NO: 1482971 - DNA, 13 bp, Homo sapiens
gcagtcctcagga

SEQ ID NO: 1482972 - DNA, 21 bp, Homo sapiens
gcagtcctcccaccttggcct

SEQ ID NO: 1482973 - DNA, 17 bp, Homo sapiens
gcagtcctgaggagagg

SEQ ID NO: 1482974 - DNA, 18 bp, Homo sapiens
gcagtcctgcctcagcct

SEQ ID NO: 1482975 - DNA, 18 bp, Homo sapiens
gcagtcctggaagccagc

SEQ ID NO: 1482976 - DNA, 13 bp, Homo sapiens
gcagtcctggagg

SEQ ID NO: 1482977 - DNA, 22 bp, Homo sapiens
gcagtcctggaggcagggggtg

SEQ ID NO: 1482978 - DNA, 12 bp, Homo sapiens
gcagtcgcagga

SEQ ID NO: 1482979 - DNA, 21 bp, Homo sapiens
gcagtcgcaggatccgctgcc

SEQ ID NO: 1482980 - DNA, 22 bp, Homo sapiens
gcagtcgcaggatccgctgcca

SEQ ID NO: 1482981 - DNA, 23 bp, Homo sapiens
gcagtcgcaggatccgctgccac

SEQ ID NO: 1482982 - DNA, 18 bp, Homo sapiens
gcagtcggcatgccagga

SEQ ID NO: 1482983 - DNA, 20 bp, Homo sapiens
gcagtcggcatgccaggacc

SEQ ID NO: 1482984 - DNA, 17 bp, Homo sapiens
gcagtcgggggctggcc

SEQ ID NO: 1482985 - DNA, 13 bp, Homo sapiens
gcagtcgtgcctg

SEQ ID NO: 1482986 - DNA, 15 bp, Homo sapiens
gcagtcgtgcctgtg

SEQ ID NO: 1482987 - DNA, 17 bp, Homo sapiens
gcagtcgtgcctgtgtc

SEQ ID NO: 1482988 - DNA, 13 bp, Homo sapiens
gcagtctgaaccc

SEQ ID NO: 1482989 - DNA, 14 bp, Homo sapiens
gcagtctgaaccct

SEQ ID NO: 1482990 - DNA, 12 bp, Homo sapiens
gcagtctgcctg

SEQ ID NO: 1482991 - DNA, 15 bp, Homo sapiens
gcagtcttctctctg

SEQ ID NO: 1482992 - DNA, 17 bp, Homo sapiens
gcagtcttctctctggc

SEQ ID NO: 1482993 - DNA, 23 bp, Homo sapiens
gcagtcttctctctggctcaggt

SEQ ID NO: 1482994 - DNA, 14 bp, Homo sapiens
gcagtgactggcag

SEQ ID NO: 1482995 - DNA, 18 bp, Homo sapiens
gcagtgactggcaggtgc

SEQ ID NO: 1482996 - DNA, 16 bp, Homo sapiens
gcagtgagcagggttc

SEQ ID NO: 1482997 - DNA, 19 bp, Homo sapiens
gcagtgagcagggttcctg

SEQ ID NO: 1482998 - DNA, 14 bp, Homo sapiens
gcagtgagctgtgt

SEQ ID NO: 1482999 - DNA, 19 bp, Homo sapiens
gcagtgatctcagggcaga

SEQ ID NO: 1483000 - DNA, 13 bp, Homo sapiens
gcagtgatgtcac

SEQ ID NO: 1483001 - DNA, 17 bp, Homo sapiens
gcagtgattcagcaggc

SEQ ID NO: 1483002 - DNA, 19 bp, Homo sapiens
gcagtgcaatgcttgtaga

SEQ ID NO: 1483003 - DNA, 13 bp, Homo sapiens
gcagtgcacattt

SEQ ID NO: 1483004 - DNA, 20 bp, Homo sapiens
gcagtgcatgtgaagcatgc

SEQ ID NO: 1483005 - DNA, 12 bp, Homo sapiens
gcagtgccaccc

SEQ ID NO: 1483006 - DNA, 14 bp, Homo sapiens
gcagtgccagctcc

SEQ ID NO: 1483007 - DNA, 17 bp, Homo sapiens
gcagtgccagctccctc

SEQ ID NO: 1483008 - DNA, 18 bp, Homo sapiens
gcagtgcccatgtgtaca

SEQ ID NO: 1483009 - DNA, 16 bp, Homo sapiens
gcagtgcctaaaaccc

SEQ ID NO: 1483010 - DNA, 17 bp, Homo sapiens
gcagtgcctcgaggcac

SEQ ID NO: 1483011 - DNA, 19 bp, Homo sapiens
gcagtgcctcgaggcaccg

SEQ ID NO: 1483012 - DNA, 15 bp, Homo sapiens
gcagtgccttgggga

SEQ ID NO: 1483013 - DNA, 22 bp, Homo sapiens
gcagtgcgcgtgcacgtggaga

SEQ ID NO: 1483014 - DNA, 14 bp, Homo sapiens
gcagtgctgggacc

SEQ ID NO: 1483015 - DNA, 17 bp, Homo sapiens
gcagtgctgggaccaga

SEQ ID NO: 1483016 - DNA, 18 bp, Homo sapiens
gcagtgctgggaccagag

SEQ ID NO: 1483017 - DNA, 22 bp, Homo sapiens
gcagtgctgggaccagagccag

SEQ ID NO: 1483018 - DNA, 23 bp, Homo sapiens
gcagtgcttccaaggatggacca

SEQ ID NO: 1483019 - DNA, 16 bp, Homo sapiens
gcagtgcttctctaca

SEQ ID NO: 1483020 - DNA, 21 bp, Homo sapiens
gcagtggacatcgtaggcagc

SEQ ID NO: 1483021 - DNA, 14 bp, Homo sapiens
gcagtggagaggga

SEQ ID NO: 1483022 - DNA, 19 bp, Homo sapiens
gcagtggaggctgctgtga

SEQ ID NO: 1483023 - DNA, 14 bp, Homo sapiens
gcagtggaggtggg

SEQ ID NO: 1483024 - DNA, 23 bp, Homo sapiens
gcagtggaggtggggtgtttggg

SEQ ID NO: 1483025 - DNA, 22 bp, Homo sapiens
gcagtggcatcatctcagctca

SEQ ID NO: 1483026 - DNA, 14 bp, Homo sapiens
gcagtggccaggca

SEQ ID NO: 1483027 - DNA, 15 bp, Homo sapiens
gcagtggccaggcag

SEQ ID NO: 1483028 - DNA, 23 bp, Homo sapiens
gcagtggcctggccgttcagcct

SEQ ID NO: 1483029 - DNA, 15 bp, Homo sapiens
gcagtggctggtcca

SEQ ID NO: 1483030 - DNA, 18 bp, Homo sapiens
gcagtggctggtccaggg

SEQ ID NO: 1483031 - DNA, 19 bp, Homo sapiens
gcagtggctggtccagggc

SEQ ID NO: 1483032 - DNA, 21 bp, Homo sapiens
gcagtgggacagggcatggcc

SEQ ID NO: 1483033 - DNA, 17 bp, Homo sapiens
gcagtgggcaggtggcc

SEQ ID NO: 1483034 - DNA, 14 bp, Homo sapiens
gcagtgggtggagg

SEQ ID NO: 1483035 - DNA, 21 bp, Homo sapiens
gcagtgtcccctgccccagag

SEQ ID NO: 1483036 - DNA, 14 bp, Homo sapiens
gcagtgtctccacc

SEQ ID NO: 1483037 - DNA, 11 bp, Homo sapiens
gcagtgtcttc

SEQ ID NO: 1483038 - DNA, 12 bp, Homo sapiens
gcagtgtggcct

SEQ ID NO: 1483039 - DNA, 13 bp, Homo sapiens
gcagttacaaatt

SEQ ID NO: 1483040 - DNA, 22 bp, Homo sapiens
gcagttagccccagaaaatgaa

SEQ ID NO: 1483041 - DNA, 17 bp, Homo sapiens
gcagttagctgaagaat

SEQ ID NO: 1483042 - DNA, 19 bp, Homo sapiens
gcagttcaaatcctcacca

SEQ ID NO: 1483043 - DNA, 21 bp, Homo sapiens
gcagttcagaatggcagtcct

SEQ ID NO: 1483044 - DNA, 23 bp, Homo sapiens
gcagttctagaagccacagtgcc

SEQ ID NO: 1483045 - DNA, 19 bp, Homo sapiens
gcagttgaaaagactccaa

SEQ ID NO: 1483046 - DNA, 20 bp, Homo sapiens
gcagttgacatccaaatcta

SEQ ID NO: 1483047 - DNA, 18 bp, Homo sapiens
gcagttggccaagcagaa

SEQ ID NO: 1483048 - DNA, 15 bp, Homo sapiens
gcagtttcctggaaa

SEQ ID NO: 1483049 - DNA, 12 bp, Homo sapiens
gcagtttgcaaa

SEQ ID NO: 1483050 - DNA, 21 bp, Homo sapiens
gcagtttggccctggagccag

SEQ ID NO: 1483051 - DNA, 15 bp, Homo sapiens
gcagttttcccctgg

SEQ ID NO: 1483052 - DNA, 14 bp, Homo sapiens
gcagttttgtaaat

SEQ ID NO: 1483053 - DNA, 23 bp, Homo sapiens
gcagtttttcaggagcgcaagat

SEQ ID NO: 1483054 - DNA, 16 bp, Homo sapiens
gcataaaaacatttta

SEQ ID NO: 1483055 - DNA, 15 bp, Homo sapiens
gcataaattgcatca

SEQ ID NO: 1483056 - DNA, 16 bp, Homo sapiens
gcataagattaaagga

SEQ ID NO: 1483057 - DNA, 23 bp, Homo sapiens
gcataagattaaaggaaggaaaa

SEQ ID NO: 1483058 - DNA, 23 bp, Homo sapiens
gcatacacacatgccctcctgga

SEQ ID NO: 1483059 - DNA, 15 bp, Homo sapiens
gcatacactgtagtt

SEQ ID NO: 1483060 - DNA, 13 bp, Homo sapiens
gcatacagttttc

SEQ ID NO: 1483061 - DNA, 23 bp, Homo sapiens
gcataccaattacccataaacag

SEQ ID NO: 1483062 - DNA, 22 bp, Homo sapiens
gcatactccgtgaggctgctgc

SEQ ID NO: 1483063 - DNA, 21 bp, Homo sapiens
gcatacttcaaaactgtttgt

SEQ ID NO: 1483064 - DNA, 14 bp, Homo sapiens
gcatactttgtaaa

SEQ ID NO: 1483065 - DNA, 20 bp, Homo sapiens
gcatagactgaggtataaag

SEQ ID NO: 1483066 - DNA, 23 bp, Homo sapiens
gcatagataatattgtttggtaa

SEQ ID NO: 1483067 - DNA, 23 bp, Homo sapiens
gcatagccagcattcagcacaca

SEQ ID NO: 1483068 - DNA, 15 bp, Homo sapiens
gcatagcgtcctgcc

SEQ ID NO: 1483069 - DNA, 18 bp, Homo sapiens
gcatagcgtcctgccctg

SEQ ID NO: 1483070 - DNA, 12 bp, Homo sapiens
gcataggcctgg

SEQ ID NO: 1483071 - DNA, 23 bp, Homo sapiens
gcataggcctgggtgctggctgc

SEQ ID NO: 1483072 - DNA, 19 bp, Homo sapiens
gcatagggtcactttgcca

SEQ ID NO: 1483073 - DNA, 18 bp, Homo sapiens
gcatagttgtagacaaag

SEQ ID NO: 1483074 - DNA, 14 bp, Homo sapiens
gcatatacagtgaa

SEQ ID NO: 1483075 - DNA, 14 bp, Homo sapiens
gcatatatatatgt

SEQ ID NO: 1483076 - DNA, 23 bp, Homo sapiens
gcatatcacccttccctgctccc

SEQ ID NO: 1483077 - DNA, 16 bp, Homo sapiens
gcatatctgcctcccc

SEQ ID NO: 1483078 - DNA, 19 bp, Homo sapiens
gcatatgacaaatgtttct

SEQ ID NO: 1483079 - DNA, 11 bp, Homo sapiens
gcatatgcagc

SEQ ID NO: 1483080 - DNA, 21 bp, Homo sapiens
gcatattcatggttgtttttt

SEQ ID NO: 1483081 - DNA, 23 bp, Homo sapiens
gcatatttatccaaaatgtgtat

SEQ ID NO: 1483082 - DNA, 19 bp, Homo sapiens
gcatatttgccaataaagc

SEQ ID NO: 1483083 - DNA, 20 bp, Homo sapiens
gcatatttgccaataaagct

SEQ ID NO: 1483084 - DNA, 22 bp, Homo sapiens
gcatatttgccaataaagcttt

SEQ ID NO: 1483085 - DNA, 14 bp, Homo sapiens
gcatatttgtatag

SEQ ID NO: 1483086 - DNA, 15 bp, Homo sapiens
gcatattttgagaaa

SEQ ID NO: 1483087 - DNA, 20 bp, Homo sapiens
gcatattttgagaaactgct

SEQ ID NO: 1483088 - DNA, 13 bp, Homo sapiens
gcatattttgctg

SEQ ID NO: 1483089 - DNA, 15 bp, Homo sapiens
gcatattttgctggt

SEQ ID NO: 1483090 - DNA, 20 bp, Homo sapiens
gcatatttttcacatatcta

SEQ ID NO: 1483091 - DNA, 24 bp, Homo sapiens
gcatcaaccaggaagagttctatc

SEQ ID NO: 1483092 - DNA, 22 bp, Homo sapiens
gcatcaagggagacaccagtgg

SEQ ID NO: 1483093 - DNA, 21 bp, Homo sapiens
gcatcaaggtcagcatgagga

SEQ ID NO: 1483094 - DNA, 14 bp, Homo sapiens
gcatcaatcttgtt

SEQ ID NO: 1483095 - DNA, 18 bp, Homo sapiens
gcatcacacttatatttt

SEQ ID NO: 1483096 - DNA, 19 bp, Homo sapiens
gcatcacacttatatttta

SEQ ID NO: 1483097 - DNA, 14 bp, Homo sapiens
gcatcacctcaggc

SEQ ID NO: 1483098 - DNA, 14 bp, Homo sapiens
gcatcacctgcctg

SEQ ID NO: 1483099 - DNA, 15 bp, Homo sapiens
gcatcacctgcctgt

SEQ ID NO: 1483100 - DNA, 19 bp, Homo sapiens
gcatcacgtaccccactgg

SEQ ID NO: 1483101 - DNA, 17 bp, Homo sapiens
gcatcactagtgacaag

SEQ ID NO: 1483102 - DNA, 12 bp, Homo sapiens
gcatcagagggc

SEQ ID NO: 1483103 - DNA, 22 bp, Homo sapiens
gcatcagctgctgaaacaacaa

SEQ ID NO: 1483104 - DNA, 13 bp, Homo sapiens
gcatcaggcactg

SEQ ID NO: 1483105 - DNA, 12 bp, Homo sapiens
gcatcagttcat

SEQ ID NO: 1483106 - DNA, 15 bp, Homo sapiens
gcatcatctcagctc

SEQ ID NO: 1483107 - DNA, 16 bp, Homo sapiens
gcatccacccagtgct

SEQ ID NO: 1483108 - DNA, 17 bp, Homo sapiens
gcatccacccagtgctg

SEQ ID NO: 1483109 - DNA, 22 bp, Homo sapiens
gcatccacccagtgctgccatg

SEQ ID NO: 1483110 - DNA, 12 bp, Homo sapiens
gcatccagcctg

SEQ ID NO: 1483111 - DNA, 13 bp, Homo sapiens
gcatcccagggga

SEQ ID NO: 1483112 - DNA, 15 bp, Homo sapiens
gcatcccaggggacc

SEQ ID NO: 1483113 - DNA, 20 bp, Homo sapiens
gcatcccccaaagttcacaa

SEQ ID NO: 1483114 - DNA, 21 bp, Homo sapiens
gcatccctcacccatcctaga

SEQ ID NO: 1483115 - DNA, 13 bp, Homo sapiens
gcatccctgagac

SEQ ID NO: 1483116 - DNA, 13 bp, Homo sapiens
gcatccctggagc

SEQ ID NO: 1483117 - DNA, 19 bp, Homo sapiens
gcatccctggagcaggagc

SEQ ID NO: 1483118 - DNA, 20 bp, Homo sapiens
gcatccctggagcaggagcc

SEQ ID NO: 1483119 - DNA, 19 bp, Homo sapiens
gcatcccttcgcctgcagc

SEQ ID NO: 1483120 - DNA, 17 bp, Homo sapiens
gcatccgtagttccctg

SEQ ID NO: 1483121 - DNA, 13 bp, Homo sapiens
gcatcctggatga

SEQ ID NO: 1483122 - DNA, 15 bp, Homo sapiens
gcatccttcctgggg

SEQ ID NO: 1483123 - DNA, 16 bp, Homo sapiens
gcatccttcctgggga

SEQ ID NO: 1483124 - DNA, 15 bp, Homo sapiens
gcatccttgtaatac

SEQ ID NO: 1483125 - DNA, 14 bp, Homo sapiens
gcatccttgtcttt

SEQ ID NO: 1483126 - DNA, 17 bp, Homo sapiens
gcatccttgtcttttga

SEQ ID NO: 1483127 - DNA, 18 bp, Homo sapiens
gcatccttgtcttttgag

SEQ ID NO: 1483128 - DNA, 17 bp, Homo sapiens
gcatcgcatcctcttcc

SEQ ID NO: 1483129 - DNA, 22 bp, Homo sapiens
gcatcggacaagacccccagca

SEQ ID NO: 1483130 - DNA, 18 bp, Homo sapiens
gcatcgggagcacccaga

SEQ ID NO: 1483131 - DNA, 19 bp, Homo sapiens
gcatcgggagcacccagag

SEQ ID NO: 1483132 - DNA, 19 bp, Homo sapiens
gcatcgtagaagagatgtg

SEQ ID NO: 1483133 - DNA, 21 bp, Homo sapiens
gcatcgtgacccttcagggcc

SEQ ID NO: 1483134 - DNA, 20 bp, Homo sapiens
gcatctactctaaagaaaaa

SEQ ID NO: 1483135 - DNA, 15 bp, Homo sapiens
gcatctcagcccaca

SEQ ID NO: 1483136 - DNA, 16 bp, Homo sapiens
gcatctcaggaggggc

SEQ ID NO: 1483137 - DNA, 18 bp, Homo sapiens
gcatctcaggaggggcag

SEQ ID NO: 1483138 - DNA, 21 bp, Homo sapiens
gcatctcccctagctcaccag

SEQ ID NO: 1483139 - DNA, 20 bp, Homo sapiens
gcatctcctcccgcccttcc

SEQ ID NO: 1483140 - DNA, 15 bp, Homo sapiens
gcatctcctgtgcat

SEQ ID NO: 1483141 - DNA, 16 bp, Homo sapiens
gcatctcctgtgcatg

SEQ ID NO: 1483142 - DNA, 18 bp, Homo sapiens
gcatctcttgaggccagg

SEQ ID NO: 1483143 - DNA, 16 bp, Homo sapiens
gcatctgacacaaaaa

SEQ ID NO: 1483144 - DNA, 17 bp, Homo sapiens
gcatctgacacaaaaaa

SEQ ID NO: 1483145 - DNA, 14 bp, Homo sapiens
gcatctgcccctcc

SEQ ID NO: 1483146 - DNA, 15 bp, Homo sapiens
gcatctgcccctccc

SEQ ID NO: 1483147 - DNA, 18 bp, Homo sapiens
gcatctgcccctccccca

SEQ ID NO: 1483148 - DNA, 20 bp, Homo sapiens
gcatctggggcccatactgg

SEQ ID NO: 1483149 - DNA, 16 bp, Homo sapiens
gcatctggtgtaggaa

SEQ ID NO: 1483150 - DNA, 15 bp, Homo sapiens
gcatcttactgaagg

SEQ ID NO: 1483151 - DNA, 16 bp, Homo sapiens
gcatcttactgaaggt

SEQ ID NO: 1483152 - DNA, 23 bp, Homo sapiens
gcatcttactgaaggtaaaattg

SEQ ID NO: 1483153 - DNA, 13 bp, Homo sapiens
gcatcttctccat

SEQ ID NO: 1483154 - DNA, 13 bp, Homo sapiens
gcatcttctggag

SEQ ID NO: 1483155 - DNA, 15 bp, Homo sapiens
gcatcttctggcttg

SEQ ID NO: 1483156 - DNA, 15 bp, Homo sapiens
gcatcttgctggcta

SEQ ID NO: 1483157 - DNA, 15 bp, Homo sapiens
gcatctttgccttgg

SEQ ID NO: 1483158 - DNA, 19 bp, Homo sapiens
gcatcttttgtattaagaa

SEQ ID NO: 1483159 - DNA, 15 bp, Homo sapiens
gcatgaaatgtgaat

SEQ ID NO: 1483160 - DNA, 22 bp, Homo sapiens
gcatgaaatgtgaatttttatt

SEQ ID NO: 1483161 - DNA, 21 bp, Homo sapiens
gcatgaagaattttttctcat

SEQ ID NO: 1483162 - DNA, 19 bp, Homo sapiens
gcatgacagaaaatatgta

SEQ ID NO: 1483163 - DNA, 17 bp, Homo sapiens
gcatgacctgtgaccag

SEQ ID NO: 1483164 - DNA, 22 bp, Homo sapiens
gcatgactaatgctttttagaa

SEQ ID NO: 1483165 - DNA, 18 bp, Homo sapiens
gcatgagactcagtgcag

SEQ ID NO: 1483166 - DNA, 22 bp, Homo sapiens
gcatgagccactgagcctggcc

SEQ ID NO: 1483167 - DNA, 20 bp, Homo sapiens
gcatgataagccgaggaggc

SEQ ID NO: 1483168 - DNA, 16 bp, Homo sapiens
gcatgatctgaaaaat

SEQ ID NO: 1483169 - DNA, 18 bp, Homo sapiens
gcatgatctgaaaaatac

SEQ ID NO: 1483170 - DNA, 20 bp, Homo sapiens
gcatgatcttgttactgtga

SEQ ID NO: 1483171 - DNA, 15 bp, Homo sapiens
gcatgatgggaaaat

SEQ ID NO: 1483172 - DNA, 13 bp, Homo sapiens
gcatgatgtttgc

SEQ ID NO: 1483173 - DNA, 18 bp, Homo sapiens
gcatgatgtttgcccaaa

SEQ ID NO: 1483174 - DNA, 21 bp, Homo sapiens
gcatgcaaatgagctctgaaa

SEQ ID NO: 1483175 - DNA, 15 bp, Homo sapiens
gcatgcacacggctg

SEQ ID NO: 1483176 - DNA, 15 bp, Homo sapiens
gcatgcacgggcatg

SEQ ID NO: 1483177 - DNA, 18 bp, Homo sapiens
gcatgcacgggcatgcac

SEQ ID NO: 1483178 - DNA, 19 bp, Homo sapiens
gcatgcacgggcatgcaca

SEQ ID NO: 1483179 - DNA, 20 bp, Homo sapiens
gcatgccacgccccgtgtct

SEQ ID NO: 1483180 - DNA, 21 bp, Homo sapiens
gcatgccacgccccgtgtctg

SEQ ID NO: 1483181 - DNA, 22 bp, Homo sapiens
gcatgccacgccccgtgtctgg

SEQ ID NO: 1483182 - DNA, 14 bp, Homo sapiens
gcatgccatgtctg

SEQ ID NO: 1483183 - DNA, 19 bp, Homo sapiens
gcatgcctctgatatggga

SEQ ID NO: 1483184 - DNA, 18 bp, Homo sapiens
gcatgcctgtagtctcag

SEQ ID NO: 1483185 - DNA, 22 bp, Homo sapiens
gcatgcctgtagtctcagctag

SEQ ID NO: 1483186 - DNA, 16 bp, Homo sapiens
gcatgccttccagcac

SEQ ID NO: 1483187 - DNA, 21 bp, Homo sapiens
gcatgccttccagcaccctgc

SEQ ID NO: 1483188 - DNA, 15 bp, Homo sapiens
gcatgcggcccagga

SEQ ID NO: 1483189 - DNA, 14 bp, Homo sapiens
gcatgctctctgca

SEQ ID NO: 1483190 - DNA, 23 bp, Homo sapiens
gcatgctctctgcagccagccca

SEQ ID NO: 1483191 - DNA, 12 bp, Homo sapiens
gcatgctctgga

SEQ ID NO: 1483192 - DNA, 15 bp, Homo sapiens
gcatgctctggaagc

SEQ ID NO: 1483193 - DNA, 13 bp, Homo sapiens
gcatgctgaaaca

SEQ ID NO: 1483194 - DNA, 21 bp, Homo sapiens
gcatgctgcccagccactcca

SEQ ID NO: 1483195 - DNA, 20 bp, Homo sapiens
gcatgctgtagctgcagcct

SEQ ID NO: 1483196 - DNA, 16 bp, Homo sapiens
gcatggaaaaatggtt

SEQ ID NO: 1483197 - DNA, 18 bp, Homo sapiens
gcatggaaggggcttctg

SEQ ID NO: 1483198 - DNA, 19 bp, Homo sapiens
gcatggacagtgtgggcgc

SEQ ID NO: 1483199 - DNA, 18 bp, Homo sapiens
gccaagtggggtgctggg

SEQ ID NO: 1483200 - DNA, 20 bp, Homo sapiens
gccaagtggggtgctgggag

SEQ ID NO: 1483201 - DNA, 22 bp, Homo sapiens
gccaagttatgcagctgttctg

SEQ ID NO: 1483202 - DNA, 15 bp, Homo sapiens
gccaagttcctctag

SEQ ID NO: 1483203 - DNA, 21 bp, Homo sapiens
gccaagttcctctagtgccct

SEQ ID NO: 1483204 - DNA, 15 bp, Homo sapiens
gccaagttgctgtca

SEQ ID NO: 1483205 - DNA, 18 bp, Homo sapiens
gccaagttgctgtcactg

SEQ ID NO: 1483206 - DNA, 18 bp, Homo sapiens
gccaatcccctccttggg

SEQ ID NO: 1483207 - DNA, 22 bp, Homo sapiens
gccaatccctcaccttctgagt

SEQ ID NO: 1483208 - DNA, 12 bp, Homo sapiens
gccaatgaggtc

SEQ ID NO: 1483209 - DNA, 19 bp, Homo sapiens
gccaatgaggtctgaaatg

SEQ ID NO: 1483210 - DNA, 18 bp, Homo sapiens
gccaatgccccactggca

SEQ ID NO: 1483211 - DNA, 23 bp, Homo sapiens
gccaatgcggcccactttcctga

SEQ ID NO: 1483212 - DNA, 16 bp, Homo sapiens
gccaatggagactgtc

SEQ ID NO: 1483213 - DNA, 19 bp, Homo sapiens
gccaatgttgctgatggcc

SEQ ID NO: 1483214 - DNA, 19 bp, Homo sapiens
gccaattgaataggatcaa

SEQ ID NO: 1483215 - DNA, 20 bp, Homo sapiens
gccaattgctaccgagaagg

SEQ ID NO: 1483216 - DNA, 20 bp, Homo sapiens
gccacaaaccaccaggactg

SEQ ID NO: 1483217 - DNA, 23 bp, Homo sapiens
gccacaaatcaaagcaagggctc

SEQ ID NO: 1483218 - DNA, 21 bp, Homo sapiens
gccacaaccctgttttatact

SEQ ID NO: 1483219 - DNA, 13 bp, Homo sapiens
gccacaagctgca

SEQ ID NO: 1483220 - DNA, 19 bp, Homo sapiens
gccacaagctgcactgtga

SEQ ID NO: 1483221 - DNA, 22 bp, Homo sapiens
gccacaagctgcactgtgaacc

SEQ ID NO: 1483222 - DNA, 20 bp, Homo sapiens
gccacaaggaaaaggaggag

SEQ ID NO: 1483223 - DNA, 14 bp, Homo sapiens
gccacaaggacttc

SEQ ID NO: 1483224 - DNA, 17 bp, Homo sapiens
gccacaaggacttcctg

SEQ ID NO: 1483225 - DNA, 19 bp, Homo sapiens
gccacaaggacttcctgtc

SEQ ID NO: 1483226 - DNA, 16 bp, Homo sapiens
gccacaagtcttccag

SEQ ID NO: 1483227 - DNA, 21 bp, Homo sapiens
gccacaatgcagttctgagca

SEQ ID NO: 1483228 - DNA, 18 bp, Homo sapiens
gccacacaaacgtttact

SEQ ID NO: 1483229 - DNA, 12 bp, Homo sapiens
gccacacccagg

SEQ ID NO: 1483230 - DNA, 15 bp, Homo sapiens
gccacaccctcccca

SEQ ID NO: 1483231 - DNA, 17 bp, Homo sapiens
gccacaccctccccatt

SEQ ID NO: 1483232 - DNA, 22 bp, Homo sapiens
gccacacctgagcgctgtggac

SEQ ID NO: 1483233 - DNA, 13 bp, Homo sapiens
gccacacctggcc

SEQ ID NO: 1483234 - DNA, 18 bp, Homo sapiens
gccacactattaccatga

SEQ ID NO: 1483235 - DNA, 14 bp, Homo sapiens
gccacactcagtcc

SEQ ID NO: 1483236 - DNA, 17 bp, Homo sapiens
gccacactcagtccccc

SEQ ID NO: 1483237 - DNA, 18 bp, Homo sapiens
gccacactctccatcacc

SEQ ID NO: 1483238 - DNA, 15 bp, Homo sapiens
gccacactgggcctg

SEQ ID NO: 1483239 - DNA, 22 bp, Homo sapiens
gccacagaccacctgcttctga

SEQ ID NO: 1483240 - DNA, 13 bp, Homo sapiens
gccacagacccct

SEQ ID NO: 1483241 - DNA, 17 bp, Homo sapiens
gccacagacccctggga

SEQ ID NO: 1483242 - DNA, 18 bp, Homo sapiens
gccacagacccctgggag

SEQ ID NO: 1483243 - DNA, 20 bp, Homo sapiens
gccacagacccctgggagct

SEQ ID NO: 1483244 - DNA, 10 bp, Homo sapiens
gccacagcag

SEQ ID NO: 1483245 - DNA, 13 bp, Homo sapiens
gccacagcccagc

SEQ ID NO: 1483246 - DNA, 23 bp, Homo sapiens
gccacagccttcggacagacata

SEQ ID NO: 1483247 - DNA, 14 bp, Homo sapiens
gccacagctgctgg

SEQ ID NO: 1483248 - DNA, 16 bp, Homo sapiens
gccacagcttttgcaa

SEQ ID NO: 1483249 - DNA, 18 bp, Homo sapiens
gccacaggccaaatcctt

SEQ ID NO: 1483250 - DNA, 12 bp, Homo sapiens
gccacaggcctg

SEQ ID NO: 1483251 - DNA, 20 bp, Homo sapiens
gccacaggcctgagatttca

SEQ ID NO: 1483252 - DNA, 18 bp, Homo sapiens
gccacagtacatatgtaa

SEQ ID NO: 1483253 - DNA, 16 bp, Homo sapiens
gccacagtgtcactgg

SEQ ID NO: 1483254 - DNA, 16 bp, Homo sapiens
gccacatgccccaggc

SEQ ID NO: 1483255 - DNA, 18 bp, Homo sapiens
gccacatgccccaggctc

SEQ ID NO: 1483256 - DNA, 21 bp, Homo sapiens
gccacatggagccccctctgc

SEQ ID NO: 1483257 - DNA, 18 bp, Homo sapiens
gccacattgctggctgcc

SEQ ID NO: 1483258 - DNA, 15 bp, Homo sapiens
gccaccacccacccc

SEQ ID NO: 1483259 - DNA, 18 bp, Homo sapiens
gccaccacctttggctgg

SEQ ID NO: 1483260 - DNA, 15 bp, Homo sapiens
gccaccacgtctgcc

SEQ ID NO: 1483261 - DNA, 19 bp, Homo sapiens
gccaccacgtctgccaggc

SEQ ID NO: 1483262 - DNA, 22 bp, Homo sapiens
gccaccacgtctgccaggccca

SEQ ID NO: 1483263 - DNA, 12 bp, Homo sapiens
gccaccaggctg

SEQ ID NO: 1483264 - DNA, 14 bp, Homo sapiens
gccaccaggctggc

SEQ ID NO: 1483265 - DNA, 17 bp, Homo sapiens
gccaccaggctggcgca

SEQ ID NO: 1483266 - DNA, 11 bp, Homo sapiens
gccaccagttc

SEQ ID NO: 1483267 - DNA, 23 bp, Homo sapiens
gccaccatattcagtgctgtggc

SEQ ID NO: 1483268 - DNA, 15 bp, Homo sapiens
gccaccatccccacc

SEQ ID NO: 1483269 - DNA, 17 bp, Homo sapiens
gccaccatgcctggccc

SEQ ID NO: 1483270 - DNA, 14 bp, Homo sapiens
gccaccatggccag

SEQ ID NO: 1483271 - DNA, 17 bp, Homo sapiens
gccacccaagcctgctg

SEQ ID NO: 1483272 - DNA, 19 bp, Homo sapiens
gccacccaagcctgctggc

SEQ ID NO: 1483273 - DNA, 21 bp, Homo sapiens
gccacccatgcagctgctccc

SEQ ID NO: 1483274 - DNA, 23 bp, Homo sapiens
gccaccccagcctggccacgcag

SEQ ID NO: 1483275 - DNA, 16 bp, Homo sapiens
gccacccccagttcct

SEQ ID NO: 1483276 - DNA, 20 bp, Homo sapiens
gccacccccttccctgggag

SEQ ID NO: 1483277 - DNA, 19 bp, Homo sapiens
gccaccccgggctctctgc

SEQ ID NO: 1483278 - DNA, 21 bp, Homo sapiens
gccaccccgggctctctgctg

SEQ ID NO: 1483279 - DNA, 16 bp, Homo sapiens
gccaccccgtgccacc

SEQ ID NO: 1483280 - DNA, 16 bp, Homo sapiens
gccacccctccttcct

SEQ ID NO: 1483281 - DNA, 15 bp, Homo sapiens
gccaccccttcctcc

SEQ ID NO: 1483282 - DNA, 18 bp, Homo sapiens
gccaccccttcctcccca

SEQ ID NO: 1483283 - DNA, 20 bp, Homo sapiens
gccacccgtaggcagcctct

SEQ ID NO: 1483284 - DNA, 19 bp, Homo sapiens
gccaccctacctgttcagt

SEQ ID NO: 1483285 - DNA, 13 bp, Homo sapiens
gccaccctggccc

SEQ ID NO: 1483286 - DNA, 19 bp, Homo sapiens
gccaccgcaggggactgtc

SEQ ID NO: 1483287 - DNA, 17 bp, Homo sapiens
gccaccgcgcctggccg

SEQ ID NO: 1483288 - DNA, 16 bp, Homo sapiens
gccaccgctgccagca

SEQ ID NO: 1483289 - DNA, 15 bp, Homo sapiens
gccaccggcctgtgg

SEQ ID NO: 1483290 - DNA, 19 bp, Homo sapiens
gccaccggcctgtgggtct

SEQ ID NO: 1483291 - DNA, 14 bp, Homo sapiens
gccaccgtttcttc

SEQ ID NO: 1483292 - DNA, 23 bp, Homo sapiens
gccacctagaagtctccctgcac

SEQ ID NO: 1483293 - DNA, 12 bp, Homo sapiens
gccacctcccac

SEQ ID NO: 1483294 - DNA, 17 bp, Homo sapiens
gccacctcccaccccac

SEQ ID NO: 1483295 - DNA, 21 bp, Homo sapiens
gccacctcccaccccactcca

SEQ ID NO: 1483296 - DNA, 22 bp, Homo sapiens
gccacctcccaccccactccag

SEQ ID NO: 1483297 - DNA, 16 bp, Homo sapiens
gccacctcccactcct

SEQ ID NO: 1483298 - DNA, 19 bp, Homo sapiens
gccacctcccactcctgct

SEQ ID NO: 1483299 - DNA, 13 bp, Homo sapiens
gccacctccccta

SEQ ID NO: 1483300 - DNA, 21 bp, Homo sapiens
gccacctcccctatccaccca

SEQ ID NO: 1483301 - DNA, 20 bp, Homo sapiens
gccacctccctgacccgtct

SEQ ID NO: 1483302 - DNA, 13 bp, Homo sapiens
gccacctctccaa

SEQ ID NO: 1483303 - DNA, 13 bp, Homo sapiens
gccacctctgcct

SEQ ID NO: 1483304 - DNA, 14 bp, Homo sapiens
gccacctctgcctc

SEQ ID NO: 1483305 - DNA, 22 bp, Homo sapiens
gccacctgaggtgggcccagga

SEQ ID NO: 1483306 - DNA, 18 bp, Homo sapiens
gccacctgcaagatggac

SEQ ID NO: 1483307 - DNA, 17 bp, Homo sapiens
gccaccttcccacccct

SEQ ID NO: 1483308 - DNA, 15 bp, Homo sapiens
gccacgattgcagga

SEQ ID NO: 1483309 - DNA, 22 bp, Homo sapiens
gccacgcactgggccacggagg

SEQ ID NO: 1483310 - DNA, 14 bp, Homo sapiens
gccacgcagccagg

SEQ ID NO: 1483311 - DNA, 14 bp, Homo sapiens
gccacgcagggcca

SEQ ID NO: 1483312 - DNA, 21 bp, Homo sapiens
gccacgcagggccatccactg

SEQ ID NO: 1483313 - DNA, 14 bp, Homo sapiens
gccacgcctggaag

SEQ ID NO: 1483314 - DNA, 17 bp, Homo sapiens
gccacgctccagctgcc

SEQ ID NO: 1483315 - DNA, 19 bp, Homo sapiens
gccacgctccctctcctgt

SEQ ID NO: 1483316 - DNA, 21 bp, Homo sapiens
gccacggaggagggatgctgc

SEQ ID NO: 1483317 - DNA, 13 bp, Homo sapiens
gccacggccaccc

SEQ ID NO: 1483318 - DNA, 17 bp, Homo sapiens
gccacggccaccctcct

SEQ ID NO: 1483319 - DNA, 12 bp, Homo sapiens
gccacggcctgg

SEQ ID NO: 1483320 - DNA, 13 bp, Homo sapiens
gccacgggggcag

SEQ ID NO: 1483321 - DNA, 16 bp, Homo sapiens
gccacgtcccagcatc

SEQ ID NO: 1483322 - DNA, 13 bp, Homo sapiens
gccacgtgccagg

SEQ ID NO: 1483323 - DNA, 16 bp, Homo sapiens
gccacgtgccaggccc

SEQ ID NO: 1483324 - DNA, 18 bp, Homo sapiens
gccacgtgccaggcccgg

SEQ ID NO: 1483325 - DNA, 22 bp, Homo sapiens
gccacgttggagaagcccgtgt

SEQ ID NO: 1483326 - DNA, 15 bp, Homo sapiens
gccactaaagcttca

SEQ ID NO: 1483327 - DNA, 20 bp, Homo sapiens
gccactacactccagcctga

SEQ ID NO: 1483328 - DNA, 16 bp, Homo sapiens
gccactcaacagagag

SEQ ID NO: 1483329 - DNA, 14 bp, Homo sapiens
gccactcactaggc

SEQ ID NO: 1483330 - DNA, 15 bp, Homo sapiens
gccactcactaggcc

SEQ ID NO: 1483331 - DNA, 16 bp, Homo sapiens
gccactccagacccct

SEQ ID NO: 1483332 - DNA, 22 bp, Homo sapiens
gccactccagacccctggcttt

SEQ ID NO: 1483333 - DNA, 22 bp, Homo sapiens
gccactccccggcatgagactc

SEQ ID NO: 1483334 - DNA, 15 bp, Homo sapiens
gccactccctgagct

SEQ ID NO: 1483335 - DNA, 18 bp, Homo sapiens
gccactcctgccaggccg

SEQ ID NO: 1483336 - DNA, 14 bp, Homo sapiens
gccactcctgtccc

SEQ ID NO: 1483337 - DNA, 14 bp, Homo sapiens
gccactctgcctct

SEQ ID NO: 1483338 - DNA, 17 bp, Homo sapiens
gccactctgcctctgcc

SEQ ID NO: 1483339 - DNA, 19 bp, Homo sapiens
gccactgaagctgggattc

SEQ ID NO: 1483340 - DNA, 18 bp, Homo sapiens
gccactgactgcagggac

SEQ ID NO: 1483341 - DNA, 19 bp, Homo sapiens
gccactgactgcagggaca

SEQ ID NO: 1483342 - DNA, 16 bp, Homo sapiens
gccactgacttgctgt

SEQ ID NO: 1483343 - DNA, 12 bp, Homo sapiens
gccactgcactc

SEQ ID NO: 1483344 - DNA, 19 bp, Homo sapiens
gccactgcactccaatctg

SEQ ID NO: 1483345 - DNA, 12 bp, Homo sapiens
gccactgccagg

SEQ ID NO: 1483346 - DNA, 22 bp, Homo sapiens
gccactgccgcctactggacgc

SEQ ID NO: 1483347 - DNA, 18 bp, Homo sapiens
gccactgccttcgcttct

SEQ ID NO: 1483348 - DNA, 21 bp, Homo sapiens
gccactgcgggagctctgtat

SEQ ID NO: 1483349 - DNA, 20 bp, Homo sapiens
gccactgctttccagcctgg

SEQ ID NO: 1483350 - DNA, 16 bp, Homo sapiens
gccactgggcacctgc

SEQ ID NO: 1483351 - DNA, 19 bp, Homo sapiens
gccactgggcacctgcgca

SEQ ID NO: 1483352 - DNA, 18 bp, Homo sapiens
gccactggtttctcagaa

SEQ ID NO: 1483353 - DNA, 14 bp, Homo sapiens
gccactgtggccag

SEQ ID NO: 1483354 - DNA, 18 bp, Homo sapiens
gccactgtggccagagct

SEQ ID NO: 1483355 - DNA, 19 bp, Homo sapiens
gccactgtggccagagctg

SEQ ID NO: 1483356 - DNA, 18 bp, Homo sapiens
gccacttccttttaactg

SEQ ID NO: 1483357 - DNA, 21 bp, Homo sapiens
gccacttctcactcaccacta

SEQ ID NO: 1483358 - DNA, 15 bp, Homo sapiens
gccacttctccccag

SEQ ID NO: 1483359 - DNA, 20 bp, Homo sapiens
gccacttctggcttcagccc

SEQ ID NO: 1483360 - DNA, 14 bp, Homo sapiens
gccacttctgggtg

SEQ ID NO: 1483361 - DNA, 23 bp, Homo sapiens
gccacttctgggtggggcagtgg

SEQ ID NO: 1483362 - DNA, 22 bp, Homo sapiens
gccacttcttaaaggcctggaa

SEQ ID NO: 1483363 - DNA, 20 bp, Homo sapiens
gccacttggtttttggctct

SEQ ID NO: 1483364 - DNA, 23 bp, Homo sapiens
gccactttacccacctagaacac

SEQ ID NO: 1483365 - DNA, 21 bp, Homo sapiens
gccactttcaagctgcactga

SEQ ID NO: 1483366 - DNA, 14 bp, Homo sapiens
gccactttggctga

SEQ ID NO: 1483367 - DNA, 15 bp, Homo sapiens
gccactttggcttct

SEQ ID NO: 1483368 - DNA, 21 bp, Homo sapiens
gccactttggtacatggccag

SEQ ID NO: 1483369 - DNA, 23 bp, Homo sapiens
gccacttttgactagggattcag

SEQ ID NO: 1483370 - DNA, 23 bp, Homo sapiens
gccagaaactccttttgctgtct

SEQ ID NO: 1483371 - DNA, 13 bp, Homo sapiens
gccagaaagcact

SEQ ID NO: 1483372 - DNA, 20 bp, Homo sapiens
gccagaaggagggcagagcc

SEQ ID NO: 1483373 - DNA, 14 bp, Homo sapiens
gccagaagtaccag

SEQ ID NO: 1483374 - DNA, 17 bp, Homo sapiens
gccagaagtaccagact

SEQ ID NO: 1483375 - DNA, 17 bp, Homo sapiens
gccagacacaggccctc

SEQ ID NO: 1483376 - DNA, 14 bp, Homo sapiens
gccagacatgtggt

SEQ ID NO: 1483377 - DNA, 15 bp, Homo sapiens
gccagaccacagcag

SEQ ID NO: 1483378 - DNA, 15 bp, Homo sapiens
gccagacccactgaa

SEQ ID NO: 1483379 - DNA, 14 bp, Homo sapiens
gccagactggaaga

SEQ ID NO: 1483380 - DNA, 16 bp, Homo sapiens
gccagacttgcttcct

SEQ ID NO: 1483381 - DNA, 13 bp, Homo sapiens
gccagagaggagc

SEQ ID NO: 1483382 - DNA, 15 bp, Homo sapiens
gccagagaggagcac

SEQ ID NO: 1483383 - DNA, 17 bp, Homo sapiens
gccagagaggagcacct

SEQ ID NO: 1483384 - DNA, 18 bp, Homo sapiens
gccagagaggagcacctg

SEQ ID NO: 1483385 - DNA, 15 bp, Homo sapiens
gccagagagggccca

SEQ ID NO: 1483386 - DNA, 16 bp, Homo sapiens
gccagagatccaaaag

SEQ ID NO: 1483387 - DNA, 21 bp, Homo sapiens
gccagagatccaaaagaagcc

SEQ ID NO: 1483388 - DNA, 23 bp, Homo sapiens
gccagagatccaaaagaagcccc

SEQ ID NO: 1483389 - DNA, 17 bp, Homo sapiens
gccagagcaggagcccc

SEQ ID NO: 1483390 - DNA, 18 bp, Homo sapiens
gccagagcaggagcccct

SEQ ID NO: 1483391 - DNA, 14 bp, Homo sapiens
gccagagccaacct

SEQ ID NO: 1483392 - DNA, 19 bp, Homo sapiens
gccagagccaacctggact

SEQ ID NO: 1483393 - DNA, 22 bp, Homo sapiens
gccagagccaacctggacttcc

SEQ ID NO: 1483394 - DNA, 14 bp, Homo sapiens
gccagagccagggg

SEQ ID NO: 1483395 - DNA, 23 bp, Homo sapiens
gccagagcccttcactgccatga

SEQ ID NO: 1483396 - DNA, 12 bp, Homo sapiens
gccagagcctgg

SEQ ID NO: 1483397 - DNA, 19 bp, Homo sapiens
gccagagctgaaccttgag

SEQ ID NO: 1483398 - DNA, 16 bp, Homo sapiens
gccagagctggaaggc

SEQ ID NO: 1483399 - DNA, 17 bp, Homo sapiens
gccagagctgtgcctgc

SEQ ID NO: 1483400 - DNA, 22 bp, Homo sapiens
gccagagctgtgcctgctcagc

SEQ ID NO: 1483401 - DNA, 15 bp, Homo sapiens
gccagagctttgttt

SEQ ID NO: 1483402 - DNA, 16 bp, Homo sapiens
gccagaggaaggaaaa

SEQ ID NO: 1483403 - DNA, 14 bp, Homo sapiens
gccagaggccccca

SEQ ID NO: 1483404 - DNA, 15 bp, Homo sapiens
gccagaggcccccag

SEQ ID NO: 1483405 - DNA, 16 bp, Homo sapiens
gccagaggcccccagc

SEQ ID NO: 1483406 - DNA, 19 bp, Homo sapiens
gccagaggcccccagccca

SEQ ID NO: 1483407 - DNA, 20 bp, Homo sapiens
gccagaggcccccagcccag

SEQ ID NO: 1483408 - DNA, 24 bp, Homo sapiens
gccagaggcccccagcccagggct

SEQ ID NO: 1483409 - DNA, 13 bp, Homo sapiens
gccagaggctggg

SEQ ID NO: 1483410 - DNA, 18 bp, Homo sapiens
gccagagggccagcaggc

SEQ ID NO: 1483411 - DNA, 21 bp, Homo sapiens
gccagagggccagcaggctcc

SEQ ID NO: 1483412 - DNA, 19 bp, Homo sapiens
gccagaggtgggcaggtgg

SEQ ID NO: 1483413 - DNA, 20 bp, Homo sapiens
gccagaggtgggcaggtggt

SEQ ID NO: 1483414 - DNA, 13 bp, Homo sapiens
gccagagtggcct

SEQ ID NO: 1483415 - DNA, 15 bp, Homo sapiens
gccagagtggcctgg

SEQ ID NO: 1483416 - DNA, 19 bp, Homo sapiens
gccagagtggcctggccag

SEQ ID NO: 1483417 - DNA, 22 bp, Homo sapiens
gccagagttcctgcggagtgaa

SEQ ID NO: 1483418 - DNA, 15 bp, Homo sapiens
gccagagtttttaaa

SEQ ID NO: 1483419 - DNA, 20 bp, Homo sapiens
gccagatgcaggacaggagg

SEQ ID NO: 1483420 - DNA, 21 bp, Homo sapiens
gccagatgcaggacaggaggc

SEQ ID NO: 1483421 - DNA, 15 bp, Homo sapiens
gccagatgcctcccc

SEQ ID NO: 1483422 - DNA, 20 bp, Homo sapiens
gccagatgcctccccaagac

SEQ ID NO: 1483423 - DNA, 21 bp, Homo sapiens
gccagatgttgttcctggcta

SEQ ID NO: 1483424 - DNA, 14 bp, Homo sapiens
gccagatttgtctt

SEQ ID NO: 1483425 - DNA, 15 bp, Homo sapiens
gccagatttgtcttt

SEQ ID NO: 1483426 - DNA, 20 bp, Homo sapiens
gccagatttgtctttttgtt

SEQ ID NO: 1483427 - DNA, 18 bp, Homo sapiens
gccagcaacgcttgtaga

SEQ ID NO: 1483428 - DNA, 13 bp, Homo sapiens
gccatctgtagct

SEQ ID NO: 1483429 - DNA, 14 bp, Homo sapiens
gccatctgttttca

SEQ ID NO: 1483430 - DNA, 12 bp, Homo sapiens
gccatcttcagg

SEQ ID NO: 1483431 - DNA, 22 bp, Homo sapiens
gccatcttctccccgaggctgc

SEQ ID NO: 1483432 - DNA, 13 bp, Homo sapiens
gccatgaacaaat

SEQ ID NO: 1483433 - DNA, 22 bp, Homo sapiens
gccatgaacaaattctttagta

SEQ ID NO: 1483434 - DNA, 19 bp, Homo sapiens
gccatgatcagacatacag

SEQ ID NO: 1483435 - DNA, 18 bp, Homo sapiens
gccatgatcgagccactg

SEQ ID NO: 1483436 - DNA, 21 bp, Homo sapiens
gccatgatggcaacagatctg

SEQ ID NO: 1483437 - DNA, 17 bp, Homo sapiens
gccatgatttcccactg

SEQ ID NO: 1483438 - DNA, 19 bp, Homo sapiens
gccatgatttgtcccagcc

SEQ ID NO: 1483439 - DNA, 21 bp, Homo sapiens
gccatgatttgtcccagcctg

SEQ ID NO: 1483440 - DNA, 15 bp, Homo sapiens
gccatgcagaaagca

SEQ ID NO: 1483441 - DNA, 20 bp, Homo sapiens
gccatgcagacctcatgccc

SEQ ID NO: 1483442 - DNA, 22 bp, Homo sapiens
gccatgcagacctcatgcccag

SEQ ID NO: 1483443 - DNA, 13 bp, Homo sapiens
gccatgcaggaag

SEQ ID NO: 1483444 - DNA, 18 bp, Homo sapiens
gccatgcaggaagaggcc

SEQ ID NO: 1483445 - DNA, 20 bp, Homo sapiens
gccatgcaggaagaggccca

SEQ ID NO: 1483446 - DNA, 13 bp, Homo sapiens
gccatgcaggagg

SEQ ID NO: 1483447 - DNA, 14 bp, Homo sapiens
gccatgcaggaggt

SEQ ID NO: 1483448 - DNA, 15 bp, Homo sapiens
gccatgccactgcca

SEQ ID NO: 1483449 - DNA, 20 bp, Homo sapiens
gccatgccactgccaggcac

SEQ ID NO: 1483450 - DNA, 22 bp, Homo sapiens
gccatgccactgccaggcacct

SEQ ID NO: 1483451 - DNA, 15 bp, Homo sapiens
gccatgccaggaacc

SEQ ID NO: 1483452 - DNA, 14 bp, Homo sapiens
gccatgcctgctcc

SEQ ID NO: 1483453 - DNA, 17 bp, Homo sapiens
gccatgcctgctccctg

SEQ ID NO: 1483454 - DNA, 14 bp, Homo sapiens
gccatgctgaggcc

SEQ ID NO: 1483455 - DNA, 17 bp, Homo sapiens
gccatgctgaggcctgg

SEQ ID NO: 1483456 - DNA, 19 bp, Homo sapiens
gccatgctgaggcctgggc

SEQ ID NO: 1483457 - DNA, 16 bp, Homo sapiens
gccatgctgggccact

SEQ ID NO: 1483458 - DNA, 22 bp, Homo sapiens
gccatgctgggccactggggac

SEQ ID NO: 1483459 - DNA, 23 bp, Homo sapiens
gccatggatctgatctgtaccat

SEQ ID NO: 1483460 - DNA, 16 bp, Homo sapiens
gccatggcgtgtccct

SEQ ID NO: 1483461 - DNA, 20 bp, Homo sapiens
gccatggctcaggcaagccc

SEQ ID NO: 1483462 - DNA, 21 bp, Homo sapiens
gccatggctcaggcaagcccc

SEQ ID NO: 1483463 - DNA, 23 bp, Homo sapiens
gccatggctcaggcaagcccctc

SEQ ID NO: 1483464 - DNA, 20 bp, Homo sapiens
gccatggctgtctcaaacca

SEQ ID NO: 1483465 - DNA, 19 bp, Homo sapiens
gccatgggcctgggcctgc

SEQ ID NO: 1483466 - DNA, 22 bp, Homo sapiens
gccatggtgggagagactgtga

SEQ ID NO: 1483467 - DNA, 21 bp, Homo sapiens
gccatgtaaatccccactggg

SEQ ID NO: 1483468 - DNA, 14 bp, Homo sapiens
gccatgtccaaaga

SEQ ID NO: 1483469 - DNA, 22 bp, Homo sapiens
gccatgtccaaagaggctgccc

SEQ ID NO: 1483470 - DNA, 12 bp, Homo sapiens
gccatgtctgag

SEQ ID NO: 1483471 - DNA, 20 bp, Homo sapiens
gccatgtgagccaccgctgc

SEQ ID NO: 1483472 - DNA, 17 bp, Homo sapiens
gccatgtgcaccttggg

SEQ ID NO: 1483473 - DNA, 21 bp, Homo sapiens
gccatgtggcagaagtgctct

SEQ ID NO: 1483474 - DNA, 15 bp, Homo sapiens
gccatgttgcccctt

SEQ ID NO: 1483475 - DNA, 16 bp, Homo sapiens
gccattaccatggaga

SEQ ID NO: 1483476 - DNA, 18 bp, Homo sapiens
gccattaccatggagaca

SEQ ID NO: 1483477 - DNA, 20 bp, Homo sapiens
gccattagccagatttgtct

SEQ ID NO: 1483478 - DNA, 21 bp, Homo sapiens
gccattcacttcataatccag

SEQ ID NO: 1483479 - DNA, 16 bp, Homo sapiens
gccattctcaagccct

SEQ ID NO: 1483480 - DNA, 18 bp, Homo sapiens
gccattctcaagccctgc

SEQ ID NO: 1483481 - DNA, 15 bp, Homo sapiens
gccattctgattatt

SEQ ID NO: 1483482 - DNA, 21 bp, Homo sapiens
gccattctgcctcagcctcct

SEQ ID NO: 1483483 - DNA, 17 bp, Homo sapiens
gccattgccaccaggag

SEQ ID NO: 1483484 - DNA, 18 bp, Homo sapiens
gccattgccaccaggaga

SEQ ID NO: 1483485 - DNA, 18 bp, Homo sapiens
gccattggagagctgtct

SEQ ID NO: 1483486 - DNA, 16 bp, Homo sapiens
gccattgtactccagc

SEQ ID NO: 1483487 - DNA, 15 bp, Homo sapiens
gccatttagaatcta

SEQ ID NO: 1483488 - DNA, 19 bp, Homo sapiens
gccatttagaatctagaaa

SEQ ID NO: 1483489 - DNA, 17 bp, Homo sapiens
gccatttccccctcctc

SEQ ID NO: 1483490 - DNA, 18 bp, Homo sapiens
gccatttccttttcacat

SEQ ID NO: 1483491 - DNA, 19 bp, Homo sapiens
gccatttgctagttctgct

SEQ ID NO: 1483492 - DNA, 13 bp, Homo sapiens
gcccaaaatttat

SEQ ID NO: 1483493 - DNA, 23 bp, Homo sapiens
gcccaaaatttattttataagaa

SEQ ID NO: 1483494 - DNA, 15 bp, Homo sapiens
gcccaaagtggggag

SEQ ID NO: 1483495 - DNA, 13 bp, Homo sapiens
gcccaacctcctg

SEQ ID NO: 1483496 - DNA, 15 bp, Homo sapiens
gcccaagagccctgt

SEQ ID NO: 1483497 - DNA, 21 bp, Homo sapiens
gcccaagagccctgtggccgc

SEQ ID NO: 1483498 - DNA, 17 bp, Homo sapiens
gcccaagaggactgaga

SEQ ID NO: 1483499 - DNA, 13 bp, Homo sapiens
gcccaagccccat

SEQ ID NO: 1483500 - DNA, 20 bp, Homo sapiens
gcccaagcttccctccatcc

SEQ ID NO: 1483501 - DNA, 17 bp, Homo sapiens
gcccaaggtgctgatgt

SEQ ID NO: 1483502 - DNA, 20 bp, Homo sapiens
gcccaaggttaaaaagttca

SEQ ID NO: 1483503 - DNA, 14 bp, Homo sapiens
gcccaagtccctgt

SEQ ID NO: 1483504 - DNA, 10 bp, Homo sapiens
gcccaataaa

SEQ ID NO: 1483505 - DNA, 14 bp, Homo sapiens
gcccaatgaataat

SEQ ID NO: 1483506 - DNA, 20 bp, Homo sapiens
gcccaatgctttgggaggcc

SEQ ID NO: 1483507 - DNA, 14 bp, Homo sapiens
gcccacagctccca

SEQ ID NO: 1483508 - DNA, 17 bp, Homo sapiens
gcccacagctcccaccc

SEQ ID NO: 1483509 - DNA, 19 bp, Homo sapiens
gcccacagctcccacccca

SEQ ID NO: 1483510 - DNA, 19 bp, Homo sapiens
gcccacaggaagctcagcc

SEQ ID NO: 1483511 - DNA, 21 bp, Homo sapiens
gcccacaggaagctcagcctt

SEQ ID NO: 1483512 - DNA, 20 bp, Homo sapiens
gcccacatagtgatggttcc

SEQ ID NO: 1483513 - DNA, 23 bp, Homo sapiens
gcccacatcccacatgcggctcg

SEQ ID NO: 1483514 - DNA, 22 bp, Homo sapiens
gcccacatgtgtccatcccagc

SEQ ID NO: 1483515 - DNA, 23 bp, Homo sapiens
gcccacatttgggctcagggttg

SEQ ID NO: 1483516 - DNA, 13 bp, Homo sapiens
gcccaccaccctg

SEQ ID NO: 1483517 - DNA, 16 bp, Homo sapiens
gcccaccatcaccacc

SEQ ID NO: 1483518 - DNA, 14 bp, Homo sapiens
gcccacccacatga

SEQ ID NO: 1483519 - DNA, 13 bp, Homo sapiens
gcccacccacgca

SEQ ID NO: 1483520 - DNA, 17 bp, Homo sapiens
gcccacccccctcccca

SEQ ID NO: 1483521 - DNA, 19 bp, Homo sapiens
gcccacccccctccccaac

SEQ ID NO: 1483522 - DNA, 19 bp, Homo sapiens
gcccaccccctgccctgca

SEQ ID NO: 1483523 - DNA, 22 bp, Homo sapiens
gcccaccccctgccctgcacgt

SEQ ID NO: 1483524 - DNA, 11 bp, Homo sapiens
gcccacccctc

SEQ ID NO: 1483525 - DNA, 16 bp, Homo sapiens
gcccacccctcactcc

SEQ ID NO: 1483526 - DNA, 21 bp, Homo sapiens
gcccacccctcactccccagg

SEQ ID NO: 1483527 - DNA, 15 bp, Homo sapiens
gcccaccctgggctc

SEQ ID NO: 1483528 - DNA, 23 bp, Homo sapiens
gcccaccctgggctccacacagc

SEQ ID NO: 1483529 - DNA, 17 bp, Homo sapiens
gcccacctcggcctccc

SEQ ID NO: 1483530 - DNA, 20 bp, Homo sapiens
gcccacctgcccatcacagg

SEQ ID NO: 1483531 - DNA, 13 bp, Homo sapiens
gcccacctggcca

SEQ ID NO: 1483532 - DNA, 22 bp, Homo sapiens
gcccacgcacgacgtcagcctc

SEQ ID NO: 1483533 - DNA, 20 bp, Homo sapiens
gcccacgccctccctctccc

SEQ ID NO: 1483534 - DNA, 19 bp, Homo sapiens
gcccacgcgcttccctggg

SEQ ID NO: 1483535 - DNA, 15 bp, Homo sapiens
gcccacggtctggag

SEQ ID NO: 1483536 - DNA, 17 bp, Homo sapiens
gcccacggtctggaggc

SEQ ID NO: 1483537 - DNA, 23 bp, Homo sapiens
gcccacgttctctctgcctgtga

SEQ ID NO: 1483538 - DNA, 20 bp, Homo sapiens
gcccactagagggcccatca

SEQ ID NO: 1483539 - DNA, 12 bp, Homo sapiens
gcccactcccca

SEQ ID NO: 1483540 - DNA, 13 bp, Homo sapiens
gcccactccccag

SEQ ID NO: 1483541 - DNA, 16 bp, Homo sapiens
gcccactgcccacccc

SEQ ID NO: 1483542 - DNA, 23 bp, Homo sapiens
gcccactgctggctgcagcggca

SEQ ID NO: 1483543 - DNA, 14 bp, Homo sapiens
gcccactgtcctgg

SEQ ID NO: 1483544 - DNA, 23 bp, Homo sapiens
gcccactgtcctgggcgccctgg

SEQ ID NO: 1483545 - DNA, 22 bp, Homo sapiens
gcccactgtgcctcagagacca

SEQ ID NO: 1483546 - DNA, 15 bp, Homo sapiens
gcccactttcctgag

SEQ ID NO: 1483547 - DNA, 16 bp, Homo sapiens
gcccactttcctgagc

SEQ ID NO: 1483548 - DNA, 18 bp, Homo sapiens
gcccagaaaacctccagt

SEQ ID NO: 1483549 - DNA, 12 bp, Homo sapiens
gcccagaaagcc

SEQ ID NO: 1483550 - DNA, 17 bp, Homo sapiens
gcccagaaagcctctct

SEQ ID NO: 1483551 - DNA, 15 bp, Homo sapiens
gcccagacacatggg

SEQ ID NO: 1483552 - DNA, 13 bp, Homo sapiens
gcccagaccctgg

SEQ ID NO: 1483553 - DNA, 14 bp, Homo sapiens
gcccagaccctggg

SEQ ID NO: 1483554 - DNA, 16 bp, Homo sapiens
gcccagaccggcttct

SEQ ID NO: 1483555 - DNA, 14 bp, Homo sapiens
gcccagactacagg

SEQ ID NO: 1483556 - DNA, 21 bp, Homo sapiens
gcccagacttgcggggggtgg

SEQ ID NO: 1483557 - DNA, 13 bp, Homo sapiens
gcccagagaagcc

SEQ ID NO: 1483558 - DNA, 15 bp, Homo sapiens
gcccagagaagccaa

SEQ ID NO: 1483559 - DNA, 23 bp, Homo sapiens
gcccagagacatacttgaagggc

SEQ ID NO: 1483560 - DNA, 17 bp, Homo sapiens
gcccagagatgcctcca

SEQ ID NO: 1483561 - DNA, 12 bp, Homo sapiens
gcccagagccac

SEQ ID NO: 1483562 - DNA, 17 bp, Homo sapiens
gcccagagcccagctcc

SEQ ID NO: 1483563 - DNA, 18 bp, Homo sapiens
gcccagagcccagctcca

SEQ ID NO: 1483564 - DNA, 17 bp, Homo sapiens
gcccagaggagccaagt

SEQ ID NO: 1483565 - DNA, 22 bp, Homo sapiens
gcccagaggagctgggagccgg

SEQ ID NO: 1483566 - DNA, 23 bp, Homo sapiens
gcccagaggagggcagcagaagg

SEQ ID NO: 1483567 - DNA, 16 bp, Homo sapiens
gcccagagggcccagg

SEQ ID NO: 1483568 - DNA, 20 bp, Homo sapiens
gcccagagggcccaggcagg

SEQ ID NO: 1483569 - DNA, 14 bp, Homo sapiens
gcccagcacctgct

SEQ ID NO: 1483570 - DNA, 19 bp, Homo sapiens
gcccagcacctgctcccag

SEQ ID NO: 1483571 - DNA, 22 bp, Homo sapiens
gcccagcacctgctcccagtgg

SEQ ID NO: 1483572 - DNA, 14 bp, Homo sapiens
gcccagcacctgga

SEQ ID NO: 1483573 - DNA, 15 bp, Homo sapiens
gcccagcacctggag

SEQ ID NO: 1483574 - DNA, 14 bp, Homo sapiens
gcccagcactgtga

SEQ ID NO: 1483575 - DNA, 13 bp, Homo sapiens
gcccagcaggccc

SEQ ID NO: 1483576 - DNA, 20 bp, Homo sapiens
gcccagcatgcaggtggtgg

SEQ ID NO: 1483577 - DNA, 18 bp, Homo sapiens
gcccagcattgctggttc

SEQ ID NO: 1483578 - DNA, 19 bp, Homo sapiens
gcccagcattgctggttct

SEQ ID NO: 1483579 - DNA, 21 bp, Homo sapiens
gcccagcatttggttttacac

SEQ ID NO: 1483580 - DNA, 21 bp, Homo sapiens
gcccagccaaaccctgtctga

SEQ ID NO: 1483581 - DNA, 19 bp, Homo sapiens
gcccagccactccaggagg

SEQ ID NO: 1483582 - DNA, 11 bp, Homo sapiens
gcccagccagg

SEQ ID NO: 1483583 - DNA, 13 bp, Homo sapiens
gcccagccaggcc

SEQ ID NO: 1483584 - DNA, 21 bp, Homo sapiens
gcccagccattaccatggaga

SEQ ID NO: 1483585 - DNA, 14 bp, Homo sapiens
gcccagcccagagc

SEQ ID NO: 1483586 - DNA, 17 bp, Homo sapiens
gcccagcccagagccac

SEQ ID NO: 1483587 - DNA, 18 bp, Homo sapiens
gcccagcccagagccacc

SEQ ID NO: 1483588 - DNA, 21 bp, Homo sapiens
gcccagcccatttgggctctg

SEQ ID NO: 1483589 - DNA, 15 bp, Homo sapiens
gcccagccccagccc

SEQ ID NO: 1483590 - DNA, 18 bp, Homo sapiens
gcccagcccctactgctg

SEQ ID NO: 1483591 - DNA, 13 bp, Homo sapiens
gcccagcccctcc

SEQ ID NO: 1483592 - DNA, 12 bp, Homo sapiens
gcccagccctcc

SEQ ID NO: 1483593 - DNA, 16 bp, Homo sapiens
gcccagccctccccat

SEQ ID NO: 1483594 - DNA, 20 bp, Homo sapiens
gcccagccggcctctctggc

SEQ ID NO: 1483595 - DNA, 23 bp, Homo sapiens
gcccagccggcctctctggcctc

SEQ ID NO: 1483596 - DNA, 24 bp, Homo sapiens
gcccagccggcctctctggcctcc

SEQ ID NO: 1483597 - DNA, 15 bp, Homo sapiens
gcccagccgggcaca

SEQ ID NO: 1483598 - DNA, 23 bp, Homo sapiens
gcccagccgggcacagtggcgca

SEQ ID NO: 1483599 - DNA, 16 bp, Homo sapiens
gcccagcgcggccagc

SEQ ID NO: 1483600 - DNA, 18 bp, Homo sapiens
gcccagcgcggccagcgt

SEQ ID NO: 1483601 - DNA, 18 bp, Homo sapiens
gcccagcgctctcctgga

SEQ ID NO: 1483602 - DNA, 20 bp, Homo sapiens
gcccagcgctctcctggacg

SEQ ID NO: 1483603 - DNA, 18 bp, Homo sapiens
gcccagcggcccctccca

SEQ ID NO: 1483604 - DNA, 19 bp, Homo sapiens
gcccagcggcccctcccac

SEQ ID NO: 1483605 - DNA, 20 bp, Homo sapiens
gcccagcggcccctcccaca

SEQ ID NO: 1483606 - DNA, 15 bp, Homo sapiens
gcccagctacattcc

SEQ ID NO: 1483607 - DNA, 16 bp, Homo sapiens
gcccagctacattcct

SEQ ID NO: 1483608 - DNA, 17 bp, Homo sapiens
gcccagctacattcctc

SEQ ID NO: 1483609 - DNA, 16 bp, Homo sapiens
gcccagctccgcctgc

SEQ ID NO: 1483610 - DNA, 17 bp, Homo sapiens
gcccagctcctgaataa

SEQ ID NO: 1483611 - DNA, 13 bp, Homo sapiens
gcccagctcttgc

SEQ ID NO: 1483612 - DNA, 14 bp, Homo sapiens
gcccagctgcacct

SEQ ID NO: 1483613 - DNA, 23 bp, Homo sapiens
gcccagctgcacctgccagcctg

SEQ ID NO: 1483614 - DNA, 24 bp, Homo sapiens
gcccagctgcacctgccagcctgg

SEQ ID NO: 1483615 - DNA, 11 bp, Homo sapiens
gcccagctggc

SEQ ID NO: 1483616 - DNA, 15 bp, Homo sapiens
gcccagctgggctct

SEQ ID NO: 1483617 - DNA, 17 bp, Homo sapiens
gcccagctggtgggaag

SEQ ID NO: 1483618 - DNA, 17 bp, Homo sapiens
gcccagctgtagccatg

SEQ ID NO: 1483619 - DNA, 22 bp, Homo sapiens
gcccagctgtagccatggctca

SEQ ID NO: 1483620 - DNA, 17 bp, Homo sapiens
gcccagcttgggcccag

SEQ ID NO: 1483621 - DNA, 20 bp, Homo sapiens
gcccagcttgggcccagctg

SEQ ID NO: 1483622 - DNA, 20 bp, Homo sapiens
gcccaggaatttgaagctgc

SEQ ID NO: 1483623 - DNA, 14 bp, Homo sapiens
gcccaggaccagct

SEQ ID NO: 1483624 - DNA, 17 bp, Homo sapiens
gcccaggaccagctggg

SEQ ID NO: 1483625 - DNA, 19 bp, Homo sapiens
gcccaggagacctccagct

SEQ ID NO: 1483626 - DNA, 20 bp, Homo sapiens
gcccaggagagccagccctc

SEQ ID NO: 1483627 - DNA, 14 bp, Homo sapiens
gcccaggagctctg

SEQ ID NO: 1483628 - DNA, 19 bp, Homo sapiens
gcccaggagctctgcgcca

SEQ ID NO: 1483629 - DNA, 20 bp, Homo sapiens
gcccaggagtttgaggctgc

SEQ ID NO: 1483630 - DNA, 16 bp, Homo sapiens
gcccaggcaccaccag

SEQ ID NO: 1483631 - DNA, 17 bp, Homo sapiens
gcccaggcaccaccagg

SEQ ID NO: 1483632 - DNA, 18 bp, Homo sapiens
gcccaggcaccaccagga

SEQ ID NO: 1483633 - DNA, 20 bp, Homo sapiens
gcccaggcaccaccaggagc

SEQ ID NO: 1483634 - DNA, 21 bp, Homo sapiens
gcccaggcaccaccaggagca

SEQ ID NO: 1483635 - DNA, 15 bp, Homo sapiens
gcccaggcaggtctg

SEQ ID NO: 1483636 - DNA, 16 bp, Homo sapiens
gcccaggcaggtctgc

SEQ ID NO: 1483637 - DNA, 22 bp, Homo sapiens
gcccaggcaggtctgcaagggc

SEQ ID NO: 1483638 - DNA, 20 bp, Homo sapiens
gcccaggccagagtgcagtg

SEQ ID NO: 1483639 - DNA, 20 bp, Homo sapiens
gcccaggcccttggctgcag

SEQ ID NO: 1483640 - DNA, 21 bp, Homo sapiens
gcccaggccgttccccttggc

SEQ ID NO: 1483641 - DNA, 10 bp, Homo sapiens
gcccaggcct

SEQ ID NO: 1483642 - DNA, 19 bp, Homo sapiens
gcccaggcctctcggtgct

SEQ ID NO: 1483643 - DNA, 19 bp, Homo sapiens
gcccaggctggagtgcagt

SEQ ID NO: 1483644 - DNA, 15 bp, Homo sapiens
gcccaggctgggaac

SEQ ID NO: 1483645 - DNA, 15 bp, Homo sapiens
gcccaggcttcctgg

SEQ ID NO: 1483646 - DNA, 19 bp, Homo sapiens
gcccaggcttcctgggtcc

SEQ ID NO: 1483647 - DNA, 22 bp, Homo sapiens
gcccaggcttcctgggtcctgc

SEQ ID NO: 1483648 - DNA, 20 bp, Homo sapiens
gcccagggcatcttgctggc

SEQ ID NO: 1483649 - DNA, 21 bp, Homo sapiens
gcccagggcatcttgctggct

SEQ ID NO: 1483650 - DNA, 19 bp, Homo sapiens
gcccagggccactctgcct

SEQ ID NO: 1483651 - DNA, 14 bp, Homo sapiens
gcccagggcccaga

SEQ ID NO: 1483652 - DNA, 12 bp, Homo sapiens
gcccagggctca

SEQ ID NO: 1483653 - DNA, 12 bp, Homo sapiens
gcccagggctcc

SEQ ID NO: 1483654 - DNA, 16 bp, Homo sapiens
gcccagggctcctgca

SEQ ID NO: 1483655 - DNA, 23 bp, Homo sapiens
gcccaggggctgtggccgtctcc

SEQ ID NO: 1483656 - DNA, 17 bp, Homo sapiens
gccccggtggctgggca

SEQ ID NO: 1483657 - DNA, 18 bp, Homo sapiens
gccccggtggctgggcag

SEQ ID NO: 1483658 - DNA, 18 bp, Homo sapiens
gccccgttccctgtcaga

SEQ ID NO: 1483659 - DNA, 16 bp, Homo sapiens
gcccctaccccacacc

SEQ ID NO: 1483660 - DNA, 20 bp, Homo sapiens
gcccctacgggcgctgcagc

SEQ ID NO: 1483661 - DNA, 15 bp, Homo sapiens
gcccctactgctgtg

SEQ ID NO: 1483662 - DNA, 19 bp, Homo sapiens
gcccctactgctgtgaacc

SEQ ID NO: 1483663 - DNA, 17 bp, Homo sapiens
gcccctaggatgctgca

SEQ ID NO: 1483664 - DNA, 18 bp, Homo sapiens
gcccctaggtgcccaggg

SEQ ID NO: 1483665 - DNA, 13 bp, Homo sapiens
gcccctcacctgg

SEQ ID NO: 1483666 - DNA, 16 bp, Homo sapiens
gcccctcacctggtac

SEQ ID NO: 1483667 - DNA, 15 bp, Homo sapiens
gcccctcagagactg

SEQ ID NO: 1483668 - DNA, 17 bp, Homo sapiens
gcccctcagcccttgcc

SEQ ID NO: 1483669 - DNA, 20 bp, Homo sapiens
gcccctccaaacctccagcc

SEQ ID NO: 1483670 - DNA, 21 bp, Homo sapiens
gcccctccaaacctccagcct

SEQ ID NO: 1483671 - DNA, 11 bp, Homo sapiens
gcccctccagc

SEQ ID NO: 1483672 - DNA, 16 bp, Homo sapiens
gcccctccagcacaca

SEQ ID NO: 1483673 - DNA, 14 bp, Homo sapiens
gcccctccatccac

SEQ ID NO: 1483674 - DNA, 14 bp, Homo sapiens
gcccctcccaagcg

SEQ ID NO: 1483675 - DNA, 22 bp, Homo sapiens
gcccctcccaagcgttcctggc

SEQ ID NO: 1483676 - DNA, 21 bp, Homo sapiens
gcccctcccacacacacccac

SEQ ID NO: 1483677 - DNA, 21 bp, Homo sapiens
gcccctcccacacccaaagct

SEQ ID NO: 1483678 - DNA, 19 bp, Homo sapiens
gcccctcccacgcctcacc

SEQ ID NO: 1483679 - DNA, 21 bp, Homo sapiens
gcccctcccccaacccccacc

SEQ ID NO: 1483680 - DNA, 12 bp, Homo sapiens
gcccctcccctc

SEQ ID NO: 1483681 - DNA, 14 bp, Homo sapiens
gcccctccctctgc

SEQ ID NO: 1483682 - DNA, 16 bp, Homo sapiens
gcccctccctctgccc

SEQ ID NO: 1483683 - DNA, 19 bp, Homo sapiens
gcccctccgatgctgaggc

SEQ ID NO: 1483684 - DNA, 21 bp, Homo sapiens
gcccctccgatgctgaggcca

SEQ ID NO: 1483685 - DNA, 21 bp, Homo sapiens
gcccctcctccagcccctgtc

SEQ ID NO: 1483686 - DNA, 16 bp, Homo sapiens
gcccctcctctgagca

SEQ ID NO: 1483687 - DNA, 14 bp, Homo sapiens
gcccctctcaccaa

SEQ ID NO: 1483688 - DNA, 22 bp, Homo sapiens
gcccctctccaaacaccggcag

SEQ ID NO: 1483689 - DNA, 21 bp, Homo sapiens
gcccctctcccgccagactgt

SEQ ID NO: 1483690 - DNA, 17 bp, Homo sapiens
gcccctctccttcttag

SEQ ID NO: 1483691 - DNA, 16 bp, Homo sapiens
gcccctctgcaccctt

SEQ ID NO: 1483692 - DNA, 15 bp, Homo sapiens
gcccctctgcccagc

SEQ ID NO: 1483693 - DNA, 20 bp, Homo sapiens
gcccctctgcccagcttggg

SEQ ID NO: 1483694 - DNA, 21 bp, Homo sapiens
gcccctctgctgtcctgcagt

SEQ ID NO: 1483695 - DNA, 18 bp, Homo sapiens
gcccctctggtcgctcct

SEQ ID NO: 1483696 - DNA, 19 bp, Homo sapiens
gcccctctggtcgctcctg

SEQ ID NO: 1483697 - DNA, 13 bp, Homo sapiens
gcccctgacatca

SEQ ID NO: 1483698 - DNA, 23 bp, Homo sapiens
gcccctgagagtggtgccctgga

SEQ ID NO: 1483699 - DNA, 15 bp, Homo sapiens
gcccctgaggcagcc

SEQ ID NO: 1483700 - DNA, 17 bp, Homo sapiens
gcccctgaggcagccca

SEQ ID NO: 1483701 - DNA, 16 bp, Homo sapiens
gcccctgaggcttcac

SEQ ID NO: 1483702 - DNA, 16 bp, Homo sapiens
gcccctgatgcagcct

SEQ ID NO: 1483703 - DNA, 21 bp, Homo sapiens
gcccctgatgcagcctgtggc

SEQ ID NO: 1483704 - DNA, 22 bp, Homo sapiens
gcccctgatgcagcctgtggct

SEQ ID NO: 1483705 - DNA, 20 bp, Homo sapiens
gcccctgcagtttggccctg

SEQ ID NO: 1483706 - DNA, 22 bp, Homo sapiens
gcccctgcagtttggccctgga

SEQ ID NO: 1483707 - DNA, 18 bp, Homo sapiens
gcccctggcacctgtgtt

SEQ ID NO: 1483708 - DNA, 17 bp, Homo sapiens
gcccctggcactcttgt

SEQ ID NO: 1483709 - DNA, 17 bp, Homo sapiens
gcccctggcccagcggc

SEQ ID NO: 1483710 - DNA, 19 bp, Homo sapiens
gcccctggcccagcggccc

SEQ ID NO: 1483711 - DNA, 18 bp, Homo sapiens
gcccctggccccgcctgc

SEQ ID NO: 1483712 - DNA, 15 bp, Homo sapiens
gcccctggctttgcc

SEQ ID NO: 1483713 - DNA, 11 bp, Homo sapiens
gcccctgggct

SEQ ID NO: 1483714 - DNA, 20 bp, Homo sapiens
gcccctgggctaccatctgc

SEQ ID NO: 1483715 - DNA, 15 bp, Homo sapiens
gcccctgggctctca

SEQ ID NO: 1483716 - DNA, 21 bp, Homo sapiens
gcccctgggcttggcctgctg

SEQ ID NO: 1483717 - DNA, 22 bp, Homo sapiens
gcccctgggcttggcctgctgt

SEQ ID NO: 1483718 - DNA, 23 bp, Homo sapiens
gcccctgggcttggcctgctgtg

SEQ ID NO: 1483719 - DNA, 21 bp, Homo sapiens
gcccctggggtggccaccagt

SEQ ID NO: 1483720 - DNA, 20 bp, Homo sapiens
gcccctgtggccctggccac

SEQ ID NO: 1483721 - DNA, 19 bp, Homo sapiens
gccccttaaacacaggctg

SEQ ID NO: 1483722 - DNA, 22 bp, Homo sapiens
gccccttactatgatctcagga

SEQ ID NO: 1483723 - DNA, 15 bp, Homo sapiens
gccccttcactcatt

SEQ ID NO: 1483724 - DNA, 20 bp, Homo sapiens
gccccttcatccgcctgtgg

SEQ ID NO: 1483725 - DNA, 15 bp, Homo sapiens
gccccttcccatctc

SEQ ID NO: 1483726 - DNA, 17 bp, Homo sapiens
gccccttccccctccaa

SEQ ID NO: 1483727 - DNA, 21 bp, Homo sapiens
gccccttctatgctgcttcca

SEQ ID NO: 1483728 - DNA, 21 bp, Homo sapiens
gccccttctggccggtgctgg

SEQ ID NO: 1483729 - DNA, 15 bp, Homo sapiens
gccccttggagagag

SEQ ID NO: 1483730 - DNA, 17 bp, Homo sapiens
gccccttggattcctgc

SEQ ID NO: 1483731 - DNA, 21 bp, Homo sapiens
gccccttggattcctgcacga

SEQ ID NO: 1483732 - DNA, 21 bp, Homo sapiens
gccccttgggcatccacccag

SEQ ID NO: 1483733 - DNA, 21 bp, Homo sapiens
gccccttttcgccccctgcct

SEQ ID NO: 1483734 - DNA, 12 bp, Homo sapiens
gcccgacagcct

SEQ ID NO: 1483735 - DNA, 15 bp, Homo sapiens
gcccgacagcctggc

SEQ ID NO: 1483736 - DNA, 16 bp, Homo sapiens
gcccgacagcctggca

SEQ ID NO: 1483737 - DNA, 17 bp, Homo sapiens
gcccgacagcctggcac

SEQ ID NO: 1483738 - DNA, 19 bp, Homo sapiens
gcccgacatggctccggcc

SEQ ID NO: 1483739 - DNA, 24 bp, Homo sapiens
gcccgacatggctccggcctctgc

SEQ ID NO: 1483740 - DNA, 21 bp, Homo sapiens
gcccgagggatggtgccccta

SEQ ID NO: 1483741 - DNA, 17 bp, Homo sapiens
gcccgatattctccctg

SEQ ID NO: 1483742 - DNA, 21 bp, Homo sapiens
gcccgatattctccctgacct

SEQ ID NO: 1483743 - DNA, 19 bp, Homo sapiens
gcccgcaccctggcctggt

SEQ ID NO: 1483744 - DNA, 19 bp, Homo sapiens
gcccgcaggaactgggctg

SEQ ID NO: 1483745 - DNA, 14 bp, Homo sapiens
gcccgcagtgctgg

SEQ ID NO: 1483746 - DNA, 19 bp, Homo sapiens
gcccgcagtgctgggacca

SEQ ID NO: 1483747 - DNA, 14 bp, Homo sapiens
gcccgcccactgtc

SEQ ID NO: 1483748 - DNA, 18 bp, Homo sapiens
gcccgcccactgtcctgg

SEQ ID NO: 1483749 - DNA, 19 bp, Homo sapiens
gcccgcccactgtcctggg

SEQ ID NO: 1483750 - DNA, 22 bp, Homo sapiens
gcccgcccactgtcctgggcgc

SEQ ID NO: 1483751 - DNA, 13 bp, Homo sapiens
gcccgcgcccgcg

SEQ ID NO: 1483752 - DNA, 23 bp, Homo sapiens
gcccgcgccctcgcccccgcccc

SEQ ID NO: 1483753 - DNA, 16 bp, Homo sapiens
gcccgctcccaacccc

SEQ ID NO: 1483754 - DNA, 20 bp, Homo sapiens
gcccgctcccaacccccctc

SEQ ID NO: 1483755 - DNA, 22 bp, Homo sapiens
gcccgctcccaacccccctcct

SEQ ID NO: 1483756 - DNA, 23 bp, Homo sapiens
gcccgctcccaacccccctcctg

SEQ ID NO: 1483757 - DNA, 16 bp, Homo sapiens
gcccgctcctgccgca

SEQ ID NO: 1483758 - DNA, 22 bp, Homo sapiens
gcccgctcctgccgcagacggg

SEQ ID NO: 1483759 - DNA, 12 bp, Homo sapiens
gcccgctgggct

SEQ ID NO: 1483760 - DNA, 13 bp, Homo sapiens
gcccgcttggcca

SEQ ID NO: 1483761 - DNA, 14 bp, Homo sapiens
gcccgcttggccac

SEQ ID NO: 1483762 - DNA, 15 bp, Homo sapiens
gcccgcttttgttct

SEQ ID NO: 1483763 - DNA, 16 bp, Homo sapiens
gcccggattctgggag

SEQ ID NO: 1483764 - DNA, 14 bp, Homo sapiens
gcccggcagcccct

SEQ ID NO: 1483765 - DNA, 18 bp, Homo sapiens
gcccggcagccccttctg

SEQ ID NO: 1483766 - DNA, 17 bp, Homo sapiens
gcccggcagggcgggca

SEQ ID NO: 1483767 - DNA, 14 bp, Homo sapiens
gcccggccacaccc

SEQ ID NO: 1483768 - DNA, 22 bp, Homo sapiens
gcccggccacacccagcggccc

SEQ ID NO: 1483769 - DNA, 20 bp, Homo sapiens
gcccggccagcgggcacagg

SEQ ID NO: 1483770 - DNA, 14 bp, Homo sapiens
gccctttgctctgg

SEQ ID NO: 1483771 - DNA, 16 bp, Homo sapiens
gccgaaggtgcctcag

SEQ ID NO: 1483772 - DNA, 18 bp, Homo sapiens
gccgaaggtgcctcagac

SEQ ID NO: 1483773 - DNA, 20 bp, Homo sapiens
gccgaaggtgcctcagactc

SEQ ID NO: 1483774 - DNA, 20 bp, Homo sapiens
gccgaatcccctccctgtca

SEQ ID NO: 1483775 - DNA, 18 bp, Homo sapiens
gccgacatccctccccca

SEQ ID NO: 1483776 - DNA, 14 bp, Homo sapiens
gccgaccagagccc

SEQ ID NO: 1483777 - DNA, 11 bp, Homo sapiens
gccgacctcag

SEQ ID NO: 1483778 - DNA, 15 bp, Homo sapiens
gccgacctcagcctt

SEQ ID NO: 1483779 - DNA, 13 bp, Homo sapiens
gccgacctcgtcc

SEQ ID NO: 1483780 - DNA, 20 bp, Homo sapiens
gccgacctcgtcctccccct

SEQ ID NO: 1483781 - DNA, 21 bp, Homo sapiens
gccgacctcgtcctccccctg

SEQ ID NO: 1483782 - DNA, 14 bp, Homo sapiens
gccgactggctgtg

SEQ ID NO: 1483783 - DNA, 16 bp, Homo sapiens
gccgactggctgtgag

SEQ ID NO: 1483784 - DNA, 19 bp, Homo sapiens
gccgagacagaccctctgc

SEQ ID NO: 1483785 - DNA, 19 bp, Homo sapiens
gccgagactcgactctgtg

SEQ ID NO: 1483786 - DNA, 15 bp, Homo sapiens
gccgagagcctgctc

SEQ ID NO: 1483787 - DNA, 18 bp, Homo sapiens
gccgagattgcgccactg

SEQ ID NO: 1483788 - DNA, 20 bp, Homo sapiens
gccgagattgcgccactgca

SEQ ID NO: 1483789 - DNA, 15 bp, Homo sapiens
gccgagccgggcctg

SEQ ID NO: 1483790 - DNA, 19 bp, Homo sapiens
gccgagccgggcctggggc

SEQ ID NO: 1483791 - DNA, 17 bp, Homo sapiens
gccgagcggtggccccg

SEQ ID NO: 1483792 - DNA, 21 bp, Homo sapiens
gccgagctcgtgtatcctggg

SEQ ID NO: 1483793 - DNA, 23 bp, Homo sapiens
gccgagctcgtgtatcctggggc

SEQ ID NO: 1483794 - DNA, 16 bp, Homo sapiens
gccgaggaccaccagc

SEQ ID NO: 1483795 - DNA, 20 bp, Homo sapiens
gccgaggaccaccagcaggc

SEQ ID NO: 1483796 - DNA, 16 bp, Homo sapiens
gccgaggcccagcggg

SEQ ID NO: 1483797 - DNA, 21 bp, Homo sapiens
gccgaggcccagcgggcagat

SEQ ID NO: 1483798 - DNA, 13 bp, Homo sapiens
gccgaggggagag

SEQ ID NO: 1483799 - DNA, 17 bp, Homo sapiens
gccgaggggagagaggg

SEQ ID NO: 1483800 - DNA, 19 bp, Homo sapiens
gccgaggggagagagggac

SEQ ID NO: 1483801 - DNA, 20 bp, Homo sapiens
gccgagggtcctggctcctg

SEQ ID NO: 1483802 - DNA, 17 bp, Homo sapiens
gccgagtggctgccgga

SEQ ID NO: 1483803 - DNA, 20 bp, Homo sapiens
gccgagtggctgccggagga

SEQ ID NO: 1483804 - DNA, 12 bp, Homo sapiens
gccgatgccacc

SEQ ID NO: 1483805 - DNA, 17 bp, Homo sapiens
gccgcaagtctgcagcc

SEQ ID NO: 1483806 - DNA, 13 bp, Homo sapiens
gccgcaccagccc

SEQ ID NO: 1483807 - DNA, 13 bp, Homo sapiens
gccgcaccctgca

SEQ ID NO: 1483808 - DNA, 21 bp, Homo sapiens
gccgcaccctgcacctgctgc

SEQ ID NO: 1483809 - DNA, 20 bp, Homo sapiens
gccgcacctaaagcagccag

SEQ ID NO: 1483810 - DNA, 15 bp, Homo sapiens
gccgcagacgggcac

SEQ ID NO: 1483811 - DNA, 17 bp, Homo sapiens
gccgcagacgggcacag

SEQ ID NO: 1483812 - DNA, 19 bp, Homo sapiens
gccgcagacgggcacagac

SEQ ID NO: 1483813 - DNA, 12 bp, Homo sapiens
gccgcagagctg

SEQ ID NO: 1483814 - DNA, 15 bp, Homo sapiens
gccgcagctcttgcc

SEQ ID NO: 1483815 - DNA, 19 bp, Homo sapiens
gccgcagctcttgcccttc

SEQ ID NO: 1483816 - DNA, 20 bp, Homo sapiens
gccgcagctcttgcccttcc

SEQ ID NO: 1483817 - DNA, 15 bp, Homo sapiens
gccgcatcttctcca

SEQ ID NO: 1483818 - DNA, 15 bp, Homo sapiens
gccgccacccccatc

SEQ ID NO: 1483819 - DNA, 19 bp, Homo sapiens
gccgccactaggtgtcccc

SEQ ID NO: 1483820 - DNA, 22 bp, Homo sapiens
gccgccactaggtgtccccaac

SEQ ID NO: 1483821 - DNA, 16 bp, Homo sapiens
gccgccccctcctgaa

SEQ ID NO: 1483822 - DNA, 17 bp, Homo sapiens
gccgccccctgcccccc

SEQ ID NO: 1483823 - DNA, 23 bp, Homo sapiens
gccgccccctgccccccagcctc

SEQ ID NO: 1483824 - DNA, 11 bp, Homo sapiens
gccgcccctga

SEQ ID NO: 1483825 - DNA, 14 bp, Homo sapiens
gccgcccctgaggc

SEQ ID NO: 1483826 - DNA, 15 bp, Homo sapiens
gccgcccctgaggct

SEQ ID NO: 1483827 - DNA, 13 bp, Homo sapiens
gccgcccgctccc

SEQ ID NO: 1483828 - DNA, 15 bp, Homo sapiens
gccgcccgggcccag

SEQ ID NO: 1483829 - DNA, 15 bp, Homo sapiens
gccgccgccgctgcc

SEQ ID NO: 1483830 - DNA, 19 bp, Homo sapiens
gccgccgctgaccctgggc

SEQ ID NO: 1483831 - DNA, 13 bp, Homo sapiens
gccgcctcaatgt

SEQ ID NO: 1483832 - DNA, 13 bp, Homo sapiens
gccgcctccagga

SEQ ID NO: 1483833 - DNA, 18 bp, Homo sapiens
gccgcctgcactcctcag

SEQ ID NO: 1483834 - DNA, 15 bp, Homo sapiens
gccgcctgctcctca

SEQ ID NO: 1483835 - DNA, 15 bp, Homo sapiens
gccgccttaagctga

SEQ ID NO: 1483836 - DNA, 22 bp, Homo sapiens
gccgccttggccttgcagctgg

SEQ ID NO: 1483837 - DNA, 18 bp, Homo sapiens
gccgcgccagtccccgct

SEQ ID NO: 1483838 - DNA, 19 bp, Homo sapiens
gccgcggccgcccgcacgt

SEQ ID NO: 1483839 - DNA, 16 bp, Homo sapiens
gccgcgggcggccagg

SEQ ID NO: 1483840 - DNA, 18 bp, Homo sapiens
gccgcgggcggccaggca

SEQ ID NO: 1483841 - DNA, 13 bp, Homo sapiens
gccgcgtccctgc

SEQ ID NO: 1483842 - DNA, 20 bp, Homo sapiens
gccgcgtgacggacatccag

SEQ ID NO: 1483843 - DNA, 15 bp, Homo sapiens
gccgctagaggcctg

SEQ ID NO: 1483844 - DNA, 23 bp, Homo sapiens
gccgctcctgtctgccagccagc

SEQ ID NO: 1483845 - DNA, 17 bp, Homo sapiens
gccgctgaccctgggcc

SEQ ID NO: 1483846 - DNA, 18 bp, Homo sapiens
gccgctgaccctgggcct

SEQ ID NO: 1483847 - DNA, 18 bp, Homo sapiens
gccgctgcccgctcagcc

SEQ ID NO: 1483848 - DNA, 17 bp, Homo sapiens
gccgctgctttgcgctg

SEQ ID NO: 1483849 - DNA, 19 bp, Homo sapiens
gccgctgctttgcgctggt

SEQ ID NO: 1483850 - DNA, 12 bp, Homo sapiens
gccgctggggtc

SEQ ID NO: 1483851 - DNA, 12 bp, Homo sapiens
gccgctgtctct

SEQ ID NO: 1483852 - DNA, 22 bp, Homo sapiens
gccgctgtctctgaggggtggg

SEQ ID NO: 1483853 - DNA, 17 bp, Homo sapiens
gccgctgttcacccaca

SEQ ID NO: 1483854 - DNA, 16 bp, Homo sapiens
gccggacagctgccca

SEQ ID NO: 1483855 - DNA, 15 bp, Homo sapiens
gccggagcccagata

SEQ ID NO: 1483856 - DNA, 15 bp, Homo sapiens
gccggatctgggctg

SEQ ID NO: 1483857 - DNA, 15 bp, Homo sapiens
gccggatgtgctttt

SEQ ID NO: 1483858 - DNA, 22 bp, Homo sapiens
gccggcagcgggcggaggggat

SEQ ID NO: 1483859 - DNA, 14 bp, Homo sapiens
gccggccctggctt

SEQ ID NO: 1483860 - DNA, 19 bp, Homo sapiens
gccggcctctctggcctcc

SEQ ID NO: 1483861 - DNA, 19 bp, Homo sapiens
gccggcggcagccccactt

SEQ ID NO: 1483862 - DNA, 17 bp, Homo sapiens
gccggcggcccaagccc

SEQ ID NO: 1483863 - DNA, 16 bp, Homo sapiens
gccggcggcctctcga

SEQ ID NO: 1483864 - DNA, 13 bp, Homo sapiens
gccggctctgggc

SEQ ID NO: 1483865 - DNA, 19 bp, Homo sapiens
gccggctctgggcctgagg

SEQ ID NO: 1483866 - DNA, 17 bp, Homo sapiens
gccggctgagtggcagc

SEQ ID NO: 1483867 - DNA, 19 bp, Homo sapiens
gccggctgagtggcagcag

SEQ ID NO: 1483868 - DNA, 19 bp, Homo sapiens
gccggcttcatgccagcta

SEQ ID NO: 1483869 - DNA, 18 bp, Homo sapiens
gccggcttctgcctgggg

SEQ ID NO: 1483870 - DNA, 22 bp, Homo sapiens
gccgggaacagacaacagaagt

SEQ ID NO: 1483871 - DNA, 18 bp, Homo sapiens
gccgggagaagccacctt

SEQ ID NO: 1483872 - DNA, 19 bp, Homo sapiens
gccgggcatggtggcaggc

SEQ ID NO: 1483873 - DNA, 23 bp, Homo sapiens
gccgggcatggtggcgcaagcct

SEQ ID NO: 1483874 - DNA, 12 bp, Homo sapiens
gccgggcccctg

SEQ ID NO: 1483875 - DNA, 18 bp, Homo sapiens
gccgggcgcggtggctca

SEQ ID NO: 1483876 - DNA, 19 bp, Homo sapiens
gccgggcgtggtggcgggc

SEQ ID NO: 1483877 - DNA, 18 bp, Homo sapiens
gccgggctgagggcctgc

SEQ ID NO: 1483878 - DNA, 14 bp, Homo sapiens
gccgggctgctgct

SEQ ID NO: 1483879 - DNA, 15 bp, Homo sapiens
gccgggctgctgctg

SEQ ID NO: 1483880 - DNA, 17 bp, Homo sapiens
gccgggcttgggccctg

SEQ ID NO: 1483881 - DNA, 16 bp, Homo sapiens
gccggggtccaggccc

SEQ ID NO: 1483882 - DNA, 18 bp, Homo sapiens
gccggggtgtaacttcct

SEQ ID NO: 1483883 - DNA, 21 bp, Homo sapiens
gccggggtgtaacttcctgct

SEQ ID NO: 1483884 - DNA, 16 bp, Homo sapiens
gccggtaactgtcctg

SEQ ID NO: 1483885 - DNA, 13 bp, Homo sapiens
gccggtcccccat

SEQ ID NO: 1483886 - DNA, 20 bp, Homo sapiens
gccggtcccccatgccacca

SEQ ID NO: 1483887 - DNA, 22 bp, Homo sapiens
gccggtcccccatgccaccacc

SEQ ID NO: 1483888 - DNA, 14 bp, Homo sapiens
gccggtcgggcagc

SEQ ID NO: 1483889 - DNA, 22 bp, Homo sapiens
gccggtgcacaggcctctgcct

SEQ ID NO: 1483890 - DNA, 17 bp, Homo sapiens
gccggtgctgggttccc

SEQ ID NO: 1483891 - DNA, 13 bp, Homo sapiens
gccggtgggaccc

SEQ ID NO: 1483892 - DNA, 18 bp, Homo sapiens
gccggtgggaccctgtcc

SEQ ID NO: 1483893 - DNA, 17 bp, Homo sapiens
gccgtaattctttctgt

SEQ ID NO: 1483894 - DNA, 23 bp, Homo sapiens
gccgtaattctttctgtctccct

SEQ ID NO: 1483895 - DNA, 21 bp, Homo sapiens
gccgtagggagtacctgctgc

SEQ ID NO: 1483896 - DNA, 19 bp, Homo sapiens
gccgtaggggctcctgagt

SEQ ID NO: 1483897 - DNA, 18 bp, Homo sapiens
gccgtcagccaaatgtaa

SEQ ID NO: 1483898 - DNA, 17 bp, Homo sapiens
gccgtccatggcaccag

SEQ ID NO: 1483899 - DNA, 19 bp, Homo sapiens
gccgtccatggcaccagcc

SEQ ID NO: 1483900 - DNA, 22 bp, Homo sapiens
gccgtccatggcaccagccccc

SEQ ID NO: 1483901 - DNA, 18 bp, Homo sapiens
gccgtcccgcgttcaaga

SEQ ID NO: 1483902 - DNA, 19 bp, Homo sapiens
gccgtcctcccgggccctc

SEQ ID NO: 1483903 - DNA, 23 bp, Homo sapiens
gccgtctccaggggctgcttcct

SEQ ID NO: 1483904 - DNA, 22 bp, Homo sapiens
gccgtctcccttggcccagaga

SEQ ID NO: 1483905 - DNA, 21 bp, Homo sapiens
gccgtctgactccagagtctg

SEQ ID NO: 1483906 - DNA, 15 bp, Homo sapiens
gccgtgagcaggctt

SEQ ID NO: 1483907 - DNA, 18 bp, Homo sapiens
gccgtgagcaggctttgg

SEQ ID NO: 1483908 - DNA, 17 bp, Homo sapiens
gccgtgatgctcaggct

SEQ ID NO: 1483909 - DNA, 22 bp, Homo sapiens
gccgtgcatggctcctgtctgg

SEQ ID NO: 1483910 - DNA, 17 bp, Homo sapiens
gccgtgccttcagctct

SEQ ID NO: 1483911 - DNA, 12 bp, Homo sapiens
gccgtggatgcg

SEQ ID NO: 1483912 - DNA, 23 bp, Homo sapiens
gccgtggattgcacgtggcctct

SEQ ID NO: 1483913 - DNA, 12 bp, Homo sapiens
gccgtggcttcc

SEQ ID NO: 1483914 - DNA, 21 bp, Homo sapiens
gccgtggcttcccgctcagcc

SEQ ID NO: 1483915 - DNA, 20 bp, Homo sapiens
gccgtggggccgccgcctct

SEQ ID NO: 1483916 - DNA, 17 bp, Homo sapiens
gccgtggtccagctctt

SEQ ID NO: 1483917 - DNA, 18 bp, Homo sapiens
gccgtggtccagctcttg

SEQ ID NO: 1483918 - DNA, 19 bp, Homo sapiens
gccgtggtccagctcttgg

SEQ ID NO: 1483919 - DNA, 18 bp, Homo sapiens
gccgtgtctcagcctctg

SEQ ID NO: 1483920 - DNA, 18 bp, Homo sapiens
gccgttactctccaacct

SEQ ID NO: 1483921 - DNA, 16 bp, Homo sapiens
gccgttccccttggct

SEQ ID NO: 1483922 - DNA, 14 bp, Homo sapiens
gcctaaagggcagg

SEQ ID NO: 1483923 - DNA, 21 bp, Homo sapiens
gcctaaagggcagggcccacg

SEQ ID NO: 1483924 - DNA, 22 bp, Homo sapiens
gcctaaagtatacaactgcctg

SEQ ID NO: 1483925 - DNA, 12 bp, Homo sapiens
gcctaaatgatg

SEQ ID NO: 1483926 - DNA, 14 bp, Homo sapiens
gcctaacttgtaaa

SEQ ID NO: 1483927 - DNA, 20 bp, Homo sapiens
gcctacagaacttcagaaag

SEQ ID NO: 1483928 - DNA, 21 bp, Homo sapiens
gcctaccccgcagacaccttg

SEQ ID NO: 1483929 - DNA, 21 bp, Homo sapiens
gcctaccgctggccctgccgt

SEQ ID NO: 1483930 - DNA, 17 bp, Homo sapiens
gcctactccaaaatgtt

SEQ ID NO: 1483931 - DNA, 23 bp, Homo sapiens
gcctactgtccctctcagtgcct

SEQ ID NO: 1483932 - DNA, 17 bp, Homo sapiens
gcctagaaaatgcaaaa

SEQ ID NO: 1483933 - DNA, 19 bp, Homo sapiens
gcctagaaatatctttctc

SEQ ID NO: 1483934 - DNA, 18 bp, Homo sapiens
gcctagacaacctttctg

SEQ ID NO: 1483935 - DNA, 23 bp, Homo sapiens
gcctagaccagcagacagagcca

SEQ ID NO: 1483936 - DNA, 20 bp, Homo sapiens
gcctagactgttactttggc

SEQ ID NO: 1483937 - DNA, 12 bp, Homo sapiens
gcctagagtgta

SEQ ID NO: 1483938 - DNA, 16 bp, Homo sapiens
gcctagagtgtagcct

SEQ ID NO: 1483939 - DNA, 20 bp, Homo sapiens
gcctagatccacacacagag

SEQ ID NO: 1483940 - DNA, 12 bp, Homo sapiens
gcctagccacct

SEQ ID NO: 1483941 - DNA, 23 bp, Homo sapiens
gcctagccacctcccaccccact

SEQ ID NO: 1483942 - DNA, 18 bp, Homo sapiens
gcctagccgacctcagcc

SEQ ID NO: 1483943 - DNA, 16 bp, Homo sapiens
gcctagcggagcccag

SEQ ID NO: 1483944 - DNA, 21 bp, Homo sapiens
gcctagcggagcccagcctgg

SEQ ID NO: 1483945 - DNA, 18 bp, Homo sapiens
gcctaggagatatctgag

SEQ ID NO: 1483946 - DNA, 23 bp, Homo sapiens
gcctaggagctggctggcaggtg

SEQ ID NO: 1483947 - DNA, 21 bp, Homo sapiens
gcctaggagttgagtacagtg

SEQ ID NO: 1483948 - DNA, 12 bp, Homo sapiens
gcctaggattct

SEQ ID NO: 1483949 - DNA, 21 bp, Homo sapiens
gcctaggccaaatgcacaagc

SEQ ID NO: 1483950 - DNA, 12 bp, Homo sapiens
gcctagggagcc

SEQ ID NO: 1483951 - DNA, 23 bp, Homo sapiens
gcctagtggggtctccctctcct

SEQ ID NO: 1483952 - DNA, 15 bp, Homo sapiens
gcctataatcccagc

SEQ ID NO: 1483953 - DNA, 16 bp, Homo sapiens
gcctataatcccagct

SEQ ID NO: 1483954 - DNA, 18 bp, Homo sapiens
gcctataatcccagctac

SEQ ID NO: 1483955 - DNA, 18 bp, Homo sapiens
gcctatatcagtcgtttt

SEQ ID NO: 1483956 - DNA, 20 bp, Homo sapiens
gcctattcacgccgtaattc

SEQ ID NO: 1483957 - DNA, 17 bp, Homo sapiens
gcctattttggtgaggt

SEQ ID NO: 1483958 - DNA, 23 bp, Homo sapiens
gcctatttttttagattgagaaa

SEQ ID NO: 1483959 - DNA, 18 bp, Homo sapiens
gcctcaaaacgggtcagt

SEQ ID NO: 1483960 - DNA, 17 bp, Homo sapiens
gcctcaaaggcccgctc

SEQ ID NO: 1483961 - DNA, 23 bp, Homo sapiens
gcctcaagaaatatactctccca

SEQ ID NO: 1483962 - DNA, 15 bp, Homo sapiens
gcctcacagaagaat

SEQ ID NO: 1483963 - DNA, 19 bp, Homo sapiens
gcctcaccagccctggcaa

SEQ ID NO: 1483964 - DNA, 21 bp, Homo sapiens
gcctcaccatgtgagctcttc

SEQ ID NO: 1483965 - DNA, 17 bp, Homo sapiens
gcctcacccacccctgc

SEQ ID NO: 1483966 - DNA, 18 bp, Homo sapiens
gcctcacccacccctgca

SEQ ID NO: 1483967 - DNA, 19 bp, Homo sapiens
gcctcaccctcccaagtag

SEQ ID NO: 1483968 - DNA, 21 bp, Homo sapiens
gcctcacgtatttcacagagc

SEQ ID NO: 1483969 - DNA, 23 bp, Homo sapiens
gcctcacgtatttcacagagcac

SEQ ID NO: 1483970 - DNA, 20 bp, Homo sapiens
gcctcactgaaacatggctg

SEQ ID NO: 1483971 - DNA, 14 bp, Homo sapiens
gcctcactggctgg

SEQ ID NO: 1483972 - DNA, 18 bp, Homo sapiens
gcctcacttgaatgtgtc

SEQ ID NO: 1483973 - DNA, 9 bp, Homo sapiens
gcctcagaa

SEQ ID NO: 1483974 - DNA, 13 bp, Homo sapiens
gcctcagaagaaa

SEQ ID NO: 1483975 - DNA, 15 bp, Homo sapiens
gcctcagaaggcccc

SEQ ID NO: 1483976 - DNA, 22 bp, Homo sapiens
gcctcagaaggccccagagaga

SEQ ID NO: 1483977 - DNA, 23 bp, Homo sapiens
gcctcagaaggccccagagagac

SEQ ID NO: 1483978 - DNA, 23 bp, Homo sapiens
gcctcagaattgatcattttccc

SEQ ID NO: 1483979 - DNA, 16 bp, Homo sapiens
gcctcagactccgccc

SEQ ID NO: 1483980 - DNA, 14 bp, Homo sapiens
gcctcagatccagg

SEQ ID NO: 1483981 - DNA, 22 bp, Homo sapiens
gcctcagcgtcctgggctcaaa

SEQ ID NO: 1483982 - DNA, 14 bp, Homo sapiens
gcctcagctgcctc

SEQ ID NO: 1483983 - DNA, 19 bp, Homo sapiens
gcctcagctgcctcacttc

SEQ ID NO: 1483984 - DNA, 16 bp, Homo sapiens
gcctcaggccagggct

SEQ ID NO: 1483985 - DNA, 15 bp, Homo sapiens
gcctcagggcgctca

SEQ ID NO: 1483986 - DNA, 16 bp, Homo sapiens
gcctcagggcgctcag

SEQ ID NO: 1483987 - DNA, 17 bp, Homo sapiens
gcctcagggcgctcaga

SEQ ID NO: 1483988 - DNA, 18 bp, Homo sapiens
gcctcagggcgctcagac

SEQ ID NO: 1483989 - DNA, 12 bp, Homo sapiens
gcctcaggtgct

SEQ ID NO: 1483990 - DNA, 14 bp, Homo sapiens
gcctcagttcccag

SEQ ID NO: 1483991 - DNA, 15 bp, Homo sapiens
gcctcagttcccagc

SEQ ID NO: 1483992 - DNA, 16 bp, Homo sapiens
gcctcagttcccagct

SEQ ID NO: 1483993 - DNA, 16 bp, Homo sapiens
gcctcagtttctccat

SEQ ID NO: 1483994 - DNA, 19 bp, Homo sapiens
gcctcagtttctccatcag

SEQ ID NO: 1483995 - DNA, 16 bp, Homo sapiens
gcctcagttttccttc

SEQ ID NO: 1483996 - DNA, 18 bp, Homo sapiens
gcctcagttttccttctg

SEQ ID NO: 1483997 - DNA, 16 bp, Homo sapiens
gcctcatagcatagcc

SEQ ID NO: 1483998 - DNA, 20 bp, Homo sapiens
gcctcatagcatagccagca

SEQ ID NO: 1483999 - DNA, 19 bp, Homo sapiens
gcctgagggtccacctgga

SEQ ID NO: 1484000 - DNA, 20 bp, Homo sapiens
gcctgagggtccacctggag

SEQ ID NO: 1484001 - DNA, 21 bp, Homo sapiens
gcctgagggtccacctggaga

SEQ ID NO: 1484002 - DNA, 17 bp, Homo sapiens
gcctgagtcagtgctct

SEQ ID NO: 1484003 - DNA, 23 bp, Homo sapiens
gcctgagtcagtgctctcagctg

SEQ ID NO: 1484004 - DNA, 15 bp, Homo sapiens
gcctgagtctcctgt

SEQ ID NO: 1484005 - DNA, 16 bp, Homo sapiens
gcctgagtctcctgtg

SEQ ID NO: 1484006 - DNA, 20 bp, Homo sapiens
gcctgagtgacagagcgaga

SEQ ID NO: 1484007 - DNA, 14 bp, Homo sapiens
gcctgagttataaa

SEQ ID NO: 1484008 - DNA, 15 bp, Homo sapiens
gcctgataagcttca

SEQ ID NO: 1484009 - DNA, 21 bp, Homo sapiens
gcctgatactttagccatcat

SEQ ID NO: 1484010 - DNA, 14 bp, Homo sapiens
gcctgatataaatg

SEQ ID NO: 1484011 - DNA, 15 bp, Homo sapiens
gcctgatataaatgc

SEQ ID NO: 1484012 - DNA, 12 bp, Homo sapiens
gcctgatccctg

SEQ ID NO: 1484013 - DNA, 23 bp, Homo sapiens
gcctgatctgcccatcgtgaaga

SEQ ID NO: 1484014 - DNA, 17 bp, Homo sapiens
gcctgatctttctagag

SEQ ID NO: 1484015 - DNA, 17 bp, Homo sapiens
gcctgatgctccctccc

SEQ ID NO: 1484016 - DNA, 20 bp, Homo sapiens
gcctgatgctccctcccctg

SEQ ID NO: 1484017 - DNA, 13 bp, Homo sapiens
gcctgatgctgcc

SEQ ID NO: 1484018 - DNA, 15 bp, Homo sapiens
gcctgatgctgcccc

SEQ ID NO: 1484019 - DNA, 16 bp, Homo sapiens
gcctgatgctgccccg

SEQ ID NO: 1484020 - DNA, 13 bp, Homo sapiens
gcctgatggccaa

SEQ ID NO: 1484021 - DNA, 14 bp, Homo sapiens
gcctgatggccaag

SEQ ID NO: 1484022 - DNA, 19 bp, Homo sapiens
gcctgatggtgctgctcag

SEQ ID NO: 1484023 - DNA, 17 bp, Homo sapiens
gcctgattcggacggcc

SEQ ID NO: 1484024 - DNA, 20 bp, Homo sapiens
gcctgattcggacggccaat

SEQ ID NO: 1484025 - DNA, 16 bp, Homo sapiens
gcctgcacaataaaaa

SEQ ID NO: 1484026 - DNA, 16 bp, Homo sapiens
gcctgcacacacctgc

SEQ ID NO: 1484027 - DNA, 19 bp, Homo sapiens
gcctgcacacacctgcctg

SEQ ID NO: 1484028 - DNA, 13 bp, Homo sapiens
gcctgcaccagga

SEQ ID NO: 1484029 - DNA, 14 bp, Homo sapiens
gcctgcactccctg

SEQ ID NO: 1484030 - DNA, 16 bp, Homo sapiens
gcctgcactccctggc

SEQ ID NO: 1484031 - DNA, 16 bp, Homo sapiens
gcctgcagaatttggg

SEQ ID NO: 1484032 - DNA, 22 bp, Homo sapiens
gcctgcagcacatgcgggctcg

SEQ ID NO: 1484033 - DNA, 18 bp, Homo sapiens
gcctgcagggccatggct

SEQ ID NO: 1484034 - DNA, 14 bp, Homo sapiens
gcctgcaggggagc

SEQ ID NO: 1484035 - DNA, 20 bp, Homo sapiens
gcctgcagggtggtgctggg

SEQ ID NO: 1484036 - DNA, 21 bp, Homo sapiens
gcctgcagggtggtgctggga

SEQ ID NO: 1484037 - DNA, 18 bp, Homo sapiens
gcctgcagtgattcagca

SEQ ID NO: 1484038 - DNA, 22 bp, Homo sapiens
gcctgcataggagtttggagga

SEQ ID NO: 1484039 - DNA, 16 bp, Homo sapiens
gcctgcatgagctggc

SEQ ID NO: 1484040 - DNA, 12 bp, Homo sapiens
gcctgcatgctg

SEQ ID NO: 1484041 - DNA, 13 bp, Homo sapiens
gcctgcattctgc

SEQ ID NO: 1484042 - DNA, 16 bp, Homo sapiens
gcctgcattgagcttg

SEQ ID NO: 1484043 - DNA, 21 bp, Homo sapiens
gcctgcattgagcttgcatgc

SEQ ID NO: 1484044 - DNA, 17 bp, Homo sapiens
gcctgccaaattttgat

SEQ ID NO: 1484045 - DNA, 11 bp, Homo sapiens
gcctgccaaga

SEQ ID NO: 1484046 - DNA, 14 bp, Homo sapiens
gcctgccactctct

SEQ ID NO: 1484047 - DNA, 15 bp, Homo sapiens
gcctgccagctgcac

SEQ ID NO: 1484048 - DNA, 15 bp, Homo sapiens
gcctgccatcttctc

SEQ ID NO: 1484049 - DNA, 20 bp, Homo sapiens
gcctgccatcttctccccga

SEQ ID NO: 1484050 - DNA, 17 bp, Homo sapiens
gcctgccccaaacaaat

SEQ ID NO: 1484051 - DNA, 23 bp, Homo sapiens
gcctgccccaaacaaatatgcaa

SEQ ID NO: 1484052 - DNA, 16 bp, Homo sapiens
gcctgcccccctcatc

SEQ ID NO: 1484053 - DNA, 20 bp, Homo sapiens
gcctgccccgcccccagtcc

SEQ ID NO: 1484054 - DNA, 18 bp, Homo sapiens
gcctgcccgcaccctggc

SEQ ID NO: 1484055 - DNA, 22 bp, Homo sapiens
gcctgccctcatggcccctctg

SEQ ID NO: 1484056 - DNA, 14 bp, Homo sapiens
gcctgccctcccgc

SEQ ID NO: 1484057 - DNA, 12 bp, Homo sapiens
gcctgccctctg

SEQ ID NO: 1484058 - DNA, 23 bp, Homo sapiens
gcctgccgcccccgcctgggcac

SEQ ID NO: 1484059 - DNA, 14 bp, Homo sapiens
gcctgccgtgcatg

SEQ ID NO: 1484060 - DNA, 21 bp, Homo sapiens
gcctgccgtgcatggctcctg

SEQ ID NO: 1484061 - DNA, 20 bp, Homo sapiens
gcctgcctatgaaatttcaa

SEQ ID NO: 1484062 - DNA, 14 bp, Homo sapiens
gcctgcctcctggc

SEQ ID NO: 1484063 - DNA, 13 bp, Homo sapiens
gcctgcctgtctg

SEQ ID NO: 1484064 - DNA, 16 bp, Homo sapiens
gcctgcctgtctgtct

SEQ ID NO: 1484065 - DNA, 15 bp, Homo sapiens
gcctgccttcgttaa

SEQ ID NO: 1484066 - DNA, 16 bp, Homo sapiens
gcctgccttgaagcca

SEQ ID NO: 1484067 - DNA, 23 bp, Homo sapiens
gcctgccttgaagccactgaagc

SEQ ID NO: 1484068 - DNA, 16 bp, Homo sapiens
gcctgcgaccctgggg

SEQ ID NO: 1484069 - DNA, 21 bp, Homo sapiens
gcctgcggcccagaagtttcc

SEQ ID NO: 1484070 - DNA, 20 bp, Homo sapiens
gcctgcgttttggaagctct

SEQ ID NO: 1484071 - DNA, 17 bp, Homo sapiens
gcctgctagagcaaccc

SEQ ID NO: 1484072 - DNA, 18 bp, Homo sapiens
gcctgctagagcaacccc

SEQ ID NO: 1484073 - DNA, 23 bp, Homo sapiens
gcctgctagagcaacccctgtac

SEQ ID NO: 1484074 - DNA, 14 bp, Homo sapiens
gcctgctcagcagc

SEQ ID NO: 1484075 - DNA, 17 bp, Homo sapiens
gcctgctcagcagccag

SEQ ID NO: 1484076 - DNA, 21 bp, Homo sapiens
gcctgctcagcagccagtctc

SEQ ID NO: 1484077 - DNA, 23 bp, Homo sapiens
gcctgctcagcagccagtctcag

SEQ ID NO: 1484078 - DNA, 13 bp, Homo sapiens
gcctgctccagac

SEQ ID NO: 1484079 - DNA, 15 bp, Homo sapiens
gcctgctccagacct

SEQ ID NO: 1484080 - DNA, 17 bp, Homo sapiens
gcctgctccagacctga

SEQ ID NO: 1484081 - DNA, 13 bp, Homo sapiens
gcctgctcccagc

SEQ ID NO: 1484082 - DNA, 13 bp, Homo sapiens
gcctgctccccca

SEQ ID NO: 1484083 - DNA, 14 bp, Homo sapiens
gcctgctccctgtc

SEQ ID NO: 1484084 - DNA, 18 bp, Homo sapiens
gcctgctccctgtctgtg

SEQ ID NO: 1484085 - DNA, 21 bp, Homo sapiens
gcctgctccctgtctgtgtcc

SEQ ID NO: 1484086 - DNA, 19 bp, Homo sapiens
gcctgctctagtgggacag

SEQ ID NO: 1484087 - DNA, 18 bp, Homo sapiens
gcctgctgcatggggtgg

SEQ ID NO: 1484088 - DNA, 12 bp, Homo sapiens
gcctgctgccag

SEQ ID NO: 1484089 - DNA, 14 bp, Homo sapiens
gcctgctgccagtg

SEQ ID NO: 1484090 - DNA, 22 bp, Homo sapiens
gcctgctgccagtgcagccact

SEQ ID NO: 1484091 - DNA, 23 bp, Homo sapiens
gcctgctgccagtgcagccactg

SEQ ID NO: 1484092 - DNA, 17 bp, Homo sapiens
gcctgctgcgcgtgtgg

SEQ ID NO: 1484093 - DNA, 17 bp, Homo sapiens
gcctgctggaggcctca

SEQ ID NO: 1484094 - DNA, 18 bp, Homo sapiens
gcctgctggaggcctcag

SEQ ID NO: 1484095 - DNA, 19 bp, Homo sapiens
gcctgctggaggcctcagg

SEQ ID NO: 1484096 - DNA, 23 bp, Homo sapiens
gcctgctggaggcctcaggtgct

SEQ ID NO: 1484097 - DNA, 13 bp, Homo sapiens
gcctgctggcacc

SEQ ID NO: 1484098 - DNA, 16 bp, Homo sapiens
gcctgctggcacccac

SEQ ID NO: 1484099 - DNA, 12 bp, Homo sapiens
gcctgctggctg

SEQ ID NO: 1484100 - DNA, 21 bp, Homo sapiens
gcctgctggctgcggccccct

SEQ ID NO: 1484101 - DNA, 13 bp, Homo sapiens
gcctgctgggaac

SEQ ID NO: 1484102 - DNA, 20 bp, Homo sapiens
gcctgctgggaaccccgcag

SEQ ID NO: 1484103 - DNA, 21 bp, Homo sapiens
gcctgctgggaaccccgcagc

SEQ ID NO: 1484104 - DNA, 21 bp, Homo sapiens
gcctgctgggaagagctcccc

SEQ ID NO: 1484105 - DNA, 17 bp, Homo sapiens
gcctgctgggctctcca

SEQ ID NO: 1484106 - DNA, 19 bp, Homo sapiens
gcctgctgggctctccacc

SEQ ID NO: 1484107 - DNA, 23 bp, Homo sapiens
gcctgctgggctctccacctcag

SEQ ID NO: 1484108 - DNA, 14 bp, Homo sapiens
gcctgctggggatt

SEQ ID NO: 1484109 - DNA, 22 bp, Homo sapiens
gcctgctgttggtcctctctct

SEQ ID NO: 1484110 - DNA, 14 bp, Homo sapiens
gcctgcttccccct

SEQ ID NO: 1484111 - DNA, 15 bp, Homo sapiens
gcctgcttttccagg

SEQ ID NO: 1484112 - DNA, 16 bp, Homo sapiens
gcctggaacaccagca

SEQ ID NO: 1484113 - DNA, 19 bp, Homo sapiens
gcctggaaccagggaggag

SEQ ID NO: 1484114 - DNA, 15 bp, Homo sapiens
gcctggactgactgc

SEQ ID NO: 1484115 - DNA, 18 bp, Homo sapiens
gcctggactgactgcagc

SEQ ID NO: 1484116 - DNA, 14 bp, Homo sapiens
gcctggactttcct

SEQ ID NO: 1484117 - DNA, 15 bp, Homo sapiens
gcctggactttcctg

SEQ ID NO: 1484118 - DNA, 19 bp, Homo sapiens
gcctggagacttagggcac

SEQ ID NO: 1484119 - DNA, 16 bp, Homo sapiens
gcctggagatcctcct

SEQ ID NO: 1484120 - DNA, 17 bp, Homo sapiens
gcctggagatcctcctg

SEQ ID NO: 1484121 - DNA, 18 bp, Homo sapiens
gcctggagatcctcctgc

SEQ ID NO: 1484122 - DNA, 20 bp, Homo sapiens
gcctggagatcctcctgcag

SEQ ID NO: 1484123 - DNA, 18 bp, Homo sapiens
gcctggagcatggacagt

SEQ ID NO: 1484124 - DNA, 20 bp, Homo sapiens
gcctggagggggagcaccag

SEQ ID NO: 1484125 - DNA, 13 bp, Homo sapiens
gcctggaggtctg

SEQ ID NO: 1484126 - DNA, 18 bp, Homo sapiens
gcctggaggtctggctga

SEQ ID NO: 1484127 - DNA, 19 bp, Homo sapiens
gcctggaggtctggctgag

SEQ ID NO: 1484128 - DNA, 12 bp, Homo sapiens
gcctggatctcc

SEQ ID NO: 1484129 - DNA, 16 bp, Homo sapiens
gcctggatgagaaaca

SEQ ID NO: 1484130 - DNA, 23 bp, Homo sapiens
gcctggatgagaaacagctcagc

SEQ ID NO: 1484131 - DNA, 21 bp, Homo sapiens
gcctggatgccaaggagcccc

SEQ ID NO: 1484132 - DNA, 23 bp, Homo sapiens
gcctggatgggggtgcaggcagc

SEQ ID NO: 1484133 - DNA, 23 bp, Homo sapiens
gcctggattccagcagtgaatgc

SEQ ID NO: 1484134 - DNA, 15 bp, Homo sapiens
gcctggcaacagagc

SEQ ID NO: 1484135 - DNA, 17 bp, Homo sapiens
gcctggcaacagagcga

SEQ ID NO: 1484136 - DNA, 13 bp, Homo sapiens
gcctggcacacat

SEQ ID NO: 1484137 - DNA, 14 bp, Homo sapiens
gcctggcacacatc

SEQ ID NO: 1484138 - DNA, 18 bp, Homo sapiens
gcctggcacagggcagtg

SEQ ID NO: 1484139 - DNA, 12 bp, Homo sapiens
gcctggcagccg

SEQ ID NO: 1484140 - DNA, 14 bp, Homo sapiens
gcctggcaggtgga

SEQ ID NO: 1484141 - DNA, 15 bp, Homo sapiens
gcctggccacgcagc

SEQ ID NO: 1484142 - DNA, 19 bp, Homo sapiens
gcctggccacgcagccagg

SEQ ID NO: 1484143 - DNA, 21 bp, Homo sapiens
gcctggccacgcagccaggac

SEQ ID NO: 1484144 - DNA, 21 bp, Homo sapiens
gcctggccagacacaggccct

SEQ ID NO: 1484145 - DNA, 14 bp, Homo sapiens
gcctggccaggcag

SEQ ID NO: 1484146 - DNA, 16 bp, Homo sapiens
gcctggccaggccctg

SEQ ID NO: 1484147 - DNA, 14 bp, Homo sapiens
gcctggccagtcct

SEQ ID NO: 1484148 - DNA, 15 bp, Homo sapiens
gcctggccagtcctg

SEQ ID NO: 1484149 - DNA, 23 bp, Homo sapiens
gcctggccagtcctggtcctggc

SEQ ID NO: 1484150 - DNA, 16 bp, Homo sapiens
gcctggccatttccaa

SEQ ID NO: 1484151 - DNA, 18 bp, Homo sapiens
gcctggcccacgccctcc

SEQ ID NO: 1484152 - DNA, 19 bp, Homo sapiens
gcctggcccatagaaacat

SEQ ID NO: 1484153 - DNA, 11 bp, Homo sapiens
gcctggcctcc

SEQ ID NO: 1484154 - DNA, 16 bp, Homo sapiens
gcctggcctccagctc

SEQ ID NO: 1484155 - DNA, 20 bp, Homo sapiens
gcctggcctctgggcagtgt

SEQ ID NO: 1484156 - DNA, 13 bp, Homo sapiens
gcctggcctgagc

SEQ ID NO: 1484157 - DNA, 16 bp, Homo sapiens
gcctggcctgagctgg

SEQ ID NO: 1484158 - DNA, 22 bp, Homo sapiens
gcctggcctgagctggggccac

SEQ ID NO: 1484159 - DNA, 12 bp, Homo sapiens
gcctggcctggc

SEQ ID NO: 1484160 - DNA, 16 bp, Homo sapiens
gcctggcctggcacac

SEQ ID NO: 1484161 - DNA, 13 bp, Homo sapiens
gcctggctctgcc

SEQ ID NO: 1484162 - DNA, 18 bp, Homo sapiens
gcctggctggagagctgc

SEQ ID NO: 1484163 - DNA, 19 bp, Homo sapiens
gcctggctggagagctgct

SEQ ID NO: 1484164 - DNA, 14 bp, Homo sapiens
gcctggctggtggg

SEQ ID NO: 1484165 - DNA, 10 bp, Homo sapiens
gcctggctgt

SEQ ID NO: 1484166 - DNA, 17 bp, Homo sapiens
gcctggctgtggaggcc

SEQ ID NO: 1484167 - DNA, 18 bp, Homo sapiens
gcctggctgtggaggcct

SEQ ID NO: 1484168 - DNA, 17 bp, Homo sapiens
gcctggcttctggagcc

SEQ ID NO: 1484169 - DNA, 18 bp, Homo sapiens
gcctggcttctggagccc

SEQ ID NO: 1484170 - DNA, 22 bp, Homo sapiens
gcctggcttctggagcccttgg

SEQ ID NO: 1484171 - DNA, 16 bp, Homo sapiens
gcctggcttgctccag

SEQ ID NO: 1484172 - DNA, 21 bp, Homo sapiens
gcctggcttgctccagggtct

SEQ ID NO: 1484173 - DNA, 15 bp, Homo sapiens
gcctgggacccagct

SEQ ID NO: 1484174 - DNA, 18 bp, Homo sapiens
gcctgggacccagctact

SEQ ID NO: 1484175 - DNA, 18 bp, Homo sapiens
gcctgggactcccagtga

SEQ ID NO: 1484176 - DNA, 22 bp, Homo sapiens
gcctgggagggttcccctggcc

SEQ ID NO: 1484177 - DNA, 16 bp, Homo sapiens
gcctgggcaacagagc

SEQ ID NO: 1484178 - DNA, 19 bp, Homo sapiens
gcctgggcaccgggacccc

SEQ ID NO: 1484179 - DNA, 17 bp, Homo sapiens
gcctgggccctgggctg

SEQ ID NO: 1484180 - DNA, 21 bp, Homo sapiens
gcctgggccgtagcttgtctg

SEQ ID NO: 1484181 - DNA, 15 bp, Homo sapiens
gcctgggcctcctgg

SEQ ID NO: 1484182 - DNA, 13 bp, Homo sapiens
gcctgggcctgct

SEQ ID NO: 1484183 - DNA, 13 bp, Homo sapiens
gcctgggcctgtg

SEQ ID NO: 1484184 - DNA, 16 bp, Homo sapiens
gcctgggcctgtgcag

SEQ ID NO: 1484185 - DNA, 22 bp, Homo sapiens
gcctgggcctgtgcagcagccc

SEQ ID NO: 1484186 - DNA, 23 bp, Homo sapiens
gcctgggcctgtgcagcagccca

SEQ ID NO: 1484187 - DNA, 15 bp, Homo sapiens
gcctgggcgacagag

SEQ ID NO: 1484188 - DNA, 19 bp, Homo sapiens
gcctgggctcactgtgctg

SEQ ID NO: 1484189 - DNA, 20 bp, Homo sapiens
gcctgggctgttggcactca

SEQ ID NO: 1484190 - DNA, 22 bp, Homo sapiens
gcctggggatgtaaccaagctg

SEQ ID NO: 1484191 - DNA, 23 bp, Homo sapiens
gcctggggatgtaaccaagctgt

SEQ ID NO: 1484192 - DNA, 15 bp, Homo sapiens
gcctggggctccctc

SEQ ID NO: 1484193 - DNA, 22 bp, Homo sapiens
gcctggggctcctttctccagc

SEQ ID NO: 1484194 - DNA, 14 bp, Homo sapiens
gcctgggggagaga

SEQ ID NO: 1484195 - DNA, 17 bp, Homo sapiens
gcctgggggcagtgact

SEQ ID NO: 1484196 - DNA, 18 bp, Homo sapiens
gcctgggggcagtgactg

SEQ ID NO: 1484197 - DNA, 21 bp, Homo sapiens
gcctgggggcagtgactggca

SEQ ID NO: 1484198 - DNA, 18 bp, Homo sapiens
gcctggggtgacctctag

SEQ ID NO: 1484199 - DNA, 21 bp, Homo sapiens
gcctggggtgttagtggcacc

SEQ ID NO: 1484200 - DNA, 22 bp, Homo sapiens
gcctggggtgttagtggcaccg

SEQ ID NO: 1484201 - DNA, 18 bp, Homo sapiens
gcctgggtcacagagtga

SEQ ID NO: 1484202 - DNA, 23 bp, Homo sapiens
gcctgggtcacagagtgagactc

SEQ ID NO: 1484203 - DNA, 21 bp, Homo sapiens
gcctgggtctcaccggctctc

SEQ ID NO: 1484204 - DNA, 18 bp, Homo sapiens
gcctgggtgacagagtga

SEQ ID NO: 1484205 - DNA, 12 bp, Homo sapiens
gcctgggtgctg

SEQ ID NO: 1484206 - DNA, 19 bp, Homo sapiens
gcctgggtggggctgctcc

SEQ ID NO: 1484207 - DNA, 20 bp, Homo sapiens
gcctgggtggggctgctcct

SEQ ID NO: 1484208 - DNA, 21 bp, Homo sapiens
gcctgggtggtacccaggctt

SEQ ID NO: 1484209 - DNA, 15 bp, Homo sapiens
gcctggtccctggga

SEQ ID NO: 1484210 - DNA, 17 bp, Homo sapiens
gcctggtccctggtcct

SEQ ID NO: 1484211 - DNA, 14 bp, Homo sapiens
gcctggtcctccct

SEQ ID NO: 1484212 - DNA, 20 bp, Homo sapiens
gcctggtgcttccaaatatt

SEQ ID NO: 1484213 - DNA, 16 bp, Homo sapiens
gcctggtggttttcaa

SEQ ID NO: 1484214 - DNA, 14 bp, Homo sapiens
gcctggtttagcct

SEQ ID NO: 1484215 - DNA, 13 bp, Homo sapiens
gcctgtaaacttt

SEQ ID NO: 1484216 - DNA, 22 bp, Homo sapiens
gcctgtaacactcctctgcgtc

SEQ ID NO: 1484217 - DNA, 18 bp, Homo sapiens
gcctgtaatcccagaact

SEQ ID NO: 1484218 - DNA, 17 bp, Homo sapiens
gcctgtaatcccagcac

SEQ ID NO: 1484219 - DNA, 19 bp, Homo sapiens
gcctgtaatcccagctact

SEQ ID NO: 1484220 - DNA, 21 bp, Homo sapiens
gcctgtaatctaccagtggtg

SEQ ID NO: 1484221 - DNA, 22 bp, Homo sapiens
gcctgtagagacaatacagtaa

SEQ ID NO: 1484222 - DNA, 13 bp, Homo sapiens
gcctgtagagttg

SEQ ID NO: 1484223 - DNA, 17 bp, Homo sapiens
gcctgtagagttgctga

SEQ ID NO: 1484224 - DNA, 21 bp, Homo sapiens
gcctgtagctcccctgctgag

SEQ ID NO: 1484225 - DNA, 17 bp, Homo sapiens
gcctgtagtctcagcta

SEQ ID NO: 1484226 - DNA, 22 bp, Homo sapiens
gcctgtatcctccctggcagac

SEQ ID NO: 1484227 - DNA, 19 bp, Homo sapiens
gcctgtatgtggtgtgggg

SEQ ID NO: 1484228 - DNA, 16 bp, Homo sapiens
gcggaggtctctggga

SEQ ID NO: 1484229 - DNA, 23 bp, Homo sapiens
gcggaggtctctgggagcccaga

SEQ ID NO: 1484230 - DNA, 21 bp, Homo sapiens
gcggaggtgtggagccgaggc

SEQ ID NO: 1484231 - DNA, 15 bp, Homo sapiens
gcggaggttgcaggg

SEQ ID NO: 1484232 - DNA, 22 bp, Homo sapiens
gcggagtgaagaggggcagccc

SEQ ID NO: 1484233 - DNA, 13 bp, Homo sapiens
gcggatcctgctg

SEQ ID NO: 1484234 - DNA, 20 bp, Homo sapiens
gcggattaatttgcatctga

SEQ ID NO: 1484235 - DNA, 16 bp, Homo sapiens
gcggattgctctggag

SEQ ID NO: 1484236 - DNA, 22 bp, Homo sapiens
gcggattgctctggagcagcca

SEQ ID NO: 1484237 - DNA, 16 bp, Homo sapiens
gcggcaaaaggaaagc

SEQ ID NO: 1484238 - DNA, 17 bp, Homo sapiens
gcggcacccaggcctcc

SEQ ID NO: 1484239 - DNA, 19 bp, Homo sapiens
gcggcacccaggcctccct

SEQ ID NO: 1484240 - DNA, 19 bp, Homo sapiens
gcggcagagcaattccagg

SEQ ID NO: 1484241 - DNA, 21 bp, Homo sapiens
gcggcagagcaattccaggct

SEQ ID NO: 1484242 - DNA, 23 bp, Homo sapiens
gcggcagccccacttcaccccca

SEQ ID NO: 1484243 - DNA, 19 bp, Homo sapiens
gcggcaggaccgccatggt

SEQ ID NO: 1484244 - DNA, 23 bp, Homo sapiens
gcggccacgcactgggccacgga

SEQ ID NO: 1484245 - DNA, 22 bp, Homo sapiens
gcggccagcgtcccagggtacc

SEQ ID NO: 1484246 - DNA, 21 bp, Homo sapiens
gcggccaggcacagggcccgc

SEQ ID NO: 1484247 - DNA, 15 bp, Homo sapiens
gcggccaggcaccca

SEQ ID NO: 1484248 - DNA, 17 bp, Homo sapiens
gcggcccactttcctga

SEQ ID NO: 1484249 - DNA, 19 bp, Homo sapiens
gcggcccactttcctgagc

SEQ ID NO: 1484250 - DNA, 18 bp, Homo sapiens
gcggccccccgcacagcc

SEQ ID NO: 1484251 - DNA, 22 bp, Homo sapiens
gcggccccctctcggccaggca

SEQ ID NO: 1484252 - DNA, 13 bp, Homo sapiens
gcggcccggccag

SEQ ID NO: 1484253 - DNA, 13 bp, Homo sapiens
gcggccctgtcat

SEQ ID NO: 1484254 - DNA, 15 bp, Homo sapiens
gcggccgcattccct

SEQ ID NO: 1484255 - DNA, 17 bp, Homo sapiens
gcggccgcattccctga

SEQ ID NO: 1484256 - DNA, 23 bp, Homo sapiens
gcggcctccggcgtcttgcccag

SEQ ID NO: 1484257 - DNA, 16 bp, Homo sapiens
gcggccttccgggtct

SEQ ID NO: 1484258 - DNA, 13 bp, Homo sapiens
gcggcgcagagcc

SEQ ID NO: 1484259 - DNA, 14 bp, Homo sapiens
gcggcgcagagccc

SEQ ID NO: 1484260 - DNA, 19 bp, Homo sapiens
gcggcgcagagccctccag

SEQ ID NO: 1484261 - DNA, 14 bp, Homo sapiens
gcggcgggcggctg

SEQ ID NO: 1484262 - DNA, 13 bp, Homo sapiens
gcggctactcagc

SEQ ID NO: 1484263 - DNA, 19 bp, Homo sapiens
gcggctactcagcagccct

SEQ ID NO: 1484264 - DNA, 19 bp, Homo sapiens
gcggctcaaaaggaaacca

SEQ ID NO: 1484265 - DNA, 15 bp, Homo sapiens
gcggctcccggggca

SEQ ID NO: 1484266 - DNA, 22 bp, Homo sapiens
gcggctcccggggcagggcagc

SEQ ID NO: 1484267 - DNA, 21 bp, Homo sapiens
gcggctgagagccccagctga

SEQ ID NO: 1484268 - DNA, 16 bp, Homo sapiens
gcggctgtgggcgagc

SEQ ID NO: 1484269 - DNA, 13 bp, Homo sapiens
gcgggacagccaa

SEQ ID NO: 1484270 - DNA, 23 bp, Homo sapiens
gcgggacgagaccctacaggaga

SEQ ID NO: 1484271 - DNA, 21 bp, Homo sapiens
gcgggagccatgcgccccctc

SEQ ID NO: 1484272 - DNA, 18 bp, Homo sapiens
gcgggagggcctgcagtg

SEQ ID NO: 1484273 - DNA, 20 bp, Homo sapiens
gcgggatcctccacagagag

SEQ ID NO: 1484274 - DNA, 16 bp, Homo sapiens
gcgggatggtcctggg

SEQ ID NO: 1484275 - DNA, 12 bp, Homo sapiens
gcgggcacaggg

SEQ ID NO: 1484276 - DNA, 19 bp, Homo sapiens
gcgggcagagggctggagg

SEQ ID NO: 1484277 - DNA, 13 bp, Homo sapiens
gcgggcagcgggc

SEQ ID NO: 1484278 - DNA, 17 bp, Homo sapiens
gcgggcagcgggccagg

SEQ ID NO: 1484279 - DNA, 15 bp, Homo sapiens
gcgggccagccaggc

SEQ ID NO: 1484280 - DNA, 15 bp, Homo sapiens
gcgggccaggcccgc

SEQ ID NO: 1484281 - DNA, 13 bp, Homo sapiens
gcgggccagggtg

SEQ ID NO: 1484282 - DNA, 14 bp, Homo sapiens
gcgggccagggtgg

SEQ ID NO: 1484283 - DNA, 19 bp, Homo sapiens
gcgggccagggtgggaaga

SEQ ID NO: 1484284 - DNA, 20 bp, Homo sapiens
gcgggcccctcacctggtac

SEQ ID NO: 1484285 - DNA, 18 bp, Homo sapiens
gcgggcctggacaaggtc

SEQ ID NO: 1484286 - DNA, 19 bp, Homo sapiens
gcgggcctggacaaggtct

SEQ ID NO: 1484287 - DNA, 16 bp, Homo sapiens
gcgggcctggccctca

SEQ ID NO: 1484288 - DNA, 19 bp, Homo sapiens
gcgggcctggccctcactc

SEQ ID NO: 1484289 - DNA, 12 bp, Homo sapiens
gcgggcggccag

SEQ ID NO: 1484290 - DNA, 19 bp, Homo sapiens
gcgggcggctgggtctgtg

SEQ ID NO: 1484291 - DNA, 12 bp, Homo sapiens
gcggggcagcaa

SEQ ID NO: 1484292 - DNA, 14 bp, Homo sapiens
gcggggcagcagga

SEQ ID NO: 1484293 - DNA, 14 bp, Homo sapiens
gcggggctgtcacc

SEQ ID NO: 1484294 - DNA, 14 bp, Homo sapiens
gcggggtgctgtgg

SEQ ID NO: 1484295 - DNA, 11 bp, Homo sapiens
gcggggtggag

SEQ ID NO: 1484296 - DNA, 16 bp, Homo sapiens
gcggggtttcaccatg

SEQ ID NO: 1484297 - DNA, 22 bp, Homo sapiens
gcgggtaaaaaacctgggttag

SEQ ID NO: 1484298 - DNA, 20 bp, Homo sapiens
gcgggtggatcacctgaggt

SEQ ID NO: 1484299 - DNA, 19 bp, Homo sapiens
gcgggttataatgaatgac

SEQ ID NO: 1484300 - DNA, 13 bp, Homo sapiens
gcggtcatgtgtg

SEQ ID NO: 1484301 - DNA, 16 bp, Homo sapiens
gcggtcatgtgtgcat

SEQ ID NO: 1484302 - DNA, 18 bp, Homo sapiens
gcggtcatgtgtgcatgt

SEQ ID NO: 1484303 - DNA, 18 bp, Homo sapiens
gcggtccctgtccctcta

SEQ ID NO: 1484304 - DNA, 21 bp, Homo sapiens
gcggtccctgtccctctagtg

SEQ ID NO: 1484305 - DNA, 12 bp, Homo sapiens
gcggtgctctgg

SEQ ID NO: 1484306 - DNA, 13 bp, Homo sapiens
gcggtgctctggc

SEQ ID NO: 1484307 - DNA, 21 bp, Homo sapiens
gcggtgctgactgaggcctgc

SEQ ID NO: 1484308 - DNA, 14 bp, Homo sapiens
gcggtggcatgcat

SEQ ID NO: 1484309 - DNA, 18 bp, Homo sapiens
gcggttataaaaaatggt

SEQ ID NO: 1484310 - DNA, 19 bp, Homo sapiens
gcggttataaaaaatggtt

SEQ ID NO: 1484311 - DNA, 19 bp, Homo sapiens
gcggttcctcatctgagag

SEQ ID NO: 1484312 - DNA, 20 bp, Homo sapiens
gcggtttactcactgctgca

SEQ ID NO: 1484313 - DNA, 12 bp, Homo sapiens
gcgtacacagag

SEQ ID NO: 1484314 - DNA, 14 bp, Homo sapiens
gcgtacacagagaa

SEQ ID NO: 1484315 - DNA, 15 bp, Homo sapiens
gcgtacacagagaag

SEQ ID NO: 1484316 - DNA, 16 bp, Homo sapiens
gcgtacacagagaagg

SEQ ID NO: 1484317 - DNA, 22 bp, Homo sapiens
gcgtagacttgacaacatccca

SEQ ID NO: 1484318 - DNA, 16 bp, Homo sapiens
gcgtagcagagttaaa

SEQ ID NO: 1484319 - DNA, 20 bp, Homo sapiens
gcgtagcgtgcccgtgtgca

SEQ ID NO: 1484320 - DNA, 13 bp, Homo sapiens
gcgtcaagacatt

SEQ ID NO: 1484321 - DNA, 13 bp, Homo sapiens
gcgtcactccagt

SEQ ID NO: 1484322 - DNA, 18 bp, Homo sapiens
gcgtcactccagtgctca

SEQ ID NO: 1484323 - DNA, 21 bp, Homo sapiens
gcgtcactccagtgctcagct

SEQ ID NO: 1484324 - DNA, 17 bp, Homo sapiens
gcgtcagctgctccctg

SEQ ID NO: 1484325 - DNA, 12 bp, Homo sapiens
gcgtcccagctg

SEQ ID NO: 1484326 - DNA, 17 bp, Homo sapiens
gcgtcccccgccgcgcc

SEQ ID NO: 1484327 - DNA, 16 bp, Homo sapiens
gcgtccctagcagtga

SEQ ID NO: 1484328 - DNA, 18 bp, Homo sapiens
gcgtccctggcgcaggtg

SEQ ID NO: 1484329 - DNA, 20 bp, Homo sapiens
gcgtccgcgcgccagcacag

SEQ ID NO: 1484330 - DNA, 18 bp, Homo sapiens
gcgtcctgacgccctgcg

SEQ ID NO: 1484331 - DNA, 18 bp, Homo sapiens
gcgtcctgcagaggacca

SEQ ID NO: 1484332 - DNA, 13 bp, Homo sapiens
gcgtcctgggctc

SEQ ID NO: 1484333 - DNA, 17 bp, Homo sapiens
gcgtccttccccctgta

SEQ ID NO: 1484334 - DNA, 21 bp, Homo sapiens
gcgtccttccccctgtagact

SEQ ID NO: 1484335 - DNA, 14 bp, Homo sapiens
gcgtctacccagac

SEQ ID NO: 1484336 - DNA, 13 bp, Homo sapiens
gcgtcttcctgag

SEQ ID NO: 1484337 - DNA, 17 bp, Homo sapiens
gcgtcttgcccagcagc

SEQ ID NO: 1484338 - DNA, 16 bp, Homo sapiens
gcgtgaagagcagtga

SEQ ID NO: 1484339 - DNA, 16 bp, Homo sapiens
gcgtgacggacatcca

SEQ ID NO: 1484340 - DNA, 13 bp, Homo sapiens
gcgtgagaggcaa

SEQ ID NO: 1484341 - DNA, 16 bp, Homo sapiens
gcgtgatctcagctca

SEQ ID NO: 1484342 - DNA, 13 bp, Homo sapiens
gcgtgcacatctg

SEQ ID NO: 1484343 - DNA, 16 bp, Homo sapiens
gctacctctctgtccc

SEQ ID NO: 1484344 - DNA, 22 bp, Homo sapiens
gctacctctctgtcccttgctg

SEQ ID NO: 1484345 - DNA, 14 bp, Homo sapiens
gctacctgtgagca

SEQ ID NO: 1484346 - DNA, 12 bp, Homo sapiens
gctacgcctctt

SEQ ID NO: 1484347 - DNA, 15 bp, Homo sapiens
gctacgcctcttctg

SEQ ID NO: 1484348 - DNA, 20 bp, Homo sapiens
gctactacccgagcccagct

SEQ ID NO: 1484349 - DNA, 21 bp, Homo sapiens
gctactacccgagcccagcta

SEQ ID NO: 1484350 - DNA, 15 bp, Homo sapiens
gctactcagaagcct

SEQ ID NO: 1484351 - DNA, 18 bp, Homo sapiens
gctactcagaagcctgag

SEQ ID NO: 1484352 - DNA, 15 bp, Homo sapiens
gctactcaggaggct

SEQ ID NO: 1484353 - DNA, 16 bp, Homo sapiens
gctactcaggaggctg

SEQ ID NO: 1484354 - DNA, 17 bp, Homo sapiens
gctactcaggaggctga

SEQ ID NO: 1484355 - DNA, 20 bp, Homo sapiens
gctactcaggaggctgagac

SEQ ID NO: 1484356 - DNA, 19 bp, Homo sapiens
gctactcagtggggctggc

SEQ ID NO: 1484357 - DNA, 20 bp, Homo sapiens
gctactcagtggggctggca

SEQ ID NO: 1484358 - DNA, 16 bp, Homo sapiens
gctactcctgtgctct

SEQ ID NO: 1484359 - DNA, 23 bp, Homo sapiens
gctactctccccacgagggctgg

SEQ ID NO: 1484360 - DNA, 12 bp, Homo sapiens
gctactctgtcc

SEQ ID NO: 1484361 - DNA, 13 bp, Homo sapiens
gctactctgtcca

SEQ ID NO: 1484362 - DNA, 16 bp, Homo sapiens
gctactctgtccaggc

SEQ ID NO: 1484363 - DNA, 12 bp, Homo sapiens
gctactggcagc

SEQ ID NO: 1484364 - DNA, 13 bp, Homo sapiens
gctactggcagct

SEQ ID NO: 1484365 - DNA, 19 bp, Homo sapiens
gctactggggaggctgagg

SEQ ID NO: 1484366 - DNA, 20 bp, Homo sapiens
gctactggggaggctgaggc

SEQ ID NO: 1484367 - DNA, 14 bp, Homo sapiens
gctactgtcttact

SEQ ID NO: 1484368 - DNA, 19 bp, Homo sapiens
gctactgttgtaagaattc

SEQ ID NO: 1484369 - DNA, 12 bp, Homo sapiens
gctacttccctt

SEQ ID NO: 1484370 - DNA, 15 bp, Homo sapiens
gctacttcccttcct

SEQ ID NO: 1484371 - DNA, 18 bp, Homo sapiens
gctacttcctcctcccca

SEQ ID NO: 1484372 - DNA, 19 bp, Homo sapiens
gctacttcctcctccccac

SEQ ID NO: 1484373 - DNA, 13 bp, Homo sapiens
gctacttgggagg

SEQ ID NO: 1484374 - DNA, 22 bp, Homo sapiens
gctacttgggaggctgaggcag

SEQ ID NO: 1484375 - DNA, 15 bp, Homo sapiens
gctacttggtttgtg

SEQ ID NO: 1484376 - DNA, 20 bp, Homo sapiens
gctactttatgtaaatcact

SEQ ID NO: 1484377 - DNA, 18 bp, Homo sapiens
gctactttggtttctgtc

SEQ ID NO: 1484378 - DNA, 22 bp, Homo sapiens
gctagactcctcaggagagacc

SEQ ID NO: 1484379 - DNA, 12 bp, Homo sapiens
gctagagaaatc

SEQ ID NO: 1484380 - DNA, 21 bp, Homo sapiens
gctagagaaatcagctgctat

SEQ ID NO: 1484381 - DNA, 17 bp, Homo sapiens
gctagagaaggaccaga

SEQ ID NO: 1484382 - DNA, 21 bp, Homo sapiens
gctagagatatggcagcgaaa

SEQ ID NO: 1484383 - DNA, 20 bp, Homo sapiens
gctagagcaacccctgtacc

SEQ ID NO: 1484384 - DNA, 21 bp, Homo sapiens
gctagagcaacccctgtaccc

SEQ ID NO: 1484385 - DNA, 18 bp, Homo sapiens
gctagagccgaggggaga

SEQ ID NO: 1484386 - DNA, 11 bp, Homo sapiens
gctagaggcat

SEQ ID NO: 1484387 - DNA, 20 bp, Homo sapiens
gctagaggccacctatgcca

SEQ ID NO: 1484388 - DNA, 13 bp, Homo sapiens
gctagaggcctga

SEQ ID NO: 1484389 - DNA, 18 bp, Homo sapiens
gctagattttaatttatt

SEQ ID NO: 1484390 - DNA, 14 bp, Homo sapiens
gctagcatccctga

SEQ ID NO: 1484391 - DNA, 22 bp, Homo sapiens
gctagcccagtccctggagctg

SEQ ID NO: 1484392 - DNA, 12 bp, Homo sapiens
gctagccctggg

SEQ ID NO: 1484393 - DNA, 21 bp, Homo sapiens
gctagcgctgccgcaccccag

SEQ ID NO: 1484394 - DNA, 17 bp, Homo sapiens
gctagcggggccaggag

SEQ ID NO: 1484395 - DNA, 19 bp, Homo sapiens
gctagcggggccaggagcc

SEQ ID NO: 1484396 - DNA, 12 bp, Homo sapiens
gctagctgccac

SEQ ID NO: 1484397 - DNA, 16 bp, Homo sapiens
gctagctgccactttc

SEQ ID NO: 1484398 - DNA, 18 bp, Homo sapiens
gctagctgtagaaatgta

SEQ ID NO: 1484399 - DNA, 18 bp, Homo sapiens
gctagcttctgcttttct

SEQ ID NO: 1484400 - DNA, 16 bp, Homo sapiens
gctagcttttaggaaa

SEQ ID NO: 1484401 - DNA, 21 bp, Homo sapiens
gctagcttttaggaaaatcac

SEQ ID NO: 1484402 - DNA, 12 bp, Homo sapiens
gctaggactgag

SEQ ID NO: 1484403 - DNA, 14 bp, Homo sapiens
gctaggactgagga

SEQ ID NO: 1484404 - DNA, 18 bp, Homo sapiens
gctaggactgaggagtgg

SEQ ID NO: 1484405 - DNA, 19 bp, Homo sapiens
gctaggagagactgaaagc

SEQ ID NO: 1484406 - DNA, 14 bp, Homo sapiens
gctaggagccccag

SEQ ID NO: 1484407 - DNA, 16 bp, Homo sapiens
gctaggccccagaggc

SEQ ID NO: 1484408 - DNA, 18 bp, Homo sapiens
gctaggccccagaggccc

SEQ ID NO: 1484409 - DNA, 15 bp, Homo sapiens
gctagggtggccctt

SEQ ID NO: 1484410 - DNA, 17 bp, Homo sapiens
gctagtatcttcaaact

SEQ ID NO: 1484411 - DNA, 19 bp, Homo sapiens
gctagtcactggcagcctg

SEQ ID NO: 1484412 - DNA, 23 bp, Homo sapiens
gctagtcactggcagcctgcacc

SEQ ID NO: 1484413 - DNA, 14 bp, Homo sapiens
gctagtcagagaga

SEQ ID NO: 1484414 - DNA, 21 bp, Homo sapiens
gctagtcttcccttacctcaa

SEQ ID NO: 1484415 - DNA, 19 bp, Homo sapiens
gctagtcttgaatttctga

SEQ ID NO: 1484416 - DNA, 19 bp, Homo sapiens
gctagtgaaatggctgggg

SEQ ID NO: 1484417 - DNA, 21 bp, Homo sapiens
gctagtgaaatggctggggcc

SEQ ID NO: 1484418 - DNA, 14 bp, Homo sapiens
gctagtgacttgtg

SEQ ID NO: 1484419 - DNA, 21 bp, Homo sapiens
gctagtgacttgtgtcccatg

SEQ ID NO: 1484420 - DNA, 23 bp, Homo sapiens
gctagtgatacactgtatctaaa

SEQ ID NO: 1484421 - DNA, 13 bp, Homo sapiens
gctagtgccttta

SEQ ID NO: 1484422 - DNA, 19 bp, Homo sapiens
gctagtgggccctctctct

SEQ ID NO: 1484423 - DNA, 22 bp, Homo sapiens
gctagtgggccctctctctggg

SEQ ID NO: 1484424 - DNA, 23 bp, Homo sapiens
gctagtgggccctctctctgggc

SEQ ID NO: 1484425 - DNA, 17 bp, Homo sapiens
gctagtggggtgaacag

SEQ ID NO: 1484426 - DNA, 20 bp, Homo sapiens
gctagtggggtgaacagctg

SEQ ID NO: 1484427 - DNA, 21 bp, Homo sapiens
gctagtggggtgaacagctgg

SEQ ID NO: 1484428 - DNA, 19 bp, Homo sapiens
gctagtggtagtatctcgt

SEQ ID NO: 1484429 - DNA, 20 bp, Homo sapiens
gctagtgtgagtggcagcca

SEQ ID NO: 1484430 - DNA, 20 bp, Homo sapiens
gctagtgtgctttcctttct

SEQ ID NO: 1484431 - DNA, 22 bp, Homo sapiens
gctagttatacttatttgtata

SEQ ID NO: 1484432 - DNA, 17 bp, Homo sapiens
gctagttctgctgccct

SEQ ID NO: 1484433 - DNA, 15 bp, Homo sapiens
gctagttttacagat

SEQ ID NO: 1484434 - DNA, 16 bp, Homo sapiens
gctataaagtatatat

SEQ ID NO: 1484435 - DNA, 13 bp, Homo sapiens
gctataatcatta

SEQ ID NO: 1484436 - DNA, 18 bp, Homo sapiens
gctataatcattagtttt

SEQ ID NO: 1484437 - DNA, 20 bp, Homo sapiens
gctataatcattagttttag

SEQ ID NO: 1484438 - DNA, 18 bp, Homo sapiens
gctataatgagcatgttt

SEQ ID NO: 1484439 - DNA, 22 bp, Homo sapiens
gctataatgtttccctcaagaa

SEQ ID NO: 1484440 - DNA, 13 bp, Homo sapiens
gctataggtgcta

SEQ ID NO: 1484441 - DNA, 19 bp, Homo sapiens
gctataggtgctacaaaaa

SEQ ID NO: 1484442 - DNA, 19 bp, Homo sapiens
gctatcacctagcagcctc

SEQ ID NO: 1484443 - DNA, 20 bp, Homo sapiens
gctatcacctagcagcctca

SEQ ID NO: 1484444 - DNA, 14 bp, Homo sapiens
gctatcagtgcttt

SEQ ID NO: 1484445 - DNA, 20 bp, Homo sapiens
gctatcctgccaaaatcatt

SEQ ID NO: 1484446 - DNA, 14 bp, Homo sapiens
gctatcgccctcct

SEQ ID NO: 1484447 - DNA, 16 bp, Homo sapiens
gctatcgccctccttt

SEQ ID NO: 1484448 - DNA, 18 bp, Homo sapiens
gctatcgccctcctttcc

SEQ ID NO: 1484449 - DNA, 20 bp, Homo sapiens
gctatcgccctcctttccct

SEQ ID NO: 1484450 - DNA, 23 bp, Homo sapiens
gctatctctcagtgaactgtgag

SEQ ID NO: 1484451 - DNA, 23 bp, Homo sapiens
gctatgaagggacagctgctggg

SEQ ID NO: 1484452 - DNA, 17 bp, Homo sapiens
gctatgcatattcaatg

SEQ ID NO: 1484453 - DNA, 20 bp, Homo sapiens
gctatgcggaggaaagcaag

SEQ ID NO: 1484454 - DNA, 21 bp, Homo sapiens
gctatggcaagggggtgtcat

SEQ ID NO: 1484455 - DNA, 20 bp, Homo sapiens
gctatggcaggataagaaag

SEQ ID NO: 1484456 - DNA, 15 bp, Homo sapiens
gctatgggaggcagc

SEQ ID NO: 1484457 - DNA, 16 bp, Homo sapiens
gctatgggaggcagcc

SEQ ID NO: 1484458 - DNA, 14 bp, Homo sapiens
gctatgtaagggtc

SEQ ID NO: 1484459 - DNA, 12 bp, Homo sapiens
gctatgtgaaac

SEQ ID NO: 1484460 - DNA, 13 bp, Homo sapiens
gctatgtgacttg

SEQ ID NO: 1484461 - DNA, 17 bp, Homo sapiens
gctatgttactattttc

SEQ ID NO: 1484462 - DNA, 16 bp, Homo sapiens
gctattcacctcagta

SEQ ID NO: 1484463 - DNA, 20 bp, Homo sapiens
gctattcacctcagtagaaa

SEQ ID NO: 1484464 - DNA, 18 bp, Homo sapiens
gctattgaagatgctgcc

SEQ ID NO: 1484465 - DNA, 22 bp, Homo sapiens
gctattgaagatgctgcctgta

SEQ ID NO: 1484466 - DNA, 16 bp, Homo sapiens
gctattggaggatcag

SEQ ID NO: 1484467 - DNA, 19 bp, Homo sapiens
gctattggaggatcagttt

SEQ ID NO: 1484468 - DNA, 12 bp, Homo sapiens
gctatttaatat

SEQ ID NO: 1484469 - DNA, 11 bp, Homo sapiens
gctatttatgc

SEQ ID NO: 1484470 - DNA, 19 bp, Homo sapiens
gctatttatgggcccctgg

SEQ ID NO: 1484471 - DNA, 20 bp, Homo sapiens
gctatttattttcctaaaga

SEQ ID NO: 1484472 - DNA, 13 bp, Homo sapiens
gctatttctctcc

SEQ ID NO: 1484473 - DNA, 13 bp, Homo sapiens
gctatttctgtgt

SEQ ID NO: 1484474 - DNA, 18 bp, Homo sapiens
gctatttgtacaaataaa

SEQ ID NO: 1484475 - DNA, 17 bp, Homo sapiens
gctattttatttgtatt

SEQ ID NO: 1484476 - DNA, 19 bp, Homo sapiens
gctattttatttgtattca

SEQ ID NO: 1484477 - DNA, 13 bp, Homo sapiens
gctcaaaactttc

SEQ ID NO: 1484478 - DNA, 19 bp, Homo sapiens
gctcaaaaggaaaccaagt

SEQ ID NO: 1484479 - DNA, 17 bp, Homo sapiens
gctcaaaattgcttcta

SEQ ID NO: 1484480 - DNA, 20 bp, Homo sapiens
gctcaaagcccttcctacct

SEQ ID NO: 1484481 - DNA, 23 bp, Homo sapiens
gctcaaaggtttggaaggagcag

SEQ ID NO: 1484482 - DNA, 14 bp, Homo sapiens
gctcaaatctattc

SEQ ID NO: 1484483 - DNA, 18 bp, Homo sapiens
gctcaaatctattcagac

SEQ ID NO: 1484484 - DNA, 20 bp, Homo sapiens
gctcaaatctattcagacaa

SEQ ID NO: 1484485 - DNA, 19 bp, Homo sapiens
gctcaactctacccctgct

SEQ ID NO: 1484486 - DNA, 21 bp, Homo sapiens
gctcaagaagacatggagact

SEQ ID NO: 1484487 - DNA, 17 bp, Homo sapiens
gctcaagatgacagctc

SEQ ID NO: 1484488 - DNA, 15 bp, Homo sapiens
gctcaagcagcgacc

SEQ ID NO: 1484489 - DNA, 21 bp, Homo sapiens
gctcaagcagcgaccgccccc

SEQ ID NO: 1484490 - DNA, 22 bp, Homo sapiens
gctcaagcagcgaccgccccct

SEQ ID NO: 1484491 - DNA, 23 bp, Homo sapiens
gctcaagcagcgaccgccccctc

SEQ ID NO: 1484492 - DNA, 13 bp, Homo sapiens
gctcaaggaaagg

SEQ ID NO: 1484493 - DNA, 13 bp, Homo sapiens
gctcaaggctgtg

SEQ ID NO: 1484494 - DNA, 13 bp, Homo sapiens
gctcaagtagaaa

SEQ ID NO: 1484495 - DNA, 12 bp, Homo sapiens
gctcaagttcat

SEQ ID NO: 1484496 - DNA, 19 bp, Homo sapiens
gctcaatattcctgaatga

SEQ ID NO: 1484497 - DNA, 21 bp, Homo sapiens
gctcaatattcctgaatgaaa

SEQ ID NO: 1484498 - DNA, 16 bp, Homo sapiens
gctcaatcaagaaaat

SEQ ID NO: 1484499 - DNA, 20 bp, Homo sapiens
gctcaatccctgaggactga

SEQ ID NO: 1484500 - DNA, 17 bp, Homo sapiens
gctcaatggactggaag

SEQ ID NO: 1484501 - DNA, 22 bp, Homo sapiens
gctcaattcaagtgacacatta

SEQ ID NO: 1484502 - DNA, 14 bp, Homo sapiens
gctcacaaaccatg

SEQ ID NO: 1484503 - DNA, 18 bp, Homo sapiens
gctcacaacttgggttct

SEQ ID NO: 1484504 - DNA, 14 bp, Homo sapiens
gctcacaaggccca

SEQ ID NO: 1484505 - DNA, 16 bp, Homo sapiens
gctcacaaggcccagg

SEQ ID NO: 1484506 - DNA, 17 bp, Homo sapiens
gctcacaaggcccagga

SEQ ID NO: 1484507 - DNA, 22 bp, Homo sapiens
gctcacagttcctcgccctggg

SEQ ID NO: 1484508 - DNA, 14 bp, Homo sapiens
gctcaccaggcctg

SEQ ID NO: 1484509 - DNA, 15 bp, Homo sapiens
gctcaccaggcctgg

SEQ ID NO: 1484510 - DNA, 18 bp, Homo sapiens
gctcaccaggcctggcct

SEQ ID NO: 1484511 - DNA, 22 bp, Homo sapiens
gctcaccaggcctggcctctgg

SEQ ID NO: 1484512 - DNA, 23 bp, Homo sapiens
gctcaccaggcctggcctctggg

SEQ ID NO: 1484513 - DNA, 18 bp, Homo sapiens
gctcacccgtaggcaaat

SEQ ID NO: 1484514 - DNA, 21 bp, Homo sapiens
gctcaccctgcccgctcccaa

SEQ ID NO: 1484515 - DNA, 14 bp, Homo sapiens
gctcacctcagagc

SEQ ID NO: 1484516 - DNA, 16 bp, Homo sapiens
gctcacctcagagcag

SEQ ID NO: 1484517 - DNA, 14 bp, Homo sapiens
gctcacctctgaag

SEQ ID NO: 1484518 - DNA, 17 bp, Homo sapiens
gctcacctgtgtgccca

SEQ ID NO: 1484519 - DNA, 20 bp, Homo sapiens
gctcacgcctgtaatcccag

SEQ ID NO: 1484520 - DNA, 22 bp, Homo sapiens
gctcacgtaatgcattgcctgt

SEQ ID NO: 1484521 - DNA, 14 bp, Homo sapiens
gctcacgtcacact

SEQ ID NO: 1484522 - DNA, 13 bp, Homo sapiens
gctcacgtctctg

SEQ ID NO: 1484523 - DNA, 15 bp, Homo sapiens
gctcactcagccacc

SEQ ID NO: 1484524 - DNA, 19 bp, Homo sapiens
gctcactcccaagggacag

SEQ ID NO: 1484525 - DNA, 17 bp, Homo sapiens
gctcactgaaacctctg

SEQ ID NO: 1484526 - DNA, 19 bp, Homo sapiens
gctcactgaaacctctgcc

SEQ ID NO: 1484527 - DNA, 20 bp, Homo sapiens
gctcactgaaacctctgcct

SEQ ID NO: 1484528 - DNA, 20 bp, Homo sapiens
gctcactgagtgatacttta

SEQ ID NO: 1484529 - DNA, 19 bp, Homo sapiens
gctcactgcaacctctgcc

SEQ ID NO: 1484530 - DNA, 17 bp, Homo sapiens
gctcactgcagcctccg

SEQ ID NO: 1484531 - DNA, 14 bp, Homo sapiens
gctcactgccaggc

SEQ ID NO: 1484532 - DNA, 20 bp, Homo sapiens
gctcactgccaggccagcct

SEQ ID NO: 1484533 - DNA, 17 bp, Homo sapiens
gctcactggcaggtgtg

SEQ ID NO: 1484534 - DNA, 18 bp, Homo sapiens
gctcactgtgctggggca

SEQ ID NO: 1484535 - DNA, 21 bp, Homo sapiens
gctcagaacaccccgctctgg

SEQ ID NO: 1484536 - DNA, 20 bp, Homo sapiens
gctcagaacttgctgctgtc

SEQ ID NO: 1484537 - DNA, 22 bp, Homo sapiens
gctcagaatccaagtgaacact

SEQ ID NO: 1484538 - DNA, 19 bp, Homo sapiens
gctcagacccccactctca

SEQ ID NO: 1484539 - DNA, 18 bp, Homo sapiens
gctcagacggcggccagg

SEQ ID NO: 1484540 - DNA, 17 bp, Homo sapiens
gctcagagaaggaaaag

SEQ ID NO: 1484541 - DNA, 21 bp, Homo sapiens
gctcagcagccagtctcagag

SEQ ID NO: 1484542 - DNA, 22 bp, Homo sapiens
gctcagcagccagtctcagaga

SEQ ID NO: 1484543 - DNA, 17 bp, Homo sapiens
gctcagccacagcctga

SEQ ID NO: 1484544 - DNA, 18 bp, Homo sapiens
gctcagccacagcctgac

SEQ ID NO: 1484545 - DNA, 17 bp, Homo sapiens
gctcagcccgcttggcc

SEQ ID NO: 1484546 - DNA, 18 bp, Homo sapiens
gctcagcccgcttggcca

SEQ ID NO: 1484547 - DNA, 18 bp, Homo sapiens
gctcagccctccctgccc

SEQ ID NO: 1484548 - DNA, 11 bp, Homo sapiens
gctcagcctgg

SEQ ID NO: 1484549 - DNA, 14 bp, Homo sapiens
gctcagcctggtgg

SEQ ID NO: 1484550 - DNA, 19 bp, Homo sapiens
gctcagcctggtgggcctc

SEQ ID NO: 1484551 - DNA, 22 bp, Homo sapiens
gctcagccttgctgctctgcgt

SEQ ID NO: 1484552 - DNA, 12 bp, Homo sapiens
gctcagctgcat

SEQ ID NO: 1484553 - DNA, 19 bp, Homo sapiens
gctcagctgcattccgcag

SEQ ID NO: 1484554 - DNA, 14 bp, Homo sapiens
gctcagctgtggct

SEQ ID NO: 1484555 - DNA, 17 bp, Homo sapiens
gctcaggacagatgcca

SEQ ID NO: 1484556 - DNA, 17 bp, Homo sapiens
gctcaggacccaggccc

SEQ ID NO: 1484557 - DNA, 21 bp, Homo sapiens
gctcaggacccaggccctcca

SEQ ID NO: 1484558 - DNA, 15 bp, Homo sapiens
gctcaggaggcttgg

SEQ ID NO: 1484559 - DNA, 22 bp, Homo sapiens
gctcaggagggtgacgcccagc

SEQ ID NO: 1484560 - DNA, 23 bp, Homo sapiens
gctcaggagggtgacgcccagct

SEQ ID NO: 1484561 - DNA, 18 bp, Homo sapiens
gctcaggcaagcccctca

SEQ ID NO: 1484562 - DNA, 19 bp, Homo sapiens
gctcaggcaagcccctcag

SEQ ID NO: 1484563 - DNA, 21 bp, Homo sapiens
gctcaggcaagcccctcagcc

SEQ ID NO: 1484564 - DNA, 11 bp, Homo sapiens
gctcaggcaga

SEQ ID NO: 1484565 - DNA, 20 bp, Homo sapiens
gctcaggcctataaccccag

SEQ ID NO: 1484566 - DNA, 19 bp, Homo sapiens
gctcaggcgatccacctgt

SEQ ID NO: 1484567 - DNA, 12 bp, Homo sapiens
gctcagggctgg

SEQ ID NO: 1484568 - DNA, 16 bp, Homo sapiens
gctcagggttggccat

SEQ ID NO: 1484569 - DNA, 12 bp, Homo sapiens
gctcaggtgcct

SEQ ID NO: 1484570 - DNA, 19 bp, Homo sapiens
gctcaggtgccttacatct

SEQ ID NO: 1484571 - DNA, 12 bp, Homo sapiens
gctcagtaaacg

SEQ ID NO: 1484572 - DNA, 13 bp, Homo sapiens
gctccctgtctgt

SEQ ID NO: 1484573 - DNA, 15 bp, Homo sapiens
gctccctgtctgtgt

SEQ ID NO: 1484574 - DNA, 22 bp, Homo sapiens
gctccctgtctgtgtcccagcc

SEQ ID NO: 1484575 - DNA, 16 bp, Homo sapiens
gctccctgtggcactc

SEQ ID NO: 1484576 - DNA, 23 bp, Homo sapiens
gctcccttcaagacgaggggcag

SEQ ID NO: 1484577 - DNA, 21 bp, Homo sapiens
gctcccttcatctccagggag

SEQ ID NO: 1484578 - DNA, 16 bp, Homo sapiens
gctcccttccctccat

SEQ ID NO: 1484579 - DNA, 17 bp, Homo sapiens
gctccgagctgtaggag

SEQ ID NO: 1484580 - DNA, 23 bp, Homo sapiens
gctccgcccgctcctgccgcaga

SEQ ID NO: 1484581 - DNA, 14 bp, Homo sapiens
gctccgctgcctgg

SEQ ID NO: 1484582 - DNA, 16 bp, Homo sapiens
gctccgctgcctggaa

SEQ ID NO: 1484583 - DNA, 16 bp, Homo sapiens
gctccggtttgggctg

SEQ ID NO: 1484584 - DNA, 22 bp, Homo sapiens
gctccgtgagtgaaccatcatt

SEQ ID NO: 1484585 - DNA, 21 bp, Homo sapiens
gctccgtggactgcagtcggc

SEQ ID NO: 1484586 - DNA, 17 bp, Homo sapiens
gctcctacctgtctgct

SEQ ID NO: 1484587 - DNA, 18 bp, Homo sapiens
gctcctacctgtctgctg

SEQ ID NO: 1484588 - DNA, 14 bp, Homo sapiens
gctcctcacccctg

SEQ ID NO: 1484589 - DNA, 19 bp, Homo sapiens
gctcctcatggtgggttca

SEQ ID NO: 1484590 - DNA, 11 bp, Homo sapiens
gctcctcccac

SEQ ID NO: 1484591 - DNA, 23 bp, Homo sapiens
gctcctccccttcctcttgtctg

SEQ ID NO: 1484592 - DNA, 16 bp, Homo sapiens
gctcctcccggtgccc

SEQ ID NO: 1484593 - DNA, 13 bp, Homo sapiens
gctcctccctgcc

SEQ ID NO: 1484594 - DNA, 14 bp, Homo sapiens
gctcctccctgccc

SEQ ID NO: 1484595 - DNA, 16 bp, Homo sapiens
gctcctccctgccccc

SEQ ID NO: 1484596 - DNA, 17 bp, Homo sapiens
gctcctccctgcccccc

SEQ ID NO: 1484597 - DNA, 18 bp, Homo sapiens
gctcctccctgcccccca

SEQ ID NO: 1484598 - DNA, 18 bp, Homo sapiens
gctcctccctggctgccc

SEQ ID NO: 1484599 - DNA, 20 bp, Homo sapiens
gctcctccctggctgccctg

SEQ ID NO: 1484600 - DNA, 21 bp, Homo sapiens
gctcctccctggctgccctgg

SEQ ID NO: 1484601 - DNA, 22 bp, Homo sapiens
gctcctccctggctgccctggc

SEQ ID NO: 1484602 - DNA, 16 bp, Homo sapiens
gctcctccgcagaagg

SEQ ID NO: 1484603 - DNA, 17 bp, Homo sapiens
gctcctcctcctgggct

SEQ ID NO: 1484604 - DNA, 18 bp, Homo sapiens
gctcctcctcctgggcta

SEQ ID NO: 1484605 - DNA, 19 bp, Homo sapiens
gctcctcctcctgggctat

SEQ ID NO: 1484606 - DNA, 19 bp, Homo sapiens
gctcctccttgcccagact

SEQ ID NO: 1484607 - DNA, 15 bp, Homo sapiens
gctcctctccccagc

SEQ ID NO: 1484608 - DNA, 16 bp, Homo sapiens
gctcctctccccagcc

SEQ ID NO: 1484609 - DNA, 18 bp, Homo sapiens
gctcctctccccagccca

SEQ ID NO: 1484610 - DNA, 19 bp, Homo sapiens
gctcctctccccagcccag

SEQ ID NO: 1484611 - DNA, 20 bp, Homo sapiens
gctcctctccccagcccaga

SEQ ID NO: 1484612 - DNA, 17 bp, Homo sapiens
gctcctctccttgggct

SEQ ID NO: 1484613 - DNA, 18 bp, Homo sapiens
gctcctctccttgggctc

SEQ ID NO: 1484614 - DNA, 19 bp, Homo sapiens
gctcctctccttgggctcc

SEQ ID NO: 1484615 - DNA, 18 bp, Homo sapiens
gctcctcttaccgtagcc

SEQ ID NO: 1484616 - DNA, 22 bp, Homo sapiens
gctcctcttaccgtagcctccg

SEQ ID NO: 1484617 - DNA, 21 bp, Homo sapiens
gctcctgaggggcatctgccc

SEQ ID NO: 1484618 - DNA, 12 bp, Homo sapiens
gctcctgcccac

SEQ ID NO: 1484619 - DNA, 15 bp, Homo sapiens
gctcctgcccaggag

SEQ ID NO: 1484620 - DNA, 18 bp, Homo sapiens
gctcctgcccaggagcag

SEQ ID NO: 1484621 - DNA, 21 bp, Homo sapiens
gctcctgcccaggagcagctt

SEQ ID NO: 1484622 - DNA, 19 bp, Homo sapiens
gctcctgccgcagacgggc

SEQ ID NO: 1484623 - DNA, 17 bp, Homo sapiens
gctcctgccgcagagct

SEQ ID NO: 1484624 - DNA, 18 bp, Homo sapiens
gctcctgccgcagagctg

SEQ ID NO: 1484625 - DNA, 21 bp, Homo sapiens
gctcctgcttttctgtcctgg

SEQ ID NO: 1484626 - DNA, 22 bp, Homo sapiens
gctcctgcttttctgtcctggg

SEQ ID NO: 1484627 - DNA, 18 bp, Homo sapiens
gctcctggaaaggctcag

SEQ ID NO: 1484628 - DNA, 18 bp, Homo sapiens
gctcctggctgccaggcg

SEQ ID NO: 1484629 - DNA, 18 bp, Homo sapiens
gctcctggctgtgcccag

SEQ ID NO: 1484630 - DNA, 19 bp, Homo sapiens
gctcctgggccggctgagt

SEQ ID NO: 1484631 - DNA, 19 bp, Homo sapiens
gctcctggtcttgagatgt

SEQ ID NO: 1484632 - DNA, 14 bp, Homo sapiens
gctcctgtctgcca

SEQ ID NO: 1484633 - DNA, 20 bp, Homo sapiens
gctcctgtctgccagccagc

SEQ ID NO: 1484634 - DNA, 21 bp, Homo sapiens
gctcctgtctgccagccagca

SEQ ID NO: 1484635 - DNA, 13 bp, Homo sapiens
gctcctgtggccc

SEQ ID NO: 1484636 - DNA, 21 bp, Homo sapiens
gctcctgtggccccaccctgg

SEQ ID NO: 1484637 - DNA, 18 bp, Homo sapiens
gctccttcactgttccct

SEQ ID NO: 1484638 - DNA, 13 bp, Homo sapiens
gctccttcccatc

SEQ ID NO: 1484639 - DNA, 12 bp, Homo sapiens
gctccttcccct

SEQ ID NO: 1484640 - DNA, 16 bp, Homo sapiens
gctccttcccctgcac

SEQ ID NO: 1484641 - DNA, 19 bp, Homo sapiens
gctccttcccctgcacctg

SEQ ID NO: 1484642 - DNA, 13 bp, Homo sapiens
gctccttcctgtc

SEQ ID NO: 1484643 - DNA, 20 bp, Homo sapiens
gctccttggggcagggcctg

SEQ ID NO: 1484644 - DNA, 16 bp, Homo sapiens
gctcctttctccagcc

SEQ ID NO: 1484645 - DNA, 18 bp, Homo sapiens
gctcctttctccagccag

SEQ ID NO: 1484646 - DNA, 19 bp, Homo sapiens
gctcctttctccagccagc

SEQ ID NO: 1484647 - DNA, 13 bp, Homo sapiens
gctcctttgtgtg

SEQ ID NO: 1484648 - DNA, 19 bp, Homo sapiens
gctcctttgtgtgtgtgtc

SEQ ID NO: 1484649 - DNA, 15 bp, Homo sapiens
gctccttttctcttt

SEQ ID NO: 1484650 - DNA, 16 bp, Homo sapiens
gctccttttgctcttt

SEQ ID NO: 1484651 - DNA, 17 bp, Homo sapiens
gctccttttgtccccag

SEQ ID NO: 1484652 - DNA, 21 bp, Homo sapiens
gctccttttgtccccagggcc

SEQ ID NO: 1484653 - DNA, 16 bp, Homo sapiens
gctcgaatctctgtgc

SEQ ID NO: 1484654 - DNA, 17 bp, Homo sapiens
gctcgagcagtcctgcc

SEQ ID NO: 1484655 - DNA, 21 bp, Homo sapiens
gctcgagcagtcctgcctcag

SEQ ID NO: 1484656 - DNA, 18 bp, Homo sapiens
gctcgcccctgttttttg

SEQ ID NO: 1484657 - DNA, 19 bp, Homo sapiens
gctcgcgggcagcgggcca

SEQ ID NO: 1484658 - DNA, 21 bp, Homo sapiens
gctcgcgggcagcgggccagg

SEQ ID NO: 1484659 - DNA, 23 bp, Homo sapiens
gctcgcgggcagcgggccaggcc

SEQ ID NO: 1484660 - DNA, 15 bp, Homo sapiens
gctcgcggggcagca

SEQ ID NO: 1484661 - DNA, 14 bp, Homo sapiens
gctcgctggctttc

SEQ ID NO: 1484662 - DNA, 17 bp, Homo sapiens
gctcggacccaccccaa

SEQ ID NO: 1484663 - DNA, 18 bp, Homo sapiens
gctcggggtaaaaagtgg

SEQ ID NO: 1484664 - DNA, 22 bp, Homo sapiens
gctcggggtaaaaagtggctgc

SEQ ID NO: 1484665 - DNA, 14 bp, Homo sapiens
gctcggtggaccca

SEQ ID NO: 1484666 - DNA, 16 bp, Homo sapiens
gctcgtggactgtgct

SEQ ID NO: 1484667 - DNA, 23 bp, Homo sapiens
gctcgtgtatcctggggctccct

SEQ ID NO: 1484668 - DNA, 14 bp, Homo sapiens
gctctaaaaggtaa

SEQ ID NO: 1484669 - DNA, 15 bp, Homo sapiens
gctctaaaatattta

SEQ ID NO: 1484670 - DNA, 23 bp, Homo sapiens
gctctaaaatatttatgaagaaa

SEQ ID NO: 1484671 - DNA, 14 bp, Homo sapiens
gctctaaattggct

SEQ ID NO: 1484672 - DNA, 19 bp, Homo sapiens
gctctaattcacagtgctc

SEQ ID NO: 1484673 - DNA, 20 bp, Homo sapiens
gctctacatcttctgcctta

SEQ ID NO: 1484674 - DNA, 14 bp, Homo sapiens
gctctacatttgca

SEQ ID NO: 1484675 - DNA, 15 bp, Homo sapiens
gctctaccctgtctg

SEQ ID NO: 1484676 - DNA, 22 bp, Homo sapiens
gctctaccctgtctgtcccttt

SEQ ID NO: 1484677 - DNA, 16 bp, Homo sapiens
gctctactgccctccc

SEQ ID NO: 1484678 - DNA, 17 bp, Homo sapiens
gctctactgccctcccc

SEQ ID NO: 1484679 - DNA, 13 bp, Homo sapiens
gctctagaatctg

SEQ ID NO: 1484680 - DNA, 18 bp, Homo sapiens
gctctagattcataaata

SEQ ID NO: 1484681 - DNA, 21 bp, Homo sapiens
gctctagattcataaatacaa

SEQ ID NO: 1484682 - DNA, 16 bp, Homo sapiens
gctctagccaggagtc

SEQ ID NO: 1484683 - DNA, 22 bp, Homo sapiens
gctctagccaggagtctgtgct

SEQ ID NO: 1484684 - DNA, 14 bp, Homo sapiens
gctctagcctgggc

SEQ ID NO: 1484685 - DNA, 21 bp, Homo sapiens
gctctagcctgggcaacaaca

SEQ ID NO: 1484686 - DNA, 17 bp, Homo sapiens
gctgactcacacctgaa

SEQ ID NO: 1484687 - DNA, 12 bp, Homo sapiens
gctgactgaggc

SEQ ID NO: 1484688 - DNA, 20 bp, Homo sapiens
gctgactgaggcctgcttcc

SEQ ID NO: 1484689 - DNA, 18 bp, Homo sapiens
gctgactgtactcctccc

SEQ ID NO: 1484690 - DNA, 20 bp, Homo sapiens
gctgactgtggccccctccg

SEQ ID NO: 1484691 - DNA, 14 bp, Homo sapiens
gctgagaagaatga

SEQ ID NO: 1484692 - DNA, 14 bp, Homo sapiens
gctgagaaggcagt

SEQ ID NO: 1484693 - DNA, 19 bp, Homo sapiens
gctgagaaggccagccctc

SEQ ID NO: 1484694 - DNA, 14 bp, Homo sapiens
gctgagagacccaa

SEQ ID NO: 1484695 - DNA, 15 bp, Homo sapiens
gctgagagacccaag

SEQ ID NO: 1484696 - DNA, 14 bp, Homo sapiens
gctgagagccccag

SEQ ID NO: 1484697 - DNA, 13 bp, Homo sapiens
gctgagagccctg

SEQ ID NO: 1484698 - DNA, 16 bp, Homo sapiens
gctgagatcgaagagg

SEQ ID NO: 1484699 - DNA, 18 bp, Homo sapiens
gctgagatcgaagaggcc

SEQ ID NO: 1484700 - DNA, 22 bp, Homo sapiens
gctgagatgagccccacgtgga

SEQ ID NO: 1484701 - DNA, 13 bp, Homo sapiens
gctgagcagcttt

SEQ ID NO: 1484702 - DNA, 13 bp, Homo sapiens
gctgagccactcg

SEQ ID NO: 1484703 - DNA, 14 bp, Homo sapiens
gctgagcccctacc

SEQ ID NO: 1484704 - DNA, 20 bp, Homo sapiens
gctgagcccctaccccacac

SEQ ID NO: 1484705 - DNA, 16 bp, Homo sapiens
gctgagcccctgggga

SEQ ID NO: 1484706 - DNA, 13 bp, Homo sapiens
gctgagcctctgc

SEQ ID NO: 1484707 - DNA, 20 bp, Homo sapiens
gctgagcctctgctccccag

SEQ ID NO: 1484708 - DNA, 14 bp, Homo sapiens
gctgagctctctgt

SEQ ID NO: 1484709 - DNA, 22 bp, Homo sapiens
gctgagctggaaggggccacgt

SEQ ID NO: 1484710 - DNA, 13 bp, Homo sapiens
gctgagctgggga

SEQ ID NO: 1484711 - DNA, 22 bp, Homo sapiens
gctgagcttagccttgtgccct

SEQ ID NO: 1484712 - DNA, 14 bp, Homo sapiens
gctgagcttgagct

SEQ ID NO: 1484713 - DNA, 21 bp, Homo sapiens
gctgaggatacagctcttctc

SEQ ID NO: 1484714 - DNA, 20 bp, Homo sapiens
gctgaggatttcaagcctgc

SEQ ID NO: 1484715 - DNA, 19 bp, Homo sapiens
gctgaggcaccgtccaggc

SEQ ID NO: 1484716 - DNA, 20 bp, Homo sapiens
gctgaggccacccactgacc

SEQ ID NO: 1484717 - DNA, 12 bp, Homo sapiens
gctgaggccagg

SEQ ID NO: 1484718 - DNA, 15 bp, Homo sapiens
gctgaggccagggct

SEQ ID NO: 1484719 - DNA, 13 bp, Homo sapiens
gctgaggcccagt

SEQ ID NO: 1484720 - DNA, 12 bp, Homo sapiens
gctgaggcctgg

SEQ ID NO: 1484721 - DNA, 13 bp, Homo sapiens
gctgaggcctgga

SEQ ID NO: 1484722 - DNA, 21 bp, Homo sapiens
gctgaggcctggactttcctg

SEQ ID NO: 1484723 - DNA, 15 bp, Homo sapiens
gctgaggcctgggcc

SEQ ID NO: 1484724 - DNA, 17 bp, Homo sapiens
gctgaggcctgggccgc

SEQ ID NO: 1484725 - DNA, 23 bp, Homo sapiens
gctgaggctgggggagagccgtg

SEQ ID NO: 1484726 - DNA, 15 bp, Homo sapiens
gctgagggaccgagc

SEQ ID NO: 1484727 - DNA, 21 bp, Homo sapiens
gctgagggaccgagcccagca

SEQ ID NO: 1484728 - DNA, 14 bp, Homo sapiens
gctgagggccctgt

SEQ ID NO: 1484729 - DNA, 17 bp, Homo sapiens
gctgaggggtctcggat

SEQ ID NO: 1484730 - DNA, 21 bp, Homo sapiens
gctgagggtgcccttttccag

SEQ ID NO: 1484731 - DNA, 14 bp, Homo sapiens
gctgagggtttgaa

SEQ ID NO: 1484732 - DNA, 19 bp, Homo sapiens
gctgaggtgagaggatcag

SEQ ID NO: 1484733 - DNA, 19 bp, Homo sapiens
gctgaggtgggaggatcac

SEQ ID NO: 1484734 - DNA, 20 bp, Homo sapiens
gctgaggttcctctgcctgc

SEQ ID NO: 1484735 - DNA, 22 bp, Homo sapiens
gctgaggttcctctgcctgccc

SEQ ID NO: 1484736 - DNA, 18 bp, Homo sapiens
gctgagtagctctgcctt

SEQ ID NO: 1484737 - DNA, 16 bp, Homo sapiens
gctgagtcacctcctc

SEQ ID NO: 1484738 - DNA, 23 bp, Homo sapiens
gctgagtcatctgttagggcctt

SEQ ID NO: 1484739 - DNA, 22 bp, Homo sapiens
gctgagtgaaaaatctgtggaa

SEQ ID NO: 1484740 - DNA, 17 bp, Homo sapiens
gctgagtgacagctttc

SEQ ID NO: 1484741 - DNA, 18 bp, Homo sapiens
gctgagtggaatgcaggg

SEQ ID NO: 1484742 - DNA, 20 bp, Homo sapiens
gctgagtggaatgcagggaa

SEQ ID NO: 1484743 - DNA, 13 bp, Homo sapiens
gctgagtggcagc

SEQ ID NO: 1484744 - DNA, 18 bp, Homo sapiens
gctgagtggcagcagccc

SEQ ID NO: 1484745 - DNA, 17 bp, Homo sapiens
gctgagtggcaggggac

SEQ ID NO: 1484746 - DNA, 21 bp, Homo sapiens
gctgagtggcaggggacagga

SEQ ID NO: 1484747 - DNA, 16 bp, Homo sapiens
gctgagtggggagcag

SEQ ID NO: 1484748 - DNA, 23 bp, Homo sapiens
gctgagttacttgtctgaggcct

SEQ ID NO: 1484749 - DNA, 15 bp, Homo sapiens
gctgagttctggttc

SEQ ID NO: 1484750 - DNA, 15 bp, Homo sapiens
gctgagttggcctgg

SEQ ID NO: 1484751 - DNA, 15 bp, Homo sapiens
gctgagttgttctaa

SEQ ID NO: 1484752 - DNA, 11 bp, Homo sapiens
gctgagtttcc

SEQ ID NO: 1484753 - DNA, 12 bp, Homo sapiens
gctgagtttcct

SEQ ID NO: 1484754 - DNA, 15 bp, Homo sapiens
gctgagtttcctatg

SEQ ID NO: 1484755 - DNA, 17 bp, Homo sapiens
gctgataagcattgact

SEQ ID NO: 1484756 - DNA, 15 bp, Homo sapiens
gctgatattatttct

SEQ ID NO: 1484757 - DNA, 22 bp, Homo sapiens
gctgatattatttcttctctta

SEQ ID NO: 1484758 - DNA, 20 bp, Homo sapiens
gctgatcagagttcctccta

SEQ ID NO: 1484759 - DNA, 18 bp, Homo sapiens
gctgatcctaagaatttt

SEQ ID NO: 1484760 - DNA, 18 bp, Homo sapiens
gctgatcctgctgacctc

SEQ ID NO: 1484761 - DNA, 21 bp, Homo sapiens
gctgatctcagggaagcccag

SEQ ID NO: 1484762 - DNA, 22 bp, Homo sapiens
gctgatctcagggaagcccagc

SEQ ID NO: 1484763 - DNA, 22 bp, Homo sapiens
gctgatctgcggatctcagctt

SEQ ID NO: 1484764 - DNA, 12 bp, Homo sapiens
gctgatgaaact

SEQ ID NO: 1484765 - DNA, 17 bp, Homo sapiens
gctgatgaaactcctga

SEQ ID NO: 1484766 - DNA, 15 bp, Homo sapiens
gctgatgatccagaa

SEQ ID NO: 1484767 - DNA, 19 bp, Homo sapiens
gctgatgatccagaacagt

SEQ ID NO: 1484768 - DNA, 22 bp, Homo sapiens
gctgatgatgtctcttgtagaa

SEQ ID NO: 1484769 - DNA, 20 bp, Homo sapiens
gctgatgatttgtttttgta

SEQ ID NO: 1484770 - DNA, 11 bp, Homo sapiens
gctgatgcaga

SEQ ID NO: 1484771 - DNA, 15 bp, Homo sapiens
gctgatgcagacaca

SEQ ID NO: 1484772 - DNA, 16 bp, Homo sapiens
gctgatgcctccttgg

SEQ ID NO: 1484773 - DNA, 19 bp, Homo sapiens
gctgatggagccccacctt

SEQ ID NO: 1484774 - DNA, 15 bp, Homo sapiens
gctgatggaggaaaa

SEQ ID NO: 1484775 - DNA, 16 bp, Homo sapiens
gctgatggaggaaaaa

SEQ ID NO: 1484776 - DNA, 13 bp, Homo sapiens
gctgatggcagct

SEQ ID NO: 1484777 - DNA, 14 bp, Homo sapiens
gctgatggcagctg

SEQ ID NO: 1484778 - DNA, 23 bp, Homo sapiens
gctgatggctgctagattttaat

SEQ ID NO: 1484779 - DNA, 17 bp, Homo sapiens
gctgatgtaggagctgg

SEQ ID NO: 1484780 - DNA, 17 bp, Homo sapiens
gctgatgtggactgtct

SEQ ID NO: 1484781 - DNA, 14 bp, Homo sapiens
gctgattactgtca

SEQ ID NO: 1484782 - DNA, 17 bp, Homo sapiens
gctgattatttatgacc

SEQ ID NO: 1484783 - DNA, 18 bp, Homo sapiens
gctgattcagcagtgcct

SEQ ID NO: 1484784 - DNA, 19 bp, Homo sapiens
gctgattcagcagtgccta

SEQ ID NO: 1484785 - DNA, 14 bp, Homo sapiens
gctgattcttgtaa

SEQ ID NO: 1484786 - DNA, 16 bp, Homo sapiens
gctgattcttgtaaat

SEQ ID NO: 1484787 - DNA, 15 bp, Homo sapiens
gctgatttcccctct

SEQ ID NO: 1484788 - DNA, 21 bp, Homo sapiens
gctgcaaacattgtacatcca

SEQ ID NO: 1484789 - DNA, 15 bp, Homo sapiens
gctgcaaaggagaag

SEQ ID NO: 1484790 - DNA, 17 bp, Homo sapiens
gctgcaaataaggacag

SEQ ID NO: 1484791 - DNA, 20 bp, Homo sapiens
gctgcaaggtggcctctgcc

SEQ ID NO: 1484792 - DNA, 24 bp, Homo sapiens
gctgcaaggtggcctctgcctggg

SEQ ID NO: 1484793 - DNA, 18 bp, Homo sapiens
gctgcacaaaagcagata

SEQ ID NO: 1484794 - DNA, 12 bp, Homo sapiens
gctgcacagcat

SEQ ID NO: 1484795 - DNA, 13 bp, Homo sapiens
gctgcacatgtgc

SEQ ID NO: 1484796 - DNA, 13 bp, Homo sapiens
gctgcacattcct

SEQ ID NO: 1484797 - DNA, 22 bp, Homo sapiens
gctgcacattgcctgttctgct

SEQ ID NO: 1484798 - DNA, 12 bp, Homo sapiens
gctgcaccagag

SEQ ID NO: 1484799 - DNA, 16 bp, Homo sapiens
gctgcaccagagtgaa

SEQ ID NO: 1484800 - DNA, 21 bp, Homo sapiens
gctgcaccctgcgcctccaga

SEQ ID NO: 1484801 - DNA, 22 bp, Homo sapiens
gctggagctcttggaagagctc

SEQ ID NO: 1484802 - DNA, 15 bp, Homo sapiens
gctggaggagctggc

SEQ ID NO: 1484803 - DNA, 17 bp, Homo sapiens
gctggaggagctggcct

SEQ ID NO: 1484804 - DNA, 20 bp, Homo sapiens
gctggaggagctggcctgtg

SEQ ID NO: 1484805 - DNA, 22 bp, Homo sapiens
gctggaggagctggcctgtggc

SEQ ID NO: 1484806 - DNA, 21 bp, Homo sapiens
gctggaggcagggccttgccc

SEQ ID NO: 1484807 - DNA, 14 bp, Homo sapiens
gctggaggcccagg

SEQ ID NO: 1484808 - DNA, 19 bp, Homo sapiens
gctggaggcctcaggtgct

SEQ ID NO: 1484809 - DNA, 12 bp, Homo sapiens
gctggagggagg

SEQ ID NO: 1484810 - DNA, 13 bp, Homo sapiens
gctggagggaggc

SEQ ID NO: 1484811 - DNA, 13 bp, Homo sapiens
gctggaggggtgg

SEQ ID NO: 1484812 - DNA, 16 bp, Homo sapiens
gctggaggggtgggga

SEQ ID NO: 1484813 - DNA, 19 bp, Homo sapiens
gctggaggggtggggagct

SEQ ID NO: 1484814 - DNA, 15 bp, Homo sapiens
gctggagtaatcaga

SEQ ID NO: 1484815 - DNA, 15 bp, Homo sapiens
gctggagtctcagag

SEQ ID NO: 1484816 - DNA, 18 bp, Homo sapiens
gctggagtctcagagcac

SEQ ID NO: 1484817 - DNA, 22 bp, Homo sapiens
gctggagtctcagagcacagag

SEQ ID NO: 1484818 - DNA, 12 bp, Homo sapiens
gctggagtgcag

SEQ ID NO: 1484819 - DNA, 20 bp, Homo sapiens
gctggagtgcagtggcgcga

SEQ ID NO: 1484820 - DNA, 20 bp, Homo sapiens
gctggagtgcagtggtgtga

SEQ ID NO: 1484821 - DNA, 20 bp, Homo sapiens
gctggatgagacttccaaac

SEQ ID NO: 1484822 - DNA, 21 bp, Homo sapiens
gctggatttgggagctctgct

SEQ ID NO: 1484823 - DNA, 16 bp, Homo sapiens
gctggcaaccagccag

SEQ ID NO: 1484824 - DNA, 18 bp, Homo sapiens
gctggcaaccagccagcg

SEQ ID NO: 1484825 - DNA, 20 bp, Homo sapiens
gctggcacccaccgtggagg

SEQ ID NO: 1484826 - DNA, 23 bp, Homo sapiens
gctggcacccaccgtggaggagg

SEQ ID NO: 1484827 - DNA, 19 bp, Homo sapiens
gctggcacttttttaaata

SEQ ID NO: 1484828 - DNA, 19 bp, Homo sapiens
gctggcagctgagagccct

SEQ ID NO: 1484829 - DNA, 20 bp, Homo sapiens
gctggcagctgagagccctg

SEQ ID NO: 1484830 - DNA, 20 bp, Homo sapiens
gctggcaggcagttctagaa

SEQ ID NO: 1484831 - DNA, 14 bp, Homo sapiens
gctggcatgcagtg

SEQ ID NO: 1484832 - DNA, 15 bp, Homo sapiens
gctggcatgttttct

SEQ ID NO: 1484833 - DNA, 20 bp, Homo sapiens
gctggccaaagagcctttcc

SEQ ID NO: 1484834 - DNA, 19 bp, Homo sapiens
gctggccaaatagcaaaga

SEQ ID NO: 1484835 - DNA, 24 bp, Homo sapiens
gctggccaaggtgtccagggtcct

SEQ ID NO: 1484836 - DNA, 15 bp, Homo sapiens
gctggccagtccagg

SEQ ID NO: 1484837 - DNA, 16 bp, Homo sapiens
gctggcccagccggcc

SEQ ID NO: 1484838 - DNA, 13 bp, Homo sapiens
gctggcccagggg

SEQ ID NO: 1484839 - DNA, 16 bp, Homo sapiens
gctggccccagccctg

SEQ ID NO: 1484840 - DNA, 17 bp, Homo sapiens
gctggccccagccctgc

SEQ ID NO: 1484841 - DNA, 22 bp, Homo sapiens
gctggccccagccctgctgggg

SEQ ID NO: 1484842 - DNA, 20 bp, Homo sapiens
gctggccgagggtcctggct

SEQ ID NO: 1484843 - DNA, 12 bp, Homo sapiens
gctggcctgagc

SEQ ID NO: 1484844 - DNA, 12 bp, Homo sapiens
gctggcctggat

SEQ ID NO: 1484845 - DNA, 14 bp, Homo sapiens
gctggcctgtggca

SEQ ID NO: 1484846 - DNA, 22 bp, Homo sapiens
gctggcctgtggcacagccctg

SEQ ID NO: 1484847 - DNA, 16 bp, Homo sapiens
gctggcgcagccaagg

SEQ ID NO: 1484848 - DNA, 14 bp, Homo sapiens
gctggcgcccatcc

SEQ ID NO: 1484849 - DNA, 12 bp, Homo sapiens
gctggctctgag

SEQ ID NO: 1484850 - DNA, 18 bp, Homo sapiens
gctggctctgagaatcac

SEQ ID NO: 1484851 - DNA, 14 bp, Homo sapiens
gctggctgcaattg

SEQ ID NO: 1484852 - DNA, 17 bp, Homo sapiens
gctggctgcggccccct

SEQ ID NO: 1484853 - DNA, 20 bp, Homo sapiens
gctggctggagtctcagagc

SEQ ID NO: 1484854 - DNA, 14 bp, Homo sapiens
gctggctggagtga

SEQ ID NO: 1484855 - DNA, 12 bp, Homo sapiens
gctggctggcct

SEQ ID NO: 1484856 - DNA, 12 bp, Homo sapiens
gctggctttctc

SEQ ID NO: 1484857 - DNA, 22 bp, Homo sapiens
gctgggaaccccgcagcccgtg

SEQ ID NO: 1484858 - DNA, 23 bp, Homo sapiens
gctgggaagctgtactcagagca

SEQ ID NO: 1484859 - DNA, 16 bp, Homo sapiens
gctgggaatggggaca

SEQ ID NO: 1484860 - DNA, 15 bp, Homo sapiens
gctgggaccagagcc

SEQ ID NO: 1484861 - DNA, 20 bp, Homo sapiens
gctgggaccagagccagatg

SEQ ID NO: 1484862 - DNA, 15 bp, Homo sapiens
gctgggacccacctc

SEQ ID NO: 1484863 - DNA, 19 bp, Homo sapiens
gctgggacccacctccccc

SEQ ID NO: 1484864 - DNA, 12 bp, Homo sapiens
gctgggacccct

SEQ ID NO: 1484865 - DNA, 19 bp, Homo sapiens
gctgggacgatcgcccagg

SEQ ID NO: 1484866 - DNA, 14 bp, Homo sapiens
gctgggactcagcc

SEQ ID NO: 1484867 - DNA, 22 bp, Homo sapiens
gctgggactcagccttcagaca

SEQ ID NO: 1484868 - DNA, 23 bp, Homo sapiens
gctgggactcagccttcagacag

SEQ ID NO: 1484869 - DNA, 17 bp, Homo sapiens
gctgggactgagccagt

SEQ ID NO: 1484870 - DNA, 14 bp, Homo sapiens
gctgggagaagaaa

SEQ ID NO: 1484871 - DNA, 18 bp, Homo sapiens
gctgggagctccactctg

SEQ ID NO: 1484872 - DNA, 13 bp, Homo sapiens
gctgggagctgaa

SEQ ID NO: 1484873 - DNA, 15 bp, Homo sapiens
gctgggaggaaggac

SEQ ID NO: 1484874 - DNA, 22 bp, Homo sapiens
gctgggattactggcatgagcc

SEQ ID NO: 1484875 - DNA, 22 bp, Homo sapiens
gctgggatttcttcgctgctct

SEQ ID NO: 1484876 - DNA, 24 bp, Homo sapiens
gctgggatttcttcgctgctctag

SEQ ID NO: 1484877 - DNA, 19 bp, Homo sapiens
gctgggcagaaggccaaga

SEQ ID NO: 1484878 - DNA, 12 bp, Homo sapiens
gctgggccaggg

SEQ ID NO: 1484879 - DNA, 19 bp, Homo sapiens
gctgggccagtggctgggg

SEQ ID NO: 1484880 - DNA, 13 bp, Homo sapiens
gctgggcccagca

SEQ ID NO: 1484881 - DNA, 15 bp, Homo sapiens
gctgggccccaccta

SEQ ID NO: 1484882 - DNA, 20 bp, Homo sapiens
gctgggcccgacatggctcc

SEQ ID NO: 1484883 - DNA, 13 bp, Homo sapiens
gctgggccctctg

SEQ ID NO: 1484884 - DNA, 15 bp, Homo sapiens
gctgggccctctgtc

SEQ ID NO: 1484885 - DNA, 19 bp, Homo sapiens
gctgggccctctttccctg

SEQ ID NO: 1484886 - DNA, 24 bp, Homo sapiens
gctgggccctctttccctgcgaga

SEQ ID NO: 1484887 - DNA, 14 bp, Homo sapiens
gctgggcctcctgc

SEQ ID NO: 1484888 - DNA, 17 bp, Homo sapiens
gctgggcctcctgcctc

SEQ ID NO: 1484889 - DNA, 13 bp, Homo sapiens
gctgggccttcac

SEQ ID NO: 1484890 - DNA, 15 bp, Homo sapiens
gctgggctctccacc

SEQ ID NO: 1484891 - DNA, 13 bp, Homo sapiens
gctgggctctgca

SEQ ID NO: 1484892 - DNA, 16 bp, Homo sapiens
gctgggctctgcctgt

SEQ ID NO: 1484893 - DNA, 22 bp, Homo sapiens
gctgggctgagcccctacccca

SEQ ID NO: 1484894 - DNA, 15 bp, Homo sapiens
gctgggctggactgg

SEQ ID NO: 1484895 - DNA, 19 bp, Homo sapiens
gctgggctggactggccat

SEQ ID NO: 1484896 - DNA, 18 bp, Homo sapiens
gctgggctgggccctctt

SEQ ID NO: 1484897 - DNA, 12 bp, Homo sapiens
gctggggaaagg

SEQ ID NO: 1484898 - DNA, 16 bp, Homo sapiens
gctggggaagacagtg

SEQ ID NO: 1484899 - DNA, 21 bp, Homo sapiens
gctggggaagacagtggcccc

SEQ ID NO: 1484900 - DNA, 12 bp, Homo sapiens
gctggggaaggg

SEQ ID NO: 1484901 - DNA, 20 bp, Homo sapiens
gctggggaagggttttcttt

SEQ ID NO: 1484902 - DNA, 23 bp, Homo sapiens
gctggggaagggttttcttttct

SEQ ID NO: 1484903 - DNA, 16 bp, Homo sapiens
gctggggacagagggt

SEQ ID NO: 1484904 - DNA, 23 bp, Homo sapiens
gctggggacctggtaccctcctg

SEQ ID NO: 1484905 - DNA, 15 bp, Homo sapiens
gctggggactcaggg

SEQ ID NO: 1484906 - DNA, 17 bp, Homo sapiens
gctggggactcagggac

SEQ ID NO: 1484907 - DNA, 15 bp, Homo sapiens
gctggggagcagctg

SEQ ID NO: 1484908 - DNA, 14 bp, Homo sapiens
gctggggagtccct

SEQ ID NO: 1484909 - DNA, 21 bp, Homo sapiens
gctggggatccccgcctggcc

SEQ ID NO: 1484910 - DNA, 22 bp, Homo sapiens
gctggggatccccgcctggcca

SEQ ID NO: 1484911 - DNA, 13 bp, Homo sapiens
gctggggcagagg

SEQ ID NO: 1484912 - DNA, 20 bp, Homo sapiens
gctggggcagaggggcagcc

SEQ ID NO: 1484913 - DNA, 19 bp, Homo sapiens
gctggggcatggcaggctg

SEQ ID NO: 1484914 - DNA, 18 bp, Homo sapiens
gctggggcatgtgtgcct

SEQ ID NO: 1484915 - DNA, 22 bp, Homo sapiens
gctggggccgccacggcctggc

SEQ ID NO: 1484916 - DNA, 21 bp, Homo sapiens
gcttaatccaatattttgcct

SEQ ID NO: 1484917 - DNA, 16 bp, Homo sapiens
gcttaatgctacatgt

SEQ ID NO: 1484918 - DNA, 14 bp, Homo sapiens
gcttacactgagga

SEQ ID NO: 1484919 - DNA, 11 bp, Homo sapiens
gcttacatttt

SEQ ID NO: 1484920 - DNA, 17 bp, Homo sapiens
gcttacccaagctgtgg

SEQ ID NO: 1484921 - DNA, 18 bp, Homo sapiens
gcttacccaagctgtggc

SEQ ID NO: 1484922 - DNA, 20 bp, Homo sapiens
gcttacctgaacaggaatcc

SEQ ID NO: 1484923 - DNA, 21 bp, Homo sapiens
gcttactagccctgcggagcc

SEQ ID NO: 1484924 - DNA, 19 bp, Homo sapiens
gcttagaacgttaaactat

SEQ ID NO: 1484925 - DNA, 23 bp, Homo sapiens
gcttagaacgttaaactattaga

SEQ ID NO: 1484926 - DNA, 14 bp, Homo sapiens
gcttagacctcagc

SEQ ID NO: 1484927 - DNA, 15 bp, Homo sapiens
gcttagacctcagcc

SEQ ID NO: 1484928 - DNA, 17 bp, Homo sapiens
gcttagacctcagcctg

SEQ ID NO: 1484929 - DNA, 23 bp, Homo sapiens
gcttagacctcagcctgtgctgc

SEQ ID NO: 1484930 - DNA, 13 bp, Homo sapiens
gcttagccttgtg

SEQ ID NO: 1484931 - DNA, 19 bp, Homo sapiens
gcttagccttgtgccctgc

SEQ ID NO: 1484932 - DNA, 24 bp, Homo sapiens
gcttaggtcctcacttctgtctcc

SEQ ID NO: 1484933 - DNA, 15 bp, Homo sapiens
gcttagtcactgcct

SEQ ID NO: 1484934 - DNA, 16 bp, Homo sapiens
gcttagtgctatgtgt

SEQ ID NO: 1484935 - DNA, 17 bp, Homo sapiens
gcttagtgctatgtgtg

SEQ ID NO: 1484936 - DNA, 22 bp, Homo sapiens
gcttataacctagttaaagaaa

SEQ ID NO: 1484937 - DNA, 17 bp, Homo sapiens
gcttatatctggcctct

SEQ ID NO: 1484938 - DNA, 20 bp, Homo sapiens
gcttatatctggcctctgct

SEQ ID NO: 1484939 - DNA, 21 bp, Homo sapiens
gcttatgaatatttataacag

SEQ ID NO: 1484940 - DNA, 18 bp, Homo sapiens
gcttatgacatcacttgt

SEQ ID NO: 1484941 - DNA, 23 bp, Homo sapiens
gcttattagaagccaagtaaagt

SEQ ID NO: 1484942 - DNA, 18 bp, Homo sapiens
gcttattctcaaagcagg

SEQ ID NO: 1484943 - DNA, 22 bp, Homo sapiens
gcttattgtgtgcgctgcctgg

SEQ ID NO: 1484944 - DNA, 12 bp, Homo sapiens
gcttatttctaa

SEQ ID NO: 1484945 - DNA, 13 bp, Homo sapiens
gcttatttctaac

SEQ ID NO: 1484946 - DNA, 23 bp, Homo sapiens
gcttatttctatgacaaattcaa

SEQ ID NO: 1484947 - DNA, 14 bp, Homo sapiens
gcttattttgtaag

SEQ ID NO: 1484948 - DNA, 22 bp, Homo sapiens
gcttatttttttaagaaaaaag

SEQ ID NO: 1484949 - DNA, 16 bp, Homo sapiens
gcttcaaaatagagaa

SEQ ID NO: 1484950 - DNA, 13 bp, Homo sapiens
gcttcaatataag

SEQ ID NO: 1484951 - DNA, 17 bp, Homo sapiens
gcttcacagtagagcca

SEQ ID NO: 1484952 - DNA, 21 bp, Homo sapiens
gcttcacagtagagccagctt

SEQ ID NO: 1484953 - DNA, 22 bp, Homo sapiens
gcttcacagtagagccagcttg

SEQ ID NO: 1484954 - DNA, 17 bp, Homo sapiens
gcttcaccagtctgtct

SEQ ID NO: 1484955 - DNA, 18 bp, Homo sapiens
gcttcaccagtctgtcta

SEQ ID NO: 1484956 - DNA, 20 bp, Homo sapiens
gcttcaccatggccttatga

SEQ ID NO: 1484957 - DNA, 14 bp, Homo sapiens
gcttcacccctgca

SEQ ID NO: 1484958 - DNA, 15 bp, Homo sapiens
gcttcacccctgcac

SEQ ID NO: 1484959 - DNA, 16 bp, Homo sapiens
gcttcacccctgcact

SEQ ID NO: 1484960 - DNA, 17 bp, Homo sapiens
gcttcacccctgcactt

SEQ ID NO: 1484961 - DNA, 21 bp, Homo sapiens
gcttcacccctgcacttcaga

SEQ ID NO: 1484962 - DNA, 15 bp, Homo sapiens
gcttcaccctgtcaa

SEQ ID NO: 1484963 - DNA, 19 bp, Homo sapiens
gcttcactgaccagcggct

SEQ ID NO: 1484964 - DNA, 23 bp, Homo sapiens
gcttcactgaccagcggctgctc

SEQ ID NO: 1484965 - DNA, 12 bp, Homo sapiens
gcttcagagcct

SEQ ID NO: 1484966 - DNA, 14 bp, Homo sapiens
gcttcagagcctag

SEQ ID NO: 1484967 - DNA, 18 bp, Homo sapiens
gcttcagagtttgtgtgt

SEQ ID NO: 1484968 - DNA, 19 bp, Homo sapiens
gcttcagcatatttatagc

SEQ ID NO: 1484969 - DNA, 20 bp, Homo sapiens
gcttcagcctgaggctgaga

SEQ ID NO: 1484970 - DNA, 21 bp, Homo sapiens
gcttcagcctgaggctgagac

SEQ ID NO: 1484971 - DNA, 24 bp, Homo sapiens
gcttcagctcaactcacagcttct

SEQ ID NO: 1484972 - DNA, 18 bp, Homo sapiens
gcttcataaatgaagcag

SEQ ID NO: 1484973 - DNA, 19 bp, Homo sapiens
gcttcatcattccctctca

SEQ ID NO: 1484974 - DNA, 16 bp, Homo sapiens
gcttcatgcctttgta

SEQ ID NO: 1484975 - DNA, 22 bp, Homo sapiens
gcttcattcaatattgacattt

SEQ ID NO: 1484976 - DNA, 19 bp, Homo sapiens
gcttcattccggactggca

SEQ ID NO: 1484977 - DNA, 18 bp, Homo sapiens
gcttcattctggaaactt

SEQ ID NO: 1484978 - DNA, 23 bp, Homo sapiens
gcttcattctggaaacttttgtt

SEQ ID NO: 1484979 - DNA, 15 bp, Homo sapiens
gcttccaaagcctag

SEQ ID NO: 1484980 - DNA, 21 bp, Homo sapiens
gcttccaaatgtgtcagaata

SEQ ID NO: 1484981 - DNA, 14 bp, Homo sapiens
gcttccacaaaatt

SEQ ID NO: 1484982 - DNA, 11 bp, Homo sapiens
gcttccaggct

SEQ ID NO: 1484983 - DNA, 12 bp, Homo sapiens
gcttccaggctc

SEQ ID NO: 1484984 - DNA, 18 bp, Homo sapiens
gcttccaggctcttcctg

SEQ ID NO: 1484985 - DNA, 15 bp, Homo sapiens
gcttcccacacctgc

SEQ ID NO: 1484986 - DNA, 18 bp, Homo sapiens
gcttcccacacctgcctg

SEQ ID NO: 1484987 - DNA, 20 bp, Homo sapiens
gcttcccacacctgcctgcg

SEQ ID NO: 1484988 - DNA, 16 bp, Homo sapiens
gcttcccagaggagca

SEQ ID NO: 1484989 - DNA, 14 bp, Homo sapiens
gcttcccagctctg

SEQ ID NO: 1484990 - DNA, 12 bp, Homo sapiens
gcttccccacag

SEQ ID NO: 1484991 - DNA, 14 bp, Homo sapiens
gcttcccccacccc

SEQ ID NO: 1484992 - DNA, 21 bp, Homo sapiens
gcttcccccacccctccacgt

SEQ ID NO: 1484993 - DNA, 20 bp, Homo sapiens
gcttccccctccccctcctg

SEQ ID NO: 1484994 - DNA, 22 bp, Homo sapiens
gcttccccctccccctcctgct

SEQ ID NO: 1484995 - DNA, 13 bp, Homo sapiens
gcttcccgctgca

SEQ ID NO: 1484996 - DNA, 14 bp, Homo sapiens
gcttccctaatcta

SEQ ID NO: 1484997 - DNA, 15 bp, Homo sapiens
gcttccctgttgaat

SEQ ID NO: 1484998 - DNA, 15 bp, Homo sapiens
gcttcccttactttg

SEQ ID NO: 1484999 - DNA, 14 bp, Homo sapiens
gcttccgagacacc

SEQ ID NO: 1485000 - DNA, 23 bp, Homo sapiens
gcttccgagatccccagggcagc

SEQ ID NO: 1485001 - DNA, 12 bp, Homo sapiens
gcttccgccact

SEQ ID NO: 1485002 - DNA, 16 bp, Homo sapiens
gcttcctcacacccct

SEQ ID NO: 1485003 - DNA, 17 bp, Homo sapiens
gcttcctcacacccctg

SEQ ID NO: 1485004 - DNA, 15 bp, Homo sapiens
gcttcctcagcctcc

SEQ ID NO: 1485005 - DNA, 17 bp, Homo sapiens
gcttcctcagcctccaa

SEQ ID NO: 1485006 - DNA, 22 bp, Homo sapiens
gcttcctcagtaacatttctgt

SEQ ID NO: 1485007 - DNA, 22 bp, Homo sapiens
gcttcctccgtccacccaggct

SEQ ID NO: 1485008 - DNA, 11 bp, Homo sapiens
gcttcctcctg

SEQ ID NO: 1485009 - DNA, 20 bp, Homo sapiens
gcttcctctagaagccaagg

SEQ ID NO: 1485010 - DNA, 20 bp, Homo sapiens
gcttcctgcgtcctcctcac

SEQ ID NO: 1485011 - DNA, 13 bp, Homo sapiens
gcttcctgcttgc

SEQ ID NO: 1485012 - DNA, 14 bp, Homo sapiens
gcttcctgcttgcc

SEQ ID NO: 1485013 - DNA, 13 bp, Homo sapiens
gcttcctggcctc

SEQ ID NO: 1485014 - DNA, 14 bp, Homo sapiens
gcttcctggcctcc

SEQ ID NO: 1485015 - DNA, 18 bp, Homo sapiens
gcttcctgggtcctgcct

SEQ ID NO: 1485016 - DNA, 18 bp, Homo sapiens
gcttcctggtgagaactg

SEQ ID NO: 1485017 - DNA, 13 bp, Homo sapiens
gcttcctgtccac

SEQ ID NO: 1485018 - DNA, 19 bp, Homo sapiens
gcttcctgtccactctcgg

SEQ ID NO: 1485019 - DNA, 22 bp, Homo sapiens
gcttccttggcatcacagggca

SEQ ID NO: 1485020 - DNA, 24 bp, Homo sapiens
gcttcctttcccaagccttcgggc

SEQ ID NO: 1485021 - DNA, 14 bp, Homo sapiens
gcttcctttctctc

SEQ ID NO: 1485022 - DNA, 19 bp, Homo sapiens
gcttcctttctctcctggc

SEQ ID NO: 1485023 - DNA, 15 bp, Homo sapiens
gcttcgactactgct

SEQ ID NO: 1485024 - DNA, 19 bp, Homo sapiens
gcttcgaggcccagcgacc

SEQ ID NO: 1485025 - DNA, 14 bp, Homo sapiens
gcttcgtttatttt

SEQ ID NO: 1485026 - DNA, 17 bp, Homo sapiens
gcttcgtttattttcaa

SEQ ID NO: 1485027 - DNA, 15 bp, Homo sapiens
gcttctaaagcaggt

SEQ ID NO: 1485028 - DNA, 22 bp, Homo sapiens
gcttctactttcatcttaaact

SEQ ID NO: 1485029 - DNA, 19 bp, Homo sapiens
gcttctataattttgcctt

SEQ ID NO: 1485030 - DNA, 23 bp, Homo sapiens
ggaaaaataatcaagattttagg

SEQ ID NO: 1485031 - DNA, 15 bp, Homo sapiens
ggaaaaatagtaaac

SEQ ID NO: 1485032 - DNA, 18 bp, Homo sapiens
ggaaaaatagtaaacatt

SEQ ID NO: 1485033 - DNA, 15 bp, Homo sapiens
ggaaaaatggttgat

SEQ ID NO: 1485034 - DNA, 17 bp, Homo sapiens
ggaaaaatggttgatgg

SEQ ID NO: 1485035 - DNA, 21 bp, Homo sapiens
ggaaaaatggttgatggaaaa

SEQ ID NO: 1485036 - DNA, 11 bp, Homo sapiens
ggaaaaattca

SEQ ID NO: 1485037 - DNA, 14 bp, Homo sapiens
ggaaaacatttgct

SEQ ID NO: 1485038 - DNA, 23 bp, Homo sapiens
ggaaaagaagaaactttgcctca

SEQ ID NO: 1485039 - DNA, 17 bp, Homo sapiens
ggaaaagaccagggctt

SEQ ID NO: 1485040 - DNA, 15 bp, Homo sapiens
ggaaaaggcccctgc

SEQ ID NO: 1485041 - DNA, 15 bp, Homo sapiens
ggaaaagtacattta

SEQ ID NO: 1485042 - DNA, 22 bp, Homo sapiens
ggaaaagtcaaagtgttgctgt

SEQ ID NO: 1485043 - DNA, 14 bp, Homo sapiens
ggaaaataaattat

SEQ ID NO: 1485044 - DNA, 21 bp, Homo sapiens
ggaaaatacctaattgtggat

SEQ ID NO: 1485045 - DNA, 19 bp, Homo sapiens
ggaaaatctatatttgtct

SEQ ID NO: 1485046 - DNA, 23 bp, Homo sapiens
ggaaaatctatatttgtcttccg

SEQ ID NO: 1485047 - DNA, 19 bp, Homo sapiens
ggaaaatgtattgattcaa

SEQ ID NO: 1485048 - DNA, 21 bp, Homo sapiens
ggaaaattaaaccaatgaaga

SEQ ID NO: 1485049 - DNA, 15 bp, Homo sapiens
ggaaaattcattttt

SEQ ID NO: 1485050 - DNA, 15 bp, Homo sapiens
ggaaaattttctcct

SEQ ID NO: 1485051 - DNA, 23 bp, Homo sapiens
ggaaacaaagtttacattgtcct

SEQ ID NO: 1485052 - DNA, 14 bp, Homo sapiens
ggaaacagcatgaa

SEQ ID NO: 1485053 - DNA, 15 bp, Homo sapiens
ggaaacagcatgaat

SEQ ID NO: 1485054 - DNA, 17 bp, Homo sapiens
ggaaacagttgcatgta

SEQ ID NO: 1485055 - DNA, 18 bp, Homo sapiens
ggaaacagttgcatgtag

SEQ ID NO: 1485056 - DNA, 18 bp, Homo sapiens
ggaaacatacagaggatg

SEQ ID NO: 1485057 - DNA, 17 bp, Homo sapiens
ggaaaccaagtggtcag

SEQ ID NO: 1485058 - DNA, 16 bp, Homo sapiens
ggaaaccctggagcca

SEQ ID NO: 1485059 - DNA, 17 bp, Homo sapiens
ggaaaccctggagccat

SEQ ID NO: 1485060 - DNA, 12 bp, Homo sapiens
ggaaacctgccc

SEQ ID NO: 1485061 - DNA, 22 bp, Homo sapiens
ggaaacctgccctgcctgaggg

SEQ ID NO: 1485062 - DNA, 15 bp, Homo sapiens
ggaaaccttggagag

SEQ ID NO: 1485063 - DNA, 20 bp, Homo sapiens
ggaaactccacatctgcctt

SEQ ID NO: 1485064 - DNA, 14 bp, Homo sapiens
ggaaactgaagcat

SEQ ID NO: 1485065 - DNA, 17 bp, Homo sapiens
ggaaactgggaaactgg

SEQ ID NO: 1485066 - DNA, 15 bp, Homo sapiens
ggaaagaagggggcc

SEQ ID NO: 1485067 - DNA, 12 bp, Homo sapiens
ggaaagagacca

SEQ ID NO: 1485068 - DNA, 21 bp, Homo sapiens
ggaaagagcaccctcgagaag

SEQ ID NO: 1485069 - DNA, 14 bp, Homo sapiens
ggaaagatggataa

SEQ ID NO: 1485070 - DNA, 19 bp, Homo sapiens
ggaaagcagcctggccaac

SEQ ID NO: 1485071 - DNA, 13 bp, Homo sapiens
ggaaagcctctgc

SEQ ID NO: 1485072 - DNA, 14 bp, Homo sapiens
ggaaagcctctgct

SEQ ID NO: 1485073 - DNA, 22 bp, Homo sapiens
ggaaagcctctggccgtcacac

SEQ ID NO: 1485074 - DNA, 19 bp, Homo sapiens
ggaaaggatctgtgattgg

SEQ ID NO: 1485075 - DNA, 12 bp, Homo sapiens
ggaaaggctcag

SEQ ID NO: 1485076 - DNA, 23 bp, Homo sapiens
ggaaaggctcagtctcaggagca

SEQ ID NO: 1485077 - DNA, 12 bp, Homo sapiens
ggaaaggggaga

SEQ ID NO: 1485078 - DNA, 13 bp, Homo sapiens
ggaaaggggagag

SEQ ID NO: 1485079 - DNA, 14 bp, Homo sapiens
ggaaagtcacccaa

SEQ ID NO: 1485080 - DNA, 11 bp, Homo sapiens
ggaaagtcaga

SEQ ID NO: 1485081 - DNA, 19 bp, Homo sapiens
ggaaagtgctgtcttaaac

SEQ ID NO: 1485082 - DNA, 23 bp, Homo sapiens
ggaaagtggccaagaagcagtgg

SEQ ID NO: 1485083 - DNA, 15 bp, Homo sapiens
ggaaagttactgtaa

SEQ ID NO: 1485084 - DNA, 21 bp, Homo sapiens
ggaaagtttacccatgaagat

SEQ ID NO: 1485085 - DNA, 18 bp, Homo sapiens
ggaaataaaacagctgca

SEQ ID NO: 1485086 - DNA, 14 bp, Homo sapiens
ggaaataacagaga

SEQ ID NO: 1485087 - DNA, 18 bp, Homo sapiens
ggaaataacagagagaat

SEQ ID NO: 1485088 - DNA, 19 bp, Homo sapiens
ggaaataacagagagaatg

SEQ ID NO: 1485089 - DNA, 17 bp, Homo sapiens
ggaaataagaaaaatca

SEQ ID NO: 1485090 - DNA, 18 bp, Homo sapiens
ggaaataatttgaatgta

SEQ ID NO: 1485091 - DNA, 11 bp, Homo sapiens
ggaaatacagt

SEQ ID NO: 1485092 - DNA, 20 bp, Homo sapiens
ggaaatagtctgattttaat

SEQ ID NO: 1485093 - DNA, 16 bp, Homo sapiens
ggaaatatcagttact

SEQ ID NO: 1485094 - DNA, 16 bp, Homo sapiens
ggaaatcaaatatgca

SEQ ID NO: 1485095 - DNA, 11 bp, Homo sapiens
ggaaatcagaa

SEQ ID NO: 1485096 - DNA, 17 bp, Homo sapiens
ggaaatccgagcggcta

SEQ ID NO: 1485097 - DNA, 22 bp, Homo sapiens
ggaaatgctattgttgtgggct

SEQ ID NO: 1485098 - DNA, 18 bp, Homo sapiens
ggaaatgtcacagaagca

SEQ ID NO: 1485099 - DNA, 14 bp, Homo sapiens
ggaaatgtctgctg

SEQ ID NO: 1485100 - DNA, 21 bp, Homo sapiens
ggaaattcaaagcataaaact

SEQ ID NO: 1485101 - DNA, 18 bp, Homo sapiens
ggaaattgctattttatt

SEQ ID NO: 1485102 - DNA, 15 bp, Homo sapiens
ggaacaaacagggct

SEQ ID NO: 1485103 - DNA, 14 bp, Homo sapiens
ggaacaaagacagg

SEQ ID NO: 1485104 - DNA, 17 bp, Homo sapiens
ggaacaaagacaggcaa

SEQ ID NO: 1485105 - DNA, 19 bp, Homo sapiens
ggaacaaattagaggagac

SEQ ID NO: 1485106 - DNA, 15 bp, Homo sapiens
ggaacaaattatttt

SEQ ID NO: 1485107 - DNA, 13 bp, Homo sapiens
ggaacaacttgta

SEQ ID NO: 1485108 - DNA, 15 bp, Homo sapiens
ggaacaagcatgtct

SEQ ID NO: 1485109 - DNA, 21 bp, Homo sapiens
ggaacaattgaagtaaacttt

SEQ ID NO: 1485110 - DNA, 20 bp, Homo sapiens
ggaacactaaaggtggaaat

SEQ ID NO: 1485111 - DNA, 12 bp, Homo sapiens
ggaacactggcc

SEQ ID NO: 1485112 - DNA, 11 bp, Homo sapiens
ggaacagaagg

SEQ ID NO: 1485113 - DNA, 12 bp, Homo sapiens
ggaacagaatgt

SEQ ID NO: 1485114 - DNA, 16 bp, Homo sapiens
ggaacagacaggagaa

SEQ ID NO: 1485115 - DNA, 20 bp, Homo sapiens
ggaacagcgggagacctgtg

SEQ ID NO: 1485116 - DNA, 22 bp, Homo sapiens
ggaacagtaaagaaagcagaat

SEQ ID NO: 1485117 - DNA, 16 bp, Homo sapiens
ggaacatggctagcct

SEQ ID NO: 1485118 - DNA, 13 bp, Homo sapiens
ggaacatggctgg

SEQ ID NO: 1485119 - DNA, 16 bp, Homo sapiens
ggaacatggctggcct

SEQ ID NO: 1485120 - DNA, 19 bp, Homo sapiens
ggaacatggctggcctggt

SEQ ID NO: 1485121 - DNA, 21 bp, Homo sapiens
ggaacatttgatatttttcca

SEQ ID NO: 1485122 - DNA, 13 bp, Homo sapiens
ggaaccactccca

SEQ ID NO: 1485123 - DNA, 13 bp, Homo sapiens
ggaaccagactct

SEQ ID NO: 1485124 - DNA, 17 bp, Homo sapiens
ggaaccagggaggagag

SEQ ID NO: 1485125 - DNA, 13 bp, Homo sapiens
ggaacccagactc

SEQ ID NO: 1485126 - DNA, 14 bp, Homo sapiens
ggaacccagactca

SEQ ID NO: 1485127 - DNA, 13 bp, Homo sapiens
ggaacctcagcct

SEQ ID NO: 1485128 - DNA, 15 bp, Homo sapiens
ggaacctcagcctgg

SEQ ID NO: 1485129 - DNA, 23 bp, Homo sapiens
ggaacctcagcctggccagacac

SEQ ID NO: 1485130 - DNA, 13 bp, Homo sapiens
ggaacctgccatg

SEQ ID NO: 1485131 - DNA, 19 bp, Homo sapiens
ggaaccttccttcctgctt

SEQ ID NO: 1485132 - DNA, 14 bp, Homo sapiens
ggaacgagcactgg

SEQ ID NO: 1485133 - DNA, 22 bp, Homo sapiens
ggaacggtgaaggtgacagcag

SEQ ID NO: 1485134 - DNA, 15 bp, Homo sapiens
ggaacgttggacttt

SEQ ID NO: 1485135 - DNA, 17 bp, Homo sapiens
ggaacgtttctgaacaa

SEQ ID NO: 1485136 - DNA, 21 bp, Homo sapiens
ggaactagagggatacactga

SEQ ID NO: 1485137 - DNA, 22 bp, Homo sapiens
ggaactagagggatacactgaa

SEQ ID NO: 1485138 - DNA, 13 bp, Homo sapiens
ggaactagataac

SEQ ID NO: 1485139 - DNA, 14 bp, Homo sapiens
ggaactagataaca

SEQ ID NO: 1485140 - DNA, 23 bp, Homo sapiens
ggaactcacgtggggagcggtgg

SEQ ID NO: 1485141 - DNA, 13 bp, Homo sapiens
ggaactcagatcc

SEQ ID NO: 1485142 - DNA, 19 bp, Homo sapiens
ggaactcagatccagggac

SEQ ID NO: 1485143 - DNA, 21 bp, Homo sapiens
ggaactcattcctgcctgtct

SEQ ID NO: 1485144 - DNA, 13 bp, Homo sapiens
ggaactccactct

SEQ ID NO: 1485145 - DNA, 19 bp, Homo sapiens
ggaactccactctccttcg

SEQ ID NO: 1485146 - DNA, 19 bp, Homo sapiens
ggacagcagctggtgcccc

SEQ ID NO: 1485147 - DNA, 20 bp, Homo sapiens
ggacagcagctggtgcccca

SEQ ID NO: 1485148 - DNA, 14 bp, Homo sapiens
ggacagcccactga

SEQ ID NO: 1485149 - DNA, 15 bp, Homo sapiens
ggacagccttcagca

SEQ ID NO: 1485150 - DNA, 19 bp, Homo sapiens
ggacagcgatgaggggaca

SEQ ID NO: 1485151 - DNA, 13 bp, Homo sapiens
ggacagctgccca

SEQ ID NO: 1485152 - DNA, 14 bp, Homo sapiens
ggacagctgcccag

SEQ ID NO: 1485153 - DNA, 15 bp, Homo sapiens
ggacagctgcccaga

SEQ ID NO: 1485154 - DNA, 16 bp, Homo sapiens
ggacagctgcccagac

SEQ ID NO: 1485155 - DNA, 17 bp, Homo sapiens
ggacagctgcccagaca

SEQ ID NO: 1485156 - DNA, 14 bp, Homo sapiens
ggacagctgcttgt

SEQ ID NO: 1485157 - DNA, 15 bp, Homo sapiens
ggacagctggctggg

SEQ ID NO: 1485158 - DNA, 17 bp, Homo sapiens
ggacagctggctgggcc

SEQ ID NO: 1485159 - DNA, 18 bp, Homo sapiens
ggacagctggctgggcct

SEQ ID NO: 1485160 - DNA, 15 bp, Homo sapiens
ggacagcttcctcac

SEQ ID NO: 1485161 - DNA, 20 bp, Homo sapiens
ggacagctttgctccgctcc

SEQ ID NO: 1485162 - DNA, 12 bp, Homo sapiens
ggacaggaagga

SEQ ID NO: 1485163 - DNA, 12 bp, Homo sapiens
ggacaggaccct

SEQ ID NO: 1485164 - DNA, 23 bp, Homo sapiens
ggacaggaccctcaggaattcag

SEQ ID NO: 1485165 - DNA, 17 bp, Homo sapiens
ggacaggagaagagagg

SEQ ID NO: 1485166 - DNA, 23 bp, Homo sapiens
ggacaggatgaggacagagggca

SEQ ID NO: 1485167 - DNA, 20 bp, Homo sapiens
ggacaggcccagcgcggcca

SEQ ID NO: 1485168 - DNA, 21 bp, Homo sapiens
ggacaggcccagcgcggccag

SEQ ID NO: 1485169 - DNA, 16 bp, Homo sapiens
ggacaggccgcagctc

SEQ ID NO: 1485170 - DNA, 14 bp, Homo sapiens
ggacaggctctgct

SEQ ID NO: 1485171 - DNA, 15 bp, Homo sapiens
ggacagggcatggcc

SEQ ID NO: 1485172 - DNA, 14 bp, Homo sapiens
ggacaggtggaggt

SEQ ID NO: 1485173 - DNA, 14 bp, Homo sapiens
ggacagtcctggga

SEQ ID NO: 1485174 - DNA, 15 bp, Homo sapiens
ggacagtcctgggag

SEQ ID NO: 1485175 - DNA, 16 bp, Homo sapiens
ggacagtcctgggaga

SEQ ID NO: 1485176 - DNA, 14 bp, Homo sapiens
ggacagtgcttcag

SEQ ID NO: 1485177 - DNA, 22 bp, Homo sapiens
ggacagtgcttcagcctgaggc

SEQ ID NO: 1485178 - DNA, 15 bp, Homo sapiens
ggacagttggcagag

SEQ ID NO: 1485179 - DNA, 18 bp, Homo sapiens
ggacagttggcagagaag

SEQ ID NO: 1485180 - DNA, 23 bp, Homo sapiens
ggacagttggcagagaaggcctc

SEQ ID NO: 1485181 - DNA, 20 bp, Homo sapiens
ggacagtttaccagttgcct

SEQ ID NO: 1485182 - DNA, 18 bp, Homo sapiens
ggacatcaggagactggg

SEQ ID NO: 1485183 - DNA, 18 bp, Homo sapiens
ggacatcgtaggcagcca

SEQ ID NO: 1485184 - DNA, 19 bp, Homo sapiens
ggacatcgtaggcagccac

SEQ ID NO: 1485185 - DNA, 12 bp, Homo sapiens
ggacatgaagga

SEQ ID NO: 1485186 - DNA, 22 bp, Homo sapiens
ggacatgagatggagaggctga

SEQ ID NO: 1485187 - DNA, 14 bp, Homo sapiens
ggacattctctttg

SEQ ID NO: 1485188 - DNA, 17 bp, Homo sapiens
ggacattgctctctggg

SEQ ID NO: 1485189 - DNA, 19 bp, Homo sapiens
ggacatttgaacatgttta

SEQ ID NO: 1485190 - DNA, 12 bp, Homo sapiens
ggaccaaagcaa

SEQ ID NO: 1485191 - DNA, 23 bp, Homo sapiens
ggaccaaagggaagtgaggccca

SEQ ID NO: 1485192 - DNA, 16 bp, Homo sapiens
ggaccaaccctgggga

SEQ ID NO: 1485193 - DNA, 14 bp, Homo sapiens
ggaccaactggctt

SEQ ID NO: 1485194 - DNA, 21 bp, Homo sapiens
ggaccaagaatgagctggttt

SEQ ID NO: 1485195 - DNA, 16 bp, Homo sapiens
ggaccaagcatcttgg

SEQ ID NO: 1485196 - DNA, 11 bp, Homo sapiens
ggaccaaggca

SEQ ID NO: 1485197 - DNA, 19 bp, Homo sapiens
ggaccaaggcaaggcaggt

SEQ ID NO: 1485198 - DNA, 20 bp, Homo sapiens
ggaccaaggcaaggcaggtg

SEQ ID NO: 1485199 - DNA, 22 bp, Homo sapiens
ggaccaattctggacagacaga

SEQ ID NO: 1485200 - DNA, 24 bp, Homo sapiens
ggaccaattctggacagacagatg

SEQ ID NO: 1485201 - DNA, 13 bp, Homo sapiens
ggaccacacctcc

SEQ ID NO: 1485202 - DNA, 14 bp, Homo sapiens
ggaccacagctgct

SEQ ID NO: 1485203 - DNA, 20 bp, Homo sapiens
ggaccacagtgggtggcacc

SEQ ID NO: 1485204 - DNA, 13 bp, Homo sapiens
ggaccacatttta

SEQ ID NO: 1485205 - DNA, 17 bp, Homo sapiens
ggaccaccaatggattg

SEQ ID NO: 1485206 - DNA, 13 bp, Homo sapiens
ggaccaccagccc

SEQ ID NO: 1485207 - DNA, 18 bp, Homo sapiens
ggaccaccagccccagca

SEQ ID NO: 1485208 - DNA, 16 bp, Homo sapiens
ggaccactcctgtccc

SEQ ID NO: 1485209 - DNA, 21 bp, Homo sapiens
ggaccactgggtgagagagga

SEQ ID NO: 1485210 - DNA, 14 bp, Homo sapiens
ggaccagagccaga

SEQ ID NO: 1485211 - DNA, 18 bp, Homo sapiens
ggaccagagccagatgca

SEQ ID NO: 1485212 - DNA, 13 bp, Homo sapiens
ggaccagctcagg

SEQ ID NO: 1485213 - DNA, 16 bp, Homo sapiens
ggaccagctcaggaca

SEQ ID NO: 1485214 - DNA, 19 bp, Homo sapiens
ggaccagctggggcgtggg

SEQ ID NO: 1485215 - DNA, 15 bp, Homo sapiens
ggaccagggccaccg

SEQ ID NO: 1485216 - DNA, 23 bp, Homo sapiens
ggaccaggtcctgctccgctgcc

SEQ ID NO: 1485217 - DNA, 20 bp, Homo sapiens
ggaccagtggtttccagtca

SEQ ID NO: 1485218 - DNA, 20 bp, Homo sapiens
ggaccatggccgaagcccct

SEQ ID NO: 1485219 - DNA, 20 bp, Homo sapiens
ggaccattgacctcagctgc

SEQ ID NO: 1485220 - DNA, 12 bp, Homo sapiens
ggacccaccaaa

SEQ ID NO: 1485221 - DNA, 20 bp, Homo sapiens
ggacccaccaaactgcacac

SEQ ID NO: 1485222 - DNA, 22 bp, Homo sapiens
ggacccacccatcttcctgctg

SEQ ID NO: 1485223 - DNA, 19 bp, Homo sapiens
ggacccacctccccctccc

SEQ ID NO: 1485224 - DNA, 17 bp, Homo sapiens
ggacccactacccttct

SEQ ID NO: 1485225 - DNA, 23 bp, Homo sapiens
ggacccagcctcagatccaggca

SEQ ID NO: 1485226 - DNA, 17 bp, Homo sapiens
ggacccagcgggcaggt

SEQ ID NO: 1485227 - DNA, 18 bp, Homo sapiens
ggacccagcgggcaggtt

SEQ ID NO: 1485228 - DNA, 20 bp, Homo sapiens
ggacccagctactctgtcca

SEQ ID NO: 1485229 - DNA, 13 bp, Homo sapiens
ggacccaggccct

SEQ ID NO: 1485230 - DNA, 14 bp, Homo sapiens
ggacccaggccctc

SEQ ID NO: 1485231 - DNA, 13 bp, Homo sapiens
ggacccaggtgtg

SEQ ID NO: 1485232 - DNA, 11 bp, Homo sapiens
ggacccagtgc

SEQ ID NO: 1485233 - DNA, 20 bp, Homo sapiens
ggacccatagatcttctgaa

SEQ ID NO: 1485234 - DNA, 19 bp, Homo sapiens
ggacccatcacgcctgtgc

SEQ ID NO: 1485235 - DNA, 14 bp, Homo sapiens
ggaccccagcattt

SEQ ID NO: 1485236 - DNA, 18 bp, Homo sapiens
ggaccccagctgggaggc

SEQ ID NO: 1485237 - DNA, 16 bp, Homo sapiens
ggacccccgtggggca

SEQ ID NO: 1485238 - DNA, 22 bp, Homo sapiens
ggacccccgtggggcagggagc

SEQ ID NO: 1485239 - DNA, 19 bp, Homo sapiens
ggaccccctcaccatccag

SEQ ID NO: 1485240 - DNA, 21 bp, Homo sapiens
ggaccccgagaaccctgagca

SEQ ID NO: 1485241 - DNA, 15 bp, Homo sapiens
ggacccctcccaacc

SEQ ID NO: 1485242 - DNA, 21 bp, Homo sapiens
ggacccggaggggcctggcag

SEQ ID NO: 1485243 - DNA, 21 bp, Homo sapiens
ggacccggccgccgccaggac

SEQ ID NO: 1485244 - DNA, 22 bp, Homo sapiens
ggacccggccgccgccaggact

SEQ ID NO: 1485245 - DNA, 19 bp, Homo sapiens
ggacccggggtctcctgga

SEQ ID NO: 1485246 - DNA, 20 bp, Homo sapiens
ggacccggggtctcctggac

SEQ ID NO: 1485247 - DNA, 13 bp, Homo sapiens
ggaccctgaaggg

SEQ ID NO: 1485248 - DNA, 17 bp, Homo sapiens
ggaccctgacctccgcc

SEQ ID NO: 1485249 - DNA, 22 bp, Homo sapiens
ggaccctgacctccgcccctgc

SEQ ID NO: 1485250 - DNA, 12 bp, Homo sapiens
ggaccctggaaa

SEQ ID NO: 1485251 - DNA, 13 bp, Homo sapiens
ggaccctgtccaa

SEQ ID NO: 1485252 - DNA, 21 bp, Homo sapiens
ggaccctgtccggcccagtgc

SEQ ID NO: 1485253 - DNA, 16 bp, Homo sapiens
ggaccctgtgacatgg

SEQ ID NO: 1485254 - DNA, 18 bp, Homo sapiens
ggaccctttttgttatga

SEQ ID NO: 1485255 - DNA, 17 bp, Homo sapiens
ggaccgccatggtgctg

SEQ ID NO: 1485256 - DNA, 15 bp, Homo sapiens
ggaccgggtgggcct

SEQ ID NO: 1485257 - DNA, 16 bp, Homo sapiens
ggaccgggtgggcctg

SEQ ID NO: 1485258 - DNA, 17 bp, Homo sapiens
ggaccgggtgggcctgg

SEQ ID NO: 1485259 - DNA, 22 bp, Homo sapiens
ggaccgggtgggcctggcctga

SEQ ID NO: 1485260 - DNA, 17 bp, Homo sapiens
ggaccggtacagaaagg

SEQ ID NO: 1485261 - DNA, 19 bp, Homo sapiens
ggaccgtccaggggagatg

SEQ ID NO: 1485262 - DNA, 19 bp, Homo sapiens
ggaccgtggacaggcccag

SEQ ID NO: 1485263 - DNA, 21 bp, Homo sapiens
ggaccgtggacaggcccagcg

SEQ ID NO: 1485264 - DNA, 11 bp, Homo sapiens
ggacctcctta

SEQ ID NO: 1485265 - DNA, 21 bp, Homo sapiens
ggacctccttagccctgtctg

SEQ ID NO: 1485266 - DNA, 12 bp, Homo sapiens
ggacctctgctt

SEQ ID NO: 1485267 - DNA, 22 bp, Homo sapiens
ggacctctttactctctccgat

SEQ ID NO: 1485268 - DNA, 20 bp, Homo sapiens
ggacctgcatccttcctggg

SEQ ID NO: 1485269 - DNA, 17 bp, Homo sapiens
ggacctgccaggcaggg

SEQ ID NO: 1485270 - DNA, 22 bp, Homo sapiens
ggacctgcctcctgcctgcccc

SEQ ID NO: 1485271 - DNA, 23 bp, Homo sapiens
ggacctgcctcctgcctgcccct

SEQ ID NO: 1485272 - DNA, 13 bp, Homo sapiens
ggacctgcctgca

SEQ ID NO: 1485273 - DNA, 12 bp, Homo sapiens
ggacctgctgct

SEQ ID NO: 1485274 - DNA, 17 bp, Homo sapiens
ggacctgctgctccatg

SEQ ID NO: 1485275 - DNA, 19 bp, Homo sapiens
ggaccttcgggctgtgccc

SEQ ID NO: 1485276 - DNA, 19 bp, Homo sapiens
ggaccttctttattctgtg

SEQ ID NO: 1485277 - DNA, 20 bp, Homo sapiens
ggaccttctttattctgtgt

SEQ ID NO: 1485278 - DNA, 16 bp, Homo sapiens
ggaccttgacagagca

SEQ ID NO: 1485279 - DNA, 17 bp, Homo sapiens
ggaccttgacagagcag

SEQ ID NO: 1485280 - DNA, 22 bp, Homo sapiens
ggacctttccaccacagccagc

SEQ ID NO: 1485281 - DNA, 16 bp, Homo sapiens
ggaccttttgttttct

SEQ ID NO: 1485282 - DNA, 19 bp, Homo sapiens
ggacgagacccccatccag

SEQ ID NO: 1485283 - DNA, 23 bp, Homo sapiens
ggacgagacccccatccagcctc

SEQ ID NO: 1485284 - DNA, 19 bp, Homo sapiens
ggacgctggctactgtcta

SEQ ID NO: 1485285 - DNA, 13 bp, Homo sapiens
ggacgctggctcc

SEQ ID NO: 1485286 - DNA, 16 bp, Homo sapiens
ggacgggccacacgtg

SEQ ID NO: 1485287 - DNA, 23 bp, Homo sapiens
ggacggttttgctttatggctag

SEQ ID NO: 1485288 - DNA, 18 bp, Homo sapiens
ggactaacataaaatctg

SEQ ID NO: 1485289 - DNA, 12 bp, Homo sapiens
ggactaagcaat

SEQ ID NO: 1485290 - DNA, 16 bp, Homo sapiens
ggactaccgcaggccc

SEQ ID NO: 1485291 - DNA, 18 bp, Homo sapiens
ggactaccgcaggcccgg

SEQ ID NO: 1485292 - DNA, 20 bp, Homo sapiens
ggactaccgcaggcccggac

SEQ ID NO: 1485293 - DNA, 19 bp, Homo sapiens
ggactattgtgccaactgc

SEQ ID NO: 1485294 - DNA, 22 bp, Homo sapiens
ggactcacttgatgtttcctgg

SEQ ID NO: 1485295 - DNA, 14 bp, Homo sapiens
ggactcagcagtga

SEQ ID NO: 1485296 - DNA, 16 bp, Homo sapiens
ggactcagcagtgacc

SEQ ID NO: 1485297 - DNA, 13 bp, Homo sapiens
ggactcagccctg

SEQ ID NO: 1485298 - DNA, 15 bp, Homo sapiens
ggactcagccctgag

SEQ ID NO: 1485299 - DNA, 17 bp, Homo sapiens
ggactcagccctgaggt

SEQ ID NO: 1485300 - DNA, 15 bp, Homo sapiens
ggactcaggaccaga

SEQ ID NO: 1485301 - DNA, 20 bp, Homo sapiens
ggactcaggatgcccagggc

SEQ ID NO: 1485302 - DNA, 11 bp, Homo sapiens
ggactcaggga

SEQ ID NO: 1485303 - DNA, 20 bp, Homo sapiens
ggactcagggccatgcctgc

SEQ ID NO: 1485304 - DNA, 15 bp, Homo sapiens
ggactccaggcccaa

SEQ ID NO: 1485305 - DNA, 22 bp, Homo sapiens
ggactccaggcccaaggctccc

SEQ ID NO: 1485306 - DNA, 23 bp, Homo sapiens
ggactccaggcccaaggctcccg

SEQ ID NO: 1485307 - DNA, 13 bp, Homo sapiens
ggactccaggcct

SEQ ID NO: 1485308 - DNA, 14 bp, Homo sapiens
ggactccaggcctg

SEQ ID NO: 1485309 - DNA, 18 bp, Homo sapiens
ggactccaggcctgacca

SEQ ID NO: 1485310 - DNA, 19 bp, Homo sapiens
ggactccaggcctgaccag

SEQ ID NO: 1485311 - DNA, 13 bp, Homo sapiens
ggactcccagtga

SEQ ID NO: 1485312 - DNA, 20 bp, Homo sapiens
ggactccctcctcacctctg

SEQ ID NO: 1485313 - DNA, 22 bp, Homo sapiens
ggactccctcctcacctctgga

SEQ ID NO: 1485314 - DNA, 18 bp, Homo sapiens
ggactctaagctggagct

SEQ ID NO: 1485315 - DNA, 20 bp, Homo sapiens
ggactctcagggattctggg

SEQ ID NO: 1485316 - DNA, 22 bp, Homo sapiens
ggactctccactcaatgtctta

SEQ ID NO: 1485317 - DNA, 11 bp, Homo sapiens
ggactctgagg

SEQ ID NO: 1485318 - DNA, 20 bp, Homo sapiens
ggactctgaggactcctgag

SEQ ID NO: 1485319 - DNA, 13 bp, Homo sapiens
ggactctgcacat

SEQ ID NO: 1485320 - DNA, 15 bp, Homo sapiens
ggactctgcacatga

SEQ ID NO: 1485321 - DNA, 20 bp, Homo sapiens
ggactctgcacatgtcttgt

SEQ ID NO: 1485322 - DNA, 21 bp, Homo sapiens
ggactgaaagaagaaaacagt

SEQ ID NO: 1485323 - DNA, 13 bp, Homo sapiens
ggactgaactcca

SEQ ID NO: 1485324 - DNA, 21 bp, Homo sapiens
ggactgaccaaagactgcaga

SEQ ID NO: 1485325 - DNA, 17 bp, Homo sapiens
ggactgactgcagcccc

SEQ ID NO: 1485326 - DNA, 14 bp, Homo sapiens
ggactgactgtgtt

SEQ ID NO: 1485327 - DNA, 17 bp, Homo sapiens
ggactgagggcagtgcc

SEQ ID NO: 1485328 - DNA, 19 bp, Homo sapiens
ggactgatgtcatcttgag

SEQ ID NO: 1485329 - DNA, 14 bp, Homo sapiens
ggactgatttgtgg

SEQ ID NO: 1485330 - DNA, 16 bp, Homo sapiens
ggactgcagtgtggag

SEQ ID NO: 1485331 - DNA, 19 bp, Homo sapiens
ggactgcatggggaggcag

SEQ ID NO: 1485332 - DNA, 23 bp, Homo sapiens
ggactgctacctttcaaagcttg

SEQ ID NO: 1485333 - DNA, 16 bp, Homo sapiens
ggactggcagaagcat

SEQ ID NO: 1485334 - DNA, 11 bp, Homo sapiens
ggactggccat

SEQ ID NO: 1485335 - DNA, 19 bp, Homo sapiens
ggactggctagagtcctca

SEQ ID NO: 1485336 - DNA, 22 bp, Homo sapiens
ggactggctagagtcctcactc

SEQ ID NO: 1485337 - DNA, 18 bp, Homo sapiens
ggactggctgtgcccctg

SEQ ID NO: 1485338 - DNA, 15 bp, Homo sapiens
ggactgggggccaga

SEQ ID NO: 1485339 - DNA, 13 bp, Homo sapiens
ggactgggtttgg

SEQ ID NO: 1485340 - DNA, 21 bp, Homo sapiens
ggactgggtttggaccccagc

SEQ ID NO: 1485341 - DNA, 24 bp, Homo sapiens
ggactgggtttggaccccagctgg

SEQ ID NO: 1485342 - DNA, 11 bp, Homo sapiens
ggactggtgcc

SEQ ID NO: 1485343 - DNA, 14 bp, Homo sapiens
ggactggtgccctc

SEQ ID NO: 1485344 - DNA, 21 bp, Homo sapiens
ggactggtgccctcctcactc

SEQ ID NO: 1485345 - DNA, 18 bp, Homo sapiens
ggactgtaaagatttgtt

SEQ ID NO: 1485346 - DNA, 15 bp, Homo sapiens
ggactgtcatagaaa

SEQ ID NO: 1485347 - DNA, 21 bp, Homo sapiens
ggactgtcctgaggagccctg

SEQ ID NO: 1485348 - DNA, 20 bp, Homo sapiens
ggactgtgatttgaatccag

SEQ ID NO: 1485349 - DNA, 15 bp, Homo sapiens
ggactgtgcctcagg

SEQ ID NO: 1485350 - DNA, 13 bp, Homo sapiens
ggactgtgctggt

SEQ ID NO: 1485351 - DNA, 17 bp, Homo sapiens
ggactgtttcagtgtga

SEQ ID NO: 1485352 - DNA, 20 bp, Homo sapiens
ggacttaaaattagtctttt

SEQ ID NO: 1485353 - DNA, 19 bp, Homo sapiens
ggacttaacggctccagga

SEQ ID NO: 1485354 - DNA, 15 bp, Homo sapiens
ggacttccatgcctt

SEQ ID NO: 1485355 - DNA, 14 bp, Homo sapiens
ggacttcctggggc

SEQ ID NO: 1485356 - DNA, 20 bp, Homo sapiens
ggacttcctgtccagctcca

SEQ ID NO: 1485357 - DNA, 16 bp, Homo sapiens
ggacttgctaaagcac

SEQ ID NO: 1485358 - DNA, 17 bp, Homo sapiens
ggacttgtgattggctg

SEQ ID NO: 1485359 - DNA, 18 bp, Homo sapiens
ggacttgtttagagagcc

SEQ ID NO: 1485360 - DNA, 18 bp, Homo sapiens
ggactttatttatttcta

SEQ ID NO: 1485361 - DNA, 17 bp, Homo sapiens
ggactttccttccctct

SEQ ID NO: 1485362 - DNA, 17 bp, Homo sapiens
ggactttgcagccggca

SEQ ID NO: 1485363 - DNA, 22 bp, Homo sapiens
ggactttgctgatttcccctct

SEQ ID NO: 1485364 - DNA, 15 bp, Homo sapiens
ggacttttattttgg

SEQ ID NO: 1485365 - DNA, 23 bp, Homo sapiens
ggagaaaaaaaaccttgtaaaaa

SEQ ID NO: 1485366 - DNA, 12 bp, Homo sapiens
ggagaaaaacaa

SEQ ID NO: 1485367 - DNA, 16 bp, Homo sapiens
ggagaaacagagacag

SEQ ID NO: 1485368 - DNA, 12 bp, Homo sapiens
ggagaaaccagc

SEQ ID NO: 1485369 - DNA, 20 bp, Homo sapiens
ggagaaagaagtggagacag

SEQ ID NO: 1485370 - DNA, 21 bp, Homo sapiens
ggagaaagaagtggagacagt

SEQ ID NO: 1485371 - DNA, 23 bp, Homo sapiens
ggagaaatgcaataactctggga

SEQ ID NO: 1485372 - DNA, 20 bp, Homo sapiens
ggagaaatgcatccattcct

SEQ ID NO: 1485373 - DNA, 22 bp, Homo sapiens
ggagaacagtggttgcctgggg

SEQ ID NO: 1485374 - DNA, 20 bp, Homo sapiens
ggagaaccaaatctggaagc

SEQ ID NO: 1485375 - DNA, 19 bp, Homo sapiens
ggaggaaccagagtgctga

SEQ ID NO: 1485376 - DNA, 14 bp, Homo sapiens
ggaggaagcccaca

SEQ ID NO: 1485377 - DNA, 17 bp, Homo sapiens
ggaggaaggcctttctt

SEQ ID NO: 1485378 - DNA, 14 bp, Homo sapiens
ggaggaaggtgctg

SEQ ID NO: 1485379 - DNA, 19 bp, Homo sapiens
ggaggaagtagtccagcct

SEQ ID NO: 1485380 - DNA, 19 bp, Homo sapiens
ggaggaatagtgcttgctg

SEQ ID NO: 1485381 - DNA, 21 bp, Homo sapiens
ggaggaatagtgcttgctggc

SEQ ID NO: 1485382 - DNA, 20 bp, Homo sapiens
ggaggacccgggaccacagc

SEQ ID NO: 1485383 - DNA, 14 bp, Homo sapiens
ggaggactctcctc

SEQ ID NO: 1485384 - DNA, 13 bp, Homo sapiens
ggaggagaatgag

SEQ ID NO: 1485385 - DNA, 19 bp, Homo sapiens
ggaggagagagaccccgca

SEQ ID NO: 1485386 - DNA, 17 bp, Homo sapiens
ggaggagagagtcccag

SEQ ID NO: 1485387 - DNA, 16 bp, Homo sapiens
ggaggagcagcttcct

SEQ ID NO: 1485388 - DNA, 12 bp, Homo sapiens
ggaggagcatgc

SEQ ID NO: 1485389 - DNA, 14 bp, Homo sapiens
ggaggagccttgct

SEQ ID NO: 1485390 - DNA, 12 bp, Homo sapiens
ggaggagctgcc

SEQ ID NO: 1485391 - DNA, 16 bp, Homo sapiens
ggaggaggacacagca

SEQ ID NO: 1485392 - DNA, 17 bp, Homo sapiens
ggaggaggagccttgct

SEQ ID NO: 1485393 - DNA, 13 bp, Homo sapiens
ggaggaggaggga

SEQ ID NO: 1485394 - DNA, 22 bp, Homo sapiens
ggaggaggccacctctccaagg

SEQ ID NO: 1485395 - DNA, 14 bp, Homo sapiens
ggaggagggaggcg

SEQ ID NO: 1485396 - DNA, 15 bp, Homo sapiens
ggaggagggttgtgc

SEQ ID NO: 1485397 - DNA, 16 bp, Homo sapiens
ggaggatcactggagc

SEQ ID NO: 1485398 - DNA, 19 bp, Homo sapiens
ggaggcaagaggggtggag

SEQ ID NO: 1485399 - DNA, 16 bp, Homo sapiens
ggaggcaccagctctg

SEQ ID NO: 1485400 - DNA, 16 bp, Homo sapiens
ggaggcacctccaggc

SEQ ID NO: 1485401 - DNA, 23 bp, Homo sapiens
ggaggcacctccaggcaggccag

SEQ ID NO: 1485402 - DNA, 20 bp, Homo sapiens
ggaggcacgcaccactgctt

SEQ ID NO: 1485403 - DNA, 12 bp, Homo sapiens
ggaggcagcaga

SEQ ID NO: 1485404 - DNA, 14 bp, Homo sapiens
ggaggcagcagagc

SEQ ID NO: 1485405 - DNA, 18 bp, Homo sapiens
ggaggcagccgaggcctg

SEQ ID NO: 1485406 - DNA, 13 bp, Homo sapiens
ggaggcaggggac

SEQ ID NO: 1485407 - DNA, 20 bp, Homo sapiens
ggaggcaggggacaagggag

SEQ ID NO: 1485408 - DNA, 14 bp, Homo sapiens
ggaggccaaccagc

SEQ ID NO: 1485409 - DNA, 21 bp, Homo sapiens
ggaggccaaccagcccgacag

SEQ ID NO: 1485410 - DNA, 22 bp, Homo sapiens
ggaggccaagcagtgcctgcct

SEQ ID NO: 1485411 - DNA, 18 bp, Homo sapiens
ggaggccaaggcaggtag

SEQ ID NO: 1485412 - DNA, 23 bp, Homo sapiens
ggaggccaccgggacagacctgg

SEQ ID NO: 1485413 - DNA, 14 bp, Homo sapiens
ggaggccacctctc

SEQ ID NO: 1485414 - DNA, 19 bp, Homo sapiens
ggaggccacctctccaagg

SEQ ID NO: 1485415 - DNA, 14 bp, Homo sapiens
ggaggcccaggctg

SEQ ID NO: 1485416 - DNA, 15 bp, Homo sapiens
ggaggcccatgccct

SEQ ID NO: 1485417 - DNA, 22 bp, Homo sapiens
ggaggccccaaccctgtcctcc

SEQ ID NO: 1485418 - DNA, 22 bp, Homo sapiens
ggaggccccaggctgagagcca

SEQ ID NO: 1485419 - DNA, 14 bp, Homo sapiens
ggaggccccagggg

SEQ ID NO: 1485420 - DNA, 15 bp, Homo sapiens
ggaggccccaggggg

SEQ ID NO: 1485421 - DNA, 16 bp, Homo sapiens
ggaggcccctggccca

SEQ ID NO: 1485422 - DNA, 17 bp, Homo sapiens
ggaggcccctggcccag

SEQ ID NO: 1485423 - DNA, 22 bp, Homo sapiens
ggaggcccctggcccagcggcc

SEQ ID NO: 1485424 - DNA, 13 bp, Homo sapiens
ggaggcccctggg

SEQ ID NO: 1485425 - DNA, 20 bp, Homo sapiens
ggaggcccctgggctctcac

SEQ ID NO: 1485426 - DNA, 16 bp, Homo sapiens
ggaggcccttgtcgtg

SEQ ID NO: 1485427 - DNA, 21 bp, Homo sapiens
ggaggcccttgtcgtgggatg

SEQ ID NO: 1485428 - DNA, 18 bp, Homo sapiens
ggaggccgaggtgggcag

SEQ ID NO: 1485429 - DNA, 13 bp, Homo sapiens
ggaggcctcaggt

SEQ ID NO: 1485430 - DNA, 18 bp, Homo sapiens
ggaggccttccagctgct

SEQ ID NO: 1485431 - DNA, 19 bp, Homo sapiens
ggaggccttccagctgctg

SEQ ID NO: 1485432 - DNA, 16 bp, Homo sapiens
ggaggcgatgccagcc

SEQ ID NO: 1485433 - DNA, 13 bp, Homo sapiens
ggaggcgcccttg

SEQ ID NO: 1485434 - DNA, 23 bp, Homo sapiens
ggaggcgcccttggcttctgtga

SEQ ID NO: 1485435 - DNA, 14 bp, Homo sapiens
ggaggcggcccggc

SEQ ID NO: 1485436 - DNA, 18 bp, Homo sapiens
ggaggcgtctcgggagag

SEQ ID NO: 1485437 - DNA, 19 bp, Homo sapiens
ggaggctacctcacctggg

SEQ ID NO: 1485438 - DNA, 20 bp, Homo sapiens
ggaggctcccgaggggaagg

SEQ ID NO: 1485439 - DNA, 18 bp, Homo sapiens
ggaggctgaggcagaaga

SEQ ID NO: 1485440 - DNA, 16 bp, Homo sapiens
ggaggctgaggcagga

SEQ ID NO: 1485441 - DNA, 17 bp, Homo sapiens
ggaggctgaggcaggag

SEQ ID NO: 1485442 - DNA, 22 bp, Homo sapiens
ggaggctgcatgctctggaagc

SEQ ID NO: 1485443 - DNA, 12 bp, Homo sapiens
ggaggctgctgt

SEQ ID NO: 1485444 - DNA, 12 bp, Homo sapiens
ggaggctggagg

SEQ ID NO: 1485445 - DNA, 12 bp, Homo sapiens
ggaggctggcca

SEQ ID NO: 1485446 - DNA, 18 bp, Homo sapiens
ggaggctgtgatttgctg

SEQ ID NO: 1485447 - DNA, 15 bp, Homo sapiens
ggaggcttttcactg

SEQ ID NO: 1485448 - DNA, 17 bp, Homo sapiens
ggaggcttttcactgcc

SEQ ID NO: 1485449 - DNA, 14 bp, Homo sapiens
ggagggaagaccag

SEQ ID NO: 1485450 - DNA, 12 bp, Homo sapiens
ggagggagaaga

SEQ ID NO: 1485451 - DNA, 21 bp, Homo sapiens
ggagggagctgaggagccctt

SEQ ID NO: 1485452 - DNA, 13 bp, Homo sapiens
ggagggaggcccc

SEQ ID NO: 1485453 - DNA, 21 bp, Homo sapiens
ggagggatgctgcctgagtca

SEQ ID NO: 1485454 - DNA, 16 bp, Homo sapiens
ggagggatgctgctcc

SEQ ID NO: 1485455 - DNA, 20 bp, Homo sapiens
ggagggatgctgctccgccc

SEQ ID NO: 1485456 - DNA, 17 bp, Homo sapiens
ggagggcagagccatgg

SEQ ID NO: 1485457 - DNA, 18 bp, Homo sapiens
ggagggcagagccatggg

SEQ ID NO: 1485458 - DNA, 16 bp, Homo sapiens
ggagggcagcagaagg

SEQ ID NO: 1485459 - DNA, 14 bp, Homo sapiens
ggagggcccctgcg

SEQ ID NO: 1485460 - DNA, 16 bp, Homo sapiens
ggagggcctgcagtga

SEQ ID NO: 1485461 - DNA, 17 bp, Homo sapiens
ggagggcttggcccagc

SEQ ID NO: 1485462 - DNA, 15 bp, Homo sapiens
ggaggggaaggggct

SEQ ID NO: 1485463 - DNA, 19 bp, Homo sapiens
ggaggggaaggggctgagg

SEQ ID NO: 1485464 - DNA, 13 bp, Homo sapiens
ggaggggaggcag

SEQ ID NO: 1485465 - DNA, 17 bp, Homo sapiens
ggaggggcagcctgtgc

SEQ ID NO: 1485466 - DNA, 19 bp, Homo sapiens
ggaggggcagcctgtgcct

SEQ ID NO: 1485467 - DNA, 21 bp, Homo sapiens
ggaggggcagcgcatgtgtgc

SEQ ID NO: 1485468 - DNA, 12 bp, Homo sapiens
ggaggggcccac

SEQ ID NO: 1485469 - DNA, 13 bp, Homo sapiens
ggaggggcccacc

SEQ ID NO: 1485470 - DNA, 15 bp, Homo sapiens
ggaggggcccaccca

SEQ ID NO: 1485471 - DNA, 18 bp, Homo sapiens
ggaggggcctggcagccg

SEQ ID NO: 1485472 - DNA, 12 bp, Homo sapiens
ggaggggcgctg

SEQ ID NO: 1485473 - DNA, 20 bp, Homo sapiens
ggaggggcgctggcccagcc

SEQ ID NO: 1485474 - DNA, 21 bp, Homo sapiens
ggagggggctatttctctccc

SEQ ID NO: 1485475 - DNA, 15 bp, Homo sapiens
ggaggggggtgctgg

SEQ ID NO: 1485476 - DNA, 16 bp, Homo sapiens
ggaggggtggggagct

SEQ ID NO: 1485477 - DNA, 16 bp, Homo sapiens
ggaggggttgttttgg

SEQ ID NO: 1485478 - DNA, 15 bp, Homo sapiens
ggagggttgccatgg

SEQ ID NO: 1485479 - DNA, 19 bp, Homo sapiens
ggagggttggggaggggcg

SEQ ID NO: 1485480 - DNA, 20 bp, Homo sapiens
ggaggtccttaggcctctga

SEQ ID NO: 1485481 - DNA, 14 bp, Homo sapiens
ggaggtctctggga

SEQ ID NO: 1485482 - DNA, 17 bp, Homo sapiens
ggaggtctggctgagcc

SEQ ID NO: 1485483 - DNA, 22 bp, Homo sapiens
ggaggtctggctgagcccctgg

SEQ ID NO: 1485484 - DNA, 23 bp, Homo sapiens
ggaggtctggctgagcccctggg

SEQ ID NO: 1485485 - DNA, 18 bp, Homo sapiens
ggaggtgatagcattgct

SEQ ID NO: 1485486 - DNA, 17 bp, Homo sapiens
ggaggtggaagaaggga

SEQ ID NO: 1485487 - DNA, 21 bp, Homo sapiens
ggaggtgggcaaagggaagta

SEQ ID NO: 1485488 - DNA, 12 bp, Homo sapiens
ggaggtggtcct

SEQ ID NO: 1485489 - DNA, 15 bp, Homo sapiens
ggaggtgtctggggt

SEQ ID NO: 1485490 - DNA, 22 bp, Homo sapiens
ggaggtgtctggggtgagggag

SEQ ID NO: 1485491 - DNA, 17 bp, Homo sapiens
ggatctgctgggctctg

SEQ ID NO: 1485492 - DNA, 21 bp, Homo sapiens
ggatctggtagggggaaaatg

SEQ ID NO: 1485493 - DNA, 16 bp, Homo sapiens
ggatctgttttctgga

SEQ ID NO: 1485494 - DNA, 17 bp, Homo sapiens
ggatctgttttctggaa

SEQ ID NO: 1485495 - DNA, 22 bp, Homo sapiens
ggatcttcatctgactatgaca

SEQ ID NO: 1485496 - DNA, 23 bp, Homo sapiens
ggatcttcatctgactatgacat

SEQ ID NO: 1485497 - DNA, 18 bp, Homo sapiens
ggatcttcccacaggagg

SEQ ID NO: 1485498 - DNA, 19 bp, Homo sapiens
ggatcttcccacaggaggg

SEQ ID NO: 1485499 - DNA, 13 bp, Homo sapiens
ggatcttttctaa

SEQ ID NO: 1485500 - DNA, 21 bp, Homo sapiens
ggatgaaagttcccccatcag

SEQ ID NO: 1485501 - DNA, 17 bp, Homo sapiens
ggatgaagagaaggcac

SEQ ID NO: 1485502 - DNA, 18 bp, Homo sapiens
ggatgaatgaggtcccag

SEQ ID NO: 1485503 - DNA, 21 bp, Homo sapiens
ggatgaattccaaattctgct

SEQ ID NO: 1485504 - DNA, 16 bp, Homo sapiens
ggatgaattttctgca

SEQ ID NO: 1485505 - DNA, 18 bp, Homo sapiens
ggatgaattttctgcagc

SEQ ID NO: 1485506 - DNA, 15 bp, Homo sapiens
ggatgacagggcaga

SEQ ID NO: 1485507 - DNA, 20 bp, Homo sapiens
ggatgacatgtccctacacc

SEQ ID NO: 1485508 - DNA, 17 bp, Homo sapiens
ggatgaccatactcaga

SEQ ID NO: 1485509 - DNA, 13 bp, Homo sapiens
ggatgagaaacag

SEQ ID NO: 1485510 - DNA, 18 bp, Homo sapiens
ggatgagaaacagctcag

SEQ ID NO: 1485511 - DNA, 13 bp, Homo sapiens
ggatgagcagagg

SEQ ID NO: 1485512 - DNA, 15 bp, Homo sapiens
ggatgagctggaagg

SEQ ID NO: 1485513 - DNA, 15 bp, Homo sapiens
ggatgaggagacaga

SEQ ID NO: 1485514 - DNA, 20 bp, Homo sapiens
ggatgaggccgctagaggcc

SEQ ID NO: 1485515 - DNA, 21 bp, Homo sapiens
ggatgagggtggcatgaggag

SEQ ID NO: 1485516 - DNA, 19 bp, Homo sapiens
ggatgagtgttgggagggg

SEQ ID NO: 1485517 - DNA, 21 bp, Homo sapiens
ggatgatagttgaagggaggt

SEQ ID NO: 1485518 - DNA, 15 bp, Homo sapiens
ggatgatgcctcatg

SEQ ID NO: 1485519 - DNA, 18 bp, Homo sapiens
ggatgatggcagagccag

SEQ ID NO: 1485520 - DNA, 20 bp, Homo sapiens
ggatgatggcagagccaggc

SEQ ID NO: 1485521 - DNA, 20 bp, Homo sapiens
ggatgattcagaaattggaa

SEQ ID NO: 1485522 - DNA, 17 bp, Homo sapiens
ggatgattggattattc

SEQ ID NO: 1485523 - DNA, 18 bp, Homo sapiens
ggatgcacagatgccatg

SEQ ID NO: 1485524 - DNA, 11 bp, Homo sapiens
ggatgcacatt

SEQ ID NO: 1485525 - DNA, 18 bp, Homo sapiens
ggatgcacatttctggat

SEQ ID NO: 1485526 - DNA, 19 bp, Homo sapiens
ggatgccacgcctggaagg

SEQ ID NO: 1485527 - DNA, 22 bp, Homo sapiens
ggatgcccagggccactctgcc

SEQ ID NO: 1485528 - DNA, 23 bp, Homo sapiens
ggatgcccagggccactctgcct

SEQ ID NO: 1485529 - DNA, 14 bp, Homo sapiens
ggatgccgttctgt

SEQ ID NO: 1485530 - DNA, 18 bp, Homo sapiens
ggatgccgttctgttcca

SEQ ID NO: 1485531 - DNA, 16 bp, Homo sapiens
ggatgccttttctgtg

SEQ ID NO: 1485532 - DNA, 17 bp, Homo sapiens
ggatgccttttctgtga

SEQ ID NO: 1485533 - DNA, 19 bp, Homo sapiens
ggatgctccagggcagcct

SEQ ID NO: 1485534 - DNA, 17 bp, Homo sapiens
ggatgctctttcccagg

SEQ ID NO: 1485535 - DNA, 18 bp, Homo sapiens
ggatgctctttcccagga

SEQ ID NO: 1485536 - DNA, 19 bp, Homo sapiens
ggatgctctttcccaggac

SEQ ID NO: 1485537 - DNA, 14 bp, Homo sapiens
ggatgctgcctgag

SEQ ID NO: 1485538 - DNA, 15 bp, Homo sapiens
ggatgctgggctggg

SEQ ID NO: 1485539 - DNA, 16 bp, Homo sapiens
ggatgctgggctgggc

SEQ ID NO: 1485540 - DNA, 22 bp, Homo sapiens
ggatgctgttgagggccaagag

SEQ ID NO: 1485541 - DNA, 23 bp, Homo sapiens
ggatggacttgtgattggctgca

SEQ ID NO: 1485542 - DNA, 19 bp, Homo sapiens
ggatggagaaagaagtgga

SEQ ID NO: 1485543 - DNA, 20 bp, Homo sapiens
ggatggagaaagaagtggag

SEQ ID NO: 1485544 - DNA, 13 bp, Homo sapiens
ggatggatggcac

SEQ ID NO: 1485545 - DNA, 15 bp, Homo sapiens
ggatggccgggctgc

SEQ ID NO: 1485546 - DNA, 20 bp, Homo sapiens
ggatgggaggccgggagagg

SEQ ID NO: 1485547 - DNA, 19 bp, Homo sapiens
ggatgggatcccaggccag

SEQ ID NO: 1485548 - DNA, 21 bp, Homo sapiens
ggatgggatcccaggccaggg

SEQ ID NO: 1485549 - DNA, 23 bp, Homo sapiens
ggatgggcagcccaacagcactt

SEQ ID NO: 1485550 - DNA, 22 bp, Homo sapiens
ggatgggcagtcattttgcaga

SEQ ID NO: 1485551 - DNA, 18 bp, Homo sapiens
ggatggggacatttgaac

SEQ ID NO: 1485552 - DNA, 15 bp, Homo sapiens
ggatgggggaactca

SEQ ID NO: 1485553 - DNA, 22 bp, Homo sapiens
ggatgggggaactcagatccag

SEQ ID NO: 1485554 - DNA, 23 bp, Homo sapiens
ggatgggggaactcagatccagg

SEQ ID NO: 1485555 - DNA, 15 bp, Homo sapiens
ggatgggtcagagct

SEQ ID NO: 1485556 - DNA, 15 bp, Homo sapiens
ggatgggttccagag

SEQ ID NO: 1485557 - DNA, 16 bp, Homo sapiens
ggatggtcctggggct

SEQ ID NO: 1485558 - DNA, 15 bp, Homo sapiens
ggatggttctgtgac

SEQ ID NO: 1485559 - DNA, 20 bp, Homo sapiens
ggatgtaaacagtgcctgct

SEQ ID NO: 1485560 - DNA, 21 bp, Homo sapiens
ggatgtaaacagtgcctgctg

SEQ ID NO: 1485561 - DNA, 16 bp, Homo sapiens
ggatgtacatttccaa

SEQ ID NO: 1485562 - DNA, 15 bp, Homo sapiens
ggatgtactgtttgc

SEQ ID NO: 1485563 - DNA, 13 bp, Homo sapiens
ggatgtagaactt

SEQ ID NO: 1485564 - DNA, 14 bp, Homo sapiens
ggatgtcacagtcc

SEQ ID NO: 1485565 - DNA, 17 bp, Homo sapiens
ggatgtccacagatgcc

SEQ ID NO: 1485566 - DNA, 20 bp, Homo sapiens
ggatgtctgccaatttttgc

SEQ ID NO: 1485567 - DNA, 13 bp, Homo sapiens
ggatgtctgggcc

SEQ ID NO: 1485568 - DNA, 19 bp, Homo sapiens
ggatgtgggtaagaggagc

SEQ ID NO: 1485569 - DNA, 22 bp, Homo sapiens
ggatgtgggtaagaggagcaga

SEQ ID NO: 1485570 - DNA, 15 bp, Homo sapiens
ggatgttatgaacag

SEQ ID NO: 1485571 - DNA, 20 bp, Homo sapiens
ggatgttatgaacagctgtg

SEQ ID NO: 1485572 - DNA, 23 bp, Homo sapiens
ggatgttcagcactgtcccttgc

SEQ ID NO: 1485573 - DNA, 21 bp, Homo sapiens
ggatgttttgtcccatttcct

SEQ ID NO: 1485574 - DNA, 16 bp, Homo sapiens
ggattaacctctgcac

SEQ ID NO: 1485575 - DNA, 18 bp, Homo sapiens
ggattaacctctgcacta

SEQ ID NO: 1485576 - DNA, 19 bp, Homo sapiens
ggattattcatttaaaatg

SEQ ID NO: 1485577 - DNA, 14 bp, Homo sapiens
ggattcaggctgct

SEQ ID NO: 1485578 - DNA, 14 bp, Homo sapiens
ggattcatttcctg

SEQ ID NO: 1485579 - DNA, 17 bp, Homo sapiens
ggattcatttcctgccc

SEQ ID NO: 1485580 - DNA, 11 bp, Homo sapiens
ggattcccttc

SEQ ID NO: 1485581 - DNA, 14 bp, Homo sapiens
ggattcctgaccca

SEQ ID NO: 1485582 - DNA, 13 bp, Homo sapiens
ggattctgggagg

SEQ ID NO: 1485583 - DNA, 12 bp, Homo sapiens
ggattctttaaa

SEQ ID NO: 1485584 - DNA, 16 bp, Homo sapiens
ggattctttccccaga

SEQ ID NO: 1485585 - DNA, 17 bp, Homo sapiens
ggattctttccccagag

SEQ ID NO: 1485586 - DNA, 20 bp, Homo sapiens
ggattctttgacatttggtg

SEQ ID NO: 1485587 - DNA, 19 bp, Homo sapiens
ggattgaggggccctggcc

SEQ ID NO: 1485588 - DNA, 16 bp, Homo sapiens
ggattgatcattcttt

SEQ ID NO: 1485589 - DNA, 20 bp, Homo sapiens
ggattgatcggagcctcctc

SEQ ID NO: 1485590 - DNA, 18 bp, Homo sapiens
ggattgattttaaaatgt

SEQ ID NO: 1485591 - DNA, 15 bp, Homo sapiens
ggattgcacgtggcc

SEQ ID NO: 1485592 - DNA, 18 bp, Homo sapiens
ggattgcacgtggcctct

SEQ ID NO: 1485593 - DNA, 23 bp, Homo sapiens
ggattgcccctggctttgcctct

SEQ ID NO: 1485594 - DNA, 18 bp, Homo sapiens
ggattgctctggagcagc

SEQ ID NO: 1485595 - DNA, 15 bp, Homo sapiens
ggattgctgccactt

SEQ ID NO: 1485596 - DNA, 17 bp, Homo sapiens
ggattgcttgagcccag

SEQ ID NO: 1485597 - DNA, 23 bp, Homo sapiens
ggattgctttgcattactgtccc

SEQ ID NO: 1485598 - DNA, 16 bp, Homo sapiens
ggattggaatgcagag

SEQ ID NO: 1485599 - DNA, 14 bp, Homo sapiens
ggattgggggctgg

SEQ ID NO: 1485600 - DNA, 23 bp, Homo sapiens
ggattgtggttccatgcagcctt

SEQ ID NO: 1485601 - DNA, 19 bp, Homo sapiens
ggatttaaaagcctgctca

SEQ ID NO: 1485602 - DNA, 20 bp, Homo sapiens
ggatttatctttaggccagg

SEQ ID NO: 1485603 - DNA, 20 bp, Homo sapiens
ggatttcactgtgttagcca

SEQ ID NO: 1485604 - DNA, 21 bp, Homo sapiens
ggatttctctaaccctatcct

SEQ ID NO: 1485605 - DNA, 19 bp, Homo sapiens
ggcactcaactctgagccc

SEQ ID NO: 1485606 - DNA, 20 bp, Homo sapiens
ggcactccaaacctgtcttg

SEQ ID NO: 1485607 - DNA, 22 bp, Homo sapiens
ggcactccgcgccgatgccacc

SEQ ID NO: 1485608 - DNA, 23 bp, Homo sapiens
ggcactccgcgccgatgccaccg

SEQ ID NO: 1485609 - DNA, 13 bp, Homo sapiens
ggcactctagatt

SEQ ID NO: 1485610 - DNA, 16 bp, Homo sapiens
ggcactgcccttttca

SEQ ID NO: 1485611 - DNA, 21 bp, Homo sapiens
ggcactgcccttttcaggaag

SEQ ID NO: 1485612 - DNA, 14 bp, Homo sapiens
ggcactggtgggcc

SEQ ID NO: 1485613 - DNA, 18 bp, Homo sapiens
ggcactgtagttctaaga

SEQ ID NO: 1485614 - DNA, 17 bp, Homo sapiens
ggcactgttagtgacag

SEQ ID NO: 1485615 - DNA, 17 bp, Homo sapiens
ggcacttaagtgcactt

SEQ ID NO: 1485616 - DNA, 17 bp, Homo sapiens
ggcacttagcccaagag

SEQ ID NO: 1485617 - DNA, 16 bp, Homo sapiens
ggcacttgcctgggtc

SEQ ID NO: 1485618 - DNA, 13 bp, Homo sapiens
ggcacttggagga

SEQ ID NO: 1485619 - DNA, 10 bp, Homo sapiens
ggcacttgta

SEQ ID NO: 1485620 - DNA, 17 bp, Homo sapiens
ggcacttgtatttaatt

SEQ ID NO: 1485621 - DNA, 22 bp, Homo sapiens
ggcactttgaaggggcctcacc

SEQ ID NO: 1485622 - DNA, 16 bp, Homo sapiens
ggcacttttttaaata

SEQ ID NO: 1485623 - DNA, 23 bp, Homo sapiens
ggcagaaaacggagagtgcttgg

SEQ ID NO: 1485624 - DNA, 17 bp, Homo sapiens
ggcagaaaagaggagac

SEQ ID NO: 1485625 - DNA, 21 bp, Homo sapiens
ggcagaaaagaggagaccctg

SEQ ID NO: 1485626 - DNA, 11 bp, Homo sapiens
ggcagaaaatt

SEQ ID NO: 1485627 - DNA, 23 bp, Homo sapiens
ggcagaagaattgaacccaggag

SEQ ID NO: 1485628 - DNA, 15 bp, Homo sapiens
ggcagaagactagag

SEQ ID NO: 1485629 - DNA, 22 bp, Homo sapiens
ggcagaagcattgcctggactg

SEQ ID NO: 1485630 - DNA, 15 bp, Homo sapiens
ggcagaagtgctctt

SEQ ID NO: 1485631 - DNA, 19 bp, Homo sapiens
ggcagacagcagctcaggc

SEQ ID NO: 1485632 - DNA, 16 bp, Homo sapiens
ggcagacccagtatga

SEQ ID NO: 1485633 - DNA, 16 bp, Homo sapiens
ggcagagccataatgg

SEQ ID NO: 1485634 - DNA, 13 bp, Homo sapiens
ggcagagccatgg

SEQ ID NO: 1485635 - DNA, 14 bp, Homo sapiens
ggcagagccatggg

SEQ ID NO: 1485636 - DNA, 24 bp, Homo sapiens
ggcagagccatgggcctgggcctg

SEQ ID NO: 1485637 - DNA, 16 bp, Homo sapiens
ggcagagctgagggcc

SEQ ID NO: 1485638 - DNA, 16 bp, Homo sapiens
ggcagagctggctctg

SEQ ID NO: 1485639 - DNA, 19 bp, Homo sapiens
ggcagagctggctctgagc

SEQ ID NO: 1485640 - DNA, 21 bp, Homo sapiens
ggcagagcttgcagtgagccg

SEQ ID NO: 1485641 - DNA, 13 bp, Homo sapiens
ggcagaggcctgg

SEQ ID NO: 1485642 - DNA, 17 bp, Homo sapiens
ggcagaggcctgggctg

SEQ ID NO: 1485643 - DNA, 13 bp, Homo sapiens
ggcagaggctgga

SEQ ID NO: 1485644 - DNA, 23 bp, Homo sapiens
ggcagaggctggaggcagggcct

SEQ ID NO: 1485645 - DNA, 20 bp, Homo sapiens
ggcagagggaatgttccctg

SEQ ID NO: 1485646 - DNA, 19 bp, Homo sapiens
ggcagagggcagaggctgg

SEQ ID NO: 1485647 - DNA, 20 bp, Homo sapiens
ggcagagggctggaggccca

SEQ ID NO: 1485648 - DNA, 18 bp, Homo sapiens
ggcagaggggcagccgct

SEQ ID NO: 1485649 - DNA, 20 bp, Homo sapiens
ggcagaggttgcagtgagcc

SEQ ID NO: 1485650 - DNA, 22 bp, Homo sapiens
ggcagaggttttaatgtctgtt

SEQ ID NO: 1485651 - DNA, 19 bp, Homo sapiens
ggcagagttacagttctgt

SEQ ID NO: 1485652 - DNA, 21 bp, Homo sapiens
ggcagagtttgtgtgttgtct

SEQ ID NO: 1485653 - DNA, 17 bp, Homo sapiens
ggcagataagttggagc

SEQ ID NO: 1485654 - DNA, 20 bp, Homo sapiens
ggcagatctgtgccccatgc

SEQ ID NO: 1485655 - DNA, 16 bp, Homo sapiens
ggcagatggagcccat

SEQ ID NO: 1485656 - DNA, 16 bp, Homo sapiens
ggcagattcccactgc

SEQ ID NO: 1485657 - DNA, 24 bp, Homo sapiens
ggcagatttagtgaaagctagaga

SEQ ID NO: 1485658 - DNA, 16 bp, Homo sapiens
ggcagattttacaaaa

SEQ ID NO: 1485659 - DNA, 16 bp, Homo sapiens
ggcagcaaagcagctg

SEQ ID NO: 1485660 - DNA, 12 bp, Homo sapiens
ggcagcaaggcc

SEQ ID NO: 1485661 - DNA, 13 bp, Homo sapiens
ggcagcaaggcct

SEQ ID NO: 1485662 - DNA, 21 bp, Homo sapiens
ggcagcaaggctgctgccgga

SEQ ID NO: 1485663 - DNA, 20 bp, Homo sapiens
ggcagcactccccagagctg

SEQ ID NO: 1485664 - DNA, 22 bp, Homo sapiens
ggcagcactccccagagctgtg

SEQ ID NO: 1485665 - DNA, 12 bp, Homo sapiens
ggcagcagagcg

SEQ ID NO: 1485666 - DNA, 12 bp, Homo sapiens
ggcagcagccat

SEQ ID NO: 1485667 - DNA, 13 bp, Homo sapiens
ggcagcagccatc

SEQ ID NO: 1485668 - DNA, 13 bp, Homo sapiens
ggcagcaggagga

SEQ ID NO: 1485669 - DNA, 17 bp, Homo sapiens
ggcagcatagcaagaca

SEQ ID NO: 1485670 - DNA, 19 bp, Homo sapiens
ggcagcatagcaagacaca

SEQ ID NO: 1485671 - DNA, 23 bp, Homo sapiens
ggcagcatgcttgggctgaccca

SEQ ID NO: 1485672 - DNA, 18 bp, Homo sapiens
ggcagccaaacccatgag

SEQ ID NO: 1485673 - DNA, 16 bp, Homo sapiens
ggcagccacaccactg

SEQ ID NO: 1485674 - DNA, 22 bp, Homo sapiens
ggcagccacccaagcctgctgg

SEQ ID NO: 1485675 - DNA, 14 bp, Homo sapiens
ggcagccacggccc

SEQ ID NO: 1485676 - DNA, 11 bp, Homo sapiens
ggcagccagac

SEQ ID NO: 1485677 - DNA, 12 bp, Homo sapiens
ggcagccagcag

SEQ ID NO: 1485678 - DNA, 13 bp, Homo sapiens
ggcagccagcaga

SEQ ID NO: 1485679 - DNA, 12 bp, Homo sapiens
ggcagccatgcc

SEQ ID NO: 1485680 - DNA, 14 bp, Homo sapiens
ggcagccatgcctc

SEQ ID NO: 1485681 - DNA, 15 bp, Homo sapiens
ggcagccatgcctca

SEQ ID NO: 1485682 - DNA, 15 bp, Homo sapiens
ggcagcccagagact

SEQ ID NO: 1485683 - DNA, 20 bp, Homo sapiens
ggcagccctcacctctgagg

SEQ ID NO: 1485684 - DNA, 22 bp, Homo sapiens
ggcagccctccacttctggtat

SEQ ID NO: 1485685 - DNA, 13 bp, Homo sapiens
ggcagccctgtag

SEQ ID NO: 1485686 - DNA, 13 bp, Homo sapiens
ggcagccgagctc

SEQ ID NO: 1485687 - DNA, 15 bp, Homo sapiens
ggcagccgtcccagg

SEQ ID NO: 1485688 - DNA, 19 bp, Homo sapiens
ggcagccgtcccaggccac

SEQ ID NO: 1485689 - DNA, 22 bp, Homo sapiens
ggcagccgtgccttcagctcta

SEQ ID NO: 1485690 - DNA, 22 bp, Homo sapiens
ggcagcctccaccttgctcttc

SEQ ID NO: 1485691 - DNA, 19 bp, Homo sapiens
ggcagcctccagagccagc

SEQ ID NO: 1485692 - DNA, 20 bp, Homo sapiens
ggcagcctccagagccagcc

SEQ ID NO: 1485693 - DNA, 21 bp, Homo sapiens
ggcagcctggctcccaggaca

SEQ ID NO: 1485694 - DNA, 22 bp, Homo sapiens
ggcagcctggctcccaggacac

SEQ ID NO: 1485695 - DNA, 12 bp, Homo sapiens
ggcagcgacccc

SEQ ID NO: 1485696 - DNA, 23 bp, Homo sapiens
ggcagcgacctcaagtgtcctga

SEQ ID NO: 1485697 - DNA, 18 bp, Homo sapiens
ggcagcgcatgtgtgcat

SEQ ID NO: 1485698 - DNA, 13 bp, Homo sapiens
ggcagcgggccag

SEQ ID NO: 1485699 - DNA, 17 bp, Homo sapiens
ggcagcgggccaggccc

SEQ ID NO: 1485700 - DNA, 13 bp, Homo sapiens
ggcagcgggcgga

SEQ ID NO: 1485701 - DNA, 19 bp, Homo sapiens
ggcagcgttagggctgctt

SEQ ID NO: 1485702 - DNA, 15 bp, Homo sapiens
ggcagctataggaaa

SEQ ID NO: 1485703 - DNA, 14 bp, Homo sapiens
ggcagctcctctcc

SEQ ID NO: 1485704 - DNA, 18 bp, Homo sapiens
ggcagctgagagccctgc

SEQ ID NO: 1485705 - DNA, 22 bp, Homo sapiens
ggcagctgagagccctgctgtg

SEQ ID NO: 1485706 - DNA, 18 bp, Homo sapiens
ggcagctgcctctgctcc

SEQ ID NO: 1485707 - DNA, 22 bp, Homo sapiens
ggcagctgcctctgctccctct

SEQ ID NO: 1485708 - DNA, 11 bp, Homo sapiens
ggcagctgcta

SEQ ID NO: 1485709 - DNA, 12 bp, Homo sapiens
ggcagctgctct

SEQ ID NO: 1485710 - DNA, 22 bp, Homo sapiens
ggcagctgctcttagtgcccgc

SEQ ID NO: 1485711 - DNA, 12 bp, Homo sapiens
ggcagctgggcc

SEQ ID NO: 1485712 - DNA, 19 bp, Homo sapiens
ggcagctggggagcagctg

SEQ ID NO: 1485713 - DNA, 20 bp, Homo sapiens
ggcagctggggggctgtcct

SEQ ID NO: 1485714 - DNA, 21 bp, Homo sapiens
ggcagctggggggctgtcctg

SEQ ID NO: 1485715 - DNA, 21 bp, Homo sapiens
ggcagcttaacattgacttct

SEQ ID NO: 1485716 - DNA, 15 bp, Homo sapiens
ggcaggaacaaacag

SEQ ID NO: 1485717 - DNA, 23 bp, Homo sapiens
ggcaggaagcccaattgctggag

SEQ ID NO: 1485718 - DNA, 21 bp, Homo sapiens
ggcaggacacatcccggcctc

SEQ ID NO: 1485719 - DNA, 20 bp, Homo sapiens
ggcaggaccgccatggtgct

SEQ ID NO: 1485720 - DNA, 16 bp, Homo sapiens
ggccagagctggaagg

SEQ ID NO: 1485721 - DNA, 18 bp, Homo sapiens
ggccagaggcccccagcc

SEQ ID NO: 1485722 - DNA, 15 bp, Homo sapiens
ggccagagggcagtg

SEQ ID NO: 1485723 - DNA, 18 bp, Homo sapiens
ggccagagtggcctggcc

SEQ ID NO: 1485724 - DNA, 19 bp, Homo sapiens
ggccagagtggcctggcca

SEQ ID NO: 1485725 - DNA, 16 bp, Homo sapiens
ggccagatccagcctg

SEQ ID NO: 1485726 - DNA, 20 bp, Homo sapiens
ggccagatgttgttcctggc

SEQ ID NO: 1485727 - DNA, 12 bp, Homo sapiens
ggccagcaggct

SEQ ID NO: 1485728 - DNA, 12 bp, Homo sapiens
ggccagccaggc

SEQ ID NO: 1485729 - DNA, 14 bp, Homo sapiens
ggccagccaggcgg

SEQ ID NO: 1485730 - DNA, 17 bp, Homo sapiens
ggccagcccagccaggc

SEQ ID NO: 1485731 - DNA, 15 bp, Homo sapiens
ggccagccccaccca

SEQ ID NO: 1485732 - DNA, 14 bp, Homo sapiens
ggccagcccggctg

SEQ ID NO: 1485733 - DNA, 18 bp, Homo sapiens
ggccagcccggctggttt

SEQ ID NO: 1485734 - DNA, 22 bp, Homo sapiens
ggccagccctccctggctgtga

SEQ ID NO: 1485735 - DNA, 19 bp, Homo sapiens
ggccagccctgcagcccaa

SEQ ID NO: 1485736 - DNA, 19 bp, Homo sapiens
ggccagcctccgagaggga

SEQ ID NO: 1485737 - DNA, 22 bp, Homo sapiens
ggccagcctccgagagggagag

SEQ ID NO: 1485738 - DNA, 15 bp, Homo sapiens
ggccagcgggcacag

SEQ ID NO: 1485739 - DNA, 19 bp, Homo sapiens
ggccagcgggcacagggca

SEQ ID NO: 1485740 - DNA, 14 bp, Homo sapiens
ggccagcgtcccag

SEQ ID NO: 1485741 - DNA, 17 bp, Homo sapiens
ggccagcgtcccagggt

SEQ ID NO: 1485742 - DNA, 19 bp, Homo sapiens
ggccagcgtcccagggtac

SEQ ID NO: 1485743 - DNA, 21 bp, Homo sapiens
ggccaggagcaggcacgggtg

SEQ ID NO: 1485744 - DNA, 15 bp, Homo sapiens
ggccaggagctcttc

SEQ ID NO: 1485745 - DNA, 12 bp, Homo sapiens
ggccaggcacag

SEQ ID NO: 1485746 - DNA, 22 bp, Homo sapiens
ggccaggcagatctgtgcccca

SEQ ID NO: 1485747 - DNA, 20 bp, Homo sapiens
ggccaggcaggagcccttct

SEQ ID NO: 1485748 - DNA, 16 bp, Homo sapiens
ggccaggccctgggtc

SEQ ID NO: 1485749 - DNA, 14 bp, Homo sapiens
ggccaggctgcctc

SEQ ID NO: 1485750 - DNA, 23 bp, Homo sapiens
ggccagggaaacaaagtttacat

SEQ ID NO: 1485751 - DNA, 19 bp, Homo sapiens
ggccagggcagcaagggac

SEQ ID NO: 1485752 - DNA, 20 bp, Homo sapiens
ggccagggccacgctccagc

SEQ ID NO: 1485753 - DNA, 13 bp, Homo sapiens
ggccagggccctg

SEQ ID NO: 1485754 - DNA, 18 bp, Homo sapiens
ggccagggccctgcagag

SEQ ID NO: 1485755 - DNA, 21 bp, Homo sapiens
ggccagggctcaccagctggg

SEQ ID NO: 1485756 - DNA, 15 bp, Homo sapiens
ggccagtccccgagg

SEQ ID NO: 1485757 - DNA, 18 bp, Homo sapiens
ggccagtcctgcctggcc

SEQ ID NO: 1485758 - DNA, 19 bp, Homo sapiens
ggccagtcctgcctggcca

SEQ ID NO: 1485759 - DNA, 20 bp, Homo sapiens
ggccagtcctgcctggccag

SEQ ID NO: 1485760 - DNA, 20 bp, Homo sapiens
ggccagtcctggtcctggct

SEQ ID NO: 1485761 - DNA, 14 bp, Homo sapiens
ggccagtggctggg

SEQ ID NO: 1485762 - DNA, 19 bp, Homo sapiens
ggccagtgtttaaaacttc

SEQ ID NO: 1485763 - DNA, 24 bp, Homo sapiens
ggccagtttatatactgctattta

SEQ ID NO: 1485764 - DNA, 12 bp, Homo sapiens
ggccagttttct

SEQ ID NO: 1485765 - DNA, 14 bp, Homo sapiens
ggccatactgcctt

SEQ ID NO: 1485766 - DNA, 13 bp, Homo sapiens
ggccatagaggcc

SEQ ID NO: 1485767 - DNA, 15 bp, Homo sapiens
ggccatagaggccca

SEQ ID NO: 1485768 - DNA, 16 bp, Homo sapiens
ggccatagaggcccag

SEQ ID NO: 1485769 - DNA, 18 bp, Homo sapiens
ggccatagaggcccaggc

SEQ ID NO: 1485770 - DNA, 11 bp, Homo sapiens
ggccatccact

SEQ ID NO: 1485771 - DNA, 16 bp, Homo sapiens
ggccatctccttcacc

SEQ ID NO: 1485772 - DNA, 21 bp, Homo sapiens
ggccatctgactgccaagcca

SEQ ID NO: 1485773 - DNA, 23 bp, Homo sapiens
ggccatctgactgccaagccaga

SEQ ID NO: 1485774 - DNA, 15 bp, Homo sapiens
ggccatgcaggaggt

SEQ ID NO: 1485775 - DNA, 23 bp, Homo sapiens
ggccatgcaggaggtggagaaaa

SEQ ID NO: 1485776 - DNA, 14 bp, Homo sapiens
ggccatgcctgccc

SEQ ID NO: 1485777 - DNA, 14 bp, Homo sapiens
ggccatgtgagcca

SEQ ID NO: 1485778 - DNA, 13 bp, Homo sapiens
ggccattcttatg

SEQ ID NO: 1485779 - DNA, 18 bp, Homo sapiens
ggccatttgctagttctg

SEQ ID NO: 1485780 - DNA, 19 bp, Homo sapiens
ggcccaagagatgaagagt

SEQ ID NO: 1485781 - DNA, 18 bp, Homo sapiens
ggcccaaggagcttaccc

SEQ ID NO: 1485782 - DNA, 13 bp, Homo sapiens
ggcccacagctcc

SEQ ID NO: 1485783 - DNA, 14 bp, Homo sapiens
ggcccacagctccc

SEQ ID NO: 1485784 - DNA, 22 bp, Homo sapiens
ggcccacaggaagctcagcctt

SEQ ID NO: 1485785 - DNA, 14 bp, Homo sapiens
ggcccaccagggtc

SEQ ID NO: 1485786 - DNA, 22 bp, Homo sapiens
ggcccaccatcaccaccgcctc

SEQ ID NO: 1485787 - DNA, 13 bp, Homo sapiens
ggcccacccacat

SEQ ID NO: 1485788 - DNA, 23 bp, Homo sapiens
ggcccacccacatgacttttcca

SEQ ID NO: 1485789 - DNA, 22 bp, Homo sapiens
ggcccacccagtccatgctcca

SEQ ID NO: 1485790 - DNA, 18 bp, Homo sapiens
ggcccacccggtgggacc

SEQ ID NO: 1485791 - DNA, 16 bp, Homo sapiens
ggcccacctggccacc

SEQ ID NO: 1485792 - DNA, 12 bp, Homo sapiens
ggcccacgcacg

SEQ ID NO: 1485793 - DNA, 22 bp, Homo sapiens
ggcccacgcacgacgtcagcct

SEQ ID NO: 1485794 - DNA, 23 bp, Homo sapiens
ggcccacgcacgacgtcagcctc

SEQ ID NO: 1485795 - DNA, 22 bp, Homo sapiens
ggcccacgccctccctctccca

SEQ ID NO: 1485796 - DNA, 13 bp, Homo sapiens
ggcccactagagg

SEQ ID NO: 1485797 - DNA, 15 bp, Homo sapiens
ggcccactagagggc

SEQ ID NO: 1485798 - DNA, 17 bp, Homo sapiens
ggcccactccccagccc

SEQ ID NO: 1485799 - DNA, 21 bp, Homo sapiens
ggcccactgtgcctcagagac

SEQ ID NO: 1485800 - DNA, 16 bp, Homo sapiens
ggcccactttcctgag

SEQ ID NO: 1485801 - DNA, 18 bp, Homo sapiens
ggcccactttcctgagct

SEQ ID NO: 1485802 - DNA, 17 bp, Homo sapiens
ggcccagaagtttccct

SEQ ID NO: 1485803 - DNA, 15 bp, Homo sapiens
ggcccagaccctggg

SEQ ID NO: 1485804 - DNA, 16 bp, Homo sapiens
ggcccagaccctgggc

SEQ ID NO: 1485805 - DNA, 17 bp, Homo sapiens
ggcccagaccctgggca

SEQ ID NO: 1485806 - DNA, 16 bp, Homo sapiens
ggcccagagcccagct

SEQ ID NO: 1485807 - DNA, 17 bp, Homo sapiens
ggcccagagcccagctc

SEQ ID NO: 1485808 - DNA, 18 bp, Homo sapiens
ggcccagagcccagctcc

SEQ ID NO: 1485809 - DNA, 18 bp, Homo sapiens
ggcccagagcgaggaaag

SEQ ID NO: 1485810 - DNA, 20 bp, Homo sapiens
ggcccagagcgaggaaagga

SEQ ID NO: 1485811 - DNA, 22 bp, Homo sapiens
ggcccagaggagctgggagccg

SEQ ID NO: 1485812 - DNA, 20 bp, Homo sapiens
ggcccagagtgaaccgtcct

SEQ ID NO: 1485813 - DNA, 14 bp, Homo sapiens
ggcccagcatgcag

SEQ ID NO: 1485814 - DNA, 17 bp, Homo sapiens
ggcccagcattgctggt

SEQ ID NO: 1485815 - DNA, 13 bp, Homo sapiens
ggcccagccagga

SEQ ID NO: 1485816 - DNA, 16 bp, Homo sapiens
ggcccagccggcctct

SEQ ID NO: 1485817 - DNA, 17 bp, Homo sapiens
ggcccagccggcctctc

SEQ ID NO: 1485818 - DNA, 19 bp, Homo sapiens
ggcccagccggcctctctg

SEQ ID NO: 1485819 - DNA, 22 bp, Homo sapiens
ggcccagccggcctctctggcc

SEQ ID NO: 1485820 - DNA, 16 bp, Homo sapiens
ggcccagcgacctcgg

SEQ ID NO: 1485821 - DNA, 16 bp, Homo sapiens
ggcccagcgcggccag

SEQ ID NO: 1485822 - DNA, 21 bp, Homo sapiens
ggcccagcgcggccagcgtcc

SEQ ID NO: 1485823 - DNA, 15 bp, Homo sapiens
ggcccagcgctctcc

SEQ ID NO: 1485824 - DNA, 17 bp, Homo sapiens
ggcccagcgctctcctg

SEQ ID NO: 1485825 - DNA, 22 bp, Homo sapiens
ggcccagcgctctcctggacgc

SEQ ID NO: 1485826 - DNA, 11 bp, Homo sapiens
ggcccagctga

SEQ ID NO: 1485827 - DNA, 15 bp, Homo sapiens
ggcccagctgggctc

SEQ ID NO: 1485828 - DNA, 16 bp, Homo sapiens
ggcccagctgtagcca

SEQ ID NO: 1485829 - DNA, 18 bp, Homo sapiens
ggcccagctgtagccatg

SEQ ID NO: 1485830 - DNA, 20 bp, Homo sapiens
ggcccaggagacctccagct

SEQ ID NO: 1485831 - DNA, 15 bp, Homo sapiens
ggcccaggagctctg

SEQ ID NO: 1485832 - DNA, 17 bp, Homo sapiens
ggcccaggagctctgcg

SEQ ID NO: 1485833 - DNA, 13 bp, Homo sapiens
ggcccaggcaggt

SEQ ID NO: 1485834 - DNA, 15 bp, Homo sapiens
ggcccaggcaggtct

SEQ ID NO: 1485835 - DNA, 13 bp, Homo sapiens
ggccctcccttgg

SEQ ID NO: 1485836 - DNA, 23 bp, Homo sapiens
ggccctcccttggaaacctgccc

SEQ ID NO: 1485837 - DNA, 20 bp, Homo sapiens
ggccctcggaggtccagctg

SEQ ID NO: 1485838 - DNA, 23 bp, Homo sapiens
ggccctctgcctgcactccctgg

SEQ ID NO: 1485839 - DNA, 18 bp, Homo sapiens
ggccctgacttctggaga

SEQ ID NO: 1485840 - DNA, 15 bp, Homo sapiens
ggccctgaggtgtgg

SEQ ID NO: 1485841 - DNA, 18 bp, Homo sapiens
ggccctgaggtgtggggg

SEQ ID NO: 1485842 - DNA, 19 bp, Homo sapiens
ggccctgaggtgtgggggc

SEQ ID NO: 1485843 - DNA, 21 bp, Homo sapiens
ggccctgaggtgtgggggctg

SEQ ID NO: 1485844 - DNA, 13 bp, Homo sapiens
ggccctgagtcct

SEQ ID NO: 1485845 - DNA, 18 bp, Homo sapiens
ggccctgcacctgtgcag

SEQ ID NO: 1485846 - DNA, 17 bp, Homo sapiens
ggccctgcagccagctc

SEQ ID NO: 1485847 - DNA, 18 bp, Homo sapiens
ggccctgcattggcctgg

SEQ ID NO: 1485848 - DNA, 11 bp, Homo sapiens
ggccctgcccc

SEQ ID NO: 1485849 - DNA, 17 bp, Homo sapiens
ggccctgccccacccca

SEQ ID NO: 1485850 - DNA, 9 bp, Homo sapiens
ggccctgct

SEQ ID NO: 1485851 - DNA, 14 bp, Homo sapiens
ggccctgctacctg

SEQ ID NO: 1485852 - DNA, 15 bp, Homo sapiens
ggccctgcttcctgc

SEQ ID NO: 1485853 - DNA, 16 bp, Homo sapiens
ggccctgcttcctgct

SEQ ID NO: 1485854 - DNA, 11 bp, Homo sapiens
ggccctggagc

SEQ ID NO: 1485855 - DNA, 16 bp, Homo sapiens
ggccctggagccaggg

SEQ ID NO: 1485856 - DNA, 13 bp, Homo sapiens
ggccctggcctcc

SEQ ID NO: 1485857 - DNA, 16 bp, Homo sapiens
ggccctggcctgctgg

SEQ ID NO: 1485858 - DNA, 22 bp, Homo sapiens
ggccctggctcccacaggccct

SEQ ID NO: 1485859 - DNA, 11 bp, Homo sapiens
ggccctggctt

SEQ ID NO: 1485860 - DNA, 14 bp, Homo sapiens
ggccctggcttgga

SEQ ID NO: 1485861 - DNA, 12 bp, Homo sapiens
ggccctgggctg

SEQ ID NO: 1485862 - DNA, 13 bp, Homo sapiens
ggccctgggctga

SEQ ID NO: 1485863 - DNA, 14 bp, Homo sapiens
ggccctgggctgga

SEQ ID NO: 1485864 - DNA, 15 bp, Homo sapiens
ggccctgggctggaa

SEQ ID NO: 1485865 - DNA, 20 bp, Homo sapiens
ggccctggttcctgctgtcc

SEQ ID NO: 1485866 - DNA, 19 bp, Homo sapiens
ggccctgtcagagccgcca

SEQ ID NO: 1485867 - DNA, 19 bp, Homo sapiens
ggccctgtcatccagctca

SEQ ID NO: 1485868 - DNA, 12 bp, Homo sapiens
ggccctgtgcct

SEQ ID NO: 1485869 - DNA, 20 bp, Homo sapiens
ggccctgtgcctgggccctg

SEQ ID NO: 1485870 - DNA, 14 bp, Homo sapiens
ggccctgtgtgcag

SEQ ID NO: 1485871 - DNA, 15 bp, Homo sapiens
ggccctgtgtgcagg

SEQ ID NO: 1485872 - DNA, 15 bp, Homo sapiens
ggccctgttccctgg

SEQ ID NO: 1485873 - DNA, 19 bp, Homo sapiens
ggccctgttctcctcccca

SEQ ID NO: 1485874 - DNA, 18 bp, Homo sapiens
ggcccttcagtctgctcc

SEQ ID NO: 1485875 - DNA, 22 bp, Homo sapiens
ggcccttcagtctgctccacca

SEQ ID NO: 1485876 - DNA, 15 bp, Homo sapiens
ggcccttcctctcca

SEQ ID NO: 1485877 - DNA, 18 bp, Homo sapiens
ggcccttcctctccactg

SEQ ID NO: 1485878 - DNA, 18 bp, Homo sapiens
ggcccttctgactgttta

SEQ ID NO: 1485879 - DNA, 19 bp, Homo sapiens
ggcccttctgactgtttat

SEQ ID NO: 1485880 - DNA, 16 bp, Homo sapiens
ggcccttggctgcagg

SEQ ID NO: 1485881 - DNA, 17 bp, Homo sapiens
ggcccttggggcctggc

SEQ ID NO: 1485882 - DNA, 19 bp, Homo sapiens
ggcccttggggcctggctt

SEQ ID NO: 1485883 - DNA, 20 bp, Homo sapiens
ggcccttggggcctggcttg

SEQ ID NO: 1485884 - DNA, 14 bp, Homo sapiens
ggcccttgtcctgc

SEQ ID NO: 1485885 - DNA, 22 bp, Homo sapiens
ggcccttgtcctgccagctgcc

SEQ ID NO: 1485886 - DNA, 11 bp, Homo sapiens
ggccctttcct

SEQ ID NO: 1485887 - DNA, 19 bp, Homo sapiens
ggccgaagccccttggaga

SEQ ID NO: 1485888 - DNA, 17 bp, Homo sapiens
ggccgaaggtgcctcag

SEQ ID NO: 1485889 - DNA, 19 bp, Homo sapiens
ggccgaaggtgcctcagac

SEQ ID NO: 1485890 - DNA, 13 bp, Homo sapiens
ggccgaccaggct

SEQ ID NO: 1485891 - DNA, 19 bp, Homo sapiens
ggccgaccaggctggacac

SEQ ID NO: 1485892 - DNA, 13 bp, Homo sapiens
ggccgaggacttt

SEQ ID NO: 1485893 - DNA, 21 bp, Homo sapiens
ggccgcaccatttctgtcact

SEQ ID NO: 1485894 - DNA, 16 bp, Homo sapiens
ggccgcacgcctctcc

SEQ ID NO: 1485895 - DNA, 20 bp, Homo sapiens
ggccgcagctcttgcccttc

SEQ ID NO: 1485896 - DNA, 22 bp, Homo sapiens
ggccgcagctcttgcccttccc

SEQ ID NO: 1485897 - DNA, 13 bp, Homo sapiens
ggccgccaccccc

SEQ ID NO: 1485898 - DNA, 18 bp, Homo sapiens
ggccgccacccccatctt

SEQ ID NO: 1485899 - DNA, 15 bp, Homo sapiens
ggccgccacggcctg

SEQ ID NO: 1485900 - DNA, 16 bp, Homo sapiens
ggccgccagcgtgtgg

SEQ ID NO: 1485901 - DNA, 19 bp, Homo sapiens
ggccgccagcgtgtggagc

SEQ ID NO: 1485902 - DNA, 21 bp, Homo sapiens
ggccgccagcgtgtggagcag

SEQ ID NO: 1485903 - DNA, 22 bp, Homo sapiens
ggccgcccacccgcccgaggga

SEQ ID NO: 1485904 - DNA, 18 bp, Homo sapiens
ggccgccccctgcccccc

SEQ ID NO: 1485905 - DNA, 14 bp, Homo sapiens
ggccgcccctgagg

SEQ ID NO: 1485906 - DNA, 16 bp, Homo sapiens
ggccgccgccaggact

SEQ ID NO: 1485907 - DNA, 20 bp, Homo sapiens
ggccgccgctgaccctgggc

SEQ ID NO: 1485908 - DNA, 15 bp, Homo sapiens
ggccgcctccaggag

SEQ ID NO: 1485909 - DNA, 22 bp, Homo sapiens
ggccgcgccaaataatgtctct

SEQ ID NO: 1485910 - DNA, 13 bp, Homo sapiens
ggccgcggccgcc

SEQ ID NO: 1485911 - DNA, 14 bp, Homo sapiens
ggccgctccaccag

SEQ ID NO: 1485912 - DNA, 16 bp, Homo sapiens
ggccgctgccccagcc

SEQ ID NO: 1485913 - DNA, 18 bp, Homo sapiens
ggccgctgccccagcccc

SEQ ID NO: 1485914 - DNA, 22 bp, Homo sapiens
ggccgctggctggtgggccccc

SEQ ID NO: 1485915 - DNA, 13 bp, Homo sapiens
ggccgctggggtc

SEQ ID NO: 1485916 - DNA, 16 bp, Homo sapiens
ggccgctgttcaccca

SEQ ID NO: 1485917 - DNA, 19 bp, Homo sapiens
ggccggacgcaggtgctgc

SEQ ID NO: 1485918 - DNA, 12 bp, Homo sapiens
ggccggccctgg

SEQ ID NO: 1485919 - DNA, 18 bp, Homo sapiens
ggccggccctggcttgga

SEQ ID NO: 1485920 - DNA, 15 bp, Homo sapiens
ggccggccctgtgtg

SEQ ID NO: 1485921 - DNA, 13 bp, Homo sapiens
ggccggctgagtg

SEQ ID NO: 1485922 - DNA, 14 bp, Homo sapiens
ggccgggctgctgc

SEQ ID NO: 1485923 - DNA, 18 bp, Homo sapiens
ggccgggctgtagatcag

SEQ ID NO: 1485924 - DNA, 18 bp, Homo sapiens
ggccggtgctgggttccc

SEQ ID NO: 1485925 - DNA, 15 bp, Homo sapiens
ggccggtgtgggctg

SEQ ID NO: 1485926 - DNA, 22 bp, Homo sapiens
ggccgtaccccaccctcagcac

SEQ ID NO: 1485927 - DNA, 19 bp, Homo sapiens
ggccgtaggggctcctgag

SEQ ID NO: 1485928 - DNA, 15 bp, Homo sapiens
ggccgtcctcccggg

SEQ ID NO: 1485929 - DNA, 23 bp, Homo sapiens
ggccgtctcccttggcccagaga

SEQ ID NO: 1485930 - DNA, 15 bp, Homo sapiens
ggccgtctcctccct

SEQ ID NO: 1485931 - DNA, 15 bp, Homo sapiens
ggccgtgaggacacg

SEQ ID NO: 1485932 - DNA, 15 bp, Homo sapiens
ggccgtgcccttgcc

SEQ ID NO: 1485933 - DNA, 18 bp, Homo sapiens
ggccgtggtccagctctt

SEQ ID NO: 1485934 - DNA, 14 bp, Homo sapiens
ggccgttcagcctg

SEQ ID NO: 1485935 - DNA, 23 bp, Homo sapiens
ggcctaagacatgtgaggaggaa

SEQ ID NO: 1485936 - DNA, 23 bp, Homo sapiens
ggcctacagctttgatccctgac

SEQ ID NO: 1485937 - DNA, 20 bp, Homo sapiens
ggcctaccccgcagacacct

SEQ ID NO: 1485938 - DNA, 23 bp, Homo sapiens
ggcctaccccgcagacaccttgg

SEQ ID NO: 1485939 - DNA, 17 bp, Homo sapiens
ggcctagatccacacac

SEQ ID NO: 1485940 - DNA, 21 bp, Homo sapiens
ggcctagcgatctctcctggc

SEQ ID NO: 1485941 - DNA, 13 bp, Homo sapiens
ggcctcacccacc

SEQ ID NO: 1485942 - DNA, 18 bp, Homo sapiens
ggcctcacccacccctgc

SEQ ID NO: 1485943 - DNA, 19 bp, Homo sapiens
ggcctcaccgagtgggggc

SEQ ID NO: 1485944 - DNA, 13 bp, Homo sapiens
ggcctcactggct

SEQ ID NO: 1485945 - DNA, 14 bp, Homo sapiens
ggcctcactggctg

SEQ ID NO: 1485946 - DNA, 13 bp, Homo sapiens
ggcctcagctgcc

SEQ ID NO: 1485947 - DNA, 16 bp, Homo sapiens
ggcctcagctgcctca

SEQ ID NO: 1485948 - DNA, 22 bp, Homo sapiens
ggcctcagctgcctcacttcct

SEQ ID NO: 1485949 - DNA, 22 bp, Homo sapiens
ggcctcaggcgtttctgaagtg

SEQ ID NO: 1485950 - DNA, 14 bp, Homo sapiens
ggcctggcctgagc

SEQ ID NO: 1485951 - DNA, 18 bp, Homo sapiens
ggcctggcttgctccagg

SEQ ID NO: 1485952 - DNA, 15 bp, Homo sapiens
ggcctgggccacacc

SEQ ID NO: 1485953 - DNA, 18 bp, Homo sapiens
ggcctgggcctcatggct

SEQ ID NO: 1485954 - DNA, 14 bp, Homo sapiens
ggcctgggcctgct

SEQ ID NO: 1485955 - DNA, 15 bp, Homo sapiens
ggcctgggcctgctt

SEQ ID NO: 1485956 - DNA, 18 bp, Homo sapiens
ggcctggggctcctttct

SEQ ID NO: 1485957 - DNA, 22 bp, Homo sapiens
ggcctgggggacccctggctct

SEQ ID NO: 1485958 - DNA, 21 bp, Homo sapiens
ggcctgggtgctggctgccca

SEQ ID NO: 1485959 - DNA, 16 bp, Homo sapiens
ggcctggtccctggtc

SEQ ID NO: 1485960 - DNA, 14 bp, Homo sapiens
ggcctggtccctgt

SEQ ID NO: 1485961 - DNA, 23 bp, Homo sapiens
ggcctgtatcctccctggcagac

SEQ ID NO: 1485962 - DNA, 13 bp, Homo sapiens
ggcctgtccccca

SEQ ID NO: 1485963 - DNA, 17 bp, Homo sapiens
ggcctgtcccccaaggt

SEQ ID NO: 1485964 - DNA, 19 bp, Homo sapiens
ggcctgtcccttgcctctg

SEQ ID NO: 1485965 - DNA, 20 bp, Homo sapiens
ggcctgtcccttgcctctgc

SEQ ID NO: 1485966 - DNA, 21 bp, Homo sapiens
ggcctgtcccttgcctctgcc

SEQ ID NO: 1485967 - DNA, 17 bp, Homo sapiens
ggcctgtctcatcccca

SEQ ID NO: 1485968 - DNA, 18 bp, Homo sapiens
ggcctgtctcatccccag

SEQ ID NO: 1485969 - DNA, 20 bp, Homo sapiens
ggcctgtctcatccccaggg

SEQ ID NO: 1485970 - DNA, 23 bp, Homo sapiens
ggcctgtctcatccccaggggtc

SEQ ID NO: 1485971 - DNA, 22 bp, Homo sapiens
ggcctgtctcatcttctgaaga

SEQ ID NO: 1485972 - DNA, 20 bp, Homo sapiens
ggcctgtgcagcagcccagc

SEQ ID NO: 1485973 - DNA, 17 bp, Homo sapiens
ggcctgtgctgggccag

SEQ ID NO: 1485974 - DNA, 21 bp, Homo sapiens
ggcctgtgctgggccagtggc

SEQ ID NO: 1485975 - DNA, 21 bp, Homo sapiens
ggcctgtggcacagccctgag

SEQ ID NO: 1485976 - DNA, 18 bp, Homo sapiens
ggcctgtggcctgtgtcc

SEQ ID NO: 1485977 - DNA, 21 bp, Homo sapiens
ggcctgtgggtctctgaaggg

SEQ ID NO: 1485978 - DNA, 15 bp, Homo sapiens
ggcctgtgtccagca

SEQ ID NO: 1485979 - DNA, 21 bp, Homo sapiens
ggcctgtgtcccatgacccac

SEQ ID NO: 1485980 - DNA, 22 bp, Homo sapiens
ggcctgtgtcccatgacccacc

SEQ ID NO: 1485981 - DNA, 14 bp, Homo sapiens
ggcctgttctcttg

SEQ ID NO: 1485982 - DNA, 22 bp, Homo sapiens
ggccttaaaaggggcccaagcc

SEQ ID NO: 1485983 - DNA, 17 bp, Homo sapiens
ggccttaacacactggc

SEQ ID NO: 1485984 - DNA, 13 bp, Homo sapiens
ggccttaagaact

SEQ ID NO: 1485985 - DNA, 21 bp, Homo sapiens
ggccttaggggtcatgtatga

SEQ ID NO: 1485986 - DNA, 17 bp, Homo sapiens
ggccttattgcatccca

SEQ ID NO: 1485987 - DNA, 12 bp, Homo sapiens
ggccttcacaat

SEQ ID NO: 1485988 - DNA, 15 bp, Homo sapiens
ggccttccagctgct

SEQ ID NO: 1485989 - DNA, 16 bp, Homo sapiens
ggccttccccagcctc

SEQ ID NO: 1485990 - DNA, 18 bp, Homo sapiens
ggccttgaagactccctg

SEQ ID NO: 1485991 - DNA, 16 bp, Homo sapiens
ggccttgcagctggcc

SEQ ID NO: 1485992 - DNA, 13 bp, Homo sapiens
ggccttgcccaga

SEQ ID NO: 1485993 - DNA, 15 bp, Homo sapiens
ggccttgcccagaga

SEQ ID NO: 1485994 - DNA, 14 bp, Homo sapiens
ggccttgcccgtcg

SEQ ID NO: 1485995 - DNA, 22 bp, Homo sapiens
ggccttggatcgctaagctggc

SEQ ID NO: 1485996 - DNA, 22 bp, Homo sapiens
ggccttggtggagcagccagag

SEQ ID NO: 1485997 - DNA, 18 bp, Homo sapiens
ggccttgtgtgtcaggcc

SEQ ID NO: 1485998 - DNA, 23 bp, Homo sapiens
ggccttgtgtgtcaggccctctg

SEQ ID NO: 1485999 - DNA, 12 bp, Homo sapiens
ggcctttcttct

SEQ ID NO: 1486000 - DNA, 14 bp, Homo sapiens
ggcctttcttctgt

SEQ ID NO: 1486001 - DNA, 15 bp, Homo sapiens
ggcctttcttctgtg

SEQ ID NO: 1486002 - DNA, 17 bp, Homo sapiens
ggcctttcttggggaga

SEQ ID NO: 1486003 - DNA, 23 bp, Homo sapiens
ggcctttgcttatgaatatttat

SEQ ID NO: 1486004 - DNA, 16 bp, Homo sapiens
ggccttttctggcacc

SEQ ID NO: 1486005 - DNA, 17 bp, Homo sapiens
ggccttttctggcaccg

SEQ ID NO: 1486006 - DNA, 13 bp, Homo sapiens
ggcgaagatggtc

SEQ ID NO: 1486007 - DNA, 13 bp, Homo sapiens
ggcgaatctcaaa

SEQ ID NO: 1486008 - DNA, 17 bp, Homo sapiens
ggcgacaaaatctcctg

SEQ ID NO: 1486009 - DNA, 23 bp, Homo sapiens
ggcgacagagcgagagtctgtct

SEQ ID NO: 1486010 - DNA, 15 bp, Homo sapiens
ggcgactctgcagag

SEQ ID NO: 1486011 - DNA, 19 bp, Homo sapiens
ggcgagaaggggaaaaatg

SEQ ID NO: 1486012 - DNA, 21 bp, Homo sapiens
ggcgagcatgggggctgccag

SEQ ID NO: 1486013 - DNA, 18 bp, Homo sapiens
ggcgcaaaggtgcctcat

SEQ ID NO: 1486014 - DNA, 15 bp, Homo sapiens
ggcgcagagccctcc

SEQ ID NO: 1486015 - DNA, 15 bp, Homo sapiens
ggcgcagccaaggcc

SEQ ID NO: 1486016 - DNA, 17 bp, Homo sapiens
ggcgcagccaaggccga

SEQ ID NO: 1486017 - DNA, 14 bp, Homo sapiens
ggcgcaggtgggct

SEQ ID NO: 1486018 - DNA, 16 bp, Homo sapiens
ggcgcaggtgggctgg

SEQ ID NO: 1486019 - DNA, 20 bp, Homo sapiens
ggcgcaggtgggctggactt

SEQ ID NO: 1486020 - DNA, 17 bp, Homo sapiens
ggcgcatattaagcact

SEQ ID NO: 1486021 - DNA, 23 bp, Homo sapiens
ggcgcatgcatgggaggaattca

SEQ ID NO: 1486022 - DNA, 16 bp, Homo sapiens
ggcgcccaccctgggc

SEQ ID NO: 1486023 - DNA, 17 bp, Homo sapiens
ggcgcccaccctgggct

SEQ ID NO: 1486024 - DNA, 15 bp, Homo sapiens
ggcgcccccagtgtg

SEQ ID NO: 1486025 - DNA, 13 bp, Homo sapiens
ggcgcccctgcca

SEQ ID NO: 1486026 - DNA, 15 bp, Homo sapiens
ggcgccctctctgct

SEQ ID NO: 1486027 - DNA, 14 bp, Homo sapiens
ggcgccctggaagc

SEQ ID NO: 1486028 - DNA, 18 bp, Homo sapiens
ggcgccgggcaccaactc

SEQ ID NO: 1486029 - DNA, 21 bp, Homo sapiens
ggcgccgtctccaggggctgc

SEQ ID NO: 1486030 - DNA, 17 bp, Homo sapiens
ggcgccttctcggagct

SEQ ID NO: 1486031 - DNA, 15 bp, Homo sapiens
ggcgcgggaggcacc

SEQ ID NO: 1486032 - DNA, 16 bp, Homo sapiens
ggcgcgggaggcacca

SEQ ID NO: 1486033 - DNA, 16 bp, Homo sapiens
ggcgcgggcagccacc

SEQ ID NO: 1486034 - DNA, 23 bp, Homo sapiens
ggcgcgggcccctcacctggtac

SEQ ID NO: 1486035 - DNA, 19 bp, Homo sapiens
ggcgcggtggctcacgcct

SEQ ID NO: 1486036 - DNA, 17 bp, Homo sapiens
ggcgctattgcactcca

SEQ ID NO: 1486037 - DNA, 12 bp, Homo sapiens
ggcgctcagacg

SEQ ID NO: 1486038 - DNA, 18 bp, Homo sapiens
ggcgctcaggacccaggc

SEQ ID NO: 1486039 - DNA, 14 bp, Homo sapiens
ggcgctggcccagc

SEQ ID NO: 1486040 - DNA, 16 bp, Homo sapiens
ggcgctggcccagccg

SEQ ID NO: 1486041 - DNA, 14 bp, Homo sapiens
ggcggaagagttac

SEQ ID NO: 1486042 - DNA, 19 bp, Homo sapiens
ggcggaaggtgaaaggcat

SEQ ID NO: 1486043 - DNA, 17 bp, Homo sapiens
ggcggagatgggtcctg

SEQ ID NO: 1486044 - DNA, 16 bp, Homo sapiens
ggcggaggtctctggg

SEQ ID NO: 1486045 - DNA, 20 bp, Homo sapiens
ggcggaggtctctgggagcc

SEQ ID NO: 1486046 - DNA, 23 bp, Homo sapiens
ggcggaggtctctgggagcccag

SEQ ID NO: 1486047 - DNA, 17 bp, Homo sapiens
ggcggcaggggcctgga

SEQ ID NO: 1486048 - DNA, 18 bp, Homo sapiens
ggcggcaggggcctggag

SEQ ID NO: 1486049 - DNA, 19 bp, Homo sapiens
ggcggccacgcactgggcc

SEQ ID NO: 1486050 - DNA, 16 bp, Homo sapiens
ggcggccaggcacagg

SEQ ID NO: 1486051 - DNA, 22 bp, Homo sapiens
ggcggcccttctgactgtttat

SEQ ID NO: 1486052 - DNA, 16 bp, Homo sapiens
ggcggcgggcggctgg

SEQ ID NO: 1486053 - DNA, 20 bp, Homo sapiens
ggcggctactcagcagccct

SEQ ID NO: 1486054 - DNA, 21 bp, Homo sapiens
ggcggctactcagcagccctc

SEQ ID NO: 1486055 - DNA, 22 bp, Homo sapiens
ggcggctactcagcagccctcc

SEQ ID NO: 1486056 - DNA, 23 bp, Homo sapiens
ggcggctgagagccccagctgac

SEQ ID NO: 1486057 - DNA, 12 bp, Homo sapiens
ggcgggccagcc

SEQ ID NO: 1486058 - DNA, 13 bp, Homo sapiens
ggcgggccagcca

SEQ ID NO: 1486059 - DNA, 17 bp, Homo sapiens
ggcgggccagccaggcg

SEQ ID NO: 1486060 - DNA, 15 bp, Homo sapiens
ggcgggccagggtgg

SEQ ID NO: 1486061 - DNA, 20 bp, Homo sapiens
ggcgggccagggtgggaaga

SEQ ID NO: 1486062 - DNA, 23 bp, Homo sapiens
ggcgggccagggtgggaagagaa

SEQ ID NO: 1486063 - DNA, 20 bp, Homo sapiens
ggcgggtggatcacaaggtc

SEQ ID NO: 1486064 - DNA, 19 bp, Homo sapiens
ggctgcaggaagaaacttt

SEQ ID NO: 1486065 - DNA, 19 bp, Homo sapiens
ggctgcagggtcggtactg

SEQ ID NO: 1486066 - DNA, 22 bp, Homo sapiens
ggctgcagtgacgtgcacctgt

SEQ ID NO: 1486067 - DNA, 22 bp, Homo sapiens
ggctgcatgatgtttgcccaaa

SEQ ID NO: 1486068 - DNA, 18 bp, Homo sapiens
ggctgcatgctctggaag

SEQ ID NO: 1486069 - DNA, 15 bp, Homo sapiens
ggctgccaaggccag

SEQ ID NO: 1486070 - DNA, 17 bp, Homo sapiens
ggctgccaaggccagag

SEQ ID NO: 1486071 - DNA, 12 bp, Homo sapiens
ggctgccaggcg

SEQ ID NO: 1486072 - DNA, 23 bp, Homo sapiens
ggctgccaggcgttggtgccact

SEQ ID NO: 1486073 - DNA, 12 bp, Homo sapiens
ggctgcccagga

SEQ ID NO: 1486074 - DNA, 19 bp, Homo sapiens
ggctgcccatcatgtggcc

SEQ ID NO: 1486075 - DNA, 14 bp, Homo sapiens
ggctgccccaggcc

SEQ ID NO: 1486076 - DNA, 15 bp, Homo sapiens
ggctgccccaggccg

SEQ ID NO: 1486077 - DNA, 19 bp, Homo sapiens
ggctgccccgggtccccag

SEQ ID NO: 1486078 - DNA, 13 bp, Homo sapiens
ggctgccctgcca

SEQ ID NO: 1486079 - DNA, 15 bp, Homo sapiens
ggctgccctggccct

SEQ ID NO: 1486080 - DNA, 19 bp, Homo sapiens
ggctgccctggccctgagg

SEQ ID NO: 1486081 - DNA, 12 bp, Homo sapiens
ggctgccctggt

SEQ ID NO: 1486082 - DNA, 22 bp, Homo sapiens
ggctgccctggtgctgccacac

SEQ ID NO: 1486083 - DNA, 19 bp, Homo sapiens
ggctgccctgtctggaaca

SEQ ID NO: 1486084 - DNA, 17 bp, Homo sapiens
ggctgcccttgttgcct

SEQ ID NO: 1486085 - DNA, 19 bp, Homo sapiens
ggctgccgagacagaccct

SEQ ID NO: 1486086 - DNA, 11 bp, Homo sapiens
ggctgcctcag

SEQ ID NO: 1486087 - DNA, 13 bp, Homo sapiens
ggctgcctcagcc

SEQ ID NO: 1486088 - DNA, 15 bp, Homo sapiens
ggctgcctcagccag

SEQ ID NO: 1486089 - DNA, 20 bp, Homo sapiens
ggctgcctcccttgtggcag

SEQ ID NO: 1486090 - DNA, 18 bp, Homo sapiens
ggctgcctcctgccctta

SEQ ID NO: 1486091 - DNA, 21 bp, Homo sapiens
ggctgcctcggactccatggc

SEQ ID NO: 1486092 - DNA, 10 bp, Homo sapiens
ggctgcctgc

SEQ ID NO: 1486093 - DNA, 17 bp, Homo sapiens
ggctgcctgggctgttg

SEQ ID NO: 1486094 - DNA, 14 bp, Homo sapiens
ggctgcggccccct

SEQ ID NO: 1486095 - DNA, 20 bp, Homo sapiens
ggctgcgggacagaggacca

SEQ ID NO: 1486096 - DNA, 15 bp, Homo sapiens
ggctgctacccagaa

SEQ ID NO: 1486097 - DNA, 21 bp, Homo sapiens
ggctgctcaagccgcaagctc

SEQ ID NO: 1486098 - DNA, 21 bp, Homo sapiens
ggctgctcagcctcatcctga

SEQ ID NO: 1486099 - DNA, 20 bp, Homo sapiens
ggctgctccccacccgcctc

SEQ ID NO: 1486100 - DNA, 15 bp, Homo sapiens
ggctgctcctccagg

SEQ ID NO: 1486101 - DNA, 14 bp, Homo sapiens
ggctgctgccatcc

SEQ ID NO: 1486102 - DNA, 14 bp, Homo sapiens
ggctgctgcggctg

SEQ ID NO: 1486103 - DNA, 16 bp, Homo sapiens
ggctgctgcggctgtg

SEQ ID NO: 1486104 - DNA, 15 bp, Homo sapiens
ggctgctgctacaat

SEQ ID NO: 1486105 - DNA, 16 bp, Homo sapiens
ggctgctggggcatgt

SEQ ID NO: 1486106 - DNA, 24 bp, Homo sapiens
ggctgctggggcatgtgtgcctgt

SEQ ID NO: 1486107 - DNA, 16 bp, Homo sapiens
ggctgcttcctcctgg

SEQ ID NO: 1486108 - DNA, 19 bp, Homo sapiens
ggctgcttcctcctggaaa

SEQ ID NO: 1486109 - DNA, 13 bp, Homo sapiens
ggctgcttcctgt

SEQ ID NO: 1486110 - DNA, 16 bp, Homo sapiens
ggctgcttctccacct

SEQ ID NO: 1486111 - DNA, 18 bp, Homo sapiens
ggctgcttctccacctcc

SEQ ID NO: 1486112 - DNA, 23 bp, Homo sapiens
ggctgcttctccacctcccccaa

SEQ ID NO: 1486113 - DNA, 24 bp, Homo sapiens
ggctgcttctctacagaggtgaaa

SEQ ID NO: 1486114 - DNA, 20 bp, Homo sapiens
ggctgcttttcttaagtgcc

SEQ ID NO: 1486115 - DNA, 19 bp, Homo sapiens
ggctggaagatcctgcggg

SEQ ID NO: 1486116 - DNA, 17 bp, Homo sapiens
ggctggacaccctctgc

SEQ ID NO: 1486117 - DNA, 19 bp, Homo sapiens
ggctggacaccctctgccg

SEQ ID NO: 1486118 - DNA, 12 bp, Homo sapiens
ggctggactggc

SEQ ID NO: 1486119 - DNA, 14 bp, Homo sapiens
ggctggactggcca

SEQ ID NO: 1486120 - DNA, 15 bp, Homo sapiens
ggctggactggccat

SEQ ID NO: 1486121 - DNA, 17 bp, Homo sapiens
ggctggagaaagatgca

SEQ ID NO: 1486122 - DNA, 19 bp, Homo sapiens
ggctggaggagctggcctg

SEQ ID NO: 1486123 - DNA, 14 bp, Homo sapiens
ggctggaggcccag

SEQ ID NO: 1486124 - DNA, 17 bp, Homo sapiens
ggctggatctgtgaggg

SEQ ID NO: 1486125 - DNA, 15 bp, Homo sapiens
ggctggatgtggtgg

SEQ ID NO: 1486126 - DNA, 21 bp, Homo sapiens
ggctggcaaaccctcccagaa

SEQ ID NO: 1486127 - DNA, 13 bp, Homo sapiens
ggctggcaagcag

SEQ ID NO: 1486128 - DNA, 14 bp, Homo sapiens
ggctggcaagcagg

SEQ ID NO: 1486129 - DNA, 16 bp, Homo sapiens
ggctggcaagcaggga

SEQ ID NO: 1486130 - DNA, 17 bp, Homo sapiens
ggctggcagctgagagc

SEQ ID NO: 1486131 - DNA, 21 bp, Homo sapiens
ggctggccagtccaggctgcc

SEQ ID NO: 1486132 - DNA, 23 bp, Homo sapiens
ggctggcctcacccacccctgca

SEQ ID NO: 1486133 - DNA, 12 bp, Homo sapiens
ggctggcctgag

SEQ ID NO: 1486134 - DNA, 14 bp, Homo sapiens
ggctggcctgagca

SEQ ID NO: 1486135 - DNA, 13 bp, Homo sapiens
ggctggcctggta

SEQ ID NO: 1486136 - DNA, 19 bp, Homo sapiens
ggctggcgcagccaaggcc

SEQ ID NO: 1486137 - DNA, 17 bp, Homo sapiens
ggctggctcctctgccc

SEQ ID NO: 1486138 - DNA, 13 bp, Homo sapiens
ggctggctgagtg

SEQ ID NO: 1486139 - DNA, 23 bp, Homo sapiens
ggctgggagtagttgtctttcct

SEQ ID NO: 1486140 - DNA, 14 bp, Homo sapiens
ggctgggcccagca

SEQ ID NO: 1486141 - DNA, 13 bp, Homo sapiens
ggctgggcctcct

SEQ ID NO: 1486142 - DNA, 22 bp, Homo sapiens
ggctgggcctccttcttccact

SEQ ID NO: 1486143 - DNA, 15 bp, Homo sapiens
ggctgggctggctga

SEQ ID NO: 1486144 - DNA, 17 bp, Homo sapiens
ggctggggaggaggaga

SEQ ID NO: 1486145 - DNA, 13 bp, Homo sapiens
ggctggggcagag

SEQ ID NO: 1486146 - DNA, 15 bp, Homo sapiens
ggctggggcagaggg

SEQ ID NO: 1486147 - DNA, 15 bp, Homo sapiens
ggctggggctgctcc

SEQ ID NO: 1486148 - DNA, 15 bp, Homo sapiens
ggctgggggagagcc

SEQ ID NO: 1486149 - DNA, 16 bp, Homo sapiens
ggctgggggagagccg

SEQ ID NO: 1486150 - DNA, 14 bp, Homo sapiens
ggctgggggcagga

SEQ ID NO: 1486151 - DNA, 17 bp, Homo sapiens
ggctgggggtgctagac

SEQ ID NO: 1486152 - DNA, 13 bp, Homo sapiens
ggctgggtcacca

SEQ ID NO: 1486153 - DNA, 12 bp, Homo sapiens
ggctgggtcagg

SEQ ID NO: 1486154 - DNA, 15 bp, Homo sapiens
ggctgggtccttggg

SEQ ID NO: 1486155 - DNA, 20 bp, Homo sapiens
ggctggtagcagcaggctca

SEQ ID NO: 1486156 - DNA, 21 bp, Homo sapiens
ggctggtagcagcaggctcag

SEQ ID NO: 1486157 - DNA, 22 bp, Homo sapiens
ggctggtagcagcaggctcagg

SEQ ID NO: 1486158 - DNA, 13 bp, Homo sapiens
ggctggtcactct

SEQ ID NO: 1486159 - DNA, 17 bp, Homo sapiens
ggctggtcactctgccc

SEQ ID NO: 1486160 - DNA, 19 bp, Homo sapiens
ggctggtcactctgccctc

SEQ ID NO: 1486161 - DNA, 20 bp, Homo sapiens
ggctggtcactctgccctct

SEQ ID NO: 1486162 - DNA, 13 bp, Homo sapiens
ggctggtgcaggg

SEQ ID NO: 1486163 - DNA, 10 bp, Homo sapiens
ggctggtgcc

SEQ ID NO: 1486164 - DNA, 15 bp, Homo sapiens
ggctggtgccagcct

SEQ ID NO: 1486165 - DNA, 15 bp, Homo sapiens
ggctggtgggaaggc

SEQ ID NO: 1486166 - DNA, 18 bp, Homo sapiens
ggctggtgtatgcacagg

SEQ ID NO: 1486167 - DNA, 16 bp, Homo sapiens
ggctggtgtggctgct

SEQ ID NO: 1486168 - DNA, 22 bp, Homo sapiens
ggctggttttgtaagatgctgg

SEQ ID NO: 1486169 - DNA, 15 bp, Homo sapiens
ggctgtaaggctcta

SEQ ID NO: 1486170 - DNA, 18 bp, Homo sapiens
ggctgtaatgacaaaaga

SEQ ID NO: 1486171 - DNA, 19 bp, Homo sapiens
ggctgtagatggtgacctg

SEQ ID NO: 1486172 - DNA, 22 bp, Homo sapiens
ggctgtatttatctctgaggca

SEQ ID NO: 1486173 - DNA, 15 bp, Homo sapiens
ggctgtcaggacacc

SEQ ID NO: 1486174 - DNA, 12 bp, Homo sapiens
ggctgtcctgct

SEQ ID NO: 1486175 - DNA, 14 bp, Homo sapiens
ggctgtcctgctgc

SEQ ID NO: 1486176 - DNA, 20 bp, Homo sapiens
ggctgtcctgctgccctccc

SEQ ID NO: 1486177 - DNA, 21 bp, Homo sapiens
ggctgtcctgctgccctccca

SEQ ID NO: 1486178 - DNA, 13 bp, Homo sapiens
ggctgtctgcctg

SEQ ID NO: 1486179 - DNA, 20 bp, Homo sapiens
ggctgtctgcctgtattttc

SEQ ID NO: 1486180 - DNA, 12 bp, Homo sapiens
ggctgtctgcga

SEQ ID NO: 1486181 - DNA, 22 bp, Homo sapiens
ggctgtcttctcaggctctgcc

SEQ ID NO: 1486182 - DNA, 23 bp, Homo sapiens
ggctgtcttctcaggctctgccc

SEQ ID NO: 1486183 - DNA, 23 bp, Homo sapiens
ggctgtgagacgaggcaggggct

SEQ ID NO: 1486184 - DNA, 16 bp, Homo sapiens
ggctgtgagcagcctc

SEQ ID NO: 1486185 - DNA, 17 bp, Homo sapiens
ggctgtgagcagcctcc

SEQ ID NO: 1486186 - DNA, 13 bp, Homo sapiens
ggctgtgattgct

SEQ ID NO: 1486187 - DNA, 11 bp, Homo sapiens
ggctgtgccaa

SEQ ID NO: 1486188 - DNA, 14 bp, Homo sapiens
ggctgtgcccagca

SEQ ID NO: 1486189 - DNA, 15 bp, Homo sapiens
ggctgtgcccagcag

SEQ ID NO: 1486190 - DNA, 16 bp, Homo sapiens
ggctgtgcccagcagg

SEQ ID NO: 1486191 - DNA, 21 bp, Homo sapiens
ggctgtgcccagcaggcccag

SEQ ID NO: 1486192 - DNA, 22 bp, Homo sapiens
ggctgtgcccagcaggcccagc

SEQ ID NO: 1486193 - DNA, 14 bp, Homo sapiens
ggctgtgcccctga

SEQ ID NO: 1486194 - DNA, 19 bp, Homo sapiens
ggctgtgcccctgatgcag

SEQ ID NO: 1486195 - DNA, 17 bp, Homo sapiens
ggctgtgcttgaaggcc

SEQ ID NO: 1486196 - DNA, 20 bp, Homo sapiens
ggctgtgcttgaaggccctg

SEQ ID NO: 1486197 - DNA, 21 bp, Homo sapiens
ggctgtgcttgaaggccctgc

SEQ ID NO: 1486198 - DNA, 16 bp, Homo sapiens
ggctgtggaggcctga

SEQ ID NO: 1486199 - DNA, 17 bp, Homo sapiens
ggctgtggaggcctgat

SEQ ID NO: 1486200 - DNA, 21 bp, Homo sapiens
ggctgtggaggcctgatgctg

SEQ ID NO: 1486201 - DNA, 14 bp, Homo sapiens
ggctgtgggcaagc

SEQ ID NO: 1486202 - DNA, 15 bp, Homo sapiens
ggctgtggtcacagc

SEQ ID NO: 1486203 - DNA, 18 bp, Homo sapiens
ggctgtgtaaccttgggt

SEQ ID NO: 1486204 - DNA, 14 bp, Homo sapiens
ggctgtgtgacaga

SEQ ID NO: 1486205 - DNA, 20 bp, Homo sapiens
ggctgttccagactcaggtt

SEQ ID NO: 1486206 - DNA, 15 bp, Homo sapiens
ggctgttctgcactg

SEQ ID NO: 1486207 - DNA, 18 bp, Homo sapiens
ggctgttctgcactgaaa

SEQ ID NO: 1486208 - DNA, 21 bp, Homo sapiens
ggctgttctgcactgaaaagg

SEQ ID NO: 1486209 - DNA, 18 bp, Homo sapiens
ggctgttctgtggttcct

SEQ ID NO: 1486210 - DNA, 12 bp, Homo sapiens
ggctgttggcac

SEQ ID NO: 1486211 - DNA, 17 bp, Homo sapiens
ggctgttggcactcaca

SEQ ID NO: 1486212 - DNA, 21 bp, Homo sapiens
ggcttaagtgagcagaacagg

SEQ ID NO: 1486213 - DNA, 12 bp, Homo sapiens
ggcttaatgttt

SEQ ID NO: 1486214 - DNA, 21 bp, Homo sapiens
ggcttagacttcgactcagga

SEQ ID NO: 1486215 - DNA, 19 bp, Homo sapiens
ggcttagtatttctcagga

SEQ ID NO: 1486216 - DNA, 15 bp, Homo sapiens
ggcttagtgccaccc

SEQ ID NO: 1486217 - DNA, 22 bp, Homo sapiens
ggcttagtttgtgtgttgtctc

SEQ ID NO: 1486218 - DNA, 15 bp, Homo sapiens
ggcttatgtctctgc

SEQ ID NO: 1486219 - DNA, 20 bp, Homo sapiens
ggcttcaatcactgtaacct

SEQ ID NO: 1486220 - DNA, 23 bp, Homo sapiens
ggcttcaatcactgtaacctgat

SEQ ID NO: 1486221 - DNA, 22 bp, Homo sapiens
ggcttcaattggtggaattcct

SEQ ID NO: 1486222 - DNA, 16 bp, Homo sapiens
ggcttcaccagtctgt

SEQ ID NO: 1486223 - DNA, 20 bp, Homo sapiens
ggcttcactgaccagcggct

SEQ ID NO: 1486224 - DNA, 21 bp, Homo sapiens
ggcttcactgaccagcggctg

SEQ ID NO: 1486225 - DNA, 19 bp, Homo sapiens
ggcttcagaggcctggcat

SEQ ID NO: 1486226 - DNA, 18 bp, Homo sapiens
ggcttcaggggagtcccg

SEQ ID NO: 1486227 - DNA, 21 bp, Homo sapiens
ggcttccagaaaaccccagca

SEQ ID NO: 1486228 - DNA, 12 bp, Homo sapiens
ggcttccaggct

SEQ ID NO: 1486229 - DNA, 14 bp, Homo sapiens
ggcttccaggctct

SEQ ID NO: 1486230 - DNA, 15 bp, Homo sapiens
ggcttccccactccc

SEQ ID NO: 1486231 - DNA, 18 bp, Homo sapiens
ggcttcccgctcagccct

SEQ ID NO: 1486232 - DNA, 15 bp, Homo sapiens
ggcttccctggaagc

SEQ ID NO: 1486233 - DNA, 14 bp, Homo sapiens
ggcttcccttctcc

SEQ ID NO: 1486234 - DNA, 20 bp, Homo sapiens
ggcttcccttctccccagcc

SEQ ID NO: 1486235 - DNA, 22 bp, Homo sapiens
ggcttcccttctccccagccag

SEQ ID NO: 1486236 - DNA, 23 bp, Homo sapiens
ggcttcctccgtccacccaggct

SEQ ID NO: 1486237 - DNA, 11 bp, Homo sapiens
ggcttcctggg

SEQ ID NO: 1486238 - DNA, 13 bp, Homo sapiens
ggcttcctgtcca

SEQ ID NO: 1486239 - DNA, 17 bp, Homo sapiens
ggcttctccgccagcct

SEQ ID NO: 1486240 - DNA, 21 bp, Homo sapiens
ggcttctccgccagcctcctc

SEQ ID NO: 1486241 - DNA, 14 bp, Homo sapiens
ggcttctcctcctc

SEQ ID NO: 1486242 - DNA, 12 bp, Homo sapiens
ggcttctcctga

SEQ ID NO: 1486243 - DNA, 14 bp, Homo sapiens
ggcttctcctgtga

SEQ ID NO: 1486244 - DNA, 18 bp, Homo sapiens
ggcttctctccacagtgt

SEQ ID NO: 1486245 - DNA, 20 bp, Homo sapiens
ggcttctctgtgaattgcct

SEQ ID NO: 1486246 - DNA, 20 bp, Homo sapiens
ggcttctgatttttctcttt

SEQ ID NO: 1486247 - DNA, 21 bp, Homo sapiens
ggcttctgtgatgagctgatc

SEQ ID NO: 1486248 - DNA, 12 bp, Homo sapiens
ggcttctgtgca

SEQ ID NO: 1486249 - DNA, 23 bp, Homo sapiens
ggcttctgtgcactagcctgtga

SEQ ID NO: 1486250 - DNA, 20 bp, Homo sapiens
ggcttcttcagatcagtgct

SEQ ID NO: 1486251 - DNA, 19 bp, Homo sapiens
ggcttgacacctgtcttga

SEQ ID NO: 1486252 - DNA, 16 bp, Homo sapiens
ggcttgagctagagat

SEQ ID NO: 1486253 - DNA, 19 bp, Homo sapiens
ggcttgagtgagaagagct

SEQ ID NO: 1486254 - DNA, 12 bp, Homo sapiens
ggcttggcctgc

SEQ ID NO: 1486255 - DNA, 21 bp, Homo sapiens
ggcttggggattgtacacggg

SEQ ID NO: 1486256 - DNA, 15 bp, Homo sapiens
ggcttgtaactccac

SEQ ID NO: 1486257 - DNA, 20 bp, Homo sapiens
ggcttgtacatttttaaatt

SEQ ID NO: 1486258 - DNA, 22 bp, Homo sapiens
ggcttgtctatactccttccct

SEQ ID NO: 1486259 - DNA, 18 bp, Homo sapiens
ggcttgtgacattcgtga

SEQ ID NO: 1486260 - DNA, 16 bp, Homo sapiens
ggctttaattgtataa

SEQ ID NO: 1486261 - DNA, 17 bp, Homo sapiens
ggctttaattgtataag

SEQ ID NO: 1486262 - DNA, 14 bp, Homo sapiens
ggctttatgcaaat

SEQ ID NO: 1486263 - DNA, 17 bp, Homo sapiens
ggctttatgcaaataca

SEQ ID NO: 1486264 - DNA, 18 bp, Homo sapiens
ggctttatgcaaatacaa

SEQ ID NO: 1486265 - DNA, 22 bp, Homo sapiens
ggctttctccggggtctgtgct

SEQ ID NO: 1486266 - DNA, 23 bp, Homo sapiens
ggctttctccggggtctgtgctg

SEQ ID NO: 1486267 - DNA, 16 bp, Homo sapiens
ggctttctcttcccct

SEQ ID NO: 1486268 - DNA, 13 bp, Homo sapiens
ggctttctggaga

SEQ ID NO: 1486269 - DNA, 13 bp, Homo sapiens
ggctttgcaggct

SEQ ID NO: 1486270 - DNA, 14 bp, Homo sapiens
ggctttgcaggctc

SEQ ID NO: 1486271 - DNA, 15 bp, Homo sapiens
ggctttgcaggctct

SEQ ID NO: 1486272 - DNA, 21 bp, Homo sapiens
ggctttgcccacccctcactc

SEQ ID NO: 1486273 - DNA, 15 bp, Homo sapiens
ggctttgcctcttct

SEQ ID NO: 1486274 - DNA, 17 bp, Homo sapiens
ggctttgcctcttcttt

SEQ ID NO: 1486275 - DNA, 18 bp, Homo sapiens
ggctttggttccttctct

SEQ ID NO: 1486276 - DNA, 17 bp, Homo sapiens
ggcttttcactgctggc

SEQ ID NO: 1486277 - DNA, 22 bp, Homo sapiens
ggcttttcactgctggctgcct

SEQ ID NO: 1486278 - DNA, 21 bp, Homo sapiens
ggcttttcccaccagctccca

SEQ ID NO: 1486279 - DNA, 21 bp, Homo sapiens
ggcttttgctttccctgaagc

SEQ ID NO: 1486280 - DNA, 20 bp, Homo sapiens
ggctttttaatggaaaccaa

SEQ ID NO: 1486281 - DNA, 17 bp, Homo sapiens
ggctttttttttctctt

SEQ ID NO: 1486282 - DNA, 15 bp, Homo sapiens
gggaaaaaaaatgta

SEQ ID NO: 1486283 - DNA, 17 bp, Homo sapiens
gggaaaatatttcctga

SEQ ID NO: 1486284 - DNA, 20 bp, Homo sapiens
gggaaaccctggagccatcc

SEQ ID NO: 1486285 - DNA, 19 bp, Homo sapiens
gggaaaccttggagaggag

SEQ ID NO: 1486286 - DNA, 18 bp, Homo sapiens
gggaaacgggctccttcc

SEQ ID NO: 1486287 - DNA, 14 bp, Homo sapiens
gggaaacttggctc

SEQ ID NO: 1486288 - DNA, 17 bp, Homo sapiens
gggaaagacactgcctg

SEQ ID NO: 1486289 - DNA, 13 bp, Homo sapiens
gggaaagcctctg

SEQ ID NO: 1486290 - DNA, 14 bp, Homo sapiens
gggaaagcctctgg

SEQ ID NO: 1486291 - DNA, 18 bp, Homo sapiens
gggaaagccttaaaaata

SEQ ID NO: 1486292 - DNA, 22 bp, Homo sapiens
gggaaagtgtgagctcttccct

SEQ ID NO: 1486293 - DNA, 14 bp, Homo sapiens
gggaaataagagag

SEQ ID NO: 1486294 - DNA, 16 bp, Homo sapiens
gggattcaggctgctt

SEQ ID NO: 1486295 - DNA, 16 bp, Homo sapiens
gggattcctgacccag

SEQ ID NO: 1486296 - DNA, 11 bp, Homo sapiens
gggattctggg

SEQ ID NO: 1486297 - DNA, 18 bp, Homo sapiens
gggattgaggggccctgg

SEQ ID NO: 1486298 - DNA, 22 bp, Homo sapiens
gggattgcccctggctttgcct

SEQ ID NO: 1486299 - DNA, 20 bp, Homo sapiens
gggattggaccgagctggaa

SEQ ID NO: 1486300 - DNA, 18 bp, Homo sapiens
gggatttcttcgctgctc

SEQ ID NO: 1486301 - DNA, 20 bp, Homo sapiens
gggatttcttcgctgctcta

SEQ ID NO: 1486302 - DNA, 22 bp, Homo sapiens
gggcaaatgacatgcactgacc

SEQ ID NO: 1486303 - DNA, 15 bp, Homo sapiens
gggcaaatggctgag

SEQ ID NO: 1486304 - DNA, 21 bp, Homo sapiens
gggcaagcctaagggatcctg

SEQ ID NO: 1486305 - DNA, 23 bp, Homo sapiens
gggcaagctaggccccagaggcc

SEQ ID NO: 1486306 - DNA, 15 bp, Homo sapiens
gggcacaccactgcc

SEQ ID NO: 1486307 - DNA, 21 bp, Homo sapiens
gggcacaccactgccctgcct

SEQ ID NO: 1486308 - DNA, 22 bp, Homo sapiens
gggcacaccactgccctgcctg

SEQ ID NO: 1486309 - DNA, 18 bp, Homo sapiens
gggcacaggaggcaggca

SEQ ID NO: 1486310 - DNA, 13 bp, Homo sapiens
gggcacagggcac

SEQ ID NO: 1486311 - DNA, 15 bp, Homo sapiens
gggcacagggcacca

SEQ ID NO: 1486312 - DNA, 20 bp, Homo sapiens
gggcacattgcccatggctg

SEQ ID NO: 1486313 - DNA, 16 bp, Homo sapiens
gggcaccagaggccga

SEQ ID NO: 1486314 - DNA, 15 bp, Homo sapiens
gggcaccagccagcg

SEQ ID NO: 1486315 - DNA, 20 bp, Homo sapiens
gggcaccaggggtttctcgc

SEQ ID NO: 1486316 - DNA, 14 bp, Homo sapiens
gggcaccctcccac

SEQ ID NO: 1486317 - DNA, 18 bp, Homo sapiens
gggcactccgcgccgatg

SEQ ID NO: 1486318 - DNA, 21 bp, Homo sapiens
gggcactccgcgccgatgcca

SEQ ID NO: 1486319 - DNA, 14 bp, Homo sapiens
gggcactgggctgt

SEQ ID NO: 1486320 - DNA, 22 bp, Homo sapiens
gggcactttttaattcaccaaa

SEQ ID NO: 1486321 - DNA, 23 bp, Homo sapiens
gggcactttttaattcaccaaag

SEQ ID NO: 1486322 - DNA, 22 bp, Homo sapiens
gggcagaagactagaggccagg

SEQ ID NO: 1486323 - DNA, 11 bp, Homo sapiens
gggcagacaca

SEQ ID NO: 1486324 - DNA, 20 bp, Homo sapiens
gggcagaccctgagcagaat

SEQ ID NO: 1486325 - DNA, 14 bp, Homo sapiens
gggcagactgtgaa

SEQ ID NO: 1486326 - DNA, 14 bp, Homo sapiens
gggcagagcaggaa

SEQ ID NO: 1486327 - DNA, 18 bp, Homo sapiens
gggcagagccatgggcct

SEQ ID NO: 1486328 - DNA, 13 bp, Homo sapiens
gggcagagccggg

SEQ ID NO: 1486329 - DNA, 14 bp, Homo sapiens
gggcagagccggga

SEQ ID NO: 1486330 - DNA, 17 bp, Homo sapiens
gggcagagccgggaagc

SEQ ID NO: 1486331 - DNA, 11 bp, Homo sapiens
gggcagagctg

SEQ ID NO: 1486332 - DNA, 16 bp, Homo sapiens
gggcagagctggctct

SEQ ID NO: 1486333 - DNA, 17 bp, Homo sapiens
gggcagagctggctctg

SEQ ID NO: 1486334 - DNA, 23 bp, Homo sapiens
gggcagaggctggaggcagggcc

SEQ ID NO: 1486335 - DNA, 14 bp, Homo sapiens
gggcagagggaatg

SEQ ID NO: 1486336 - DNA, 14 bp, Homo sapiens
gggcagaggggcag

SEQ ID NO: 1486337 - DNA, 15 bp, Homo sapiens
gggcagaggggcagc

SEQ ID NO: 1486338 - DNA, 16 bp, Homo sapiens
gggcagcactccccag

SEQ ID NO: 1486339 - DNA, 20 bp, Homo sapiens
gggcagcatagcaagacaca

SEQ ID NO: 1486340 - DNA, 17 bp, Homo sapiens
gggcagccaaacccatg

SEQ ID NO: 1486341 - DNA, 13 bp, Homo sapiens
gggcagccaggct

SEQ ID NO: 1486342 - DNA, 19 bp, Homo sapiens
gggcagcccttgcttgttg

SEQ ID NO: 1486343 - DNA, 17 bp, Homo sapiens
gggcagccgctaggaga

SEQ ID NO: 1486344 - DNA, 22 bp, Homo sapiens
gggcagcctggctcccaggaca

SEQ ID NO: 1486345 - DNA, 17 bp, Homo sapiens
gggcagcgggccaggcc

SEQ ID NO: 1486346 - DNA, 21 bp, Homo sapiens
gggcagcgggccaggcccgca

SEQ ID NO: 1486347 - DNA, 12 bp, Homo sapiens
gggcagctgcta

SEQ ID NO: 1486348 - DNA, 19 bp, Homo sapiens
gggcagcttgccccggccc

SEQ ID NO: 1486349 - DNA, 18 bp, Homo sapiens
gggcaggaaggagagcct

SEQ ID NO: 1486350 - DNA, 14 bp, Homo sapiens
gggcaggagtgcca

SEQ ID NO: 1486351 - DNA, 18 bp, Homo sapiens
gggcaggagtgccaggac

SEQ ID NO: 1486352 - DNA, 21 bp, Homo sapiens
gggcaggagtgccaggaccag

SEQ ID NO: 1486353 - DNA, 18 bp, Homo sapiens
gggcaggatctcaagcca

SEQ ID NO: 1486354 - DNA, 19 bp, Homo sapiens
gggcaggatctcaagccag

SEQ ID NO: 1486355 - DNA, 21 bp, Homo sapiens
gggcaggatctcaagccagcc

SEQ ID NO: 1486356 - DNA, 22 bp, Homo sapiens
gggcaggatctcaagccagccc

SEQ ID NO: 1486357 - DNA, 11 bp, Homo sapiens
gggcaggcctg

SEQ ID NO: 1486358 - DNA, 12 bp, Homo sapiens
gggcaggcctgg

SEQ ID NO: 1486359 - DNA, 19 bp, Homo sapiens
gggcaggcctgggacccag

SEQ ID NO: 1486360 - DNA, 23 bp, Homo sapiens
gggcaggcctgggacccagctac

SEQ ID NO: 1486361 - DNA, 13 bp, Homo sapiens
gggcaggctgaca

SEQ ID NO: 1486362 - DNA, 13 bp, Homo sapiens
gggcaggctgggc

SEQ ID NO: 1486363 - DNA, 14 bp, Homo sapiens
gggcaggcttgggg

SEQ ID NO: 1486364 - DNA, 22 bp, Homo sapiens
gggcagggaaggacaggaccct

SEQ ID NO: 1486365 - DNA, 11 bp, Homo sapiens
gggcagggagc

SEQ ID NO: 1486366 - DNA, 12 bp, Homo sapiens
gggcagggaggc

SEQ ID NO: 1486367 - DNA, 13 bp, Homo sapiens
gggcagggaggca

SEQ ID NO: 1486368 - DNA, 13 bp, Homo sapiens
gggcagggcagcc

SEQ ID NO: 1486369 - DNA, 14 bp, Homo sapiens
gggcagggcccacg

SEQ ID NO: 1486370 - DNA, 18 bp, Homo sapiens
gggcagggctcccacaga

SEQ ID NO: 1486371 - DNA, 12 bp, Homo sapiens
gggcagggctgt

SEQ ID NO: 1486372 - DNA, 16 bp, Homo sapiens
gggcagggtgagaagc

SEQ ID NO: 1486373 - DNA, 21 bp, Homo sapiens
gggcaggtggccgcccctgag

SEQ ID NO: 1486374 - DNA, 18 bp, Homo sapiens
gggcaggtggtggcactg

SEQ ID NO: 1486375 - DNA, 22 bp, Homo sapiens
gggcaggtggtggcactgagcc

SEQ ID NO: 1486376 - DNA, 17 bp, Homo sapiens
gggcaggtgtttctttc

SEQ ID NO: 1486377 - DNA, 20 bp, Homo sapiens
gggcaggtgtttctttcctg

SEQ ID NO: 1486378 - DNA, 12 bp, Homo sapiens
gggcagtgactg

SEQ ID NO: 1486379 - DNA, 17 bp, Homo sapiens
gggcagtgactggcagg

SEQ ID NO: 1486380 - DNA, 16 bp, Homo sapiens
gggcagtgccacccgc

SEQ ID NO: 1486381 - DNA, 14 bp, Homo sapiens
gggcagtgcccttt

SEQ ID NO: 1486382 - DNA, 21 bp, Homo sapiens
gggcagtgtgaggacctccct

SEQ ID NO: 1486383 - DNA, 23 bp, Homo sapiens
gggcagtgtgaggacctccctgt

SEQ ID NO: 1486384 - DNA, 14 bp, Homo sapiens
gggcagtgtggcct

SEQ ID NO: 1486385 - DNA, 15 bp, Homo sapiens
gggcatagtcagtgt

SEQ ID NO: 1486386 - DNA, 16 bp, Homo sapiens
gggcatcaggcactgg

SEQ ID NO: 1486387 - DNA, 22 bp, Homo sapiens
gggcatccacccagtgctgcca

SEQ ID NO: 1486388 - DNA, 13 bp, Homo sapiens
gggcatcctggat

SEQ ID NO: 1486389 - DNA, 15 bp, Homo sapiens
gggcatcctggatga

SEQ ID NO: 1486390 - DNA, 17 bp, Homo sapiens
gggcatctgcccctccc

SEQ ID NO: 1486391 - DNA, 15 bp, Homo sapiens
gggcatcttctggct

SEQ ID NO: 1486392 - DNA, 17 bp, Homo sapiens
gggcatcttctggcttg

SEQ ID NO: 1486393 - DNA, 22 bp, Homo sapiens
gggcatgcacacggctggtcac

SEQ ID NO: 1486394 - DNA, 23 bp, Homo sapiens
gggcatgcacacggctggtcact

SEQ ID NO: 1486395 - DNA, 14 bp, Homo sapiens
gggcatgctggggc

SEQ ID NO: 1486396 - DNA, 16 bp, Homo sapiens
gggcatggcaggctgg

SEQ ID NO: 1486397 - DNA, 20 bp, Homo sapiens
gggcatggccaggtggccac

SEQ ID NO: 1486398 - DNA, 16 bp, Homo sapiens
gggcatggcgtggagg

SEQ ID NO: 1486399 - DNA, 16 bp, Homo sapiens
gggcatgggtggaggg

SEQ ID NO: 1486400 - DNA, 22 bp, Homo sapiens
gggcatggttccttccctggga

SEQ ID NO: 1486401 - DNA, 18 bp, Homo sapiens
gggcatgtattggcctgg

SEQ ID NO: 1486402 - DNA, 21 bp, Homo sapiens
gggcatgtattggcctggagg

SEQ ID NO: 1486403 - DNA, 22 bp, Homo sapiens
gggcatgtgtgcctgtggcaga

SEQ ID NO: 1486404 - DNA, 23 bp, Homo sapiens
gggcattgctcagcccgcttggc

SEQ ID NO: 1486405 - DNA, 23 bp, Homo sapiens
gggcattgggctgacacctacca

SEQ ID NO: 1486406 - DNA, 21 bp, Homo sapiens
gggcatttcttgcgagcctcg

SEQ ID NO: 1486407 - DNA, 19 bp, Homo sapiens
gggccaaagcacagctggg

SEQ ID NO: 1486408 - DNA, 23 bp, Homo sapiens
gggccaagagatctgtgtggctc

SEQ ID NO: 1486409 - DNA, 16 bp, Homo sapiens
gggctgacccagcatc

SEQ ID NO: 1486410 - DNA, 14 bp, Homo sapiens
gggctgagccccta

SEQ ID NO: 1486411 - DNA, 17 bp, Homo sapiens
gggctgagccctggcag

SEQ ID NO: 1486412 - DNA, 18 bp, Homo sapiens
gggctgagccctggcagg

SEQ ID NO: 1486413 - DNA, 16 bp, Homo sapiens
gggctgagctgcctgt

SEQ ID NO: 1486414 - DNA, 19 bp, Homo sapiens
gggctgaggacgagacccc

SEQ ID NO: 1486415 - DNA, 18 bp, Homo sapiens
gggctgaggggcaacgaa

SEQ ID NO: 1486416 - DNA, 17 bp, Homo sapiens
gggctgagtgacacaag

SEQ ID NO: 1486417 - DNA, 16 bp, Homo sapiens
gggctgcatgatgttt

SEQ ID NO: 1486418 - DNA, 18 bp, Homo sapiens
gggctgccatgtgaagag

SEQ ID NO: 1486419 - DNA, 12 bp, Homo sapiens
gggctgccctgc

SEQ ID NO: 1486420 - DNA, 17 bp, Homo sapiens
gggctgccttctggcct

SEQ ID NO: 1486421 - DNA, 14 bp, Homo sapiens
gggctgctcctcat

SEQ ID NO: 1486422 - DNA, 18 bp, Homo sapiens
gggctgctgagggtctgg

SEQ ID NO: 1486423 - DNA, 14 bp, Homo sapiens
gggctgctgcaggc

SEQ ID NO: 1486424 - DNA, 14 bp, Homo sapiens
gggctgctggggca

SEQ ID NO: 1486425 - DNA, 21 bp, Homo sapiens
gggctgcttaggtctcatgga

SEQ ID NO: 1486426 - DNA, 17 bp, Homo sapiens
gggctgcttcctcctgg

SEQ ID NO: 1486427 - DNA, 14 bp, Homo sapiens
gggctgcttctcca

SEQ ID NO: 1486428 - DNA, 14 bp, Homo sapiens
gggctgcttttctt

SEQ ID NO: 1486429 - DNA, 14 bp, Homo sapiens
gggctggactgagg

SEQ ID NO: 1486430 - DNA, 19 bp, Homo sapiens
gggctggagaaagagctgc

SEQ ID NO: 1486431 - DNA, 14 bp, Homo sapiens
gggctggaggccca

SEQ ID NO: 1486432 - DNA, 15 bp, Homo sapiens
gggctggcaagcagg

SEQ ID NO: 1486433 - DNA, 13 bp, Homo sapiens
gggctggcctagg

SEQ ID NO: 1486434 - DNA, 15 bp, Homo sapiens
gggctggcctaggag

SEQ ID NO: 1486435 - DNA, 19 bp, Homo sapiens
gggctggcggctactcagc

SEQ ID NO: 1486436 - DNA, 15 bp, Homo sapiens
gggctggctcctctg

SEQ ID NO: 1486437 - DNA, 22 bp, Homo sapiens
gggctggctggagtctcagagc

SEQ ID NO: 1486438 - DNA, 18 bp, Homo sapiens
gggctgggagaagaaata

SEQ ID NO: 1486439 - DNA, 17 bp, Homo sapiens
gggctgggccaggtctc

SEQ ID NO: 1486440 - DNA, 18 bp, Homo sapiens
gggctgggccctctcttc

SEQ ID NO: 1486441 - DNA, 16 bp, Homo sapiens
gggctggggaggagga

SEQ ID NO: 1486442 - DNA, 20 bp, Homo sapiens
gggctggggaggaggagaga

SEQ ID NO: 1486443 - DNA, 11 bp, Homo sapiens
gggctggggca

SEQ ID NO: 1486444 - DNA, 13 bp, Homo sapiens
gggctgggggagg

SEQ ID NO: 1486445 - DNA, 16 bp, Homo sapiens
gggctggtccttattt

SEQ ID NO: 1486446 - DNA, 22 bp, Homo sapiens
gggctgtcctgctcacctgtgt

SEQ ID NO: 1486447 - DNA, 16 bp, Homo sapiens
gggctgtcgggggctg

SEQ ID NO: 1486448 - DNA, 22 bp, Homo sapiens
gggctgtgactctgggcaggga

SEQ ID NO: 1486449 - DNA, 21 bp, Homo sapiens
gggctgtgtcctaaggcccat

SEQ ID NO: 1486450 - DNA, 20 bp, Homo sapiens
gggctgttcttccaggaggc

SEQ ID NO: 1486451 - DNA, 17 bp, Homo sapiens
gggctgttggacagctg

SEQ ID NO: 1486452 - DNA, 22 bp, Homo sapiens
gggctgttggacagctgcttgt

SEQ ID NO: 1486453 - DNA, 16 bp, Homo sapiens
gggctgttggcactca

SEQ ID NO: 1486454 - DNA, 15 bp, Homo sapiens
gggcttaagaaatct

SEQ ID NO: 1486455 - DNA, 19 bp, Homo sapiens
gggcttatatctggcctct

SEQ ID NO: 1486456 - DNA, 19 bp, Homo sapiens
gggcttatgtctctgcctt

SEQ ID NO: 1486457 - DNA, 12 bp, Homo sapiens
gggcttcatctg

SEQ ID NO: 1486458 - DNA, 19 bp, Homo sapiens
gggcttcccttctccccag

SEQ ID NO: 1486459 - DNA, 22 bp, Homo sapiens
gggcttcccttctccccagcca

SEQ ID NO: 1486460 - DNA, 17 bp, Homo sapiens
gggcttcctgggtcctg

SEQ ID NO: 1486461 - DNA, 16 bp, Homo sapiens
gggcttctcctgaccc

SEQ ID NO: 1486462 - DNA, 17 bp, Homo sapiens
gggcttctgcaccctcc

SEQ ID NO: 1486463 - DNA, 21 bp, Homo sapiens
gggcttctgcaccctccaccc

SEQ ID NO: 1486464 - DNA, 23 bp, Homo sapiens
gggcttctgcaccctccaccctg

SEQ ID NO: 1486465 - DNA, 13 bp, Homo sapiens
gggcttgaagcca

SEQ ID NO: 1486466 - DNA, 21 bp, Homo sapiens
gggcttggacttcctggggcc

SEQ ID NO: 1486467 - DNA, 15 bp, Homo sapiens
gggcttggcccagcg

SEQ ID NO: 1486468 - DNA, 23 bp, Homo sapiens
gggcttgttgctgttgatgtttt

SEQ ID NO: 1486469 - DNA, 21 bp, Homo sapiens
gggctttccttttatttttta

SEQ ID NO: 1486470 - DNA, 21 bp, Homo sapiens
gggctttctcttccccttcct

SEQ ID NO: 1486471 - DNA, 22 bp, Homo sapiens
gggctttctcttccccttcctg

SEQ ID NO: 1486472 - DNA, 23 bp, Homo sapiens
gggctttctcttccccttcctgt

SEQ ID NO: 1486473 - DNA, 15 bp, Homo sapiens
gggctttctggggcc

SEQ ID NO: 1486474 - DNA, 15 bp, Homo sapiens
gggctttgcaggctc

SEQ ID NO: 1486475 - DNA, 20 bp, Homo sapiens
gggctttgcaggctctgggc

SEQ ID NO: 1486476 - DNA, 18 bp, Homo sapiens
gggctttggttccttctc

SEQ ID NO: 1486477 - DNA, 19 bp, Homo sapiens
gggctttggttccttctct

SEQ ID NO: 1486478 - DNA, 15 bp, Homo sapiens
gggcttttgccactc

SEQ ID NO: 1486479 - DNA, 23 bp, Homo sapiens
ggggaaaatggccatgcaggagg

SEQ ID NO: 1486480 - DNA, 22 bp, Homo sapiens
ggggaaagacactgcctgggct

SEQ ID NO: 1486481 - DNA, 17 bp, Homo sapiens
ggggaaagggctggctg

SEQ ID NO: 1486482 - DNA, 21 bp, Homo sapiens
ggggaacatggctggcctggt

SEQ ID NO: 1486483 - DNA, 13 bp, Homo sapiens
ggggaagccctgg

SEQ ID NO: 1486484 - DNA, 15 bp, Homo sapiens
ggggaagctgcacat

SEQ ID NO: 1486485 - DNA, 22 bp, Homo sapiens
ggggaagggccagtctgggctg

SEQ ID NO: 1486486 - DNA, 17 bp, Homo sapiens
ggggaagggttttcttt

SEQ ID NO: 1486487 - DNA, 15 bp, Homo sapiens
ggggaattccctccc

SEQ ID NO: 1486488 - DNA, 13 bp, Homo sapiens
ggggacagccttc

SEQ ID NO: 1486489 - DNA, 14 bp, Homo sapiens
ggggacagctgtgt

SEQ ID NO: 1486490 - DNA, 15 bp, Homo sapiens
ggggacagcttcctc

SEQ ID NO: 1486491 - DNA, 18 bp, Homo sapiens
ggggaccaattctggaca

SEQ ID NO: 1486492 - DNA, 16 bp, Homo sapiens
ggggacgctccgctgc

SEQ ID NO: 1486493 - DNA, 16 bp, Homo sapiens
ggggactcagccctga

SEQ ID NO: 1486494 - DNA, 10 bp, Homo sapiens
ggggagaaat

SEQ ID NO: 1486495 - DNA, 18 bp, Homo sapiens
ggggagagcctgctggca

SEQ ID NO: 1486496 - DNA, 17 bp, Homo sapiens
ggggagatggggaggag

SEQ ID NO: 1486497 - DNA, 18 bp, Homo sapiens
ggggagccaaaatctcaa

SEQ ID NO: 1486498 - DNA, 11 bp, Homo sapiens
ggggagccagc

SEQ ID NO: 1486499 - DNA, 12 bp, Homo sapiens
ggggagcccagt

SEQ ID NO: 1486500 - DNA, 12 bp, Homo sapiens
ggggaggaaggg

SEQ ID NO: 1486501 - DNA, 22 bp, Homo sapiens
ggggaggacccgggaccacagc

SEQ ID NO: 1486502 - DNA, 12 bp, Homo sapiens
ggggaggcaaga

SEQ ID NO: 1486503 - DNA, 14 bp, Homo sapiens
ggggagggatgaag

SEQ ID NO: 1486504 - DNA, 20 bp, Homo sapiens
ggggaggggcctagggagcc

SEQ ID NO: 1486505 - DNA, 21 bp, Homo sapiens
ggggaggggcctagggagccg

SEQ ID NO: 1486506 - DNA, 15 bp, Homo sapiens
ggggagggggatccg

SEQ ID NO: 1486507 - DNA, 11 bp, Homo sapiens
ggggagtgagt

SEQ ID NO: 1486508 - DNA, 21 bp, Homo sapiens
ggggagttgagtcacaagagg

SEQ ID NO: 1486509 - DNA, 21 bp, Homo sapiens
ggggatccagccacttccccc

SEQ ID NO: 1486510 - DNA, 21 bp, Homo sapiens
ggggatccctcccccccatgc

SEQ ID NO: 1486511 - DNA, 18 bp, Homo sapiens
ggggattgcccctggctt

SEQ ID NO: 1486512 - DNA, 23 bp, Homo sapiens
ggggattgcccctggctttgcct

SEQ ID NO: 1486513 - DNA, 23 bp, Homo sapiens
ggggatttcaaacttaaacaaaa

SEQ ID NO: 1486514 - DNA, 15 bp, Homo sapiens
ggggcaaggtctcct

SEQ ID NO: 1486515 - DNA, 21 bp, Homo sapiens
ggggcacaccactgccctgcc

SEQ ID NO: 1486516 - DNA, 13 bp, Homo sapiens
ggggcacaggagg

SEQ ID NO: 1486517 - DNA, 20 bp, Homo sapiens
ggggcaccttccgacatccc

SEQ ID NO: 1486518 - DNA, 21 bp, Homo sapiens
ggggcacgccctcctcagcga

SEQ ID NO: 1486519 - DNA, 13 bp, Homo sapiens
ggggcagaacagc

SEQ ID NO: 1486520 - DNA, 22 bp, Homo sapiens
ggggcagagggcagaggctgga

SEQ ID NO: 1486521 - DNA, 14 bp, Homo sapiens
ggggcagcaaggcc

SEQ ID NO: 1486522 - DNA, 16 bp, Homo sapiens
ggggcagcactcccca

SEQ ID NO: 1486523 - DNA, 17 bp, Homo sapiens
ggggcaggactgagtcc

SEQ ID NO: 1486524 - DNA, 21 bp, Homo sapiens
ggggcaggagtgccaggacca

SEQ ID NO: 1486525 - DNA, 13 bp, Homo sapiens
ggggcaggcctgg

SEQ ID NO: 1486526 - DNA, 12 bp, Homo sapiens
ggggcaggctga

SEQ ID NO: 1486527 - DNA, 14 bp, Homo sapiens
ggggcagggcctgg

SEQ ID NO: 1486528 - DNA, 13 bp, Homo sapiens
ggggcagtgtgag

SEQ ID NO: 1486529 - DNA, 18 bp, Homo sapiens
ggggccaccaaagctgcc

SEQ ID NO: 1486530 - DNA, 18 bp, Homo sapiens
ggggccacctcctccccc

SEQ ID NO: 1486531 - DNA, 23 bp, Homo sapiens
ggggccactttcagagcccccag

SEQ ID NO: 1486532 - DNA, 17 bp, Homo sapiens
ggggccagatccagcct

SEQ ID NO: 1486533 - DNA, 22 bp, Homo sapiens
ggggcccacaggaagctcagcc

SEQ ID NO: 1486534 - DNA, 19 bp, Homo sapiens
ggggcccagcgctctcctg

SEQ ID NO: 1486535 - DNA, 14 bp, Homo sapiens
ggggccccagatct

SEQ ID NO: 1486536 - DNA, 22 bp, Homo sapiens
ggggccccagatctgcctgggc

SEQ ID NO: 1486537 - DNA, 18 bp, Homo sapiens
ggggccccggggctggca

SEQ ID NO: 1486538 - DNA, 12 bp, Homo sapiens
ggggccctgccc

SEQ ID NO: 1486539 - DNA, 14 bp, Homo sapiens
ggggccctgcccca

SEQ ID NO: 1486540 - DNA, 19 bp, Homo sapiens
ggggccctgccccacccca

SEQ ID NO: 1486541 - DNA, 11 bp, Homo sapiens
ggggccctgct

SEQ ID NO: 1486542 - DNA, 21 bp, Homo sapiens
ggggccctggtccttccaggc

SEQ ID NO: 1486543 - DNA, 17 bp, Homo sapiens
ggggcctagggagccgc

SEQ ID NO: 1486544 - DNA, 15 bp, Homo sapiens
ggggcctccagaagc

SEQ ID NO: 1486545 - DNA, 17 bp, Homo sapiens
ggggcctccagaagctg

SEQ ID NO: 1486546 - DNA, 20 bp, Homo sapiens
ggggcctccttgtccaggtc

SEQ ID NO: 1486547 - DNA, 12 bp, Homo sapiens
ggggcctgcaga

SEQ ID NO: 1486548 - DNA, 15 bp, Homo sapiens
ggggcctgcagaagg

SEQ ID NO: 1486549 - DNA, 20 bp, Homo sapiens
ggggcctgccctctgcccca

SEQ ID NO: 1486550 - DNA, 15 bp, Homo sapiens
ggggcctggacctgc

SEQ ID NO: 1486551 - DNA, 12 bp, Homo sapiens
ggggcctggagg

SEQ ID NO: 1486552 - DNA, 13 bp, Homo sapiens
ggggcctggaggt

SEQ ID NO: 1486553 - DNA, 11 bp, Homo sapiens
ggggcctggct

SEQ ID NO: 1486554 - DNA, 14 bp, Homo sapiens
ggggcctggcttgc

SEQ ID NO: 1486555 - DNA, 16 bp, Homo sapiens
ggggcctgggacttcc

SEQ ID NO: 1486556 - DNA, 17 bp, Homo sapiens
ggggccttatcgggctc

SEQ ID NO: 1486557 - DNA, 20 bp, Homo sapiens
ggggccttgaagactccctg

SEQ ID NO: 1486558 - DNA, 12 bp, Homo sapiens
ggggcgctcagg

SEQ ID NO: 1486559 - DNA, 21 bp, Homo sapiens
ggggcgctcaggacccaggcc

SEQ ID NO: 1486560 - DNA, 15 bp, Homo sapiens
ggggcgctggcccag

SEQ ID NO: 1486561 - DNA, 23 bp, Homo sapiens
ggggcgctggcccagccggcctc

SEQ ID NO: 1486562 - DNA, 19 bp, Homo sapiens
ggggcgtggagggaggccc

SEQ ID NO: 1486563 - DNA, 22 bp, Homo sapiens
ggggctaaggtttccagtcaga

SEQ ID NO: 1486564 - DNA, 14 bp, Homo sapiens
ggggctaatttaac

SEQ ID NO: 1486565 - DNA, 16 bp, Homo sapiens
ggggctccctctctgg

SEQ ID NO: 1486566 - DNA, 12 bp, Homo sapiens
ggggctcctgga

SEQ ID NO: 1486567 - DNA, 13 bp, Homo sapiens
ggggctcctggaa

SEQ ID NO: 1486568 - DNA, 21 bp, Homo sapiens
ggggctcctggaaaggctcag

SEQ ID NO: 1486569 - DNA, 24 bp, Homo sapiens
ggggctctccaaaggggctgctgg

SEQ ID NO: 1486570 - DNA, 14 bp, Homo sapiens
ggggctctgcttcc

SEQ ID NO: 1486571 - DNA, 21 bp, Homo sapiens
ggggctctgcttcctcagccc

SEQ ID NO: 1486572 - DNA, 14 bp, Homo sapiens
ggggctgagctggg

SEQ ID NO: 1486573 - DNA, 20 bp, Homo sapiens
ggggctgatctcagggaagc

SEQ ID NO: 1486574 - DNA, 12 bp, Homo sapiens
ggggctgctccc

SEQ ID NO: 1486575 - DNA, 18 bp, Homo sapiens
ggggctggcaagcaggga

SEQ ID NO: 1486576 - DNA, 12 bp, Homo sapiens
ggggctggggca

SEQ ID NO: 1486577 - DNA, 22 bp, Homo sapiens
ggggctgtcaccacgtgcagta

SEQ ID NO: 1486578 - DNA, 14 bp, Homo sapiens
ggggctgtgccaac

SEQ ID NO: 1486579 - DNA, 12 bp, Homo sapiens
ggggctgtggat

SEQ ID NO: 1486580 - DNA, 22 bp, Homo sapiens
ggggcttagggtcggaacccaa

SEQ ID NO: 1486581 - DNA, 19 bp, Homo sapiens
ggggctttcccaggagaaa

SEQ ID NO: 1486582 - DNA, 15 bp, Homo sapiens
ggggctttctggaga

SEQ ID NO: 1486583 - DNA, 16 bp, Homo sapiens
ggggcttttgccactc

SEQ ID NO: 1486584 - DNA, 22 bp, Homo sapiens
gggggagccggtaactgtcctg

SEQ ID NO: 1486585 - DNA, 13 bp, Homo sapiens
gggggagtgggcg

SEQ ID NO: 1486586 - DNA, 15 bp, Homo sapiens
gggggcacaggaggc

SEQ ID NO: 1486587 - DNA, 11 bp, Homo sapiens
gggggcagagg

SEQ ID NO: 1486588 - DNA, 13 bp, Homo sapiens
gggggcagggctg

SEQ ID NO: 1486589 - DNA, 14 bp, Homo sapiens
gggggccaaggtcc

SEQ ID NO: 1486590 - DNA, 22 bp, Homo sapiens
gggggccccgccagggctgggg

SEQ ID NO: 1486591 - DNA, 13 bp, Homo sapiens
gggggccctgcta

SEQ ID NO: 1486592 - DNA, 14 bp, Homo sapiens
gggggccttgaaga

SEQ ID NO: 1486593 - DNA, 12 bp, Homo sapiens
gggggcgctcag

SEQ ID NO: 1486594 - DNA, 12 bp, Homo sapiens
gggggctctcca

SEQ ID NO: 1486595 - DNA, 12 bp, Homo sapiens
gggggctggcct

SEQ ID NO: 1486596 - DNA, 12 bp, Homo sapiens
gggggctggggg

SEQ ID NO: 1486597 - DNA, 13 bp, Homo sapiens
gggggctggtgcc

SEQ ID NO: 1486598 - DNA, 18 bp, Homo sapiens
gggggctgtgccaacctg

SEQ ID NO: 1486599 - DNA, 22 bp, Homo sapiens
gggggtcccagtgggaggggca

SEQ ID NO: 1486600 - DNA, 18 bp, Homo sapiens
gggggtctcacccatgca

SEQ ID NO: 1486601 - DNA, 15 bp, Homo sapiens
gggggtgctgctctc

SEQ ID NO: 1486602 - DNA, 13 bp, Homo sapiens
gggggtggccgct

SEQ ID NO: 1486603 - DNA, 19 bp, Homo sapiens
gggggtgggggctgtcctg

SEQ ID NO: 1486604 - DNA, 15 bp, Homo sapiens
ggggtaagccagagc

SEQ ID NO: 1486605 - DNA, 15 bp, Homo sapiens
ggggtagcagctgga

SEQ ID NO: 1486606 - DNA, 18 bp, Homo sapiens
ggggtccctccaccccac

SEQ ID NO: 1486607 - DNA, 20 bp, Homo sapiens
ggggtccgtcttcacactgc

SEQ ID NO: 1486608 - DNA, 13 bp, Homo sapiens
ggggtcctctctg

SEQ ID NO: 1486609 - DNA, 20 bp, Homo sapiens
ggggtcctctctgagtcaaa

SEQ ID NO: 1486610 - DNA, 14 bp, Homo sapiens
ggggtctccctggc

SEQ ID NO: 1486611 - DNA, 12 bp, Homo sapiens
ggggtctcctgg

SEQ ID NO: 1486612 - DNA, 17 bp, Homo sapiens
ggggtctgtgctgtgcc

SEQ ID NO: 1486613 - DNA, 23 bp, Homo sapiens
ggggtctgtgtgtttatgtgtgt

SEQ ID NO: 1486614 - DNA, 14 bp, Homo sapiens
ggggtcttaccttg

SEQ ID NO: 1486615 - DNA, 13 bp, Homo sapiens
ggggtgactggaa

SEQ ID NO: 1486616 - DNA, 14 bp, Homo sapiens
ggggtgaggagctg

SEQ ID NO: 1486617 - DNA, 15 bp, Homo sapiens
ggggtgaggagctgg

SEQ ID NO: 1486618 - DNA, 17 bp, Homo sapiens
ggggtgcatctcctccc

SEQ ID NO: 1486619 - DNA, 20 bp, Homo sapiens
ggggtgccccctcctctccc

SEQ ID NO: 1486620 - DNA, 16 bp, Homo sapiens
ggggtgccgctctctc

SEQ ID NO: 1486621 - DNA, 21 bp, Homo sapiens
ggggtgcgctcacctgcagcc

SEQ ID NO: 1486622 - DNA, 22 bp, Homo sapiens
ggggtgcgctcacctgcagccc

SEQ ID NO: 1486623 - DNA, 18 bp, Homo sapiens
ggggtgggggctgtcctg

SEQ ID NO: 1486624 - DNA, 14 bp, Homo sapiens
ggggtggtgtcaga

SEQ ID NO: 1486625 - DNA, 16 bp, Homo sapiens
ggggtgtaacttcctg

SEQ ID NO: 1486626 - DNA, 19 bp, Homo sapiens
ggggttaacttggtcagag

SEQ ID NO: 1486627 - DNA, 17 bp, Homo sapiens
ggggttacaaactgcaa

SEQ ID NO: 1486628 - DNA, 21 bp, Homo sapiens
ggggttacttctcccctgggt

SEQ ID NO: 1486629 - DNA, 20 bp, Homo sapiens
ggggttcataggtcactggc

SEQ ID NO: 1486630 - DNA, 21 bp, Homo sapiens
ggggttccccacacagggcac

SEQ ID NO: 1486631 - DNA, 21 bp, Homo sapiens
ggggttgggattgggggctgg

SEQ ID NO: 1486632 - DNA, 18 bp, Homo sapiens
ggggttgggggacagcct

SEQ ID NO: 1486633 - DNA, 19 bp, Homo sapiens
ggggtttgtgtttgattgg

SEQ ID NO: 1486634 - DNA, 15 bp, Homo sapiens
gggtaaaatactttt

SEQ ID NO: 1486635 - DNA, 17 bp, Homo sapiens
gggtaagccagagcctg

SEQ ID NO: 1486636 - DNA, 14 bp, Homo sapiens
gggtaaggggaggc

SEQ ID NO: 1486637 - DNA, 22 bp, Homo sapiens
gggtaatcagcattattcttca

SEQ ID NO: 1486638 - DNA, 17 bp, Homo sapiens
gggtaatccctgctttt

SEQ ID NO: 1486639 - DNA, 20 bp, Homo sapiens
gggtacagcgcggaggagga

SEQ ID NO: 1486640 - DNA, 16 bp, Homo sapiens
gggttcagcccctcct

SEQ ID NO: 1486641 - DNA, 21 bp, Homo sapiens
gggttcataggtcactggctc

SEQ ID NO: 1486642 - DNA, 22 bp, Homo sapiens
gggttcataggtcactggctct

SEQ ID NO: 1486643 - DNA, 17 bp, Homo sapiens
gggttcctcaaattttt

SEQ ID NO: 1486644 - DNA, 18 bp, Homo sapiens
gggttctgcagcggcaga

SEQ ID NO: 1486645 - DNA, 14 bp, Homo sapiens
gggttctgccctgc

SEQ ID NO: 1486646 - DNA, 21 bp, Homo sapiens
gggttctgccctgcctgagga

SEQ ID NO: 1486647 - DNA, 19 bp, Homo sapiens
gggttctggaaatccagat

SEQ ID NO: 1486648 - DNA, 16 bp, Homo sapiens
gggttcttgagccagc

SEQ ID NO: 1486649 - DNA, 21 bp, Homo sapiens
gggttgaagacggaaaacaat

SEQ ID NO: 1486650 - DNA, 17 bp, Homo sapiens
gggttgaaggcagtctg

SEQ ID NO: 1486651 - DNA, 19 bp, Homo sapiens
gggttgcagtggagaggga

SEQ ID NO: 1486652 - DNA, 20 bp, Homo sapiens
gggttgcgtcctgacggcgc

SEQ ID NO: 1486653 - DNA, 19 bp, Homo sapiens
gggttggctgttccagact

SEQ ID NO: 1486654 - DNA, 22 bp, Homo sapiens
gggttgggcccagatctggtcc

SEQ ID NO: 1486655 - DNA, 15 bp, Homo sapiens
gggtttattcactga

SEQ ID NO: 1486656 - DNA, 20 bp, Homo sapiens
gggtttcaccatgttggcca

SEQ ID NO: 1486657 - DNA, 20 bp, Homo sapiens
gggtttcaccgtgttagcca

SEQ ID NO: 1486658 - DNA, 23 bp, Homo sapiens
gggtttcgactggtccagctctg

SEQ ID NO: 1486659 - DNA, 18 bp, Homo sapiens
gggtttggaccccagctg

SEQ ID NO: 1486660 - DNA, 19 bp, Homo sapiens
gggtttgtgtttgattggc

SEQ ID NO: 1486661 - DNA, 17 bp, Homo sapiens
gggttttccaccctgga

SEQ ID NO: 1486662 - DNA, 22 bp, Homo sapiens
gggttttttagttgaatttttt

SEQ ID NO: 1486663 - DNA, 12 bp, Homo sapiens
ggtaaaaacagc

SEQ ID NO: 1486664 - DNA, 17 bp, Homo sapiens
ggtaaaaagaagaaaaa

SEQ ID NO: 1486665 - DNA, 12 bp, Homo sapiens
ggtaaaaagtgg

SEQ ID NO: 1486666 - DNA, 13 bp, Homo sapiens
ggtaaaatacttc

SEQ ID NO: 1486667 - DNA, 17 bp, Homo sapiens
ggtaaaatctctgaagg

SEQ ID NO: 1486668 - DNA, 21 bp, Homo sapiens
ggtaaatgtttcttttaaaga

SEQ ID NO: 1486669 - DNA, 22 bp, Homo sapiens
ggtaacagtaatacattccatt

SEQ ID NO: 1486670 - DNA, 12 bp, Homo sapiens
ggtaacagtggc

SEQ ID NO: 1486671 - DNA, 15 bp, Homo sapiens
ggtaaccagccacag

SEQ ID NO: 1486672 - DNA, 13 bp, Homo sapiens
ggtaactgtcctg

SEQ ID NO: 1486673 - DNA, 14 bp, Homo sapiens
ggtaagaggagcag

SEQ ID NO: 1486674 - DNA, 15 bp, Homo sapiens
ggtaagccagagcct

SEQ ID NO: 1486675 - DNA, 20 bp, Homo sapiens
ggtaagccagagcctggggt

SEQ ID NO: 1486676 - DNA, 16 bp, Homo sapiens
ggtaagtgttctcatg

SEQ ID NO: 1486677 - DNA, 18 bp, Homo sapiens
ggtaatatacctggttta

SEQ ID NO: 1486678 - DNA, 18 bp, Homo sapiens
ggtaatattgataagcta

SEQ ID NO: 1486679 - DNA, 20 bp, Homo sapiens
ggtaatctacaccaatgaaa

SEQ ID NO: 1486680 - DNA, 12 bp, Homo sapiens
ggtaattgtaca

SEQ ID NO: 1486681 - DNA, 14 bp, Homo sapiens
ggtaattgtacaat

SEQ ID NO: 1486682 - DNA, 14 bp, Homo sapiens
ggtacaacggaggc

SEQ ID NO: 1486683 - DNA, 16 bp, Homo sapiens
ggtacaacggaggcct

SEQ ID NO: 1486684 - DNA, 14 bp, Homo sapiens
ggtacaactgtatt

SEQ ID NO: 1486685 - DNA, 15 bp, Homo sapiens
ggtacaactgtattt

SEQ ID NO: 1486686 - DNA, 17 bp, Homo sapiens
ggtacaatctggctcac

SEQ ID NO: 1486687 - DNA, 15 bp, Homo sapiens
ggtacaggagaggca

SEQ ID NO: 1486688 - DNA, 17 bp, Homo sapiens
ggtacaggagaggcagc

SEQ ID NO: 1486689 - DNA, 21 bp, Homo sapiens
ggtacaggcagttaggtgctg

SEQ ID NO: 1486690 - DNA, 14 bp, Homo sapiens
ggtacatttctctg

SEQ ID NO: 1486691 - DNA, 18 bp, Homo sapiens
ggtacatttctctgagca

SEQ ID NO: 1486692 - DNA, 14 bp, Homo sapiens
ggtaccactgattt

SEQ ID NO: 1486693 - DNA, 20 bp, Homo sapiens
ggtaccaggtgtcaggaaac

SEQ ID NO: 1486694 - DNA, 21 bp, Homo sapiens
ggtacccagccatctgcccag

SEQ ID NO: 1486695 - DNA, 19 bp, Homo sapiens
ggtacccctttctggctct

SEQ ID NO: 1486696 - DNA, 15 bp, Homo sapiens
ggtaccgatttctgc

SEQ ID NO: 1486697 - DNA, 17 bp, Homo sapiens
ggtacctcaagccccat

SEQ ID NO: 1486698 - DNA, 17 bp, Homo sapiens
ggtacctgcaagcagaa

SEQ ID NO: 1486699 - DNA, 12 bp, Homo sapiens
ggtacctggacg

SEQ ID NO: 1486700 - DNA, 12 bp, Homo sapiens
ggtaccttgaac

SEQ ID NO: 1486701 - DNA, 14 bp, Homo sapiens
ggtacggtggcacg

SEQ ID NO: 1486702 - DNA, 14 bp, Homo sapiens
ggtactatatttgc

SEQ ID NO: 1486703 - DNA, 19 bp, Homo sapiens
ggtactggggtgggatctt

SEQ ID NO: 1486704 - DNA, 18 bp, Homo sapiens
ggtactgtctgcttctct

SEQ ID NO: 1486705 - DNA, 21 bp, Homo sapiens
ggtacttcctcctgatggcca

SEQ ID NO: 1486706 - DNA, 19 bp, Homo sapiens
ggtacttcttgaaggtgct

SEQ ID NO: 1486707 - DNA, 16 bp, Homo sapiens
ggtacttgtcatttcg

SEQ ID NO: 1486708 - DNA, 16 bp, Homo sapiens
ggtacttttaaaaaca

SEQ ID NO: 1486709 - DNA, 16 bp, Homo sapiens
ggtagaaggggaggac

SEQ ID NO: 1486710 - DNA, 17 bp, Homo sapiens
ggtagaatgattaatca

SEQ ID NO: 1486711 - DNA, 14 bp, Homo sapiens
ggtagactttgctt

SEQ ID NO: 1486712 - DNA, 16 bp, Homo sapiens
ggtagagacccccagg

SEQ ID NO: 1486713 - DNA, 18 bp, Homo sapiens
ggtagagacccccaggcc

SEQ ID NO: 1486714 - DNA, 21 bp, Homo sapiens
ggtagagctgatccagagcac

SEQ ID NO: 1486715 - DNA, 23 bp, Homo sapiens
ggtagagctgatccagagcacag

SEQ ID NO: 1486716 - DNA, 20 bp, Homo sapiens
ggtagatgcatgacttgtgt

SEQ ID NO: 1486717 - DNA, 15 bp, Homo sapiens
ggtagatgctgaggc

SEQ ID NO: 1486718 - DNA, 13 bp, Homo sapiens
ggtagcagcaggc

SEQ ID NO: 1486719 - DNA, 18 bp, Homo sapiens
ggtagcccagcactgtga

SEQ ID NO: 1486720 - DNA, 20 bp, Homo sapiens
ggtagcccagcactgtgaag

SEQ ID NO: 1486721 - DNA, 18 bp, Homo sapiens
ggtagcttacctgacaca

SEQ ID NO: 1486722 - DNA, 18 bp, Homo sapiens
ggtaggaactgctgggct

SEQ ID NO: 1486723 - DNA, 18 bp, Homo sapiens
ggtaggagttttgttcca

SEQ ID NO: 1486724 - DNA, 16 bp, Homo sapiens
ggtagggaaataatag

SEQ ID NO: 1486725 - DNA, 14 bp, Homo sapiens
ggtagggtaaatca

SEQ ID NO: 1486726 - DNA, 15 bp, Homo sapiens
ggtagggtaaatcag

SEQ ID NO: 1486727 - DNA, 14 bp, Homo sapiens
ggtaggtaaatcta

SEQ ID NO: 1486728 - DNA, 15 bp, Homo sapiens
ggtaggttcagccaa

SEQ ID NO: 1486729 - DNA, 18 bp, Homo sapiens
ggtaggttgggacaccag

SEQ ID NO: 1486730 - DNA, 19 bp, Homo sapiens
ggtaggttgggacaccagg

SEQ ID NO: 1486731 - DNA, 16 bp, Homo sapiens
ggtagtacccagggcc

SEQ ID NO: 1486732 - DNA, 17 bp, Homo sapiens
ggtagtacccagggcca

SEQ ID NO: 1486733 - DNA, 23 bp, Homo sapiens
ggtagtactcctgcaaaatttta

SEQ ID NO: 1486734 - DNA, 15 bp, Homo sapiens
ggtagtctcactgct

SEQ ID NO: 1486735 - DNA, 17 bp, Homo sapiens
ggtagttctgtgcctcc

SEQ ID NO: 1486736 - DNA, 18 bp, Homo sapiens
ggtagttgcaattgaatt

SEQ ID NO: 1486737 - DNA, 22 bp, Homo sapiens
ggtataaaaggttgccaaattg

SEQ ID NO: 1486738 - DNA, 17 bp, Homo sapiens
ggtataatggttgactg

SEQ ID NO: 1486739 - DNA, 22 bp, Homo sapiens
ggtatcattacaattttctgta

SEQ ID NO: 1486740 - DNA, 14 bp, Homo sapiens
ggtatcccctgcct

SEQ ID NO: 1486741 - DNA, 15 bp, Homo sapiens
ggtatcccctgcctc

SEQ ID NO: 1486742 - DNA, 20 bp, Homo sapiens
ggtatcccctgcctcctgcc

SEQ ID NO: 1486743 - DNA, 17 bp, Homo sapiens
ggtatcctgcccagtgt

SEQ ID NO: 1486744 - DNA, 19 bp, Homo sapiens
ggtatctcagaaagtgcct

SEQ ID NO: 1486745 - DNA, 16 bp, Homo sapiens
ggtatctggcttccct

SEQ ID NO: 1486746 - DNA, 18 bp, Homo sapiens
ggtatctggcttccctgg

SEQ ID NO: 1486747 - DNA, 18 bp, Homo sapiens
ggtatgtagccagctgtg

SEQ ID NO: 1486748 - DNA, 12 bp, Homo sapiens
ggtatgtctgcc

SEQ ID NO: 1486749 - DNA, 18 bp, Homo sapiens
ggtatgtttaatctgtta

SEQ ID NO: 1486750 - DNA, 11 bp, Homo sapiens
ggtattaaact

SEQ ID NO: 1486751 - DNA, 18 bp, Homo sapiens
ggtattaagattataatt

SEQ ID NO: 1486752 - DNA, 23 bp, Homo sapiens
ggtattagcaaagcaaaaggctg

SEQ ID NO: 1486753 - DNA, 19 bp, Homo sapiens
ggtatttttattcatgtga

SEQ ID NO: 1486754 - DNA, 18 bp, Homo sapiens
ggtatttttgccctgagt

SEQ ID NO: 1486755 - DNA, 15 bp, Homo sapiens
ggtgaggaccactcc

SEQ ID NO: 1486756 - DNA, 18 bp, Homo sapiens
ggtgaggaccactcctgt

SEQ ID NO: 1486757 - DNA, 15 bp, Homo sapiens
ggtgaggcaataaaa

SEQ ID NO: 1486758 - DNA, 21 bp, Homo sapiens
ggtgaggcccaagagccctgt

SEQ ID NO: 1486759 - DNA, 16 bp, Homo sapiens
ggtgagggacagagcc

SEQ ID NO: 1486760 - DNA, 18 bp, Homo sapiens
ggtgaggggctttctctt

SEQ ID NO: 1486761 - DNA, 14 bp, Homo sapiens
ggtgagggtgcccc

SEQ ID NO: 1486762 - DNA, 16 bp, Homo sapiens
ggtgagtaaggcatgt

SEQ ID NO: 1486763 - DNA, 20 bp, Homo sapiens
ggtgagtcttggttctaaag

SEQ ID NO: 1486764 - DNA, 19 bp, Homo sapiens
ggtgagtttgagctgcctt

SEQ ID NO: 1486765 - DNA, 22 bp, Homo sapiens
ggtgataatagaagagtggcag

SEQ ID NO: 1486766 - DNA, 16 bp, Homo sapiens
ggtgatagcattgctt

SEQ ID NO: 1486767 - DNA, 19 bp, Homo sapiens
ggtgatcaattaaatgtag

SEQ ID NO: 1486768 - DNA, 20 bp, Homo sapiens
ggtgatcctgttctgcgctg

SEQ ID NO: 1486769 - DNA, 12 bp, Homo sapiens
ggtgatgactta

SEQ ID NO: 1486770 - DNA, 12 bp, Homo sapiens
ggtgatgcctaa

SEQ ID NO: 1486771 - DNA, 18 bp, Homo sapiens
ggtgatgcctaattatga

SEQ ID NO: 1486772 - DNA, 19 bp, Homo sapiens
ggtgatgtttccagctgcc

SEQ ID NO: 1486773 - DNA, 20 bp, Homo sapiens
ggtgatgtttccagctgcca

SEQ ID NO: 1486774 - DNA, 21 bp, Homo sapiens
ggtgatgtttccagctgccaa

SEQ ID NO: 1486775 - DNA, 23 bp, Homo sapiens
ggtgatttcagactgcagagggg

SEQ ID NO: 1486776 - DNA, 12 bp, Homo sapiens
ggtgcaaatcct

SEQ ID NO: 1486777 - DNA, 15 bp, Homo sapiens
ggtgcacagtgattt

SEQ ID NO: 1486778 - DNA, 22 bp, Homo sapiens
ggtgcacccacctgttttctga

SEQ ID NO: 1486779 - DNA, 11 bp, Homo sapiens
ggtgcagaggt

SEQ ID NO: 1486780 - DNA, 16 bp, Homo sapiens
ggtgcagagtgcccag

SEQ ID NO: 1486781 - DNA, 17 bp, Homo sapiens
ggtgcagagtgcccaga

SEQ ID NO: 1486782 - DNA, 22 bp, Homo sapiens
ggtgcatacacccccacctcct

SEQ ID NO: 1486783 - DNA, 13 bp, Homo sapiens
ggtgcatgggctc

SEQ ID NO: 1486784 - DNA, 17 bp, Homo sapiens
ggtgccaaatagcccca

SEQ ID NO: 1486785 - DNA, 21 bp, Homo sapiens
ggtgccaaatagccccagact

SEQ ID NO: 1486786 - DNA, 15 bp, Homo sapiens
ggtgccaactggtgt

SEQ ID NO: 1486787 - DNA, 22 bp, Homo sapiens
ggtgccaagggccccaggggca

SEQ ID NO: 1486788 - DNA, 22 bp, Homo sapiens
ggtgccacttcttaaaggcctg

SEQ ID NO: 1486789 - DNA, 14 bp, Homo sapiens
ggtgccagccttcc

SEQ ID NO: 1486790 - DNA, 20 bp, Homo sapiens
ggtgccagccttcctctgca

SEQ ID NO: 1486791 - DNA, 23 bp, Homo sapiens
ggtgccagccttcctctgcagct

SEQ ID NO: 1486792 - DNA, 17 bp, Homo sapiens
ggtgccatgcctgctcc

SEQ ID NO: 1486793 - DNA, 17 bp, Homo sapiens
ggtgcccaagccagagg

SEQ ID NO: 1486794 - DNA, 21 bp, Homo sapiens
ggtgcccacaccggggacagg

SEQ ID NO: 1486795 - DNA, 14 bp, Homo sapiens
ggtgcccagggcca

SEQ ID NO: 1486796 - DNA, 15 bp, Homo sapiens
ggtgccccacctgcc

SEQ ID NO: 1486797 - DNA, 19 bp, Homo sapiens
ggtgccccacctgcctggt

SEQ ID NO: 1486798 - DNA, 14 bp, Homo sapiens
ggtgccccaggacc

SEQ ID NO: 1486799 - DNA, 22 bp, Homo sapiens
ggtgccccccacccctggaaga

SEQ ID NO: 1486800 - DNA, 12 bp, Homo sapiens
ggtgccccctcc

SEQ ID NO: 1486801 - DNA, 23 bp, Homo sapiens
ggtgccccctcctctcccatccc

SEQ ID NO: 1486802 - DNA, 19 bp, Homo sapiens
ggtgcccgtaatcccagct

SEQ ID NO: 1486803 - DNA, 16 bp, Homo sapiens
ggtgccctgaaagggc

SEQ ID NO: 1486804 - DNA, 19 bp, Homo sapiens
ggtgccctgaaagggccct

SEQ ID NO: 1486805 - DNA, 19 bp, Homo sapiens
ggtgccgctctctctgagg

SEQ ID NO: 1486806 - DNA, 16 bp, Homo sapiens
ggtgccgctttctctg

SEQ ID NO: 1486807 - DNA, 17 bp, Homo sapiens
ggtgccgctttctctga

SEQ ID NO: 1486808 - DNA, 21 bp, Homo sapiens
ggtgccggcatctcccctagc

SEQ ID NO: 1486809 - DNA, 14 bp, Homo sapiens
ggtgccgtgagcag

SEQ ID NO: 1486810 - DNA, 13 bp, Homo sapiens
ggtgcctcagact

SEQ ID NO: 1486811 - DNA, 22 bp, Homo sapiens
ggtgcctcagttttccttctgt

SEQ ID NO: 1486812 - DNA, 21 bp, Homo sapiens
ggtgcctcatagcatagccag

SEQ ID NO: 1486813 - DNA, 14 bp, Homo sapiens
ggtgcctccaggtg

SEQ ID NO: 1486814 - DNA, 15 bp, Homo sapiens
ggtgcctgagaggca

SEQ ID NO: 1486815 - DNA, 23 bp, Homo sapiens
ggtgcctgggtggggctgctcct

SEQ ID NO: 1486816 - DNA, 15 bp, Homo sapiens
ggtgcgggcctggcc

SEQ ID NO: 1486817 - DNA, 17 bp, Homo sapiens
ggtgcgtctccagtcat

SEQ ID NO: 1486818 - DNA, 17 bp, Homo sapiens
ggtgcgtggctgtggca

SEQ ID NO: 1486819 - DNA, 18 bp, Homo sapiens
ggtgcgtggctgtggcac

SEQ ID NO: 1486820 - DNA, 16 bp, Homo sapiens
ggtgcgtgttcagcag

SEQ ID NO: 1486821 - DNA, 13 bp, Homo sapiens
ggtgcgtttttac

SEQ ID NO: 1486822 - DNA, 17 bp, Homo sapiens
ggtgctaaagccaacca

SEQ ID NO: 1486823 - DNA, 20 bp, Homo sapiens
ggtgctaaatggtcgcccag

SEQ ID NO: 1486824 - DNA, 23 bp, Homo sapiens
ggtgctaaatggtcgcccaggag

SEQ ID NO: 1486825 - DNA, 21 bp, Homo sapiens
ggtgctacaaaaacacagcaa

SEQ ID NO: 1486826 - DNA, 23 bp, Homo sapiens
ggtgctacaaaaacacagcaagg

SEQ ID NO: 1486827 - DNA, 14 bp, Homo sapiens
ggtgctctctgcca

SEQ ID NO: 1486828 - DNA, 16 bp, Homo sapiens
ggtgctctctgccact

SEQ ID NO: 1486829 - DNA, 19 bp, Homo sapiens
ggtgctctgaggcctcact

SEQ ID NO: 1486830 - DNA, 17 bp, Homo sapiens
ggtgctgaactgtgcat

SEQ ID NO: 1486831 - DNA, 16 bp, Homo sapiens
ggtgctgacggccagg

SEQ ID NO: 1486832 - DNA, 18 bp, Homo sapiens
ggtgctgactgaggcctg

SEQ ID NO: 1486833 - DNA, 20 bp, Homo sapiens
ggtgctgaggatacagctct

SEQ ID NO: 1486834 - DNA, 21 bp, Homo sapiens
ggtgctgcaggagtgtcctgc

SEQ ID NO: 1486835 - DNA, 20 bp, Homo sapiens
ggtgctgctaattctttgca

SEQ ID NO: 1486836 - DNA, 13 bp, Homo sapiens
ggtgctgctcagg

SEQ ID NO: 1486837 - DNA, 24 bp, Homo sapiens
ggtgctgggactgagccagtccca

SEQ ID NO: 1486838 - DNA, 15 bp, Homo sapiens
ggtgctgggaggagg

SEQ ID NO: 1486839 - DNA, 17 bp, Homo sapiens
ggtgctgggctggactg

SEQ ID NO: 1486840 - DNA, 13 bp, Homo sapiens
ggtgctggtcccg

SEQ ID NO: 1486841 - DNA, 14 bp, Homo sapiens
ggtgctgtgaggga

SEQ ID NO: 1486842 - DNA, 17 bp, Homo sapiens
ggtgctgtggtggggag

SEQ ID NO: 1486843 - DNA, 16 bp, Homo sapiens
ggtgctgtgtgcccca

SEQ ID NO: 1486844 - DNA, 17 bp, Homo sapiens
ggtgctgtttaaagtca

SEQ ID NO: 1486845 - DNA, 21 bp, Homo sapiens
ggtgcttggtgagtcttggtt

SEQ ID NO: 1486846 - DNA, 19 bp, Homo sapiens
ggtgcttttatagaggcta

SEQ ID NO: 1486847 - DNA, 18 bp, Homo sapiens
ggtgcttttgatgtgaaa

SEQ ID NO: 1486848 - DNA, 21 bp, Homo sapiens
ggtggaaataatttgaatgta

SEQ ID NO: 1486849 - DNA, 18 bp, Homo sapiens
ggtggaagccctccttcc

SEQ ID NO: 1486850 - DNA, 20 bp, Homo sapiens
ggtggaagctgggtgagcca

SEQ ID NO: 1486851 - DNA, 15 bp, Homo sapiens
ggtggaaggatggga

SEQ ID NO: 1486852 - DNA, 21 bp, Homo sapiens
ggtggaagggggtgtgcgtgc

SEQ ID NO: 1486853 - DNA, 17 bp, Homo sapiens
ggtggaagtgcccagcc

SEQ ID NO: 1486854 - DNA, 20 bp, Homo sapiens
ggtggaagtgcccagcccct

SEQ ID NO: 1486855 - DNA, 17 bp, Homo sapiens
ggtggacagtcctggga

SEQ ID NO: 1486856 - DNA, 13 bp, Homo sapiens
ggtggacctggca

SEQ ID NO: 1486857 - DNA, 21 bp, Homo sapiens
ggtggagaaaattggaactct

SEQ ID NO: 1486858 - DNA, 21 bp, Homo sapiens
ggtggagaagatcgcatggca

SEQ ID NO: 1486859 - DNA, 16 bp, Homo sapiens
ggtggagaagggaggg

SEQ ID NO: 1486860 - DNA, 15 bp, Homo sapiens
ggtggagcagccaga

SEQ ID NO: 1486861 - DNA, 17 bp, Homo sapiens
ggtggagcagccagagc

SEQ ID NO: 1486862 - DNA, 23 bp, Homo sapiens
ggtggagccaagtggtccagcgt

SEQ ID NO: 1486863 - DNA, 16 bp, Homo sapiens
ggtggagccagggcct

SEQ ID NO: 1486864 - DNA, 15 bp, Homo sapiens
ggtggaggcttcctg

SEQ ID NO: 1486865 - DNA, 15 bp, Homo sapiens
ggtggagtcaggctt

SEQ ID NO: 1486866 - DNA, 22 bp, Homo sapiens
ggtggattctccctgggcctca

SEQ ID NO: 1486867 - DNA, 12 bp, Homo sapiens
ggtggcaagtgc

SEQ ID NO: 1486868 - DNA, 17 bp, Homo sapiens
ggtggcacaggccccct

SEQ ID NO: 1486869 - DNA, 21 bp, Homo sapiens
gtaaaaaatggaaaaaaacat

SEQ ID NO: 1486870 - DNA, 23 bp, Homo sapiens
gtaaaaaatgtctcatgtcaatg

SEQ ID NO: 1486871 - DNA, 18 bp, Homo sapiens
gtaaaaacagcattgctt

SEQ ID NO: 1486872 - DNA, 19 bp, Homo sapiens
gtaaaaacagcattgcttt

SEQ ID NO: 1486873 - DNA, 23 bp, Homo sapiens
gtaaaaacagcattgctttctga

SEQ ID NO: 1486874 - DNA, 17 bp, Homo sapiens
gtaaaaactagaaggct

SEQ ID NO: 1486875 - DNA, 15 bp, Homo sapiens
gtaaaaagtggctgc

SEQ ID NO: 1486876 - DNA, 13 bp, Homo sapiens
gtaaaaatgctgc

SEQ ID NO: 1486877 - DNA, 16 bp, Homo sapiens
gtaaaaatgctgctct

SEQ ID NO: 1486878 - DNA, 14 bp, Homo sapiens
gtaaaacaaaattt

SEQ ID NO: 1486879 - DNA, 22 bp, Homo sapiens
gtaaaacaatgccatgaacaaa

SEQ ID NO: 1486880 - DNA, 13 bp, Homo sapiens
gtaaaacacatat

SEQ ID NO: 1486881 - DNA, 20 bp, Homo sapiens
gtaaaacagggccacataga

SEQ ID NO: 1486882 - DNA, 18 bp, Homo sapiens
gtaaaagaacagtaaaca

SEQ ID NO: 1486883 - DNA, 17 bp, Homo sapiens
gtaaaagataacaagat

SEQ ID NO: 1486884 - DNA, 12 bp, Homo sapiens
gtaaaagtctac

SEQ ID NO: 1486885 - DNA, 22 bp, Homo sapiens
gtaaaatacttttactctgcct

SEQ ID NO: 1486886 - DNA, 18 bp, Homo sapiens
gtaaaatatgtaaaacta

SEQ ID NO: 1486887 - DNA, 23 bp, Homo sapiens
gtaaaatccccttcgctgaaatt

SEQ ID NO: 1486888 - DNA, 12 bp, Homo sapiens
gtaaaatcttgt

SEQ ID NO: 1486889 - DNA, 13 bp, Homo sapiens
gtaaaatgaacat

SEQ ID NO: 1486890 - DNA, 15 bp, Homo sapiens
gtaaaatgaattgaa

SEQ ID NO: 1486891 - DNA, 16 bp, Homo sapiens
gtaaaatgaattgaaa

SEQ ID NO: 1486892 - DNA, 20 bp, Homo sapiens
gtaaaatgtgaagtgaatga

SEQ ID NO: 1486893 - DNA, 19 bp, Homo sapiens
gtaaaattgctgtgcttta

SEQ ID NO: 1486894 - DNA, 19 bp, Homo sapiens
gtaaacagatggcactttg

SEQ ID NO: 1486895 - DNA, 22 bp, Homo sapiens
gtaaacaggtatttttttaaat

SEQ ID NO: 1486896 - DNA, 13 bp, Homo sapiens
gtaaacagtgcct

SEQ ID NO: 1486897 - DNA, 15 bp, Homo sapiens
gtaaacataaaaact

SEQ ID NO: 1486898 - DNA, 16 bp, Homo sapiens
gtaaaccactgaaaaa

SEQ ID NO: 1486899 - DNA, 20 bp, Homo sapiens
gtaaaccactgaaaaaatat

SEQ ID NO: 1486900 - DNA, 22 bp, Homo sapiens
gtaaactatcttggtgaatttt

SEQ ID NO: 1486901 - DNA, 16 bp, Homo sapiens
gtaaactcaaaatatt

SEQ ID NO: 1486902 - DNA, 20 bp, Homo sapiens
gtaaactgtatcaaatctgt

SEQ ID NO: 1486903 - DNA, 20 bp, Homo sapiens
gtaaactgtgtattccaaga

SEQ ID NO: 1486904 - DNA, 16 bp, Homo sapiens
gtaaacttctgcaaca

SEQ ID NO: 1486905 - DNA, 17 bp, Homo sapiens
gtaaactttatcactta

SEQ ID NO: 1486906 - DNA, 19 bp, Homo sapiens
gtaaagaattttcatcccg

SEQ ID NO: 1486907 - DNA, 14 bp, Homo sapiens
gtaaagacaaataa

SEQ ID NO: 1486908 - DNA, 19 bp, Homo sapiens
gtaaagatatttttatctt

SEQ ID NO: 1486909 - DNA, 22 bp, Homo sapiens
gtaaagatatttttatctttat

SEQ ID NO: 1486910 - DNA, 21 bp, Homo sapiens
gtaaagatgtttatttcaggc

SEQ ID NO: 1486911 - DNA, 14 bp, Homo sapiens
gtaaagatttctgt

SEQ ID NO: 1486912 - DNA, 16 bp, Homo sapiens
gtaaagatttctgttc

SEQ ID NO: 1486913 - DNA, 18 bp, Homo sapiens
gtaaagcctcatttgaat

SEQ ID NO: 1486914 - DNA, 23 bp, Homo sapiens
gtaaagctatttatgggcccctg

SEQ ID NO: 1486915 - DNA, 17 bp, Homo sapiens
gtaaagcttaaattgct

SEQ ID NO: 1486916 - DNA, 12 bp, Homo sapiens
gtaaaggaggaa

SEQ ID NO: 1486917 - DNA, 14 bp, Homo sapiens
gtaaaggagggaga

SEQ ID NO: 1486918 - DNA, 17 bp, Homo sapiens
gtaaagtatgtattatt

SEQ ID NO: 1486919 - DNA, 19 bp, Homo sapiens
gtaaagttatgtatttaaa

SEQ ID NO: 1486920 - DNA, 15 bp, Homo sapiens
gtaaataaaatgtgt

SEQ ID NO: 1486921 - DNA, 16 bp, Homo sapiens
gtaaataaactattta

SEQ ID NO: 1486922 - DNA, 20 bp, Homo sapiens
gtaaataactggaaaacaga

SEQ ID NO: 1486923 - DNA, 21 bp, Homo sapiens
gtaaataactggaaaacagaa

SEQ ID NO: 1486924 - DNA, 16 bp, Homo sapiens
gtaaataagagatttg

SEQ ID NO: 1486925 - DNA, 20 bp, Homo sapiens
gtaaataggatttttagaat

SEQ ID NO: 1486926 - DNA, 23 bp, Homo sapiens
gtaaatagtgtcatataaactca

SEQ ID NO: 1486927 - DNA, 15 bp, Homo sapiens
gtaaatatgaatctg

SEQ ID NO: 1486928 - DNA, 14 bp, Homo sapiens
gtaaatattctata

SEQ ID NO: 1486929 - DNA, 21 bp, Homo sapiens
gtaaatcagtaagaggtgtta

SEQ ID NO: 1486930 - DNA, 19 bp, Homo sapiens
gtaaatcctgccatttaaa

SEQ ID NO: 1486931 - DNA, 16 bp, Homo sapiens
gtaaatcctttttctt

SEQ ID NO: 1486932 - DNA, 22 bp, Homo sapiens
gtaaatcctttttctttataaa

SEQ ID NO: 1486933 - DNA, 15 bp, Homo sapiens
gtaaatctgccacaa

SEQ ID NO: 1486934 - DNA, 15 bp, Homo sapiens
gtaaatgcatattaa

SEQ ID NO: 1486935 - DNA, 19 bp, Homo sapiens
gtaaatgcatattaaataa

SEQ ID NO: 1486936 - DNA, 22 bp, Homo sapiens
gtaaatgcctcttaaattatat

SEQ ID NO: 1486937 - DNA, 18 bp, Homo sapiens
gtaaatgctctaactgga

SEQ ID NO: 1486938 - DNA, 12 bp, Homo sapiens
gtaaatgtactg

SEQ ID NO: 1486939 - DNA, 22 bp, Homo sapiens
gtaaatgtactggtaattgtac

SEQ ID NO: 1486940 - DNA, 23 bp, Homo sapiens
gtaaatgtactggtaattgtaca

SEQ ID NO: 1486941 - DNA, 12 bp, Homo sapiens
gtaaatgtttct

SEQ ID NO: 1486942 - DNA, 14 bp, Homo sapiens
gtaaatgtttcttt

SEQ ID NO: 1486943 - DNA, 19 bp, Homo sapiens
gtaaatgtttcttttccct

SEQ ID NO: 1486944 - DNA, 17 bp, Homo sapiens
gtaaattaaacattttt

SEQ ID NO: 1486945 - DNA, 12 bp, Homo sapiens
gtaaattcagac

SEQ ID NO: 1486946 - DNA, 13 bp, Homo sapiens
gtaaattcagaca

SEQ ID NO: 1486947 - DNA, 17 bp, Homo sapiens
gtaaattcagacaacat

SEQ ID NO: 1486948 - DNA, 20 bp, Homo sapiens
gtaaatttgtactatttaac

SEQ ID NO: 1486949 - DNA, 14 bp, Homo sapiens
gtaacaatacaaat

SEQ ID NO: 1486950 - DNA, 18 bp, Homo sapiens
gtaacaatacaaatggat

SEQ ID NO: 1486951 - DNA, 17 bp, Homo sapiens
gtaacaatgaagataaa

SEQ ID NO: 1486952 - DNA, 19 bp, Homo sapiens
gtaacaattttaatgctat

SEQ ID NO: 1486953 - DNA, 12 bp, Homo sapiens
gtaacacagtat

SEQ ID NO: 1486954 - DNA, 15 bp, Homo sapiens
gtaacactaatatat

SEQ ID NO: 1486955 - DNA, 19 bp, Homo sapiens
gtaacactaatatatttaa

SEQ ID NO: 1486956 - DNA, 16 bp, Homo sapiens
gtaacaggtctcctct

SEQ ID NO: 1486957 - DNA, 20 bp, Homo sapiens
gtaacaggtctcctcttaaa

SEQ ID NO: 1486958 - DNA, 17 bp, Homo sapiens
gtaacatttctgttctc

SEQ ID NO: 1486959 - DNA, 14 bp, Homo sapiens
gtaacatttgctgt

SEQ ID NO: 1486960 - DNA, 20 bp, Homo sapiens
gtaaccaaatattaaagatt

SEQ ID NO: 1486961 - DNA, 22 bp, Homo sapiens
gtaaccagccacagtacatatg

SEQ ID NO: 1486962 - DNA, 16 bp, Homo sapiens
gtaaccagttataaat

SEQ ID NO: 1486963 - DNA, 17 bp, Homo sapiens
gtaacccctcctggctg

SEQ ID NO: 1486964 - DNA, 10 bp, Homo sapiens
gtaactacaa

SEQ ID NO: 1486965 - DNA, 17 bp, Homo sapiens
gtaactccaccaaccca

SEQ ID NO: 1486966 - DNA, 19 bp, Homo sapiens
gtaactctaattcccattt

SEQ ID NO: 1486967 - DNA, 19 bp, Homo sapiens
gtaactgcattgagaactg

SEQ ID NO: 1486968 - DNA, 22 bp, Homo sapiens
gtaactgcattgagaactgcat

SEQ ID NO: 1486969 - DNA, 12 bp, Homo sapiens
gtaactgccagc

SEQ ID NO: 1486970 - DNA, 14 bp, Homo sapiens
gtaactgctgaaaa

SEQ ID NO: 1486971 - DNA, 18 bp, Homo sapiens
gtaactgctgagccactc

SEQ ID NO: 1486972 - DNA, 22 bp, Homo sapiens
gtaactgctgagccactcgcag

SEQ ID NO: 1486973 - DNA, 23 bp, Homo sapiens
gtaactggttaaaaaacaaatgt

SEQ ID NO: 1486974 - DNA, 15 bp, Homo sapiens
gtaactggttgctgt

SEQ ID NO: 1486975 - DNA, 14 bp, Homo sapiens
gtaacttatattga

SEQ ID NO: 1486976 - DNA, 22 bp, Homo sapiens
gtaacttatattgaagacaatt

SEQ ID NO: 1486977 - DNA, 23 bp, Homo sapiens
gtaacttatattgaagacaattt

SEQ ID NO: 1486978 - DNA, 13 bp, Homo sapiens
gtaacttcctgct

SEQ ID NO: 1486979 - DNA, 20 bp, Homo sapiens
gtaacttgcttaaatttctt

SEQ ID NO: 1486980 - DNA, 12 bp, Homo sapiens
gtaactttatgt

SEQ ID NO: 1486981 - DNA, 15 bp, Homo sapiens
gtaacttttgtaaga

SEQ ID NO: 1486982 - DNA, 17 bp, Homo sapiens
gtaagaaaagtggttgt

SEQ ID NO: 1486983 - DNA, 23 bp, Homo sapiens
gtaagaacaactacctgagctaa

SEQ ID NO: 1486984 - DNA, 23 bp, Homo sapiens
gtacggatttgtccaaataaatt

SEQ ID NO: 1486985 - DNA, 17 bp, Homo sapiens
gtacgtttgtatgtgtg

SEQ ID NO: 1486986 - DNA, 16 bp, Homo sapiens
gtactaatctgagatt

SEQ ID NO: 1486987 - DNA, 15 bp, Homo sapiens
gtactacccagctct

SEQ ID NO: 1486988 - DNA, 20 bp, Homo sapiens
gtactactagatgtctttag

SEQ ID NO: 1486989 - DNA, 14 bp, Homo sapiens
gtactagtgttctg

SEQ ID NO: 1486990 - DNA, 13 bp, Homo sapiens
gtactagttttag

SEQ ID NO: 1486991 - DNA, 19 bp, Homo sapiens
gtactataagtagttggtt

SEQ ID NO: 1486992 - DNA, 20 bp, Homo sapiens
gtactataagtagttggttt

SEQ ID NO: 1486993 - DNA, 15 bp, Homo sapiens
gtactatgtatcaat

SEQ ID NO: 1486994 - DNA, 21 bp, Homo sapiens
gtactatttagatataacact

SEQ ID NO: 1486995 - DNA, 14 bp, Homo sapiens
gtactcacatataa

SEQ ID NO: 1486996 - DNA, 20 bp, Homo sapiens
gtactcacatataacatgca

SEQ ID NO: 1486997 - DNA, 14 bp, Homo sapiens
gtactcagagcaga

SEQ ID NO: 1486998 - DNA, 16 bp, Homo sapiens
gtactcagagcagagc

SEQ ID NO: 1486999 - DNA, 24 bp, Homo sapiens
gtactccagcccggcactccagcc

SEQ ID NO: 1487000 - DNA, 16 bp, Homo sapiens
gtactccctctcagga

SEQ ID NO: 1487001 - DNA, 15 bp, Homo sapiens
gtactcctgcaaaat

SEQ ID NO: 1487002 - DNA, 16 bp, Homo sapiens
gtactcctgcaaaatt

SEQ ID NO: 1487003 - DNA, 18 bp, Homo sapiens
gtactctataagaggtgt

SEQ ID NO: 1487004 - DNA, 15 bp, Homo sapiens
gtactctctgctcta

SEQ ID NO: 1487005 - DNA, 23 bp, Homo sapiens
gtactcttccgatgtttgtgtca

SEQ ID NO: 1487006 - DNA, 14 bp, Homo sapiens
gtactcttgctgat

SEQ ID NO: 1487007 - DNA, 14 bp, Homo sapiens
gtactgaaagcctt

SEQ ID NO: 1487008 - DNA, 22 bp, Homo sapiens
gtactgaatttttttgtaataa

SEQ ID NO: 1487009 - DNA, 20 bp, Homo sapiens
gtactgactgagataagaaa

SEQ ID NO: 1487010 - DNA, 14 bp, Homo sapiens
gtactgactttgct

SEQ ID NO: 1487011 - DNA, 17 bp, Homo sapiens
gtactgattcaagaaca

SEQ ID NO: 1487012 - DNA, 22 bp, Homo sapiens
gtactgattcaagaacaagcaa

SEQ ID NO: 1487013 - DNA, 14 bp, Homo sapiens
gtactgatttcagt

SEQ ID NO: 1487014 - DNA, 20 bp, Homo sapiens
gtactgatttcagtaagtct

SEQ ID NO: 1487015 - DNA, 22 bp, Homo sapiens
gtactgcattctctcccatcct

SEQ ID NO: 1487016 - DNA, 22 bp, Homo sapiens
gtactgccccccatgaggaagg

SEQ ID NO: 1487017 - DNA, 16 bp, Homo sapiens
gtactggaaaagccct

SEQ ID NO: 1487018 - DNA, 16 bp, Homo sapiens
gtactggcatggtacg

SEQ ID NO: 1487019 - DNA, 17 bp, Homo sapiens
gtactgtctgcttctct

SEQ ID NO: 1487020 - DNA, 22 bp, Homo sapiens
gtactgttcggaaggggttcct

SEQ ID NO: 1487021 - DNA, 17 bp, Homo sapiens
gtacttaaatgaaagca

SEQ ID NO: 1487022 - DNA, 23 bp, Homo sapiens
gtacttaaatggtaataagcact

SEQ ID NO: 1487023 - DNA, 19 bp, Homo sapiens
gtacttagcagctatctct

SEQ ID NO: 1487024 - DNA, 19 bp, Homo sapiens
gtacttagccagttcaaag

SEQ ID NO: 1487025 - DNA, 23 bp, Homo sapiens
gtacttagccagttcaaagtgta

SEQ ID NO: 1487026 - DNA, 23 bp, Homo sapiens
gtacttaggcttggctgccctgt

SEQ ID NO: 1487027 - DNA, 16 bp, Homo sapiens
gtacttattactgcta

SEQ ID NO: 1487028 - DNA, 14 bp, Homo sapiens
gtacttcctcctga

SEQ ID NO: 1487029 - DNA, 18 bp, Homo sapiens
gtacttcctcctgatggc

SEQ ID NO: 1487030 - DNA, 16 bp, Homo sapiens
gtacttctctgtgtgc

SEQ ID NO: 1487031 - DNA, 22 bp, Homo sapiens
gtacttggtttttttttttctt

SEQ ID NO: 1487032 - DNA, 16 bp, Homo sapiens
gtacttgtttctctgt

SEQ ID NO: 1487033 - DNA, 12 bp, Homo sapiens
gtacttgtttgc

SEQ ID NO: 1487034 - DNA, 15 bp, Homo sapiens
gtacttgtttgctat

SEQ ID NO: 1487035 - DNA, 17 bp, Homo sapiens
gtactttaaaaaggaaa

SEQ ID NO: 1487036 - DNA, 15 bp, Homo sapiens
gtactttatcatgaa

SEQ ID NO: 1487037 - DNA, 20 bp, Homo sapiens
gtactttatcatgaatgctt

SEQ ID NO: 1487038 - DNA, 22 bp, Homo sapiens
gtactttattgtacagactgtt

SEQ ID NO: 1487039 - DNA, 19 bp, Homo sapiens
gtactttatttttctgata

SEQ ID NO: 1487040 - DNA, 18 bp, Homo sapiens
gtactttctaagagaaag

SEQ ID NO: 1487041 - DNA, 16 bp, Homo sapiens
gtacttttaaaaacat

SEQ ID NO: 1487042 - DNA, 23 bp, Homo sapiens
gtacttttattttacacagaaac

SEQ ID NO: 1487043 - DNA, 16 bp, Homo sapiens
gtacttttcattctct

SEQ ID NO: 1487044 - DNA, 20 bp, Homo sapiens
gtacttttcattctctttta

SEQ ID NO: 1487045 - DNA, 18 bp, Homo sapiens
gtacttttgagtgtgtgt

SEQ ID NO: 1487046 - DNA, 19 bp, Homo sapiens
gtacttttgagtgtgtgtg

SEQ ID NO: 1487047 - DNA, 22 bp, Homo sapiens
gtacttttgagtgtgtgtgtgc

SEQ ID NO: 1487048 - DNA, 22 bp, Homo sapiens
gtagaaagttgtaaaatagaaa

SEQ ID NO: 1487049 - DNA, 17 bp, Homo sapiens
gtagaaataatatgcat

SEQ ID NO: 1487050 - DNA, 14 bp, Homo sapiens
gtagaaatgatgat

SEQ ID NO: 1487051 - DNA, 17 bp, Homo sapiens
gtagaacactaattcat

SEQ ID NO: 1487052 - DNA, 17 bp, Homo sapiens
gtagaactcactctggg

SEQ ID NO: 1487053 - DNA, 19 bp, Homo sapiens
gtagaactcactctgggct

SEQ ID NO: 1487054 - DNA, 21 bp, Homo sapiens
gtagaactcactctgggctgt

SEQ ID NO: 1487055 - DNA, 17 bp, Homo sapiens
gtagaactccaggccct

SEQ ID NO: 1487056 - DNA, 16 bp, Homo sapiens
gtagaactgttcattt

SEQ ID NO: 1487057 - DNA, 21 bp, Homo sapiens
gtagaagtcttagatgtatat

SEQ ID NO: 1487058 - DNA, 19 bp, Homo sapiens
gtagaagtgagtttgtaaa

SEQ ID NO: 1487059 - DNA, 21 bp, Homo sapiens
gtagaagtgagtttgtaaata

SEQ ID NO: 1487060 - DNA, 22 bp, Homo sapiens
gtagaattaccattaattacat

SEQ ID NO: 1487061 - DNA, 13 bp, Homo sapiens
gtagaattccttc

SEQ ID NO: 1487062 - DNA, 17 bp, Homo sapiens
gtagaattgaaaatgca

SEQ ID NO: 1487063 - DNA, 18 bp, Homo sapiens
gtagacagatatttcaaa

SEQ ID NO: 1487064 - DNA, 15 bp, Homo sapiens
gtagaccaaaataaa

SEQ ID NO: 1487065 - DNA, 21 bp, Homo sapiens
gtagaccttgttacttctgag

SEQ ID NO: 1487066 - DNA, 22 bp, Homo sapiens
gtagaccttgttacttctgagg

SEQ ID NO: 1487067 - DNA, 13 bp, Homo sapiens
gtagactttgctt

SEQ ID NO: 1487068 - DNA, 11 bp, Homo sapiens
gtagagacagg

SEQ ID NO: 1487069 - DNA, 12 bp, Homo sapiens
gtagagccagct

SEQ ID NO: 1487070 - DNA, 17 bp, Homo sapiens
gtagaggagcagggtct

SEQ ID NO: 1487071 - DNA, 23 bp, Homo sapiens
gtagagtcatctccatcagctgt

SEQ ID NO: 1487072 - DNA, 19 bp, Homo sapiens
gtagatattgttttctgta

SEQ ID NO: 1487073 - DNA, 22 bp, Homo sapiens
gtagatccatttccattgctta

SEQ ID NO: 1487074 - DNA, 17 bp, Homo sapiens
gtagatcgcttgagccc

SEQ ID NO: 1487075 - DNA, 16 bp, Homo sapiens
gtagatgaacctgcag

SEQ ID NO: 1487076 - DNA, 15 bp, Homo sapiens
gtagatgctgaggcc

SEQ ID NO: 1487077 - DNA, 18 bp, Homo sapiens
gtagatggcgatgtgtta

SEQ ID NO: 1487078 - DNA, 14 bp, Homo sapiens
gtagatgggcattt

SEQ ID NO: 1487079 - DNA, 17 bp, Homo sapiens
gtagatggtgacctggg

SEQ ID NO: 1487080 - DNA, 21 bp, Homo sapiens
gtagatgtgcatttttgtgaa

SEQ ID NO: 1487081 - DNA, 12 bp, Homo sapiens
gtagatgttctt

SEQ ID NO: 1487082 - DNA, 14 bp, Homo sapiens
gtagatgttctttt

SEQ ID NO: 1487083 - DNA, 22 bp, Homo sapiens
gtagatgttcttttctatttat

SEQ ID NO: 1487084 - DNA, 23 bp, Homo sapiens
gtagattcgctgtcccctcagcg

SEQ ID NO: 1487085 - DNA, 18 bp, Homo sapiens
gtagcaataggctgtaat

SEQ ID NO: 1487086 - DNA, 12 bp, Homo sapiens
gtagcaatgtgc

SEQ ID NO: 1487087 - DNA, 16 bp, Homo sapiens
gtagcacatgtatgct

SEQ ID NO: 1487088 - DNA, 14 bp, Homo sapiens
gtagcactgacaga

SEQ ID NO: 1487089 - DNA, 12 bp, Homo sapiens
gtagcactgagg

SEQ ID NO: 1487090 - DNA, 17 bp, Homo sapiens
gtagcagagttaaatct

SEQ ID NO: 1487091 - DNA, 15 bp, Homo sapiens
gtagcagcaggctca

SEQ ID NO: 1487092 - DNA, 16 bp, Homo sapiens
gtagcagcaggctcag

SEQ ID NO: 1487093 - DNA, 12 bp, Homo sapiens
gtagcagcctgg

SEQ ID NO: 1487094 - DNA, 11 bp, Homo sapiens
gtagcagctgg

SEQ ID NO: 1487095 - DNA, 13 bp, Homo sapiens
gtagcagctggac

SEQ ID NO: 1487096 - DNA, 19 bp, Homo sapiens
gtagcagggtcgggaaagg

SEQ ID NO: 1487097 - DNA, 18 bp, Homo sapiens
gtagcaggtaccactgat

SEQ ID NO: 1487098 - DNA, 16 bp, Homo sapiens
gtatgtggaagtgtgg

SEQ ID NO: 1487099 - DNA, 18 bp, Homo sapiens
gtatgtggaagtgtgggt

SEQ ID NO: 1487100 - DNA, 19 bp, Homo sapiens
gtatgtgggggtctgtgtg

SEQ ID NO: 1487101 - DNA, 16 bp, Homo sapiens
gtatgtgtggctgtgg

SEQ ID NO: 1487102 - DNA, 13 bp, Homo sapiens
gtatgtgtgtaga

SEQ ID NO: 1487103 - DNA, 17 bp, Homo sapiens
gtatgttccaaaccctc

SEQ ID NO: 1487104 - DNA, 21 bp, Homo sapiens
gtatgttccaaaccctcctgg

SEQ ID NO: 1487105 - DNA, 13 bp, Homo sapiens
gtatgtttcttag

SEQ ID NO: 1487106 - DNA, 14 bp, Homo sapiens
gtatgtttgcacac

SEQ ID NO: 1487107 - DNA, 20 bp, Homo sapiens
gtatgtttgctgattattta

SEQ ID NO: 1487108 - DNA, 15 bp, Homo sapiens
gtatgttttttatgt

SEQ ID NO: 1487109 - DNA, 18 bp, Homo sapiens
gtattaaaagttgcattt

SEQ ID NO: 1487110 - DNA, 15 bp, Homo sapiens
gtattaaatcttaaa

SEQ ID NO: 1487111 - DNA, 17 bp, Homo sapiens
gtattaaatcttaaaca

SEQ ID NO: 1487112 - DNA, 22 bp, Homo sapiens
gtattaaatcttaaacaatgta

SEQ ID NO: 1487113 - DNA, 11 bp, Homo sapiens
gtattaataaa

SEQ ID NO: 1487114 - DNA, 19 bp, Homo sapiens
gtattaataaagcattctt

SEQ ID NO: 1487115 - DNA, 21 bp, Homo sapiens
gtattaataaagcattcttta

SEQ ID NO: 1487116 - DNA, 14 bp, Homo sapiens
gtattaatatatag

SEQ ID NO: 1487117 - DNA, 22 bp, Homo sapiens
gtattaatttctgataaagttc

SEQ ID NO: 1487118 - DNA, 18 bp, Homo sapiens
gtattacatctaatgctt

SEQ ID NO: 1487119 - DNA, 21 bp, Homo sapiens
gtattactagaagatgaatac

SEQ ID NO: 1487120 - DNA, 22 bp, Homo sapiens
gtattacttaggttattttgct

SEQ ID NO: 1487121 - DNA, 13 bp, Homo sapiens
gtattaggaaaat

SEQ ID NO: 1487122 - DNA, 22 bp, Homo sapiens
gtattatacatgtgatacattt

SEQ ID NO: 1487123 - DNA, 16 bp, Homo sapiens
gtattatttaaatgtt

SEQ ID NO: 1487124 - DNA, 17 bp, Homo sapiens
gtattatttcaccagca

SEQ ID NO: 1487125 - DNA, 14 bp, Homo sapiens
gtattatttgcaca

SEQ ID NO: 1487126 - DNA, 19 bp, Homo sapiens
gtattcatatttgtacttt

SEQ ID NO: 1487127 - DNA, 21 bp, Homo sapiens
gtattcccaaaaattactttg

SEQ ID NO: 1487128 - DNA, 15 bp, Homo sapiens
gtattcccactcacc

SEQ ID NO: 1487129 - DNA, 22 bp, Homo sapiens
gtattcccttgtattttgttaa

SEQ ID NO: 1487130 - DNA, 20 bp, Homo sapiens
gtattccttttgtgtacagt

SEQ ID NO: 1487131 - DNA, 14 bp, Homo sapiens
gtattctcattctt

SEQ ID NO: 1487132 - DNA, 12 bp, Homo sapiens
gtattctctttt

SEQ ID NO: 1487133 - DNA, 18 bp, Homo sapiens
gtattctgtggattctat

SEQ ID NO: 1487134 - DNA, 19 bp, Homo sapiens
gtattctgtggattctata

SEQ ID NO: 1487135 - DNA, 21 bp, Homo sapiens
gtattctgtggattctatatt

SEQ ID NO: 1487136 - DNA, 17 bp, Homo sapiens
gtattctgttctggagg

SEQ ID NO: 1487137 - DNA, 12 bp, Homo sapiens
gtattctgtttg

SEQ ID NO: 1487138 - DNA, 15 bp, Homo sapiens
gtattcttatttaat

SEQ ID NO: 1487139 - DNA, 16 bp, Homo sapiens
gtattctttctgcctt

SEQ ID NO: 1487140 - DNA, 22 bp, Homo sapiens
gtattgacaactgcacatgaaa

SEQ ID NO: 1487141 - DNA, 22 bp, Homo sapiens
gtattgcatgcaatttgaagta

SEQ ID NO: 1487142 - DNA, 21 bp, Homo sapiens
gtattgcccccatggggtcct

SEQ ID NO: 1487143 - DNA, 14 bp, Homo sapiens
gtattgccccctct

SEQ ID NO: 1487144 - DNA, 14 bp, Homo sapiens
gtattgctgtgtct

SEQ ID NO: 1487145 - DNA, 18 bp, Homo sapiens
gtattgtttaaaatgtaa

SEQ ID NO: 1487146 - DNA, 22 bp, Homo sapiens
gtatttaaactatcttgtgtga

SEQ ID NO: 1487147 - DNA, 21 bp, Homo sapiens
gtatttaaagaaaataaacac

SEQ ID NO: 1487148 - DNA, 20 bp, Homo sapiens
gtatttaacagaaattgtat

SEQ ID NO: 1487149 - DNA, 17 bp, Homo sapiens
gtatttaagcctaaaga

SEQ ID NO: 1487150 - DNA, 14 bp, Homo sapiens
gtatttagaagcca

SEQ ID NO: 1487151 - DNA, 12 bp, Homo sapiens
gtatttatatat

SEQ ID NO: 1487152 - DNA, 15 bp, Homo sapiens
gtatttatatattta

SEQ ID NO: 1487153 - DNA, 17 bp, Homo sapiens
gtatttatatatttata

SEQ ID NO: 1487154 - DNA, 14 bp, Homo sapiens
gtatttatatttgg

SEQ ID NO: 1487155 - DNA, 15 bp, Homo sapiens
gtatttatatttgga

SEQ ID NO: 1487156 - DNA, 19 bp, Homo sapiens
gtatttatatttggaaaga

SEQ ID NO: 1487157 - DNA, 20 bp, Homo sapiens
gtatttatatttggaaagag

SEQ ID NO: 1487158 - DNA, 13 bp, Homo sapiens
gtatttatcttta

SEQ ID NO: 1487159 - DNA, 22 bp, Homo sapiens
gtatttatgggtggatttatcc

SEQ ID NO: 1487160 - DNA, 18 bp, Homo sapiens
gtatttattaccgtcaca

SEQ ID NO: 1487161 - DNA, 12 bp, Homo sapiens
gtatttattctt

SEQ ID NO: 1487162 - DNA, 15 bp, Homo sapiens
gtatttatttccaga

SEQ ID NO: 1487163 - DNA, 18 bp, Homo sapiens
gtatttcccttccaaaga

SEQ ID NO: 1487164 - DNA, 17 bp, Homo sapiens
gtatttcctgcttccct

SEQ ID NO: 1487165 - DNA, 12 bp, Homo sapiens
gtatttctatat

SEQ ID NO: 1487166 - DNA, 17 bp, Homo sapiens
gtatttctatatttatt

SEQ ID NO: 1487167 - DNA, 21 bp, Homo sapiens
gtatttctctattttcataat

SEQ ID NO: 1487168 - DNA, 16 bp, Homo sapiens
gtatttctcttgtcct

SEQ ID NO: 1487169 - DNA, 14 bp, Homo sapiens
gtatttgagagact

SEQ ID NO: 1487170 - DNA, 19 bp, Homo sapiens
gtatttgagagttctaaat

SEQ ID NO: 1487171 - DNA, 12 bp, Homo sapiens
gtatttgctgtt

SEQ ID NO: 1487172 - DNA, 21 bp, Homo sapiens
gtatttggaaataaagtcaga

SEQ ID NO: 1487173 - DNA, 17 bp, Homo sapiens
gtatttggaattagaac

SEQ ID NO: 1487174 - DNA, 12 bp, Homo sapiens
gtatttgtatta

SEQ ID NO: 1487175 - DNA, 16 bp, Homo sapiens
gtatttgtattaataa

SEQ ID NO: 1487176 - DNA, 17 bp, Homo sapiens
gtatttgtattaataaa

SEQ ID NO: 1487177 - DNA, 19 bp, Homo sapiens
gtatttgtattaataaagc

SEQ ID NO: 1487178 - DNA, 15 bp, Homo sapiens
gtatttgttatatat

SEQ ID NO: 1487179 - DNA, 22 bp, Homo sapiens
gtatttgttatatataataaat

SEQ ID NO: 1487180 - DNA, 18 bp, Homo sapiens
gtattttaacactttgta

SEQ ID NO: 1487181 - DNA, 22 bp, Homo sapiens
gtattttaagatccagaaatac

SEQ ID NO: 1487182 - DNA, 12 bp, Homo sapiens
gtattttatctg

SEQ ID NO: 1487183 - DNA, 22 bp, Homo sapiens
gtattttatctttgattctcct

SEQ ID NO: 1487184 - DNA, 23 bp, Homo sapiens
gtattttatctttgattctcctt

SEQ ID NO: 1487185 - DNA, 14 bp, Homo sapiens
gtattttgcatact

SEQ ID NO: 1487186 - DNA, 13 bp, Homo sapiens
gtatttttaaagg

SEQ ID NO: 1487187 - DNA, 22 bp, Homo sapiens
gtatttttaacacttaaatttc

SEQ ID NO: 1487188 - DNA, 22 bp, Homo sapiens
gtatttttaatgggggtagcag

SEQ ID NO: 1487189 - DNA, 16 bp, Homo sapiens
gtatttttcaaggcat

SEQ ID NO: 1487190 - DNA, 21 bp, Homo sapiens
gtatttttcaggtaggccctt

SEQ ID NO: 1487191 - DNA, 13 bp, Homo sapiens
gtatttttcttga

SEQ ID NO: 1487192 - DNA, 19 bp, Homo sapiens
gtatttttgatgtatatat

SEQ ID NO: 1487193 - DNA, 21 bp, Homo sapiens
gtatttttgattaacaatgta

SEQ ID NO: 1487194 - DNA, 22 bp, Homo sapiens
gtatttttgattaacaatgtat

SEQ ID NO: 1487195 - DNA, 23 bp, Homo sapiens
gtatttttgtgaagtattcacaa

SEQ ID NO: 1487196 - DNA, 15 bp, Homo sapiens
gtattttttatttac

SEQ ID NO: 1487197 - DNA, 16 bp, Homo sapiens
gtattttttatttaca

SEQ ID NO: 1487198 - DNA, 16 bp, Homo sapiens
gtatttttttaaatca

SEQ ID NO: 1487199 - DNA, 17 bp, Homo sapiens
gtatttttttaaatcaa

SEQ ID NO: 1487200 - DNA, 23 bp, Homo sapiens
gtattttttttttaaataaaagc

SEQ ID NO: 1487201 - DNA, 14 bp, Homo sapiens
gtcaaaatatgtaa

SEQ ID NO: 1487202 - DNA, 15 bp, Homo sapiens
gtcaaagaagcttcc

SEQ ID NO: 1487203 - DNA, 20 bp, Homo sapiens
gtcaaagacagaatggtgga

SEQ ID NO: 1487204 - DNA, 18 bp, Homo sapiens
gtcaaatatcatttactc

SEQ ID NO: 1487205 - DNA, 22 bp, Homo sapiens
gtcaaatccagtggtgggtaat

SEQ ID NO: 1487206 - DNA, 23 bp, Homo sapiens
gtcaaatgtttccttaaacatga

SEQ ID NO: 1487207 - DNA, 18 bp, Homo sapiens
gtcaacagagaaggcagg

SEQ ID NO: 1487208 - DNA, 14 bp, Homo sapiens
gtcaacagtaaacc

SEQ ID NO: 1487209 - DNA, 14 bp, Homo sapiens
gtcaactacacaaa

SEQ ID NO: 1487210 - DNA, 15 bp, Homo sapiens
gtcaactgctgtttt

SEQ ID NO: 1487211 - DNA, 16 bp, Homo sapiens
gtcaactgctgtttta

SEQ ID NO: 1487212 - DNA, 13 bp, Homo sapiens
gtcaactggagca

SEQ ID NO: 1487213 - DNA, 18 bp, Homo sapiens
gtcattttgtgttgaaga

SEQ ID NO: 1487214 - DNA, 21 bp, Homo sapiens
gtcatttttaacagcatgctg

SEQ ID NO: 1487215 - DNA, 16 bp, Homo sapiens
gtcatttttaatgtat

SEQ ID NO: 1487216 - DNA, 19 bp, Homo sapiens
gtcatttttaatgtatcta

SEQ ID NO: 1487217 - DNA, 11 bp, Homo sapiens
gtcatttttgt

SEQ ID NO: 1487218 - DNA, 19 bp, Homo sapiens
gtccaaagaggctgcccct

SEQ ID NO: 1487219 - DNA, 14 bp, Homo sapiens
gtccaaaggaggct

SEQ ID NO: 1487220 - DNA, 19 bp, Homo sapiens
gtccaaagtgcgtgtgtgt

SEQ ID NO: 1487221 - DNA, 13 bp, Homo sapiens
gtccaacatggtg

SEQ ID NO: 1487222 - DNA, 17 bp, Homo sapiens
gtccaacctaacccctt

SEQ ID NO: 1487223 - DNA, 21 bp, Homo sapiens
gtccaacctaacccctttcct

SEQ ID NO: 1487224 - DNA, 22 bp, Homo sapiens
gtccaagattccggatcctaag

SEQ ID NO: 1487225 - DNA, 18 bp, Homo sapiens
gtccaagggacagcccac

SEQ ID NO: 1487226 - DNA, 16 bp, Homo sapiens
gtccaattagtttcct

SEQ ID NO: 1487227 - DNA, 12 bp, Homo sapiens
gtccaatttgta

SEQ ID NO: 1487228 - DNA, 16 bp, Homo sapiens
gtccacagatgcctcc

SEQ ID NO: 1487229 - DNA, 17 bp, Homo sapiens
gtccacaggggcaggcc

SEQ ID NO: 1487230 - DNA, 20 bp, Homo sapiens
gtccacaggggcaggcctgg

SEQ ID NO: 1487231 - DNA, 15 bp, Homo sapiens
gtccacaggggccac

SEQ ID NO: 1487232 - DNA, 15 bp, Homo sapiens
gtccacatccccaga

SEQ ID NO: 1487233 - DNA, 16 bp, Homo sapiens
gtccacatccccagag

SEQ ID NO: 1487234 - DNA, 21 bp, Homo sapiens
gtccacatccccagagcccag

SEQ ID NO: 1487235 - DNA, 22 bp, Homo sapiens
gtccacatccccagagcccagc

SEQ ID NO: 1487236 - DNA, 22 bp, Homo sapiens
gtccacatgtggggacagggct

SEQ ID NO: 1487237 - DNA, 15 bp, Homo sapiens
gtccacccaggctgc

SEQ ID NO: 1487238 - DNA, 22 bp, Homo sapiens
gtccaccctcatttctgccagc

SEQ ID NO: 1487239 - DNA, 23 bp, Homo sapiens
gtccaccctcatttctgccagcg

SEQ ID NO: 1487240 - DNA, 14 bp, Homo sapiens
gtccacccttccat

SEQ ID NO: 1487241 - DNA, 14 bp, Homo sapiens
gtccacctggagag

SEQ ID NO: 1487242 - DNA, 18 bp, Homo sapiens
gtccactctcggggccct

SEQ ID NO: 1487243 - DNA, 19 bp, Homo sapiens
gtccactgagactttcccc

SEQ ID NO: 1487244 - DNA, 23 bp, Homo sapiens
gtccactgagactttcccctctc

SEQ ID NO: 1487245 - DNA, 20 bp, Homo sapiens
gtccactgttgagccccagt

SEQ ID NO: 1487246 - DNA, 22 bp, Homo sapiens
gtccagaagaatattcaggact

SEQ ID NO: 1487247 - DNA, 14 bp, Homo sapiens
gtccagaccctgaa

SEQ ID NO: 1487248 - DNA, 22 bp, Homo sapiens
gtccagagcttgtgctcctctt

SEQ ID NO: 1487249 - DNA, 15 bp, Homo sapiens
gtccagcacagaagg

SEQ ID NO: 1487250 - DNA, 22 bp, Homo sapiens
gtccagccagctcctgggcagc

SEQ ID NO: 1487251 - DNA, 23 bp, Homo sapiens
gtccagccagctcctgggcagct

SEQ ID NO: 1487252 - DNA, 14 bp, Homo sapiens
gtccagcctgcccc

SEQ ID NO: 1487253 - DNA, 22 bp, Homo sapiens
gtccagcctgccccggagctgg

SEQ ID NO: 1487254 - DNA, 11 bp, Homo sapiens
gtccagcctgg

SEQ ID NO: 1487255 - DNA, 13 bp, Homo sapiens
gtccagccttcca

SEQ ID NO: 1487256 - DNA, 20 bp, Homo sapiens
gtccagcgtcactccagtgc

SEQ ID NO: 1487257 - DNA, 24 bp, Homo sapiens
gtccagctcccgctgtggccgcac

SEQ ID NO: 1487258 - DNA, 18 bp, Homo sapiens
gtccagctctgacatccc

SEQ ID NO: 1487259 - DNA, 19 bp, Homo sapiens
gtccagctctgacatccct

SEQ ID NO: 1487260 - DNA, 14 bp, Homo sapiens
gtccagctctggag

SEQ ID NO: 1487261 - DNA, 12 bp, Homo sapiens
gtccagctggcc

SEQ ID NO: 1487262 - DNA, 14 bp, Homo sapiens
gtccagctggcctg

SEQ ID NO: 1487263 - DNA, 18 bp, Homo sapiens
gtccagctggcctggaca

SEQ ID NO: 1487264 - DNA, 14 bp, Homo sapiens
gtccagcttccaaa

SEQ ID NO: 1487265 - DNA, 16 bp, Homo sapiens
gtccagcttgctcttc

SEQ ID NO: 1487266 - DNA, 14 bp, Homo sapiens
gtccaggaaggcag

SEQ ID NO: 1487267 - DNA, 22 bp, Homo sapiens
gtccaggaaggcagctgctctt

SEQ ID NO: 1487268 - DNA, 22 bp, Homo sapiens
gtccaggactgggtctgacctg

SEQ ID NO: 1487269 - DNA, 22 bp, Homo sapiens
gtccaggagaagtgctccctgg

SEQ ID NO: 1487270 - DNA, 22 bp, Homo sapiens
gtccaggcagctccctcctgca

SEQ ID NO: 1487271 - DNA, 15 bp, Homo sapiens
gtccaggccactgtg

SEQ ID NO: 1487272 - DNA, 20 bp, Homo sapiens
gtccaggccactgtggccag

SEQ ID NO: 1487273 - DNA, 22 bp, Homo sapiens
gtccaggccactgtggccagag

SEQ ID NO: 1487274 - DNA, 23 bp, Homo sapiens
gtccaggccactgtggccagagc

SEQ ID NO: 1487275 - DNA, 17 bp, Homo sapiens
gtccaggccccaccggc

SEQ ID NO: 1487276 - DNA, 19 bp, Homo sapiens
gtccaggcccgtgggcgca

SEQ ID NO: 1487277 - DNA, 15 bp, Homo sapiens
gtccaggccctgtgg

SEQ ID NO: 1487278 - DNA, 16 bp, Homo sapiens
gtccaggctgccgtgg

SEQ ID NO: 1487279 - DNA, 20 bp, Homo sapiens
gtccagggaagctggccgag

SEQ ID NO: 1487280 - DNA, 14 bp, Homo sapiens
gtccagggccctga

SEQ ID NO: 1487281 - DNA, 17 bp, Homo sapiens
gtccagggccctgagct

SEQ ID NO: 1487282 - DNA, 16 bp, Homo sapiens
gtccagggcctgacac

SEQ ID NO: 1487283 - DNA, 18 bp, Homo sapiens
gtccagggctagtgactt

SEQ ID NO: 1487284 - DNA, 19 bp, Homo sapiens
gtccaggggagatggggag

SEQ ID NO: 1487285 - DNA, 16 bp, Homo sapiens
gtccaggtctcactgc

SEQ ID NO: 1487286 - DNA, 17 bp, Homo sapiens
gtccaggtctcactgct

SEQ ID NO: 1487287 - DNA, 21 bp, Homo sapiens
gtccaggtctcactgctttgc

SEQ ID NO: 1487288 - DNA, 21 bp, Homo sapiens
gtccaggtgaggcccaagagc

SEQ ID NO: 1487289 - DNA, 16 bp, Homo sapiens
gtccagtctcttctgc

SEQ ID NO: 1487290 - DNA, 16 bp, Homo sapiens
gtccagtctgtgatcc

SEQ ID NO: 1487291 - DNA, 22 bp, Homo sapiens
gtccagtgcattttgtttctgt

SEQ ID NO: 1487292 - DNA, 21 bp, Homo sapiens
gtccagttttggaggctgagt

SEQ ID NO: 1487293 - DNA, 12 bp, Homo sapiens
gtccatcccagc

SEQ ID NO: 1487294 - DNA, 17 bp, Homo sapiens
gtccatgctccagggtc

SEQ ID NO: 1487295 - DNA, 20 bp, Homo sapiens
gtccatgctccagggtcagg

SEQ ID NO: 1487296 - DNA, 18 bp, Homo sapiens
gtccatggcaccagcccc

SEQ ID NO: 1487297 - DNA, 22 bp, Homo sapiens
gtccatggcaccagccccctgg

SEQ ID NO: 1487298 - DNA, 15 bp, Homo sapiens
gtccatgtaaatact

SEQ ID NO: 1487299 - DNA, 18 bp, Homo sapiens
gtccatgtgaaatttaca

SEQ ID NO: 1487300 - DNA, 13 bp, Homo sapiens
gtccatgtttctc

SEQ ID NO: 1487301 - DNA, 15 bp, Homo sapiens
gtccatgtttctcac

SEQ ID NO: 1487302 - DNA, 13 bp, Homo sapiens
gtccattcagatg

SEQ ID NO: 1487303 - DNA, 22 bp, Homo sapiens
gtcccaaatatgtattttccta

SEQ ID NO: 1487304 - DNA, 21 bp, Homo sapiens
gtcccaaatgtagcaggtgta

SEQ ID NO: 1487305 - DNA, 13 bp, Homo sapiens
gtcccaagccggg

SEQ ID NO: 1487306 - DNA, 15 bp, Homo sapiens
gtcccaaggagctga

SEQ ID NO: 1487307 - DNA, 18 bp, Homo sapiens
gtcccaatagctctactg

SEQ ID NO: 1487308 - DNA, 20 bp, Homo sapiens
gtcccaatagctctactgcc

SEQ ID NO: 1487309 - DNA, 23 bp, Homo sapiens
gtcccaatagctctactgccctc

SEQ ID NO: 1487310 - DNA, 16 bp, Homo sapiens
gtcccacaaaatattt

SEQ ID NO: 1487311 - DNA, 19 bp, Homo sapiens
gtcccacaaaatatttcta

SEQ ID NO: 1487312 - DNA, 18 bp, Homo sapiens
gtcccacaccgctggtcc

SEQ ID NO: 1487313 - DNA, 16 bp, Homo sapiens
gtcccaccaactctgc

SEQ ID NO: 1487314 - DNA, 23 bp, Homo sapiens
gtcccaccaactctgcactccat

SEQ ID NO: 1487315 - DNA, 20 bp, Homo sapiens
gtcccacccacacagctgcc

SEQ ID NO: 1487316 - DNA, 15 bp, Homo sapiens
gtcccacccccaccc

SEQ ID NO: 1487317 - DNA, 19 bp, Homo sapiens
gtcccacccccacccccag

SEQ ID NO: 1487318 - DNA, 21 bp, Homo sapiens
gtcccacccccacccccagct

SEQ ID NO: 1487319 - DNA, 16 bp, Homo sapiens
gtcccaccctccctag

SEQ ID NO: 1487320 - DNA, 20 bp, Homo sapiens
gtcccagaatgcctcctgca

SEQ ID NO: 1487321 - DNA, 19 bp, Homo sapiens
gtcccagaggttatctgcc

SEQ ID NO: 1487322 - DNA, 21 bp, Homo sapiens
gtcccagaggttatctgcctg

SEQ ID NO: 1487323 - DNA, 24 bp, Homo sapiens
gtcccagaggttatctgcctggcc

SEQ ID NO: 1487324 - DNA, 15 bp, Homo sapiens
gtcccagcatccctg

SEQ ID NO: 1487325 - DNA, 16 bp, Homo sapiens
gtcccagcatccctgg

SEQ ID NO: 1487326 - DNA, 22 bp, Homo sapiens
gtcccagcatccctggagcagg

SEQ ID NO: 1487327 - DNA, 22 bp, Homo sapiens
gtgctctggcaccatcagcctg

SEQ ID NO: 1487328 - DNA, 13 bp, Homo sapiens
gtgctctggcggc

SEQ ID NO: 1487329 - DNA, 19 bp, Homo sapiens
gtgctgaatggttttcaaa

SEQ ID NO: 1487330 - DNA, 20 bp, Homo sapiens
gtgctgaatggttttcaaaa

SEQ ID NO: 1487331 - DNA, 15 bp, Homo sapiens
gtgctgacggccagg

SEQ ID NO: 1487332 - DNA, 22 bp, Homo sapiens
gtgctgacgggacccacatgct

SEQ ID NO: 1487333 - DNA, 14 bp, Homo sapiens
gtgctgactgaaca

SEQ ID NO: 1487334 - DNA, 23 bp, Homo sapiens
gtgctgactgaacattagttgca

SEQ ID NO: 1487335 - DNA, 19 bp, Homo sapiens
gtgctgactgaggcctgct

SEQ ID NO: 1487336 - DNA, 23 bp, Homo sapiens
gtgctgactgaggcctgcttccc

SEQ ID NO: 1487337 - DNA, 22 bp, Homo sapiens
gtgctgaggccttatcattcat

SEQ ID NO: 1487338 - DNA, 14 bp, Homo sapiens
gtgctgatcctgct

SEQ ID NO: 1487339 - DNA, 20 bp, Homo sapiens
gtgctgatcgtgctaaattt

SEQ ID NO: 1487340 - DNA, 19 bp, Homo sapiens
gtgctgcacaaaagcagat

SEQ ID NO: 1487341 - DNA, 14 bp, Homo sapiens
gtgctgcagcaccg

SEQ ID NO: 1487342 - DNA, 13 bp, Homo sapiens
gtgctgcaggagt

SEQ ID NO: 1487343 - DNA, 23 bp, Homo sapiens
gtgctgcaggagtgtcctgccca

SEQ ID NO: 1487344 - DNA, 21 bp, Homo sapiens
gtgctgcatccctgtgtccac

SEQ ID NO: 1487345 - DNA, 20 bp, Homo sapiens
gtgctgcatgcgacagcgtc

SEQ ID NO: 1487346 - DNA, 16 bp, Homo sapiens
gtgctgccaacttgat

SEQ ID NO: 1487347 - DNA, 12 bp, Homo sapiens
gtgctgccacac

SEQ ID NO: 1487348 - DNA, 19 bp, Homo sapiens
gtgctgccatgccactgcc

SEQ ID NO: 1487349 - DNA, 21 bp, Homo sapiens
gtgctgccatgccactgccag

SEQ ID NO: 1487350 - DNA, 14 bp, Homo sapiens
gtgctgcccaggcc

SEQ ID NO: 1487351 - DNA, 15 bp, Homo sapiens
gtgctgctaattctt

SEQ ID NO: 1487352 - DNA, 23 bp, Homo sapiens
gtgctggaattccacagggacca

SEQ ID NO: 1487353 - DNA, 20 bp, Homo sapiens
gtgctggaggattttccagt

SEQ ID NO: 1487354 - DNA, 12 bp, Homo sapiens
gtgctggccccc

SEQ ID NO: 1487355 - DNA, 11 bp, Homo sapiens
gtgctgggacc

SEQ ID NO: 1487356 - DNA, 14 bp, Homo sapiens
gtgctgggaccaga

SEQ ID NO: 1487357 - DNA, 16 bp, Homo sapiens
gtgctgggagctccac

SEQ ID NO: 1487358 - DNA, 18 bp, Homo sapiens
gtgctgggaggagggaga

SEQ ID NO: 1487359 - DNA, 19 bp, Homo sapiens
gtgctgggaggagggagag

SEQ ID NO: 1487360 - DNA, 14 bp, Homo sapiens
gtgctgggccagtg

SEQ ID NO: 1487361 - DNA, 19 bp, Homo sapiens
gtgctggggagccaaaggc

SEQ ID NO: 1487362 - DNA, 20 bp, Homo sapiens
gtgctgggttcccactcccg

SEQ ID NO: 1487363 - DNA, 13 bp, Homo sapiens
gtgctggtgtcct

SEQ ID NO: 1487364 - DNA, 19 bp, Homo sapiens
gtgctggtgtcctgaccac

SEQ ID NO: 1487365 - DNA, 18 bp, Homo sapiens
gtgctgtaatattgtaaa

SEQ ID NO: 1487366 - DNA, 21 bp, Homo sapiens
gtgctgtcttttgttctctga

SEQ ID NO: 1487367 - DNA, 15 bp, Homo sapiens
gtgctgtgaccattt

SEQ ID NO: 1487368 - DNA, 16 bp, Homo sapiens
gtgctgtgagggaggg

SEQ ID NO: 1487369 - DNA, 16 bp, Homo sapiens
gtgctgtgcctgctag

SEQ ID NO: 1487370 - DNA, 15 bp, Homo sapiens
gtgctgtgctctggc

SEQ ID NO: 1487371 - DNA, 16 bp, Homo sapiens
gtgctgtggcctgggc

SEQ ID NO: 1487372 - DNA, 19 bp, Homo sapiens
gtgctgtggcctgggcaag

SEQ ID NO: 1487373 - DNA, 12 bp, Homo sapiens
gtgctgtgtgcc

SEQ ID NO: 1487374 - DNA, 22 bp, Homo sapiens
gtgctgtgtgccccactccagc

SEQ ID NO: 1487375 - DNA, 15 bp, Homo sapiens
gtgctgtttattaat

SEQ ID NO: 1487376 - DNA, 19 bp, Homo sapiens
gtgctgtttattaatctta

SEQ ID NO: 1487377 - DNA, 17 bp, Homo sapiens
gtgcttcagagtttgtg

SEQ ID NO: 1487378 - DNA, 13 bp, Homo sapiens
gtgcttcagcctg

SEQ ID NO: 1487379 - DNA, 22 bp, Homo sapiens
gtgcttccttctccctcctctg

SEQ ID NO: 1487380 - DNA, 20 bp, Homo sapiens
gtgcttcgactactgctcct

SEQ ID NO: 1487381 - DNA, 19 bp, Homo sapiens
gtgcttgctggccacaagg

SEQ ID NO: 1487382 - DNA, 19 bp, Homo sapiens
gtgcttggggctatttgtg

SEQ ID NO: 1487383 - DNA, 23 bp, Homo sapiens
gtgcttggtggggctcgtggcct

SEQ ID NO: 1487384 - DNA, 20 bp, Homo sapiens
gtgcttgttccctctccctg

SEQ ID NO: 1487385 - DNA, 13 bp, Homo sapiens
gtgcttgttttat

SEQ ID NO: 1487386 - DNA, 18 bp, Homo sapiens
gtgctttagttaggtcat

SEQ ID NO: 1487387 - DNA, 22 bp, Homo sapiens
gtgctttccgtggcactgcata

SEQ ID NO: 1487388 - DNA, 17 bp, Homo sapiens
gtgcttttccatctaaa

SEQ ID NO: 1487389 - DNA, 13 bp, Homo sapiens
gtgcttttctgtt

SEQ ID NO: 1487390 - DNA, 23 bp, Homo sapiens
gtgcttttctgttttcaagtgta

SEQ ID NO: 1487391 - DNA, 13 bp, Homo sapiens
gtggaaaacaggg

SEQ ID NO: 1487392 - DNA, 16 bp, Homo sapiens
gtggaaaacagggtgc

SEQ ID NO: 1487393 - DNA, 15 bp, Homo sapiens
gtggaaagcctctgc

SEQ ID NO: 1487394 - DNA, 17 bp, Homo sapiens
gtggaaagtagctgcta

SEQ ID NO: 1487395 - DNA, 16 bp, Homo sapiens
gtggaaataatttgaa

SEQ ID NO: 1487396 - DNA, 20 bp, Homo sapiens
gtggaaattaagactttatg

SEQ ID NO: 1487397 - DNA, 20 bp, Homo sapiens
gtggaagaactgtgataaaa

SEQ ID NO: 1487398 - DNA, 16 bp, Homo sapiens
gtggaagaagggagaa

SEQ ID NO: 1487399 - DNA, 16 bp, Homo sapiens
gtggaagagcagcctg

SEQ ID NO: 1487400 - DNA, 13 bp, Homo sapiens
gtggaagccctcc

SEQ ID NO: 1487401 - DNA, 14 bp, Homo sapiens
gtggaagctgggtg

SEQ ID NO: 1487402 - DNA, 20 bp, Homo sapiens
gtggaaggcatcagtcccta

SEQ ID NO: 1487403 - DNA, 15 bp, Homo sapiens
gtggaagtgcccagc

SEQ ID NO: 1487404 - DNA, 16 bp, Homo sapiens
gtggacacacacagac

SEQ ID NO: 1487405 - DNA, 18 bp, Homo sapiens
gtggacaggatgaggaca

SEQ ID NO: 1487406 - DNA, 21 bp, Homo sapiens
gtggacagggcccccggccac

SEQ ID NO: 1487407 - DNA, 13 bp, Homo sapiens
gtggacagtcctg

SEQ ID NO: 1487408 - DNA, 14 bp, Homo sapiens
gtggacagtcctgg

SEQ ID NO: 1487409 - DNA, 21 bp, Homo sapiens
gtggacatgtgggtggagaag

SEQ ID NO: 1487410 - DNA, 21 bp, Homo sapiens
gtggaccaaaggaaggaagca

SEQ ID NO: 1487411 - DNA, 14 bp, Homo sapiens
gtggaccaggacag

SEQ ID NO: 1487412 - DNA, 16 bp, Homo sapiens
gtggaccgtggacagg

SEQ ID NO: 1487413 - DNA, 14 bp, Homo sapiens
gtggacctgcctac

SEQ ID NO: 1487414 - DNA, 15 bp, Homo sapiens
gtggactctgctaga

SEQ ID NO: 1487415 - DNA, 14 bp, Homo sapiens
gtggactcttccct

SEQ ID NO: 1487416 - DNA, 17 bp, Homo sapiens
gtggactgagtgggaag

SEQ ID NO: 1487417 - DNA, 23 bp, Homo sapiens
gtggactgcagtcggcatgccag

SEQ ID NO: 1487418 - DNA, 23 bp, Homo sapiens
gtggactgtcctgaggagccctg

SEQ ID NO: 1487419 - DNA, 21 bp, Homo sapiens
gtggactgtgcctcaggccag

SEQ ID NO: 1487420 - DNA, 22 bp, Homo sapiens
gtggactgtggcacttgcctgg

SEQ ID NO: 1487421 - DNA, 23 bp, Homo sapiens
gtggagaagggagggtggccagc

SEQ ID NO: 1487422 - DNA, 14 bp, Homo sapiens
gtggagagcccggc

SEQ ID NO: 1487423 - DNA, 12 bp, Homo sapiens
gtggagagctgg

SEQ ID NO: 1487424 - DNA, 14 bp, Homo sapiens
gtggagagctggtg

SEQ ID NO: 1487425 - DNA, 14 bp, Homo sapiens
gtggagagggaatg

SEQ ID NO: 1487426 - DNA, 15 bp, Homo sapiens
gtggagagggaatgt

SEQ ID NO: 1487427 - DNA, 14 bp, Homo sapiens
gtggagcagcagcc

SEQ ID NO: 1487428 - DNA, 13 bp, Homo sapiens
gtggagcagccag

SEQ ID NO: 1487429 - DNA, 14 bp, Homo sapiens
gtggagcagccaga

SEQ ID NO: 1487430 - DNA, 16 bp, Homo sapiens
gtggagcagccagagc

SEQ ID NO: 1487431 - DNA, 22 bp, Homo sapiens
gtggagcagccagagctgtgcc

SEQ ID NO: 1487432 - DNA, 16 bp, Homo sapiens
gtggagcatgggcctg

SEQ ID NO: 1487433 - DNA, 11 bp, Homo sapiens
gtggagccagg

SEQ ID NO: 1487434 - DNA, 15 bp, Homo sapiens
gtggagcctgccgcc

SEQ ID NO: 1487435 - DNA, 20 bp, Homo sapiens
gtggagcctgccgcccccgc

SEQ ID NO: 1487436 - DNA, 21 bp, Homo sapiens
gtggagcctgccgcccccgcc

SEQ ID NO: 1487437 - DNA, 16 bp, Homo sapiens
gtggagcttgcagtga

SEQ ID NO: 1487438 - DNA, 16 bp, Homo sapiens
gtggaggaaggtgctg

SEQ ID NO: 1487439 - DNA, 20 bp, Homo sapiens
gtggaggaaggtgctgagct

SEQ ID NO: 1487440 - DNA, 20 bp, Homo sapiens
gtggaggaggaggaggagcc

SEQ ID NO: 1487441 - DNA, 13 bp, Homo sapiens
gtggaggcctgat

SEQ ID NO: 1487442 - DNA, 13 bp, Homo sapiens
gtgggtgggagtg

SEQ ID NO: 1487443 - DNA, 16 bp, Homo sapiens
gtgggtggtggggagg

SEQ ID NO: 1487444 - DNA, 18 bp, Homo sapiens
gtgggtgtcctgcctgtc

SEQ ID NO: 1487445 - DNA, 13 bp, Homo sapiens
gtgggtgtggcca

SEQ ID NO: 1487446 - DNA, 15 bp, Homo sapiens
gtgggtttctctgtg

SEQ ID NO: 1487447 - DNA, 17 bp, Homo sapiens
gtgggtttctctgtgct

SEQ ID NO: 1487448 - DNA, 16 bp, Homo sapiens
gtgggtttggttagag

SEQ ID NO: 1487449 - DNA, 16 bp, Homo sapiens
gtggtaaatactgtga

SEQ ID NO: 1487450 - DNA, 15 bp, Homo sapiens
gtggtaactgccagc

SEQ ID NO: 1487451 - DNA, 16 bp, Homo sapiens
gtggtaagggttgggc

SEQ ID NO: 1487452 - DNA, 18 bp, Homo sapiens
gtggtaatttttgtacat

SEQ ID NO: 1487453 - DNA, 20 bp, Homo sapiens
gtggtacaatctggctcact

SEQ ID NO: 1487454 - DNA, 14 bp, Homo sapiens
gtggtacaggaagg

SEQ ID NO: 1487455 - DNA, 21 bp, Homo sapiens
gtggtagccatcaagcacttc

SEQ ID NO: 1487456 - DNA, 15 bp, Homo sapiens
gtggtagctccagcg

SEQ ID NO: 1487457 - DNA, 16 bp, Homo sapiens
gtggtagctccagcga

SEQ ID NO: 1487458 - DNA, 19 bp, Homo sapiens
gtggtagtacccagggcca

SEQ ID NO: 1487459 - DNA, 19 bp, Homo sapiens
gtggtatacatgtgtacat

SEQ ID NO: 1487460 - DNA, 13 bp, Homo sapiens
gtggtatgtctct

SEQ ID NO: 1487461 - DNA, 23 bp, Homo sapiens
gtggtcagagggactgtcagctg

SEQ ID NO: 1487462 - DNA, 14 bp, Homo sapiens
gtggtcataaaata

SEQ ID NO: 1487463 - DNA, 22 bp, Homo sapiens
gtggtcataaaatagaataatt

SEQ ID NO: 1487464 - DNA, 16 bp, Homo sapiens
gtggtcatgctcagcc

SEQ ID NO: 1487465 - DNA, 19 bp, Homo sapiens
gtggtcatgctcagccttg

SEQ ID NO: 1487466 - DNA, 16 bp, Homo sapiens
gtggtcattaagcatt

SEQ ID NO: 1487467 - DNA, 18 bp, Homo sapiens
gtggtccaaccaggagct

SEQ ID NO: 1487468 - DNA, 20 bp, Homo sapiens
gtggtccagcgtcactccag

SEQ ID NO: 1487469 - DNA, 23 bp, Homo sapiens
gtggtccagcgtcactccagtgc

SEQ ID NO: 1487470 - DNA, 15 bp, Homo sapiens
gtggtccagctcttg

SEQ ID NO: 1487471 - DNA, 23 bp, Homo sapiens
gtggtctccttgcactttctcag

SEQ ID NO: 1487472 - DNA, 19 bp, Homo sapiens
gtggtctctgccccagcct

SEQ ID NO: 1487473 - DNA, 20 bp, Homo sapiens
gtggtctcttcttggggccc

SEQ ID NO: 1487474 - DNA, 17 bp, Homo sapiens
gtggtctgttggcaggc

SEQ ID NO: 1487475 - DNA, 22 bp, Homo sapiens
gtggtctgttggcaggctggcc

SEQ ID NO: 1487476 - DNA, 18 bp, Homo sapiens
gtggtgatttgaaaaata

SEQ ID NO: 1487477 - DNA, 23 bp, Homo sapiens
gtggtgcgtttataattggctta

SEQ ID NO: 1487478 - DNA, 15 bp, Homo sapiens
gtggtggagccaggg

SEQ ID NO: 1487479 - DNA, 16 bp, Homo sapiens
gtggtggcacaggccc

SEQ ID NO: 1487480 - DNA, 14 bp, Homo sapiens
gtggtgggaatcag

SEQ ID NO: 1487481 - DNA, 12 bp, Homo sapiens
gtggtgggactc

SEQ ID NO: 1487482 - DNA, 22 bp, Homo sapiens
gtggtggggaggggcgctggcc

SEQ ID NO: 1487483 - DNA, 12 bp, Homo sapiens
gtggtggggctg

SEQ ID NO: 1487484 - DNA, 13 bp, Homo sapiens
gtggtgtgaccat

SEQ ID NO: 1487485 - DNA, 18 bp, Homo sapiens
gtggtgtgaccatgttca

SEQ ID NO: 1487486 - DNA, 14 bp, Homo sapiens
gtggtgttcctgaa

SEQ ID NO: 1487487 - DNA, 15 bp, Homo sapiens
gtggtgttcctgaag

SEQ ID NO: 1487488 - DNA, 20 bp, Homo sapiens
gtggttacagtgcagacagg

SEQ ID NO: 1487489 - DNA, 21 bp, Homo sapiens
gtggttattggactccaggcc

SEQ ID NO: 1487490 - DNA, 17 bp, Homo sapiens
gtggttcaagcacactg

SEQ ID NO: 1487491 - DNA, 13 bp, Homo sapiens
gtggttcctctgc

SEQ ID NO: 1487492 - DNA, 16 bp, Homo sapiens
gtggttcctctgctca

SEQ ID NO: 1487493 - DNA, 22 bp, Homo sapiens
gtggttgttgccaactaagccc

SEQ ID NO: 1487494 - DNA, 17 bp, Homo sapiens
gtggtttgcaggtcagc

SEQ ID NO: 1487495 - DNA, 14 bp, Homo sapiens
gtggtttgccatgt

SEQ ID NO: 1487496 - DNA, 18 bp, Homo sapiens
gtggtttgccatgtcgct

SEQ ID NO: 1487497 - DNA, 11 bp, Homo sapiens
gtggtttgtgg

SEQ ID NO: 1487498 - DNA, 16 bp, Homo sapiens
gtggtttgtggcttta

SEQ ID NO: 1487499 - DNA, 16 bp, Homo sapiens
gtggttttcccctccc

SEQ ID NO: 1487500 - DNA, 18 bp, Homo sapiens
gtggttttcccctccctg

SEQ ID NO: 1487501 - DNA, 19 bp, Homo sapiens
gtggttttcccctccctgg

SEQ ID NO: 1487502 - DNA, 16 bp, Homo sapiens
gtgtaaaaaatggaaa

SEQ ID NO: 1487503 - DNA, 13 bp, Homo sapiens
gtgtaaattatgt

SEQ ID NO: 1487504 - DNA, 22 bp, Homo sapiens
gtgtaaattatgtaatgcaaaa

SEQ ID NO: 1487505 - DNA, 21 bp, Homo sapiens
gtgtaacagctgaggtctctt

SEQ ID NO: 1487506 - DNA, 19 bp, Homo sapiens
gtgtaacaggtctcctctt

SEQ ID NO: 1487507 - DNA, 18 bp, Homo sapiens
gtgtaacatccaagccag

SEQ ID NO: 1487508 - DNA, 19 bp, Homo sapiens
gtgtaacatccaagccaga

SEQ ID NO: 1487509 - DNA, 19 bp, Homo sapiens
gtgtaacttcctgctgcac

SEQ ID NO: 1487510 - DNA, 20 bp, Homo sapiens
gtgtaactttcataccactt

SEQ ID NO: 1487511 - DNA, 18 bp, Homo sapiens
gtgtaagaactgtacatt

SEQ ID NO: 1487512 - DNA, 18 bp, Homo sapiens
gtgtaagaggctgacttt

SEQ ID NO: 1487513 - DNA, 21 bp, Homo sapiens
gtgtaagtattcttatttaat

SEQ ID NO: 1487514 - DNA, 15 bp, Homo sapiens
gtgtaataagaaagt

SEQ ID NO: 1487515 - DNA, 19 bp, Homo sapiens
gtgtaatccaggggtgtag

SEQ ID NO: 1487516 - DNA, 20 bp, Homo sapiens
gtgtaattgttttggaataa

SEQ ID NO: 1487517 - DNA, 21 bp, Homo sapiens
gtgtaatttaagtgacacaga

SEQ ID NO: 1487518 - DNA, 12 bp, Homo sapiens
gtgtacacctgc

SEQ ID NO: 1487519 - DNA, 12 bp, Homo sapiens
gtgtacaggtac

SEQ ID NO: 1487520 - DNA, 14 bp, Homo sapiens
gtgtacatcatgtt

SEQ ID NO: 1487521 - DNA, 22 bp, Homo sapiens
gtgtacatggaataacatgtaa

SEQ ID NO: 1487522 - DNA, 18 bp, Homo sapiens
gtgtaccacttcctgagg

SEQ ID NO: 1487523 - DNA, 14 bp, Homo sapiens
gtgtacctctagaa

SEQ ID NO: 1487524 - DNA, 16 bp, Homo sapiens
gtgtactttttttgga

SEQ ID NO: 1487525 - DNA, 19 bp, Homo sapiens
gtgtagaacactaattcat

SEQ ID NO: 1487526 - DNA, 23 bp, Homo sapiens
gtgtagatagttaaaagactgca

SEQ ID NO: 1487527 - DNA, 16 bp, Homo sapiens
gtgtagccgccctgag

SEQ ID NO: 1487528 - DNA, 18 bp, Homo sapiens
gtgtagcctaaagggcag

SEQ ID NO: 1487529 - DNA, 17 bp, Homo sapiens
gtgtagccttgcccgga

SEQ ID NO: 1487530 - DNA, 17 bp, Homo sapiens
gtgtagctgcaaaaata

SEQ ID NO: 1487531 - DNA, 16 bp, Homo sapiens
gtgtagctgtaagggc

SEQ ID NO: 1487532 - DNA, 19 bp, Homo sapiens
gtgtagctgtaagggcagt

SEQ ID NO: 1487533 - DNA, 23 bp, Homo sapiens
gtgtagctgtaagggcagtgccc

SEQ ID NO: 1487534 - DNA, 14 bp, Homo sapiens
gtgtagctgtcctc

SEQ ID NO: 1487535 - DNA, 12 bp, Homo sapiens
gtgtagctgtgt

SEQ ID NO: 1487536 - DNA, 17 bp, Homo sapiens
gtgtaggggccacctcc

SEQ ID NO: 1487537 - DNA, 19 bp, Homo sapiens
gtgtagtggaagagcagcc

SEQ ID NO: 1487538 - DNA, 18 bp, Homo sapiens
gtgtataaaaataaaaaa

SEQ ID NO: 1487539 - DNA, 17 bp, Homo sapiens
gtgtatagtgttcacaa

SEQ ID NO: 1487540 - DNA, 21 bp, Homo sapiens
gtgtatatgattctcttgaga

SEQ ID NO: 1487541 - DNA, 18 bp, Homo sapiens
gtgtatatgttggtttaa

SEQ ID NO: 1487542 - DNA, 14 bp, Homo sapiens
gtgtatcctggggc

SEQ ID NO: 1487543 - DNA, 15 bp, Homo sapiens
gtgtatcctggggct

SEQ ID NO: 1487544 - DNA, 15 bp, Homo sapiens
gtgtatgactaaaga

SEQ ID NO: 1487545 - DNA, 16 bp, Homo sapiens
gtgtatgactaaagag

SEQ ID NO: 1487546 - DNA, 13 bp, Homo sapiens
gtgtatgcacagg

SEQ ID NO: 1487547 - DNA, 14 bp, Homo sapiens
gtgtatgcacagta

SEQ ID NO: 1487548 - DNA, 20 bp, Homo sapiens
gtgtatgccacacctggcct

SEQ ID NO: 1487549 - DNA, 23 bp, Homo sapiens
gtgtatgcgaaaaggtttttagg

SEQ ID NO: 1487550 - DNA, 19 bp, Homo sapiens
gtgtattctagttttgtca

SEQ ID NO: 1487551 - DNA, 20 bp, Homo sapiens
gtgtattctgtggattctat

SEQ ID NO: 1487552 - DNA, 15 bp, Homo sapiens
gtgtattgatgcaat

SEQ ID NO: 1487553 - DNA, 12 bp, Homo sapiens
gtgtatttattt

SEQ ID NO: 1487554 - DNA, 10 bp, Homo sapiens
gtgtatttgc

SEQ ID NO: 1487555 - DNA, 20 bp, Homo sapiens
gtgtatttgtattaataaag

SEQ ID NO: 1487556 - DNA, 22 bp, Homo sapiens
gtgtatttgtattaataaagca

SEQ ID NO: 1487557 - DNA, 21 bp, Homo sapiens
gttaaaataactagtgttgct

SEQ ID NO: 1487558 - DNA, 14 bp, Homo sapiens
gttaaaatgtacac

SEQ ID NO: 1487559 - DNA, 15 bp, Homo sapiens
gttaaaatgtacact

SEQ ID NO: 1487560 - DNA, 18 bp, Homo sapiens
gttaaaatgtttactgta

SEQ ID NO: 1487561 - DNA, 18 bp, Homo sapiens
gttaaacaaatgatttcc

SEQ ID NO: 1487562 - DNA, 21 bp, Homo sapiens
gttaaacattaatatttacca

SEQ ID NO: 1487563 - DNA, 14 bp, Homo sapiens
gttaaacattgaag

SEQ ID NO: 1487564 - DNA, 22 bp, Homo sapiens
gttaaactaaaaaaaaaaaggc

SEQ ID NO: 1487565 - DNA, 15 bp, Homo sapiens
gttaaagaaaggaaa

SEQ ID NO: 1487566 - DNA, 15 bp, Homo sapiens
gttaaagctgccggc

SEQ ID NO: 1487567 - DNA, 20 bp, Homo sapiens
gttaaagctggaacatttga

SEQ ID NO: 1487568 - DNA, 21 bp, Homo sapiens
gttaaagggaagaaaacactg

SEQ ID NO: 1487569 - DNA, 18 bp, Homo sapiens
gttaaaggttttctctaa

SEQ ID NO: 1487570 - DNA, 20 bp, Homo sapiens
gttaaagtcagtgggaacgt

SEQ ID NO: 1487571 - DNA, 15 bp, Homo sapiens
gttaaataactgtgt

SEQ ID NO: 1487572 - DNA, 16 bp, Homo sapiens
gttaaatacaggaaac

SEQ ID NO: 1487573 - DNA, 19 bp, Homo sapiens
gttaaatagagtatatgca

SEQ ID NO: 1487574 - DNA, 20 bp, Homo sapiens
gttaaatagagtatatgcac

SEQ ID NO: 1487575 - DNA, 15 bp, Homo sapiens
gttaaatatgtagat

SEQ ID NO: 1487576 - DNA, 23 bp, Homo sapiens
gttaaatgtaatataatgtattt

SEQ ID NO: 1487577 - DNA, 14 bp, Homo sapiens
gttaaattcagtaa

SEQ ID NO: 1487578 - DNA, 11 bp, Homo sapiens
gttaacaaatg

SEQ ID NO: 1487579 - DNA, 14 bp, Homo sapiens
gttaacaaatgagc

SEQ ID NO: 1487580 - DNA, 12 bp, Homo sapiens
gttaacagattt

SEQ ID NO: 1487581 - DNA, 17 bp, Homo sapiens
gttaacaggcaaacatt

SEQ ID NO: 1487582 - DNA, 15 bp, Homo sapiens
gttaacattgaccaa

SEQ ID NO: 1487583 - DNA, 19 bp, Homo sapiens
gttaacattttttttgttt

SEQ ID NO: 1487584 - DNA, 19 bp, Homo sapiens
gttaactgtgaaataccac

SEQ ID NO: 1487585 - DNA, 14 bp, Homo sapiens
gttaacttggtcag

SEQ ID NO: 1487586 - DNA, 16 bp, Homo sapiens
gttaagacctggcagc

SEQ ID NO: 1487587 - DNA, 15 bp, Homo sapiens
gttaagataacttac

SEQ ID NO: 1487588 - DNA, 22 bp, Homo sapiens
gttaaggagaatcatgtttctt

SEQ ID NO: 1487589 - DNA, 11 bp, Homo sapiens
gttaaggcctg

SEQ ID NO: 1487590 - DNA, 24 bp, Homo sapiens
gttaataacttgtcctatgtcaat

SEQ ID NO: 1487591 - DNA, 15 bp, Homo sapiens
gttaatacaaggtat

SEQ ID NO: 1487592 - DNA, 20 bp, Homo sapiens
gttaatactggatagcatga

SEQ ID NO: 1487593 - DNA, 15 bp, Homo sapiens
gttaatgctttctga

SEQ ID NO: 1487594 - DNA, 23 bp, Homo sapiens
gttaatgttatatcatatgtata

SEQ ID NO: 1487595 - DNA, 18 bp, Homo sapiens
gttaattcagcactgatt

SEQ ID NO: 1487596 - DNA, 21 bp, Homo sapiens
gttaattcagcactgatttca

SEQ ID NO: 1487597 - DNA, 16 bp, Homo sapiens
gttaatttatttagtt

SEQ ID NO: 1487598 - DNA, 18 bp, Homo sapiens
gttaattttattcaagaa

SEQ ID NO: 1487599 - DNA, 17 bp, Homo sapiens
gttaattttgaagtgct

SEQ ID NO: 1487600 - DNA, 22 bp, Homo sapiens
gttaattttgaagtgctgttta

SEQ ID NO: 1487601 - DNA, 15 bp, Homo sapiens
gttaattttgctaac

SEQ ID NO: 1487602 - DNA, 16 bp, Homo sapiens
gttaattttgctaact

SEQ ID NO: 1487603 - DNA, 17 bp, Homo sapiens
gttaattttgctaactg

SEQ ID NO: 1487604 - DNA, 18 bp, Homo sapiens
gttaattttgctaactgg

SEQ ID NO: 1487605 - DNA, 14 bp, Homo sapiens
gttaatttttccta

SEQ ID NO: 1487606 - DNA, 16 bp, Homo sapiens
gttaatttttcctgca

SEQ ID NO: 1487607 - DNA, 22 bp, Homo sapiens
gttaatttttcctgcatgttct

SEQ ID NO: 1487608 - DNA, 20 bp, Homo sapiens
gttacacagaaatgctgctg

SEQ ID NO: 1487609 - DNA, 21 bp, Homo sapiens
gttacacagaaatgctgctgg

SEQ ID NO: 1487610 - DNA, 12 bp, Homo sapiens
gttacacccttt

SEQ ID NO: 1487611 - DNA, 20 bp, Homo sapiens
gttacactaatttgaataaa

SEQ ID NO: 1487612 - DNA, 14 bp, Homo sapiens
gttacactgggctg

SEQ ID NO: 1487613 - DNA, 17 bp, Homo sapiens
gttacactgggctgggt

SEQ ID NO: 1487614 - DNA, 13 bp, Homo sapiens
gttacacttgtgc

SEQ ID NO: 1487615 - DNA, 19 bp, Homo sapiens
gttacataagataaatgtg

SEQ ID NO: 1487616 - DNA, 18 bp, Homo sapiens
gttacataaggatgactt

SEQ ID NO: 1487617 - DNA, 17 bp, Homo sapiens
gttacatgtaatatatt

SEQ ID NO: 1487618 - DNA, 14 bp, Homo sapiens
gttacattaatgtt

SEQ ID NO: 1487619 - DNA, 13 bp, Homo sapiens
gttaccattcaca

SEQ ID NO: 1487620 - DNA, 19 bp, Homo sapiens
gttacccaaagggcttatt

SEQ ID NO: 1487621 - DNA, 13 bp, Homo sapiens
gttacccagagaa

SEQ ID NO: 1487622 - DNA, 19 bp, Homo sapiens
gttacccagggctctgcag

SEQ ID NO: 1487623 - DNA, 17 bp, Homo sapiens
gttacccattcaaccat

SEQ ID NO: 1487624 - DNA, 13 bp, Homo sapiens
gttacctgtgtgc

SEQ ID NO: 1487625 - DNA, 16 bp, Homo sapiens
gttactaatatgccta

SEQ ID NO: 1487626 - DNA, 23 bp, Homo sapiens
gttactaattggcctctttaaga

SEQ ID NO: 1487627 - DNA, 22 bp, Homo sapiens
gttactacctatacaatgtatg

SEQ ID NO: 1487628 - DNA, 12 bp, Homo sapiens
gttactattttc

SEQ ID NO: 1487629 - DNA, 17 bp, Homo sapiens
gttactcagatataaga

SEQ ID NO: 1487630 - DNA, 13 bp, Homo sapiens
gttactcagccct

SEQ ID NO: 1487631 - DNA, 16 bp, Homo sapiens
gttactcagccctggg

SEQ ID NO: 1487632 - DNA, 18 bp, Homo sapiens
gttactcagccctgggcc

SEQ ID NO: 1487633 - DNA, 22 bp, Homo sapiens
gttactctccaacctggacaac

SEQ ID NO: 1487634 - DNA, 14 bp, Homo sapiens
gttactctgaaggg

SEQ ID NO: 1487635 - DNA, 13 bp, Homo sapiens
gttactctgtccc

SEQ ID NO: 1487636 - DNA, 21 bp, Homo sapiens
gttactgaaggtgatggaggt

SEQ ID NO: 1487637 - DNA, 14 bp, Homo sapiens
gttactgggccctg

SEQ ID NO: 1487638 - DNA, 12 bp, Homo sapiens
gttactgtaaat

SEQ ID NO: 1487639 - DNA, 14 bp, Homo sapiens
gttacttctgaggt

SEQ ID NO: 1487640 - DNA, 15 bp, Homo sapiens
gttacttgcttcagt

SEQ ID NO: 1487641 - DNA, 17 bp, Homo sapiens
gttacttgtctgaggcc

SEQ ID NO: 1487642 - DNA, 18 bp, Homo sapiens
gttacttgtctgaggcct

SEQ ID NO: 1487643 - DNA, 19 bp, Homo sapiens
gttacttgtctgaggcctc

SEQ ID NO: 1487644 - DNA, 23 bp, Homo sapiens
gttacttgtctgaggcctcatcc

SEQ ID NO: 1487645 - DNA, 21 bp, Homo sapiens
gttactttagttagcatgcgc

SEQ ID NO: 1487646 - DNA, 23 bp, Homo sapiens
gttacttttaggatgggggagag

SEQ ID NO: 1487647 - DNA, 15 bp, Homo sapiens
gttagaaaatgactt

SEQ ID NO: 1487648 - DNA, 15 bp, Homo sapiens
gttagaaaggcagcc

SEQ ID NO: 1487649 - DNA, 11 bp, Homo sapiens
gttagaatcaa

SEQ ID NO: 1487650 - DNA, 16 bp, Homo sapiens
gttagaatcaaatact

SEQ ID NO: 1487651 - DNA, 18 bp, Homo sapiens
gttagaatcaaatactca

SEQ ID NO: 1487652 - DNA, 15 bp, Homo sapiens
gttagaatgtaaggt

SEQ ID NO: 1487653 - DNA, 22 bp, Homo sapiens
gttagacaatagtttttaaaag

SEQ ID NO: 1487654 - DNA, 22 bp, Homo sapiens
gttagactgacttgtttgtctt

SEQ ID NO: 1487655 - DNA, 19 bp, Homo sapiens
gttagcagggatgttcctt

SEQ ID NO: 1487656 - DNA, 18 bp, Homo sapiens
gttagcatgtatgaatgt

SEQ ID NO: 1487657 - DNA, 21 bp, Homo sapiens
gttagctgacagtcagctgtg

SEQ ID NO: 1487658 - DNA, 18 bp, Homo sapiens
gttaggaaaaaattgaaa

SEQ ID NO: 1487659 - DNA, 21 bp, Homo sapiens
gttaggaaaaccacaaacgga

SEQ ID NO: 1487660 - DNA, 19 bp, Homo sapiens
gttaggaataacactgcag

SEQ ID NO: 1487661 - DNA, 16 bp, Homo sapiens
gttaggaatctcttca

SEQ ID NO: 1487662 - DNA, 15 bp, Homo sapiens
gttaggaggctgcat

SEQ ID NO: 1487663 - DNA, 18 bp, Homo sapiens
gttaggaggctgcatgct

SEQ ID NO: 1487664 - DNA, 16 bp, Homo sapiens
gttaggattcaggcag

SEQ ID NO: 1487665 - DNA, 18 bp, Homo sapiens
gttaggcattaatgtttc

SEQ ID NO: 1487666 - DNA, 17 bp, Homo sapiens
gttaggcatttcctgct

SEQ ID NO: 1487667 - DNA, 17 bp, Homo sapiens
gttaggcttttctgcct

SEQ ID NO: 1487668 - DNA, 20 bp, Homo sapiens
gttagggagagagaagcagg

SEQ ID NO: 1487669 - DNA, 22 bp, Homo sapiens
gttagggagagagaagcaggca

SEQ ID NO: 1487670 - DNA, 17 bp, Homo sapiens
gttagggctgcttttct

SEQ ID NO: 1487671 - DNA, 17 bp, Homo sapiens
gttagggtcagccattt

SEQ ID NO: 1487672 - DNA, 20 bp, Homo sapiens
gttctcaagaatctagaaga

SEQ ID NO: 1487673 - DNA, 12 bp, Homo sapiens
gttctcacaccc

SEQ ID NO: 1487674 - DNA, 15 bp, Homo sapiens
gttctcagacctcca

SEQ ID NO: 1487675 - DNA, 16 bp, Homo sapiens
gttctcatctttcttg

SEQ ID NO: 1487676 - DNA, 19 bp, Homo sapiens
gttctcatgaagcaggagg

SEQ ID NO: 1487677 - DNA, 22 bp, Homo sapiens
gttctcatttggtctgccagaa

SEQ ID NO: 1487678 - DNA, 22 bp, Homo sapiens
gttctccaacatcacagcccag

SEQ ID NO: 1487679 - DNA, 19 bp, Homo sapiens
gttctccagcttcagctca

SEQ ID NO: 1487680 - DNA, 23 bp, Homo sapiens
gttctccgttagctcctgtggcc

SEQ ID NO: 1487681 - DNA, 16 bp, Homo sapiens
gttctcctgaatattt

SEQ ID NO: 1487682 - DNA, 13 bp, Homo sapiens
gttctccttttcc

SEQ ID NO: 1487683 - DNA, 22 bp, Homo sapiens
gttctctcatcggaggcccatg

SEQ ID NO: 1487684 - DNA, 13 bp, Homo sapiens
gttctctccagga

SEQ ID NO: 1487685 - DNA, 12 bp, Homo sapiens
gttctctgggag

SEQ ID NO: 1487686 - DNA, 14 bp, Homo sapiens
gttctctgggagaa

SEQ ID NO: 1487687 - DNA, 19 bp, Homo sapiens
gttctctgggagaaaatca

SEQ ID NO: 1487688 - DNA, 20 bp, Homo sapiens
gttctctgggagaaaatcat

SEQ ID NO: 1487689 - DNA, 21 bp, Homo sapiens
gttctctgggagaaaatcatc

SEQ ID NO: 1487690 - DNA, 14 bp, Homo sapiens
gttctctgtcctac

SEQ ID NO: 1487691 - DNA, 15 bp, Homo sapiens
gttctctttaaaata

SEQ ID NO: 1487692 - DNA, 12 bp, Homo sapiens
gttctctttgga

SEQ ID NO: 1487693 - DNA, 15 bp, Homo sapiens
gttctgaataatttc

SEQ ID NO: 1487694 - DNA, 16 bp, Homo sapiens
gttctgaataatttct

SEQ ID NO: 1487695 - DNA, 14 bp, Homo sapiens
gttctgcactgaaa

SEQ ID NO: 1487696 - DNA, 21 bp, Homo sapiens
gttctgcagacacgccttccc

SEQ ID NO: 1487697 - DNA, 16 bp, Homo sapiens
gttctgcagcggcaga

SEQ ID NO: 1487698 - DNA, 13 bp, Homo sapiens
gttctgcagtcat

SEQ ID NO: 1487699 - DNA, 23 bp, Homo sapiens
gttctgcccacgatcccctcccc

SEQ ID NO: 1487700 - DNA, 12 bp, Homo sapiens
gttctgccctgc

SEQ ID NO: 1487701 - DNA, 16 bp, Homo sapiens
gttctgccctgcctga

SEQ ID NO: 1487702 - DNA, 13 bp, Homo sapiens
gttctgcctgcca

SEQ ID NO: 1487703 - DNA, 22 bp, Homo sapiens
gttctgcctgccagctgcactg

SEQ ID NO: 1487704 - DNA, 20 bp, Homo sapiens
gttctgcctttagcctggac

SEQ ID NO: 1487705 - DNA, 19 bp, Homo sapiens
gttctgcgctgtgtacaat

SEQ ID NO: 1487706 - DNA, 16 bp, Homo sapiens
gttctgctacattata

SEQ ID NO: 1487707 - DNA, 21 bp, Homo sapiens
gttctgctcccagatgccttc

SEQ ID NO: 1487708 - DNA, 11 bp, Homo sapiens
gttctgctcct

SEQ ID NO: 1487709 - DNA, 18 bp, Homo sapiens
gttctgctcctgcttttc

SEQ ID NO: 1487710 - DNA, 14 bp, Homo sapiens
gttctgctgccctc

SEQ ID NO: 1487711 - DNA, 13 bp, Homo sapiens
gttctgctggcct

SEQ ID NO: 1487712 - DNA, 21 bp, Homo sapiens
gttctgcttcaataaatcttt

SEQ ID NO: 1487713 - DNA, 17 bp, Homo sapiens
gttctggacctgggcat

SEQ ID NO: 1487714 - DNA, 15 bp, Homo sapiens
gttctggactctgcc

SEQ ID NO: 1487715 - DNA, 17 bp, Homo sapiens
gttctggactctgcccc

SEQ ID NO: 1487716 - DNA, 18 bp, Homo sapiens
gttctggactctgcccca

SEQ ID NO: 1487717 - DNA, 20 bp, Homo sapiens
gttctggaggaaagggagga

SEQ ID NO: 1487718 - DNA, 12 bp, Homo sapiens
gttctggccaga

SEQ ID NO: 1487719 - DNA, 16 bp, Homo sapiens
gttctggccagaatgc

SEQ ID NO: 1487720 - DNA, 23 bp, Homo sapiens
gttctggccctcacccctgccct

SEQ ID NO: 1487721 - DNA, 16 bp, Homo sapiens
gttctggctgtttgag

SEQ ID NO: 1487722 - DNA, 19 bp, Homo sapiens
gttctggcttttttgtggg

SEQ ID NO: 1487723 - DNA, 13 bp, Homo sapiens
gttctggttccat

SEQ ID NO: 1487724 - DNA, 22 bp, Homo sapiens
gttctgtgacccatctgtagta

SEQ ID NO: 1487725 - DNA, 14 bp, Homo sapiens
gttctgtgactgaa

SEQ ID NO: 1487726 - DNA, 17 bp, Homo sapiens
gttctgtgcctcccccc

SEQ ID NO: 1487727 - DNA, 16 bp, Homo sapiens
gttctgtggtttcatg

SEQ ID NO: 1487728 - DNA, 21 bp, Homo sapiens
gttctgtggtttcatgttagt

SEQ ID NO: 1487729 - DNA, 23 bp, Homo sapiens
gttctgtgtctttcacagctcct

SEQ ID NO: 1487730 - DNA, 21 bp, Homo sapiens
gttctgttccaacctcctgct

SEQ ID NO: 1487731 - DNA, 24 bp, Homo sapiens
gttctgttccaacctcctgctctg

SEQ ID NO: 1487732 - DNA, 18 bp, Homo sapiens
gttctgttgtctgcgcct

SEQ ID NO: 1487733 - DNA, 16 bp, Homo sapiens
gttctgtttggcactt

SEQ ID NO: 1487734 - DNA, 22 bp, Homo sapiens
gttctgtttgttattgttttgt

SEQ ID NO: 1487735 - DNA, 23 bp, Homo sapiens
gttctgtttgttattgttttgtt

SEQ ID NO: 1487736 - DNA, 16 bp, Homo sapiens
gttctgttttgttttg

SEQ ID NO: 1487737 - DNA, 22 bp, Homo sapiens
gttcttaaaaaaataaaatatt

SEQ ID NO: 1487738 - DNA, 16 bp, Homo sapiens
gttcttagcaataaat

SEQ ID NO: 1487739 - DNA, 15 bp, Homo sapiens
gttcttaggtttact

SEQ ID NO: 1487740 - DNA, 22 bp, Homo sapiens
gttcttagttgacaacctagaa

SEQ ID NO: 1487741 - DNA, 22 bp, Homo sapiens
gttcttattaccctgattgaat

SEQ ID NO: 1487742 - DNA, 22 bp, Homo sapiens
gttcttattttgcattccagaa

SEQ ID NO: 1487743 - DNA, 19 bp, Homo sapiens
gttcttctttctctgtatt

SEQ ID NO: 1487744 - DNA, 19 bp, Homo sapiens
gttcttgccactgcactcc

SEQ ID NO: 1487745 - DNA, 22 bp, Homo sapiens
gttcttgggcctcaggctctgc

SEQ ID NO: 1487746 - DNA, 12 bp, Homo sapiens
gttcttgtattt

SEQ ID NO: 1487747 - DNA, 17 bp, Homo sapiens
gttcttgtgtcctggta

SEQ ID NO: 1487748 - DNA, 23 bp, Homo sapiens
gttcttgtttttaagtttgcact

SEQ ID NO: 1487749 - DNA, 13 bp, Homo sapiens
gttctttaatgtt

SEQ ID NO: 1487750 - DNA, 16 bp, Homo sapiens
gttctttcctctttct

SEQ ID NO: 1487751 - DNA, 23 bp, Homo sapiens
gttctttcctctttctgctctgc

SEQ ID NO: 1487752 - DNA, 15 bp, Homo sapiens
gttctttgggccaga

SEQ ID NO: 1487753 - DNA, 20 bp, Homo sapiens
gttctttgttcatagcccag

SEQ ID NO: 1487754 - DNA, 21 bp, Homo sapiens
gttctttgttcatagcccagt

SEQ ID NO: 1487755 - DNA, 15 bp, Homo sapiens
gttcttttaaagact

SEQ ID NO: 1487756 - DNA, 19 bp, Homo sapiens
gttgaaaaagtttgttttt

SEQ ID NO: 1487757 - DNA, 13 bp, Homo sapiens
gttgaaagacatc

SEQ ID NO: 1487758 - DNA, 14 bp, Homo sapiens
gttgaaagacatca

SEQ ID NO: 1487759 - DNA, 16 bp, Homo sapiens
gttgaaagacatcaat

SEQ ID NO: 1487760 - DNA, 15 bp, Homo sapiens
gttgaacaaaataaa

SEQ ID NO: 1487761 - DNA, 17 bp, Homo sapiens
gttgaacaaaataaatt

SEQ ID NO: 1487762 - DNA, 18 bp, Homo sapiens
gttgaacaaaataaattg

SEQ ID NO: 1487763 - DNA, 14 bp, Homo sapiens
gttgaactgttaga

SEQ ID NO: 1487764 - DNA, 22 bp, Homo sapiens
gttgaagagacagagacaagta

SEQ ID NO: 1487765 - DNA, 13 bp, Homo sapiens
gttgaaggcagtc

SEQ ID NO: 1487766 - DNA, 21 bp, Homo sapiens
gttgaaggcagtctgaaccct

SEQ ID NO: 1487767 - DNA, 12 bp, Homo sapiens
gttgaagggagg

SEQ ID NO: 1487768 - DNA, 14 bp, Homo sapiens
gttgaatgaataaa

SEQ ID NO: 1487769 - DNA, 21 bp, Homo sapiens
gttgaattttttttaacattc

SEQ ID NO: 1487770 - DNA, 17 bp, Homo sapiens
gttgacaacctagaatg

SEQ ID NO: 1487771 - DNA, 19 bp, Homo sapiens
gttgacaacctagaatgtc

SEQ ID NO: 1487772 - DNA, 14 bp, Homo sapiens
gttgacgagactgg

SEQ ID NO: 1487773 - DNA, 19 bp, Homo sapiens
gttgactgtgattagatca

SEQ ID NO: 1487774 - DNA, 11 bp, Homo sapiens
gttgagagaac

SEQ ID NO: 1487775 - DNA, 13 bp, Homo sapiens
gttgagatccagt

SEQ ID NO: 1487776 - DNA, 18 bp, Homo sapiens
gttgagatgtgctttgct

SEQ ID NO: 1487777 - DNA, 19 bp, Homo sapiens
gttgagcatgacagcctgc

SEQ ID NO: 1487778 - DNA, 21 bp, Homo sapiens
gttgagcatgacagcctgcag

SEQ ID NO: 1487779 - DNA, 20 bp, Homo sapiens
gttgagccccaagtcctgaa

SEQ ID NO: 1487780 - DNA, 16 bp, Homo sapiens
gttgagccccagtgct

SEQ ID NO: 1487781 - DNA, 14 bp, Homo sapiens
gttgagccttttcc

SEQ ID NO: 1487782 - DNA, 13 bp, Homo sapiens
gttgagctgtttt

SEQ ID NO: 1487783 - DNA, 22 bp, Homo sapiens
gttgagggaacagacaggagaa

SEQ ID NO: 1487784 - DNA, 16 bp, Homo sapiens
gttgaggggctcctgg

SEQ ID NO: 1487785 - DNA, 23 bp, Homo sapiens
gttgagtctcctctctgagactg

SEQ ID NO: 1487786 - DNA, 18 bp, Homo sapiens
gttgataaattccactgg

SEQ ID NO: 1487787 - DNA, 14 bp, Homo sapiens
gttgtgtgtgggag

SEQ ID NO: 1487788 - DNA, 22 bp, Homo sapiens
gttgtgtgtgggagtgtgtaat

SEQ ID NO: 1487789 - DNA, 17 bp, Homo sapiens
gttgtgttcctggctga

SEQ ID NO: 1487790 - DNA, 12 bp, Homo sapiens
gttgtgttgtca

SEQ ID NO: 1487791 - DNA, 11 bp, Homo sapiens
gttgttaaaac

SEQ ID NO: 1487792 - DNA, 21 bp, Homo sapiens
gttgttaaacacgtgtctata

SEQ ID NO: 1487793 - DNA, 16 bp, Homo sapiens
gttgttaatgaaaatg

SEQ ID NO: 1487794 - DNA, 18 bp, Homo sapiens
gttgttaatgaaaatgtc

SEQ ID NO: 1487795 - DNA, 14 bp, Homo sapiens
gttgttattattca

SEQ ID NO: 1487796 - DNA, 18 bp, Homo sapiens
gttgttccattttatgca

SEQ ID NO: 1487797 - DNA, 12 bp, Homo sapiens
gttgttcctcta

SEQ ID NO: 1487798 - DNA, 22 bp, Homo sapiens
gttgttcctctatactttgttc

SEQ ID NO: 1487799 - DNA, 13 bp, Homo sapiens
gttgttctgcctg

SEQ ID NO: 1487800 - DNA, 15 bp, Homo sapiens
gttgttgactgtgat

SEQ ID NO: 1487801 - DNA, 20 bp, Homo sapiens
gttgttgccaactaagccct

SEQ ID NO: 1487802 - DNA, 22 bp, Homo sapiens
gttgttgccaactaagccctcg

SEQ ID NO: 1487803 - DNA, 14 bp, Homo sapiens
gttgttgccaggtt

SEQ ID NO: 1487804 - DNA, 18 bp, Homo sapiens
gttgttgccaggttgcag

SEQ ID NO: 1487805 - DNA, 22 bp, Homo sapiens
gttgttgccaggttgcagctgc

SEQ ID NO: 1487806 - DNA, 13 bp, Homo sapiens
gttgttgctgctg

SEQ ID NO: 1487807 - DNA, 15 bp, Homo sapiens
gttgttgctgctgtt

SEQ ID NO: 1487808 - DNA, 14 bp, Homo sapiens
gttgttgttgctgc

SEQ ID NO: 1487809 - DNA, 20 bp, Homo sapiens
gttgtttagaaacagaaata

SEQ ID NO: 1487810 - DNA, 13 bp, Homo sapiens
gttgtttgtaaat

SEQ ID NO: 1487811 - DNA, 17 bp, Homo sapiens
gttgttttgtacagatg

SEQ ID NO: 1487812 - DNA, 20 bp, Homo sapiens
gttgttttttcctttgctct

SEQ ID NO: 1487813 - DNA, 14 bp, Homo sapiens
gtttaaaaaaataa

SEQ ID NO: 1487814 - DNA, 17 bp, Homo sapiens
gtttaaaaaaataacat

SEQ ID NO: 1487815 - DNA, 18 bp, Homo sapiens
gtttaaaaagtatgttct

SEQ ID NO: 1487816 - DNA, 19 bp, Homo sapiens
gtttaaaatgtaatttaaa

SEQ ID NO: 1487817 - DNA, 22 bp, Homo sapiens
gtttaaacacttatcttctgga

SEQ ID NO: 1487818 - DNA, 19 bp, Homo sapiens
gtttaaacccaagtgctgc

SEQ ID NO: 1487819 - DNA, 20 bp, Homo sapiens
gtttaaacccaagtgctgca

SEQ ID NO: 1487820 - DNA, 23 bp, Homo sapiens
gtttaaacccaagtgctgcacaa

SEQ ID NO: 1487821 - DNA, 12 bp, Homo sapiens
gtttaaactgat

SEQ ID NO: 1487822 - DNA, 14 bp, Homo sapiens
gtttaaagagtcta

SEQ ID NO: 1487823 - DNA, 19 bp, Homo sapiens
gtttaaagagtctagattc

SEQ ID NO: 1487824 - DNA, 14 bp, Homo sapiens
gtttaaataaacac

SEQ ID NO: 1487825 - DNA, 13 bp, Homo sapiens
gtttaaatatttc

SEQ ID NO: 1487826 - DNA, 16 bp, Homo sapiens
gtttaacaaatctaat

SEQ ID NO: 1487827 - DNA, 18 bp, Homo sapiens
gtttaacaataataaaaa

SEQ ID NO: 1487828 - DNA, 18 bp, Homo sapiens
gtttaaccttaaaattaa

SEQ ID NO: 1487829 - DNA, 23 bp, Homo sapiens
gtttaagaaaaaataacacacat

SEQ ID NO: 1487830 - DNA, 18 bp, Homo sapiens
gtttaagttgattaaaaa

SEQ ID NO: 1487831 - DNA, 14 bp, Homo sapiens
gtttaataaaggct

SEQ ID NO: 1487832 - DNA, 16 bp, Homo sapiens
gtttaatacaggaaat

SEQ ID NO: 1487833 - DNA, 15 bp, Homo sapiens
gtttaatattgagaa

SEQ ID NO: 1487834 - DNA, 18 bp, Homo sapiens
gtttaatcccagcacttt

SEQ ID NO: 1487835 - DNA, 13 bp, Homo sapiens
gtttaatcttttt

SEQ ID NO: 1487836 - DNA, 18 bp, Homo sapiens
gtttaatgggtatgctca

SEQ ID NO: 1487837 - DNA, 14 bp, Homo sapiens
gtttaatttaaagc

SEQ ID NO: 1487838 - DNA, 14 bp, Homo sapiens
gtttaatttacaca

SEQ ID NO: 1487839 - DNA, 20 bp, Homo sapiens
gtttacaaatggacatagga

SEQ ID NO: 1487840 - DNA, 22 bp, Homo sapiens
gtttacactgcggaagccaaag

SEQ ID NO: 1487841 - DNA, 13 bp, Homo sapiens
gtttacagaaaaa

SEQ ID NO: 1487842 - DNA, 21 bp, Homo sapiens
gtttacatttgatgcatgtct

SEQ ID NO: 1487843 - DNA, 15 bp, Homo sapiens
gtttaccagttgcct

SEQ ID NO: 1487844 - DNA, 13 bp, Homo sapiens
gtttaccatttgt

SEQ ID NO: 1487845 - DNA, 17 bp, Homo sapiens
gtttaccatttgtaata

SEQ ID NO: 1487846 - DNA, 21 bp, Homo sapiens
gtttaccatttgtaataaagt

SEQ ID NO: 1487847 - DNA, 16 bp, Homo sapiens
gtttacctgtgaaata

SEQ ID NO: 1487848 - DNA, 13 bp, Homo sapiens
gtttacctttctc

SEQ ID NO: 1487849 - DNA, 23 bp, Homo sapiens
gtttactatgtgccagttcctgt

SEQ ID NO: 1487850 - DNA, 13 bp, Homo sapiens
gtttactgtaaat

SEQ ID NO: 1487851 - DNA, 20 bp, Homo sapiens
gtttactgtgaagagaatgt

SEQ ID NO: 1487852 - DNA, 14 bp, Homo sapiens
gtttacttaaagat

SEQ ID NO: 1487853 - DNA, 16 bp, Homo sapiens
gtttacttaaagattt

SEQ ID NO: 1487854 - DNA, 18 bp, Homo sapiens
gtttacttatcttatgcc

SEQ ID NO: 1487855 - DNA, 11 bp, Homo sapiens
gtttacttgtc

SEQ ID NO: 1487856 - DNA, 23 bp, Homo sapiens
gtttacttgtctgtcaaatgttt

SEQ ID NO: 1487857 - DNA, 15 bp, Homo sapiens
gtttagagagcctgt

SEQ ID NO: 1487858 - DNA, 20 bp, Homo sapiens
gtttagatttatggttgtta

SEQ ID NO: 1487859 - DNA, 19 bp, Homo sapiens
gtttaggatcatctctgca

SEQ ID NO: 1487860 - DNA, 14 bp, Homo sapiens
gtttaggctatttg

SEQ ID NO: 1487861 - DNA, 22 bp, Homo sapiens
gtttaggctatttgtaaatctg

SEQ ID NO: 1487862 - DNA, 18 bp, Homo sapiens
gtttagtggctcaacatt

SEQ ID NO: 1487863 - DNA, 13 bp, Homo sapiens
gtttataaaatat

SEQ ID NO: 1487864 - DNA, 16 bp, Homo sapiens
gtttatacagtgtaca

SEQ ID NO: 1487865 - DNA, 21 bp, Homo sapiens
gtttatagatcactgcccttt

SEQ ID NO: 1487866 - DNA, 12 bp, Homo sapiens
gtttatatactg

SEQ ID NO: 1487867 - DNA, 15 bp, Homo sapiens
gtttatatctccttt

SEQ ID NO: 1487868 - DNA, 21 bp, Homo sapiens
gtttatatggaagaaagtaag

SEQ ID NO: 1487869 - DNA, 21 bp, Homo sapiens
gtttatattttttcagttgtt

SEQ ID NO: 1487870 - DNA, 16 bp, Homo sapiens
gtttatcccttaagaa

SEQ ID NO: 1487871 - DNA, 22 bp, Homo sapiens
gtttatcccttaagaatgagtt

SEQ ID NO: 1487872 - DNA, 17 bp, Homo sapiens
gtttatgcaaggaagga

SEQ ID NO: 1487873 - DNA, 16 bp, Homo sapiens
gtttatgcatgtatat

SEQ ID NO: 1487874 - DNA, 15 bp, Homo sapiens
gtttatgccaccagg

SEQ ID NO: 1487875 - DNA, 16 bp, Homo sapiens
gtttatggcagaaggg

SEQ ID NO: 1487876 - DNA, 18 bp, Homo sapiens
gtttatggccacatttaa

SEQ ID NO: 1487877 - DNA, 23 bp, Homo sapiens
gtttatggccacatttaatatct

SEQ ID NO: 1487878 - DNA, 20 bp, Homo sapiens
gtttatgtaaacaaatcttt

SEQ ID NO: 1487879 - DNA, 19 bp, Homo sapiens
gtttatgtaatagttctat

SEQ ID NO: 1487880 - DNA, 16 bp, Homo sapiens
gtttatgtgtgtgtgt

SEQ ID NO: 1487881 - DNA, 14 bp, Homo sapiens
gtttattaaatgct

SEQ ID NO: 1487882 - DNA, 13 bp, Homo sapiens
gtttattaacaaa

SEQ ID NO: 1487883 - DNA, 18 bp, Homo sapiens
gtttattaacaaattatg

SEQ ID NO: 1487884 - DNA, 19 bp, Homo sapiens
gtttattacaatgtatctt

SEQ ID NO: 1487885 - DNA, 14 bp, Homo sapiens
gtttattacaattt

SEQ ID NO: 1487886 - DNA, 18 bp, Homo sapiens
gtttattcccaagtatgc

SEQ ID NO: 1487887 - DNA, 20 bp, Homo sapiens
gtttattcccaagtatgcct

SEQ ID NO: 1487888 - DNA, 21 bp, Homo sapiens
gtttattcccaagtatgcctt

SEQ ID NO: 1487889 - DNA, 16 bp, Homo sapiens
gtttattcttccagaa

SEQ ID NO: 1487890 - DNA, 18 bp, Homo sapiens
gtttattcttgatgaaaa

SEQ ID NO: 1487891 - DNA, 14 bp, Homo sapiens
gtttattggaagtg

SEQ ID NO: 1487892 - DNA, 17 bp, Homo sapiens
gtttatttaaggatgga

SEQ ID NO: 1487893 - DNA, 14 bp, Homo sapiens
gtttatttatcagt

SEQ ID NO: 1487894 - DNA, 19 bp, Homo sapiens
gtttatttatttccagtgg

SEQ ID NO: 1487895 - DNA, 19 bp, Homo sapiens
gtttattttcaagaataat

SEQ ID NO: 1487896 - DNA, 23 bp, Homo sapiens
gtttattttgagtcctaggactt

SEQ ID NO: 1487897 - DNA, 20 bp, Homo sapiens
gtttcaaaaccatgcctggt

SEQ ID NO: 1487898 - DNA, 19 bp, Homo sapiens
gtttcaaaagcaaaacatc

SEQ ID NO: 1487899 - DNA, 15 bp, Homo sapiens
gtttcaaactgaatt

SEQ ID NO: 1487900 - DNA, 16 bp, Homo sapiens
gtttcaaactgaattt

SEQ ID NO: 1487901 - DNA, 12 bp, Homo sapiens
gtttcaaacttt

SEQ ID NO: 1487902 - DNA, 17 bp, Homo sapiens
gttttgtcccatttcct

SEQ ID NO: 1487903 - DNA, 21 bp, Homo sapiens
gttttgtcccatttccttgga

SEQ ID NO: 1487904 - DNA, 19 bp, Homo sapiens
gttttgtcttgaaagtggc

SEQ ID NO: 1487905 - DNA, 18 bp, Homo sapiens
gttttgtgtttgttgtag

SEQ ID NO: 1487906 - DNA, 12 bp, Homo sapiens
gttttgttgagc

SEQ ID NO: 1487907 - DNA, 14 bp, Homo sapiens
gtttttaaagcctt

SEQ ID NO: 1487908 - DNA, 16 bp, Homo sapiens
gtttttaaagccttct

SEQ ID NO: 1487909 - DNA, 13 bp, Homo sapiens
gtttttaagctgt

SEQ ID NO: 1487910 - DNA, 16 bp, Homo sapiens
gtttttaatttaaact

SEQ ID NO: 1487911 - DNA, 14 bp, Homo sapiens
gtttttactgctct

SEQ ID NO: 1487912 - DNA, 17 bp, Homo sapiens
gtttttactttctgttg

SEQ ID NO: 1487913 - DNA, 13 bp, Homo sapiens
gtttttagagaat

SEQ ID NO: 1487914 - DNA, 23 bp, Homo sapiens
gtttttagagaatgtgtttcaaa

SEQ ID NO: 1487915 - DNA, 20 bp, Homo sapiens
gtttttagcatgttcctcct

SEQ ID NO: 1487916 - DNA, 17 bp, Homo sapiens
gtttttattaatttata

SEQ ID NO: 1487917 - DNA, 16 bp, Homo sapiens
gtttttattccttgtg

SEQ ID NO: 1487918 - DNA, 12 bp, Homo sapiens
gtttttcacatt

SEQ ID NO: 1487919 - DNA, 14 bp, Homo sapiens
gtttttcacatttt

SEQ ID NO: 1487920 - DNA, 12 bp, Homo sapiens
gtttttcatgtt

SEQ ID NO: 1487921 - DNA, 15 bp, Homo sapiens
gtttttcatgtttta

SEQ ID NO: 1487922 - DNA, 21 bp, Homo sapiens
gtttttcatgttttagcattt

SEQ ID NO: 1487923 - DNA, 18 bp, Homo sapiens
gtttttcattaaataaat

SEQ ID NO: 1487924 - DNA, 21 bp, Homo sapiens
gtttttcatttgttttgcttt

SEQ ID NO: 1487925 - DNA, 18 bp, Homo sapiens
gtttttcctttttttgta

SEQ ID NO: 1487926 - DNA, 15 bp, Homo sapiens
gtttttgcttcaagt

SEQ ID NO: 1487927 - DNA, 20 bp, Homo sapiens
gtttttggtcttttataatt

SEQ ID NO: 1487928 - DNA, 11 bp, Homo sapiens
gtttttgtaac

SEQ ID NO: 1487929 - DNA, 19 bp, Homo sapiens
gtttttgtatctttatgct

SEQ ID NO: 1487930 - DNA, 14 bp, Homo sapiens
gtttttgtttactg

SEQ ID NO: 1487931 - DNA, 21 bp, Homo sapiens
gttttttaaaatatttatctg

SEQ ID NO: 1487932 - DNA, 13 bp, Homo sapiens
gttttttaaagca

SEQ ID NO: 1487933 - DNA, 15 bp, Homo sapiens
gttttttaaagcaag

SEQ ID NO: 1487934 - DNA, 16 bp, Homo sapiens
gttttttaaagcaagt

SEQ ID NO: 1487935 - DNA, 22 bp, Homo sapiens
gttttttaagtaagacttttat

SEQ ID NO: 1487936 - DNA, 12 bp, Homo sapiens
gttttttaagtc

SEQ ID NO: 1487937 - DNA, 15 bp, Homo sapiens
gttttttatgctaat

SEQ ID NO: 1487938 - DNA, 15 bp, Homo sapiens
gttttttcctttata

SEQ ID NO: 1487939 - DNA, 16 bp, Homo sapiens
gttttttcctttataa

SEQ ID NO: 1487940 - DNA, 23 bp, Homo sapiens
gttttttgccacagcttttgcaa

SEQ ID NO: 1487941 - DNA, 22 bp, Homo sapiens
gttttttgcctaaatccaaaga

SEQ ID NO: 1487942 - DNA, 22 bp, Homo sapiens
gttttttggagggtgaaagaag

SEQ ID NO: 1487943 - DNA, 13 bp, Homo sapiens
gttttttgtagaa

SEQ ID NO: 1487944 - DNA, 21 bp, Homo sapiens
gttttttgttcaatgttccat

SEQ ID NO: 1487945 - DNA, 18 bp, Homo sapiens
gttttttttaaataaaag

SEQ ID NO: 1487946 - DNA, 14 bp, Homo sapiens
gttttttttgtttg

SEQ ID NO: 1487947 - DNA, 14 bp, Homo sapiens
gtttttttttcatt

SEQ ID NO: 1487948 - DNA, 23 bp, Homo sapiens
gttttttttttttttatgtgatc

SEQ ID NO: 1487949 - DNA, 18 bp, Homo sapiens
taaaaaaaaaaggatgaa

SEQ ID NO: 1487950 - DNA, 12 bp, Homo sapiens
taaaaaaactgg

SEQ ID NO: 1487951 - DNA, 18 bp, Homo sapiens
taaaaaaaggcattgttt

SEQ ID NO: 1487952 - DNA, 14 bp, Homo sapiens
taaaaaaataacat

SEQ ID NO: 1487953 - DNA, 12 bp, Homo sapiens
taaaaaaatttt

SEQ ID NO: 1487954 - DNA, 22 bp, Homo sapiens
taaaaaaatttttataaattac

SEQ ID NO: 1487955 - DNA, 19 bp, Homo sapiens
taaaaaaatttttgcaaat

SEQ ID NO: 1487956 - DNA, 18 bp, Homo sapiens
taaaaaacactaaacatt

SEQ ID NO: 1487957 - DNA, 20 bp, Homo sapiens
taaaaaagactgaacatgtt

SEQ ID NO: 1487958 - DNA, 15 bp, Homo sapiens
taaaaaagccttcct

SEQ ID NO: 1487959 - DNA, 18 bp, Homo sapiens
taaaaaatattttctctg

SEQ ID NO: 1487960 - DNA, 11 bp, Homo sapiens
taaaaaatgga

SEQ ID NO: 1487961 - DNA, 16 bp, Homo sapiens
taaaaaatggaaaaaa

SEQ ID NO: 1487962 - DNA, 12 bp, Homo sapiens
taaaaaatgtct

SEQ ID NO: 1487963 - DNA, 21 bp, Homo sapiens
taaaaaatgttttctggggaa

SEQ ID NO: 1487964 - DNA, 18 bp, Homo sapiens
taaaaaattaaagcccat

SEQ ID NO: 1487965 - DNA, 19 bp, Homo sapiens
taaaaaattttaaaaatct

SEQ ID NO: 1487966 - DNA, 21 bp, Homo sapiens
taaaaacaaaaacaaaaccag

SEQ ID NO: 1487967 - DNA, 17 bp, Homo sapiens
taaaaacaaatgagttt

SEQ ID NO: 1487968 - DNA, 18 bp, Homo sapiens
taaaaacaactttatacc

SEQ ID NO: 1487969 - DNA, 15 bp, Homo sapiens
taaaaacaactttca

SEQ ID NO: 1487970 - DNA, 18 bp, Homo sapiens
taaaaacaactttcactt

SEQ ID NO: 1487971 - DNA, 20 bp, Homo sapiens
taaaaacaatccttttgata

SEQ ID NO: 1487972 - DNA, 18 bp, Homo sapiens
taaaaacagcattgcttt

SEQ ID NO: 1487973 - DNA, 15 bp, Homo sapiens
taaaaacatgaccac

SEQ ID NO: 1487974 - DNA, 16 bp, Homo sapiens
taaaaactgactcctt

SEQ ID NO: 1487975 - DNA, 17 bp, Homo sapiens
taaaaactgacttaatg

SEQ ID NO: 1487976 - DNA, 21 bp, Homo sapiens
taaaaacttctttttaatctt

SEQ ID NO: 1487977 - DNA, 15 bp, Homo sapiens
taaaaagaaatccag

SEQ ID NO: 1487978 - DNA, 18 bp, Homo sapiens
taaaaagagtaatttcat

SEQ ID NO: 1487979 - DNA, 16 bp, Homo sapiens
taaaaagcctctttct

SEQ ID NO: 1487980 - DNA, 19 bp, Homo sapiens
taaaaagcctgcaatttca

SEQ ID NO: 1487981 - DNA, 10 bp, Homo sapiens
taaaaaggaa

SEQ ID NO: 1487982 - DNA, 13 bp, Homo sapiens
taaaaaggaacaa

SEQ ID NO: 1487983 - DNA, 18 bp, Homo sapiens
taaaaaggccaaagataa

SEQ ID NO: 1487984 - DNA, 20 bp, Homo sapiens
taaaaaggccaaagataaaa

SEQ ID NO: 1487985 - DNA, 17 bp, Homo sapiens
taaaaaggctaaatgga

SEQ ID NO: 1487986 - DNA, 23 bp, Homo sapiens
taaaaaggtcctcacaggtgtct

SEQ ID NO: 1487987 - DNA, 18 bp, Homo sapiens
taaaaagtattttttcaa

SEQ ID NO: 1487988 - DNA, 21 bp, Homo sapiens
taaaaataaaaaagatcccaa

SEQ ID NO: 1487989 - DNA, 16 bp, Homo sapiens
taaaaataaacatgtt

SEQ ID NO: 1487990 - DNA, 14 bp, Homo sapiens
taaaaataaatccc

SEQ ID NO: 1487991 - DNA, 17 bp, Homo sapiens
taaaaataaatttggtt

SEQ ID NO: 1487992 - DNA, 13 bp, Homo sapiens
taaaaataactgt

SEQ ID NO: 1487993 - DNA, 16 bp, Homo sapiens
taaaaataactgtaat

SEQ ID NO: 1487994 - DNA, 17 bp, Homo sapiens
taaaaataactgtaatt

SEQ ID NO: 1487995 - DNA, 16 bp, Homo sapiens
taaaaataagtcaaca

SEQ ID NO: 1487996 - DNA, 17 bp, Homo sapiens
taaaaatacacatgaaa

SEQ ID NO: 1487997 - DNA, 18 bp, Homo sapiens
taaaaatacacatgaaaa

SEQ ID NO: 1487998 - DNA, 12 bp, Homo sapiens
taaaaatacacc

SEQ ID NO: 1487999 - DNA, 13 bp, Homo sapiens
taaaaatatacat

SEQ ID NO: 1488000 - DNA, 15 bp, Homo sapiens
taaaaatatttcaga

SEQ ID NO: 1488001 - DNA, 15 bp, Homo sapiens
taaaaatcatagtac

SEQ ID NO: 1488002 - DNA, 18 bp, Homo sapiens
taaaaatcctaaaatatg

SEQ ID NO: 1488003 - DNA, 15 bp, Homo sapiens
taaaaatctccatta

SEQ ID NO: 1488004 - DNA, 18 bp, Homo sapiens
taaaaatcttttgaagca

SEQ ID NO: 1488005 - DNA, 12 bp, Homo sapiens
taaaaatgaaaa

SEQ ID NO: 1488006 - DNA, 22 bp, Homo sapiens
taaaaatggaaactatattgac

SEQ ID NO: 1488007 - DNA, 15 bp, Homo sapiens
taaaaatggacaaaa

SEQ ID NO: 1488008 - DNA, 21 bp, Homo sapiens
taaaaatggctcaagtagaaa

SEQ ID NO: 1488009 - DNA, 22 bp, Homo sapiens
taaaaatggctcaagtagaaaa

SEQ ID NO: 1488010 - DNA, 13 bp, Homo sapiens
taaaaatgtaaat

SEQ ID NO: 1488011 - DNA, 18 bp, Homo sapiens
taaaaatgtaaatattct

SEQ ID NO: 1488012 - DNA, 19 bp, Homo sapiens
taaaaatgtaaatattcta

SEQ ID NO: 1488013 - DNA, 21 bp, Homo sapiens
taaaaatgtaaatattctata

SEQ ID NO: 1488014 - DNA, 17 bp, Homo sapiens
taaaaattaaaaaatga

SEQ ID NO: 1488015 - DNA, 13 bp, Homo sapiens
taaaaattagcat

SEQ ID NO: 1488016 - DNA, 14 bp, Homo sapiens
taaaaattagcatg

SEQ ID NO: 1488017 - DNA, 20 bp, Homo sapiens
taaaaattagcatgctgctt

SEQ ID NO: 1488018 - DNA, 13 bp, Homo sapiens
taaaaattgtttc

SEQ ID NO: 1488019 - DNA, 14 bp, Homo sapiens
taaaaattgtttct

SEQ ID NO: 1488020 - DNA, 15 bp, Homo sapiens
taaaaattgtttctt

SEQ ID NO: 1488021 - DNA, 22 bp, Homo sapiens
taaaaattgtttcttgacaagc

SEQ ID NO: 1488022 - DNA, 20 bp, Homo sapiens
taaaacaaaaccaagccttg

SEQ ID NO: 1488023 - DNA, 21 bp, Homo sapiens
taaaacaaaaccaagccttgg

SEQ ID NO: 1488024 - DNA, 14 bp, Homo sapiens
taaaacaaaatgtt

SEQ ID NO: 1488025 - DNA, 15 bp, Homo sapiens
taaaacaaaatttga

SEQ ID NO: 1488026 - DNA, 17 bp, Homo sapiens
taaaacaaaatttgact

SEQ ID NO: 1488027 - DNA, 11 bp, Homo sapiens
taaaacaaata

SEQ ID NO: 1488028 - DNA, 22 bp, Homo sapiens
taaaacaaatatacattttcta

SEQ ID NO: 1488029 - DNA, 13 bp, Homo sapiens
taaaacaaccagt

SEQ ID NO: 1488030 - DNA, 13 bp, Homo sapiens
taaaacacaaagt

SEQ ID NO: 1488031 - DNA, 15 bp, Homo sapiens
taaaacagacactgg

SEQ ID NO: 1488032 - DNA, 21 bp, Homo sapiens
taaaacaggtagaattatcta

SEQ ID NO: 1488033 - DNA, 21 bp, Homo sapiens
taaaacatcacctatttaatg

SEQ ID NO: 1488034 - DNA, 17 bp, Homo sapiens
taaaacatggtgcctat

SEQ ID NO: 1488035 - DNA, 23 bp, Homo sapiens
taaaacatggtgcctatatctga

SEQ ID NO: 1488036 - DNA, 12 bp, Homo sapiens
taaaacatgtaa

SEQ ID NO: 1488037 - DNA, 18 bp, Homo sapiens
taaaacatttgtttcccc

SEQ ID NO: 1488038 - DNA, 19 bp, Homo sapiens
taaaacatttgtttccccc

SEQ ID NO: 1488039 - DNA, 13 bp, Homo sapiens
taaaaccaaagag

SEQ ID NO: 1488040 - DNA, 13 bp, Homo sapiens
taaaaccacagct

SEQ ID NO: 1488041 - DNA, 21 bp, Homo sapiens
taaaaccacagctgggcaggg

SEQ ID NO: 1488042 - DNA, 23 bp, Homo sapiens
taaaaccatcagatatttcttat

SEQ ID NO: 1488043 - DNA, 19 bp, Homo sapiens
taaaaccctttaaatgtaa

SEQ ID NO: 1488044 - DNA, 20 bp, Homo sapiens
taaaaccctttaaatgtaaa

SEQ ID NO: 1488045 - DNA, 16 bp, Homo sapiens
taaaacgatctaaagg

SEQ ID NO: 1488046 - DNA, 20 bp, Homo sapiens
taaaactaagctctttgaga

SEQ ID NO: 1488047 - DNA, 12 bp, Homo sapiens
taaaactgcttt

SEQ ID NO: 1488048 - DNA, 18 bp, Homo sapiens
taaaactggacctgtata

SEQ ID NO: 1488049 - DNA, 19 bp, Homo sapiens
taaaactgggtcatcattt

SEQ ID NO: 1488050 - DNA, 17 bp, Homo sapiens
taaaactgttatttttt

SEQ ID NO: 1488051 - DNA, 17 bp, Homo sapiens
taaaactttcctcgcct

SEQ ID NO: 1488052 - DNA, 14 bp, Homo sapiens
taaaactttgctgc

SEQ ID NO: 1488053 - DNA, 16 bp, Homo sapiens
taaaacttttctgctg

SEQ ID NO: 1488054 - DNA, 16 bp, Homo sapiens
taaaagaaaccctgca

SEQ ID NO: 1488055 - DNA, 17 bp, Homo sapiens
taaaagaacagtaaaca

SEQ ID NO: 1488056 - DNA, 18 bp, Homo sapiens
taaaagaacttactgatt

SEQ ID NO: 1488057 - DNA, 19 bp, Homo sapiens
taaaagaacttactgatta

SEQ ID NO: 1488058 - DNA, 22 bp, Homo sapiens
taaaagaagaaatagttctgtg

SEQ ID NO: 1488059 - DNA, 13 bp, Homo sapiens
taaaagaagcttt

SEQ ID NO: 1488060 - DNA, 17 bp, Homo sapiens
taaaagagatttcaaga

SEQ ID NO: 1488061 - DNA, 14 bp, Homo sapiens
taaaagataaatta

SEQ ID NO: 1488062 - DNA, 17 bp, Homo sapiens
taaaagatcaccttgta

SEQ ID NO: 1488063 - DNA, 21 bp, Homo sapiens
taaaagatcaggttatacttt

SEQ ID NO: 1488064 - DNA, 23 bp, Homo sapiens
taaaagatgcagagtaagtatta

SEQ ID NO: 1488065 - DNA, 21 bp, Homo sapiens
taaaagatggttgtagcattt

SEQ ID NO: 1488066 - DNA, 22 bp, Homo sapiens
taaaagatggttgtagcattta

SEQ ID NO: 1488067 - DNA, 14 bp, Homo sapiens
taaaagattcattt

SEQ ID NO: 1488068 - DNA, 14 bp, Homo sapiens
taaaagcaaaagag

SEQ ID NO: 1488069 - DNA, 13 bp, Homo sapiens
taaaagcaaatca

SEQ ID NO: 1488070 - DNA, 20 bp, Homo sapiens
taaaagcacaagtacttttg

SEQ ID NO: 1488071 - DNA, 20 bp, Homo sapiens
taaaagcagcatctgctaat

SEQ ID NO: 1488072 - DNA, 21 bp, Homo sapiens
taaaagcagcatctgctaata

SEQ ID NO: 1488073 - DNA, 12 bp, Homo sapiens
taaaagcctgct

SEQ ID NO: 1488074 - DNA, 16 bp, Homo sapiens
taaaagctataaagta

SEQ ID NO: 1488075 - DNA, 19 bp, Homo sapiens
taaaaggagagaagaaagt

SEQ ID NO: 1488076 - DNA, 18 bp, Homo sapiens
taaaaggcaaatgtgtac

SEQ ID NO: 1488077 - DNA, 19 bp, Homo sapiens
taaaaggcaaatgtgtaca

SEQ ID NO: 1488078 - DNA, 22 bp, Homo sapiens
taaaaggcccatagcagccagt

SEQ ID NO: 1488079 - DNA, 19 bp, Homo sapiens
taaaaggctaagaatagtg

SEQ ID NO: 1488080 - DNA, 13 bp, Homo sapiens
taaaaggggccca

SEQ ID NO: 1488081 - DNA, 22 bp, Homo sapiens
taaaaggtattaaattgatgtt

SEQ ID NO: 1488082 - DNA, 21 bp, Homo sapiens
taaaagtactttaaaaaggaa

SEQ ID NO: 1488083 - DNA, 21 bp, Homo sapiens
taaaagtgaagtgaatctgat

SEQ ID NO: 1488084 - DNA, 12 bp, Homo sapiens
taaaagttcttt

SEQ ID NO: 1488085 - DNA, 14 bp, Homo sapiens
taaaataaactaga

SEQ ID NO: 1488086 - DNA, 22 bp, Homo sapiens
taaaataaagcctatttttcaa

SEQ ID NO: 1488087 - DNA, 23 bp, Homo sapiens
taaaataaagcctatttttcaaa

SEQ ID NO: 1488088 - DNA, 13 bp, Homo sapiens
taaaataaagtat

SEQ ID NO: 1488089 - DNA, 17 bp, Homo sapiens
taaaataaatgaagtga

SEQ ID NO: 1488090 - DNA, 14 bp, Homo sapiens
taaaataaattagt

SEQ ID NO: 1488091 - DNA, 21 bp, Homo sapiens
taaaataactagtgttgcttg

SEQ ID NO: 1488092 - DNA, 23 bp, Homo sapiens
taaaataagtggattttgtattt

SEQ ID NO: 1488093 - DNA, 19 bp, Homo sapiens
taaaataattatataactg

SEQ ID NO: 1488094 - DNA, 16 bp, Homo sapiens
taaaatacagaataca

SEQ ID NO: 1488095 - DNA, 19 bp, Homo sapiens
taaaatacatagtgaaaat

SEQ ID NO: 1488096 - DNA, 17 bp, Homo sapiens
taaaataccactgtaat

SEQ ID NO: 1488097 - DNA, 22 bp, Homo sapiens
taaaatacctctaataaacact

SEQ ID NO: 1488098 - DNA, 22 bp, Homo sapiens
taaaatacgatcggtttcatat

SEQ ID NO: 1488099 - DNA, 18 bp, Homo sapiens
taaaatacggtacctggc

SEQ ID NO: 1488100 - DNA, 19 bp, Homo sapiens
taaaatacttttactctgc

SEQ ID NO: 1488101 - DNA, 16 bp, Homo sapiens
taaaatagaataattc

SEQ ID NO: 1488102 - DNA, 17 bp, Homo sapiens
taaaatagagtgtagtt

SEQ ID NO: 1488103 - DNA, 16 bp, Homo sapiens
taaaatagatataaat

SEQ ID NO: 1488104 - DNA, 20 bp, Homo sapiens
taaaatatagagacaggaca

SEQ ID NO: 1488105 - DNA, 23 bp, Homo sapiens
taaaatatagagacaggacagaa

SEQ ID NO: 1488106 - DNA, 16 bp, Homo sapiens
taaaatatatctggaa

SEQ ID NO: 1488107 - DNA, 15 bp, Homo sapiens
taaaatatcctcagg

SEQ ID NO: 1488108 - DNA, 18 bp, Homo sapiens
taaaatatggctataaat

SEQ ID NO: 1488109 - DNA, 16 bp, Homo sapiens
taaaatatgttcttta

SEQ ID NO: 1488110 - DNA, 11 bp, Homo sapiens
taaaatattta

SEQ ID NO: 1488111 - DNA, 12 bp, Homo sapiens
taaaatatttaa

SEQ ID NO: 1488112 - DNA, 15 bp, Homo sapiens
taaaatatttatctg

SEQ ID NO: 1488113 - DNA, 17 bp, Homo sapiens
taaaatatttatgaaga

SEQ ID NO: 1488114 - DNA, 16 bp, Homo sapiens
taaaatatttgagaat

SEQ ID NO: 1488115 - DNA, 15 bp, Homo sapiens
taaaatcaaatgtaa

SEQ ID NO: 1488116 - DNA, 18 bp, Homo sapiens
taaaatcactctcagtgc

SEQ ID NO: 1488117 - DNA, 16 bp, Homo sapiens
taaaatcataagtatt

SEQ ID NO: 1488118 - DNA, 18 bp, Homo sapiens
taaaatccaatattgtaa

SEQ ID NO: 1488119 - DNA, 19 bp, Homo sapiens
taaaatccaatattgtaat

SEQ ID NO: 1488120 - DNA, 22 bp, Homo sapiens
taaaatccccttcgctgaaatt

SEQ ID NO: 1488121 - DNA, 13 bp, Homo sapiens
taaaatcttatag

SEQ ID NO: 1488122 - DNA, 18 bp, Homo sapiens
taaaatcttatagttcta

SEQ ID NO: 1488123 - DNA, 14 bp, Homo sapiens
taaaatcttgtcat

SEQ ID NO: 1488124 - DNA, 22 bp, Homo sapiens
taaaatcttgtcatgtgtataa

SEQ ID NO: 1488125 - DNA, 23 bp, Homo sapiens
taaaatcttgtcatgtgtataaa

SEQ ID NO: 1488126 - DNA, 12 bp, Homo sapiens
taaaatgaaaga

SEQ ID NO: 1488127 - DNA, 13 bp, Homo sapiens
taaaatgaacatc

SEQ ID NO: 1488128 - DNA, 16 bp, Homo sapiens
taaaatgaacatctct

SEQ ID NO: 1488129 - DNA, 15 bp, Homo sapiens
taaaatgcaaaaaat

SEQ ID NO: 1488130 - DNA, 15 bp, Homo sapiens
taaaatgcaatgtaa

SEQ ID NO: 1488131 - DNA, 13 bp, Homo sapiens
taaaatgcattta

SEQ ID NO: 1488132 - DNA, 13 bp, Homo sapiens
taaaatggaaaat

SEQ ID NO: 1488133 - DNA, 15 bp, Homo sapiens
taaagtatgaatcta

SEQ ID NO: 1488134 - DNA, 16 bp, Homo sapiens
taaagtatgaatctat

SEQ ID NO: 1488135 - DNA, 13 bp, Homo sapiens
taaagtatgtgaa

SEQ ID NO: 1488136 - DNA, 17 bp, Homo sapiens
taaagtcacatccctgt

SEQ ID NO: 1488137 - DNA, 16 bp, Homo sapiens
taaagtcacttccagt

SEQ ID NO: 1488138 - DNA, 21 bp, Homo sapiens
taaagtcagttgctcaaaaag

SEQ ID NO: 1488139 - DNA, 15 bp, Homo sapiens
taaagtccaaagtca

SEQ ID NO: 1488140 - DNA, 14 bp, Homo sapiens
taaagtgatgtttg

SEQ ID NO: 1488141 - DNA, 16 bp, Homo sapiens
taaagtgctaaggttc

SEQ ID NO: 1488142 - DNA, 17 bp, Homo sapiens
taaagtgctaaggttct

SEQ ID NO: 1488143 - DNA, 18 bp, Homo sapiens
taaagtgctaaggttcta

SEQ ID NO: 1488144 - DNA, 16 bp, Homo sapiens
taaagtgtaaatcctt

SEQ ID NO: 1488145 - DNA, 18 bp, Homo sapiens
taaagtgtaagttcacaa

SEQ ID NO: 1488146 - DNA, 17 bp, Homo sapiens
taaagtgttactttttg

SEQ ID NO: 1488147 - DNA, 13 bp, Homo sapiens
taaagttctaaga

SEQ ID NO: 1488148 - DNA, 16 bp, Homo sapiens
taaagttctaagattc

SEQ ID NO: 1488149 - DNA, 20 bp, Homo sapiens
taaagttcttattttagtat

SEQ ID NO: 1488150 - DNA, 20 bp, Homo sapiens
taaagttgaagctaagattt

SEQ ID NO: 1488151 - DNA, 12 bp, Homo sapiens
taaagttgcttt

SEQ ID NO: 1488152 - DNA, 15 bp, Homo sapiens
taaagttgtattgca

SEQ ID NO: 1488153 - DNA, 14 bp, Homo sapiens
taaagttttgtcag

SEQ ID NO: 1488154 - DNA, 20 bp, Homo sapiens
taaagttttgtcagaaaaga

SEQ ID NO: 1488155 - DNA, 19 bp, Homo sapiens
taaataaaaactaattaag

SEQ ID NO: 1488156 - DNA, 16 bp, Homo sapiens
taaataaaaagaaagg

SEQ ID NO: 1488157 - DNA, 15 bp, Homo sapiens
taaataaaaatatgt

SEQ ID NO: 1488158 - DNA, 21 bp, Homo sapiens
taaataaaaatatgtaatttc

SEQ ID NO: 1488159 - DNA, 21 bp, Homo sapiens
taaataaaaatgcattgaaca

SEQ ID NO: 1488160 - DNA, 14 bp, Homo sapiens
taaataaaaatgga

SEQ ID NO: 1488161 - DNA, 22 bp, Homo sapiens
taaataaaatgtgtacagtgaa

SEQ ID NO: 1488162 - DNA, 20 bp, Homo sapiens
taaataaactgttgctcgtt

SEQ ID NO: 1488163 - DNA, 21 bp, Homo sapiens
taaataaagaagaaaataacc

SEQ ID NO: 1488164 - DNA, 14 bp, Homo sapiens
taaataaatatttt

SEQ ID NO: 1488165 - DNA, 21 bp, Homo sapiens
taaataaatgagctgttggaa

SEQ ID NO: 1488166 - DNA, 16 bp, Homo sapiens
taaataaatttgactt

SEQ ID NO: 1488167 - DNA, 22 bp, Homo sapiens
taaataacaggcatttgttcac

SEQ ID NO: 1488168 - DNA, 23 bp, Homo sapiens
taaataacctatttttttctcta

SEQ ID NO: 1488169 - DNA, 13 bp, Homo sapiens
taaataactgtgt

SEQ ID NO: 1488170 - DNA, 14 bp, Homo sapiens
taaataagattcta

SEQ ID NO: 1488171 - DNA, 13 bp, Homo sapiens
taaataatgaaaa

SEQ ID NO: 1488172 - DNA, 18 bp, Homo sapiens
taaataatgcttcagata

SEQ ID NO: 1488173 - DNA, 20 bp, Homo sapiens
taaataattgcatcagttca

SEQ ID NO: 1488174 - DNA, 14 bp, Homo sapiens
taaataatttattt

SEQ ID NO: 1488175 - DNA, 14 bp, Homo sapiens
taaatacaacacat

SEQ ID NO: 1488176 - DNA, 22 bp, Homo sapiens
taaatacaatttgtactttttt

SEQ ID NO: 1488177 - DNA, 18 bp, Homo sapiens
taaatacacaacacacac

SEQ ID NO: 1488178 - DNA, 17 bp, Homo sapiens
taaatacagacactaag

SEQ ID NO: 1488179 - DNA, 17 bp, Homo sapiens
taaatacagataattca

SEQ ID NO: 1488180 - DNA, 23 bp, Homo sapiens
taaatacagataattcatttgta

SEQ ID NO: 1488181 - DNA, 17 bp, Homo sapiens
taaatacagcatacttc

SEQ ID NO: 1488182 - DNA, 13 bp, Homo sapiens
taaatacaggaaa

SEQ ID NO: 1488183 - DNA, 14 bp, Homo sapiens
taaatacaggaaac

SEQ ID NO: 1488184 - DNA, 15 bp, Homo sapiens
taaatacaggaaaca

SEQ ID NO: 1488185 - DNA, 16 bp, Homo sapiens
taaatacaggaaacag

SEQ ID NO: 1488186 - DNA, 20 bp, Homo sapiens
taaatacatgcacacacttg

SEQ ID NO: 1488187 - DNA, 20 bp, Homo sapiens
taaatacatgccacatcaaa

SEQ ID NO: 1488188 - DNA, 20 bp, Homo sapiens
taaatacccattgaactctg

SEQ ID NO: 1488189 - DNA, 22 bp, Homo sapiens
taaatacctcaacctatggtat

SEQ ID NO: 1488190 - DNA, 13 bp, Homo sapiens
taaatactgcaaa

SEQ ID NO: 1488191 - DNA, 23 bp, Homo sapiens
taaatactggactcaggaacttt

SEQ ID NO: 1488192 - DNA, 15 bp, Homo sapiens
taaatagatgatttc

SEQ ID NO: 1488193 - DNA, 14 bp, Homo sapiens
taaatagcctaaat

SEQ ID NO: 1488194 - DNA, 16 bp, Homo sapiens
taaatagcctaaatga

SEQ ID NO: 1488195 - DNA, 17 bp, Homo sapiens
taaatagcctaaatgat

SEQ ID NO: 1488196 - DNA, 18 bp, Homo sapiens
taaatagtatttgagagt

SEQ ID NO: 1488197 - DNA, 21 bp, Homo sapiens
taaatagtgtcatataaactc

SEQ ID NO: 1488198 - DNA, 15 bp, Homo sapiens
taaatataaaaatgg

SEQ ID NO: 1488199 - DNA, 16 bp, Homo sapiens
taaatataattctgta

SEQ ID NO: 1488200 - DNA, 21 bp, Homo sapiens
taaatatatattttgtacttt

SEQ ID NO: 1488201 - DNA, 13 bp, Homo sapiens
taaatatcaccta

SEQ ID NO: 1488202 - DNA, 18 bp, Homo sapiens
taaatatccacagtactc

SEQ ID NO: 1488203 - DNA, 19 bp, Homo sapiens
taaatatccacagtactca

SEQ ID NO: 1488204 - DNA, 22 bp, Homo sapiens
taaatatgaatctgctcacttt

SEQ ID NO: 1488205 - DNA, 15 bp, Homo sapiens
taaatatgaatgaac

SEQ ID NO: 1488206 - DNA, 17 bp, Homo sapiens
taaatatgtaatataaa

SEQ ID NO: 1488207 - DNA, 12 bp, Homo sapiens
taaatatgtaga

SEQ ID NO: 1488208 - DNA, 21 bp, Homo sapiens
taaatatgttagcaaagagtt

SEQ ID NO: 1488209 - DNA, 14 bp, Homo sapiens
taaatattcacact

SEQ ID NO: 1488210 - DNA, 18 bp, Homo sapiens
taaatattcacacttgaa

SEQ ID NO: 1488211 - DNA, 17 bp, Homo sapiens
taaatatttatgtagat

SEQ ID NO: 1488212 - DNA, 20 bp, Homo sapiens
taaatatttgttacttttag

SEQ ID NO: 1488213 - DNA, 16 bp, Homo sapiens
taaatattttctattt

SEQ ID NO: 1488214 - DNA, 17 bp, Homo sapiens
taaatattttctatttt

SEQ ID NO: 1488215 - DNA, 17 bp, Homo sapiens
taaatatttttttaacc

SEQ ID NO: 1488216 - DNA, 21 bp, Homo sapiens
taaatcagaaagtaacaatct

SEQ ID NO: 1488217 - DNA, 12 bp, Homo sapiens
taaatcagacca

SEQ ID NO: 1488218 - DNA, 23 bp, Homo sapiens
taaatcagctgcaatccatttat

SEQ ID NO: 1488219 - DNA, 18 bp, Homo sapiens
taaatcagtaagaggtgt

SEQ ID NO: 1488220 - DNA, 11 bp, Homo sapiens
taaatcagtgg

SEQ ID NO: 1488221 - DNA, 14 bp, Homo sapiens
taaatcatcctcat

SEQ ID NO: 1488222 - DNA, 16 bp, Homo sapiens
taaatcatcctcatgt

SEQ ID NO: 1488223 - DNA, 16 bp, Homo sapiens
taaatcatgatgctag

SEQ ID NO: 1488224 - DNA, 22 bp, Homo sapiens
taaatcatgatgctagccagca

SEQ ID NO: 1488225 - DNA, 18 bp, Homo sapiens
taaatccattttctaaac

SEQ ID NO: 1488226 - DNA, 15 bp, Homo sapiens
taaatcctctattga

SEQ ID NO: 1488227 - DNA, 18 bp, Homo sapiens
taaatcctgccatttaaa

SEQ ID NO: 1488228 - DNA, 17 bp, Homo sapiens
taaatcctttttcttta

SEQ ID NO: 1488229 - DNA, 16 bp, Homo sapiens
taaatctaaacaaaaa

SEQ ID NO: 1488230 - DNA, 18 bp, Homo sapiens
taaatctaaacaaaaaat

SEQ ID NO: 1488231 - DNA, 14 bp, Homo sapiens
taaatctaaatcta

SEQ ID NO: 1488232 - DNA, 17 bp, Homo sapiens
taaatctagagtttata

SEQ ID NO: 1488233 - DNA, 19 bp, Homo sapiens
taaatctatgaagtatata

SEQ ID NO: 1488234 - DNA, 16 bp, Homo sapiens
taaatctatttattaa

SEQ ID NO: 1488235 - DNA, 19 bp, Homo sapiens
taaatctatttattaatat

SEQ ID NO: 1488236 - DNA, 20 bp, Homo sapiens
taaatctatttattaatatt

SEQ ID NO: 1488237 - DNA, 14 bp, Homo sapiens
taaatctgacccag

SEQ ID NO: 1488238 - DNA, 17 bp, Homo sapiens
taaatctgacccagtgc

SEQ ID NO: 1488239 - DNA, 16 bp, Homo sapiens
taaatctgtctgattc

SEQ ID NO: 1488240 - DNA, 12 bp, Homo sapiens
taaatctgtgat

SEQ ID NO: 1488241 - DNA, 14 bp, Homo sapiens
taaatctgtgatga

SEQ ID NO: 1488242 - DNA, 14 bp, Homo sapiens
taaatcttaaacaa

SEQ ID NO: 1488243 - DNA, 15 bp, Homo sapiens
taaatcttaaacaat

SEQ ID NO: 1488244 - DNA, 19 bp, Homo sapiens
taaatcttaaacaatgtat

SEQ ID NO: 1488245 - DNA, 18 bp, Homo sapiens
taaatcttccttgtgagg

SEQ ID NO: 1488246 - DNA, 19 bp, Homo sapiens
taaatcttccttgtgagga

SEQ ID NO: 1488247 - DNA, 17 bp, Homo sapiens
taaatcttttcttcaac

SEQ ID NO: 1488248 - DNA, 16 bp, Homo sapiens
taacaactatttttgt

SEQ ID NO: 1488249 - DNA, 19 bp, Homo sapiens
taacaactgctcttacttt

SEQ ID NO: 1488250 - DNA, 12 bp, Homo sapiens
taacaagaatgt

SEQ ID NO: 1488251 - DNA, 15 bp, Homo sapiens
taacaagaggggaaa

SEQ ID NO: 1488252 - DNA, 22 bp, Homo sapiens
taacaaggaatgcctgtgccaa

SEQ ID NO: 1488253 - DNA, 16 bp, Homo sapiens
taacaaggagatttct

SEQ ID NO: 1488254 - DNA, 18 bp, Homo sapiens
taacaaggagatttctta

SEQ ID NO: 1488255 - DNA, 12 bp, Homo sapiens
taacaaggtgtc

SEQ ID NO: 1488256 - DNA, 17 bp, Homo sapiens
taacaataatatttcaa

SEQ ID NO: 1488257 - DNA, 24 bp, Homo sapiens
taacaataatatttcaagtgccta

SEQ ID NO: 1488258 - DNA, 14 bp, Homo sapiens
taacaatacaaatg

SEQ ID NO: 1488259 - DNA, 16 bp, Homo sapiens
taacaatacaaatgga

SEQ ID NO: 1488260 - DNA, 20 bp, Homo sapiens
taacaatacaaatggatttt

SEQ ID NO: 1488261 - DNA, 14 bp, Homo sapiens
taacaatagttctt

SEQ ID NO: 1488262 - DNA, 13 bp, Homo sapiens
taacaatcactgg

SEQ ID NO: 1488263 - DNA, 17 bp, Homo sapiens
taacaatgaagataaaa

SEQ ID NO: 1488264 - DNA, 18 bp, Homo sapiens
taacaatgacaagatgtt

SEQ ID NO: 1488265 - DNA, 13 bp, Homo sapiens
taacaatgatata

SEQ ID NO: 1488266 - DNA, 19 bp, Homo sapiens
taacaatgatatatggata

SEQ ID NO: 1488267 - DNA, 23 bp, Homo sapiens
taacaattgtgtagcctttttgt

SEQ ID NO: 1488268 - DNA, 12 bp, Homo sapiens
taacacaaaatc

SEQ ID NO: 1488269 - DNA, 16 bp, Homo sapiens
taacacagagagacag

SEQ ID NO: 1488270 - DNA, 21 bp, Homo sapiens
taacacatttcatagcctaca

SEQ ID NO: 1488271 - DNA, 16 bp, Homo sapiens
taacaccttggactgt

SEQ ID NO: 1488272 - DNA, 16 bp, Homo sapiens
taacacgctgcctggt

SEQ ID NO: 1488273 - DNA, 13 bp, Homo sapiens
taacactaatata

SEQ ID NO: 1488274 - DNA, 14 bp, Homo sapiens
taacactactcaaa

SEQ ID NO: 1488275 - DNA, 19 bp, Homo sapiens
taacactatgtttatttac

SEQ ID NO: 1488276 - DNA, 15 bp, Homo sapiens
taacactgcaagaag

SEQ ID NO: 1488277 - DNA, 15 bp, Homo sapiens
taacactgttaagag

SEQ ID NO: 1488278 - DNA, 13 bp, Homo sapiens
taacactttgctt

SEQ ID NO: 1488279 - DNA, 17 bp, Homo sapiens
taacagaaattgtatat

SEQ ID NO: 1488280 - DNA, 22 bp, Homo sapiens
taacagaaattgtatattgtaa

SEQ ID NO: 1488281 - DNA, 22 bp, Homo sapiens
taacagattttggggttgtgtt

SEQ ID NO: 1488282 - DNA, 19 bp, Homo sapiens
taacagccaggagtgttaa

SEQ ID NO: 1488283 - DNA, 15 bp, Homo sapiens
taacagggagaagta

SEQ ID NO: 1488284 - DNA, 18 bp, Homo sapiens
taacagggattgatttta

SEQ ID NO: 1488285 - DNA, 13 bp, Homo sapiens
taacaggtctcct

SEQ ID NO: 1488286 - DNA, 14 bp, Homo sapiens
taacaggtctcctc

SEQ ID NO: 1488287 - DNA, 24 bp, Homo sapiens
taacaggtgtggggacacagcagt

SEQ ID NO: 1488288 - DNA, 15 bp, Homo sapiens
taacagtaatacatt

SEQ ID NO: 1488289 - DNA, 21 bp, Homo sapiens
taacagtatgtgggatattga

SEQ ID NO: 1488290 - DNA, 15 bp, Homo sapiens
taacagtcttactgc

SEQ ID NO: 1488291 - DNA, 16 bp, Homo sapiens
taacagttatattttt

SEQ ID NO: 1488292 - DNA, 20 bp, Homo sapiens
taacataaaatctgtgaatt

SEQ ID NO: 1488293 - DNA, 12 bp, Homo sapiens
taacataaattt

SEQ ID NO: 1488294 - DNA, 22 bp, Homo sapiens
taacataactgcttcttggagc

SEQ ID NO: 1488295 - DNA, 16 bp, Homo sapiens
taacataatttgtaca

SEQ ID NO: 1488296 - DNA, 23 bp, Homo sapiens
taacatacaagaaaatgtatcca

SEQ ID NO: 1488297 - DNA, 18 bp, Homo sapiens
taacatatctaaagtcat

SEQ ID NO: 1488298 - DNA, 23 bp, Homo sapiens
taacatattcttgctttcacaaa

SEQ ID NO: 1488299 - DNA, 14 bp, Homo sapiens
taacatcataatta

SEQ ID NO: 1488300 - DNA, 14 bp, Homo sapiens
taacatccaagcca

SEQ ID NO: 1488301 - DNA, 13 bp, Homo sapiens
taacatctgaaaa

SEQ ID NO: 1488302 - DNA, 17 bp, Homo sapiens
taacatctgaaaagaaa

SEQ ID NO: 1488303 - DNA, 20 bp, Homo sapiens
taacatctttattgaaattc

SEQ ID NO: 1488304 - DNA, 22 bp, Homo sapiens
taacatgctggtgaatattttc

SEQ ID NO: 1488305 - DNA, 13 bp, Homo sapiens
taacatgtaaaat

SEQ ID NO: 1488306 - DNA, 15 bp, Homo sapiens
taacatgtatcccaa

SEQ ID NO: 1488307 - DNA, 15 bp, Homo sapiens
taacattaaatcaca

SEQ ID NO: 1488308 - DNA, 21 bp, Homo sapiens
taacattcaggaattcttgga

SEQ ID NO: 1488309 - DNA, 12 bp, Homo sapiens
taacattccaag

SEQ ID NO: 1488310 - DNA, 13 bp, Homo sapiens
taacattccaaga

SEQ ID NO: 1488311 - DNA, 10 bp, Homo sapiens
taacattcct

SEQ ID NO: 1488312 - DNA, 21 bp, Homo sapiens
taacattcctcatgaatgtaa

SEQ ID NO: 1488313 - DNA, 21 bp, Homo sapiens
taacattgaccaagaactgca

SEQ ID NO: 1488314 - DNA, 13 bp, Homo sapiens
taacattgctgat

SEQ ID NO: 1488315 - DNA, 13 bp, Homo sapiens
taacatttgctgt

SEQ ID NO: 1488316 - DNA, 14 bp, Homo sapiens
taacatttgctgtt

SEQ ID NO: 1488317 - DNA, 16 bp, Homo sapiens
taacatttgctgtttt

SEQ ID NO: 1488318 - DNA, 21 bp, Homo sapiens
taaccaaatattaaagattct

SEQ ID NO: 1488319 - DNA, 22 bp, Homo sapiens
taaccaaatattaaagattctc

SEQ ID NO: 1488320 - DNA, 20 bp, Homo sapiens
taaccacttaaaaaatgtcc

SEQ ID NO: 1488321 - DNA, 15 bp, Homo sapiens
taaccagcattccct

SEQ ID NO: 1488322 - DNA, 20 bp, Homo sapiens
taaccagccacagtacatat

SEQ ID NO: 1488323 - DNA, 19 bp, Homo sapiens
taaccaggccatttttggt

SEQ ID NO: 1488324 - DNA, 14 bp, Homo sapiens
taaccagtggccgg

SEQ ID NO: 1488325 - DNA, 21 bp, Homo sapiens
taaccatatgattgaaaagaa

SEQ ID NO: 1488326 - DNA, 22 bp, Homo sapiens
taaccatatgattgaaaagaag

SEQ ID NO: 1488327 - DNA, 15 bp, Homo sapiens
taacccacctctcct

SEQ ID NO: 1488328 - DNA, 16 bp, Homo sapiens
taacccacctctcctg

SEQ ID NO: 1488329 - DNA, 22 bp, Homo sapiens
taacccacctctcctgccctgt

SEQ ID NO: 1488330 - DNA, 19 bp, Homo sapiens
taacccagtggctggaaga

SEQ ID NO: 1488331 - DNA, 17 bp, Homo sapiens
taacccagttaacttac

SEQ ID NO: 1488332 - DNA, 19 bp, Homo sapiens
taacccatttttgagccaa

SEQ ID NO: 1488333 - DNA, 16 bp, Homo sapiens
taacccctcctggctg

SEQ ID NO: 1488334 - DNA, 17 bp, Homo sapiens
taaccccttacccatct

SEQ ID NO: 1488335 - DNA, 16 bp, Homo sapiens
taacccctttcctgcg

SEQ ID NO: 1488336 - DNA, 23 bp, Homo sapiens
taacccgctcatcactggatgaa

SEQ ID NO: 1488337 - DNA, 22 bp, Homo sapiens
taaccctatcctaattgtccac

SEQ ID NO: 1488338 - DNA, 18 bp, Homo sapiens
taaccctcccatggcacc

SEQ ID NO: 1488339 - DNA, 21 bp, Homo sapiens
taaccggcatgtttccagcag

SEQ ID NO: 1488340 - DNA, 22 bp, Homo sapiens
taacctaatcaccatgtaagca

SEQ ID NO: 1488341 - DNA, 21 bp, Homo sapiens
taacctaattaatatattaaa

SEQ ID NO: 1488342 - DNA, 18 bp, Homo sapiens
taacctagaagtattttt

SEQ ID NO: 1488343 - DNA, 17 bp, Homo sapiens
taacctagttaaagaaa

SEQ ID NO: 1488344 - DNA, 22 bp, Homo sapiens
taacctagttaaagaaaggaaa

SEQ ID NO: 1488345 - DNA, 12 bp, Homo sapiens
taacctattttt

SEQ ID NO: 1488346 - DNA, 23 bp, Homo sapiens
taacctatttttttctctattct

SEQ ID NO: 1488347 - DNA, 19 bp, Homo sapiens
taacctcagtgtcatttat

SEQ ID NO: 1488348 - DNA, 22 bp, Homo sapiens
taacctgactggttaacagcag

SEQ ID NO: 1488349 - DNA, 18 bp, Homo sapiens
taacctgtctcacctgga

SEQ ID NO: 1488350 - DNA, 17 bp, Homo sapiens
taaccttaaaattgata

SEQ ID NO: 1488351 - DNA, 19 bp, Homo sapiens
taaccttaaccttaaaatt

SEQ ID NO: 1488352 - DNA, 15 bp, Homo sapiens
taaccttgaatgctg

SEQ ID NO: 1488353 - DNA, 20 bp, Homo sapiens
taaccttgaatgctgccagt

SEQ ID NO: 1488354 - DNA, 13 bp, Homo sapiens
taacctttgctat

SEQ ID NO: 1488355 - DNA, 14 bp, Homo sapiens
taacgaataaaggt

SEQ ID NO: 1488356 - DNA, 22 bp, Homo sapiens
taacgcgtatctaggctttggt

SEQ ID NO: 1488357 - DNA, 15 bp, Homo sapiens
taacgcgtcttcctg

SEQ ID NO: 1488358 - DNA, 20 bp, Homo sapiens
taacgctctatctggttttg

SEQ ID NO: 1488359 - DNA, 13 bp, Homo sapiens
taacgctgaactg

SEQ ID NO: 1488360 - DNA, 18 bp, Homo sapiens
taacggctccaggatttt

SEQ ID NO: 1488361 - DNA, 23 bp, Homo sapiens
taacggtctgttctgtttcaagg

SEQ ID NO: 1488362 - DNA, 13 bp, Homo sapiens
taacggtgctaaa

SEQ ID NO: 1488363 - DNA, 21 bp, Homo sapiens
taagaaaaataggtcagataa

SEQ ID NO: 1488364 - DNA, 17 bp, Homo sapiens
taagaaaaatcatgttt

SEQ ID NO: 1488365 - DNA, 17 bp, Homo sapiens
taagaaaagcctgaact

SEQ ID NO: 1488366 - DNA, 14 bp, Homo sapiens
taagaaaatacaat

SEQ ID NO: 1488367 - DNA, 17 bp, Homo sapiens
taagaaaatacaataaa

SEQ ID NO: 1488368 - DNA, 20 bp, Homo sapiens
taagaaaccttgctctcctc

SEQ ID NO: 1488369 - DNA, 24 bp, Homo sapiens
taagaaagactatctaaatgttga

SEQ ID NO: 1488370 - DNA, 18 bp, Homo sapiens
taagaaagcacttaaaca

SEQ ID NO: 1488371 - DNA, 19 bp, Homo sapiens
taagaaagcctaaaattga

SEQ ID NO: 1488372 - DNA, 23 bp, Homo sapiens
taagaaaggaagcattgtaaaat

SEQ ID NO: 1488373 - DNA, 18 bp, Homo sapiens
taagaaagtataaagtca

SEQ ID NO: 1488374 - DNA, 13 bp, Homo sapiens
taagaaataaatc

SEQ ID NO: 1488375 - DNA, 20 bp, Homo sapiens
taagaaatgctgaaaatcaa

SEQ ID NO: 1488376 - DNA, 12 bp, Homo sapiens
taagaactgtac

SEQ ID NO: 1488377 - DNA, 12 bp, Homo sapiens
taagaactgtgt

SEQ ID NO: 1488378 - DNA, 14 bp, Homo sapiens
taagaagagactgg

SEQ ID NO: 1488379 - DNA, 15 bp, Homo sapiens
taagaagaggagcct

SEQ ID NO: 1488380 - DNA, 18 bp, Homo sapiens
taagaagaggagcctcag

SEQ ID NO: 1488381 - DNA, 19 bp, Homo sapiens
taagaagaggagcctcaga

SEQ ID NO: 1488382 - DNA, 20 bp, Homo sapiens
taagaagaggagcctcagaa

SEQ ID NO: 1488383 - DNA, 15 bp, Homo sapiens
taagaagattcaaga

SEQ ID NO: 1488384 - DNA, 16 bp, Homo sapiens
taagaagcaatctttg

SEQ ID NO: 1488385 - DNA, 18 bp, Homo sapiens
taagaagcaatctttgaa

SEQ ID NO: 1488386 - DNA, 15 bp, Homo sapiens
taagaaggcaatatt

SEQ ID NO: 1488387 - DNA, 17 bp, Homo sapiens
taagaaggcaatattaa

SEQ ID NO: 1488388 - DNA, 20 bp, Homo sapiens
taagaaggcaatattaacct

SEQ ID NO: 1488389 - DNA, 21 bp, Homo sapiens
taagaagtttgttatagattt

SEQ ID NO: 1488390 - DNA, 21 bp, Homo sapiens
taagaataaataaagaagaaa

SEQ ID NO: 1488391 - DNA, 16 bp, Homo sapiens
taagaatatttttaga

SEQ ID NO: 1488392 - DNA, 23 bp, Homo sapiens
taagaatatttttagactatttc

SEQ ID NO: 1488393 - DNA, 17 bp, Homo sapiens
taagaatgaagttctgc

SEQ ID NO: 1488394 - DNA, 22 bp, Homo sapiens
taagaatgcagattcctgggcc

SEQ ID NO: 1488395 - DNA, 15 bp, Homo sapiens
taagaatgctggttt

SEQ ID NO: 1488396 - DNA, 16 bp, Homo sapiens
taagaatgcttaaaaa

SEQ ID NO: 1488397 - DNA, 14 bp, Homo sapiens
taagaattcaaact

SEQ ID NO: 1488398 - DNA, 15 bp, Homo sapiens
taagaattcagacat

SEQ ID NO: 1488399 - DNA, 16 bp, Homo sapiens
taagaattgagtaatg

SEQ ID NO: 1488400 - DNA, 18 bp, Homo sapiens
taagaattgagtaatggt

SEQ ID NO: 1488401 - DNA, 21 bp, Homo sapiens
taagaattgagtaatggtgta

SEQ ID NO: 1488402 - DNA, 10 bp, Homo sapiens
taagaattgt

SEQ ID NO: 1488403 - DNA, 13 bp, Homo sapiens
taagaattgttta

SEQ ID NO: 1488404 - DNA, 18 bp, Homo sapiens
taagaatttctgctaaat

SEQ ID NO: 1488405 - DNA, 15 bp, Homo sapiens
taagaattttgcttt

SEQ ID NO: 1488406 - DNA, 12 bp, Homo sapiens
taagacaaacac

SEQ ID NO: 1488407 - DNA, 14 bp, Homo sapiens
taagacaaacactg

SEQ ID NO: 1488408 - DNA, 17 bp, Homo sapiens
taagacaaatgggactg

SEQ ID NO: 1488409 - DNA, 22 bp, Homo sapiens
taagacaaatgggactgatgtc

SEQ ID NO: 1488410 - DNA, 18 bp, Homo sapiens
taagacaagagatctaca

SEQ ID NO: 1488411 - DNA, 23 bp, Homo sapiens
taagacaagagatctacacatgt

SEQ ID NO: 1488412 - DNA, 21 bp, Homo sapiens
taagacagtgtacaaaactgt

SEQ ID NO: 1488413 - DNA, 16 bp, Homo sapiens
taagacatttcctttt

SEQ ID NO: 1488414 - DNA, 15 bp, Homo sapiens
taagacatttgtata

SEQ ID NO: 1488415 - DNA, 17 bp, Homo sapiens
taagacatttgtatatt

SEQ ID NO: 1488416 - DNA, 20 bp, Homo sapiens
taagacatttgtatattgtg

SEQ ID NO: 1488417 - DNA, 21 bp, Homo sapiens
taagaccgtgtcccaaggagc

SEQ ID NO: 1488418 - DNA, 17 bp, Homo sapiens
taagacctactgttcta

SEQ ID NO: 1488419 - DNA, 13 bp, Homo sapiens
taagacctggcag

SEQ ID NO: 1488420 - DNA, 19 bp, Homo sapiens
taagactatatatataaat

SEQ ID NO: 1488421 - DNA, 21 bp, Homo sapiens
taagactcaaatgttctaagt

SEQ ID NO: 1488422 - DNA, 16 bp, Homo sapiens
taagactctcacactc

SEQ ID NO: 1488423 - DNA, 17 bp, Homo sapiens
taagactgtagatatgt

SEQ ID NO: 1488424 - DNA, 18 bp, Homo sapiens
taagacttactctaagat

SEQ ID NO: 1488425 - DNA, 19 bp, Homo sapiens
taagagaattagacaaatt

SEQ ID NO: 1488426 - DNA, 20 bp, Homo sapiens
taagagacacatacagagtg

SEQ ID NO: 1488427 - DNA, 18 bp, Homo sapiens
taagagacagttctctgt

SEQ ID NO: 1488428 - DNA, 20 bp, Homo sapiens
taagagctagcgctgccgca

SEQ ID NO: 1488429 - DNA, 14 bp, Homo sapiens
taagagctggtgtc

SEQ ID NO: 1488430 - DNA, 17 bp, Homo sapiens
taagagctggtgtctga

SEQ ID NO: 1488431 - DNA, 19 bp, Homo sapiens
taagaggaaagtacatttt

SEQ ID NO: 1488432 - DNA, 20 bp, Homo sapiens
taagaggcagaaaattgcac

SEQ ID NO: 1488433 - DNA, 15 bp, Homo sapiens
taagaggcagcgtga

SEQ ID NO: 1488434 - DNA, 15 bp, Homo sapiens
taagagggcagactg

SEQ ID NO: 1488435 - DNA, 21 bp, Homo sapiens
taagaggtgtgggtgtctgtt

SEQ ID NO: 1488436 - DNA, 17 bp, Homo sapiens
taagagtggaggaggag

SEQ ID NO: 1488437 - DNA, 13 bp, Homo sapiens
taagagtgtttaa

SEQ ID NO: 1488438 - DNA, 21 bp, Homo sapiens
taagagttagtttctttggga

SEQ ID NO: 1488439 - DNA, 21 bp, Homo sapiens
taagagttgctttgccagagc

SEQ ID NO: 1488440 - DNA, 23 bp, Homo sapiens
taagagttgctttgccagagcag

SEQ ID NO: 1488441 - DNA, 14 bp, Homo sapiens
taagataaatgaaa

SEQ ID NO: 1488442 - DNA, 15 bp, Homo sapiens
taagataaatgaaat

SEQ ID NO: 1488443 - DNA, 13 bp, Homo sapiens
taagataattata

SEQ ID NO: 1488444 - DNA, 22 bp, Homo sapiens
taagatacaaattaattttact

SEQ ID NO: 1488445 - DNA, 22 bp, Homo sapiens
taagatacaagtttcagacagg

SEQ ID NO: 1488446 - DNA, 23 bp, Homo sapiens
taagatacaagtttcagacaggg

SEQ ID NO: 1488447 - DNA, 14 bp, Homo sapiens
taagatagaaagct

SEQ ID NO: 1488448 - DNA, 18 bp, Homo sapiens
taagatagaaagctggac

SEQ ID NO: 1488449 - DNA, 20 bp, Homo sapiens
taagatagaaagctggactg

SEQ ID NO: 1488450 - DNA, 15 bp, Homo sapiens
taagatagaacacaa

SEQ ID NO: 1488451 - DNA, 15 bp, Homo sapiens
taagatagtgtaact

SEQ ID NO: 1488452 - DNA, 16 bp, Homo sapiens
taagatagtgtaactt

SEQ ID NO: 1488453 - DNA, 16 bp, Homo sapiens
taagatatacttgttt

SEQ ID NO: 1488454 - DNA, 15 bp, Homo sapiens
taagatatagaaact

SEQ ID NO: 1488455 - DNA, 17 bp, Homo sapiens
taagatatccatctttt

SEQ ID NO: 1488456 - DNA, 20 bp, Homo sapiens
taagatatccatctttttct

SEQ ID NO: 1488457 - DNA, 13 bp, Homo sapiens
taagatccagaaa

SEQ ID NO: 1488458 - DNA, 23 bp, Homo sapiens
taagatcctagatcctaagggtc

SEQ ID NO: 1488459 - DNA, 16 bp, Homo sapiens
taagatctgactgcca

SEQ ID NO: 1488460 - DNA, 16 bp, Homo sapiens
taagatctgtgtttta

SEQ ID NO: 1488461 - DNA, 13 bp, Homo sapiens
taagatgctgggt

SEQ ID NO: 1488462 - DNA, 16 bp, Homo sapiens
taagatggctgtggca

SEQ ID NO: 1488463 - DNA, 21 bp, Homo sapiens
taagatggctgtggcatttcc

SEQ ID NO: 1488464 - DNA, 18 bp, Homo sapiens
taagatgtgatattctaa

SEQ ID NO: 1488465 - DNA, 21 bp, Homo sapiens
taagatgtgatattctaagac

SEQ ID NO: 1488466 - DNA, 17 bp, Homo sapiens
taagatgtgttcttatt

SEQ ID NO: 1488467 - DNA, 13 bp, Homo sapiens
taagattaaagga

SEQ ID NO: 1488468 - DNA, 19 bp, Homo sapiens
taagattacaaatcagaag

SEQ ID NO: 1488469 - DNA, 22 bp, Homo sapiens
taagattacaaatcagaagtca

SEQ ID NO: 1488470 - DNA, 14 bp, Homo sapiens
taagattataattg

SEQ ID NO: 1488471 - DNA, 20 bp, Homo sapiens
taagattatagattctaaag

SEQ ID NO: 1488472 - DNA, 14 bp, Homo sapiens
taagattcatattt

SEQ ID NO: 1488473 - DNA, 21 bp, Homo sapiens
taagattccagagagtggctc

SEQ ID NO: 1488474 - DNA, 11 bp, Homo sapiens
taagattctaa

SEQ ID NO: 1488475 - DNA, 12 bp, Homo sapiens
taagattctaaa

SEQ ID NO: 1488476 - DNA, 13 bp, Homo sapiens
taagattctaaag

SEQ ID NO: 1488477 - DNA, 14 bp, Homo sapiens
taagattctaaagg

SEQ ID NO: 1488478 - DNA, 12 bp, Homo sapiens
taatagcctgtc

SEQ ID NO: 1488479 - DNA, 15 bp, Homo sapiens
taatagcctgtcata

SEQ ID NO: 1488480 - DNA, 13 bp, Homo sapiens
taatagcttctgt

SEQ ID NO: 1488481 - DNA, 15 bp, Homo sapiens
taatagggaatatat

SEQ ID NO: 1488482 - DNA, 21 bp, Homo sapiens
taataggtatatagaacacaa

SEQ ID NO: 1488483 - DNA, 20 bp, Homo sapiens
taataggtgggggaaaatga

SEQ ID NO: 1488484 - DNA, 21 bp, Homo sapiens
taataggtgggggaaaatgaa

SEQ ID NO: 1488485 - DNA, 16 bp, Homo sapiens
taatagttctatcctt

SEQ ID NO: 1488486 - DNA, 23 bp, Homo sapiens
taatagttctatccttttgcctg

SEQ ID NO: 1488487 - DNA, 20 bp, Homo sapiens
taatagtttgtctattttaa

SEQ ID NO: 1488488 - DNA, 15 bp, Homo sapiens
taatataaaaaattt

SEQ ID NO: 1488489 - DNA, 21 bp, Homo sapiens
taatataaagtagtcctgtga

SEQ ID NO: 1488490 - DNA, 13 bp, Homo sapiens
taatataaattta

SEQ ID NO: 1488491 - DNA, 16 bp, Homo sapiens
taatatacctggttta

SEQ ID NO: 1488492 - DNA, 13 bp, Homo sapiens
taatatatatcta

SEQ ID NO: 1488493 - DNA, 16 bp, Homo sapiens
taatatatatgaataa

SEQ ID NO: 1488494 - DNA, 17 bp, Homo sapiens
taatatatattttaagg

SEQ ID NO: 1488495 - DNA, 16 bp, Homo sapiens
taatatattgtacaaa

SEQ ID NO: 1488496 - DNA, 14 bp, Homo sapiens
taatatatttaaaa

SEQ ID NO: 1488497 - DNA, 16 bp, Homo sapiens
taatatcaactctgaa

SEQ ID NO: 1488498 - DNA, 18 bp, Homo sapiens
taatatcaactctgaagc

SEQ ID NO: 1488499 - DNA, 13 bp, Homo sapiens
taatatctgtgag

SEQ ID NO: 1488500 - DNA, 12 bp, Homo sapiens
taatatgagaat

SEQ ID NO: 1488501 - DNA, 15 bp, Homo sapiens
taatatgagcttcaa

SEQ ID NO: 1488502 - DNA, 19 bp, Homo sapiens
taatatgcagccatatatg

SEQ ID NO: 1488503 - DNA, 16 bp, Homo sapiens
taatatgctgccaaat

SEQ ID NO: 1488504 - DNA, 19 bp, Homo sapiens
taatatgtgccttaagttt

SEQ ID NO: 1488505 - DNA, 21 bp, Homo sapiens
taatatgtgccttaagtttta

SEQ ID NO: 1488506 - DNA, 18 bp, Homo sapiens
taatattcaatgaacttc

SEQ ID NO: 1488507 - DNA, 20 bp, Homo sapiens
taatattcagccagcttaaa

SEQ ID NO: 1488508 - DNA, 19 bp, Homo sapiens
taatattgagaaagaaact

SEQ ID NO: 1488509 - DNA, 21 bp, Homo sapiens
taatattgtaaatactggact

SEQ ID NO: 1488510 - DNA, 17 bp, Homo sapiens
taatattgtctgtctct

SEQ ID NO: 1488511 - DNA, 13 bp, Homo sapiens
taatatttaccaa

SEQ ID NO: 1488512 - DNA, 17 bp, Homo sapiens
taatatttaccaaagta

SEQ ID NO: 1488513 - DNA, 12 bp, Homo sapiens
taatatttatgt

SEQ ID NO: 1488514 - DNA, 13 bp, Homo sapiens
taatatttatgtt

SEQ ID NO: 1488515 - DNA, 17 bp, Homo sapiens
taatatttcaagtgcct

SEQ ID NO: 1488516 - DNA, 12 bp, Homo sapiens
taatattttgta

SEQ ID NO: 1488517 - DNA, 15 bp, Homo sapiens
taatattttgtattt

SEQ ID NO: 1488518 - DNA, 19 bp, Homo sapiens
taatattttgtattttcaa

SEQ ID NO: 1488519 - DNA, 17 bp, Homo sapiens
taatcaaaagctattta

SEQ ID NO: 1488520 - DNA, 19 bp, Homo sapiens
taatcaaaattgtctcttc

SEQ ID NO: 1488521 - DNA, 11 bp, Homo sapiens
taatcaagaga

SEQ ID NO: 1488522 - DNA, 15 bp, Homo sapiens
taatcaagagaaact

SEQ ID NO: 1488523 - DNA, 10 bp, Homo sapiens
taatcaagat

SEQ ID NO: 1488524 - DNA, 11 bp, Homo sapiens
taatcaagatt

SEQ ID NO: 1488525 - DNA, 15 bp, Homo sapiens
taatcacgctttcct

SEQ ID NO: 1488526 - DNA, 18 bp, Homo sapiens
taatcacgctttcctgaa

SEQ ID NO: 1488527 - DNA, 12 bp, Homo sapiens
taatcagaacac

SEQ ID NO: 1488528 - DNA, 20 bp, Homo sapiens
taatcagcaagaatttgatc

SEQ ID NO: 1488529 - DNA, 15 bp, Homo sapiens
taatcagcaataaaa

SEQ ID NO: 1488530 - DNA, 12 bp, Homo sapiens
taatcaggcagc

SEQ ID NO: 1488531 - DNA, 19 bp, Homo sapiens
taatcaggtcctcagagaa

SEQ ID NO: 1488532 - DNA, 18 bp, Homo sapiens
taatcagtgtgtctaaat

SEQ ID NO: 1488533 - DNA, 23 bp, Homo sapiens
taatcagttcattagaaatattt

SEQ ID NO: 1488534 - DNA, 14 bp, Homo sapiens
taatcatacaaact

SEQ ID NO: 1488535 - DNA, 18 bp, Homo sapiens
taatcatacaaactctca

SEQ ID NO: 1488536 - DNA, 18 bp, Homo sapiens
taatcatagattattata

SEQ ID NO: 1488537 - DNA, 14 bp, Homo sapiens
taatcatctaagtc

SEQ ID NO: 1488538 - DNA, 23 bp, Homo sapiens
taatcatctaagtcagtacccac

SEQ ID NO: 1488539 - DNA, 16 bp, Homo sapiens
taatcatctataaaga

SEQ ID NO: 1488540 - DNA, 19 bp, Homo sapiens
taatcatgtgggtgagcca

SEQ ID NO: 1488541 - DNA, 21 bp, Homo sapiens
taatcatttgtttacatttga

SEQ ID NO: 1488542 - DNA, 19 bp, Homo sapiens
taatccaatgggtttttcc

SEQ ID NO: 1488543 - DNA, 18 bp, Homo sapiens
taatccaggcacagctga

SEQ ID NO: 1488544 - DNA, 22 bp, Homo sapiens
taatccaggcagatccaggact

SEQ ID NO: 1488545 - DNA, 16 bp, Homo sapiens
taatcccacccacctc

SEQ ID NO: 1488546 - DNA, 16 bp, Homo sapiens
taatcccagcactttg

SEQ ID NO: 1488547 - DNA, 19 bp, Homo sapiens
taatcccagcactttggga

SEQ ID NO: 1488548 - DNA, 13 bp, Homo sapiens
taatcccatttcc

SEQ ID NO: 1488549 - DNA, 20 bp, Homo sapiens
taatcccatttcccaaacct

SEQ ID NO: 1488550 - DNA, 19 bp, Homo sapiens
taatcccctaaaataacag

SEQ ID NO: 1488551 - DNA, 18 bp, Homo sapiens
taatccccttctcccctg

SEQ ID NO: 1488552 - DNA, 21 bp, Homo sapiens
taatccccttctcccctgcac

SEQ ID NO: 1488553 - DNA, 22 bp, Homo sapiens
taatccctgggcattgctttcc

SEQ ID NO: 1488554 - DNA, 20 bp, Homo sapiens
taatccttctagtttcccac

SEQ ID NO: 1488555 - DNA, 21 bp, Homo sapiens
taatccttctagtttcccaca

SEQ ID NO: 1488556 - DNA, 16 bp, Homo sapiens
taatcctttgttttct

SEQ ID NO: 1488557 - DNA, 18 bp, Homo sapiens
taatcctttgttttctga

SEQ ID NO: 1488558 - DNA, 10 bp, Homo sapiens
taatctacac

SEQ ID NO: 1488559 - DNA, 13 bp, Homo sapiens
taatctacaccaa

SEQ ID NO: 1488560 - DNA, 17 bp, Homo sapiens
taatctacaccaatgaa

SEQ ID NO: 1488561 - DNA, 15 bp, Homo sapiens
taatctagtttacag

SEQ ID NO: 1488562 - DNA, 16 bp, Homo sapiens
taatctcaaaggagaa

SEQ ID NO: 1488563 - DNA, 18 bp, Homo sapiens
taatctcaaaggagaaaa

SEQ ID NO: 1488564 - DNA, 18 bp, Homo sapiens
taatctctctgcagctgc

SEQ ID NO: 1488565 - DNA, 13 bp, Homo sapiens
taatctctgatta

SEQ ID NO: 1488566 - DNA, 17 bp, Homo sapiens
taatctgaataaagtgt

SEQ ID NO: 1488567 - DNA, 23 bp, Homo sapiens
taatctgagattgtgtttgttca

SEQ ID NO: 1488568 - DNA, 15 bp, Homo sapiens
taatctggtgacaaa

SEQ ID NO: 1488569 - DNA, 17 bp, Homo sapiens
taatctgtagggctgga

SEQ ID NO: 1488570 - DNA, 18 bp, Homo sapiens
taatcttagtgtatgatt

SEQ ID NO: 1488571 - DNA, 15 bp, Homo sapiens
taatcttataattgt

SEQ ID NO: 1488572 - DNA, 20 bp, Homo sapiens
taatcttattgtttaatctt

SEQ ID NO: 1488573 - DNA, 17 bp, Homo sapiens
taatcttcaaagccttc

SEQ ID NO: 1488574 - DNA, 17 bp, Homo sapiens
taatcttgctttcttta

SEQ ID NO: 1488575 - DNA, 18 bp, Homo sapiens
taatcttgctttctttag

SEQ ID NO: 1488576 - DNA, 20 bp, Homo sapiens
taatcttgctttctttagaa

SEQ ID NO: 1488577 - DNA, 21 bp, Homo sapiens
taatctttcacttgaaagatt

SEQ ID NO: 1488578 - DNA, 17 bp, Homo sapiens
taatcttttttttaaaa

SEQ ID NO: 1488579 - DNA, 23 bp, Homo sapiens
taatgaaaataaaacacacctcg

SEQ ID NO: 1488580 - DNA, 15 bp, Homo sapiens
taatgaaaatgtcag

SEQ ID NO: 1488581 - DNA, 23 bp, Homo sapiens
taatgaaagactgtacaaagtag

SEQ ID NO: 1488582 - DNA, 19 bp, Homo sapiens
taatgaaatcaaatgtatg

SEQ ID NO: 1488583 - DNA, 16 bp, Homo sapiens
taatgaagagaaaaaa

SEQ ID NO: 1488584 - DNA, 15 bp, Homo sapiens
taatgaattataaca

SEQ ID NO: 1488585 - DNA, 15 bp, Homo sapiens
taatgacagagccag

SEQ ID NO: 1488586 - DNA, 21 bp, Homo sapiens
taatgacagataaatccttaa

SEQ ID NO: 1488587 - DNA, 24 bp, Homo sapiens
taatgacttgtacaaacagtattt

SEQ ID NO: 1488588 - DNA, 12 bp, Homo sapiens
taatgactttat

SEQ ID NO: 1488589 - DNA, 21 bp, Homo sapiens
taatgagagcaaatgcaaaaa

SEQ ID NO: 1488590 - DNA, 11 bp, Homo sapiens
taatgagccat

SEQ ID NO: 1488591 - DNA, 22 bp, Homo sapiens
taatgagccatcactagaagaa

SEQ ID NO: 1488592 - DNA, 18 bp, Homo sapiens
taatgaggaaaaaatggt

SEQ ID NO: 1488593 - DNA, 16 bp, Homo sapiens
taatgagtgcacctgc

SEQ ID NO: 1488594 - DNA, 17 bp, Homo sapiens
taatgagtgcacctgcc

SEQ ID NO: 1488595 - DNA, 20 bp, Homo sapiens
taatgataaactcagatctg

SEQ ID NO: 1488596 - DNA, 21 bp, Homo sapiens
taatgataaactcagatctga

SEQ ID NO: 1488597 - DNA, 14 bp, Homo sapiens
taatgatactgtgt

SEQ ID NO: 1488598 - DNA, 15 bp, Homo sapiens
taatgatactgtgtg

SEQ ID NO: 1488599 - DNA, 18 bp, Homo sapiens
taatgattatataaaata

SEQ ID NO: 1488600 - DNA, 23 bp, Homo sapiens
taatgatttcttgataattgtgt

SEQ ID NO: 1488601 - DNA, 15 bp, Homo sapiens
taatgcagaagtatt

SEQ ID NO: 1488602 - DNA, 16 bp, Homo sapiens
taatgcatgttaggaa

SEQ ID NO: 1488603 - DNA, 17 bp, Homo sapiens
taatgcatgttaggaaa

SEQ ID NO: 1488604 - DNA, 21 bp, Homo sapiens
taatgcatgttaggaaaattt

SEQ ID NO: 1488605 - DNA, 22 bp, Homo sapiens
taatgccggtgagaataagaga

SEQ ID NO: 1488606 - DNA, 16 bp, Homo sapiens
taatgcctctcccgca

SEQ ID NO: 1488607 - DNA, 18 bp, Homo sapiens
taatgcctcttcattctt

SEQ ID NO: 1488608 - DNA, 15 bp, Homo sapiens
taatgcctgcttttt

SEQ ID NO: 1488609 - DNA, 22 bp, Homo sapiens
taatgcctttaaagtatgaatc

SEQ ID NO: 1488610 - DNA, 19 bp, Homo sapiens
taatgctaatttaaagaga

SEQ ID NO: 1488611 - DNA, 14 bp, Homo sapiens
taatgctacaattt

SEQ ID NO: 1488612 - DNA, 14 bp, Homo sapiens
taatgctaccagga

SEQ ID NO: 1488613 - DNA, 20 bp, Homo sapiens
taatgctaccaggatgctaa

SEQ ID NO: 1488614 - DNA, 13 bp, Homo sapiens
taatgctactgtc

SEQ ID NO: 1488615 - DNA, 19 bp, Homo sapiens
taatgctcttcaaaataaa

SEQ ID NO: 1488616 - DNA, 17 bp, Homo sapiens
taatgctgttgcctcat

SEQ ID NO: 1488617 - DNA, 17 bp, Homo sapiens
taatgcttcaagtgttg

SEQ ID NO: 1488618 - DNA, 23 bp, Homo sapiens
taatgcttcaagtgttgctcttg

SEQ ID NO: 1488619 - DNA, 21 bp, Homo sapiens
taatgcttgtaatttaaacat

SEQ ID NO: 1488620 - DNA, 19 bp, Homo sapiens
taatgctttcacaacattt

SEQ ID NO: 1488621 - DNA, 14 bp, Homo sapiens
taatgctttttaga

SEQ ID NO: 1488622 - DNA, 19 bp, Homo sapiens
taatgctttttagaaagca

SEQ ID NO: 1488623 - DNA, 11 bp, Homo sapiens
taatggaaaaa

SEQ ID NO: 1488624 - DNA, 18 bp, Homo sapiens
taatggaaacatttacaa

SEQ ID NO: 1488625 - DNA, 20 bp, Homo sapiens
taatggaagtgtatttattt

SEQ ID NO: 1488626 - DNA, 23 bp, Homo sapiens
taatggaagtgtatttattttac

SEQ ID NO: 1488627 - DNA, 19 bp, Homo sapiens
taatggacatgagataatg

SEQ ID NO: 1488628 - DNA, 13 bp, Homo sapiens
taatggcactgat

SEQ ID NO: 1488629 - DNA, 19 bp, Homo sapiens
taatggcagctagtgcctt

SEQ ID NO: 1488630 - DNA, 20 bp, Homo sapiens
taatggcagctagtgccttt

SEQ ID NO: 1488631 - DNA, 14 bp, Homo sapiens
taatggcatttctc

SEQ ID NO: 1488632 - DNA, 18 bp, Homo sapiens
taatgggtttcatatttc

SEQ ID NO: 1488633 - DNA, 18 bp, Homo sapiens
taatggtcccatccaggc

SEQ ID NO: 1488634 - DNA, 20 bp, Homo sapiens
taatggtcccatccaggcag

SEQ ID NO: 1488635 - DNA, 17 bp, Homo sapiens
taatgtaaaattcatag

SEQ ID NO: 1488636 - DNA, 15 bp, Homo sapiens
taatgtaatcattta

SEQ ID NO: 1488637 - DNA, 15 bp, Homo sapiens
taatgtacaagtttt

SEQ ID NO: 1488638 - DNA, 19 bp, Homo sapiens
taatgtacaagttttgtat

SEQ ID NO: 1488639 - DNA, 17 bp, Homo sapiens
taatgtactcacatata

SEQ ID NO: 1488640 - DNA, 22 bp, Homo sapiens
taatgtactcacatataacatg

SEQ ID NO: 1488641 - DNA, 18 bp, Homo sapiens
taatgtactgatttcagt

SEQ ID NO: 1488642 - DNA, 21 bp, Homo sapiens
taatgtatctatttgtacaat

SEQ ID NO: 1488643 - DNA, 15 bp, Homo sapiens
taatgtattcatatt

SEQ ID NO: 1488644 - DNA, 17 bp, Homo sapiens
taatgtattcatatttg

SEQ ID NO: 1488645 - DNA, 22 bp, Homo sapiens
taatgtcaccaccttcccagct

SEQ ID NO: 1488646 - DNA, 14 bp, Homo sapiens
taatgtcattgcta

SEQ ID NO: 1488647 - DNA, 16 bp, Homo sapiens
taatgtctcctttgct

SEQ ID NO: 1488648 - DNA, 17 bp, Homo sapiens
taatgtctcctttgctc

SEQ ID NO: 1488649 - DNA, 17 bp, Homo sapiens
taatgtctgcagctcaa

SEQ ID NO: 1488650 - DNA, 23 bp, Homo sapiens
taatgtgaggaactcacatactg

SEQ ID NO: 1488651 - DNA, 22 bp, Homo sapiens
taatgtgcagaaaatatttaat

SEQ ID NO: 1488652 - DNA, 23 bp, Homo sapiens
taatgtgcagggatattgcctta

SEQ ID NO: 1488653 - DNA, 19 bp, Homo sapiens
taatgtgtcatctagcatt

SEQ ID NO: 1488654 - DNA, 15 bp, Homo sapiens
taatgtgtcccctga

SEQ ID NO: 1488655 - DNA, 15 bp, Homo sapiens
taatgttaattcagc

SEQ ID NO: 1488656 - DNA, 20 bp, Homo sapiens
taatgttctgaataatttct

SEQ ID NO: 1488657 - DNA, 22 bp, Homo sapiens
taatgttctgaataatttctta

SEQ ID NO: 1488658 - DNA, 16 bp, Homo sapiens
taatgttgaacaaaat

SEQ ID NO: 1488659 - DNA, 21 bp, Homo sapiens
taatgttggacacctttaggt

SEQ ID NO: 1488660 - DNA, 13 bp, Homo sapiens
taatgttgtgaat

SEQ ID NO: 1488661 - DNA, 16 bp, Homo sapiens
taatgttgtgaataat

SEQ ID NO: 1488662 - DNA, 14 bp, Homo sapiens
taatgttgttattt

SEQ ID NO: 1488663 - DNA, 23 bp, Homo sapiens
taatgttgttccttttgaaagaa

SEQ ID NO: 1488664 - DNA, 22 bp, Homo sapiens
taatgtttatgagccagacaaa

SEQ ID NO: 1488665 - DNA, 17 bp, Homo sapiens
taatgtttattaaatgc

SEQ ID NO: 1488666 - DNA, 17 bp, Homo sapiens
taatgtttctatctgat

SEQ ID NO: 1488667 - DNA, 14 bp, Homo sapiens
taatgtttgaacaa

SEQ ID NO: 1488668 - DNA, 15 bp, Homo sapiens
taatgttttaactct

SEQ ID NO: 1488669 - DNA, 13 bp, Homo sapiens
taatgttttcaaa

SEQ ID NO: 1488670 - DNA, 17 bp, Homo sapiens
taatgttttgtacaatt

SEQ ID NO: 1488671 - DNA, 23 bp, Homo sapiens
taatgttttttgccacagctttt

SEQ ID NO: 1488672 - DNA, 17 bp, Homo sapiens
taattaaagactcaaga

SEQ ID NO: 1488673 - DNA, 17 bp, Homo sapiens
taattaagtactatgta

SEQ ID NO: 1488674 - DNA, 20 bp, Homo sapiens
taattaagtactatgtatca

SEQ ID NO: 1488675 - DNA, 19 bp, Homo sapiens
taattaataatatgtacta

SEQ ID NO: 1488676 - DNA, 17 bp, Homo sapiens
taattaatgaaatatct

SEQ ID NO: 1488677 - DNA, 20 bp, Homo sapiens
taattaatgaaatatctgta

SEQ ID NO: 1488678 - DNA, 21 bp, Homo sapiens
taattaatgaaatatctgtat

SEQ ID NO: 1488679 - DNA, 19 bp, Homo sapiens
taattacagtgcctaaaat

SEQ ID NO: 1488680 - DNA, 22 bp, Homo sapiens
taattacattcctaactagaat

SEQ ID NO: 1488681 - DNA, 15 bp, Homo sapiens
taattactaatttca

SEQ ID NO: 1488682 - DNA, 14 bp, Homo sapiens
taattactctttga

SEQ ID NO: 1488683 - DNA, 13 bp, Homo sapiens
taattactggaat

SEQ ID NO: 1488684 - DNA, 21 bp, Homo sapiens
taattaggcaaggctatgtga

SEQ ID NO: 1488685 - DNA, 14 bp, Homo sapiens
taattagtgccact

SEQ ID NO: 1488686 - DNA, 19 bp, Homo sapiens
taattagtgccacttaatg

SEQ ID NO: 1488687 - DNA, 12 bp, Homo sapiens
taattagtttat

SEQ ID NO: 1488688 - DNA, 21 bp, Homo sapiens
taattagtttatattactctc

SEQ ID NO: 1488689 - DNA, 14 bp, Homo sapiens
taattatataactg

SEQ ID NO: 1488690 - DNA, 16 bp, Homo sapiens
taattatataactgta

SEQ ID NO: 1488691 - DNA, 21 bp, Homo sapiens
taattatatattttgttgttc

SEQ ID NO: 1488692 - DNA, 20 bp, Homo sapiens
taattatcgggaacagtgtt

SEQ ID NO: 1488693 - DNA, 21 bp, Homo sapiens
taattatcgggaacagtgttt

SEQ ID NO: 1488694 - DNA, 13 bp, Homo sapiens
taattatgacagt

SEQ ID NO: 1488695 - DNA, 20 bp, Homo sapiens
taattatgtaccatgaatat

SEQ ID NO: 1488696 - DNA, 14 bp, Homo sapiens
taattattattctt

SEQ ID NO: 1488697 - DNA, 12 bp, Homo sapiens
taattatttgaa

SEQ ID NO: 1488698 - DNA, 13 bp, Homo sapiens
taattatttgaat

SEQ ID NO: 1488699 - DNA, 18 bp, Homo sapiens
taattattttaaaatatt

SEQ ID NO: 1488700 - DNA, 20 bp, Homo sapiens
taattattttaaaatattta

SEQ ID NO: 1488701 - DNA, 13 bp, Homo sapiens
taattattttggt

SEQ ID NO: 1488702 - DNA, 16 bp, Homo sapiens
taattattttggtact

SEQ ID NO: 1488703 - DNA, 22 bp, Homo sapiens
taattcaaagctctattaagat

SEQ ID NO: 1488704 - DNA, 13 bp, Homo sapiens
taattcaagaaaa

SEQ ID NO: 1488705 - DNA, 21 bp, Homo sapiens
taattcacagaatagcacaaa

SEQ ID NO: 1488706 - DNA, 22 bp, Homo sapiens
taattcacagtgctcttttctc

SEQ ID NO: 1488707 - DNA, 15 bp, Homo sapiens
tacacaatacagtat

SEQ ID NO: 1488708 - DNA, 16 bp, Homo sapiens
tacacaatacagtatt

SEQ ID NO: 1488709 - DNA, 15 bp, Homo sapiens
tacacacatccacgc

SEQ ID NO: 1488710 - DNA, 19 bp, Homo sapiens
tacacacatgccctcctgg

SEQ ID NO: 1488711 - DNA, 18 bp, Homo sapiens
tacacaccagaagatgtg

SEQ ID NO: 1488712 - DNA, 16 bp, Homo sapiens
tacacacgtaccttca

SEQ ID NO: 1488713 - DNA, 11 bp, Homo sapiens
tacacagaaac

SEQ ID NO: 1488714 - DNA, 15 bp, Homo sapiens
tacacagaaacactg

SEQ ID NO: 1488715 - DNA, 18 bp, Homo sapiens
tacacagaaatgctgctg

SEQ ID NO: 1488716 - DNA, 21 bp, Homo sapiens
tacacagagaaggctatgtaa

SEQ ID NO: 1488717 - DNA, 17 bp, Homo sapiens
tacacagcacaccagcc

SEQ ID NO: 1488718 - DNA, 16 bp, Homo sapiens
tacacagcccaagagg

SEQ ID NO: 1488719 - DNA, 14 bp, Homo sapiens
tacacagcctggac

SEQ ID NO: 1488720 - DNA, 16 bp, Homo sapiens
tacacaggaagagaag

SEQ ID NO: 1488721 - DNA, 15 bp, Homo sapiens
tacacagtaaaaact

SEQ ID NO: 1488722 - DNA, 16 bp, Homo sapiens
tacacagtaaaaactt

SEQ ID NO: 1488723 - DNA, 22 bp, Homo sapiens
tacacagtaaaaacttgtacta

SEQ ID NO: 1488724 - DNA, 23 bp, Homo sapiens
tacacagtaaaaacttgtactat

SEQ ID NO: 1488725 - DNA, 22 bp, Homo sapiens
tacacagtacctcgtttctaca

SEQ ID NO: 1488726 - DNA, 13 bp, Homo sapiens
tacacagtacttt

SEQ ID NO: 1488727 - DNA, 14 bp, Homo sapiens
tacacagtacttta

SEQ ID NO: 1488728 - DNA, 19 bp, Homo sapiens
tacacagtactttattgta

SEQ ID NO: 1488729 - DNA, 20 bp, Homo sapiens
tacacagtactttattgtac

SEQ ID NO: 1488730 - DNA, 22 bp, Homo sapiens
tacacagtgggaactctgacaa

SEQ ID NO: 1488731 - DNA, 18 bp, Homo sapiens
tacacatccccagaatcc

SEQ ID NO: 1488732 - DNA, 13 bp, Homo sapiens
tacacatgaaaac

SEQ ID NO: 1488733 - DNA, 14 bp, Homo sapiens
tacacatgtaaaat

SEQ ID NO: 1488734 - DNA, 20 bp, Homo sapiens
tacacatgtaaaatatgtaa

SEQ ID NO: 1488735 - DNA, 20 bp, Homo sapiens
tacacatgttgccttgcatt

SEQ ID NO: 1488736 - DNA, 15 bp, Homo sapiens
tacacattagatttt

SEQ ID NO: 1488737 - DNA, 23 bp, Homo sapiens
tacacattagattttattttact

SEQ ID NO: 1488738 - DNA, 13 bp, Homo sapiens
tacacatttgcta

SEQ ID NO: 1488739 - DNA, 21 bp, Homo sapiens
tacacatttgctactgttgta

SEQ ID NO: 1488740 - DNA, 21 bp, Homo sapiens
tacaccaatgaaaacatgtac

SEQ ID NO: 1488741 - DNA, 18 bp, Homo sapiens
tacaccacctcactcctg

SEQ ID NO: 1488742 - DNA, 20 bp, Homo sapiens
tacaccagagataatatgag

SEQ ID NO: 1488743 - DNA, 19 bp, Homo sapiens
tacaccatgtttgagctca

SEQ ID NO: 1488744 - DNA, 16 bp, Homo sapiens
tacacccctgtgctcc

SEQ ID NO: 1488745 - DNA, 23 bp, Homo sapiens
tacacccctgtgctcccctgcca

SEQ ID NO: 1488746 - DNA, 17 bp, Homo sapiens
tacaccgggcctggaga

SEQ ID NO: 1488747 - DNA, 23 bp, Homo sapiens
tacacctaaaggtgtatttaaac

SEQ ID NO: 1488748 - DNA, 12 bp, Homo sapiens
tacacctggctg

SEQ ID NO: 1488749 - DNA, 13 bp, Homo sapiens
tacacctggctga

SEQ ID NO: 1488750 - DNA, 15 bp, Homo sapiens
tacacctggctgagg

SEQ ID NO: 1488751 - DNA, 13 bp, Homo sapiens
tacacgggactga

SEQ ID NO: 1488752 - DNA, 16 bp, Homo sapiens
tacacgtatctcttgg

SEQ ID NO: 1488753 - DNA, 16 bp, Homo sapiens
tacacgtctggacccc

SEQ ID NO: 1488754 - DNA, 15 bp, Homo sapiens
tacactaaaaggtga

SEQ ID NO: 1488755 - DNA, 20 bp, Homo sapiens
tacactaagggtgtaagtaa

SEQ ID NO: 1488756 - DNA, 18 bp, Homo sapiens
tacactaatttgaataaa

SEQ ID NO: 1488757 - DNA, 20 bp, Homo sapiens
tacactaccaaacactcagt

SEQ ID NO: 1488758 - DNA, 15 bp, Homo sapiens
tacactcaactaatt

SEQ ID NO: 1488759 - DNA, 20 bp, Homo sapiens
tacactcaactaatttttgt

SEQ ID NO: 1488760 - DNA, 18 bp, Homo sapiens
tacactgaatatttatat

SEQ ID NO: 1488761 - DNA, 15 bp, Homo sapiens
tacactgacttgaga

SEQ ID NO: 1488762 - DNA, 13 bp, Homo sapiens
tacactgaggact

SEQ ID NO: 1488763 - DNA, 15 bp, Homo sapiens
tacactggatatgtt

SEQ ID NO: 1488764 - DNA, 15 bp, Homo sapiens
tacactgggctgggt

SEQ ID NO: 1488765 - DNA, 21 bp, Homo sapiens
tacactggtctaatgtttgtg

SEQ ID NO: 1488766 - DNA, 23 bp, Homo sapiens
tacactgtatctaaaaaataact

SEQ ID NO: 1488767 - DNA, 13 bp, Homo sapiens
tacactttgttgc

SEQ ID NO: 1488768 - DNA, 15 bp, Homo sapiens
tacagaaaaagactt

SEQ ID NO: 1488769 - DNA, 19 bp, Homo sapiens
tacagaaatactgctctga

SEQ ID NO: 1488770 - DNA, 18 bp, Homo sapiens
tacagaaattagccgggc

SEQ ID NO: 1488771 - DNA, 19 bp, Homo sapiens
tacagaactacatatttgt

SEQ ID NO: 1488772 - DNA, 18 bp, Homo sapiens
tacagaattctgctacct

SEQ ID NO: 1488773 - DNA, 21 bp, Homo sapiens
tacagaattctgctacctcac

SEQ ID NO: 1488774 - DNA, 20 bp, Homo sapiens
tacagacaaggttctgccct

SEQ ID NO: 1488775 - DNA, 11 bp, Homo sapiens
tacagacacta

SEQ ID NO: 1488776 - DNA, 13 bp, Homo sapiens
tacagacactaag

SEQ ID NO: 1488777 - DNA, 19 bp, Homo sapiens
tacagacactaagttatag

SEQ ID NO: 1488778 - DNA, 20 bp, Homo sapiens
tacagacattcaatgaatta

SEQ ID NO: 1488779 - DNA, 15 bp, Homo sapiens
tacagactccatctc

SEQ ID NO: 1488780 - DNA, 17 bp, Homo sapiens
tacagactccatctctt

SEQ ID NO: 1488781 - DNA, 19 bp, Homo sapiens
tacagactccatctcttct

SEQ ID NO: 1488782 - DNA, 14 bp, Homo sapiens
tacagacttctcca

SEQ ID NO: 1488783 - DNA, 20 bp, Homo sapiens
tacagagaggatacatttaa

SEQ ID NO: 1488784 - DNA, 17 bp, Homo sapiens
tacagagccttgagaga

SEQ ID NO: 1488785 - DNA, 10 bp, Homo sapiens
tacagaggac

SEQ ID NO: 1488786 - DNA, 18 bp, Homo sapiens
tacagaggacagtatttg

SEQ ID NO: 1488787 - DNA, 17 bp, Homo sapiens
tacagaggatgcctttt

SEQ ID NO: 1488788 - DNA, 13 bp, Homo sapiens
tacagagtgggcc

SEQ ID NO: 1488789 - DNA, 17 bp, Homo sapiens
tacagataattcatttg

SEQ ID NO: 1488790 - DNA, 18 bp, Homo sapiens
tacagataattcatttgt

SEQ ID NO: 1488791 - DNA, 13 bp, Homo sapiens
tacagatctttgg

SEQ ID NO: 1488792 - DNA, 16 bp, Homo sapiens
tacagatgtgggccac

SEQ ID NO: 1488793 - DNA, 14 bp, Homo sapiens
tacagattaaaaaa

SEQ ID NO: 1488794 - DNA, 13 bp, Homo sapiens
tacagatttaata

SEQ ID NO: 1488795 - DNA, 16 bp, Homo sapiens
tacagattttatttgt

SEQ ID NO: 1488796 - DNA, 13 bp, Homo sapiens
tacagcaaaagat

SEQ ID NO: 1488797 - DNA, 19 bp, Homo sapiens
tacagcaacaatttatgaa

SEQ ID NO: 1488798 - DNA, 20 bp, Homo sapiens
tacagcaacaatttatgaat

SEQ ID NO: 1488799 - DNA, 18 bp, Homo sapiens
tacagcaacaggaatctc

SEQ ID NO: 1488800 - DNA, 17 bp, Homo sapiens
tacagcactactctgtg

SEQ ID NO: 1488801 - DNA, 22 bp, Homo sapiens
tacagcattacaaattgcttac

SEQ ID NO: 1488802 - DNA, 16 bp, Homo sapiens
tacagcattgtctttg

SEQ ID NO: 1488803 - DNA, 20 bp, Homo sapiens
tacagccttaatattttcct

SEQ ID NO: 1488804 - DNA, 18 bp, Homo sapiens
tacagctaatcagcattc

SEQ ID NO: 1488805 - DNA, 15 bp, Homo sapiens
tacagctatatttga

SEQ ID NO: 1488806 - DNA, 18 bp, Homo sapiens
tacagctatatttgatta

SEQ ID NO: 1488807 - DNA, 23 bp, Homo sapiens
tacagctatatttgattatgtat

SEQ ID NO: 1488808 - DNA, 13 bp, Homo sapiens
tacagctcagtaa

SEQ ID NO: 1488809 - DNA, 16 bp, Homo sapiens
tacagctgcctaccta

SEQ ID NO: 1488810 - DNA, 14 bp, Homo sapiens
tacagcttctggag

SEQ ID NO: 1488811 - DNA, 15 bp, Homo sapiens
tacagcttctggagc

SEQ ID NO: 1488812 - DNA, 23 bp, Homo sapiens
tacaggaaaaaaaattctgttgt

SEQ ID NO: 1488813 - DNA, 21 bp, Homo sapiens
tacaggaaacagttgcatgta

SEQ ID NO: 1488814 - DNA, 21 bp, Homo sapiens
tacaggaagcaccccatgcca

SEQ ID NO: 1488815 - DNA, 17 bp, Homo sapiens
tacaggaaggcaggagg

SEQ ID NO: 1488816 - DNA, 18 bp, Homo sapiens
tacaggaaggtagaaata

SEQ ID NO: 1488817 - DNA, 19 bp, Homo sapiens
tacaggatggtgggcagga

SEQ ID NO: 1488818 - DNA, 15 bp, Homo sapiens
tacaggcgcctgcca

SEQ ID NO: 1488819 - DNA, 22 bp, Homo sapiens
tacagggagaaaatccaggtca

SEQ ID NO: 1488820 - DNA, 23 bp, Homo sapiens
tacagggagaaaatccaggtcat

SEQ ID NO: 1488821 - DNA, 21 bp, Homo sapiens
tacagggagccggcggcctct

SEQ ID NO: 1488822 - DNA, 22 bp, Homo sapiens
tacagggcgagactctgtctca

SEQ ID NO: 1488823 - DNA, 20 bp, Homo sapiens
tacaggggtagtttgtttta

SEQ ID NO: 1488824 - DNA, 17 bp, Homo sapiens
tacaggggttagcctgg

SEQ ID NO: 1488825 - DNA, 19 bp, Homo sapiens
tacagggtagataacctgt

SEQ ID NO: 1488826 - DNA, 18 bp, Homo sapiens
tacagggtagcaggtacc

SEQ ID NO: 1488827 - DNA, 23 bp, Homo sapiens
tacaggtcatattaatatatttc

SEQ ID NO: 1488828 - DNA, 22 bp, Homo sapiens
tacaggtgtgtgccaccacacc

SEQ ID NO: 1488829 - DNA, 22 bp, Homo sapiens
tacagtaactaattttgttgaa

SEQ ID NO: 1488830 - DNA, 13 bp, Homo sapiens
tacagtaacttta

SEQ ID NO: 1488831 - DNA, 16 bp, Homo sapiens
tacagtaactttatgt

SEQ ID NO: 1488832 - DNA, 23 bp, Homo sapiens
tacagtaactttatgtgtaaata

SEQ ID NO: 1488833 - DNA, 14 bp, Homo sapiens
tacagtaagctgct

SEQ ID NO: 1488834 - DNA, 21 bp, Homo sapiens
tacagtaagctgctctattgt

SEQ ID NO: 1488835 - DNA, 17 bp, Homo sapiens
tacagtagattttccaa

SEQ ID NO: 1488836 - DNA, 18 bp, Homo sapiens
tacagtagtgtcatcact

SEQ ID NO: 1488837 - DNA, 15 bp, Homo sapiens
tacagtatagatttt

SEQ ID NO: 1488838 - DNA, 19 bp, Homo sapiens
tacagtatgatgaaaataa

SEQ ID NO: 1488839 - DNA, 16 bp, Homo sapiens
tacagtgaattgtctt

SEQ ID NO: 1488840 - DNA, 17 bp, Homo sapiens
tacagtgaattgtcttt

SEQ ID NO: 1488841 - DNA, 18 bp, Homo sapiens
tacagtgaattgtctttt

SEQ ID NO: 1488842 - DNA, 21 bp, Homo sapiens
tacagtggttttatactgaag

SEQ ID NO: 1488843 - DNA, 22 bp, Homo sapiens
tacagtggttttatactgaagg

SEQ ID NO: 1488844 - DNA, 18 bp, Homo sapiens
tacagttagggttttgca

SEQ ID NO: 1488845 - DNA, 22 bp, Homo sapiens
tacagttagggttttgcaataa

SEQ ID NO: 1488846 - DNA, 14 bp, Homo sapiens
tacagttctgtggt

SEQ ID NO: 1488847 - DNA, 15 bp, Homo sapiens
tacagttctgtggtt

SEQ ID NO: 1488848 - DNA, 15 bp, Homo sapiens
tacagttctttcctc

SEQ ID NO: 1488849 - DNA, 21 bp, Homo sapiens
tacagttctttcctctttctg

SEQ ID NO: 1488850 - DNA, 22 bp, Homo sapiens
tacagttctttcctctttctgc

SEQ ID NO: 1488851 - DNA, 15 bp, Homo sapiens
tacagttgttggcct

SEQ ID NO: 1488852 - DNA, 13 bp, Homo sapiens
tacagtttctgct

SEQ ID NO: 1488853 - DNA, 14 bp, Homo sapiens
tacagtttctgctt

SEQ ID NO: 1488854 - DNA, 14 bp, Homo sapiens
tacagttttaactg

SEQ ID NO: 1488855 - DNA, 20 bp, Homo sapiens
tacagttttctagcaatttt

SEQ ID NO: 1488856 - DNA, 16 bp, Homo sapiens
tacagtttttttcttt

SEQ ID NO: 1488857 - DNA, 15 bp, Homo sapiens
tacataaaagaattt

SEQ ID NO: 1488858 - DNA, 11 bp, Homo sapiens
tacataaacaa

SEQ ID NO: 1488859 - DNA, 21 bp, Homo sapiens
tacataaacaacgcattgcca

SEQ ID NO: 1488860 - DNA, 13 bp, Homo sapiens
tacataactgaaa

SEQ ID NO: 1488861 - DNA, 17 bp, Homo sapiens
tacataactgaaaatgt

SEQ ID NO: 1488862 - DNA, 22 bp, Homo sapiens
tacataagagaaagaggccaga

SEQ ID NO: 1488863 - DNA, 18 bp, Homo sapiens
tacataaggatgactttt

SEQ ID NO: 1488864 - DNA, 16 bp, Homo sapiens
tacataagtaattcaa

SEQ ID NO: 1488865 - DNA, 17 bp, Homo sapiens
tacataattaaatttta

SEQ ID NO: 1488866 - DNA, 12 bp, Homo sapiens
tacatactgctg

SEQ ID NO: 1488867 - DNA, 14 bp, Homo sapiens
tacatagagcaatg

SEQ ID NO: 1488868 - DNA, 17 bp, Homo sapiens
tacatagatgcttagtc

SEQ ID NO: 1488869 - DNA, 21 bp, Homo sapiens
tacataggtctgtatggctgt

SEQ ID NO: 1488870 - DNA, 14 bp, Homo sapiens
tacatagtaaagta

SEQ ID NO: 1488871 - DNA, 16 bp, Homo sapiens
tacatagtaaagtatt

SEQ ID NO: 1488872 - DNA, 19 bp, Homo sapiens
tacatagtgctgctgtgtg

SEQ ID NO: 1488873 - DNA, 21 bp, Homo sapiens
tacatagtgctgctgtgtgct

SEQ ID NO: 1488874 - DNA, 13 bp, Homo sapiens
tacatatatattt

SEQ ID NO: 1488875 - DNA, 16 bp, Homo sapiens
tacatatatgtataat

SEQ ID NO: 1488876 - DNA, 17 bp, Homo sapiens
tacatatgagaatatac

SEQ ID NO: 1488877 - DNA, 14 bp, Homo sapiens
tacatattactgtt

SEQ ID NO: 1488878 - DNA, 18 bp, Homo sapiens
tacatattaggaaaatat

SEQ ID NO: 1488879 - DNA, 13 bp, Homo sapiens
tacatatttgtgc

SEQ ID NO: 1488880 - DNA, 21 bp, Homo sapiens
tacatcaagtccatctgacaa

SEQ ID NO: 1488881 - DNA, 22 bp, Homo sapiens
tacatcaagtccatctgacaaa

SEQ ID NO: 1488882 - DNA, 17 bp, Homo sapiens
tacatcagaaaataaaa

SEQ ID NO: 1488883 - DNA, 19 bp, Homo sapiens
tacatcagaaaataaaata

SEQ ID NO: 1488884 - DNA, 17 bp, Homo sapiens
tacatcagactctagaa

SEQ ID NO: 1488885 - DNA, 13 bp, Homo sapiens
tacatcatttctt

SEQ ID NO: 1488886 - DNA, 13 bp, Homo sapiens
tacatcccagcct

SEQ ID NO: 1488887 - DNA, 14 bp, Homo sapiens
tacatcccagcctg

SEQ ID NO: 1488888 - DNA, 17 bp, Homo sapiens
tacatctaagtcagttt

SEQ ID NO: 1488889 - DNA, 21 bp, Homo sapiens
tacatctaagtcagtttcaca

SEQ ID NO: 1488890 - DNA, 17 bp, Homo sapiens
tacatcttatttcctca

SEQ ID NO: 1488891 - DNA, 20 bp, Homo sapiens
tacatcttttcaacaagtaa

SEQ ID NO: 1488892 - DNA, 16 bp, Homo sapiens
tacatcttttctaatc

SEQ ID NO: 1488893 - DNA, 17 bp, Homo sapiens
tacatcttttctaatca

SEQ ID NO: 1488894 - DNA, 18 bp, Homo sapiens
tacatcttttttcacaaa

SEQ ID NO: 1488895 - DNA, 12 bp, Homo sapiens
tacatgaaacag

SEQ ID NO: 1488896 - DNA, 15 bp, Homo sapiens
tacatgaaacagaaa

SEQ ID NO: 1488897 - DNA, 17 bp, Homo sapiens
tacatgcagcccatgcc

SEQ ID NO: 1488898 - DNA, 14 bp, Homo sapiens
tacatgcatttgag

SEQ ID NO: 1488899 - DNA, 17 bp, Homo sapiens
tacatgccacatcaaac

SEQ ID NO: 1488900 - DNA, 18 bp, Homo sapiens
tacatgctactaaatttt

SEQ ID NO: 1488901 - DNA, 21 bp, Homo sapiens
tacatggcaacgtgtgaactg

SEQ ID NO: 1488902 - DNA, 16 bp, Homo sapiens
tacatggccagtgtga

SEQ ID NO: 1488903 - DNA, 20 bp, Homo sapiens
tacatgtaactatttcttca

SEQ ID NO: 1488904 - DNA, 18 bp, Homo sapiens
tacatgtaagtgtggttt

SEQ ID NO: 1488905 - DNA, 23 bp, Homo sapiens
tacatgtaagtgtggttttgtaa

SEQ ID NO: 1488906 - DNA, 14 bp, Homo sapiens
tacatgtaatttga

SEQ ID NO: 1488907 - DNA, 23 bp, Homo sapiens
tacatgtacatagtaaagtattt

SEQ ID NO: 1488908 - DNA, 17 bp, Homo sapiens
tacatgtactccagagg

SEQ ID NO: 1488909 - DNA, 18 bp, Homo sapiens
tacatgtgatacattttt

SEQ ID NO: 1488910 - DNA, 19 bp, Homo sapiens
tacatgtgatacatttttt

SEQ ID NO: 1488911 - DNA, 16 bp, Homo sapiens
tacatgtgcacattgt

SEQ ID NO: 1488912 - DNA, 16 bp, Homo sapiens
tacatgtggcccaaca

SEQ ID NO: 1488913 - DNA, 14 bp, Homo sapiens
tacatgtgtaaagg

SEQ ID NO: 1488914 - DNA, 16 bp, Homo sapiens
tacatgtgtaaaggtt

SEQ ID NO: 1488915 - DNA, 19 bp, Homo sapiens
tacatgtgtacatatatgt

SEQ ID NO: 1488916 - DNA, 21 bp, Homo sapiens
tacatgtgtacatatatgtat

SEQ ID NO: 1488917 - DNA, 13 bp, Homo sapiens
tacatgtttataa

SEQ ID NO: 1488918 - DNA, 19 bp, Homo sapiens
tacatgtttatgtaaacaa

SEQ ID NO: 1488919 - DNA, 13 bp, Homo sapiens
tacattaaatcac

SEQ ID NO: 1488920 - DNA, 14 bp, Homo sapiens
tacattaacggtgc

SEQ ID NO: 1488921 - DNA, 17 bp, Homo sapiens
tacattaacggtgctaa

SEQ ID NO: 1488922 - DNA, 18 bp, Homo sapiens
tacattaacggtgctaaa

SEQ ID NO: 1488923 - DNA, 15 bp, Homo sapiens
tacattaatgttaat

SEQ ID NO: 1488924 - DNA, 16 bp, Homo sapiens
tacattacactaaatt

SEQ ID NO: 1488925 - DNA, 15 bp, Homo sapiens
tacattcaatgttta

SEQ ID NO: 1488926 - DNA, 12 bp, Homo sapiens
tacattcagatt

SEQ ID NO: 1488927 - DNA, 14 bp, Homo sapiens
tacattccattgtt

SEQ ID NO: 1488928 - DNA, 17 bp, Homo sapiens
tacattcctaactagaa

SEQ ID NO: 1488929 - DNA, 21 bp, Homo sapiens
tacattcctaactagaattag

SEQ ID NO: 1488930 - DNA, 16 bp, Homo sapiens
tacattcctcagctgc

SEQ ID NO: 1488931 - DNA, 19 bp, Homo sapiens
tacattctgcctagagtgt

SEQ ID NO: 1488932 - DNA, 21 bp, Homo sapiens
tacattctttttgctctaaaa

SEQ ID NO: 1488933 - DNA, 16 bp, Homo sapiens
tacattgaaaacagat

SEQ ID NO: 1488934 - DNA, 14 bp, Homo sapiens
tacattgagcattt

SEQ ID NO: 1488935 - DNA, 19 bp, Homo sapiens
tacattggaagctttgagt

SEQ ID NO: 1488936 - DNA, 16 bp, Homo sapiens
tacattgtaaaataaa

SEQ ID NO: 1488937 - DNA, 18 bp, Homo sapiens
taccttttctcacaaaaa

SEQ ID NO: 1488938 - DNA, 18 bp, Homo sapiens
taccttttctcttttctt

SEQ ID NO: 1488939 - DNA, 20 bp, Homo sapiens
taccttttctcttttctttc

SEQ ID NO: 1488940 - DNA, 21 bp, Homo sapiens
taccttttttgataaagtttc

SEQ ID NO: 1488941 - DNA, 22 bp, Homo sapiens
tacgagcacctccagcctgaac

SEQ ID NO: 1488942 - DNA, 18 bp, Homo sapiens
tacgcctcttctgtccct

SEQ ID NO: 1488943 - DNA, 17 bp, Homo sapiens
tacgctgctgcaggaca

SEQ ID NO: 1488944 - DNA, 12 bp, Homo sapiens
tacgctttgtca

SEQ ID NO: 1488945 - DNA, 12 bp, Homo sapiens
tacgcttttctt

SEQ ID NO: 1488946 - DNA, 22 bp, Homo sapiens
tacggaaaaaattgtattgaaa

SEQ ID NO: 1488947 - DNA, 19 bp, Homo sapiens
tacggatcatcaacaagat

SEQ ID NO: 1488948 - DNA, 21 bp, Homo sapiens
tacggctatattggtttatgt

SEQ ID NO: 1488949 - DNA, 21 bp, Homo sapiens
tacgtagcctaaggctcctgt

SEQ ID NO: 1488950 - DNA, 15 bp, Homo sapiens
tacgtataaatatca

SEQ ID NO: 1488951 - DNA, 17 bp, Homo sapiens
tacgtataaatatcagt

SEQ ID NO: 1488952 - DNA, 15 bp, Homo sapiens
tacgtcccgctgctg

SEQ ID NO: 1488953 - DNA, 12 bp, Homo sapiens
tacgtctgtgac

SEQ ID NO: 1488954 - DNA, 19 bp, Homo sapiens
tacgtgccagatataactg

SEQ ID NO: 1488955 - DNA, 16 bp, Homo sapiens
tacgtgttcattttat

SEQ ID NO: 1488956 - DNA, 19 bp, Homo sapiens
tacgttttgcacattttgt

SEQ ID NO: 1488957 - DNA, 16 bp, Homo sapiens
tactaaaaaaaagatg

SEQ ID NO: 1488958 - DNA, 16 bp, Homo sapiens
tactaaaaagaaggaa

SEQ ID NO: 1488959 - DNA, 23 bp, Homo sapiens
tactaaaaagaaggaaaatgatc

SEQ ID NO: 1488960 - DNA, 19 bp, Homo sapiens
tactaaacagtaagatatc

SEQ ID NO: 1488961 - DNA, 18 bp, Homo sapiens
tactaaacattttgttat

SEQ ID NO: 1488962 - DNA, 15 bp, Homo sapiens
tactaaagaaagatt

SEQ ID NO: 1488963 - DNA, 18 bp, Homo sapiens
tactaaagatatcagagc

SEQ ID NO: 1488964 - DNA, 20 bp, Homo sapiens
tactaaagatatcagagctc

SEQ ID NO: 1488965 - DNA, 20 bp, Homo sapiens
tactaaattgtatacatttt

SEQ ID NO: 1488966 - DNA, 23 bp, Homo sapiens
tactaacctcccttaagcagcaa

SEQ ID NO: 1488967 - DNA, 14 bp, Homo sapiens
tactaagaagaaaa

SEQ ID NO: 1488968 - DNA, 13 bp, Homo sapiens
tactaagaataaa

SEQ ID NO: 1488969 - DNA, 16 bp, Homo sapiens
tactaagaataaataa

SEQ ID NO: 1488970 - DNA, 18 bp, Homo sapiens
tactaagaatgtccttat

SEQ ID NO: 1488971 - DNA, 14 bp, Homo sapiens
tactaaggaatctt

SEQ ID NO: 1488972 - DNA, 15 bp, Homo sapiens
tactaattttacaca

SEQ ID NO: 1488973 - DNA, 20 bp, Homo sapiens
tactacagctatatttgatt

SEQ ID NO: 1488974 - DNA, 21 bp, Homo sapiens
tactacagttgttttttgaaa

SEQ ID NO: 1488975 - DNA, 14 bp, Homo sapiens
tactaccacaagga

SEQ ID NO: 1488976 - DNA, 13 bp, Homo sapiens
tactacccagctc

SEQ ID NO: 1488977 - DNA, 14 bp, Homo sapiens
tactacccagctct

SEQ ID NO: 1488978 - DNA, 17 bp, Homo sapiens
tactactcctgtaggaa

SEQ ID NO: 1488979 - DNA, 15 bp, Homo sapiens
tactactgaaacaga

SEQ ID NO: 1488980 - DNA, 19 bp, Homo sapiens
tactactttgttaggattt

SEQ ID NO: 1488981 - DNA, 23 bp, Homo sapiens
tactactttgttaggattttcac

SEQ ID NO: 1488982 - DNA, 14 bp, Homo sapiens
tactagaagatgaa

SEQ ID NO: 1488983 - DNA, 22 bp, Homo sapiens
tactagaagatgaatacaaaca

SEQ ID NO: 1488984 - DNA, 19 bp, Homo sapiens
tactagagtctgaacagct

SEQ ID NO: 1488985 - DNA, 14 bp, Homo sapiens
tactagatgtcttt

SEQ ID NO: 1488986 - DNA, 17 bp, Homo sapiens
tactagtactatttctt

SEQ ID NO: 1488987 - DNA, 15 bp, Homo sapiens
tactagtgttctgtt

SEQ ID NO: 1488988 - DNA, 15 bp, Homo sapiens
tactatatttgctag

SEQ ID NO: 1488989 - DNA, 12 bp, Homo sapiens
tactatccattt

SEQ ID NO: 1488990 - DNA, 18 bp, Homo sapiens
tactatccatttcttcat

SEQ ID NO: 1488991 - DNA, 19 bp, Homo sapiens
tactatcctgtaaatatat

SEQ ID NO: 1488992 - DNA, 21 bp, Homo sapiens
tactatcttatctcagatatt

SEQ ID NO: 1488993 - DNA, 18 bp, Homo sapiens
tactatgcacaacagagt

SEQ ID NO: 1488994 - DNA, 15 bp, Homo sapiens
tactatggagtacca

SEQ ID NO: 1488995 - DNA, 12 bp, Homo sapiens
tactatgtatca

SEQ ID NO: 1488996 - DNA, 17 bp, Homo sapiens
tactatgtctgaacata

SEQ ID NO: 1488997 - DNA, 20 bp, Homo sapiens
tactattaagcagtaaaaac

SEQ ID NO: 1488998 - DNA, 13 bp, Homo sapiens
tactattgcctca

SEQ ID NO: 1488999 - DNA, 14 bp, Homo sapiens
tactattgcctcat

SEQ ID NO: 1489000 - DNA, 17 bp, Homo sapiens
tactatttaagatgtga

SEQ ID NO: 1489001 - DNA, 13 bp, Homo sapiens
tactatttagatt

SEQ ID NO: 1489002 - DNA, 18 bp, Homo sapiens
tactattttctacaatta

SEQ ID NO: 1489003 - DNA, 16 bp, Homo sapiens
tactcaagctgtctct

SEQ ID NO: 1489004 - DNA, 16 bp, Homo sapiens
tactcaatgtttctgg

SEQ ID NO: 1489005 - DNA, 15 bp, Homo sapiens
tactcacagtctctt

SEQ ID NO: 1489006 - DNA, 21 bp, Homo sapiens
tactcacagtctctttaatct

SEQ ID NO: 1489007 - DNA, 23 bp, Homo sapiens
tactcacatataacatgcaaaca

SEQ ID NO: 1489008 - DNA, 12 bp, Homo sapiens
tactcagagcag

SEQ ID NO: 1489009 - DNA, 16 bp, Homo sapiens
tactcagcagccctcc

SEQ ID NO: 1489010 - DNA, 17 bp, Homo sapiens
tactcagcagccctcct

SEQ ID NO: 1489011 - DNA, 18 bp, Homo sapiens
tactcagcagccctcctc

SEQ ID NO: 1489012 - DNA, 12 bp, Homo sapiens
tactcaggaggc

SEQ ID NO: 1489013 - DNA, 22 bp, Homo sapiens
tactcaggaggctgaggcagaa

SEQ ID NO: 1489014 - DNA, 12 bp, Homo sapiens
tactcaggtttg

SEQ ID NO: 1489015 - DNA, 22 bp, Homo sapiens
tactcataagttggaccagagg

SEQ ID NO: 1489016 - DNA, 13 bp, Homo sapiens
tactcatccagac

SEQ ID NO: 1489017 - DNA, 13 bp, Homo sapiens
tactcatgcgtga

SEQ ID NO: 1489018 - DNA, 19 bp, Homo sapiens
tactccactgccctggcag

SEQ ID NO: 1489019 - DNA, 12 bp, Homo sapiens
tactccagcctg

SEQ ID NO: 1489020 - DNA, 13 bp, Homo sapiens
tactccagcctgg

SEQ ID NO: 1489021 - DNA, 14 bp, Homo sapiens
tactccctctcagg

SEQ ID NO: 1489022 - DNA, 16 bp, Homo sapiens
tactccctcttcactg

SEQ ID NO: 1489023 - DNA, 18 bp, Homo sapiens
tactccctgcagatgcca

SEQ ID NO: 1489024 - DNA, 19 bp, Homo sapiens
tactccctgcagatgccac

SEQ ID NO: 1489025 - DNA, 16 bp, Homo sapiens
tactccctgttttagt

SEQ ID NO: 1489026 - DNA, 15 bp, Homo sapiens
tactcccttcctggc

SEQ ID NO: 1489027 - DNA, 18 bp, Homo sapiens
tactccgtgaggctgctg

SEQ ID NO: 1489028 - DNA, 12 bp, Homo sapiens
tactcctcccag

SEQ ID NO: 1489029 - DNA, 15 bp, Homo sapiens
tactcctcccctctt

SEQ ID NO: 1489030 - DNA, 16 bp, Homo sapiens
tactcctcctgctcct

SEQ ID NO: 1489031 - DNA, 12 bp, Homo sapiens
tactcctctgca

SEQ ID NO: 1489032 - DNA, 14 bp, Homo sapiens
tactcctgcaaaat

SEQ ID NO: 1489033 - DNA, 22 bp, Homo sapiens
tactccttaagaacacaaagcg

SEQ ID NO: 1489034 - DNA, 14 bp, Homo sapiens
tactccttgcttcc

SEQ ID NO: 1489035 - DNA, 18 bp, Homo sapiens
tactccttgcttcctgat

SEQ ID NO: 1489036 - DNA, 19 bp, Homo sapiens
tactccttgcttcctgatg

SEQ ID NO: 1489037 - DNA, 18 bp, Homo sapiens
tactctaagatcttagat

SEQ ID NO: 1489038 - DNA, 21 bp, Homo sapiens
tactctaagatcttagattct

SEQ ID NO: 1489039 - DNA, 21 bp, Homo sapiens
tactctagaacatgcacattt

SEQ ID NO: 1489040 - DNA, 11 bp, Homo sapiens
tactctagaag

SEQ ID NO: 1489041 - DNA, 18 bp, Homo sapiens
tactctcaaaatctttgt

SEQ ID NO: 1489042 - DNA, 14 bp, Homo sapiens
tactctccaacctg

SEQ ID NO: 1489043 - DNA, 23 bp, Homo sapiens
tactctcctggaaatattaagaa

SEQ ID NO: 1489044 - DNA, 14 bp, Homo sapiens
tactctgagcccag

SEQ ID NO: 1489045 - DNA, 13 bp, Homo sapiens
tactctgctttat

SEQ ID NO: 1489046 - DNA, 22 bp, Homo sapiens
tactctggagcaacctactgtc

SEQ ID NO: 1489047 - DNA, 11 bp, Homo sapiens
tactctgtcca

SEQ ID NO: 1489048 - DNA, 17 bp, Homo sapiens
tactctgtccaggccac

SEQ ID NO: 1489049 - DNA, 19 bp, Homo sapiens
tactctgttccttcacatc

SEQ ID NO: 1489050 - DNA, 20 bp, Homo sapiens
tactctgttgagtaaaacac

SEQ ID NO: 1489051 - DNA, 15 bp, Homo sapiens
tactcttcagggtct

SEQ ID NO: 1489052 - DNA, 19 bp, Homo sapiens
tactcttcgcttctggtat

SEQ ID NO: 1489053 - DNA, 18 bp, Homo sapiens
tacttcctcctgatggcc

SEQ ID NO: 1489054 - DNA, 13 bp, Homo sapiens
tacttcctttctc

SEQ ID NO: 1489055 - DNA, 17 bp, Homo sapiens
tacttcgtcttctaatt

SEQ ID NO: 1489056 - DNA, 13 bp, Homo sapiens
tacttctctcaga

SEQ ID NO: 1489057 - DNA, 16 bp, Homo sapiens
tacttcttatacattt

SEQ ID NO: 1489058 - DNA, 12 bp, Homo sapiens
tacttgaagggc

SEQ ID NO: 1489059 - DNA, 12 bp, Homo sapiens
tacttgaatttc

SEQ ID NO: 1489060 - DNA, 15 bp, Homo sapiens
tacttgaccattctc

SEQ ID NO: 1489061 - DNA, 14 bp, Homo sapiens
tacttgctcctttt

SEQ ID NO: 1489062 - DNA, 15 bp, Homo sapiens
tacttggaagtgttt

SEQ ID NO: 1489063 - DNA, 16 bp, Homo sapiens
tacttgtctgtcaaat

SEQ ID NO: 1489064 - DNA, 19 bp, Homo sapiens
tacttgtgaaacacagctg

SEQ ID NO: 1489065 - DNA, 20 bp, Homo sapiens
tacttgtttctctgttgtaa

SEQ ID NO: 1489066 - DNA, 13 bp, Homo sapiens
tacttgttttgga

SEQ ID NO: 1489067 - DNA, 16 bp, Homo sapiens
tacttgtttttgtaaa

SEQ ID NO: 1489068 - DNA, 22 bp, Homo sapiens
tactttaaaaaggaaatttgtt

SEQ ID NO: 1489069 - DNA, 18 bp, Homo sapiens
tactttattaatatgagt

SEQ ID NO: 1489070 - DNA, 11 bp, Homo sapiens
tactttattct

SEQ ID NO: 1489071 - DNA, 15 bp, Homo sapiens
tactttattcttgct

SEQ ID NO: 1489072 - DNA, 14 bp, Homo sapiens
tactttatttctga

SEQ ID NO: 1489073 - DNA, 17 bp, Homo sapiens
tactttatttttctgat

SEQ ID NO: 1489074 - DNA, 16 bp, Homo sapiens
tactttcatcttaaac

SEQ ID NO: 1489075 - DNA, 18 bp, Homo sapiens
tactttcatcttaaacta

SEQ ID NO: 1489076 - DNA, 17 bp, Homo sapiens
tactttcgtacattggc

SEQ ID NO: 1489077 - DNA, 15 bp, Homo sapiens
tactttgacagtgtt

SEQ ID NO: 1489078 - DNA, 15 bp, Homo sapiens
tactttgattctgat

SEQ ID NO: 1489079 - DNA, 18 bp, Homo sapiens
tactttgcaatccaaata

SEQ ID NO: 1489080 - DNA, 14 bp, Homo sapiens
tactttgccatttt

SEQ ID NO: 1489081 - DNA, 21 bp, Homo sapiens
tactttgccatttttctataa

SEQ ID NO: 1489082 - DNA, 20 bp, Homo sapiens
tactttggaatacatttctc

SEQ ID NO: 1489083 - DNA, 16 bp, Homo sapiens
tactttggcaatttcc

SEQ ID NO: 1489084 - DNA, 17 bp, Homo sapiens
tactttggcaatttcct

SEQ ID NO: 1489085 - DNA, 23 bp, Homo sapiens
tactttggcaatttcctggccct

SEQ ID NO: 1489086 - DNA, 20 bp, Homo sapiens
tactttggggctaatttaac

SEQ ID NO: 1489087 - DNA, 16 bp, Homo sapiens
tactttgtattttgat

SEQ ID NO: 1489088 - DNA, 11 bp, Homo sapiens
tactttgtcag

SEQ ID NO: 1489089 - DNA, 20 bp, Homo sapiens
tactttgtcctttttgttat

SEQ ID NO: 1489090 - DNA, 13 bp, Homo sapiens
tactttgtctttt

SEQ ID NO: 1489091 - DNA, 15 bp, Homo sapiens
tactttgtgcattct

SEQ ID NO: 1489092 - DNA, 20 bp, Homo sapiens
tactttgtgctcataaattg

SEQ ID NO: 1489093 - DNA, 19 bp, Homo sapiens
tactttgttaggattttca

SEQ ID NO: 1489094 - DNA, 14 bp, Homo sapiens
tactttgttctgtt

SEQ ID NO: 1489095 - DNA, 16 bp, Homo sapiens
tactttgttctgttgt

SEQ ID NO: 1489096 - DNA, 18 bp, Homo sapiens
tactttgttctgttgtct

SEQ ID NO: 1489097 - DNA, 17 bp, Homo sapiens
tacttttaaatattaac

SEQ ID NO: 1489098 - DNA, 18 bp, Homo sapiens
tacttttaccagtttctt

SEQ ID NO: 1489099 - DNA, 16 bp, Homo sapiens
tacttttccagtctgt

SEQ ID NO: 1489100 - DNA, 13 bp, Homo sapiens
tacttttgagtgt

SEQ ID NO: 1489101 - DNA, 16 bp, Homo sapiens
tacttttgagtgtgtg

SEQ ID NO: 1489102 - DNA, 16 bp, Homo sapiens
tacttttgcaaactgt

SEQ ID NO: 1489103 - DNA, 13 bp, Homo sapiens
tacttttggctcc

SEQ ID NO: 1489104 - DNA, 20 bp, Homo sapiens
tactttttaaaaggtatttt

SEQ ID NO: 1489105 - DNA, 20 bp, Homo sapiens
tactttttatactccataca

SEQ ID NO: 1489106 - DNA, 20 bp, Homo sapiens
tacttttttaaatattttct

SEQ ID NO: 1489107 - DNA, 21 bp, Homo sapiens
tacttttttaaatattttcta

SEQ ID NO: 1489108 - DNA, 22 bp, Homo sapiens
tacttttttaaatattttctat

SEQ ID NO: 1489109 - DNA, 15 bp, Homo sapiens
tagaaaaaaaattat

SEQ ID NO: 1489110 - DNA, 18 bp, Homo sapiens
tagaaaaaagtttacaac

SEQ ID NO: 1489111 - DNA, 21 bp, Homo sapiens
tagaaaaaggggcctgagtgg

SEQ ID NO: 1489112 - DNA, 12 bp, Homo sapiens
tagaaaaataaa

SEQ ID NO: 1489113 - DNA, 16 bp, Homo sapiens
tagaaaaataaaatgt

SEQ ID NO: 1489114 - DNA, 12 bp, Homo sapiens
tagaaaaatgta

SEQ ID NO: 1489115 - DNA, 19 bp, Homo sapiens
tagaaaaatgtataaaaat

SEQ ID NO: 1489116 - DNA, 20 bp, Homo sapiens
tagaaaaattcagcaaacca

SEQ ID NO: 1489117 - DNA, 21 bp, Homo sapiens
tagaaaaggctaggtacacag

SEQ ID NO: 1489118 - DNA, 21 bp, Homo sapiens
tagaaaaggtgataaaatcat

SEQ ID NO: 1489119 - DNA, 17 bp, Homo sapiens
tagaaaatccttcagct

SEQ ID NO: 1489120 - DNA, 17 bp, Homo sapiens
tagaaaatgacttattt

SEQ ID NO: 1489121 - DNA, 19 bp, Homo sapiens
tagaaaatgcaaaatgaaa

SEQ ID NO: 1489122 - DNA, 13 bp, Homo sapiens
tagaaaattattt

SEQ ID NO: 1489123 - DNA, 19 bp, Homo sapiens
tagaaaattatttgtatga

SEQ ID NO: 1489124 - DNA, 16 bp, Homo sapiens
tagaaaattttgtaaa

SEQ ID NO: 1489125 - DNA, 20 bp, Homo sapiens
tagaaacacataattaacac

SEQ ID NO: 1489126 - DNA, 14 bp, Homo sapiens
tagaaacatgacac

SEQ ID NO: 1489127 - DNA, 19 bp, Homo sapiens
tagaaacatgacactgacc

SEQ ID NO: 1489128 - DNA, 18 bp, Homo sapiens
tagaaactggaaatacta

SEQ ID NO: 1489129 - DNA, 16 bp, Homo sapiens
tagaaacttaaacaca

SEQ ID NO: 1489130 - DNA, 20 bp, Homo sapiens
tagaaagaaaagaccctgag

SEQ ID NO: 1489131 - DNA, 23 bp, Homo sapiens
tagaaagaaaagaccctgagact

SEQ ID NO: 1489132 - DNA, 16 bp, Homo sapiens
tagaaagagaaacagt

SEQ ID NO: 1489133 - DNA, 12 bp, Homo sapiens
tagaaagcattt

SEQ ID NO: 1489134 - DNA, 23 bp, Homo sapiens
tagaaagctgctgtgatcccagt

SEQ ID NO: 1489135 - DNA, 15 bp, Homo sapiens
tagaaagctggactg

SEQ ID NO: 1489136 - DNA, 20 bp, Homo sapiens
tagaaagctgtttatttatt

SEQ ID NO: 1489137 - DNA, 19 bp, Homo sapiens
tagaaaggacaacagttct

SEQ ID NO: 1489138 - DNA, 21 bp, Homo sapiens
tagaaaggacaacagttctga

SEQ ID NO: 1489139 - DNA, 15 bp, Homo sapiens
tagaaatataattga

SEQ ID NO: 1489140 - DNA, 20 bp, Homo sapiens
tagaaatatctgaaaatgta

SEQ ID NO: 1489141 - DNA, 21 bp, Homo sapiens
tagaaatatctgaaaatgtat

SEQ ID NO: 1489142 - DNA, 18 bp, Homo sapiens
tagaaatatctttctctt

SEQ ID NO: 1489143 - DNA, 14 bp, Homo sapiens
tagaaatattttaa

SEQ ID NO: 1489144 - DNA, 20 bp, Homo sapiens
tagaaatattttaaaatcag

SEQ ID NO: 1489145 - DNA, 14 bp, Homo sapiens
tagaaatcattgta

SEQ ID NO: 1489146 - DNA, 21 bp, Homo sapiens
tagaaatggtttcctctggat

SEQ ID NO: 1489147 - DNA, 19 bp, Homo sapiens
tagaaatgtaacttttgta

SEQ ID NO: 1489148 - DNA, 18 bp, Homo sapiens
tagaaatgtatcctgata

SEQ ID NO: 1489149 - DNA, 22 bp, Homo sapiens
tagaaattagaaaaaaattact

SEQ ID NO: 1489150 - DNA, 23 bp, Homo sapiens
tagaaattgaacaaaaatgtttc

SEQ ID NO: 1489151 - DNA, 22 bp, Homo sapiens
tagaaattttacaataggtgct

SEQ ID NO: 1489152 - DNA, 15 bp, Homo sapiens
tagaaattttgtaag

SEQ ID NO: 1489153 - DNA, 17 bp, Homo sapiens
tagaaattttgtaagaa

SEQ ID NO: 1489154 - DNA, 22 bp, Homo sapiens
tagaaattttgtaagaaggcaa

SEQ ID NO: 1489155 - DNA, 16 bp, Homo sapiens
tagaacaaaggacaga

SEQ ID NO: 1489156 - DNA, 19 bp, Homo sapiens
tagaacacaaaacttgaaa

SEQ ID NO: 1489157 - DNA, 19 bp, Homo sapiens
tagaacacaagggatataa

SEQ ID NO: 1489158 - DNA, 17 bp, Homo sapiens
tagaacataaagcaaat

SEQ ID NO: 1489159 - DNA, 20 bp, Homo sapiens
tagaacatgcacatttatat

SEQ ID NO: 1489160 - DNA, 21 bp, Homo sapiens
tagaacatgcacatttatata

SEQ ID NO: 1489161 - DNA, 17 bp, Homo sapiens
tagaaccaagcttcaga

SEQ ID NO: 1489162 - DNA, 18 bp, Homo sapiens
tagaaccaagcttcagag

SEQ ID NO: 1489163 - DNA, 20 bp, Homo sapiens
tagaaccaagcttcagagcc

SEQ ID NO: 1489164 - DNA, 21 bp, Homo sapiens
tagaaccaagcttcagagcct

SEQ ID NO: 1489165 - DNA, 21 bp, Homo sapiens
tagaacctatatcgagagtgt

SEQ ID NO: 1489166 - DNA, 23 bp, Homo sapiens
tagaacgtgcatccttgtaatac

SEQ ID NO: 1489167 - DNA, 20 bp, Homo sapiens
tagactattccttttctgta

SEQ ID NO: 1489168 - DNA, 14 bp, Homo sapiens
tagactatttcttt

SEQ ID NO: 1489169 - DNA, 17 bp, Homo sapiens
tagactcatcttactgt

SEQ ID NO: 1489170 - DNA, 21 bp, Homo sapiens
tagactcatcttactgtacct

SEQ ID NO: 1489171 - DNA, 22 bp, Homo sapiens
tagactctgtctacctggtctg

SEQ ID NO: 1489172 - DNA, 22 bp, Homo sapiens
tagactgacttgtttgtcttcc

SEQ ID NO: 1489173 - DNA, 21 bp, Homo sapiens
tagactgaggtataaagacaa

SEQ ID NO: 1489174 - DNA, 16 bp, Homo sapiens
tagacttaataaaggt

SEQ ID NO: 1489175 - DNA, 15 bp, Homo sapiens
tagacttaggcatta

SEQ ID NO: 1489176 - DNA, 22 bp, Homo sapiens
tagacttaggcattaacatgtt

SEQ ID NO: 1489177 - DNA, 14 bp, Homo sapiens
tagacttccccatc

SEQ ID NO: 1489178 - DNA, 18 bp, Homo sapiens
tagacttcgactcaggat

SEQ ID NO: 1489179 - DNA, 14 bp, Homo sapiens
tagacttctggttg

SEQ ID NO: 1489180 - DNA, 18 bp, Homo sapiens
tagacttggagctgtcct

SEQ ID NO: 1489181 - DNA, 21 bp, Homo sapiens
tagacttggagctgtcctcca

SEQ ID NO: 1489182 - DNA, 17 bp, Homo sapiens
tagactttagaaataaa

SEQ ID NO: 1489183 - DNA, 18 bp, Homo sapiens
tagactttagaaataaat

SEQ ID NO: 1489184 - DNA, 14 bp, Homo sapiens
tagacttttccaat

SEQ ID NO: 1489185 - DNA, 23 bp, Homo sapiens
tagacttttccaatatgtgattt

SEQ ID NO: 1489186 - DNA, 22 bp, Homo sapiens
tagagaaactttgagtacagat

SEQ ID NO: 1489187 - DNA, 15 bp, Homo sapiens
tagagaaatggattc

SEQ ID NO: 1489188 - DNA, 16 bp, Homo sapiens
tagagaactgtggccg

SEQ ID NO: 1489189 - DNA, 13 bp, Homo sapiens
tagagaagctgaa

SEQ ID NO: 1489190 - DNA, 14 bp, Homo sapiens
tagagaatgtgttt

SEQ ID NO: 1489191 - DNA, 13 bp, Homo sapiens
tagagagaacagg

SEQ ID NO: 1489192 - DNA, 18 bp, Homo sapiens
tagagagcctgtcaccag

SEQ ID NO: 1489193 - DNA, 13 bp, Homo sapiens
tagagagccttaa

SEQ ID NO: 1489194 - DNA, 15 bp, Homo sapiens
tagagagggggctct

SEQ ID NO: 1489195 - DNA, 20 bp, Homo sapiens
tagagataaaacagaatctt

SEQ ID NO: 1489196 - DNA, 14 bp, Homo sapiens
tagagataattgct

SEQ ID NO: 1489197 - DNA, 15 bp, Homo sapiens
tagagataattgctt

SEQ ID NO: 1489198 - DNA, 20 bp, Homo sapiens
tagagatattcttatttcac

SEQ ID NO: 1489199 - DNA, 16 bp, Homo sapiens
tagagatttgtctaat

SEQ ID NO: 1489200 - DNA, 20 bp, Homo sapiens
tagagatttgtctaattgca

SEQ ID NO: 1489201 - DNA, 19 bp, Homo sapiens
tagagattttacaaaatgc

SEQ ID NO: 1489202 - DNA, 14 bp, Homo sapiens
tagagattttctct

SEQ ID NO: 1489203 - DNA, 22 bp, Homo sapiens
tagagcaaaattgatgtgttta

SEQ ID NO: 1489204 - DNA, 21 bp, Homo sapiens
tagagcaatgttggtttttta

SEQ ID NO: 1489205 - DNA, 17 bp, Homo sapiens
tagagcacactgtagca

SEQ ID NO: 1489206 - DNA, 13 bp, Homo sapiens
tagagccagcttg

SEQ ID NO: 1489207 - DNA, 15 bp, Homo sapiens
tagagctagctgcca

SEQ ID NO: 1489208 - DNA, 16 bp, Homo sapiens
tagagctagctgccac

SEQ ID NO: 1489209 - DNA, 18 bp, Homo sapiens
tagagctgatccagagca

SEQ ID NO: 1489210 - DNA, 11 bp, Homo sapiens
tagagctgcca

SEQ ID NO: 1489211 - DNA, 14 bp, Homo sapiens
tagagctgccactg

SEQ ID NO: 1489212 - DNA, 17 bp, Homo sapiens
tagagctgccactgggc

SEQ ID NO: 1489213 - DNA, 22 bp, Homo sapiens
tagagcttccaaatgtgtcaga

SEQ ID NO: 1489214 - DNA, 17 bp, Homo sapiens
tagagctttcaagtaca

SEQ ID NO: 1489215 - DNA, 12 bp, Homo sapiens
tagagctttctt

SEQ ID NO: 1489216 - DNA, 15 bp, Homo sapiens
tagagctttttaata

SEQ ID NO: 1489217 - DNA, 12 bp, Homo sapiens
tagaggaaaagg

SEQ ID NO: 1489218 - DNA, 12 bp, Homo sapiens
tagaggaaaggg

SEQ ID NO: 1489219 - DNA, 21 bp, Homo sapiens
tagaggaaggctgaactcttc

SEQ ID NO: 1489220 - DNA, 15 bp, Homo sapiens
tagaggcattgttag

SEQ ID NO: 1489221 - DNA, 15 bp, Homo sapiens
tagaggccagcctgg

SEQ ID NO: 1489222 - DNA, 16 bp, Homo sapiens
tagaggccagcctggc

SEQ ID NO: 1489223 - DNA, 18 bp, Homo sapiens
tagaggcccaggcaccac

SEQ ID NO: 1489224 - DNA, 23 bp, Homo sapiens
tagaggcctgaggatgagctgga

SEQ ID NO: 1489225 - DNA, 17 bp, Homo sapiens
tagaggcgagccaggca

SEQ ID NO: 1489226 - DNA, 18 bp, Homo sapiens
tagaggcttctccgccag

SEQ ID NO: 1489227 - DNA, 22 bp, Homo sapiens
tagagggacggccaagaatgta

SEQ ID NO: 1489228 - DNA, 23 bp, Homo sapiens
tagagggagacttgttctagaga

SEQ ID NO: 1489229 - DNA, 12 bp, Homo sapiens
tagagggcccat

SEQ ID NO: 1489230 - DNA, 15 bp, Homo sapiens
tagagggcccatcag

SEQ ID NO: 1489231 - DNA, 17 bp, Homo sapiens
tagaggtcctctggagc

SEQ ID NO: 1489232 - DNA, 18 bp, Homo sapiens
tagaggtcctctggagcc

SEQ ID NO: 1489233 - DNA, 14 bp, Homo sapiens
tagaggtgggcagc

SEQ ID NO: 1489234 - DNA, 20 bp, Homo sapiens
tagaggtgggcagctgggcc

SEQ ID NO: 1489235 - DNA, 20 bp, Homo sapiens
tagagtatttcccttccaaa

SEQ ID NO: 1489236 - DNA, 21 bp, Homo sapiens
tagagtcaactacacaaagca

SEQ ID NO: 1489237 - DNA, 13 bp, Homo sapiens
tagagtcagcctt

SEQ ID NO: 1489238 - DNA, 14 bp, Homo sapiens
tagagtcagccttc

SEQ ID NO: 1489239 - DNA, 21 bp, Homo sapiens
tagagtcatctccatcagctg

SEQ ID NO: 1489240 - DNA, 21 bp, Homo sapiens
tagagtccttaagacggaagt

SEQ ID NO: 1489241 - DNA, 20 bp, Homo sapiens
tagagtgtagcctaaagggc

SEQ ID NO: 1489242 - DNA, 22 bp, Homo sapiens
tagagtgtagcctaaagggcag

SEQ ID NO: 1489243 - DNA, 15 bp, Homo sapiens
tagagttaacaatga

SEQ ID NO: 1489244 - DNA, 13 bp, Homo sapiens
tagagttgctgag

SEQ ID NO: 1489245 - DNA, 16 bp, Homo sapiens
tagagttgctgagagg

SEQ ID NO: 1489246 - DNA, 16 bp, Homo sapiens
tagagtttatacagtg

SEQ ID NO: 1489247 - DNA, 15 bp, Homo sapiens
tagataaaaagatgg

SEQ ID NO: 1489248 - DNA, 15 bp, Homo sapiens
tagataaacacaggc

SEQ ID NO: 1489249 - DNA, 20 bp, Homo sapiens
tagataacgaagtgcactta

SEQ ID NO: 1489250 - DNA, 13 bp, Homo sapiens
tagataatattgt

SEQ ID NO: 1489251 - DNA, 17 bp, Homo sapiens
tagatacgaaatcagtt

SEQ ID NO: 1489252 - DNA, 19 bp, Homo sapiens
tagatacgaaatcagtttc

SEQ ID NO: 1489253 - DNA, 23 bp, Homo sapiens
tagatataaatttttaagagaaa

SEQ ID NO: 1489254 - DNA, 15 bp, Homo sapiens
tagatatgaaagctg

SEQ ID NO: 1489255 - DNA, 22 bp, Homo sapiens
tagatatgtattcttttctcag

SEQ ID NO: 1489256 - DNA, 13 bp, Homo sapiens
tagatattgtttt

SEQ ID NO: 1489257 - DNA, 18 bp, Homo sapiens
tagatattgttttctgta

SEQ ID NO: 1489258 - DNA, 16 bp, Homo sapiens
tagatcacgagatcaa

SEQ ID NO: 1489259 - DNA, 20 bp, Homo sapiens
tagatcagatgctccaagat

SEQ ID NO: 1489260 - DNA, 23 bp, Homo sapiens
tagatcagatgctccaagattct

SEQ ID NO: 1489261 - DNA, 12 bp, Homo sapiens
tagatcaggttt

SEQ ID NO: 1489262 - DNA, 17 bp, Homo sapiens
tagatcaggtttgccca

SEQ ID NO: 1489263 - DNA, 14 bp, Homo sapiens
tagatcataaggct

SEQ ID NO: 1489264 - DNA, 22 bp, Homo sapiens
tagatcctgcaccccagcattc

SEQ ID NO: 1489265 - DNA, 22 bp, Homo sapiens
tagatcgatgatatgaccagaa

SEQ ID NO: 1489266 - DNA, 21 bp, Homo sapiens
tagatctgatggtgagctggg

SEQ ID NO: 1489267 - DNA, 15 bp, Homo sapiens
tagatctgcaggctg

SEQ ID NO: 1489268 - DNA, 19 bp, Homo sapiens
tagatctgcaggctgcacc

SEQ ID NO: 1489269 - DNA, 13 bp, Homo sapiens
tagatcttctgaa

SEQ ID NO: 1489270 - DNA, 14 bp, Homo sapiens
tagatgatgtattt

SEQ ID NO: 1489271 - DNA, 20 bp, Homo sapiens
tagatgattaaataagattc

SEQ ID NO: 1489272 - DNA, 23 bp, Homo sapiens
tagatgattaaataagattctaa

SEQ ID NO: 1489273 - DNA, 19 bp, Homo sapiens
tagatgcaagatatttata

SEQ ID NO: 1489274 - DNA, 15 bp, Homo sapiens
tagatgctggcccag

SEQ ID NO: 1489275 - DNA, 16 bp, Homo sapiens
tagatgctggcccagg

SEQ ID NO: 1489276 - DNA, 22 bp, Homo sapiens
tagatgctggcccagggcccag

SEQ ID NO: 1489277 - DNA, 16 bp, Homo sapiens
tagatggaatttggaa

SEQ ID NO: 1489278 - DNA, 14 bp, Homo sapiens
tagatggattctcc

SEQ ID NO: 1489279 - DNA, 16 bp, Homo sapiens
tagatgggcatttttt

SEQ ID NO: 1489280 - DNA, 18 bp, Homo sapiens
tagatgggggaactgtga

SEQ ID NO: 1489281 - DNA, 12 bp, Homo sapiens
tagatgtatata

SEQ ID NO: 1489282 - DNA, 21 bp, Homo sapiens
taggaggctgcatgctctgga

SEQ ID NO: 1489283 - DNA, 16 bp, Homo sapiens
taggagggtgggaagg

SEQ ID NO: 1489284 - DNA, 15 bp, Homo sapiens
taggagtatttttgg

SEQ ID NO: 1489285 - DNA, 15 bp, Homo sapiens
taggagttcatagaa

SEQ ID NO: 1489286 - DNA, 19 bp, Homo sapiens
taggagttcatagaaggga

SEQ ID NO: 1489287 - DNA, 21 bp, Homo sapiens
taggagttcatagaagggagt

SEQ ID NO: 1489288 - DNA, 17 bp, Homo sapiens
taggagttcgagaccag

SEQ ID NO: 1489289 - DNA, 21 bp, Homo sapiens
taggagttcgagaccagcctg

SEQ ID NO: 1489290 - DNA, 21 bp, Homo sapiens
taggagttttgttccagagga

SEQ ID NO: 1489291 - DNA, 19 bp, Homo sapiens
taggatagctaactgtaaa

SEQ ID NO: 1489292 - DNA, 16 bp, Homo sapiens
taggatattgctaatt

SEQ ID NO: 1489293 - DNA, 18 bp, Homo sapiens
taggatattgctaattgt

SEQ ID NO: 1489294 - DNA, 20 bp, Homo sapiens
taggatattgctaattgtgt

SEQ ID NO: 1489295 - DNA, 18 bp, Homo sapiens
taggatctgcaaacaatg

SEQ ID NO: 1489296 - DNA, 21 bp, Homo sapiens
taggatgattccgtgtgtgta

SEQ ID NO: 1489297 - DNA, 14 bp, Homo sapiens
taggatgctgcagc

SEQ ID NO: 1489298 - DNA, 16 bp, Homo sapiens
taggatggttctgtga

SEQ ID NO: 1489299 - DNA, 13 bp, Homo sapiens
taggattcagatc

SEQ ID NO: 1489300 - DNA, 12 bp, Homo sapiens
taggattcaggc

SEQ ID NO: 1489301 - DNA, 22 bp, Homo sapiens
taggattttcacattcttggct

SEQ ID NO: 1489302 - DNA, 13 bp, Homo sapiens
taggatttttaga

SEQ ID NO: 1489303 - DNA, 18 bp, Homo sapiens
taggcaacctttattttt

SEQ ID NO: 1489304 - DNA, 20 bp, Homo sapiens
taggcacctccccgctctcc

SEQ ID NO: 1489305 - DNA, 22 bp, Homo sapiens
taggcacctccccgctctccct

SEQ ID NO: 1489306 - DNA, 13 bp, Homo sapiens
taggcagcagctt

SEQ ID NO: 1489307 - DNA, 15 bp, Homo sapiens
taggcagccacggcc

SEQ ID NO: 1489308 - DNA, 16 bp, Homo sapiens
taggcagcctctctgc

SEQ ID NO: 1489309 - DNA, 19 bp, Homo sapiens
taggcagcctctctgctat

SEQ ID NO: 1489310 - DNA, 18 bp, Homo sapiens
taggcatacactgtagtt

SEQ ID NO: 1489311 - DNA, 16 bp, Homo sapiens
taggcatcccagggga

SEQ ID NO: 1489312 - DNA, 17 bp, Homo sapiens
taggcatctctgtactt

SEQ ID NO: 1489313 - DNA, 21 bp, Homo sapiens
taggcatgtcccacccacccg

SEQ ID NO: 1489314 - DNA, 15 bp, Homo sapiens
taggcatgttatgtt

SEQ ID NO: 1489315 - DNA, 18 bp, Homo sapiens
taggcattaacacaaagg

SEQ ID NO: 1489316 - DNA, 19 bp, Homo sapiens
taggcattaacatgtttgt

SEQ ID NO: 1489317 - DNA, 20 bp, Homo sapiens
taggcatttcctgctgaacg

SEQ ID NO: 1489318 - DNA, 13 bp, Homo sapiens
taggccactcctc

SEQ ID NO: 1489319 - DNA, 20 bp, Homo sapiens
taggccatgaaaaaaatgat

SEQ ID NO: 1489320 - DNA, 23 bp, Homo sapiens
taggccatgggtggaaagtgctc

SEQ ID NO: 1489321 - DNA, 23 bp, Homo sapiens
taggcccccaaattgccttcagc

SEQ ID NO: 1489322 - DNA, 19 bp, Homo sapiens
taggcccccacttgcctct

SEQ ID NO: 1489323 - DNA, 19 bp, Homo sapiens
taggccctggttcctgctg

SEQ ID NO: 1489324 - DNA, 15 bp, Homo sapiens
taggcccttgtcctg

SEQ ID NO: 1489325 - DNA, 18 bp, Homo sapiens
taggcccttgtcctgcca

SEQ ID NO: 1489326 - DNA, 21 bp, Homo sapiens
taggcccttgtcctgccagct

SEQ ID NO: 1489327 - DNA, 23 bp, Homo sapiens
taggcctataaaattaaatgcct

SEQ ID NO: 1489328 - DNA, 16 bp, Homo sapiens
taggcctctctgcctg

SEQ ID NO: 1489329 - DNA, 20 bp, Homo sapiens
taggcctgggtgctggctgc

SEQ ID NO: 1489330 - DNA, 22 bp, Homo sapiens
taggccttaacacactggccat

SEQ ID NO: 1489331 - DNA, 15 bp, Homo sapiens
taggcggtcatgtgt

SEQ ID NO: 1489332 - DNA, 14 bp, Homo sapiens
taggctattcacaa

SEQ ID NO: 1489333 - DNA, 16 bp, Homo sapiens
taggctatttgtaaat

SEQ ID NO: 1489334 - DNA, 22 bp, Homo sapiens
taggctctatttaactgagtca

SEQ ID NO: 1489335 - DNA, 15 bp, Homo sapiens
taggctctgcacaga

SEQ ID NO: 1489336 - DNA, 18 bp, Homo sapiens
taggctctgcacagatgg

SEQ ID NO: 1489337 - DNA, 20 bp, Homo sapiens
taggctctgcacagatggat

SEQ ID NO: 1489338 - DNA, 19 bp, Homo sapiens
taggctcttaagcagcatg

SEQ ID NO: 1489339 - DNA, 21 bp, Homo sapiens
taggctcttaagcagcatgga

SEQ ID NO: 1489340 - DNA, 21 bp, Homo sapiens
taggctgccccgggtccccag

SEQ ID NO: 1489341 - DNA, 21 bp, Homo sapiens
taggctgggcctcccctgggc

SEQ ID NO: 1489342 - DNA, 21 bp, Homo sapiens
taggctgtaactactttataa

SEQ ID NO: 1489343 - DNA, 12 bp, Homo sapiens
taggctgtattt

SEQ ID NO: 1489344 - DNA, 16 bp, Homo sapiens
taggctgtattttctt

SEQ ID NO: 1489345 - DNA, 23 bp, Homo sapiens
tagggaaaccttggagaggagag

SEQ ID NO: 1489346 - DNA, 13 bp, Homo sapiens
tagggaaatgaaa

SEQ ID NO: 1489347 - DNA, 15 bp, Homo sapiens
tagggaactggggaa

SEQ ID NO: 1489348 - DNA, 19 bp, Homo sapiens
tagggaagctggcctgaga

SEQ ID NO: 1489349 - DNA, 16 bp, Homo sapiens
tagggaatctggatta

SEQ ID NO: 1489350 - DNA, 14 bp, Homo sapiens
tagggacttaaaaa

SEQ ID NO: 1489351 - DNA, 14 bp, Homo sapiens
tagggagagaagat

SEQ ID NO: 1489352 - DNA, 15 bp, Homo sapiens
tagggagagaagata

SEQ ID NO: 1489353 - DNA, 16 bp, Homo sapiens
tagggagagagaagca

SEQ ID NO: 1489354 - DNA, 17 bp, Homo sapiens
tagggagagagaagcag

SEQ ID NO: 1489355 - DNA, 20 bp, Homo sapiens
tagggatgcggatcctgctg

SEQ ID NO: 1489356 - DNA, 20 bp, Homo sapiens
tagggcaccaggggtttctc

SEQ ID NO: 1489357 - DNA, 14 bp, Homo sapiens
tagggcactgggct

SEQ ID NO: 1489358 - DNA, 15 bp, Homo sapiens
tagggcactgggctg

SEQ ID NO: 1489359 - DNA, 18 bp, Homo sapiens
tagggcctgcatggagaa

SEQ ID NO: 1489360 - DNA, 16 bp, Homo sapiens
tagggccttttctgtg

SEQ ID NO: 1489361 - DNA, 16 bp, Homo sapiens
tagggctgcttttctt

SEQ ID NO: 1489362 - DNA, 23 bp, Homo sapiens
taggggacacttccctctgtttc

SEQ ID NO: 1489363 - DNA, 16 bp, Homo sapiens
taggggccacctcctc

SEQ ID NO: 1489364 - DNA, 17 bp, Homo sapiens
taggggccacctcctcc

SEQ ID NO: 1489365 - DNA, 22 bp, Homo sapiens
taggggccacctcctccccctg

SEQ ID NO: 1489366 - DNA, 15 bp, Homo sapiens
taggggttctattta

SEQ ID NO: 1489367 - DNA, 15 bp, Homo sapiens
taggggtttctgttg

SEQ ID NO: 1489368 - DNA, 16 bp, Homo sapiens
tagggtaaatcagtaa

SEQ ID NO: 1489369 - DNA, 18 bp, Homo sapiens
tagggtaaggtgccttct

SEQ ID NO: 1489370 - DNA, 13 bp, Homo sapiens
tagggtacatgtg

SEQ ID NO: 1489371 - DNA, 13 bp, Homo sapiens
tagggtagaatga

SEQ ID NO: 1489372 - DNA, 18 bp, Homo sapiens
tagggtagaatgattaat

SEQ ID NO: 1489373 - DNA, 13 bp, Homo sapiens
tagggtctttctt

SEQ ID NO: 1489374 - DNA, 17 bp, Homo sapiens
tagggtctttcttggga

SEQ ID NO: 1489375 - DNA, 15 bp, Homo sapiens
tagggtggcactggg

SEQ ID NO: 1489376 - DNA, 16 bp, Homo sapiens
tagggtggctttaatt

SEQ ID NO: 1489377 - DNA, 19 bp, Homo sapiens
tagggtggctttaattgta

SEQ ID NO: 1489378 - DNA, 15 bp, Homo sapiens
tagggttaaatggta

SEQ ID NO: 1489379 - DNA, 11 bp, Homo sapiens
taggtaaatct

SEQ ID NO: 1489380 - DNA, 19 bp, Homo sapiens
taggtaaatgtatttaatt

SEQ ID NO: 1489381 - DNA, 18 bp, Homo sapiens
taggtattacaagtaatg

SEQ ID NO: 1489382 - DNA, 20 bp, Homo sapiens
taggtcactggctctccaag

SEQ ID NO: 1489383 - DNA, 21 bp, Homo sapiens
taggtcactggctctccaagt

SEQ ID NO: 1489384 - DNA, 24 bp, Homo sapiens
taggtcactggctctccaagtgcc

SEQ ID NO: 1489385 - DNA, 16 bp, Homo sapiens
taggtcatcatgaaag

SEQ ID NO: 1489386 - DNA, 19 bp, Homo sapiens
taggtcccggccagctctg

SEQ ID NO: 1489387 - DNA, 15 bp, Homo sapiens
taggtcctttagaaa

SEQ ID NO: 1489388 - DNA, 13 bp, Homo sapiens
taggtctcatctc

SEQ ID NO: 1489389 - DNA, 20 bp, Homo sapiens
taggtgatgtttccagctgc

SEQ ID NO: 1489390 - DNA, 22 bp, Homo sapiens
taggtgatgtttgctcttgttt

SEQ ID NO: 1489391 - DNA, 20 bp, Homo sapiens
taggtgctacaaaaacacag

SEQ ID NO: 1489392 - DNA, 19 bp, Homo sapiens
taggtgtcccccaccccca

SEQ ID NO: 1489393 - DNA, 21 bp, Homo sapiens
taggtgtctgccttcacaaat

SEQ ID NO: 1489394 - DNA, 22 bp, Homo sapiens
taggtgtctgccttcacaaatg

SEQ ID NO: 1489395 - DNA, 22 bp, Homo sapiens
taggtgttaggcatgtcccacc

SEQ ID NO: 1489396 - DNA, 17 bp, Homo sapiens
tataaaatcctgtgcaa

SEQ ID NO: 1489397 - DNA, 12 bp, Homo sapiens
tataaaatgaaa

SEQ ID NO: 1489398 - DNA, 14 bp, Homo sapiens
tataaaatgaaaga

SEQ ID NO: 1489399 - DNA, 12 bp, Homo sapiens
tataaaatgtgc

SEQ ID NO: 1489400 - DNA, 15 bp, Homo sapiens
tataaaattaagcaa

SEQ ID NO: 1489401 - DNA, 18 bp, Homo sapiens
tataaacaaagattcatg

SEQ ID NO: 1489402 - DNA, 21 bp, Homo sapiens
tataaacagaaatggaaagca

SEQ ID NO: 1489403 - DNA, 15 bp, Homo sapiens
tataaacatattttt

SEQ ID NO: 1489404 - DNA, 18 bp, Homo sapiens
tataaacatatttttata

SEQ ID NO: 1489405 - DNA, 21 bp, Homo sapiens
tataaacatatttttatactt

SEQ ID NO: 1489406 - DNA, 17 bp, Homo sapiens
tataaacatcacacaca

SEQ ID NO: 1489407 - DNA, 15 bp, Homo sapiens
tataaacctgacctc

SEQ ID NO: 1489408 - DNA, 16 bp, Homo sapiens
tataaactataaactt

SEQ ID NO: 1489409 - DNA, 23 bp, Homo sapiens
tataaacttagtgcggacaagtt

SEQ ID NO: 1489410 - DNA, 10 bp, Homo sapiens
tataaagaca

SEQ ID NO: 1489411 - DNA, 22 bp, Homo sapiens
tataaagacaagtatgaatatt

SEQ ID NO: 1489412 - DNA, 21 bp, Homo sapiens
tataaagcctgtattctcaaa

SEQ ID NO: 1489413 - DNA, 16 bp, Homo sapiens
tataaaggttgacaat

SEQ ID NO: 1489414 - DNA, 19 bp, Homo sapiens
tataaagtacccatctagt

SEQ ID NO: 1489415 - DNA, 15 bp, Homo sapiens
tataaagtctaagca

SEQ ID NO: 1489416 - DNA, 22 bp, Homo sapiens
tataaagtctaagcaagatgtt

SEQ ID NO: 1489417 - DNA, 18 bp, Homo sapiens
tataaagttttatttgaa

SEQ ID NO: 1489418 - DNA, 20 bp, Homo sapiens
tataaagttttatttgaatg

SEQ ID NO: 1489419 - DNA, 21 bp, Homo sapiens
tataaataaaatcatgtagtt

SEQ ID NO: 1489420 - DNA, 23 bp, Homo sapiens
tataaatatcagtattctgacat

SEQ ID NO: 1489421 - DNA, 16 bp, Homo sapiens
tataaatcaatgtcac

SEQ ID NO: 1489422 - DNA, 14 bp, Homo sapiens
tataaatccagtga

SEQ ID NO: 1489423 - DNA, 13 bp, Homo sapiens
tataaatgccaga

SEQ ID NO: 1489424 - DNA, 15 bp, Homo sapiens
tataaatgccagagc

SEQ ID NO: 1489425 - DNA, 17 bp, Homo sapiens
tataaatgccagagcca

SEQ ID NO: 1489426 - DNA, 19 bp, Homo sapiens
tataaatgccagagccaac

SEQ ID NO: 1489427 - DNA, 16 bp, Homo sapiens
tataaatgtataaata

SEQ ID NO: 1489428 - DNA, 20 bp, Homo sapiens
tataaatgtataaatataca

SEQ ID NO: 1489429 - DNA, 21 bp, Homo sapiens
tataaattactatctgttgaa

SEQ ID NO: 1489430 - DNA, 15 bp, Homo sapiens
tataaatttaagcaa

SEQ ID NO: 1489431 - DNA, 17 bp, Homo sapiens
tataaatttaagcaaac

SEQ ID NO: 1489432 - DNA, 22 bp, Homo sapiens
tataaatttttaagagaaagaa

SEQ ID NO: 1489433 - DNA, 18 bp, Homo sapiens
tataacaagccaaacatt

SEQ ID NO: 1489434 - DNA, 14 bp, Homo sapiens
tataacaatcactg

SEQ ID NO: 1489435 - DNA, 22 bp, Homo sapiens
tataacacatttttttgcatgc

SEQ ID NO: 1489436 - DNA, 19 bp, Homo sapiens
tataacatatatggaagag

SEQ ID NO: 1489437 - DNA, 22 bp, Homo sapiens
tataacatgtctttcagcatta

SEQ ID NO: 1489438 - DNA, 19 bp, Homo sapiens
tataacgtgttcaatattt

SEQ ID NO: 1489439 - DNA, 20 bp, Homo sapiens
tataacgtgttcaatatttt

SEQ ID NO: 1489440 - DNA, 20 bp, Homo sapiens
tataactcatcataaaataa

SEQ ID NO: 1489441 - DNA, 16 bp, Homo sapiens
tataactgaaggagaa

SEQ ID NO: 1489442 - DNA, 12 bp, Homo sapiens
tataactgtctt

SEQ ID NO: 1489443 - DNA, 20 bp, Homo sapiens
tataactgtcttgtttcagt

SEQ ID NO: 1489444 - DNA, 11 bp, Homo sapiens
tataagaaaaa

SEQ ID NO: 1489445 - DNA, 20 bp, Homo sapiens
tataagaagcaatctttgaa

SEQ ID NO: 1489446 - DNA, 24 bp, Homo sapiens
tataagagaagtctcattcgcctt

SEQ ID NO: 1489447 - DNA, 22 bp, Homo sapiens
tataagagggcatatacagtga

SEQ ID NO: 1489448 - DNA, 18 bp, Homo sapiens
tataagatcctagatcct

SEQ ID NO: 1489449 - DNA, 19 bp, Homo sapiens
tataagcaaattgcttttt

SEQ ID NO: 1489450 - DNA, 16 bp, Homo sapiens
tataagcccactgtta

SEQ ID NO: 1489451 - DNA, 14 bp, Homo sapiens
tataagctgggaaa

SEQ ID NO: 1489452 - DNA, 17 bp, Homo sapiens
tataaggccatttcctt

SEQ ID NO: 1489453 - DNA, 13 bp, Homo sapiens
tataagggagagc

SEQ ID NO: 1489454 - DNA, 16 bp, Homo sapiens
tataaggggaaagata

SEQ ID NO: 1489455 - DNA, 21 bp, Homo sapiens
tataaggtgctctctttctgt

SEQ ID NO: 1489456 - DNA, 15 bp, Homo sapiens
tataagtagtaaatc

SEQ ID NO: 1489457 - DNA, 22 bp, Homo sapiens
tataagtgactttaaactttcc

SEQ ID NO: 1489458 - DNA, 20 bp, Homo sapiens
tataagttatttttgtacat

SEQ ID NO: 1489459 - DNA, 16 bp, Homo sapiens
tataagtttgaaggaa

SEQ ID NO: 1489460 - DNA, 16 bp, Homo sapiens
tataataaatgtacat

SEQ ID NO: 1489461 - DNA, 13 bp, Homo sapiens
tataataattgaa

SEQ ID NO: 1489462 - DNA, 11 bp, Homo sapiens
tataatacata

SEQ ID NO: 1489463 - DNA, 15 bp, Homo sapiens
tataatatatatcta

SEQ ID NO: 1489464 - DNA, 13 bp, Homo sapiens
tataatattcagc

SEQ ID NO: 1489465 - DNA, 22 bp, Homo sapiens
tataatattcagccagcttaaa

SEQ ID NO: 1489466 - DNA, 16 bp, Homo sapiens
tataatattgaaaatt

SEQ ID NO: 1489467 - DNA, 15 bp, Homo sapiens
tataatattttatct

SEQ ID NO: 1489468 - DNA, 13 bp, Homo sapiens
tataatctcaaag

SEQ ID NO: 1489469 - DNA, 16 bp, Homo sapiens
tataatcttataattg

SEQ ID NO: 1489470 - DNA, 20 bp, Homo sapiens
tataatcttccatacttctt

SEQ ID NO: 1489471 - DNA, 22 bp, Homo sapiens
tataatggaaacatttacaata

SEQ ID NO: 1489472 - DNA, 18 bp, Homo sapiens
tataatggtttcaaagat

SEQ ID NO: 1489473 - DNA, 19 bp, Homo sapiens
tataatggtttcaaagatt

SEQ ID NO: 1489474 - DNA, 14 bp, Homo sapiens
tataatgtaagctc

SEQ ID NO: 1489475 - DNA, 15 bp, Homo sapiens
tataatgtattcata

SEQ ID NO: 1489476 - DNA, 18 bp, Homo sapiens
tataatgtattcatattt

SEQ ID NO: 1489477 - DNA, 15 bp, Homo sapiens
tataatgttattcat

SEQ ID NO: 1489478 - DNA, 16 bp, Homo sapiens
tataatgttgcccagt

SEQ ID NO: 1489479 - DNA, 17 bp, Homo sapiens
tataatgttgttattta

SEQ ID NO: 1489480 - DNA, 20 bp, Homo sapiens
tataatgtttattaaatgct

SEQ ID NO: 1489481 - DNA, 22 bp, Homo sapiens
tataatgtttccctcaagaaca

SEQ ID NO: 1489482 - DNA, 15 bp, Homo sapiens
tataatgtttgctat

SEQ ID NO: 1489483 - DNA, 15 bp, Homo sapiens
tataattcaccttct

SEQ ID NO: 1489484 - DNA, 18 bp, Homo sapiens
tataattctgtactgatt

SEQ ID NO: 1489485 - DNA, 13 bp, Homo sapiens
tataattggctta

SEQ ID NO: 1489486 - DNA, 23 bp, Homo sapiens
tataattggcttaaagggatgga

SEQ ID NO: 1489487 - DNA, 16 bp, Homo sapiens
tataattgtacaaaat

SEQ ID NO: 1489488 - DNA, 23 bp, Homo sapiens
tataattgtacaaaattaagcaa

SEQ ID NO: 1489489 - DNA, 16 bp, Homo sapiens
tataattgttgcatag

SEQ ID NO: 1489490 - DNA, 16 bp, Homo sapiens
tataattgttttgcta

SEQ ID NO: 1489491 - DNA, 18 bp, Homo sapiens
tataatttaataaaaagg

SEQ ID NO: 1489492 - DNA, 19 bp, Homo sapiens
tataatttaataaaaagga

SEQ ID NO: 1489493 - DNA, 14 bp, Homo sapiens
tataatttacctaa

SEQ ID NO: 1489494 - DNA, 16 bp, Homo sapiens
tataatttacctaaga

SEQ ID NO: 1489495 - DNA, 22 bp, Homo sapiens
tataattttatgaatgtctttg

SEQ ID NO: 1489496 - DNA, 15 bp, Homo sapiens
tataattttttaaag

SEQ ID NO: 1489497 - DNA, 22 bp, Homo sapiens
tataatttttttatgttttgtt

SEQ ID NO: 1489498 - DNA, 23 bp, Homo sapiens
tatacaacaccaaaaaatatcta

SEQ ID NO: 1489499 - DNA, 16 bp, Homo sapiens
tatacaactgcctggg

SEQ ID NO: 1489500 - DNA, 12 bp, Homo sapiens
tatacactgtgt

SEQ ID NO: 1489501 - DNA, 21 bp, Homo sapiens
tatacacttacactttatgca

SEQ ID NO: 1489502 - DNA, 20 bp, Homo sapiens
tatacagctgtattgtctga

SEQ ID NO: 1489503 - DNA, 21 bp, Homo sapiens
tatacaggtcatattaatata

SEQ ID NO: 1489504 - DNA, 18 bp, Homo sapiens
tatacagtaactttatgt

SEQ ID NO: 1489505 - DNA, 21 bp, Homo sapiens
tatacagtaactttatgtgta

SEQ ID NO: 1489506 - DNA, 22 bp, Homo sapiens
tatacagtaactttatgtgtaa

SEQ ID NO: 1489507 - DNA, 14 bp, Homo sapiens
tatacagtgatata

SEQ ID NO: 1489508 - DNA, 17 bp, Homo sapiens
tatacagtgcagagcct

SEQ ID NO: 1489509 - DNA, 17 bp, Homo sapiens
tatacagtgtacatgta

SEQ ID NO: 1489510 - DNA, 20 bp, Homo sapiens
tatcaaaccctagccttgct

SEQ ID NO: 1489511 - DNA, 14 bp, Homo sapiens
tatcaaataaaata

SEQ ID NO: 1489512 - DNA, 21 bp, Homo sapiens
tatcaacactgttactttcgt

SEQ ID NO: 1489513 - DNA, 18 bp, Homo sapiens
tatcaagtccatgttatt

SEQ ID NO: 1489514 - DNA, 22 bp, Homo sapiens
tatcaagtccatgttattctct

SEQ ID NO: 1489515 - DNA, 15 bp, Homo sapiens
tatcaagtggcatgt

SEQ ID NO: 1489516 - DNA, 18 bp, Homo sapiens
tatcaatatctaatatat

SEQ ID NO: 1489517 - DNA, 22 bp, Homo sapiens
tatcaatatctaatatatatga

SEQ ID NO: 1489518 - DNA, 14 bp, Homo sapiens
tatcacaaatctta

SEQ ID NO: 1489519 - DNA, 20 bp, Homo sapiens
tatcacaaatcttaacttga

SEQ ID NO: 1489520 - DNA, 13 bp, Homo sapiens
tatcacacaatat

SEQ ID NO: 1489521 - DNA, 15 bp, Homo sapiens
tatcacacaatatag

SEQ ID NO: 1489522 - DNA, 17 bp, Homo sapiens
tatcacacttctgtgag

SEQ ID NO: 1489523 - DNA, 13 bp, Homo sapiens
tatcacaggccag

SEQ ID NO: 1489524 - DNA, 12 bp, Homo sapiens
tatcacagtgtt

SEQ ID NO: 1489525 - DNA, 20 bp, Homo sapiens
tatcacattaatctcaaaga

SEQ ID NO: 1489526 - DNA, 20 bp, Homo sapiens
tatcacattggagtcactgc

SEQ ID NO: 1489527 - DNA, 16 bp, Homo sapiens
tatcacccttccctgc

SEQ ID NO: 1489528 - DNA, 18 bp, Homo sapiens
tatcacccttccctgctc

SEQ ID NO: 1489529 - DNA, 14 bp, Homo sapiens
tatcacctcatggc

SEQ ID NO: 1489530 - DNA, 18 bp, Homo sapiens
tatcacctcattctgaac

SEQ ID NO: 1489531 - DNA, 19 bp, Homo sapiens
tatcacctcattctgaacc

SEQ ID NO: 1489532 - DNA, 16 bp, Homo sapiens
tatcacctctcttcag

SEQ ID NO: 1489533 - DNA, 15 bp, Homo sapiens
tatcacgatttgcag

SEQ ID NO: 1489534 - DNA, 18 bp, Homo sapiens
tatcactgacacaaaaag

SEQ ID NO: 1489535 - DNA, 15 bp, Homo sapiens
tatcactgtctttga

SEQ ID NO: 1489536 - DNA, 22 bp, Homo sapiens
tatcacttaaacttgcatcact

SEQ ID NO: 1489537 - DNA, 16 bp, Homo sapiens
tatcagaggtctattt

SEQ ID NO: 1489538 - DNA, 14 bp, Homo sapiens
tatcagcacgtgtg

SEQ ID NO: 1489539 - DNA, 13 bp, Homo sapiens
tatcagcctgagt

SEQ ID NO: 1489540 - DNA, 15 bp, Homo sapiens
tatcagctctctgca

SEQ ID NO: 1489541 - DNA, 14 bp, Homo sapiens
tatcagcttcagaa

SEQ ID NO: 1489542 - DNA, 21 bp, Homo sapiens
tatcagtaacccccttaaatt

SEQ ID NO: 1489543 - DNA, 22 bp, Homo sapiens
tatcagtcataactaaataaag

SEQ ID NO: 1489544 - DNA, 21 bp, Homo sapiens
tatcagtcgttttagtgtctg

SEQ ID NO: 1489545 - DNA, 23 bp, Homo sapiens
tatcagtcgttttagtgtctgac

SEQ ID NO: 1489546 - DNA, 22 bp, Homo sapiens
tatcagtgacagagttcactat

SEQ ID NO: 1489547 - DNA, 18 bp, Homo sapiens
tatcagttactcagccct

SEQ ID NO: 1489548 - DNA, 19 bp, Homo sapiens
tatcagttactcagccctg

SEQ ID NO: 1489549 - DNA, 21 bp, Homo sapiens
tatcagttgagcttcatatac

SEQ ID NO: 1489550 - DNA, 22 bp, Homo sapiens
tatcatacaaatcagttagttt

SEQ ID NO: 1489551 - DNA, 15 bp, Homo sapiens
tatcatactcttcta

SEQ ID NO: 1489552 - DNA, 18 bp, Homo sapiens
tatcatagaaatgtaact

SEQ ID NO: 1489553 - DNA, 14 bp, Homo sapiens
tatcatattattat

SEQ ID NO: 1489554 - DNA, 12 bp, Homo sapiens
tatcatgaattt

SEQ ID NO: 1489555 - DNA, 15 bp, Homo sapiens
tatcatgaattttaa

SEQ ID NO: 1489556 - DNA, 19 bp, Homo sapiens
tatcatgaattttaaagta

SEQ ID NO: 1489557 - DNA, 19 bp, Homo sapiens
tatcatgcatgtcctgtaa

SEQ ID NO: 1489558 - DNA, 19 bp, Homo sapiens
tatcatgcgttttatatct

SEQ ID NO: 1489559 - DNA, 12 bp, Homo sapiens
tatcatggaatt

SEQ ID NO: 1489560 - DNA, 12 bp, Homo sapiens
tatcatgtacct

SEQ ID NO: 1489561 - DNA, 13 bp, Homo sapiens
tatcattaaaaat

SEQ ID NO: 1489562 - DNA, 16 bp, Homo sapiens
tatcattccaattcta

SEQ ID NO: 1489563 - DNA, 17 bp, Homo sapiens
tatcattccaattctaa

SEQ ID NO: 1489564 - DNA, 20 bp, Homo sapiens
tatcatttattttttacatt

SEQ ID NO: 1489565 - DNA, 17 bp, Homo sapiens
tatccaaatctgaagat

SEQ ID NO: 1489566 - DNA, 12 bp, Homo sapiens
tatccaaggaaa

SEQ ID NO: 1489567 - DNA, 17 bp, Homo sapiens
tatccaaggaaacattt

SEQ ID NO: 1489568 - DNA, 23 bp, Homo sapiens
tatccaaggaaacattttatcat

SEQ ID NO: 1489569 - DNA, 19 bp, Homo sapiens
tatccaagtaccaatgctg

SEQ ID NO: 1489570 - DNA, 20 bp, Homo sapiens
tatccacaatagtcagaaaa

SEQ ID NO: 1489571 - DNA, 21 bp, Homo sapiens
tatccacaatagtcagaaaac

SEQ ID NO: 1489572 - DNA, 15 bp, Homo sapiens
tatccacagtactca

SEQ ID NO: 1489573 - DNA, 19 bp, Homo sapiens
tatccacagtactcacttt

SEQ ID NO: 1489574 - DNA, 18 bp, Homo sapiens
tatccacatgaaaataaa

SEQ ID NO: 1489575 - DNA, 13 bp, Homo sapiens
tatccacccagcc

SEQ ID NO: 1489576 - DNA, 20 bp, Homo sapiens
tatccacccagcccattctc

SEQ ID NO: 1489577 - DNA, 18 bp, Homo sapiens
tatccactttgcacagct

SEQ ID NO: 1489578 - DNA, 14 bp, Homo sapiens
tatccagaaaactg

SEQ ID NO: 1489579 - DNA, 17 bp, Homo sapiens
tatccagaaaactgtga

SEQ ID NO: 1489580 - DNA, 15 bp, Homo sapiens
tatccaggcaccagg

SEQ ID NO: 1489581 - DNA, 13 bp, Homo sapiens
tatccatctcctg

SEQ ID NO: 1489582 - DNA, 20 bp, Homo sapiens
tatccatctttttcttttta

SEQ ID NO: 1489583 - DNA, 13 bp, Homo sapiens
tatccatttcttc

SEQ ID NO: 1489584 - DNA, 17 bp, Homo sapiens
tatcccaaacttcggaa

SEQ ID NO: 1489585 - DNA, 18 bp, Homo sapiens
tatcccaagaatgcaaga

SEQ ID NO: 1489586 - DNA, 21 bp, Homo sapiens
tatccccatctccctgcctgg

SEQ ID NO: 1489587 - DNA, 19 bp, Homo sapiens
tatccccccatcttgcttc

SEQ ID NO: 1489588 - DNA, 15 bp, Homo sapiens
tatcccctgcctcct

SEQ ID NO: 1489589 - DNA, 14 bp, Homo sapiens
tatccctcttgtaa

SEQ ID NO: 1489590 - DNA, 14 bp, Homo sapiens
tatccctgataaat

SEQ ID NO: 1489591 - DNA, 16 bp, Homo sapiens
tatcccttccagatgg

SEQ ID NO: 1489592 - DNA, 14 bp, Homo sapiens
tatccgaaagtttc

SEQ ID NO: 1489593 - DNA, 17 bp, Homo sapiens
tatcctaattgtccaca

SEQ ID NO: 1489594 - DNA, 17 bp, Homo sapiens
tatcctctctctcttct

SEQ ID NO: 1489595 - DNA, 18 bp, Homo sapiens
tatcctctctctcttcta

SEQ ID NO: 1489596 - DNA, 14 bp, Homo sapiens
tatcctctcttcct

SEQ ID NO: 1489597 - DNA, 15 bp, Homo sapiens
tatcctctcttcctc

SEQ ID NO: 1489598 - DNA, 14 bp, Homo sapiens
tatcctgaaatttc

SEQ ID NO: 1489599 - DNA, 16 bp, Homo sapiens
tatcctgaaatttcag

SEQ ID NO: 1489600 - DNA, 12 bp, Homo sapiens
tatcctgaataa

SEQ ID NO: 1489601 - DNA, 19 bp, Homo sapiens
tatcctgattccaaatatg

SEQ ID NO: 1489602 - DNA, 11 bp, Homo sapiens
tatcctggtgc

SEQ ID NO: 1489603 - DNA, 17 bp, Homo sapiens
tatcctggtgtctagtt

SEQ ID NO: 1489604 - DNA, 13 bp, Homo sapiens
tatcctgtgactg

SEQ ID NO: 1489605 - DNA, 14 bp, Homo sapiens
tatcctgtgactgt

SEQ ID NO: 1489606 - DNA, 17 bp, Homo sapiens
tatcctgtgactgtctc

SEQ ID NO: 1489607 - DNA, 22 bp, Homo sapiens
tatccttataggcctgtccctt

SEQ ID NO: 1489608 - DNA, 23 bp, Homo sapiens
tatccttgggggctcccagggca

SEQ ID NO: 1489609 - DNA, 14 bp, Homo sapiens
tatcgagtttgcaa

SEQ ID NO: 1489610 - DNA, 22 bp, Homo sapiens
tatcgagtttgcaatgtcacaa

SEQ ID NO: 1489611 - DNA, 18 bp, Homo sapiens
tatcgccctcctttccct

SEQ ID NO: 1489612 - DNA, 16 bp, Homo sapiens
tatcgctgatgcagac

SEQ ID NO: 1489613 - DNA, 18 bp, Homo sapiens
tatcgctgatgcagacac

SEQ ID NO: 1489614 - DNA, 12 bp, Homo sapiens
tatcgtttttgt

SEQ ID NO: 1489615 - DNA, 15 bp, Homo sapiens
tatctaaaaaataac

SEQ ID NO: 1489616 - DNA, 16 bp, Homo sapiens
tatctaaaaaataact

SEQ ID NO: 1489617 - DNA, 19 bp, Homo sapiens
tatctaaaaaataactgtg

SEQ ID NO: 1489618 - DNA, 12 bp, Homo sapiens
tatctaaagtca

SEQ ID NO: 1489619 - DNA, 15 bp, Homo sapiens
tatctaaatgttgaa

SEQ ID NO: 1489620 - DNA, 18 bp, Homo sapiens
tatctaatatatatgaat

SEQ ID NO: 1489621 - DNA, 20 bp, Homo sapiens
tatctaatatatatgaataa

SEQ ID NO: 1489622 - DNA, 21 bp, Homo sapiens
tatctacaatatatattatat

SEQ ID NO: 1489623 - DNA, 21 bp, Homo sapiens
tatctacatcttttttcacaa

SEQ ID NO: 1489624 - DNA, 20 bp, Homo sapiens
tatctactgataaagaaaga

SEQ ID NO: 1489625 - DNA, 23 bp, Homo sapiens
tatggcccagaaacaacagggga

SEQ ID NO: 1489626 - DNA, 19 bp, Homo sapiens
tatggcctcagctgcctca

SEQ ID NO: 1489627 - DNA, 17 bp, Homo sapiens
tatggctataggtgcta

SEQ ID NO: 1489628 - DNA, 21 bp, Homo sapiens
tatggctgcatagtattccat

SEQ ID NO: 1489629 - DNA, 22 bp, Homo sapiens
tatgggagaagggggagtaatg

SEQ ID NO: 1489630 - DNA, 16 bp, Homo sapiens
tatgggagccccaggg

SEQ ID NO: 1489631 - DNA, 13 bp, Homo sapiens
tatgggaggcagc

SEQ ID NO: 1489632 - DNA, 16 bp, Homo sapiens
tatgggaggcagccga

SEQ ID NO: 1489633 - DNA, 14 bp, Homo sapiens
tatgggatgtaaac

SEQ ID NO: 1489634 - DNA, 13 bp, Homo sapiens
tatgggctgaagt

SEQ ID NO: 1489635 - DNA, 23 bp, Homo sapiens
tatgggcttttggggagccagaa

SEQ ID NO: 1489636 - DNA, 19 bp, Homo sapiens
tatggggatagatgtgtgg

SEQ ID NO: 1489637 - DNA, 20 bp, Homo sapiens
tatggggctgaacggggaga

SEQ ID NO: 1489638 - DNA, 15 bp, Homo sapiens
tatgggggggaggga

SEQ ID NO: 1489639 - DNA, 20 bp, Homo sapiens
tatgggtgggattttgcaaa

SEQ ID NO: 1489640 - DNA, 11 bp, Homo sapiens
tatggtaaaaa

SEQ ID NO: 1489641 - DNA, 20 bp, Homo sapiens
tatggtataatggttgactg

SEQ ID NO: 1489642 - DNA, 15 bp, Homo sapiens
tatggtattacaaaa

SEQ ID NO: 1489643 - DNA, 21 bp, Homo sapiens
tatggtatttattttttcttt

SEQ ID NO: 1489644 - DNA, 17 bp, Homo sapiens
tatggtgaagggaagtg

SEQ ID NO: 1489645 - DNA, 14 bp, Homo sapiens
tatggtgatgactt

SEQ ID NO: 1489646 - DNA, 23 bp, Homo sapiens
tatggtgtgttgtatctttgtaa

SEQ ID NO: 1489647 - DNA, 22 bp, Homo sapiens
tatggttcccaataaaagtgac

SEQ ID NO: 1489648 - DNA, 23 bp, Homo sapiens
tatggttctcagatcttgacagt

SEQ ID NO: 1489649 - DNA, 17 bp, Homo sapiens
tatgtaaacaaatcttt

SEQ ID NO: 1489650 - DNA, 21 bp, Homo sapiens
tatgtaaacaaatctttccat

SEQ ID NO: 1489651 - DNA, 18 bp, Homo sapiens
tatgtaaacataattctt

SEQ ID NO: 1489652 - DNA, 19 bp, Homo sapiens
tatgtaaactgcattagaa

SEQ ID NO: 1489653 - DNA, 23 bp, Homo sapiens
tatgtaaactgcattagaaatta

SEQ ID NO: 1489654 - DNA, 13 bp, Homo sapiens
tatgtaatataaa

SEQ ID NO: 1489655 - DNA, 17 bp, Homo sapiens
tatgtaatatattgtac

SEQ ID NO: 1489656 - DNA, 14 bp, Homo sapiens
tatgtaatgcaaaa

SEQ ID NO: 1489657 - DNA, 17 bp, Homo sapiens
tatgtaatgcaaaattt

SEQ ID NO: 1489658 - DNA, 12 bp, Homo sapiens
tatgtaattctt

SEQ ID NO: 1489659 - DNA, 15 bp, Homo sapiens
tatgtaatttatgca

SEQ ID NO: 1489660 - DNA, 17 bp, Homo sapiens
tatgtaatttatgcaag

SEQ ID NO: 1489661 - DNA, 14 bp, Homo sapiens
tatgtaatttcaaa

SEQ ID NO: 1489662 - DNA, 19 bp, Homo sapiens
tatgtaatttcaaaataca

SEQ ID NO: 1489663 - DNA, 14 bp, Homo sapiens
tatgtacatatata

SEQ ID NO: 1489664 - DNA, 15 bp, Homo sapiens
tatgtacatttctaa

SEQ ID NO: 1489665 - DNA, 16 bp, Homo sapiens
tatgtacatttctaag

SEQ ID NO: 1489666 - DNA, 21 bp, Homo sapiens
tatgtacatttctaagtcaaa

SEQ ID NO: 1489667 - DNA, 15 bp, Homo sapiens
tatgtaccatgaata

SEQ ID NO: 1489668 - DNA, 18 bp, Homo sapiens
tatgtaccatgaatattt

SEQ ID NO: 1489669 - DNA, 16 bp, Homo sapiens
tatgtacgtttgtatg

SEQ ID NO: 1489670 - DNA, 18 bp, Homo sapiens
tatgtacgtttgtatgtg

SEQ ID NO: 1489671 - DNA, 19 bp, Homo sapiens
tatgtacgtttgtatgtgt

SEQ ID NO: 1489672 - DNA, 22 bp, Homo sapiens
tatgtacgtttgtatgtgtgta

SEQ ID NO: 1489673 - DNA, 21 bp, Homo sapiens
tatgtactcctctttacactg

SEQ ID NO: 1489674 - DNA, 14 bp, Homo sapiens
tatgtagaactgtt

SEQ ID NO: 1489675 - DNA, 15 bp, Homo sapiens
tatgtagaactgttc

SEQ ID NO: 1489676 - DNA, 16 bp, Homo sapiens
tatgtagatgtgcatt

SEQ ID NO: 1489677 - DNA, 15 bp, Homo sapiens
tatgtataatatata

SEQ ID NO: 1489678 - DNA, 16 bp, Homo sapiens
tatgtatatgtatata

SEQ ID NO: 1489679 - DNA, 21 bp, Homo sapiens
tatgtatggatatatttgaaa

SEQ ID NO: 1489680 - DNA, 16 bp, Homo sapiens
tatgtatgtttacata

SEQ ID NO: 1489681 - DNA, 13 bp, Homo sapiens
tatgtattattta

SEQ ID NO: 1489682 - DNA, 19 bp, Homo sapiens
tatgtattatttacattta

SEQ ID NO: 1489683 - DNA, 21 bp, Homo sapiens
tatgtattatttacatttaat

SEQ ID NO: 1489684 - DNA, 17 bp, Homo sapiens
tatgtattatttgcaca

SEQ ID NO: 1489685 - DNA, 19 bp, Homo sapiens
tatgtattctttctgcctt

SEQ ID NO: 1489686 - DNA, 17 bp, Homo sapiens
tatgtcaatttgtatat

SEQ ID NO: 1489687 - DNA, 18 bp, Homo sapiens
tatgtcagcagctctgag

SEQ ID NO: 1489688 - DNA, 21 bp, Homo sapiens
tatgtcagtgctataaatgcc

SEQ ID NO: 1489689 - DNA, 15 bp, Homo sapiens
tatgtcatagaaata

SEQ ID NO: 1489690 - DNA, 17 bp, Homo sapiens
tatgtccccataagaca

SEQ ID NO: 1489691 - DNA, 15 bp, Homo sapiens
tatgtcccttgctgt

SEQ ID NO: 1489692 - DNA, 22 bp, Homo sapiens
tatgtcgtagaattccttcgaa

SEQ ID NO: 1489693 - DNA, 23 bp, Homo sapiens
tatgtcgtagaattccttcgaaa

SEQ ID NO: 1489694 - DNA, 19 bp, Homo sapiens
tatgtctcttctgagctat

SEQ ID NO: 1489695 - DNA, 22 bp, Homo sapiens
tatgtctgctgagttggcctgg

SEQ ID NO: 1489696 - DNA, 16 bp, Homo sapiens
tatgtctgtgtatgta

SEQ ID NO: 1489697 - DNA, 16 bp, Homo sapiens
tatgtctgtttttgta

SEQ ID NO: 1489698 - DNA, 17 bp, Homo sapiens
tatgtcttcttttgtgg

SEQ ID NO: 1489699 - DNA, 20 bp, Homo sapiens
tatgtctttttttttctttt

SEQ ID NO: 1489700 - DNA, 21 bp, Homo sapiens
tatgtgaaaaattaacttttt

SEQ ID NO: 1489701 - DNA, 18 bp, Homo sapiens
tatgtgaaatgctttctg

SEQ ID NO: 1489702 - DNA, 14 bp, Homo sapiens
tatgtgaacattta

SEQ ID NO: 1489703 - DNA, 16 bp, Homo sapiens
tatgtgagtgcctttt

SEQ ID NO: 1489704 - DNA, 16 bp, Homo sapiens
tatgtgcgtctctctt

SEQ ID NO: 1489705 - DNA, 19 bp, Homo sapiens
tatgtgctagaacaatggg

SEQ ID NO: 1489706 - DNA, 14 bp, Homo sapiens
tatgtggcagctgg

SEQ ID NO: 1489707 - DNA, 20 bp, Homo sapiens
tatgtggctgaaaatgcaaa

SEQ ID NO: 1489708 - DNA, 17 bp, Homo sapiens
tatgtgggcagattttc

SEQ ID NO: 1489709 - DNA, 23 bp, Homo sapiens
tatgtgggcagattttcagcaaa

SEQ ID NO: 1489710 - DNA, 18 bp, Homo sapiens
tatgtggttttagatttt

SEQ ID NO: 1489711 - DNA, 19 bp, Homo sapiens
tatgtggttttagattttc

SEQ ID NO: 1489712 - DNA, 14 bp, Homo sapiens
tatgtgtaaataca

SEQ ID NO: 1489713 - DNA, 20 bp, Homo sapiens
tatgtgtatgcacagtaaaa

SEQ ID NO: 1489714 - DNA, 16 bp, Homo sapiens
tatgtgtgagatatgt

SEQ ID NO: 1489715 - DNA, 15 bp, Homo sapiens
tatgtgtgaggagct

SEQ ID NO: 1489716 - DNA, 19 bp, Homo sapiens
tatgtgtggctgtgggtgt

SEQ ID NO: 1489717 - DNA, 14 bp, Homo sapiens
tatgtgtgtagaca

SEQ ID NO: 1489718 - DNA, 23 bp, Homo sapiens
tatgtgtgtgtatataaatacat

SEQ ID NO: 1489719 - DNA, 19 bp, Homo sapiens
tatgtgtgtgtatgtttgc

SEQ ID NO: 1489720 - DNA, 15 bp, Homo sapiens
tatgtgtttttcaca

SEQ ID NO: 1489721 - DNA, 17 bp, Homo sapiens
tatgtgtttttcacatt

SEQ ID NO: 1489722 - DNA, 13 bp, Homo sapiens
tatgttaaagaga

SEQ ID NO: 1489723 - DNA, 14 bp, Homo sapiens
tatgttaaagagaa

SEQ ID NO: 1489724 - DNA, 18 bp, Homo sapiens
tatgttaagctctttatg

SEQ ID NO: 1489725 - DNA, 19 bp, Homo sapiens
tatgttacatctgttttaa

SEQ ID NO: 1489726 - DNA, 16 bp, Homo sapiens
tatgttactattttct

SEQ ID NO: 1489727 - DNA, 17 bp, Homo sapiens
tatgttagattttgcat

SEQ ID NO: 1489728 - DNA, 23 bp, Homo sapiens
tatgttatacaaggcaagcattt

SEQ ID NO: 1489729 - DNA, 19 bp, Homo sapiens
tatgttcccagcagtgggg

SEQ ID NO: 1489730 - DNA, 21 bp, Homo sapiens
tatgttcctaacaaaatgaga

SEQ ID NO: 1489731 - DNA, 12 bp, Homo sapiens
tatgttcctgct

SEQ ID NO: 1489732 - DNA, 17 bp, Homo sapiens
tatgttcctgctgtatt

SEQ ID NO: 1489733 - DNA, 22 bp, Homo sapiens
tatgttcttagtggatgttctg

SEQ ID NO: 1489734 - DNA, 17 bp, Homo sapiens
tatgttgagtgttcatt

SEQ ID NO: 1489735 - DNA, 18 bp, Homo sapiens
tatgttgcctttatggtt

SEQ ID NO: 1489736 - DNA, 20 bp, Homo sapiens
tatgttgcctttatggtttc

SEQ ID NO: 1489737 - DNA, 21 bp, Homo sapiens
tatgttgctataataaagaag

SEQ ID NO: 1489738 - DNA, 20 bp, Homo sapiens
tatgttggtttaattaataa

SEQ ID NO: 1489739 - DNA, 23 bp, Homo sapiens
tatttattaaacagatttttaca

SEQ ID NO: 1489740 - DNA, 12 bp, Homo sapiens
tatttattaccg

SEQ ID NO: 1489741 - DNA, 16 bp, Homo sapiens
tatttattacctctga

SEQ ID NO: 1489742 - DNA, 19 bp, Homo sapiens
tatttattattttcacctg

SEQ ID NO: 1489743 - DNA, 20 bp, Homo sapiens
tatttattgactttgacaat

SEQ ID NO: 1489744 - DNA, 23 bp, Homo sapiens
tatttattgagtacctactgtgt

SEQ ID NO: 1489745 - DNA, 20 bp, Homo sapiens
tatttattgttagaaaatga

SEQ ID NO: 1489746 - DNA, 16 bp, Homo sapiens
tatttatttaaaagat

SEQ ID NO: 1489747 - DNA, 13 bp, Homo sapiens
tatttatttactg

SEQ ID NO: 1489748 - DNA, 13 bp, Homo sapiens
tatttatttatgg

SEQ ID NO: 1489749 - DNA, 14 bp, Homo sapiens
tatttatttatgga

SEQ ID NO: 1489750 - DNA, 23 bp, Homo sapiens
tatttattttcagtatactgtgt

SEQ ID NO: 1489751 - DNA, 21 bp, Homo sapiens
tatttattttcctaaagagag

SEQ ID NO: 1489752 - DNA, 19 bp, Homo sapiens
tatttatttttgtgtaggt

SEQ ID NO: 1489753 - DNA, 15 bp, Homo sapiens
tatttcaaaatgtcc

SEQ ID NO: 1489754 - DNA, 15 bp, Homo sapiens
tatttcaaacatcag

SEQ ID NO: 1489755 - DNA, 23 bp, Homo sapiens
tatttcaaacatcagctgaattc

SEQ ID NO: 1489756 - DNA, 14 bp, Homo sapiens
tatttcaagtgcct

SEQ ID NO: 1489757 - DNA, 20 bp, Homo sapiens
tatttcaatcttttaaattg

SEQ ID NO: 1489758 - DNA, 18 bp, Homo sapiens
tatttcactaaatgtaaa

SEQ ID NO: 1489759 - DNA, 20 bp, Homo sapiens
tatttcactaaatgtaaaat

SEQ ID NO: 1489760 - DNA, 16 bp, Homo sapiens
tatttcacttgatgat

SEQ ID NO: 1489761 - DNA, 13 bp, Homo sapiens
tatttcagacatt

SEQ ID NO: 1489762 - DNA, 20 bp, Homo sapiens
tatttcagatatcaaaattc

SEQ ID NO: 1489763 - DNA, 23 bp, Homo sapiens
tatttcagcccccatcacccaag

SEQ ID NO: 1489764 - DNA, 22 bp, Homo sapiens
tatttcagtggaatagatgtct

SEQ ID NO: 1489765 - DNA, 17 bp, Homo sapiens
tatttcagtgttacctg

SEQ ID NO: 1489766 - DNA, 21 bp, Homo sapiens
tatttcatgctgggaatgaga

SEQ ID NO: 1489767 - DNA, 13 bp, Homo sapiens
tatttcatgtttt

SEQ ID NO: 1489768 - DNA, 13 bp, Homo sapiens
tatttcatttctt

SEQ ID NO: 1489769 - DNA, 16 bp, Homo sapiens
tatttccactattttc

SEQ ID NO: 1489770 - DNA, 17 bp, Homo sapiens
tatttccactgaacaaa

SEQ ID NO: 1489771 - DNA, 23 bp, Homo sapiens
tatttccagtggtcatgctcagc

SEQ ID NO: 1489772 - DNA, 21 bp, Homo sapiens
tatttccattaaaaaatcagt

SEQ ID NO: 1489773 - DNA, 21 bp, Homo sapiens
tatttccattctttcagctgt

SEQ ID NO: 1489774 - DNA, 12 bp, Homo sapiens
tatttcccttcc

SEQ ID NO: 1489775 - DNA, 21 bp, Homo sapiens
tatttcctatagctacatgtt

SEQ ID NO: 1489776 - DNA, 19 bp, Homo sapiens
tatttcctgaacctggaaa

SEQ ID NO: 1489777 - DNA, 13 bp, Homo sapiens
tatttcctgactt

SEQ ID NO: 1489778 - DNA, 22 bp, Homo sapiens
tatttccttggattttcctgaa

SEQ ID NO: 1489779 - DNA, 18 bp, Homo sapiens
tatttcctttatgtgaat

SEQ ID NO: 1489780 - DNA, 14 bp, Homo sapiens
tatttctaagctta

SEQ ID NO: 1489781 - DNA, 22 bp, Homo sapiens
tatttctaagcttatttctaac

SEQ ID NO: 1489782 - DNA, 23 bp, Homo sapiens
tatttctaagcttatttctaact

SEQ ID NO: 1489783 - DNA, 19 bp, Homo sapiens
tatttctaatccttttcct

SEQ ID NO: 1489784 - DNA, 13 bp, Homo sapiens
tatttctagcaga

SEQ ID NO: 1489785 - DNA, 17 bp, Homo sapiens
tatttctagtccaaaat

SEQ ID NO: 1489786 - DNA, 13 bp, Homo sapiens
tatttctatctgc

SEQ ID NO: 1489787 - DNA, 17 bp, Homo sapiens
tatttctatctgcaaat

SEQ ID NO: 1489788 - DNA, 19 bp, Homo sapiens
tatttctatgacaaattca

SEQ ID NO: 1489789 - DNA, 20 bp, Homo sapiens
tatttctatgacaaattcaa

SEQ ID NO: 1489790 - DNA, 21 bp, Homo sapiens
tatttctattattaattgcaa

SEQ ID NO: 1489791 - DNA, 13 bp, Homo sapiens
tatttctctcccc

SEQ ID NO: 1489792 - DNA, 13 bp, Homo sapiens
tatttctcttgct

SEQ ID NO: 1489793 - DNA, 21 bp, Homo sapiens
tatttctgagaaggtccttaa

SEQ ID NO: 1489794 - DNA, 13 bp, Homo sapiens
tatttctgctctg

SEQ ID NO: 1489795 - DNA, 18 bp, Homo sapiens
tatttctgggtcttttgc

SEQ ID NO: 1489796 - DNA, 18 bp, Homo sapiens
tatttctggtgtatattt

SEQ ID NO: 1489797 - DNA, 19 bp, Homo sapiens
tatttcttatatatgtgaa

SEQ ID NO: 1489798 - DNA, 23 bp, Homo sapiens
tatttcttcccagaatctctgag

SEQ ID NO: 1489799 - DNA, 12 bp, Homo sapiens
tatttcttccct

SEQ ID NO: 1489800 - DNA, 20 bp, Homo sapiens
tatttcttcgtgaacataga

SEQ ID NO: 1489801 - DNA, 18 bp, Homo sapiens
tatttcttgctgcttcta

SEQ ID NO: 1489802 - DNA, 13 bp, Homo sapiens
tatttcttgtttg

SEQ ID NO: 1489803 - DNA, 14 bp, Homo sapiens
tatttctttgttat

SEQ ID NO: 1489804 - DNA, 15 bp, Homo sapiens
tatttgaaatagtat

SEQ ID NO: 1489805 - DNA, 22 bp, Homo sapiens
tatttgaaatagtatacattgt

SEQ ID NO: 1489806 - DNA, 14 bp, Homo sapiens
tatttgagaataag

SEQ ID NO: 1489807 - DNA, 22 bp, Homo sapiens
tatttgagcatgcacagctgct

SEQ ID NO: 1489808 - DNA, 19 bp, Homo sapiens
tatttgaggggtttcagaa

SEQ ID NO: 1489809 - DNA, 17 bp, Homo sapiens
tatttgattatgtatgg

SEQ ID NO: 1489810 - DNA, 20 bp, Homo sapiens
tatttgattatgtatggata

SEQ ID NO: 1489811 - DNA, 15 bp, Homo sapiens
tatttgatttctaat

SEQ ID NO: 1489812 - DNA, 16 bp, Homo sapiens
tatttgcagactagaa

SEQ ID NO: 1489813 - DNA, 16 bp, Homo sapiens
tatttgcagtatgaac

SEQ ID NO: 1489814 - DNA, 15 bp, Homo sapiens
tatttgcagttactt

SEQ ID NO: 1489815 - DNA, 19 bp, Homo sapiens
tatttgccttctactcccc

SEQ ID NO: 1489816 - DNA, 14 bp, Homo sapiens
tatttgctaatttt

SEQ ID NO: 1489817 - DNA, 11 bp, Homo sapiens
tatttgctttt

SEQ ID NO: 1489818 - DNA, 14 bp, Homo sapiens
tatttggaattaga

SEQ ID NO: 1489819 - DNA, 15 bp, Homo sapiens
tatttggaattagaa

SEQ ID NO: 1489820 - DNA, 19 bp, Homo sapiens
tatttggagtggaggcatt

SEQ ID NO: 1489821 - DNA, 23 bp, Homo sapiens
tatttggagtggaggcattgttt

SEQ ID NO: 1489822 - DNA, 17 bp, Homo sapiens
tatttgtaaatttatgt

SEQ ID NO: 1489823 - DNA, 14 bp, Homo sapiens
tatttgtacaattt

SEQ ID NO: 1489824 - DNA, 15 bp, Homo sapiens
tatttgtaggagaaa

SEQ ID NO: 1489825 - DNA, 18 bp, Homo sapiens
tatttgtataaaagtgtg

SEQ ID NO: 1489826 - DNA, 11 bp, Homo sapiens
tatttgtatta

SEQ ID NO: 1489827 - DNA, 13 bp, Homo sapiens
tatttgtattaat

SEQ ID NO: 1489828 - DNA, 14 bp, Homo sapiens
tatttgtattaata

SEQ ID NO: 1489829 - DNA, 17 bp, Homo sapiens
tatttgtattaataaag

SEQ ID NO: 1489830 - DNA, 18 bp, Homo sapiens
tatttgtattaataaagc

SEQ ID NO: 1489831 - DNA, 19 bp, Homo sapiens
tatttgtattaataaagca

SEQ ID NO: 1489832 - DNA, 21 bp, Homo sapiens
tatttgtattaataaagcatt

SEQ ID NO: 1489833 - DNA, 15 bp, Homo sapiens
tatttgtattcatga

SEQ ID NO: 1489834 - DNA, 20 bp, Homo sapiens
tatttgtatttatttccaga

SEQ ID NO: 1489835 - DNA, 12 bp, Homo sapiens
tatttgtgaata

SEQ ID NO: 1489836 - DNA, 19 bp, Homo sapiens
tatttgtgccgtaattatg

SEQ ID NO: 1489837 - DNA, 21 bp, Homo sapiens
tatttgtgttttaatttaaac

SEQ ID NO: 1489838 - DNA, 19 bp, Homo sapiens
tatttgttatatataataa

SEQ ID NO: 1489839 - DNA, 14 bp, Homo sapiens
tatttgttcagaga

SEQ ID NO: 1489840 - DNA, 20 bp, Homo sapiens
tatttgttcattatttgtgc

SEQ ID NO: 1489841 - DNA, 21 bp, Homo sapiens
tatttgtttatggtaaaaaat

SEQ ID NO: 1489842 - DNA, 13 bp, Homo sapiens
tattttaaaatat

SEQ ID NO: 1489843 - DNA, 14 bp, Homo sapiens
tattttaaaatttg

SEQ ID NO: 1489844 - DNA, 16 bp, Homo sapiens
tattttaaatataaat

SEQ ID NO: 1489845 - DNA, 20 bp, Homo sapiens
tattttaaatataaatagct

SEQ ID NO: 1489846 - DNA, 22 bp, Homo sapiens
tattttaaatatccacagtact

SEQ ID NO: 1489847 - DNA, 16 bp, Homo sapiens
tattttaacactttgt

SEQ ID NO: 1489848 - DNA, 23 bp, Homo sapiens
tattttaagactgattttaatag

SEQ ID NO: 1489849 - DNA, 21 bp, Homo sapiens
tattttaaggttgcacacagt

SEQ ID NO: 1489850 - DNA, 21 bp, Homo sapiens
tattttaataacatatctaaa

SEQ ID NO: 1489851 - DNA, 15 bp, Homo sapiens
tattttaatgaatat

SEQ ID NO: 1489852 - DNA, 14 bp, Homo sapiens
tattttaattactg

SEQ ID NO: 1489853 - DNA, 14 bp, Homo sapiens
tattttacacagaa

SEQ ID NO: 1489854 - DNA, 15 bp, Homo sapiens
tcaaatatagtatat

SEQ ID NO: 1489855 - DNA, 19 bp, Homo sapiens
tcaaatatcatttactctt

SEQ ID NO: 1489856 - DNA, 20 bp, Homo sapiens
tcaaatcaagaaacttaagg

SEQ ID NO: 1489857 - DNA, 14 bp, Homo sapiens
tcaaatcagtcagt

SEQ ID NO: 1489858 - DNA, 24 bp, Homo sapiens
tcaaatcagtcagtgcaaatgtca

SEQ ID NO: 1489859 - DNA, 16 bp, Homo sapiens
tcaaatcagtgataat

SEQ ID NO: 1489860 - DNA, 19 bp, Homo sapiens
tcaaatcagtgatctatgt

SEQ ID NO: 1489861 - DNA, 23 bp, Homo sapiens
tcaaatcagtgatctatgtttgt

SEQ ID NO: 1489862 - DNA, 11 bp, Homo sapiens
tcaaatccagt

SEQ ID NO: 1489863 - DNA, 12 bp, Homo sapiens
tcaaatccagtg

SEQ ID NO: 1489864 - DNA, 13 bp, Homo sapiens
tcaaatctattca

SEQ ID NO: 1489865 - DNA, 16 bp, Homo sapiens
tcaaatctattcagac

SEQ ID NO: 1489866 - DNA, 18 bp, Homo sapiens
tcaaatctattcagacaa

SEQ ID NO: 1489867 - DNA, 21 bp, Homo sapiens
tcaaatctgtaatcagcaata

SEQ ID NO: 1489868 - DNA, 20 bp, Homo sapiens
tcaaatctgtatatgttgta

SEQ ID NO: 1489869 - DNA, 15 bp, Homo sapiens
tcaaatgaaatgtat

SEQ ID NO: 1489870 - DNA, 16 bp, Homo sapiens
tcaaatgagtaacatt

SEQ ID NO: 1489871 - DNA, 17 bp, Homo sapiens
tcaaatgagtttaaaaa

SEQ ID NO: 1489872 - DNA, 20 bp, Homo sapiens
tcaaatgagtttaaaaaaat

SEQ ID NO: 1489873 - DNA, 22 bp, Homo sapiens
tcaaatgagtttaaaaaaataa

SEQ ID NO: 1489874 - DNA, 19 bp, Homo sapiens
tcaaatgatcctcccacct

SEQ ID NO: 1489875 - DNA, 12 bp, Homo sapiens
tcaaatgccaaa

SEQ ID NO: 1489876 - DNA, 18 bp, Homo sapiens
tcaaatgctagaaaaatt

SEQ ID NO: 1489877 - DNA, 18 bp, Homo sapiens
tcaaatgggctgctgctt

SEQ ID NO: 1489878 - DNA, 18 bp, Homo sapiens
tcaaatggggccagatcc

SEQ ID NO: 1489879 - DNA, 15 bp, Homo sapiens
tcaaatgtatgtatc

SEQ ID NO: 1489880 - DNA, 20 bp, Homo sapiens
tcaaatgttctaagtttcta

SEQ ID NO: 1489881 - DNA, 15 bp, Homo sapiens
tcaaatgtttcctta

SEQ ID NO: 1489882 - DNA, 20 bp, Homo sapiens
tcaaatgtttccttaaacat

SEQ ID NO: 1489883 - DNA, 22 bp, Homo sapiens
tcaaatgtttccttaaacatga

SEQ ID NO: 1489884 - DNA, 15 bp, Homo sapiens
tcaaattaagattct

SEQ ID NO: 1489885 - DNA, 20 bp, Homo sapiens
tcaaattaagattctctgcc

SEQ ID NO: 1489886 - DNA, 22 bp, Homo sapiens
tcaaattaagattctctgccca

SEQ ID NO: 1489887 - DNA, 14 bp, Homo sapiens
tcaaattcttctga

SEQ ID NO: 1489888 - DNA, 13 bp, Homo sapiens
tcaaatttgtaca

SEQ ID NO: 1489889 - DNA, 15 bp, Homo sapiens
tcaaatttgtgtcat

SEQ ID NO: 1489890 - DNA, 16 bp, Homo sapiens
tcaaattttttgactt

SEQ ID NO: 1489891 - DNA, 18 bp, Homo sapiens
tcaacaaactatttctta

SEQ ID NO: 1489892 - DNA, 20 bp, Homo sapiens
tcaacaaagaaacaaagatg

SEQ ID NO: 1489893 - DNA, 17 bp, Homo sapiens
tcaacaacgtgagagaa

SEQ ID NO: 1489894 - DNA, 23 bp, Homo sapiens
tcaacaatggttgaatgaataaa

SEQ ID NO: 1489895 - DNA, 22 bp, Homo sapiens
tcaacacacaacagcagatggc

SEQ ID NO: 1489896 - DNA, 18 bp, Homo sapiens
tcaacacttattttctga

SEQ ID NO: 1489897 - DNA, 12 bp, Homo sapiens
tcaacagagaag

SEQ ID NO: 1489898 - DNA, 22 bp, Homo sapiens
tcaacagagaaggcaggaatgt

SEQ ID NO: 1489899 - DNA, 16 bp, Homo sapiens
tcaacagagaggacca

SEQ ID NO: 1489900 - DNA, 22 bp, Homo sapiens
tcaacagattcagaatgagaat

SEQ ID NO: 1489901 - DNA, 14 bp, Homo sapiens
tcaacagcttccct

SEQ ID NO: 1489902 - DNA, 14 bp, Homo sapiens
tcaacagggcagca

SEQ ID NO: 1489903 - DNA, 22 bp, Homo sapiens
tcaacagtaaaccactgaaaaa

SEQ ID NO: 1489904 - DNA, 20 bp, Homo sapiens
tcaacatgttactgaccagc

SEQ ID NO: 1489905 - DNA, 14 bp, Homo sapiens
tcaacattctttgc

SEQ ID NO: 1489906 - DNA, 22 bp, Homo sapiens
tcaacatttttttttctccata

SEQ ID NO: 1489907 - DNA, 11 bp, Homo sapiens
tcaaccactgt

SEQ ID NO: 1489908 - DNA, 23 bp, Homo sapiens
tcaaccactgtaaaatgaaatta

SEQ ID NO: 1489909 - DNA, 14 bp, Homo sapiens
tcaaccagcagatg

SEQ ID NO: 1489910 - DNA, 13 bp, Homo sapiens
tcaaccatcctgg

SEQ ID NO: 1489911 - DNA, 12 bp, Homo sapiens
tcaaccctcagc

SEQ ID NO: 1489912 - DNA, 16 bp, Homo sapiens
tcaacctaagcaacag

SEQ ID NO: 1489913 - DNA, 15 bp, Homo sapiens
tcaacgcagccctgc

SEQ ID NO: 1489914 - DNA, 21 bp, Homo sapiens
tcaacggaaagtgctgtctta

SEQ ID NO: 1489915 - DNA, 23 bp, Homo sapiens
tcaactaaaaatatatctgttgg

SEQ ID NO: 1489916 - DNA, 21 bp, Homo sapiens
tcaactaaagttgtactttaa

SEQ ID NO: 1489917 - DNA, 22 bp, Homo sapiens
tcaactaaagttgtactttaaa

SEQ ID NO: 1489918 - DNA, 11 bp, Homo sapiens
tcaactcccaa

SEQ ID NO: 1489919 - DNA, 14 bp, Homo sapiens
tcaactcctgggct

SEQ ID NO: 1489920 - DNA, 16 bp, Homo sapiens
tcaactctacccctgc

SEQ ID NO: 1489921 - DNA, 23 bp, Homo sapiens
tcaactctacccctgctcccatt

SEQ ID NO: 1489922 - DNA, 12 bp, Homo sapiens
tcaactctgaag

SEQ ID NO: 1489923 - DNA, 17 bp, Homo sapiens
tcaactctgagcccata

SEQ ID NO: 1489924 - DNA, 21 bp, Homo sapiens
tcaactgagggccagggaccc

SEQ ID NO: 1489925 - DNA, 22 bp, Homo sapiens
tcaactgagggccagggaccca

SEQ ID NO: 1489926 - DNA, 22 bp, Homo sapiens
tcaactgcccctgacttaactt

SEQ ID NO: 1489927 - DNA, 20 bp, Homo sapiens
tcaactgcctactccaaaat

SEQ ID NO: 1489928 - DNA, 12 bp, Homo sapiens
tcaactgctttg

SEQ ID NO: 1489929 - DNA, 18 bp, Homo sapiens
tcaactggagcaagaagg

SEQ ID NO: 1489930 - DNA, 23 bp, Homo sapiens
tcaactggagcaagaaggaagga

SEQ ID NO: 1489931 - DNA, 17 bp, Homo sapiens
tcaactgggtccagaag

SEQ ID NO: 1489932 - DNA, 23 bp, Homo sapiens
tcaactgtcttcctcaaaataaa

SEQ ID NO: 1489933 - DNA, 16 bp, Homo sapiens
tcaacttgacaccact

SEQ ID NO: 1489934 - DNA, 13 bp, Homo sapiens
tcaactttactgt

SEQ ID NO: 1489935 - DNA, 14 bp, Homo sapiens
tcaagaaaagaatt

SEQ ID NO: 1489936 - DNA, 20 bp, Homo sapiens
tcaagaaacagccagcaaga

SEQ ID NO: 1489937 - DNA, 12 bp, Homo sapiens
tcaagaaactga

SEQ ID NO: 1489938 - DNA, 18 bp, Homo sapiens
tcaagaaactgaggaatt

SEQ ID NO: 1489939 - DNA, 23 bp, Homo sapiens
tcaagaaactgaggaattttctt

SEQ ID NO: 1489940 - DNA, 13 bp, Homo sapiens
tcaagaaaggaaa

SEQ ID NO: 1489941 - DNA, 15 bp, Homo sapiens
tcaagaaataggtta

SEQ ID NO: 1489942 - DNA, 14 bp, Homo sapiens
tcaagaagttcttt

SEQ ID NO: 1489943 - DNA, 12 bp, Homo sapiens
tcaagaatcaga

SEQ ID NO: 1489944 - DNA, 19 bp, Homo sapiens
tcaagaatctagaagatgt

SEQ ID NO: 1489945 - DNA, 14 bp, Homo sapiens
tcaagaatgaaaaa

SEQ ID NO: 1489946 - DNA, 15 bp, Homo sapiens
tcaagaatgaaaaat

SEQ ID NO: 1489947 - DNA, 21 bp, Homo sapiens
tcaagaatgaaaaatataatg

SEQ ID NO: 1489948 - DNA, 18 bp, Homo sapiens
tcaagacagggaaggatg

SEQ ID NO: 1489949 - DNA, 14 bp, Homo sapiens
tcaagaccagagac

SEQ ID NO: 1489950 - DNA, 18 bp, Homo sapiens
tcaagaccagcctgtcca

SEQ ID NO: 1489951 - DNA, 20 bp, Homo sapiens
tcaagaccaggctgcagcct

SEQ ID NO: 1489952 - DNA, 16 bp, Homo sapiens
tcaagacccctgtctt

SEQ ID NO: 1489953 - DNA, 18 bp, Homo sapiens
tcaagacctgagtatttt

SEQ ID NO: 1489954 - DNA, 17 bp, Homo sapiens
tcaagacgaggggcagg

SEQ ID NO: 1489955 - DNA, 18 bp, Homo sapiens
tcaagacgaggggcaggg

SEQ ID NO: 1489956 - DNA, 20 bp, Homo sapiens
tcaagacgaggggcagggaa

SEQ ID NO: 1489957 - DNA, 14 bp, Homo sapiens
tcaagactttagct

SEQ ID NO: 1489958 - DNA, 19 bp, Homo sapiens
tcaagactttagcttttcc

SEQ ID NO: 1489959 - DNA, 16 bp, Homo sapiens
tcaagagaaacttcaa

SEQ ID NO: 1489960 - DNA, 19 bp, Homo sapiens
tcaagagagtaatgggttt

SEQ ID NO: 1489961 - DNA, 18 bp, Homo sapiens
tcaagagatttaattaat

SEQ ID NO: 1489962 - DNA, 17 bp, Homo sapiens
tcaagagcatgcacatg

SEQ ID NO: 1489963 - DNA, 12 bp, Homo sapiens
tcaagagcctcc

SEQ ID NO: 1489964 - DNA, 22 bp, Homo sapiens
tcaagagctagaaaaataaaat

SEQ ID NO: 1489965 - DNA, 15 bp, Homo sapiens
tcaagagtccggatt

SEQ ID NO: 1489966 - DNA, 16 bp, Homo sapiens
tcaagatattaaaatg

SEQ ID NO: 1489967 - DNA, 18 bp, Homo sapiens
tcaagatattcaggtggc

SEQ ID NO: 1489968 - DNA, 15 bp, Homo sapiens
tcaagatgacagctc

SEQ ID NO: 1489969 - DNA, 23 bp, Homo sapiens
tcacagtctctttaatcttcagt

SEQ ID NO: 1489970 - DNA, 16 bp, Homo sapiens
tcacagtgcttttaag

SEQ ID NO: 1489971 - DNA, 17 bp, Homo sapiens
tcacagtgggagccagg

SEQ ID NO: 1489972 - DNA, 18 bp, Homo sapiens
tcacagtgggagccaggg

SEQ ID NO: 1489973 - DNA, 23 bp, Homo sapiens
tcacagtggtcccatttatatct

SEQ ID NO: 1489974 - DNA, 14 bp, Homo sapiens
tcacagtgtactct

SEQ ID NO: 1489975 - DNA, 13 bp, Homo sapiens
tcacagtgtgttt

SEQ ID NO: 1489976 - DNA, 11 bp, Homo sapiens
tcacagtgttt

SEQ ID NO: 1489977 - DNA, 14 bp, Homo sapiens
tcacagttcctcgc

SEQ ID NO: 1489978 - DNA, 20 bp, Homo sapiens
tcacagttcctcgccctggg

SEQ ID NO: 1489979 - DNA, 21 bp, Homo sapiens
tcacagttcctcgccctgggt

SEQ ID NO: 1489980 - DNA, 22 bp, Homo sapiens
tcacagttcctcgccctgggtc

SEQ ID NO: 1489981 - DNA, 22 bp, Homo sapiens
tcacagttgccatgtagacccc

SEQ ID NO: 1489982 - DNA, 17 bp, Homo sapiens
tcacagttggccttcag

SEQ ID NO: 1489983 - DNA, 19 bp, Homo sapiens
tcacagtttttcctggaat

SEQ ID NO: 1489984 - DNA, 17 bp, Homo sapiens
tcacataagctcagaat

SEQ ID NO: 1489985 - DNA, 20 bp, Homo sapiens
tcacataagctcagaatcca

SEQ ID NO: 1489986 - DNA, 18 bp, Homo sapiens
tcacatacaattattttt

SEQ ID NO: 1489987 - DNA, 16 bp, Homo sapiens
tcacataccctccccc

SEQ ID NO: 1489988 - DNA, 16 bp, Homo sapiens
tcacatagatgtccct

SEQ ID NO: 1489989 - DNA, 16 bp, Homo sapiens
tcacatagccaactct

SEQ ID NO: 1489990 - DNA, 18 bp, Homo sapiens
tcacatatatcaaagtga

SEQ ID NO: 1489991 - DNA, 21 bp, Homo sapiens
tcacatatctagtatgaaatt

SEQ ID NO: 1489992 - DNA, 19 bp, Homo sapiens
tcacatcagtgaggaggga

SEQ ID NO: 1489993 - DNA, 11 bp, Homo sapiens
tcacatcctgg

SEQ ID NO: 1489994 - DNA, 23 bp, Homo sapiens
tcacatcctggcctggcacatca

SEQ ID NO: 1489995 - DNA, 17 bp, Homo sapiens
tcacatcctgtgtttct

SEQ ID NO: 1489996 - DNA, 21 bp, Homo sapiens
tcacatgatgaaaaattatag

SEQ ID NO: 1489997 - DNA, 17 bp, Homo sapiens
tcacattagataaatta

SEQ ID NO: 1489998 - DNA, 19 bp, Homo sapiens
tcacattgatgtaaggact

SEQ ID NO: 1489999 - DNA, 13 bp, Homo sapiens
tcacattgcagtt

SEQ ID NO: 1490000 - DNA, 11 bp, Homo sapiens
tcacattgttt

SEQ ID NO: 1490001 - DNA, 11 bp, Homo sapiens
tcacatttaaa

SEQ ID NO: 1490002 - DNA, 19 bp, Homo sapiens
tcacatttagaaaagtgaa

SEQ ID NO: 1490003 - DNA, 17 bp, Homo sapiens
tcacatttgatgtacat

SEQ ID NO: 1490004 - DNA, 19 bp, Homo sapiens
tcacatttgatgtacatgt

SEQ ID NO: 1490005 - DNA, 23 bp, Homo sapiens
tcacatttgtgaactcaaacgat

SEQ ID NO: 1490006 - DNA, 14 bp, Homo sapiens
tcacattttccttt

SEQ ID NO: 1490007 - DNA, 17 bp, Homo sapiens
tcacattttccttttca

SEQ ID NO: 1490008 - DNA, 12 bp, Homo sapiens
tcaccaaaatat

SEQ ID NO: 1490009 - DNA, 15 bp, Homo sapiens
tcaccaacacagttg

SEQ ID NO: 1490010 - DNA, 16 bp, Homo sapiens
tcaccaagctcacagt

SEQ ID NO: 1490011 - DNA, 12 bp, Homo sapiens
tcaccaaggtga

SEQ ID NO: 1490012 - DNA, 16 bp, Homo sapiens
tcaccaatagtctctc

SEQ ID NO: 1490013 - DNA, 16 bp, Homo sapiens
tcaccaatgagcctta

SEQ ID NO: 1490014 - DNA, 19 bp, Homo sapiens
tcaccacagtaagttccta

SEQ ID NO: 1490015 - DNA, 13 bp, Homo sapiens
tcaccaccacact

SEQ ID NO: 1490016 - DNA, 16 bp, Homo sapiens
tcaccaccacactaca

SEQ ID NO: 1490017 - DNA, 14 bp, Homo sapiens
tcaccaccccctgt

SEQ ID NO: 1490018 - DNA, 22 bp, Homo sapiens
tcaccaccccctgtcccattct

SEQ ID NO: 1490019 - DNA, 16 bp, Homo sapiens
tcaccaccgcctctgg

SEQ ID NO: 1490020 - DNA, 16 bp, Homo sapiens
tcaccaccttcccagc

SEQ ID NO: 1490021 - DNA, 15 bp, Homo sapiens
tcaccacgtgcagta

SEQ ID NO: 1490022 - DNA, 16 bp, Homo sapiens
tcaccacgtggggctc

SEQ ID NO: 1490023 - DNA, 17 bp, Homo sapiens
tcaccactaccagccag

SEQ ID NO: 1490024 - DNA, 18 bp, Homo sapiens
tcaccactaccagccagc

SEQ ID NO: 1490025 - DNA, 20 bp, Homo sapiens
tcaccactaccagccagcct

SEQ ID NO: 1490026 - DNA, 16 bp, Homo sapiens
tcaccactgccccctg

SEQ ID NO: 1490027 - DNA, 14 bp, Homo sapiens
tcaccagaatttct

SEQ ID NO: 1490028 - DNA, 13 bp, Homo sapiens
tcaccagagccca

SEQ ID NO: 1490029 - DNA, 18 bp, Homo sapiens
tcaccagagcccatgctc

SEQ ID NO: 1490030 - DNA, 20 bp, Homo sapiens
tcaccagagcccatgctcaa

SEQ ID NO: 1490031 - DNA, 16 bp, Homo sapiens
tcaccagagcttctct

SEQ ID NO: 1490032 - DNA, 18 bp, Homo sapiens
tcaccagagcttctctgg

SEQ ID NO: 1490033 - DNA, 21 bp, Homo sapiens
tcaccagatttgctaatttat

SEQ ID NO: 1490034 - DNA, 15 bp, Homo sapiens
tcaccagcaacatct

SEQ ID NO: 1490035 - DNA, 12 bp, Homo sapiens
tcaccagcagca

SEQ ID NO: 1490036 - DNA, 12 bp, Homo sapiens
tcaccagctggg

SEQ ID NO: 1490037 - DNA, 15 bp, Homo sapiens
tcaccaggcctggcc

SEQ ID NO: 1490038 - DNA, 18 bp, Homo sapiens
tcaccaggcctggcctct

SEQ ID NO: 1490039 - DNA, 14 bp, Homo sapiens
tcaccaggggagga

SEQ ID NO: 1490040 - DNA, 17 bp, Homo sapiens
tcaccaggggaggagcc

SEQ ID NO: 1490041 - DNA, 18 bp, Homo sapiens
tcaccaggggaggagcct

SEQ ID NO: 1490042 - DNA, 24 bp, Homo sapiens
tcaccaggggaggagcctgtgcgt

SEQ ID NO: 1490043 - DNA, 19 bp, Homo sapiens
tcaccagtctgtctactgt

SEQ ID NO: 1490044 - DNA, 14 bp, Homo sapiens
tcaccatccacctt

SEQ ID NO: 1490045 - DNA, 14 bp, Homo sapiens
tcaccatccagtgg

SEQ ID NO: 1490046 - DNA, 15 bp, Homo sapiens
tcaccatcttggcca

SEQ ID NO: 1490047 - DNA, 11 bp, Homo sapiens
tcaccatggcc

SEQ ID NO: 1490048 - DNA, 21 bp, Homo sapiens
tcaccatgtaagcactctgga

SEQ ID NO: 1490049 - DNA, 19 bp, Homo sapiens
tcaccatgtattttgtaaa

SEQ ID NO: 1490050 - DNA, 18 bp, Homo sapiens
tcaccatgtgagctcttc

SEQ ID NO: 1490051 - DNA, 16 bp, Homo sapiens
tcaccatttggatcct

SEQ ID NO: 1490052 - DNA, 18 bp, Homo sapiens
tcacccaaacacttctgc

SEQ ID NO: 1490053 - DNA, 23 bp, Homo sapiens
tcacccaaacacttctgctttca

SEQ ID NO: 1490054 - DNA, 17 bp, Homo sapiens
tcacccacaattgcctt

SEQ ID NO: 1490055 - DNA, 12 bp, Homo sapiens
tcacccacaggg

SEQ ID NO: 1490056 - DNA, 14 bp, Homo sapiens
tcacccaccctgtg

SEQ ID NO: 1490057 - DNA, 16 bp, Homo sapiens
tcacccaccctgtggc

SEQ ID NO: 1490058 - DNA, 19 bp, Homo sapiens
tcacccagactggaatgca

SEQ ID NO: 1490059 - DNA, 21 bp, Homo sapiens
tcacccagctaatctgtaggg

SEQ ID NO: 1490060 - DNA, 20 bp, Homo sapiens
tcacccagtccccacccgcc

SEQ ID NO: 1490061 - DNA, 13 bp, Homo sapiens
tcaccccaccctt

SEQ ID NO: 1490062 - DNA, 12 bp, Homo sapiens
tcaccccatccc

SEQ ID NO: 1490063 - DNA, 12 bp, Homo sapiens
tcacccccaact

SEQ ID NO: 1490064 - DNA, 18 bp, Homo sapiens
tcacccccagctttgcta

SEQ ID NO: 1490065 - DNA, 14 bp, Homo sapiens
tcacccccatccct

SEQ ID NO: 1490066 - DNA, 22 bp, Homo sapiens
tcacccccatggccccaggccc

SEQ ID NO: 1490067 - DNA, 15 bp, Homo sapiens
tcacccccctctgct

SEQ ID NO: 1490068 - DNA, 16 bp, Homo sapiens
tcacccctagccctgg

SEQ ID NO: 1490069 - DNA, 17 bp, Homo sapiens
tcacccctagccctggt

SEQ ID NO: 1490070 - DNA, 14 bp, Homo sapiens
tcacccctcccttt

SEQ ID NO: 1490071 - DNA, 20 bp, Homo sapiens
tcacccctccctttctcccc

SEQ ID NO: 1490072 - DNA, 13 bp, Homo sapiens
tcacccctcgcca

SEQ ID NO: 1490073 - DNA, 20 bp, Homo sapiens
tcacccctcgccacctttca

SEQ ID NO: 1490074 - DNA, 13 bp, Homo sapiens
tcacccctgcact

SEQ ID NO: 1490075 - DNA, 13 bp, Homo sapiens
tcacccctgccct

SEQ ID NO: 1490076 - DNA, 14 bp, Homo sapiens
tcacccctgccctg

SEQ ID NO: 1490077 - DNA, 16 bp, Homo sapiens
tcacccctgccctggg

SEQ ID NO: 1490078 - DNA, 15 bp, Homo sapiens
tcacccctgtttctg

SEQ ID NO: 1490079 - DNA, 19 bp, Homo sapiens
tcacccgagttcctctggg

SEQ ID NO: 1490080 - DNA, 15 bp, Homo sapiens
tcaccctcatgaaaa

SEQ ID NO: 1490081 - DNA, 18 bp, Homo sapiens
tcaccctcttcctgtgat

SEQ ID NO: 1490082 - DNA, 16 bp, Homo sapiens
tcaccctgcaggactt

SEQ ID NO: 1490083 - DNA, 21 bp, Homo sapiens
tcaccctgcccgctcccaacc

SEQ ID NO: 1490084 - DNA, 13 bp, Homo sapiens
tcaccctgcctta

SEQ ID NO: 1490085 - DNA, 14 bp, Homo sapiens
tcactttagatgct

SEQ ID NO: 1490086 - DNA, 13 bp, Homo sapiens
tcactttattgct

SEQ ID NO: 1490087 - DNA, 17 bp, Homo sapiens
tcactttcacatagatg

SEQ ID NO: 1490088 - DNA, 18 bp, Homo sapiens
tcactttcacatagatgt

SEQ ID NO: 1490089 - DNA, 15 bp, Homo sapiens
tcactttgccattat

SEQ ID NO: 1490090 - DNA, 12 bp, Homo sapiens
tcacttttcctc

SEQ ID NO: 1490091 - DNA, 21 bp, Homo sapiens
tcacttttgctccgaagctac

SEQ ID NO: 1490092 - DNA, 21 bp, Homo sapiens
tcactttttatgctatttctg

SEQ ID NO: 1490093 - DNA, 14 bp, Homo sapiens
tcactttttccaaa

SEQ ID NO: 1490094 - DNA, 17 bp, Homo sapiens
tcactttttctgataaa

SEQ ID NO: 1490095 - DNA, 18 bp, Homo sapiens
tcactttttttctttttc

SEQ ID NO: 1490096 - DNA, 21 bp, Homo sapiens
tcagaaaacaacttggcattt

SEQ ID NO: 1490097 - DNA, 18 bp, Homo sapiens
tcagaaacatcagttact

SEQ ID NO: 1490098 - DNA, 19 bp, Homo sapiens
tcagaaacatgaaatgctt

SEQ ID NO: 1490099 - DNA, 13 bp, Homo sapiens
tcagaaaccagtt

SEQ ID NO: 1490100 - DNA, 18 bp, Homo sapiens
tcagaaacttgtgaagtg

SEQ ID NO: 1490101 - DNA, 23 bp, Homo sapiens
tcagaaagcctttcattttgctt

SEQ ID NO: 1490102 - DNA, 17 bp, Homo sapiens
tcagaaagtgacatttg

SEQ ID NO: 1490103 - DNA, 23 bp, Homo sapiens
tcagaaagtgcctgacacactaa

SEQ ID NO: 1490104 - DNA, 16 bp, Homo sapiens
tcagaaatacaaaaaa

SEQ ID NO: 1490105 - DNA, 13 bp, Homo sapiens
tcagaaatataac

SEQ ID NO: 1490106 - DNA, 17 bp, Homo sapiens
tcagaaatgctgcctgc

SEQ ID NO: 1490107 - DNA, 16 bp, Homo sapiens
tcagaaattggaacag

SEQ ID NO: 1490108 - DNA, 18 bp, Homo sapiens
tcagaaattggaacagaa

SEQ ID NO: 1490109 - DNA, 14 bp, Homo sapiens
tcagaaatttaatt

SEQ ID NO: 1490110 - DNA, 23 bp, Homo sapiens
tcagaaatttaattcatgtttct

SEQ ID NO: 1490111 - DNA, 14 bp, Homo sapiens
tcagaacacacaga

SEQ ID NO: 1490112 - DNA, 20 bp, Homo sapiens
tcagaacacacagactttct

SEQ ID NO: 1490113 - DNA, 22 bp, Homo sapiens
tcagaacacacagactttctgt

SEQ ID NO: 1490114 - DNA, 14 bp, Homo sapiens
tcagaacacacttt

SEQ ID NO: 1490115 - DNA, 18 bp, Homo sapiens
tcagaacattcagctctg

SEQ ID NO: 1490116 - DNA, 17 bp, Homo sapiens
tcagaacctcttcccca

SEQ ID NO: 1490117 - DNA, 20 bp, Homo sapiens
tcagaacctcttccccagaa

SEQ ID NO: 1490118 - DNA, 21 bp, Homo sapiens
tcagaactcaaatggggccag

SEQ ID NO: 1490119 - DNA, 22 bp, Homo sapiens
tcagaactcaaatggggccaga

SEQ ID NO: 1490120 - DNA, 13 bp, Homo sapiens
tcagaacttgctg

SEQ ID NO: 1490121 - DNA, 17 bp, Homo sapiens
tcagaacttgctgctgt

SEQ ID NO: 1490122 - DNA, 18 bp, Homo sapiens
tcagaacttgctgctgtc

SEQ ID NO: 1490123 - DNA, 18 bp, Homo sapiens
tcagaagaaaacaaagtt

SEQ ID NO: 1490124 - DNA, 23 bp, Homo sapiens
tcagaagaaaacaaagttctatt

SEQ ID NO: 1490125 - DNA, 12 bp, Homo sapiens
tcagaagaaatt

SEQ ID NO: 1490126 - DNA, 18 bp, Homo sapiens
tcagaagcacagaatatt

SEQ ID NO: 1490127 - DNA, 22 bp, Homo sapiens
tcagaagcctccaagcctgcct

SEQ ID NO: 1490128 - DNA, 23 bp, Homo sapiens
tcagaagcctccaagcctgcctc

SEQ ID NO: 1490129 - DNA, 13 bp, Homo sapiens
tcagaagcctgag

SEQ ID NO: 1490130 - DNA, 20 bp, Homo sapiens
tcagaaggacggcaggagtg

SEQ ID NO: 1490131 - DNA, 19 bp, Homo sapiens
tcagaaggccccagagaga

SEQ ID NO: 1490132 - DNA, 13 bp, Homo sapiens
tcagaagggctat

SEQ ID NO: 1490133 - DNA, 15 bp, Homo sapiens
tcagaaggggacctg

SEQ ID NO: 1490134 - DNA, 15 bp, Homo sapiens
tcagaagtcatcttg

SEQ ID NO: 1490135 - DNA, 18 bp, Homo sapiens
tcagaagtcatcttgcta

SEQ ID NO: 1490136 - DNA, 21 bp, Homo sapiens
tcagaagtgagctttgctgct

SEQ ID NO: 1490137 - DNA, 15 bp, Homo sapiens
tcagaagtttaaata

SEQ ID NO: 1490138 - DNA, 17 bp, Homo sapiens
tcagaagtttaaatatt

SEQ ID NO: 1490139 - DNA, 15 bp, Homo sapiens
tcagaataggaaaac

SEQ ID NO: 1490140 - DNA, 16 bp, Homo sapiens
tcagaatattttcaaa

SEQ ID NO: 1490141 - DNA, 19 bp, Homo sapiens
tcagaatattttcaaaata

SEQ ID NO: 1490142 - DNA, 15 bp, Homo sapiens
tcagaatcagaagat

SEQ ID NO: 1490143 - DNA, 15 bp, Homo sapiens
tcagaatccaaagat

SEQ ID NO: 1490144 - DNA, 22 bp, Homo sapiens
tcagaatccaagtgaacactag

SEQ ID NO: 1490145 - DNA, 18 bp, Homo sapiens
tcagaatgagaatggacg

SEQ ID NO: 1490146 - DNA, 20 bp, Homo sapiens
tcagaattaaacttttaatt

SEQ ID NO: 1490147 - DNA, 22 bp, Homo sapiens
tcagaattagagcatgggaggt

SEQ ID NO: 1490148 - DNA, 19 bp, Homo sapiens
tcagaattcggtgtgctgc

SEQ ID NO: 1490149 - DNA, 21 bp, Homo sapiens
tcagaattcggtgtgctgcca

SEQ ID NO: 1490150 - DNA, 12 bp, Homo sapiens
tcagaattctca

SEQ ID NO: 1490151 - DNA, 14 bp, Homo sapiens
tcagaattttgtat

SEQ ID NO: 1490152 - DNA, 12 bp, Homo sapiens
tcagacaacatt

SEQ ID NO: 1490153 - DNA, 17 bp, Homo sapiens
tcagacaacattatgat

SEQ ID NO: 1490154 - DNA, 20 bp, Homo sapiens
tcagacaagcactattttat

SEQ ID NO: 1490155 - DNA, 20 bp, Homo sapiens
tcagacaagtgttttggaaa

SEQ ID NO: 1490156 - DNA, 13 bp, Homo sapiens
tcagacaccaagg

SEQ ID NO: 1490157 - DNA, 18 bp, Homo sapiens
tcagacaccctctcctta

SEQ ID NO: 1490158 - DNA, 19 bp, Homo sapiens
tcagacacttcatggacca

SEQ ID NO: 1490159 - DNA, 14 bp, Homo sapiens
tcagacactttgga

SEQ ID NO: 1490160 - DNA, 17 bp, Homo sapiens
tcagacagagaggactg

SEQ ID NO: 1490161 - DNA, 15 bp, Homo sapiens
tcagacatacagctg

SEQ ID NO: 1490162 - DNA, 19 bp, Homo sapiens
tcagacatacagctgccta

SEQ ID NO: 1490163 - DNA, 21 bp, Homo sapiens
tcagacatacagctgcctacc

SEQ ID NO: 1490164 - DNA, 13 bp, Homo sapiens
tcagacattttca

SEQ ID NO: 1490165 - DNA, 14 bp, Homo sapiens
tcagacccagagaa

SEQ ID NO: 1490166 - DNA, 15 bp, Homo sapiens
tcagacccctgcctg

SEQ ID NO: 1490167 - DNA, 16 bp, Homo sapiens
tcagacccctgcctgg

SEQ ID NO: 1490168 - DNA, 18 bp, Homo sapiens
tcagaccctaccccacca

SEQ ID NO: 1490169 - DNA, 16 bp, Homo sapiens
tcagacctgtcttcca

SEQ ID NO: 1490170 - DNA, 17 bp, Homo sapiens
tcagacctgtcttccaa

SEQ ID NO: 1490171 - DNA, 17 bp, Homo sapiens
tcagacggcggccaggc

SEQ ID NO: 1490172 - DNA, 19 bp, Homo sapiens
tcagacggcggccaggcac

SEQ ID NO: 1490173 - DNA, 20 bp, Homo sapiens
tcagacggcggccaggcaca

SEQ ID NO: 1490174 - DNA, 19 bp, Homo sapiens
tcagacgtgtgacctccat

SEQ ID NO: 1490175 - DNA, 22 bp, Homo sapiens
tcagactagccactcctgccag

SEQ ID NO: 1490176 - DNA, 15 bp, Homo sapiens
tcagactcaagtacc

SEQ ID NO: 1490177 - DNA, 21 bp, Homo sapiens
tcagactcaagtacccattct

SEQ ID NO: 1490178 - DNA, 21 bp, Homo sapiens
tcagactcccattcctgaaga

SEQ ID NO: 1490179 - DNA, 16 bp, Homo sapiens
tcagactgaccccaga

SEQ ID NO: 1490180 - DNA, 15 bp, Homo sapiens
tcagactgctgggac

SEQ ID NO: 1490181 - DNA, 23 bp, Homo sapiens
tcagactgctgggactggccagg

SEQ ID NO: 1490182 - DNA, 13 bp, Homo sapiens
tcagactggccct

SEQ ID NO: 1490183 - DNA, 14 bp, Homo sapiens
tcagactggctggc

SEQ ID NO: 1490184 - DNA, 19 bp, Homo sapiens
tcagacttccaaatcctgg

SEQ ID NO: 1490185 - DNA, 19 bp, Homo sapiens
tcagagaaaatgagaaagg

SEQ ID NO: 1490186 - DNA, 20 bp, Homo sapiens
tcagagaaaatgagaaagga

SEQ ID NO: 1490187 - DNA, 23 bp, Homo sapiens
tcagagaaaatgagaaaggacag

SEQ ID NO: 1490188 - DNA, 20 bp, Homo sapiens
tcagagaaggaaaagactga

SEQ ID NO: 1490189 - DNA, 21 bp, Homo sapiens
tcagagaaggaaaagactgaa

SEQ ID NO: 1490190 - DNA, 23 bp, Homo sapiens
tcagagaatttctaccatttcag

SEQ ID NO: 1490191 - DNA, 15 bp, Homo sapiens
tcagagacaccaaac

SEQ ID NO: 1490192 - DNA, 14 bp, Homo sapiens
tcagagaccagggc

SEQ ID NO: 1490193 - DNA, 14 bp, Homo sapiens
tcagagactcaggg

SEQ ID NO: 1490194 - DNA, 22 bp, Homo sapiens
tcagagaggccttttgtttaaa

SEQ ID NO: 1490195 - DNA, 16 bp, Homo sapiens
tcagagagtgtacatc

SEQ ID NO: 1490196 - DNA, 15 bp, Homo sapiens
tcagagccagcctgg

SEQ ID NO: 1490197 - DNA, 21 bp, Homo sapiens
tcagagcccacatggccgggc

SEQ ID NO: 1490198 - DNA, 12 bp, Homo sapiens
tcagagcccagc

SEQ ID NO: 1490199 - DNA, 20 bp, Homo sapiens
tcaggaggctgaggcagaag

SEQ ID NO: 1490200 - DNA, 19 bp, Homo sapiens
tcaggaggctgaggcagga

SEQ ID NO: 1490201 - DNA, 15 bp, Homo sapiens
tcaggaggctgaggg

SEQ ID NO: 1490202 - DNA, 17 bp, Homo sapiens
tcaggaggggcagcgca

SEQ ID NO: 1490203 - DNA, 16 bp, Homo sapiens
tcaggagtctgccact

SEQ ID NO: 1490204 - DNA, 17 bp, Homo sapiens
tcaggagttagaggcca

SEQ ID NO: 1490205 - DNA, 19 bp, Homo sapiens
tcaggagttagaggccagc

SEQ ID NO: 1490206 - DNA, 21 bp, Homo sapiens
tcaggagttcaagaccagcct

SEQ ID NO: 1490207 - DNA, 12 bp, Homo sapiens
tcaggagttcct

SEQ ID NO: 1490208 - DNA, 18 bp, Homo sapiens
tcaggagtttgagaccag

SEQ ID NO: 1490209 - DNA, 20 bp, Homo sapiens
tcaggatgatacactatgaa

SEQ ID NO: 1490210 - DNA, 17 bp, Homo sapiens
tcaggatgcacatttct

SEQ ID NO: 1490211 - DNA, 19 bp, Homo sapiens
tcaggatgcacatttctgg

SEQ ID NO: 1490212 - DNA, 21 bp, Homo sapiens
tcaggatgcacatttctggat

SEQ ID NO: 1490213 - DNA, 22 bp, Homo sapiens
tcaggatgcccagggccactct

SEQ ID NO: 1490214 - DNA, 23 bp, Homo sapiens
tcaggatgctgtgatacactgaa

SEQ ID NO: 1490215 - DNA, 17 bp, Homo sapiens
tcaggcactggtggcat

SEQ ID NO: 1490216 - DNA, 18 bp, Homo sapiens
tcaggcagcaccacactg

SEQ ID NO: 1490217 - DNA, 16 bp, Homo sapiens
tcaggcagcagtgtct

SEQ ID NO: 1490218 - DNA, 19 bp, Homo sapiens
tcaggcagcagtgtctgta

SEQ ID NO: 1490219 - DNA, 14 bp, Homo sapiens
tcaggcaggtttgc

SEQ ID NO: 1490220 - DNA, 17 bp, Homo sapiens
tcaggcataggcctggg

SEQ ID NO: 1490221 - DNA, 20 bp, Homo sapiens
tcaggcataggcctgggtgc

SEQ ID NO: 1490222 - DNA, 14 bp, Homo sapiens
tcaggcattttgtt

SEQ ID NO: 1490223 - DNA, 19 bp, Homo sapiens
tcaggccccgggcttccct

SEQ ID NO: 1490224 - DNA, 21 bp, Homo sapiens
tcaggcccggcagggcgggca

SEQ ID NO: 1490225 - DNA, 20 bp, Homo sapiens
tcaggcccgtcggagctgcc

SEQ ID NO: 1490226 - DNA, 14 bp, Homo sapiens
tcaggccctctgcc

SEQ ID NO: 1490227 - DNA, 16 bp, Homo sapiens
tcaggccctctgcctg

SEQ ID NO: 1490228 - DNA, 20 bp, Homo sapiens
tcaggccctctgcctgcact

SEQ ID NO: 1490229 - DNA, 15 bp, Homo sapiens
tcaggccgaaggagg

SEQ ID NO: 1490230 - DNA, 22 bp, Homo sapiens
tcaggcctataaccccagctcc

SEQ ID NO: 1490231 - DNA, 18 bp, Homo sapiens
tcaggcctccctctctct

SEQ ID NO: 1490232 - DNA, 17 bp, Homo sapiens
tcaggcctctgcagaag

SEQ ID NO: 1490233 - DNA, 19 bp, Homo sapiens
tcaggcctctgcagaagcc

SEQ ID NO: 1490234 - DNA, 21 bp, Homo sapiens
tcaggcctctgcagaagccaa

SEQ ID NO: 1490235 - DNA, 23 bp, Homo sapiens
tcaggcctctgcagaagccaagg

SEQ ID NO: 1490236 - DNA, 22 bp, Homo sapiens
tcaggctatatgcagtccttta

SEQ ID NO: 1490237 - DNA, 11 bp, Homo sapiens
tcaggctctgc

SEQ ID NO: 1490238 - DNA, 17 bp, Homo sapiens
tcaggctctgcacagac

SEQ ID NO: 1490239 - DNA, 19 bp, Homo sapiens
tcaggctctgccctgccct

SEQ ID NO: 1490240 - DNA, 21 bp, Homo sapiens
tcaggctcttctcctttcaca

SEQ ID NO: 1490241 - DNA, 13 bp, Homo sapiens
tcaggcttcctgg

SEQ ID NO: 1490242 - DNA, 20 bp, Homo sapiens
tcaggcttcctggtgagaac

SEQ ID NO: 1490243 - DNA, 22 bp, Homo sapiens
tcaggcttcctggtgagaactg

SEQ ID NO: 1490244 - DNA, 18 bp, Homo sapiens
tcaggcttgaaatgcatt

SEQ ID NO: 1490245 - DNA, 17 bp, Homo sapiens
tcagggaagcccagctc

SEQ ID NO: 1490246 - DNA, 19 bp, Homo sapiens
tcagggaagcccagctcca

SEQ ID NO: 1490247 - DNA, 21 bp, Homo sapiens
tcagggacagagacacctgca

SEQ ID NO: 1490248 - DNA, 16 bp, Homo sapiens
tcagggaccgtccagg

SEQ ID NO: 1490249 - DNA, 20 bp, Homo sapiens
tcagggagaggtcaccagct

SEQ ID NO: 1490250 - DNA, 19 bp, Homo sapiens
tcagggcacgcaggaccag

SEQ ID NO: 1490251 - DNA, 16 bp, Homo sapiens
tcagggccagactgga

SEQ ID NO: 1490252 - DNA, 18 bp, Homo sapiens
tcagggccagactggaag

SEQ ID NO: 1490253 - DNA, 14 bp, Homo sapiens
tcagggccatgcct

SEQ ID NO: 1490254 - DNA, 17 bp, Homo sapiens
tcagggccatgctgagg

SEQ ID NO: 1490255 - DNA, 19 bp, Homo sapiens
tcagggcccaagtccctgt

SEQ ID NO: 1490256 - DNA, 18 bp, Homo sapiens
tcagggcgctcagacggc

SEQ ID NO: 1490257 - DNA, 14 bp, Homo sapiens
tcagggctcccagg

SEQ ID NO: 1490258 - DNA, 23 bp, Homo sapiens
tcagggctggagtgcgctcttgg

SEQ ID NO: 1490259 - DNA, 18 bp, Homo sapiens
tcaggggactcagccctg

SEQ ID NO: 1490260 - DNA, 16 bp, Homo sapiens
tcaggggagtcccgtc

SEQ ID NO: 1490261 - DNA, 20 bp, Homo sapiens
tcaggggagtcccgtcagga

SEQ ID NO: 1490262 - DNA, 14 bp, Homo sapiens
tcaggggctgtttg

SEQ ID NO: 1490263 - DNA, 18 bp, Homo sapiens
tcaggggctgtttgagga

SEQ ID NO: 1490264 - DNA, 21 bp, Homo sapiens
tcaggggtcaggtgtcaggcc

SEQ ID NO: 1490265 - DNA, 23 bp, Homo sapiens
tcaggggtcaggtgtcaggcccg

SEQ ID NO: 1490266 - DNA, 17 bp, Homo sapiens
tcagggtaaataggaat

SEQ ID NO: 1490267 - DNA, 18 bp, Homo sapiens
tcagggtgaactgcaaag

SEQ ID NO: 1490268 - DNA, 15 bp, Homo sapiens
tcagggtgggaagaa

SEQ ID NO: 1490269 - DNA, 13 bp, Homo sapiens
tcaggtaactttc

SEQ ID NO: 1490270 - DNA, 14 bp, Homo sapiens
tcaggtaatatacc

SEQ ID NO: 1490271 - DNA, 15 bp, Homo sapiens
tcaggtacggagaag

SEQ ID NO: 1490272 - DNA, 19 bp, Homo sapiens
tcaggtagttgcaattgaa

SEQ ID NO: 1490273 - DNA, 18 bp, Homo sapiens
tcaggtcacataaaactt

SEQ ID NO: 1490274 - DNA, 19 bp, Homo sapiens
tcaggtgatttgtatgctc

SEQ ID NO: 1490275 - DNA, 16 bp, Homo sapiens
tcaggtgccactccct

SEQ ID NO: 1490276 - DNA, 20 bp, Homo sapiens
tcaggtgccactccctgagc

SEQ ID NO: 1490277 - DNA, 22 bp, Homo sapiens
tcaggtgccttacatcttttct

SEQ ID NO: 1490278 - DNA, 23 bp, Homo sapiens
tcaggtgccttacatcttttcta

SEQ ID NO: 1490279 - DNA, 16 bp, Homo sapiens
tcaggtgtcaggcccg

SEQ ID NO: 1490280 - DNA, 18 bp, Homo sapiens
tcaggttcagtattatgt

SEQ ID NO: 1490281 - DNA, 21 bp, Homo sapiens
tcaggttccagaacagccctc

SEQ ID NO: 1490282 - DNA, 15 bp, Homo sapiens
tcaggtttgttttgt

SEQ ID NO: 1490283 - DNA, 13 bp, Homo sapiens
tcaggttttgtaa

SEQ ID NO: 1490284 - DNA, 14 bp, Homo sapiens
tcagtaaacaaatt

SEQ ID NO: 1490285 - DNA, 21 bp, Homo sapiens
tcagtaaacgggaacatgccc

SEQ ID NO: 1490286 - DNA, 17 bp, Homo sapiens
tcagtaaataactggaa

SEQ ID NO: 1490287 - DNA, 15 bp, Homo sapiens
tcagtaacataactg

SEQ ID NO: 1490288 - DNA, 19 bp, Homo sapiens
tcagtaacataactgcttc

SEQ ID NO: 1490289 - DNA, 22 bp, Homo sapiens
tcagtaacataactgcttcttg

SEQ ID NO: 1490290 - DNA, 17 bp, Homo sapiens
tcagtaacatttctgtt

SEQ ID NO: 1490291 - DNA, 18 bp, Homo sapiens
tcagtaacatttctgttc

SEQ ID NO: 1490292 - DNA, 19 bp, Homo sapiens
tcagtaataaactgtgttt

SEQ ID NO: 1490293 - DNA, 14 bp, Homo sapiens
tcagtaatatttat

SEQ ID NO: 1490294 - DNA, 24 bp, Homo sapiens
tcagtacgatcaagttgttgactg

SEQ ID NO: 1490295 - DNA, 15 bp, Homo sapiens
tcagtactgactttc

SEQ ID NO: 1490296 - DNA, 14 bp, Homo sapiens
tcagtactttttta

SEQ ID NO: 1490297 - DNA, 23 bp, Homo sapiens
tcagtacttttttaaatattttc

SEQ ID NO: 1490298 - DNA, 17 bp, Homo sapiens
tcagtagaattaccatt

SEQ ID NO: 1490299 - DNA, 20 bp, Homo sapiens
tcagtagtttgagaccagcc

SEQ ID NO: 1490300 - DNA, 19 bp, Homo sapiens
tcagtagtttgcatttcag

SEQ ID NO: 1490301 - DNA, 16 bp, Homo sapiens
tcagtataattctgta

SEQ ID NO: 1490302 - DNA, 14 bp, Homo sapiens
tcagtatactgtgt

SEQ ID NO: 1490303 - DNA, 15 bp, Homo sapiens
tcagtatactgtgtg

SEQ ID NO: 1490304 - DNA, 23 bp, Homo sapiens
tcagtatgctgcccctgtcttgc

SEQ ID NO: 1490305 - DNA, 16 bp, Homo sapiens
tcagtatgtggaagtg

SEQ ID NO: 1490306 - DNA, 20 bp, Homo sapiens
tcagtattagatgcacttaa

SEQ ID NO: 1490307 - DNA, 17 bp, Homo sapiens
tcagtattatgtagttg

SEQ ID NO: 1490308 - DNA, 13 bp, Homo sapiens
tcagtatttttta

SEQ ID NO: 1490309 - DNA, 22 bp, Homo sapiens
tcagtattttttacttttcaca

SEQ ID NO: 1490310 - DNA, 19 bp, Homo sapiens
tcagtatttttttttaatt

SEQ ID NO: 1490311 - DNA, 17 bp, Homo sapiens
tcagtcacatggcatgg

SEQ ID NO: 1490312 - DNA, 20 bp, Homo sapiens
tcagtcccctcccatctggg

SEQ ID NO: 1490313 - DNA, 22 bp, Homo sapiens
tcatctggcggaggtctctggg

SEQ ID NO: 1490314 - DNA, 20 bp, Homo sapiens
tcatctggttgaactctggt

SEQ ID NO: 1490315 - DNA, 23 bp, Homo sapiens
tcatctggttgaactctggtggc

SEQ ID NO: 1490316 - DNA, 13 bp, Homo sapiens
tcatctgtagata

SEQ ID NO: 1490317 - DNA, 19 bp, Homo sapiens
tcatctgtggagctgccac

SEQ ID NO: 1490318 - DNA, 16 bp, Homo sapiens
tcatctgttagggcct

SEQ ID NO: 1490319 - DNA, 21 bp, Homo sapiens
tcatcttcactgcaattttgt

SEQ ID NO: 1490320 - DNA, 12 bp, Homo sapiens
tcatcttcctgt

SEQ ID NO: 1490321 - DNA, 13 bp, Homo sapiens
tcatcttctggaa

SEQ ID NO: 1490322 - DNA, 15 bp, Homo sapiens
tcatcttctggaata

SEQ ID NO: 1490323 - DNA, 20 bp, Homo sapiens
tcatcttgcagcatttacta

SEQ ID NO: 1490324 - DNA, 22 bp, Homo sapiens
tcatcttgcagcatttactatg

SEQ ID NO: 1490325 - DNA, 17 bp, Homo sapiens
tcatcttggagcttttt

SEQ ID NO: 1490326 - DNA, 22 bp, Homo sapiens
tcatcttggtactactagatgt

SEQ ID NO: 1490327 - DNA, 15 bp, Homo sapiens
tcatcttgtgtttta

SEQ ID NO: 1490328 - DNA, 13 bp, Homo sapiens
tcatctttcttga

SEQ ID NO: 1490329 - DNA, 11 bp, Homo sapiens
tcatcttttat

SEQ ID NO: 1490330 - DNA, 14 bp, Homo sapiens
tcatcttttcaagg

SEQ ID NO: 1490331 - DNA, 18 bp, Homo sapiens
tcatgaaaagaggaacag

SEQ ID NO: 1490332 - DNA, 20 bp, Homo sapiens
tcatgaaacttgtttcactg

SEQ ID NO: 1490333 - DNA, 21 bp, Homo sapiens
tcatgaactggcttgtacatt

SEQ ID NO: 1490334 - DNA, 22 bp, Homo sapiens
tcatgaactggcttgtacattt

SEQ ID NO: 1490335 - DNA, 16 bp, Homo sapiens
tcatgaacttggctgt

SEQ ID NO: 1490336 - DNA, 13 bp, Homo sapiens
tcatgaatgtaaa

SEQ ID NO: 1490337 - DNA, 19 bp, Homo sapiens
tcatgaatgtaaatttgta

SEQ ID NO: 1490338 - DNA, 14 bp, Homo sapiens
tcatgaatgtgctg

SEQ ID NO: 1490339 - DNA, 21 bp, Homo sapiens
tcatgaatgtgctggtgaaca

SEQ ID NO: 1490340 - DNA, 22 bp, Homo sapiens
tcatgaatgtgctggtgaacac

SEQ ID NO: 1490341 - DNA, 17 bp, Homo sapiens
tcatgaattatataatt

SEQ ID NO: 1490342 - DNA, 16 bp, Homo sapiens
tcatgaattttaaagt

SEQ ID NO: 1490343 - DNA, 15 bp, Homo sapiens
tcatgaccagcaaat

SEQ ID NO: 1490344 - DNA, 14 bp, Homo sapiens
tcatgagcctgctg

SEQ ID NO: 1490345 - DNA, 19 bp, Homo sapiens
tcatgagcctgctggaagc

SEQ ID NO: 1490346 - DNA, 18 bp, Homo sapiens
tcatgagctgggtactga

SEQ ID NO: 1490347 - DNA, 20 bp, Homo sapiens
tcatgataccacctttactg

SEQ ID NO: 1490348 - DNA, 22 bp, Homo sapiens
tcatgataccacctttactgtg

SEQ ID NO: 1490349 - DNA, 13 bp, Homo sapiens
tcatgatccaact

SEQ ID NO: 1490350 - DNA, 17 bp, Homo sapiens
tcatgatctccctgccg

SEQ ID NO: 1490351 - DNA, 18 bp, Homo sapiens
tcatgatctccctgccgc

SEQ ID NO: 1490352 - DNA, 22 bp, Homo sapiens
tcatgatctccctgccgcctca

SEQ ID NO: 1490353 - DNA, 15 bp, Homo sapiens
tcatgatgctagcca

SEQ ID NO: 1490354 - DNA, 16 bp, Homo sapiens
tcatgattagcaagtt

SEQ ID NO: 1490355 - DNA, 17 bp, Homo sapiens
tcatgattcatgagctg

SEQ ID NO: 1490356 - DNA, 13 bp, Homo sapiens
tcatgatttataa

SEQ ID NO: 1490357 - DNA, 18 bp, Homo sapiens
tcatgcaaaagttctcat

SEQ ID NO: 1490358 - DNA, 17 bp, Homo sapiens
tcatgcaagagtttctt

SEQ ID NO: 1490359 - DNA, 20 bp, Homo sapiens
tcatgcacagtatttgtaat

SEQ ID NO: 1490360 - DNA, 20 bp, Homo sapiens
tcatgcagacaaagccctgt

SEQ ID NO: 1490361 - DNA, 23 bp, Homo sapiens
tcatgcagccgtgatcaagggaa

SEQ ID NO: 1490362 - DNA, 18 bp, Homo sapiens
tcatgccaaccccgccct

SEQ ID NO: 1490363 - DNA, 24 bp, Homo sapiens
tcatgccaaccctgggctattgct

SEQ ID NO: 1490364 - DNA, 12 bp, Homo sapiens
tcatgccagcta

SEQ ID NO: 1490365 - DNA, 21 bp, Homo sapiens
tcatgccagctacttcctcct

SEQ ID NO: 1490366 - DNA, 15 bp, Homo sapiens
tcatgccagtatttt

SEQ ID NO: 1490367 - DNA, 19 bp, Homo sapiens
tcatgccatcatgcccagc

SEQ ID NO: 1490368 - DNA, 19 bp, Homo sapiens
tcatgccatctgttttcaa

SEQ ID NO: 1490369 - DNA, 13 bp, Homo sapiens
tcatgcccacccc

SEQ ID NO: 1490370 - DNA, 19 bp, Homo sapiens
tcatgcccaccccctgccc

SEQ ID NO: 1490371 - DNA, 21 bp, Homo sapiens
tcatgcccaccccctgccctg

SEQ ID NO: 1490372 - DNA, 13 bp, Homo sapiens
tcatgcccccctc

SEQ ID NO: 1490373 - DNA, 16 bp, Homo sapiens
tcatgcccttctgatt

SEQ ID NO: 1490374 - DNA, 20 bp, Homo sapiens
tcatgctcagccttgctgct

SEQ ID NO: 1490375 - DNA, 15 bp, Homo sapiens
tcatgcttgacatac

SEQ ID NO: 1490376 - DNA, 21 bp, Homo sapiens
tcatggaaagactgggacagc

SEQ ID NO: 1490377 - DNA, 18 bp, Homo sapiens
tcatggaatggcaggtgt

SEQ ID NO: 1490378 - DNA, 17 bp, Homo sapiens
tcatggacactttgaaa

SEQ ID NO: 1490379 - DNA, 22 bp, Homo sapiens
tcatggaccagtggctggtctc

SEQ ID NO: 1490380 - DNA, 11 bp, Homo sapiens
tcatggcagct

SEQ ID NO: 1490381 - DNA, 13 bp, Homo sapiens
tcatggcagctgt

SEQ ID NO: 1490382 - DNA, 18 bp, Homo sapiens
tcatggcccaaatccagt

SEQ ID NO: 1490383 - DNA, 18 bp, Homo sapiens
tcatggcccccaggggca

SEQ ID NO: 1490384 - DNA, 19 bp, Homo sapiens
tcatggcccccaggggcag

SEQ ID NO: 1490385 - DNA, 21 bp, Homo sapiens
tcatggcccccaggggcagga

SEQ ID NO: 1490386 - DNA, 18 bp, Homo sapiens
tcatggcccctctgacct

SEQ ID NO: 1490387 - DNA, 18 bp, Homo sapiens
tcatggcgtaatgggcct

SEQ ID NO: 1490388 - DNA, 22 bp, Homo sapiens
tcatggcgtaatgggcctgccc

SEQ ID NO: 1490389 - DNA, 14 bp, Homo sapiens
tcatggcttaatgt

SEQ ID NO: 1490390 - DNA, 16 bp, Homo sapiens
tcatgggccacaaggc

SEQ ID NO: 1490391 - DNA, 24 bp, Homo sapiens
tcatgggccacaaggcacagtctt

SEQ ID NO: 1490392 - DNA, 17 bp, Homo sapiens
tcatggggatcaatttt

SEQ ID NO: 1490393 - DNA, 15 bp, Homo sapiens
tcatgggtcaagaga

SEQ ID NO: 1490394 - DNA, 21 bp, Homo sapiens
tcatgggtcccttgaaggaag

SEQ ID NO: 1490395 - DNA, 23 bp, Homo sapiens
tcatgggtcccttgaaggaagag

SEQ ID NO: 1490396 - DNA, 20 bp, Homo sapiens
tcatggtcaagttcccaact

SEQ ID NO: 1490397 - DNA, 18 bp, Homo sapiens
tcatggtcctttctggaa

SEQ ID NO: 1490398 - DNA, 19 bp, Homo sapiens
tcatggtgattccagcaag

SEQ ID NO: 1490399 - DNA, 16 bp, Homo sapiens
tcatgtaaattttgta

SEQ ID NO: 1490400 - DNA, 23 bp, Homo sapiens
tcatgtaaattttgtatgaaaaa

SEQ ID NO: 1490401 - DNA, 15 bp, Homo sapiens
tcatgtacttcctgt

SEQ ID NO: 1490402 - DNA, 17 bp, Homo sapiens
tcatgtacttcctgtgt

SEQ ID NO: 1490403 - DNA, 18 bp, Homo sapiens
tcatgtacttcctgtgta

SEQ ID NO: 1490404 - DNA, 13 bp, Homo sapiens
tcatgtacttttt

SEQ ID NO: 1490405 - DNA, 15 bp, Homo sapiens
tcatgtactttttag

SEQ ID NO: 1490406 - DNA, 17 bp, Homo sapiens
tcatgtaggttgtctaa

SEQ ID NO: 1490407 - DNA, 21 bp, Homo sapiens
tcatgtatgttcagaagaaat

SEQ ID NO: 1490408 - DNA, 22 bp, Homo sapiens
tcatgtatgttcagaagaaatt

SEQ ID NO: 1490409 - DNA, 15 bp, Homo sapiens
tcatgtatttgagca

SEQ ID NO: 1490410 - DNA, 15 bp, Homo sapiens
tcatgtcaatgacca

SEQ ID NO: 1490411 - DNA, 14 bp, Homo sapiens
tcatgtcctgtcct

SEQ ID NO: 1490412 - DNA, 15 bp, Homo sapiens
tcatgtcctgtcctg

SEQ ID NO: 1490413 - DNA, 16 bp, Homo sapiens
tcatgtcgatcctggg

SEQ ID NO: 1490414 - DNA, 14 bp, Homo sapiens
tcatgtctgaaaca

SEQ ID NO: 1490415 - DNA, 16 bp, Homo sapiens
tcatgtggctggaaga

SEQ ID NO: 1490416 - DNA, 16 bp, Homo sapiens
tcatgtgggtgagcca

SEQ ID NO: 1490417 - DNA, 14 bp, Homo sapiens
tcatgtgtgcatgt

SEQ ID NO: 1490418 - DNA, 17 bp, Homo sapiens
tcatgtgtgcatgtgag

SEQ ID NO: 1490419 - DNA, 16 bp, Homo sapiens
tcatgttaaattagaa

SEQ ID NO: 1490420 - DNA, 22 bp, Homo sapiens
tcatgttaaattagaatgaatt

SEQ ID NO: 1490421 - DNA, 14 bp, Homo sapiens
tcatgttattttat

SEQ ID NO: 1490422 - DNA, 15 bp, Homo sapiens
tcatgttcatgtgat

SEQ ID NO: 1490423 - DNA, 14 bp, Homo sapiens
tcatgtttcagtga

SEQ ID NO: 1490424 - DNA, 11 bp, Homo sapiens
tcatgtttctt

SEQ ID NO: 1490425 - DNA, 15 bp, Homo sapiens
tcatgtttcttaaat

SEQ ID NO: 1490426 - DNA, 14 bp, Homo sapiens
tcatgtttctttga

SEQ ID NO: 1490427 - DNA, 14 bp, Homo sapiens
tcatgtttgcttca

SEQ ID NO: 1490428 - DNA, 16 bp, Homo sapiens
tccaagttggactggg

SEQ ID NO: 1490429 - DNA, 16 bp, Homo sapiens
tccaatactgcccaag

SEQ ID NO: 1490430 - DNA, 17 bp, Homo sapiens
tccaatactgcccaagg

SEQ ID NO: 1490431 - DNA, 15 bp, Homo sapiens
tccaatcatgggcca

SEQ ID NO: 1490432 - DNA, 13 bp, Homo sapiens
tccaatgcattgg

SEQ ID NO: 1490433 - DNA, 19 bp, Homo sapiens
tccaatgcattggcctctg

SEQ ID NO: 1490434 - DNA, 18 bp, Homo sapiens
tccaatggggccagcact

SEQ ID NO: 1490435 - DNA, 20 bp, Homo sapiens
tccaattagtttccttttta

SEQ ID NO: 1490436 - DNA, 14 bp, Homo sapiens
tccaattccactgt

SEQ ID NO: 1490437 - DNA, 13 bp, Homo sapiens
tccaattctaaat

SEQ ID NO: 1490438 - DNA, 21 bp, Homo sapiens
tccaattgttgacagttctga

SEQ ID NO: 1490439 - DNA, 17 bp, Homo sapiens
tccaatttacatactct

SEQ ID NO: 1490440 - DNA, 12 bp, Homo sapiens
tccaatttcccc

SEQ ID NO: 1490441 - DNA, 22 bp, Homo sapiens
tccaatttgtaaaaacagcatt

SEQ ID NO: 1490442 - DNA, 23 bp, Homo sapiens
tccaatttgtaagtaacacagta

SEQ ID NO: 1490443 - DNA, 18 bp, Homo sapiens
tccaattttctggaatac

SEQ ID NO: 1490444 - DNA, 16 bp, Homo sapiens
tccacaagattcccag

SEQ ID NO: 1490445 - DNA, 21 bp, Homo sapiens
tccacaagattcccagagaca

SEQ ID NO: 1490446 - DNA, 17 bp, Homo sapiens
tccacaaggaataaatg

SEQ ID NO: 1490447 - DNA, 19 bp, Homo sapiens
tccacacaaacctaaaaat

SEQ ID NO: 1490448 - DNA, 16 bp, Homo sapiens
tccacacagcagtgtc

SEQ ID NO: 1490449 - DNA, 22 bp, Homo sapiens
tccacacagcagtgtcccctgc

SEQ ID NO: 1490450 - DNA, 17 bp, Homo sapiens
tccacaccagctgctgc

SEQ ID NO: 1490451 - DNA, 19 bp, Homo sapiens
tccacaccctctcccagga

SEQ ID NO: 1490452 - DNA, 12 bp, Homo sapiens
tccacagagagg

SEQ ID NO: 1490453 - DNA, 19 bp, Homo sapiens
tccacagccccaacctccc

SEQ ID NO: 1490454 - DNA, 14 bp, Homo sapiens
tccacagccgcagc

SEQ ID NO: 1490455 - DNA, 23 bp, Homo sapiens
tccacagccgcctgaaagccaca

SEQ ID NO: 1490456 - DNA, 20 bp, Homo sapiens
tccacagcgagggcagctgc

SEQ ID NO: 1490457 - DNA, 19 bp, Homo sapiens
tccacagcggaggagacca

SEQ ID NO: 1490458 - DNA, 22 bp, Homo sapiens
tccacagcggaggagaccagct

SEQ ID NO: 1490459 - DNA, 14 bp, Homo sapiens
tccacagctacctc

SEQ ID NO: 1490460 - DNA, 13 bp, Homo sapiens
tccacagctgcag

SEQ ID NO: 1490461 - DNA, 23 bp, Homo sapiens
tccacagctggaaagttgggccc

SEQ ID NO: 1490462 - DNA, 13 bp, Homo sapiens
tccacagggacca

SEQ ID NO: 1490463 - DNA, 16 bp, Homo sapiens
tccacaggggcaggcc

SEQ ID NO: 1490464 - DNA, 20 bp, Homo sapiens
tccacaggggcaggcctggg

SEQ ID NO: 1490465 - DNA, 21 bp, Homo sapiens
tccacaggtcatcagatgcct

SEQ ID NO: 1490466 - DNA, 17 bp, Homo sapiens
tccacaggtctagacta

SEQ ID NO: 1490467 - DNA, 15 bp, Homo sapiens
tccacagtgctgctt

SEQ ID NO: 1490468 - DNA, 17 bp, Homo sapiens
tccacagtgttgtgccc

SEQ ID NO: 1490469 - DNA, 16 bp, Homo sapiens
tccacatccccagagc

SEQ ID NO: 1490470 - DNA, 19 bp, Homo sapiens
tccacatccccagagccca

SEQ ID NO: 1490471 - DNA, 13 bp, Homo sapiens
tccacatctgcct

SEQ ID NO: 1490472 - DNA, 18 bp, Homo sapiens
tccacatctgccttaaaa

SEQ ID NO: 1490473 - DNA, 16 bp, Homo sapiens
tccacatgacctccat

SEQ ID NO: 1490474 - DNA, 16 bp, Homo sapiens
tccacattgttttaaa

SEQ ID NO: 1490475 - DNA, 17 bp, Homo sapiens
tccacattgttttaaaa

SEQ ID NO: 1490476 - DNA, 13 bp, Homo sapiens
tccacatttctaa

SEQ ID NO: 1490477 - DNA, 14 bp, Homo sapiens
tccaccaaggggct

SEQ ID NO: 1490478 - DNA, 13 bp, Homo sapiens
tccaccaatctct

SEQ ID NO: 1490479 - DNA, 21 bp, Homo sapiens
tccaccaccactggccaccag

SEQ ID NO: 1490480 - DNA, 13 bp, Homo sapiens
tccaccacccaaa

SEQ ID NO: 1490481 - DNA, 23 bp, Homo sapiens
tccaccacccaacccaaaccatg

SEQ ID NO: 1490482 - DNA, 14 bp, Homo sapiens
tccaccaccttgcc

SEQ ID NO: 1490483 - DNA, 13 bp, Homo sapiens
tccaccagcagca

SEQ ID NO: 1490484 - DNA, 12 bp, Homo sapiens
tccaccagcatc

SEQ ID NO: 1490485 - DNA, 20 bp, Homo sapiens
tccaccagcatcacctgcct

SEQ ID NO: 1490486 - DNA, 17 bp, Homo sapiens
tccaccagcctgctgac

SEQ ID NO: 1490487 - DNA, 17 bp, Homo sapiens
tccaccatccccacccc

SEQ ID NO: 1490488 - DNA, 17 bp, Homo sapiens
tccacccaccagtcagg

SEQ ID NO: 1490489 - DNA, 13 bp, Homo sapiens
tccacccaccccc

SEQ ID NO: 1490490 - DNA, 14 bp, Homo sapiens
tccacccaccccct

SEQ ID NO: 1490491 - DNA, 20 bp, Homo sapiens
tccacccaccccctttggtt

SEQ ID NO: 1490492 - DNA, 17 bp, Homo sapiens
tccacccagcccattct

SEQ ID NO: 1490493 - DNA, 12 bp, Homo sapiens
tccacccaggct

SEQ ID NO: 1490494 - DNA, 14 bp, Homo sapiens
tccacccaggctgc

SEQ ID NO: 1490495 - DNA, 15 bp, Homo sapiens
tccacccaggctgca

SEQ ID NO: 1490496 - DNA, 16 bp, Homo sapiens
tccacccaggctgcac

SEQ ID NO: 1490497 - DNA, 18 bp, Homo sapiens
tccacccaggctgcactg

SEQ ID NO: 1490498 - DNA, 23 bp, Homo sapiens
tccacccaggctgcactgcagtg

SEQ ID NO: 1490499 - DNA, 12 bp, Homo sapiens
tccacccagtgc

SEQ ID NO: 1490500 - DNA, 15 bp, Homo sapiens
tccacccagtgctgc

SEQ ID NO: 1490501 - DNA, 16 bp, Homo sapiens
tccacccagtgctgcc

SEQ ID NO: 1490502 - DNA, 21 bp, Homo sapiens
tccacccagtgctgccatgcc

SEQ ID NO: 1490503 - DNA, 13 bp, Homo sapiens
tccacccattccc

SEQ ID NO: 1490504 - DNA, 24 bp, Homo sapiens
tccacccattcccccatgtggctg

SEQ ID NO: 1490505 - DNA, 19 bp, Homo sapiens
tccaccccaagagaactcg

SEQ ID NO: 1490506 - DNA, 22 bp, Homo sapiens
tccaccccatccctccccagtt

SEQ ID NO: 1490507 - DNA, 22 bp, Homo sapiens
tccaccccccacgtctgtcctc

SEQ ID NO: 1490508 - DNA, 22 bp, Homo sapiens
tccacccccgccacggccaccc

SEQ ID NO: 1490509 - DNA, 18 bp, Homo sapiens
tccacccgggggagccca

SEQ ID NO: 1490510 - DNA, 14 bp, Homo sapiens
tccaccctccacct

SEQ ID NO: 1490511 - DNA, 12 bp, Homo sapiens
tccaccctgtcc

SEQ ID NO: 1490512 - DNA, 20 bp, Homo sapiens
tccaccctgtcccccagctc

SEQ ID NO: 1490513 - DNA, 14 bp, Homo sapiens
tccacccttccatc

SEQ ID NO: 1490514 - DNA, 18 bp, Homo sapiens
tccaccgaccaactgccc

SEQ ID NO: 1490515 - DNA, 13 bp, Homo sapiens
tccaccgctgcct

SEQ ID NO: 1490516 - DNA, 14 bp, Homo sapiens
tccacctcaactcc

SEQ ID NO: 1490517 - DNA, 13 bp, Homo sapiens
tccacctcagcct

SEQ ID NO: 1490518 - DNA, 14 bp, Homo sapiens
tccacctcagcctt

SEQ ID NO: 1490519 - DNA, 16 bp, Homo sapiens
tccacctcagccttgg

SEQ ID NO: 1490520 - DNA, 16 bp, Homo sapiens
tccacctcatcactgg

SEQ ID NO: 1490521 - DNA, 17 bp, Homo sapiens
tccacctcatcactgga

SEQ ID NO: 1490522 - DNA, 24 bp, Homo sapiens
tccacctcatcactggactgcatg

SEQ ID NO: 1490523 - DNA, 12 bp, Homo sapiens
tccacctccccc

SEQ ID NO: 1490524 - DNA, 21 bp, Homo sapiens
tccacctcccccaaaccctgc

SEQ ID NO: 1490525 - DNA, 13 bp, Homo sapiens
tccacctcctaga

SEQ ID NO: 1490526 - DNA, 19 bp, Homo sapiens
tccacctctggtggctcct

SEQ ID NO: 1490527 - DNA, 13 bp, Homo sapiens
tccacctgccaca

SEQ ID NO: 1490528 - DNA, 12 bp, Homo sapiens
tccacctggaga

SEQ ID NO: 1490529 - DNA, 16 bp, Homo sapiens
tccacctgtctcagcc

SEQ ID NO: 1490530 - DNA, 17 bp, Homo sapiens
tccacctgtctcagcct

SEQ ID NO: 1490531 - DNA, 18 bp, Homo sapiens
tccacctgtcttggcctc

SEQ ID NO: 1490532 - DNA, 15 bp, Homo sapiens
tccaccttcccactt

SEQ ID NO: 1490533 - DNA, 21 bp, Homo sapiens
tccaccttgctcttctttctg

SEQ ID NO: 1490534 - DNA, 23 bp, Homo sapiens
tccaccttggctgggaagactat

SEQ ID NO: 1490535 - DNA, 15 bp, Homo sapiens
tccacgcagcaccct

SEQ ID NO: 1490536 - DNA, 21 bp, Homo sapiens
tccactaaatgagctcctgcg

SEQ ID NO: 1490537 - DNA, 13 bp, Homo sapiens
tccactattttca

SEQ ID NO: 1490538 - DNA, 17 bp, Homo sapiens
tccactattttcaaaga

SEQ ID NO: 1490539 - DNA, 14 bp, Homo sapiens
tccactcactccag

SEQ ID NO: 1490540 - DNA, 16 bp, Homo sapiens
tccactcactccagcc

SEQ ID NO: 1490541 - DNA, 15 bp, Homo sapiens
tccactcagttgcaa

SEQ ID NO: 1490542 - DNA, 17 bp, Homo sapiens
tccactcccccacctga

SEQ ID NO: 1490543 - DNA, 18 bp, Homo sapiens
tccactcccccacctgac

SEQ ID NO: 1490544 - DNA, 14 bp, Homo sapiens
tccagtggcagaca

SEQ ID NO: 1490545 - DNA, 19 bp, Homo sapiens
tccagtggcagacaaacag

SEQ ID NO: 1490546 - DNA, 23 bp, Homo sapiens
tccagtggctcgctccctgtagc

SEQ ID NO: 1490547 - DNA, 14 bp, Homo sapiens
tccagtggtgggta

SEQ ID NO: 1490548 - DNA, 23 bp, Homo sapiens
tccagtggtgggtaattgtacaa

SEQ ID NO: 1490549 - DNA, 23 bp, Homo sapiens
tccagtggtttgagacactggtt

SEQ ID NO: 1490550 - DNA, 16 bp, Homo sapiens
tccagtgtgcacccct

SEQ ID NO: 1490551 - DNA, 17 bp, Homo sapiens
tccagtgtgcacccctc

SEQ ID NO: 1490552 - DNA, 19 bp, Homo sapiens
tccagtgtgcacccctccc

SEQ ID NO: 1490553 - DNA, 22 bp, Homo sapiens
tccagtgtgcacccctccccat

SEQ ID NO: 1490554 - DNA, 23 bp, Homo sapiens
tccagtgtgcacccctccccatt

SEQ ID NO: 1490555 - DNA, 14 bp, Homo sapiens
tccagtgttctatt

SEQ ID NO: 1490556 - DNA, 19 bp, Homo sapiens
tccagtgttggctgtgtga

SEQ ID NO: 1490557 - DNA, 23 bp, Homo sapiens
tccagtgttggctgtgtgacaga

SEQ ID NO: 1490558 - DNA, 14 bp, Homo sapiens
tccagtgttgtcat

SEQ ID NO: 1490559 - DNA, 22 bp, Homo sapiens
tccagttaaggaccgtggccct

SEQ ID NO: 1490560 - DNA, 16 bp, Homo sapiens
tccagttataagaaga

SEQ ID NO: 1490561 - DNA, 21 bp, Homo sapiens
tccagttgaagttagtggaaa

SEQ ID NO: 1490562 - DNA, 16 bp, Homo sapiens
tccagttgggactcag

SEQ ID NO: 1490563 - DNA, 15 bp, Homo sapiens
tccagtttccccatg

SEQ ID NO: 1490564 - DNA, 18 bp, Homo sapiens
tccagtttctccttgaaa

SEQ ID NO: 1490565 - DNA, 17 bp, Homo sapiens
tccagtttctttcccca

SEQ ID NO: 1490566 - DNA, 18 bp, Homo sapiens
tccagtttgcacctgtcc

SEQ ID NO: 1490567 - DNA, 16 bp, Homo sapiens
tccagtttgcatttgg

SEQ ID NO: 1490568 - DNA, 17 bp, Homo sapiens
tccataaactaagagaa

SEQ ID NO: 1490569 - DNA, 18 bp, Homo sapiens
tccataaactaagagaaa

SEQ ID NO: 1490570 - DNA, 22 bp, Homo sapiens
tccataaactaagagaaactgt

SEQ ID NO: 1490571 - DNA, 16 bp, Homo sapiens
tccataaagtacaaat

SEQ ID NO: 1490572 - DNA, 16 bp, Homo sapiens
tccataaggaatgtag

SEQ ID NO: 1490573 - DNA, 12 bp, Homo sapiens
tccataatgtat

SEQ ID NO: 1490574 - DNA, 15 bp, Homo sapiens
tccataatgttctgc

SEQ ID NO: 1490575 - DNA, 12 bp, Homo sapiens
tccataattatg

SEQ ID NO: 1490576 - DNA, 17 bp, Homo sapiens
tccataattatgacagt

SEQ ID NO: 1490577 - DNA, 14 bp, Homo sapiens
tccataccttttct

SEQ ID NO: 1490578 - DNA, 20 bp, Homo sapiens
tccataccttttctcttttc

SEQ ID NO: 1490579 - DNA, 13 bp, Homo sapiens
tccatactgggct

SEQ ID NO: 1490580 - DNA, 17 bp, Homo sapiens
tccatacttctctcaga

SEQ ID NO: 1490581 - DNA, 15 bp, Homo sapiens
tccatagcaacagga

SEQ ID NO: 1490582 - DNA, 16 bp, Homo sapiens
tccatagcaacaggaa

SEQ ID NO: 1490583 - DNA, 14 bp, Homo sapiens
tccatagtgacttt

SEQ ID NO: 1490584 - DNA, 20 bp, Homo sapiens
tccatatcagaactgtgcca

SEQ ID NO: 1490585 - DNA, 19 bp, Homo sapiens
tccatatccatagtgactt

SEQ ID NO: 1490586 - DNA, 15 bp, Homo sapiens
tccatcaaaagatgt

SEQ ID NO: 1490587 - DNA, 22 bp, Homo sapiens
tccatcaccccaacctctcctt

SEQ ID NO: 1490588 - DNA, 17 bp, Homo sapiens
tccatcaccctcttcct

SEQ ID NO: 1490589 - DNA, 23 bp, Homo sapiens
tccatcaccctcttcctgtgatc

SEQ ID NO: 1490590 - DNA, 14 bp, Homo sapiens
tccatcatcactgt

SEQ ID NO: 1490591 - DNA, 15 bp, Homo sapiens
tccatcatcactgta

SEQ ID NO: 1490592 - DNA, 15 bp, Homo sapiens
tccatcatgtctgta

SEQ ID NO: 1490593 - DNA, 22 bp, Homo sapiens
tccatcatgtctgtatactcct

SEQ ID NO: 1490594 - DNA, 14 bp, Homo sapiens
tccatccatctcca

SEQ ID NO: 1490595 - DNA, 21 bp, Homo sapiens
tccatccattacctccatcca

SEQ ID NO: 1490596 - DNA, 13 bp, Homo sapiens
tccatccctccat

SEQ ID NO: 1490597 - DNA, 16 bp, Homo sapiens
tccatccctccattca

SEQ ID NO: 1490598 - DNA, 23 bp, Homo sapiens
tccatccctctaatgagactgac

SEQ ID NO: 1490599 - DNA, 18 bp, Homo sapiens
tccatcgccatcttcttc

SEQ ID NO: 1490600 - DNA, 16 bp, Homo sapiens
tccatctaaaaatata

SEQ ID NO: 1490601 - DNA, 16 bp, Homo sapiens
tccatctcaaaacaaa

SEQ ID NO: 1490602 - DNA, 13 bp, Homo sapiens
tccatctccaggg

SEQ ID NO: 1490603 - DNA, 13 bp, Homo sapiens
tccatctccgcct

SEQ ID NO: 1490604 - DNA, 22 bp, Homo sapiens
tccatctccgcctccacactga

SEQ ID NO: 1490605 - DNA, 15 bp, Homo sapiens
tccatctctgcctgt

SEQ ID NO: 1490606 - DNA, 17 bp, Homo sapiens
tccatctctgcctgtca

SEQ ID NO: 1490607 - DNA, 18 bp, Homo sapiens
tccatctctgcctgtcaa

SEQ ID NO: 1490608 - DNA, 19 bp, Homo sapiens
tccatctctttaaaaacaa

SEQ ID NO: 1490609 - DNA, 15 bp, Homo sapiens
tccatctggcagggt

SEQ ID NO: 1490610 - DNA, 12 bp, Homo sapiens
tccatctgtcca

SEQ ID NO: 1490611 - DNA, 13 bp, Homo sapiens
tccatctgtccac

SEQ ID NO: 1490612 - DNA, 18 bp, Homo sapiens
tccatctgtttgtttttt

SEQ ID NO: 1490613 - DNA, 15 bp, Homo sapiens
tccatcttcacactg

SEQ ID NO: 1490614 - DNA, 21 bp, Homo sapiens
tccatcttgagatggtgaggc

SEQ ID NO: 1490615 - DNA, 22 bp, Homo sapiens
tccatcttggtagttctgtgcc

SEQ ID NO: 1490616 - DNA, 23 bp, Homo sapiens
tccatcttggtagttctgtgcct

SEQ ID NO: 1490617 - DNA, 18 bp, Homo sapiens
tccatctttctacagaga

SEQ ID NO: 1490618 - DNA, 14 bp, Homo sapiens
tccatctttgaact

SEQ ID NO: 1490619 - DNA, 21 bp, Homo sapiens
tccatgaagagcttgtgtcct

SEQ ID NO: 1490620 - DNA, 21 bp, Homo sapiens
tccatgaatgtatcaggaaat

SEQ ID NO: 1490621 - DNA, 23 bp, Homo sapiens
tccatgacaatatgccctttctg

SEQ ID NO: 1490622 - DNA, 14 bp, Homo sapiens
tccatgagctgctc

SEQ ID NO: 1490623 - DNA, 23 bp, Homo sapiens
tccatgagggcaggcacatgttg

SEQ ID NO: 1490624 - DNA, 17 bp, Homo sapiens
tccatgcacctcccttc

SEQ ID NO: 1490625 - DNA, 19 bp, Homo sapiens
tccatgcagactcctcaga

SEQ ID NO: 1490626 - DNA, 21 bp, Homo sapiens
tccatgcagactcctcagatc

SEQ ID NO: 1490627 - DNA, 16 bp, Homo sapiens
tccatgcagccttggg

SEQ ID NO: 1490628 - DNA, 13 bp, Homo sapiens
tccatgcatgtgc

SEQ ID NO: 1490629 - DNA, 13 bp, Homo sapiens
tccatgcctgagg

SEQ ID NO: 1490630 - DNA, 16 bp, Homo sapiens
tccatgcctgagggtg

SEQ ID NO: 1490631 - DNA, 21 bp, Homo sapiens
tccatgcctgagggtggagac

SEQ ID NO: 1490632 - DNA, 15 bp, Homo sapiens
tccatgcgctcaggg

SEQ ID NO: 1490633 - DNA, 19 bp, Homo sapiens
tccatgcgtgtttctgact

SEQ ID NO: 1490634 - DNA, 16 bp, Homo sapiens
tccatgctccttgaga

SEQ ID NO: 1490635 - DNA, 20 bp, Homo sapiens
tccatgctgcaaaggagaag

SEQ ID NO: 1490636 - DNA, 20 bp, Homo sapiens
tccatgctgtgcgcccaggg

SEQ ID NO: 1490637 - DNA, 21 bp, Homo sapiens
tccatgctgtgcgcccagggc

SEQ ID NO: 1490638 - DNA, 18 bp, Homo sapiens
tccatggatgcatgccct

SEQ ID NO: 1490639 - DNA, 17 bp, Homo sapiens
tccatggcaccagcccc

SEQ ID NO: 1490640 - DNA, 23 bp, Homo sapiens
tccatggcagcagccagggaccc

SEQ ID NO: 1490641 - DNA, 18 bp, Homo sapiens
tccatgggccccaccatt

SEQ ID NO: 1490642 - DNA, 23 bp, Homo sapiens
tccatgggccccaccatttatgt

SEQ ID NO: 1490643 - DNA, 17 bp, Homo sapiens
tccatggggttcgagac

SEQ ID NO: 1490644 - DNA, 13 bp, Homo sapiens
tccatgtaaatac

SEQ ID NO: 1490645 - DNA, 14 bp, Homo sapiens
tccatgtagcagga

SEQ ID NO: 1490646 - DNA, 15 bp, Homo sapiens
tccatgtagcaggac

SEQ ID NO: 1490647 - DNA, 17 bp, Homo sapiens
tccatgtagcaggactg

SEQ ID NO: 1490648 - DNA, 17 bp, Homo sapiens
tccatgtgaaatttaca

SEQ ID NO: 1490649 - DNA, 17 bp, Homo sapiens
tccatgtgaacagcata

SEQ ID NO: 1490650 - DNA, 23 bp, Homo sapiens
tccatgtgctagtcactggcagc

SEQ ID NO: 1490651 - DNA, 19 bp, Homo sapiens
tccatgtggacttaggaag

SEQ ID NO: 1490652 - DNA, 20 bp, Homo sapiens
tccatgtggacttaggaagg

SEQ ID NO: 1490653 - DNA, 22 bp, Homo sapiens
tccatgtggagaaaggagtgaa

SEQ ID NO: 1490654 - DNA, 19 bp, Homo sapiens
tccatgttagtttttactt

SEQ ID NO: 1490655 - DNA, 20 bp, Homo sapiens
tccatgttattctctcacag

SEQ ID NO: 1490656 - DNA, 20 bp, Homo sapiens
tccatgtttattgtttttta

SEQ ID NO: 1490657 - DNA, 22 bp, Homo sapiens
tccatgtttctcacattgctgt

SEQ ID NO: 1490658 - DNA, 17 bp, Homo sapiens
tccattaaaaagttgtt

SEQ ID NO: 1490659 - DNA, 22 bp, Homo sapiens
tccattaacttagcatgtgttg

SEQ ID NO: 1490660 - DNA, 14 bp, Homo sapiens
tccattacctccat

SEQ ID NO: 1490661 - DNA, 16 bp, Homo sapiens
tccattacctccatcc

SEQ ID NO: 1490662 - DNA, 18 bp, Homo sapiens
tccattactgtgatttct

SEQ ID NO: 1490663 - DNA, 21 bp, Homo sapiens
tccattagaaaattttgtaaa

SEQ ID NO: 1490664 - DNA, 22 bp, Homo sapiens
tccattagaaaattttgtaaaa

SEQ ID NO: 1490665 - DNA, 14 bp, Homo sapiens
tccattaggccagc

SEQ ID NO: 1490666 - DNA, 15 bp, Homo sapiens
tccattaggccagca

SEQ ID NO: 1490667 - DNA, 17 bp, Homo sapiens
tccattaggccagcaac

SEQ ID NO: 1490668 - DNA, 18 bp, Homo sapiens
tccattattttgtattct

SEQ ID NO: 1490669 - DNA, 22 bp, Homo sapiens
tccattccacacagaatgcaac

SEQ ID NO: 1490670 - DNA, 14 bp, Homo sapiens
tccattcctcaggg

SEQ ID NO: 1490671 - DNA, 12 bp, Homo sapiens
tccattctcatt

SEQ ID NO: 1490672 - DNA, 15 bp, Homo sapiens
tccattctcccaggt

SEQ ID NO: 1490673 - DNA, 17 bp, Homo sapiens
tccattgaactggaaga

SEQ ID NO: 1490674 - DNA, 14 bp, Homo sapiens
tccattgatttttt

SEQ ID NO: 1490675 - DNA, 23 bp, Homo sapiens
tccattggatctgcaagaacact

SEQ ID NO: 1490676 - DNA, 16 bp, Homo sapiens
tccattggtccaagat

SEQ ID NO: 1490677 - DNA, 22 bp, Homo sapiens
tccattggtccaagattccgga

SEQ ID NO: 1490678 - DNA, 11 bp, Homo sapiens
tccattgttgt

SEQ ID NO: 1490679 - DNA, 21 bp, Homo sapiens
tccatttcatctatttctgag

SEQ ID NO: 1490680 - DNA, 12 bp, Homo sapiens
tccatttccagt

SEQ ID NO: 1490681 - DNA, 21 bp, Homo sapiens
tccatttcccaaagtcctctg

SEQ ID NO: 1490682 - DNA, 19 bp, Homo sapiens
tccatttctcaatcagtgc

SEQ ID NO: 1490683 - DNA, 22 bp, Homo sapiens
tccatttctcaatcagtgcagt

SEQ ID NO: 1490684 - DNA, 20 bp, Homo sapiens
tccatttctctccaggaagt

SEQ ID NO: 1490685 - DNA, 11 bp, Homo sapiens
tccatttctgt

SEQ ID NO: 1490686 - DNA, 13 bp, Homo sapiens
tccatttgttcct

SEQ ID NO: 1490687 - DNA, 16 bp, Homo sapiens
tccatttgttcctgct

SEQ ID NO: 1490688 - DNA, 19 bp, Homo sapiens
tccatttgttcctgcttcc

SEQ ID NO: 1490689 - DNA, 21 bp, Homo sapiens
tccattttcccccactactgc

SEQ ID NO: 1490690 - DNA, 23 bp, Homo sapiens
tccattttctaaactgttttcat

SEQ ID NO: 1490691 - DNA, 16 bp, Homo sapiens
tccatttttcctctgt

SEQ ID NO: 1490692 - DNA, 20 bp, Homo sapiens
tccatttttcctctgttcac

SEQ ID NO: 1490693 - DNA, 23 bp, Homo sapiens
tccatttttctcccaagaaacct

SEQ ID NO: 1490694 - DNA, 17 bp, Homo sapiens
tccatttttttctttac

SEQ ID NO: 1490695 - DNA, 12 bp, Homo sapiens
tcccaaaagcta

SEQ ID NO: 1490696 - DNA, 20 bp, Homo sapiens
tcccaaaccacgcctcttga

SEQ ID NO: 1490697 - DNA, 21 bp, Homo sapiens
tcccaaacccagtctcctctc

SEQ ID NO: 1490698 - DNA, 22 bp, Homo sapiens
tcccaaacccagtctcctctcc

SEQ ID NO: 1490699 - DNA, 23 bp, Homo sapiens
tcccaaacccagtctcctctcca

SEQ ID NO: 1490700 - DNA, 19 bp, Homo sapiens
tcccaaagccagaaccaga

SEQ ID NO: 1490701 - DNA, 16 bp, Homo sapiens
tcccaaagtcctctgc

SEQ ID NO: 1490702 - DNA, 21 bp, Homo sapiens
tcccaaagtcctgggattaca

SEQ ID NO: 1490703 - DNA, 13 bp, Homo sapiens
tcccaaagtgctg

SEQ ID NO: 1490704 - DNA, 18 bp, Homo sapiens
tcccaacagaggcctccc

SEQ ID NO: 1490705 - DNA, 17 bp, Homo sapiens
tcccaacccccctcctg

SEQ ID NO: 1490706 - DNA, 23 bp, Homo sapiens
tcccaacctcaatgccctgccat

SEQ ID NO: 1490707 - DNA, 22 bp, Homo sapiens
tcccaacgtgcaaagccaaggc

SEQ ID NO: 1490708 - DNA, 16 bp, Homo sapiens
tcccaagaatgcaaga

SEQ ID NO: 1490709 - DNA, 20 bp, Homo sapiens
tcccaagaatgcaagatttc

SEQ ID NO: 1490710 - DNA, 22 bp, Homo sapiens
tcccaagagaaggggaagcact

SEQ ID NO: 1490711 - DNA, 23 bp, Homo sapiens
tcccaagatgttgatttttactg

SEQ ID NO: 1490712 - DNA, 20 bp, Homo sapiens
tcccaagcacctgggattac

SEQ ID NO: 1490713 - DNA, 12 bp, Homo sapiens
tcccaaggaaag

SEQ ID NO: 1490714 - DNA, 13 bp, Homo sapiens
tcccaaggaaagc

SEQ ID NO: 1490715 - DNA, 22 bp, Homo sapiens
tcccaaggaaagccccagcact

SEQ ID NO: 1490716 - DNA, 23 bp, Homo sapiens
tcccaaggagctgatttccaggc

SEQ ID NO: 1490717 - DNA, 16 bp, Homo sapiens
tcccaagggacagcaa

SEQ ID NO: 1490718 - DNA, 20 bp, Homo sapiens
tcccaagggacagcaagtga

SEQ ID NO: 1490719 - DNA, 22 bp, Homo sapiens
tcccaagggacagcaagtgagc

SEQ ID NO: 1490720 - DNA, 21 bp, Homo sapiens
tcccaaggttggagcccaggg

SEQ ID NO: 1490721 - DNA, 20 bp, Homo sapiens
tcccaagtaactgggattac

SEQ ID NO: 1490722 - DNA, 15 bp, Homo sapiens
tcccaagtagctggg

SEQ ID NO: 1490723 - DNA, 21 bp, Homo sapiens
tcccaagtagctgggattaca

SEQ ID NO: 1490724 - DNA, 13 bp, Homo sapiens
tcccaagtatgcc

SEQ ID NO: 1490725 - DNA, 15 bp, Homo sapiens
tcccaagtatgcctt

SEQ ID NO: 1490726 - DNA, 16 bp, Homo sapiens
tcccaagtatgcctta

SEQ ID NO: 1490727 - DNA, 20 bp, Homo sapiens
tcccaagtatgccttaagca

SEQ ID NO: 1490728 - DNA, 16 bp, Homo sapiens
tcccaagttgtgcttg

SEQ ID NO: 1490729 - DNA, 21 bp, Homo sapiens
tcccaagtttccatagcaaca

SEQ ID NO: 1490730 - DNA, 22 bp, Homo sapiens
tcccaagtttccatagcaacag

SEQ ID NO: 1490731 - DNA, 17 bp, Homo sapiens
tcccaataaaagtgact

SEQ ID NO: 1490732 - DNA, 17 bp, Homo sapiens
tcccaatagctctactg

SEQ ID NO: 1490733 - DNA, 19 bp, Homo sapiens
tcccaatcaaagaattaca

SEQ ID NO: 1490734 - DNA, 14 bp, Homo sapiens
tcccaatcagcact

SEQ ID NO: 1490735 - DNA, 16 bp, Homo sapiens
tcccaatcagcactga

SEQ ID NO: 1490736 - DNA, 17 bp, Homo sapiens
tcccaatcagcactgaa

SEQ ID NO: 1490737 - DNA, 17 bp, Homo sapiens
tcccaatcctctctccc

SEQ ID NO: 1490738 - DNA, 23 bp, Homo sapiens
tcccaatcctctctcccctctgc

SEQ ID NO: 1490739 - DNA, 18 bp, Homo sapiens
tcccaatttcagactccc

SEQ ID NO: 1490740 - DNA, 12 bp, Homo sapiens
tcccacaaaata

SEQ ID NO: 1490741 - DNA, 17 bp, Homo sapiens
tcccacaaaatatttct

SEQ ID NO: 1490742 - DNA, 23 bp, Homo sapiens
tcccacaatataaaactgtactt

SEQ ID NO: 1490743 - DNA, 13 bp, Homo sapiens
tcccacaccccaa

SEQ ID NO: 1490744 - DNA, 16 bp, Homo sapiens
tcccacacctgcctgc

SEQ ID NO: 1490745 - DNA, 21 bp, Homo sapiens
tcccacactttgaagcaaata

SEQ ID NO: 1490746 - DNA, 13 bp, Homo sapiens
tcccacaggaggg

SEQ ID NO: 1490747 - DNA, 15 bp, Homo sapiens
tcccacaggcccttc

SEQ ID NO: 1490748 - DNA, 20 bp, Homo sapiens
tcccacagtgctgggattac

SEQ ID NO: 1490749 - DNA, 15 bp, Homo sapiens
tcccaccaactctgc

SEQ ID NO: 1490750 - DNA, 16 bp, Homo sapiens
tcccaccaactctgca

SEQ ID NO: 1490751 - DNA, 20 bp, Homo sapiens
tcccaccaactctgcactcc

SEQ ID NO: 1490752 - DNA, 21 bp, Homo sapiens
tcccaccaactctgcactcca

SEQ ID NO: 1490753 - DNA, 14 bp, Homo sapiens
tcccaccattcctg

SEQ ID NO: 1490754 - DNA, 22 bp, Homo sapiens
tcccacccacccgccgcctccc

SEQ ID NO: 1490755 - DNA, 20 bp, Homo sapiens
tcccaccccacccccttcag

SEQ ID NO: 1490756 - DNA, 18 bp, Homo sapiens
tcccaccccactccagcc

SEQ ID NO: 1490757 - DNA, 20 bp, Homo sapiens
tcccacccccatctctccct

SEQ ID NO: 1490758 - DNA, 19 bp, Homo sapiens
tcccacccccgaccctgcc

SEQ ID NO: 1490759 - DNA, 14 bp, Homo sapiens
tcccaccccctccc

SEQ ID NO: 1490760 - DNA, 20 bp, Homo sapiens
tcccaccccctcctccccca

SEQ ID NO: 1490761 - DNA, 17 bp, Homo sapiens
tcccaccccggcctcca

SEQ ID NO: 1490762 - DNA, 17 bp, Homo sapiens
tcccacccgatgctgct

SEQ ID NO: 1490763 - DNA, 21 bp, Homo sapiens
tcccacccggccacagctgct

SEQ ID NO: 1490764 - DNA, 22 bp, Homo sapiens
tcccacccggccacagctgctg

SEQ ID NO: 1490765 - DNA, 14 bp, Homo sapiens
tcccaccctcccct

SEQ ID NO: 1490766 - DNA, 15 bp, Homo sapiens
tcccaccctccctag

SEQ ID NO: 1490767 - DNA, 15 bp, Homo sapiens
tcccaccgcccccac

SEQ ID NO: 1490768 - DNA, 19 bp, Homo sapiens
tcccaccgcccccacccct

SEQ ID NO: 1490769 - DNA, 17 bp, Homo sapiens
tcccacctccatcccag

SEQ ID NO: 1490770 - DNA, 20 bp, Homo sapiens
tcccacctctccttttgagg

SEQ ID NO: 1490771 - DNA, 14 bp, Homo sapiens
tcccaccttcccac

SEQ ID NO: 1490772 - DNA, 20 bp, Homo sapiens
tcccccaacccccaccccac

SEQ ID NO: 1490773 - DNA, 14 bp, Homo sapiens
tcccccaacttgag

SEQ ID NO: 1490774 - DNA, 17 bp, Homo sapiens
tcccccaccacactgaa

SEQ ID NO: 1490775 - DNA, 18 bp, Homo sapiens
tcccccaccccctcccca

SEQ ID NO: 1490776 - DNA, 13 bp, Homo sapiens
tcccccaccctcc

SEQ ID NO: 1490777 - DNA, 17 bp, Homo sapiens
tcccccaccctccatgc

SEQ ID NO: 1490778 - DNA, 20 bp, Homo sapiens
tcccccaccggtccagctgg

SEQ ID NO: 1490779 - DNA, 21 bp, Homo sapiens
tcccccaccggtccagctggc

SEQ ID NO: 1490780 - DNA, 22 bp, Homo sapiens
tcccccaccggtccagctggcc

SEQ ID NO: 1490781 - DNA, 23 bp, Homo sapiens
tcccccaccggtccagctggcct

SEQ ID NO: 1490782 - DNA, 20 bp, Homo sapiens
tcccccactgccacaccctc

SEQ ID NO: 1490783 - DNA, 22 bp, Homo sapiens
tcccccagcaacgcccctccaa

SEQ ID NO: 1490784 - DNA, 13 bp, Homo sapiens
tcccccatccccc

SEQ ID NO: 1490785 - DNA, 18 bp, Homo sapiens
tcccccatcccccactgc

SEQ ID NO: 1490786 - DNA, 15 bp, Homo sapiens
tcccccatgtgcctg

SEQ ID NO: 1490787 - DNA, 17 bp, Homo sapiens
tcccccatgtggctgaa

SEQ ID NO: 1490788 - DNA, 22 bp, Homo sapiens
tccccccatcttgcttccctaa

SEQ ID NO: 1490789 - DNA, 13 bp, Homo sapiens
tcccccccatgca

SEQ ID NO: 1490790 - DNA, 18 bp, Homo sapiens
tcccccccatgcactgtg

SEQ ID NO: 1490791 - DNA, 13 bp, Homo sapiens
tccccccgcccac

SEQ ID NO: 1490792 - DNA, 14 bp, Homo sapiens
tccccccgcccacc

SEQ ID NO: 1490793 - DNA, 19 bp, Homo sapiens
tccccccgcccacccacgc

SEQ ID NO: 1490794 - DNA, 12 bp, Homo sapiens
tcccccctgagt

SEQ ID NO: 1490795 - DNA, 13 bp, Homo sapiens
tcccccctgagtg

SEQ ID NO: 1490796 - DNA, 13 bp, Homo sapiens
tcccccctgctgc

SEQ ID NO: 1490797 - DNA, 18 bp, Homo sapiens
tcccccctgctgcccagt

SEQ ID NO: 1490798 - DNA, 21 bp, Homo sapiens
tcccccgacactgctgcacca

SEQ ID NO: 1490799 - DNA, 14 bp, Homo sapiens
tcccccgactgcct

SEQ ID NO: 1490800 - DNA, 15 bp, Homo sapiens
tcccccgactgcctg

SEQ ID NO: 1490801 - DNA, 17 bp, Homo sapiens
tcccccgcagtccccag

SEQ ID NO: 1490802 - DNA, 15 bp, Homo sapiens
tcccccggctgggcc

SEQ ID NO: 1490803 - DNA, 16 bp, Homo sapiens
tcccccgtttctcctt

SEQ ID NO: 1490804 - DNA, 20 bp, Homo sapiens
tccccctatttattgacttt

SEQ ID NO: 1490805 - DNA, 21 bp, Homo sapiens
tccccctatttattgactttg

SEQ ID NO: 1490806 - DNA, 22 bp, Homo sapiens
tccccctatttattgactttga

SEQ ID NO: 1490807 - DNA, 15 bp, Homo sapiens
tccccctcctgctgt

SEQ ID NO: 1490808 - DNA, 11 bp, Homo sapiens
tccccctctgc

SEQ ID NO: 1490809 - DNA, 13 bp, Homo sapiens
tccccctctgctt

SEQ ID NO: 1490810 - DNA, 21 bp, Homo sapiens
tccccctgcaacttccgctga

SEQ ID NO: 1490811 - DNA, 17 bp, Homo sapiens
tccccctgccagtgcct

SEQ ID NO: 1490812 - DNA, 15 bp, Homo sapiens
tccccctgccctcgt

SEQ ID NO: 1490813 - DNA, 20 bp, Homo sapiens
tccccctgccctcgtggcca

SEQ ID NO: 1490814 - DNA, 22 bp, Homo sapiens
tccccctgccctcgtggccagc

SEQ ID NO: 1490815 - DNA, 21 bp, Homo sapiens
tccccctggggcttctcctga

SEQ ID NO: 1490816 - DNA, 13 bp, Homo sapiens
tccccctgttctg

SEQ ID NO: 1490817 - DNA, 18 bp, Homo sapiens
tcccccttcccatttctt

SEQ ID NO: 1490818 - DNA, 21 bp, Homo sapiens
tcccccttcccatttcttccc

SEQ ID NO: 1490819 - DNA, 18 bp, Homo sapiens
tccccgaagagtcagccc

SEQ ID NO: 1490820 - DNA, 18 bp, Homo sapiens
tccccgacgcccacccaa

SEQ ID NO: 1490821 - DNA, 19 bp, Homo sapiens
tccccgaggagctgggccc

SEQ ID NO: 1490822 - DNA, 15 bp, Homo sapiens
tccccgaggctgccc

SEQ ID NO: 1490823 - DNA, 22 bp, Homo sapiens
tccccgaggctgccccaggccg

SEQ ID NO: 1490824 - DNA, 23 bp, Homo sapiens
tccccgataccatgctgtaagga

SEQ ID NO: 1490825 - DNA, 21 bp, Homo sapiens
tccccgatgtcccctgcgggc

SEQ ID NO: 1490826 - DNA, 16 bp, Homo sapiens
tccccgcaacccacag

SEQ ID NO: 1490827 - DNA, 17 bp, Homo sapiens
tccccgcaacccacagc

SEQ ID NO: 1490828 - DNA, 19 bp, Homo sapiens
tccccgcaacccacagctc

SEQ ID NO: 1490829 - DNA, 19 bp, Homo sapiens
tccccgcagcccgcctgcc

SEQ ID NO: 1490830 - DNA, 20 bp, Homo sapiens
tccccgcagcccgcctgccg

SEQ ID NO: 1490831 - DNA, 18 bp, Homo sapiens
tccccgcagccctggcag

SEQ ID NO: 1490832 - DNA, 15 bp, Homo sapiens
tccccgccctttttt

SEQ ID NO: 1490833 - DNA, 18 bp, Homo sapiens
tccccgcctggccaggag

SEQ ID NO: 1490834 - DNA, 20 bp, Homo sapiens
tccccgcctggccaggagca

SEQ ID NO: 1490835 - DNA, 13 bp, Homo sapiens
tccccgctcaggg

SEQ ID NO: 1490836 - DNA, 18 bp, Homo sapiens
tccccgctccgtctctgt

SEQ ID NO: 1490837 - DNA, 15 bp, Homo sapiens
tccccgctctccctg

SEQ ID NO: 1490838 - DNA, 15 bp, Homo sapiens
tccccgctgctgtgc

SEQ ID NO: 1490839 - DNA, 16 bp, Homo sapiens
tccccggccacatgcc

SEQ ID NO: 1490840 - DNA, 17 bp, Homo sapiens
tccccggccctaccagc

SEQ ID NO: 1490841 - DNA, 21 bp, Homo sapiens
tccccggggttccccacacag

SEQ ID NO: 1490842 - DNA, 14 bp, Homo sapiens
tccccgtgtaaaaa

SEQ ID NO: 1490843 - DNA, 22 bp, Homo sapiens
tccccgtgtaaaaagcctcctt

SEQ ID NO: 1490844 - DNA, 16 bp, Homo sapiens
tcccctacccaaccct

SEQ ID NO: 1490845 - DNA, 16 bp, Homo sapiens
tcccctagctcaccag

SEQ ID NO: 1490846 - DNA, 20 bp, Homo sapiens
tcccctagctcaccaggcct

SEQ ID NO: 1490847 - DNA, 22 bp, Homo sapiens
tcccctagctcaccaggcctgg

SEQ ID NO: 1490848 - DNA, 20 bp, Homo sapiens
tcccctatccacccagccca

SEQ ID NO: 1490849 - DNA, 14 bp, Homo sapiens
tcccctatgctggt

SEQ ID NO: 1490850 - DNA, 21 bp, Homo sapiens
tcccctattgcgctctcaaga

SEQ ID NO: 1490851 - DNA, 23 bp, Homo sapiens
tcccctcaaggacaaagtctcca

SEQ ID NO: 1490852 - DNA, 13 bp, Homo sapiens
tcccctccaacct

SEQ ID NO: 1490853 - DNA, 13 bp, Homo sapiens
tcccctccacagc

SEQ ID NO: 1490854 - DNA, 17 bp, Homo sapiens
tcccctccacagctgca

SEQ ID NO: 1490855 - DNA, 15 bp, Homo sapiens
tcccctcccagggga

SEQ ID NO: 1490856 - DNA, 23 bp, Homo sapiens
tcccctcccaggggagccagctg

SEQ ID NO: 1490857 - DNA, 14 bp, Homo sapiens
tcccctcccatctg

SEQ ID NO: 1490858 - DNA, 17 bp, Homo sapiens
tcccctcccccactcct

SEQ ID NO: 1490859 - DNA, 18 bp, Homo sapiens
tcccctcccccactcctc

SEQ ID NO: 1490860 - DNA, 18 bp, Homo sapiens
tcccctccccggccctac

SEQ ID NO: 1490861 - DNA, 16 bp, Homo sapiens
tcccctccctggctcc

SEQ ID NO: 1490862 - DNA, 19 bp, Homo sapiens
tcccctccctggctcccat

SEQ ID NO: 1490863 - DNA, 13 bp, Homo sapiens
tcccctccctggg

SEQ ID NO: 1490864 - DNA, 13 bp, Homo sapiens
tcccctccctgtc

SEQ ID NO: 1490865 - DNA, 16 bp, Homo sapiens
tcccctccggactggt

SEQ ID NO: 1490866 - DNA, 18 bp, Homo sapiens
tcccctccggactggtgc

SEQ ID NO: 1490867 - DNA, 15 bp, Homo sapiens
tcccctcctcagtga

SEQ ID NO: 1490868 - DNA, 16 bp, Homo sapiens
tcccctcctccactct

SEQ ID NO: 1490869 - DNA, 20 bp, Homo sapiens
tcccctcctcttcccttagc

SEQ ID NO: 1490870 - DNA, 18 bp, Homo sapiens
tcccctccttctcccttt

SEQ ID NO: 1490871 - DNA, 18 bp, Homo sapiens
tcccctccttggctttat

SEQ ID NO: 1490872 - DNA, 18 bp, Homo sapiens
tcccctccttgggcactt

SEQ ID NO: 1490873 - DNA, 17 bp, Homo sapiens
tcccctcggagaagagc

SEQ ID NO: 1490874 - DNA, 14 bp, Homo sapiens
tcccctctcagaac

SEQ ID NO: 1490875 - DNA, 15 bp, Homo sapiens
tcccctctcagaaca

SEQ ID NO: 1490876 - DNA, 19 bp, Homo sapiens
tcccctctcgcgcccagca

SEQ ID NO: 1490877 - DNA, 11 bp, Homo sapiens
tcccctctctc

SEQ ID NO: 1490878 - DNA, 13 bp, Homo sapiens
tcccctctctctg

SEQ ID NO: 1490879 - DNA, 17 bp, Homo sapiens
tcccctctcttgcaccc

SEQ ID NO: 1490880 - DNA, 23 bp, Homo sapiens
tcccctctgcaaccccccagctc

SEQ ID NO: 1490881 - DNA, 17 bp, Homo sapiens
tcccctctgctgctgtc

SEQ ID NO: 1490882 - DNA, 13 bp, Homo sapiens
tcccctctgtgct

SEQ ID NO: 1490883 - DNA, 18 bp, Homo sapiens
tcccctcttcccttcaac

SEQ ID NO: 1490884 - DNA, 18 bp, Homo sapiens
tcccctcttcttctttcc

SEQ ID NO: 1490885 - DNA, 14 bp, Homo sapiens
tcccctgaaaaact

SEQ ID NO: 1490886 - DNA, 14 bp, Homo sapiens
tcccctgcacctgg

SEQ ID NO: 1490887 - DNA, 16 bp, Homo sapiens
tcccctgcacctggcc

SEQ ID NO: 1490888 - DNA, 17 bp, Homo sapiens
tcccctgcacctggcct

SEQ ID NO: 1490889 - DNA, 18 bp, Homo sapiens
tcccctgcacctggcctg

SEQ ID NO: 1490890 - DNA, 17 bp, Homo sapiens
tcccctgccaccaggcc

SEQ ID NO: 1490891 - DNA, 13 bp, Homo sapiens
tcccctgccccag

SEQ ID NO: 1490892 - DNA, 18 bp, Homo sapiens
tcccctgccccagaggtc

SEQ ID NO: 1490893 - DNA, 19 bp, Homo sapiens
tcccctgcccccaggactg

SEQ ID NO: 1490894 - DNA, 16 bp, Homo sapiens
tcccctgctcccaggt

SEQ ID NO: 1490895 - DNA, 23 bp, Homo sapiens
tcccctggaaacccacctctctg

SEQ ID NO: 1490896 - DNA, 22 bp, Homo sapiens
tcccctggagccagcagggctg

SEQ ID NO: 1490897 - DNA, 12 bp, Homo sapiens
tcccctggcctc

SEQ ID NO: 1490898 - DNA, 13 bp, Homo sapiens
tcccctgggcagg

SEQ ID NO: 1490899 - DNA, 12 bp, Homo sapiens
tcccctgtccca

SEQ ID NO: 1490900 - DNA, 15 bp, Homo sapiens
tcccctgtcccacca

SEQ ID NO: 1490901 - DNA, 19 bp, Homo sapiens
tcccctgttgattatcttc

SEQ ID NO: 1490902 - DNA, 20 bp, Homo sapiens
tcccctgttgattatcttca

SEQ ID NO: 1490903 - DNA, 12 bp, Homo sapiens
tccccttcccct

SEQ ID NO: 1490904 - DNA, 12 bp, Homo sapiens
tccccttccctt

SEQ ID NO: 1490905 - DNA, 16 bp, Homo sapiens
tccccttcctcactgc

SEQ ID NO: 1490906 - DNA, 18 bp, Homo sapiens
tccccttcctcttgtctg

SEQ ID NO: 1490907 - DNA, 13 bp, Homo sapiens
tccccttcctgtt

SEQ ID NO: 1490908 - DNA, 21 bp, Homo sapiens
tccccttcctgtttcagaccc

SEQ ID NO: 1490909 - DNA, 20 bp, Homo sapiens
tccccttctcccctgcactg

SEQ ID NO: 1490910 - DNA, 18 bp, Homo sapiens
tccccttctctcatctct

SEQ ID NO: 1490911 - DNA, 16 bp, Homo sapiens
tccccttgcccagggc

SEQ ID NO: 1490912 - DNA, 20 bp, Homo sapiens
tccccttgcccagggctcag

SEQ ID NO: 1490913 - DNA, 22 bp, Homo sapiens
tccccttggcttcctccgtcca

SEQ ID NO: 1490914 - DNA, 17 bp, Homo sapiens
tccccttgggcggctga

SEQ ID NO: 1490915 - DNA, 22 bp, Homo sapiens
tccccttgggcggctgagagcc

SEQ ID NO: 1490916 - DNA, 21 bp, Homo sapiens
tccccttgtttgtcccttcta

SEQ ID NO: 1490917 - DNA, 17 bp, Homo sapiens
tcccctttactcagccc

SEQ ID NO: 1490918 - DNA, 23 bp, Homo sapiens
tcccctttactcagcccagctgg

SEQ ID NO: 1490919 - DNA, 16 bp, Homo sapiens
tccccttttgcctggc

SEQ ID NO: 1490920 - DNA, 17 bp, Homo sapiens
tccccttttgcctggct

SEQ ID NO: 1490921 - DNA, 19 bp, Homo sapiens
tccccttttgcctggctgt

SEQ ID NO: 1490922 - DNA, 20 bp, Homo sapiens
tccccttttgcctggctgtg

SEQ ID NO: 1490923 - DNA, 21 bp, Homo sapiens
tccccttttgcctggctgtgg

SEQ ID NO: 1490924 - DNA, 13 bp, Homo sapiens
tcccgaagccacc

SEQ ID NO: 1490925 - DNA, 18 bp, Homo sapiens
tcccgaggtatggcagag

SEQ ID NO: 1490926 - DNA, 19 bp, Homo sapiens
tcccgattcaccctgtcca

SEQ ID NO: 1490927 - DNA, 18 bp, Homo sapiens
tcccgcaccaggccgggc

SEQ ID NO: 1490928 - DNA, 20 bp, Homo sapiens
tcccgcaccttcctcctccc

SEQ ID NO: 1490929 - DNA, 18 bp, Homo sapiens
tcccgcactctgccccca

SEQ ID NO: 1490930 - DNA, 22 bp, Homo sapiens
tcccgcccttccatgtgccttt

SEQ ID NO: 1490931 - DNA, 14 bp, Homo sapiens
tcccgcctcagcct

SEQ ID NO: 1490932 - DNA, 19 bp, Homo sapiens
tcccgcctcttcttcttca

SEQ ID NO: 1490933 - DNA, 18 bp, Homo sapiens
tcccgccttcctcctcca

SEQ ID NO: 1490934 - DNA, 14 bp, Homo sapiens
tcccgcggtgctga

SEQ ID NO: 1490935 - DNA, 15 bp, Homo sapiens
tcccgcggtgctgac

SEQ ID NO: 1490936 - DNA, 16 bp, Homo sapiens
tcccgcggtgctgact

SEQ ID NO: 1490937 - DNA, 15 bp, Homo sapiens
tcccgctcagccctc

SEQ ID NO: 1490938 - DNA, 16 bp, Homo sapiens
tcccgctcagccctcc

SEQ ID NO: 1490939 - DNA, 14 bp, Homo sapiens
tcccgctgcacatg

SEQ ID NO: 1490940 - DNA, 14 bp, Homo sapiens
tcccgctgctgtgc

SEQ ID NO: 1490941 - DNA, 14 bp, Homo sapiens
tcccggagcacagc

SEQ ID NO: 1490942 - DNA, 15 bp, Homo sapiens
tcccggagcacagcc

SEQ ID NO: 1490943 - DNA, 18 bp, Homo sapiens
tcccggagcacagccctg

SEQ ID NO: 1490944 - DNA, 13 bp, Homo sapiens
tcccggagcccca

SEQ ID NO: 1490945 - DNA, 15 bp, Homo sapiens
tcccggccagctctg

SEQ ID NO: 1490946 - DNA, 19 bp, Homo sapiens
tcccggccggccctggctt

SEQ ID NO: 1490947 - DNA, 20 bp, Homo sapiens
tcccggcctcttccacccat

SEQ ID NO: 1490948 - DNA, 21 bp, Homo sapiens
tcccgggccagggctgcccct

SEQ ID NO: 1490949 - DNA, 14 bp, Homo sapiens
tcccgggccctccc

SEQ ID NO: 1490950 - DNA, 15 bp, Homo sapiens
tcccgggccctccct

SEQ ID NO: 1490951 - DNA, 13 bp, Homo sapiens
tcccgggctaaga

SEQ ID NO: 1490952 - DNA, 21 bp, Homo sapiens
tcccggggccagcacttccat

SEQ ID NO: 1490953 - DNA, 22 bp, Homo sapiens
tcccggtcatgcttttgccact

SEQ ID NO: 1490954 - DNA, 16 bp, Homo sapiens
tcccggttcaggacca

SEQ ID NO: 1490955 - DNA, 16 bp, Homo sapiens
tcccggttcttccagt

SEQ ID NO: 1490956 - DNA, 17 bp, Homo sapiens
tcccgtatcacagtgtt

SEQ ID NO: 1490957 - DNA, 20 bp, Homo sapiens
tcccgtcacccctgtttctg

SEQ ID NO: 1490958 - DNA, 21 bp, Homo sapiens
tcccgtcccatatcctgcctc

SEQ ID NO: 1490959 - DNA, 23 bp, Homo sapiens
tccctaactgttcccttatctgt

SEQ ID NO: 1490960 - DNA, 14 bp, Homo sapiens
tccctaatgtgttt

SEQ ID NO: 1490961 - DNA, 14 bp, Homo sapiens
tccctaattctctt

SEQ ID NO: 1490962 - DNA, 21 bp, Homo sapiens
tccctaccgagtctcttctcc

SEQ ID NO: 1490963 - DNA, 23 bp, Homo sapiens
tccctaccgagtctcttctccac

SEQ ID NO: 1490964 - DNA, 17 bp, Homo sapiens
tccctacctcaggcagg

SEQ ID NO: 1490965 - DNA, 16 bp, Homo sapiens
tccctaccttgcctcc

SEQ ID NO: 1490966 - DNA, 17 bp, Homo sapiens
tccctaccttgcctcct

SEQ ID NO: 1490967 - DNA, 20 bp, Homo sapiens
tccctaccttgcctcctttt

SEQ ID NO: 1490968 - DNA, 11 bp, Homo sapiens
tccctagagag

SEQ ID NO: 1490969 - DNA, 15 bp, Homo sapiens
tccctagagagaata

SEQ ID NO: 1490970 - DNA, 17 bp, Homo sapiens
tccctagcagcccaccc

SEQ ID NO: 1490971 - DNA, 13 bp, Homo sapiens
tccctagcagtga

SEQ ID NO: 1490972 - DNA, 17 bp, Homo sapiens
tccctagccagcacttg

SEQ ID NO: 1490973 - DNA, 11 bp, Homo sapiens
tccctagccca

SEQ ID NO: 1490974 - DNA, 19 bp, Homo sapiens
tccctagctttagaccctg

SEQ ID NO: 1490975 - DNA, 18 bp, Homo sapiens
tccctatgtatttgcagt

SEQ ID NO: 1490976 - DNA, 21 bp, Homo sapiens
tccctattctgtgttttatct

SEQ ID NO: 1490977 - DNA, 18 bp, Homo sapiens
tccctcacccccaggtgt

SEQ ID NO: 1490978 - DNA, 20 bp, Homo sapiens
tccctcagagacaccaaact

SEQ ID NO: 1490979 - DNA, 20 bp, Homo sapiens
tccctcaggttcctttttca

SEQ ID NO: 1490980 - DNA, 16 bp, Homo sapiens
tccctcagtgccctca

SEQ ID NO: 1490981 - DNA, 15 bp, Homo sapiens
tccctcatggctctg

SEQ ID NO: 1490982 - DNA, 22 bp, Homo sapiens
tccctccaaagggcagtgggtg

SEQ ID NO: 1490983 - DNA, 14 bp, Homo sapiens
tccctccaccagcc

SEQ ID NO: 1490984 - DNA, 20 bp, Homo sapiens
tccctccaccagcctgctga

SEQ ID NO: 1490985 - DNA, 21 bp, Homo sapiens
tccctccaccagcctgctgac

SEQ ID NO: 1490986 - DNA, 15 bp, Homo sapiens
tccctccaggcccat

SEQ ID NO: 1490987 - DNA, 20 bp, Homo sapiens
tccctccattcatccttcca

SEQ ID NO: 1490988 - DNA, 16 bp, Homo sapiens
tccctccatttttctc

SEQ ID NO: 1490989 - DNA, 14 bp, Homo sapiens
tccctcccccccat

SEQ ID NO: 1490990 - DNA, 21 bp, Homo sapiens
tccctcccccccatgcactgt

SEQ ID NO: 1490991 - DNA, 12 bp, Homo sapiens
tccctccccctc

SEQ ID NO: 1490992 - DNA, 16 bp, Homo sapiens
tccctccccctccttg

SEQ ID NO: 1490993 - DNA, 17 bp, Homo sapiens
tccctcccctctcagaa

SEQ ID NO: 1490994 - DNA, 16 bp, Homo sapiens
tccctcccctgccatt

SEQ ID NO: 1490995 - DNA, 15 bp, Homo sapiens
tccctcccctgccct

SEQ ID NO: 1490996 - DNA, 16 bp, Homo sapiens
tccctcccctgccctg

SEQ ID NO: 1490997 - DNA, 14 bp, Homo sapiens
tccctccccttctc

SEQ ID NO: 1490998 - DNA, 15 bp, Homo sapiens
tccctccctctctca

SEQ ID NO: 1490999 - DNA, 12 bp, Homo sapiens
tccctcctcacc

SEQ ID NO: 1491000 - DNA, 13 bp, Homo sapiens
tccctcctcacct

SEQ ID NO: 1491001 - DNA, 18 bp, Homo sapiens
tccctcctcacctctgga

SEQ ID NO: 1491002 - DNA, 20 bp, Homo sapiens
tccgagctctggtgctttag

SEQ ID NO: 1491003 - DNA, 12 bp, Homo sapiens
tccgaggcaggg

SEQ ID NO: 1491004 - DNA, 15 bp, Homo sapiens
tccgaggctccccgc

SEQ ID NO: 1491005 - DNA, 16 bp, Homo sapiens
tccgaggctccccgcc

SEQ ID NO: 1491006 - DNA, 15 bp, Homo sapiens
tccgatgaattctta

SEQ ID NO: 1491007 - DNA, 18 bp, Homo sapiens
tccgatgacagtgctcta

SEQ ID NO: 1491008 - DNA, 16 bp, Homo sapiens
tccgatgctgaggcca

SEQ ID NO: 1491009 - DNA, 14 bp, Homo sapiens
tccgcaccagctgc

SEQ ID NO: 1491010 - DNA, 20 bp, Homo sapiens
tccgcaccagctgctctgcc

SEQ ID NO: 1491011 - DNA, 21 bp, Homo sapiens
tccgcaccagctgctctgccc

SEQ ID NO: 1491012 - DNA, 19 bp, Homo sapiens
tccgcaggctatttgttca

SEQ ID NO: 1491013 - DNA, 17 bp, Homo sapiens
tccgcagtgtctccacc

SEQ ID NO: 1491014 - DNA, 17 bp, Homo sapiens
tccgcatccctgcttct

SEQ ID NO: 1491015 - DNA, 20 bp, Homo sapiens
tccgcatccctgcttctggc

SEQ ID NO: 1491016 - DNA, 21 bp, Homo sapiens
tccgccactcagccatttccc

SEQ ID NO: 1491017 - DNA, 12 bp, Homo sapiens
tccgccagcctc

SEQ ID NO: 1491018 - DNA, 15 bp, Homo sapiens
tccgccagcctcctc

SEQ ID NO: 1491019 - DNA, 21 bp, Homo sapiens
tccgcccacaggaagcctgca

SEQ ID NO: 1491020 - DNA, 21 bp, Homo sapiens
tccgcccgctcctgccgcaga

SEQ ID NO: 1491021 - DNA, 12 bp, Homo sapiens
tccgccctcctc

SEQ ID NO: 1491022 - DNA, 19 bp, Homo sapiens
tccgccctgctcctccctg

SEQ ID NO: 1491023 - DNA, 16 bp, Homo sapiens
tccgcctactgtccct

SEQ ID NO: 1491024 - DNA, 17 bp, Homo sapiens
tccgcctactgtccctc

SEQ ID NO: 1491025 - DNA, 12 bp, Homo sapiens
tccgcctccaca

SEQ ID NO: 1491026 - DNA, 15 bp, Homo sapiens
tccgcctccacactg

SEQ ID NO: 1491027 - DNA, 20 bp, Homo sapiens
tccgcctccacactgaccaa

SEQ ID NO: 1491028 - DNA, 18 bp, Homo sapiens
tccgcctggccggctcca

SEQ ID NO: 1491029 - DNA, 19 bp, Homo sapiens
tccgcctggccggctccag

SEQ ID NO: 1491030 - DNA, 13 bp, Homo sapiens
tccgcctgtgggc

SEQ ID NO: 1491031 - DNA, 17 bp, Homo sapiens
tccgccttcactccggt

SEQ ID NO: 1491032 - DNA, 18 bp, Homo sapiens
tccgcgccgatgccaccg

SEQ ID NO: 1491033 - DNA, 15 bp, Homo sapiens
tccgcgggtcccggc

SEQ ID NO: 1491034 - DNA, 18 bp, Homo sapiens
tccgcgtgtgcctgtgtg

SEQ ID NO: 1491035 - DNA, 14 bp, Homo sapiens
tccgctcccaccgc

SEQ ID NO: 1491036 - DNA, 20 bp, Homo sapiens
tccgctcccaccgcccccac

SEQ ID NO: 1491037 - DNA, 12 bp, Homo sapiens
tccgctgcctgg

SEQ ID NO: 1491038 - DNA, 19 bp, Homo sapiens
tccgctgcgggcccagctg

SEQ ID NO: 1491039 - DNA, 13 bp, Homo sapiens
tccgctgggcttc

SEQ ID NO: 1491040 - DNA, 19 bp, Homo sapiens
tccggaaactagtgtacat

SEQ ID NO: 1491041 - DNA, 16 bp, Homo sapiens
tccggatcctaagcat

SEQ ID NO: 1491042 - DNA, 21 bp, Homo sapiens
tccggatttctaacagtcctt

SEQ ID NO: 1491043 - DNA, 19 bp, Homo sapiens
tccggccaaggtgccacca

SEQ ID NO: 1491044 - DNA, 14 bp, Homo sapiens
tccggcctcccctc

SEQ ID NO: 1491045 - DNA, 14 bp, Homo sapiens
tccggcctctgcct

SEQ ID NO: 1491046 - DNA, 22 bp, Homo sapiens
tccggcctctttttttcttttc

SEQ ID NO: 1491047 - DNA, 21 bp, Homo sapiens
tccggcctgggtgacagagtg

SEQ ID NO: 1491048 - DNA, 14 bp, Homo sapiens
tccggcgcagacag

SEQ ID NO: 1491049 - DNA, 22 bp, Homo sapiens
tccgggcaggcaaggtttacac

SEQ ID NO: 1491050 - DNA, 18 bp, Homo sapiens
tccgggtctcgcagcctg

SEQ ID NO: 1491051 - DNA, 14 bp, Homo sapiens
tccggtgttctaag

SEQ ID NO: 1491052 - DNA, 16 bp, Homo sapiens
tccggtgttctaagat

SEQ ID NO: 1491053 - DNA, 23 bp, Homo sapiens
tccggttccccgcaacccacagc

SEQ ID NO: 1491054 - DNA, 19 bp, Homo sapiens
tccggtttgggctgtctta

SEQ ID NO: 1491055 - DNA, 21 bp, Homo sapiens
tccgtagggtctttcttggga

SEQ ID NO: 1491056 - DNA, 18 bp, Homo sapiens
tccgtcattgctgctgct

SEQ ID NO: 1491057 - DNA, 16 bp, Homo sapiens
tccgtccacccaggct

SEQ ID NO: 1491058 - DNA, 21 bp, Homo sapiens
tccgtccacccaggctgcact

SEQ ID NO: 1491059 - DNA, 13 bp, Homo sapiens
tccgtccaccctt

SEQ ID NO: 1491060 - DNA, 16 bp, Homo sapiens
tccgtccacccttcca

SEQ ID NO: 1491061 - DNA, 20 bp, Homo sapiens
tccgtccacccttccatcag

SEQ ID NO: 1491062 - DNA, 20 bp, Homo sapiens
tccgtccctttttctccaca

SEQ ID NO: 1491063 - DNA, 16 bp, Homo sapiens
tccgtctgtctcgatg

SEQ ID NO: 1491064 - DNA, 21 bp, Homo sapiens
tccgtctgtctcgatgcctga

SEQ ID NO: 1491065 - DNA, 18 bp, Homo sapiens
tccgtgaaaacggagctg

SEQ ID NO: 1491066 - DNA, 20 bp, Homo sapiens
tccgtgaatggtctctgtca

SEQ ID NO: 1491067 - DNA, 15 bp, Homo sapiens
tccgtgaattgcttt

SEQ ID NO: 1491068 - DNA, 17 bp, Homo sapiens
tccgtgaattgctttat

SEQ ID NO: 1491069 - DNA, 22 bp, Homo sapiens
tccgtgaggctgctgccatcca

SEQ ID NO: 1491070 - DNA, 18 bp, Homo sapiens
tccgtgatccatccatct

SEQ ID NO: 1491071 - DNA, 20 bp, Homo sapiens
tccgtgatccatccatctcc

SEQ ID NO: 1491072 - DNA, 14 bp, Homo sapiens
tccgtgcccaggcc

SEQ ID NO: 1491073 - DNA, 16 bp, Homo sapiens
tccgtgcccaggccct

SEQ ID NO: 1491074 - DNA, 16 bp, Homo sapiens
tccgtgcctccaccac

SEQ ID NO: 1491075 - DNA, 16 bp, Homo sapiens
tccgtggactgcagtc

SEQ ID NO: 1491076 - DNA, 18 bp, Homo sapiens
tccgtggtcagagtgcca

SEQ ID NO: 1491077 - DNA, 16 bp, Homo sapiens
tccgtggttgccctag

SEQ ID NO: 1491078 - DNA, 22 bp, Homo sapiens
tccgtgtgattgtctttgaatc

SEQ ID NO: 1491079 - DNA, 15 bp, Homo sapiens
tccgtgtgtcccaga

SEQ ID NO: 1491080 - DNA, 17 bp, Homo sapiens
tccgttagctcctgtgg

SEQ ID NO: 1491081 - DNA, 21 bp, Homo sapiens
tccgttaggaataacactgca

SEQ ID NO: 1491082 - DNA, 22 bp, Homo sapiens
tcctaaaactgggattaagaaa

SEQ ID NO: 1491083 - DNA, 15 bp, Homo sapiens
tcctaaacataattg

SEQ ID NO: 1491084 - DNA, 14 bp, Homo sapiens
tcctaaagctgaat

SEQ ID NO: 1491085 - DNA, 20 bp, Homo sapiens
tcctaaagctgaatcccggc

SEQ ID NO: 1491086 - DNA, 16 bp, Homo sapiens
tcctaacaggatgaaa

SEQ ID NO: 1491087 - DNA, 15 bp, Homo sapiens
tcctaactagaatta

SEQ ID NO: 1491088 - DNA, 19 bp, Homo sapiens
tcctaagagtgctgggcat

SEQ ID NO: 1491089 - DNA, 23 bp, Homo sapiens
tcctaagatgtgttcttattttt

SEQ ID NO: 1491090 - DNA, 13 bp, Homo sapiens
tcctaagcatcta

SEQ ID NO: 1491091 - DNA, 14 bp, Homo sapiens
tcctaagcatctaa

SEQ ID NO: 1491092 - DNA, 21 bp, Homo sapiens
tcctaagctattcagtaataa

SEQ ID NO: 1491093 - DNA, 12 bp, Homo sapiens
tcctaaggacac

SEQ ID NO: 1491094 - DNA, 16 bp, Homo sapiens
tcctaaggacacacta

SEQ ID NO: 1491095 - DNA, 23 bp, Homo sapiens
tcctaagggtcgaaagctctaga

SEQ ID NO: 1491096 - DNA, 14 bp, Homo sapiens
tcctaatactgtca

SEQ ID NO: 1491097 - DNA, 15 bp, Homo sapiens
tcctaatactgtcat

SEQ ID NO: 1491098 - DNA, 14 bp, Homo sapiens
tcctaatagctttt

SEQ ID NO: 1491099 - DNA, 18 bp, Homo sapiens
tcctaattcttctgtcct

SEQ ID NO: 1491100 - DNA, 15 bp, Homo sapiens
tcctaatttctcctc

SEQ ID NO: 1491101 - DNA, 16 bp, Homo sapiens
tcctaatttctcctcc

SEQ ID NO: 1491102 - DNA, 15 bp, Homo sapiens
tcctaattttaaata

SEQ ID NO: 1491103 - DNA, 14 bp, Homo sapiens
tcctacaacttaat

SEQ ID NO: 1491104 - DNA, 18 bp, Homo sapiens
tcctacaagagcagcctg

SEQ ID NO: 1491105 - DNA, 19 bp, Homo sapiens
tcctacaagagcagcctgt

SEQ ID NO: 1491106 - DNA, 23 bp, Homo sapiens
tcctacaagagcagcctgtggca

SEQ ID NO: 1491107 - DNA, 18 bp, Homo sapiens
tcctacaagatttagaaa

SEQ ID NO: 1491108 - DNA, 19 bp, Homo sapiens
tcctacaagatttagaaaa

SEQ ID NO: 1491109 - DNA, 22 bp, Homo sapiens
tcctacagaaatactgctctga

SEQ ID NO: 1491110 - DNA, 19 bp, Homo sapiens
tcctacatatcccttccag

SEQ ID NO: 1491111 - DNA, 20 bp, Homo sapiens
tcctacatatcccttccaga

SEQ ID NO: 1491112 - DNA, 13 bp, Homo sapiens
tcctacccttttc

SEQ ID NO: 1491113 - DNA, 14 bp, Homo sapiens
tcctacccttttct

SEQ ID NO: 1491114 - DNA, 15 bp, Homo sapiens
tcctacctattatcc

SEQ ID NO: 1491115 - DNA, 22 bp, Homo sapiens
tcctacctattatccttctact

SEQ ID NO: 1491116 - DNA, 17 bp, Homo sapiens
tcctacctgtctgctgc

SEQ ID NO: 1491117 - DNA, 16 bp, Homo sapiens
tcctctttctgctctg

SEQ ID NO: 1491118 - DNA, 17 bp, Homo sapiens
tcctgaaacaacttgga

SEQ ID NO: 1491119 - DNA, 22 bp, Homo sapiens
tcctgaaacgctcctttgtgtg

SEQ ID NO: 1491120 - DNA, 21 bp, Homo sapiens
tcctgaaagaaacagttaact

SEQ ID NO: 1491121 - DNA, 15 bp, Homo sapiens
tcctgaaatttcaga

SEQ ID NO: 1491122 - DNA, 17 bp, Homo sapiens
tcctgaaccgcacagct

SEQ ID NO: 1491123 - DNA, 23 bp, Homo sapiens
tcctgaaccgcacagctcaggag

SEQ ID NO: 1491124 - DNA, 15 bp, Homo sapiens
tcctgaacctggaaa

SEQ ID NO: 1491125 - DNA, 13 bp, Homo sapiens
tcctgaagaacca

SEQ ID NO: 1491126 - DNA, 18 bp, Homo sapiens
tcctgaagaaccagtccc

SEQ ID NO: 1491127 - DNA, 17 bp, Homo sapiens
tcctgaagaggcgggcc

SEQ ID NO: 1491128 - DNA, 23 bp, Homo sapiens
tcctgaagaggcgggccagccag

SEQ ID NO: 1491129 - DNA, 10 bp, Homo sapiens
tcctgaagca

SEQ ID NO: 1491130 - DNA, 14 bp, Homo sapiens
tcctgaagtagatg

SEQ ID NO: 1491131 - DNA, 16 bp, Homo sapiens
tcctgaatacaagcct

SEQ ID NO: 1491132 - DNA, 21 bp, Homo sapiens
tcctgaatatcagtcactgtt

SEQ ID NO: 1491133 - DNA, 22 bp, Homo sapiens
tcctgaatccaaactaatccat

SEQ ID NO: 1491134 - DNA, 14 bp, Homo sapiens
tcctgaatgaaata

SEQ ID NO: 1491135 - DNA, 15 bp, Homo sapiens
tcctgacagaaggtg

SEQ ID NO: 1491136 - DNA, 22 bp, Homo sapiens
tcctgaccataatcctagcccc

SEQ ID NO: 1491137 - DNA, 21 bp, Homo sapiens
tcctgaccccaagttatccac

SEQ ID NO: 1491138 - DNA, 15 bp, Homo sapiens
tcctgacccctgcct

SEQ ID NO: 1491139 - DNA, 15 bp, Homo sapiens
tcctgacctccgcca

SEQ ID NO: 1491140 - DNA, 14 bp, Homo sapiens
tcctgacctcgtga

SEQ ID NO: 1491141 - DNA, 14 bp, Homo sapiens
tcctgacgccctgc

SEQ ID NO: 1491142 - DNA, 15 bp, Homo sapiens
tcctgacgccctgcg

SEQ ID NO: 1491143 - DNA, 20 bp, Homo sapiens
tcctgacgtctgaagcttga

SEQ ID NO: 1491144 - DNA, 20 bp, Homo sapiens
tcctgactgaaagtaggggg

SEQ ID NO: 1491145 - DNA, 15 bp, Homo sapiens
tcctgactggtgctg

SEQ ID NO: 1491146 - DNA, 14 bp, Homo sapiens
tcctgacttccctg

SEQ ID NO: 1491147 - DNA, 12 bp, Homo sapiens
tcctgacttgag

SEQ ID NO: 1491148 - DNA, 17 bp, Homo sapiens
tcctgacttgagtgttc

SEQ ID NO: 1491149 - DNA, 23 bp, Homo sapiens
tcctgagaaggcgaggagagtgg

SEQ ID NO: 1491150 - DNA, 14 bp, Homo sapiens
tcctgagacctcaa

SEQ ID NO: 1491151 - DNA, 13 bp, Homo sapiens
tcctgagagacct

SEQ ID NO: 1491152 - DNA, 23 bp, Homo sapiens
tcctgagagacctgccctctctg

SEQ ID NO: 1491153 - DNA, 20 bp, Homo sapiens
tcctgagcacccgctgacat

SEQ ID NO: 1491154 - DNA, 19 bp, Homo sapiens
tcctgagccccctgcaccc

SEQ ID NO: 1491155 - DNA, 21 bp, Homo sapiens
tcctgagctcggggggctctg

SEQ ID NO: 1491156 - DNA, 23 bp, Homo sapiens
tcctgagctgtcgctgcctccat

SEQ ID NO: 1491157 - DNA, 20 bp, Homo sapiens
tcctgaggagccctgaggac

SEQ ID NO: 1491158 - DNA, 20 bp, Homo sapiens
tcctgaggggcatctgcccc

SEQ ID NO: 1491159 - DNA, 21 bp, Homo sapiens
tcctgaggggcatctgcccct

SEQ ID NO: 1491160 - DNA, 22 bp, Homo sapiens
tcctgaggggcatctgcccctc

SEQ ID NO: 1491161 - DNA, 19 bp, Homo sapiens
tcctgagtagctggattac

SEQ ID NO: 1491162 - DNA, 19 bp, Homo sapiens
tcctgagtttctctctcct

SEQ ID NO: 1491163 - DNA, 20 bp, Homo sapiens
tcctgataaagcacagctgt

SEQ ID NO: 1491164 - DNA, 23 bp, Homo sapiens
tcctgatagcatatgacaaatgt

SEQ ID NO: 1491165 - DNA, 14 bp, Homo sapiens
tcctgatcttccca

SEQ ID NO: 1491166 - DNA, 19 bp, Homo sapiens
tcctgatgaccaatgggat

SEQ ID NO: 1491167 - DNA, 16 bp, Homo sapiens
tcctgatgacccaggc

SEQ ID NO: 1491168 - DNA, 13 bp, Homo sapiens
tcctgatgatgat

SEQ ID NO: 1491169 - DNA, 21 bp, Homo sapiens
tcctgatgcccgttgtctagg

SEQ ID NO: 1491170 - DNA, 22 bp, Homo sapiens
tcctgatggagtgtgcagacag

SEQ ID NO: 1491171 - DNA, 15 bp, Homo sapiens
tcctgatggccaaga

SEQ ID NO: 1491172 - DNA, 18 bp, Homo sapiens
tcctgatggccaagagca

SEQ ID NO: 1491173 - DNA, 14 bp, Homo sapiens
tcctgattattgaa

SEQ ID NO: 1491174 - DNA, 13 bp, Homo sapiens
tcctgattccaaa

SEQ ID NO: 1491175 - DNA, 14 bp, Homo sapiens
tcctgattccaaat

SEQ ID NO: 1491176 - DNA, 16 bp, Homo sapiens
tcctgatttctctgaa

SEQ ID NO: 1491177 - DNA, 14 bp, Homo sapiens
tcctgcaatgaaag

SEQ ID NO: 1491178 - DNA, 21 bp, Homo sapiens
tcctgcacacagaatgctcag

SEQ ID NO: 1491179 - DNA, 14 bp, Homo sapiens
tcctgcaccccagc

SEQ ID NO: 1491180 - DNA, 16 bp, Homo sapiens
tcctgcagaagaagct

SEQ ID NO: 1491181 - DNA, 20 bp, Homo sapiens
tcctgcagaggaccacagtg

SEQ ID NO: 1491182 - DNA, 13 bp, Homo sapiens
tcctgcagcaaac

SEQ ID NO: 1491183 - DNA, 15 bp, Homo sapiens
tcctgcagcctcctc

SEQ ID NO: 1491184 - DNA, 20 bp, Homo sapiens
tcctgcaggaacgagcactg

SEQ ID NO: 1491185 - DNA, 24 bp, Homo sapiens
tcctgcaggaacgagcactggcca

SEQ ID NO: 1491186 - DNA, 22 bp, Homo sapiens
tcctgcaggcaggaacaaacag

SEQ ID NO: 1491187 - DNA, 17 bp, Homo sapiens
tcctgcaggctggctgt

SEQ ID NO: 1491188 - DNA, 19 bp, Homo sapiens
tcctgcaggtcctggtggg

SEQ ID NO: 1491189 - DNA, 16 bp, Homo sapiens
tcctgcattcacccag

SEQ ID NO: 1491190 - DNA, 18 bp, Homo sapiens
tcctgccacatggagccc

SEQ ID NO: 1491191 - DNA, 20 bp, Homo sapiens
tcctgccacatggagccccc

SEQ ID NO: 1491192 - DNA, 20 bp, Homo sapiens
tcctgccaccccttcctccc

SEQ ID NO: 1491193 - DNA, 11 bp, Homo sapiens
tcctgccagct

SEQ ID NO: 1491194 - DNA, 12 bp, Homo sapiens
tcctgccagctg

SEQ ID NO: 1491195 - DNA, 13 bp, Homo sapiens
tcctgccagctgc

SEQ ID NO: 1491196 - DNA, 14 bp, Homo sapiens
tcctgccagctgcc

SEQ ID NO: 1491197 - DNA, 15 bp, Homo sapiens
tcctgccagctgcct

SEQ ID NO: 1491198 - DNA, 16 bp, Homo sapiens
tcctgccagctgcctt

SEQ ID NO: 1491199 - DNA, 13 bp, Homo sapiens
tcctgccaggccg

SEQ ID NO: 1491200 - DNA, 15 bp, Homo sapiens
tcctgccagggtgag

SEQ ID NO: 1491201 - DNA, 20 bp, Homo sapiens
tcctgccagggtgagcaggg

SEQ ID NO: 1491202 - DNA, 16 bp, Homo sapiens
tcctgcccaggagagc

SEQ ID NO: 1491203 - DNA, 19 bp, Homo sapiens
tcctgcccaggagcagctt

SEQ ID NO: 1491204 - DNA, 23 bp, Homo sapiens
tcctgccccaagggcccagaccc

SEQ ID NO: 1491205 - DNA, 22 bp, Homo sapiens
tcctgccctctgctctgcctgg

SEQ ID NO: 1491206 - DNA, 16 bp, Homo sapiens
tcctgccgcagagctg

SEQ ID NO: 1491207 - DNA, 18 bp, Homo sapiens
tcctgccgcagagctggc

SEQ ID NO: 1491208 - DNA, 11 bp, Homo sapiens
tcctgcctact

SEQ ID NO: 1491209 - DNA, 19 bp, Homo sapiens
tcctgcctattatctgtca

SEQ ID NO: 1491210 - DNA, 19 bp, Homo sapiens
tcctgcctcagcctcccaa

SEQ ID NO: 1491211 - DNA, 17 bp, Homo sapiens
tcctgcctcagcctccg

SEQ ID NO: 1491212 - DNA, 13 bp, Homo sapiens
tcctgcctccggg

SEQ ID NO: 1491213 - DNA, 14 bp, Homo sapiens
tcctgcctccgggc

SEQ ID NO: 1491214 - DNA, 20 bp, Homo sapiens
tcctgcctgagtttccagcc

SEQ ID NO: 1491215 - DNA, 12 bp, Homo sapiens
tcctgcctggcc

SEQ ID NO: 1491216 - DNA, 16 bp, Homo sapiens
tcctgcctggccaggc

SEQ ID NO: 1491217 - DNA, 17 bp, Homo sapiens
tcctgcctgtctgcccc

SEQ ID NO: 1491218 - DNA, 14 bp, Homo sapiens
tcctgcctgtgctg

SEQ ID NO: 1491219 - DNA, 17 bp, Homo sapiens
tcctgcctttaagccaa

SEQ ID NO: 1491220 - DNA, 18 bp, Homo sapiens
tcctgcctttaagccaaa

SEQ ID NO: 1491221 - DNA, 22 bp, Homo sapiens
tcctgcggagtgaagaggggca

SEQ ID NO: 1491222 - DNA, 23 bp, Homo sapiens
tcctgcgggcttttccccggtcc

SEQ ID NO: 1491223 - DNA, 13 bp, Homo sapiens
tcctgcgggtggg

SEQ ID NO: 1491224 - DNA, 14 bp, Homo sapiens
tcctgcgggtgggg

SEQ ID NO: 1491225 - DNA, 16 bp, Homo sapiens
tcctgcgtcctcctca

SEQ ID NO: 1491226 - DNA, 18 bp, Homo sapiens
tcctgcgtcctcctcacc

SEQ ID NO: 1491227 - DNA, 21 bp, Homo sapiens
tcctgctacctcccttgcctt

SEQ ID NO: 1491228 - DNA, 23 bp, Homo sapiens
tcctgctacttccccagctctca

SEQ ID NO: 1491229 - DNA, 16 bp, Homo sapiens
tcctgctagctgtaga

SEQ ID NO: 1491230 - DNA, 22 bp, Homo sapiens
tcctgctcattatgccacttcc

SEQ ID NO: 1491231 - DNA, 18 bp, Homo sapiens
tcctgctccagcagcaca

SEQ ID NO: 1491232 - DNA, 16 bp, Homo sapiens
tcctgctccatgactg

SEQ ID NO: 1491233 - DNA, 20 bp, Homo sapiens
tcctgctccatgactggctg

SEQ ID NO: 1491234 - DNA, 21 bp, Homo sapiens
tcctgctccatgactggctgt

SEQ ID NO: 1491235 - DNA, 13 bp, Homo sapiens
tcctgctcctccc

SEQ ID NO: 1491236 - DNA, 14 bp, Homo sapiens
tcctgctcctccct

SEQ ID NO: 1491237 - DNA, 19 bp, Homo sapiens
tcctgctcctccctgcccc

SEQ ID NO: 1491238 - DNA, 15 bp, Homo sapiens
tcctgctctcttcag

SEQ ID NO: 1491239 - DNA, 17 bp, Homo sapiens
tcctgctctcttcagga

SEQ ID NO: 1491240 - DNA, 13 bp, Homo sapiens
tcctgctctggga

SEQ ID NO: 1491241 - DNA, 14 bp, Homo sapiens
tcctgctcttttgt

SEQ ID NO: 1491242 - DNA, 23 bp, Homo sapiens
tcctgctgacctcactgtcctgt

SEQ ID NO: 1491243 - DNA, 13 bp, Homo sapiens
tcctgctgcacag

SEQ ID NO: 1491244 - DNA, 18 bp, Homo sapiens
tcctgctgccttttctgg

SEQ ID NO: 1491245 - DNA, 22 bp, Homo sapiens
tcctgctgcggaggagctgcct

SEQ ID NO: 1491246 - DNA, 17 bp, Homo sapiens
tcctgctgctgctactg

SEQ ID NO: 1491247 - DNA, 12 bp, Homo sapiens
tcctgctgctgt

SEQ ID NO: 1491248 - DNA, 13 bp, Homo sapiens
tcctgctgctgta

SEQ ID NO: 1491249 - DNA, 22 bp, Homo sapiens
tcctgctgctgtaactgctgag

SEQ ID NO: 1491250 - DNA, 19 bp, Homo sapiens
tcctgctgggcgtgtgtga

SEQ ID NO: 1491251 - DNA, 11 bp, Homo sapiens
tcctgctggta

SEQ ID NO: 1491252 - DNA, 14 bp, Homo sapiens
tcctgctgtcctgg

SEQ ID NO: 1491253 - DNA, 19 bp, Homo sapiens
tcctgcttgccaaggcaga

SEQ ID NO: 1491254 - DNA, 19 bp, Homo sapiens
tcctgcttttctgtcctgg

SEQ ID NO: 1491255 - DNA, 21 bp, Homo sapiens
tcctggaaaagaagaaacttt

SEQ ID NO: 1491256 - DNA, 17 bp, Homo sapiens
tcctggaaacagcatga

SEQ ID NO: 1491257 - DNA, 20 bp, Homo sapiens
tcctggaaacagcatgaata

SEQ ID NO: 1491258 - DNA, 13 bp, Homo sapiens
tcctggaagcagg

SEQ ID NO: 1491259 - DNA, 14 bp, Homo sapiens
tcctggaagccagc

SEQ ID NO: 1491260 - DNA, 20 bp, Homo sapiens
tcctggaagccagctttccc

SEQ ID NO: 1491261 - DNA, 21 bp, Homo sapiens
tcctggaagctgtgtccttgc

SEQ ID NO: 1491262 - DNA, 19 bp, Homo sapiens
tcctggaaggacacagtga

SEQ ID NO: 1491263 - DNA, 15 bp, Homo sapiens
tcctggacatcacca

SEQ ID NO: 1491264 - DNA, 16 bp, Homo sapiens
tcctggactcccctcc

SEQ ID NO: 1491265 - DNA, 18 bp, Homo sapiens
tcctggagcagaccaccc

SEQ ID NO: 1491266 - DNA, 19 bp, Homo sapiens
tcctggagcagaccacccc

SEQ ID NO: 1491267 - DNA, 20 bp, Homo sapiens
tcctggagcccgaggcacca

SEQ ID NO: 1491268 - DNA, 14 bp, Homo sapiens
tcctggaggcccag

SEQ ID NO: 1491269 - DNA, 15 bp, Homo sapiens
tcctggaggcccagt

SEQ ID NO: 1491270 - DNA, 18 bp, Homo sapiens
tcctggaggcccagttca

SEQ ID NO: 1491271 - DNA, 19 bp, Homo sapiens
tcctggaggggctggggac

SEQ ID NO: 1491272 - DNA, 18 bp, Homo sapiens
tcctggatgttgtgtgta

SEQ ID NO: 1491273 - DNA, 18 bp, Homo sapiens
tcctggcacgccctactc

SEQ ID NO: 1491274 - DNA, 13 bp, Homo sapiens
tcctggcagccca

SEQ ID NO: 1491275 - DNA, 21 bp, Homo sapiens
tcctggccccgggctctggcc

SEQ ID NO: 1491276 - DNA, 22 bp, Homo sapiens
tcctggccccgggctctggcca

SEQ ID NO: 1491277 - DNA, 18 bp, Homo sapiens
tcctggcccctccagacc

SEQ ID NO: 1491278 - DNA, 16 bp, Homo sapiens
tcctggccctccactc

SEQ ID NO: 1491279 - DNA, 12 bp, Homo sapiens
tcctggcctcaa

SEQ ID NO: 1491280 - DNA, 22 bp, Homo sapiens
tcctggcctcactggctggggc

SEQ ID NO: 1491281 - DNA, 18 bp, Homo sapiens
tcctggcctcccttctcc

SEQ ID NO: 1491282 - DNA, 13 bp, Homo sapiens
tcctggcctgaga

SEQ ID NO: 1491283 - DNA, 13 bp, Homo sapiens
tcctggcctggca

SEQ ID NO: 1491284 - DNA, 14 bp, Homo sapiens
tcctggccttctga

SEQ ID NO: 1491285 - DNA, 16 bp, Homo sapiens
tcctggccttttgtgg

SEQ ID NO: 1491286 - DNA, 18 bp, Homo sapiens
tcctggctacatcccagc

SEQ ID NO: 1491287 - DNA, 16 bp, Homo sapiens
tcctggctcctgaggg

SEQ ID NO: 1491288 - DNA, 21 bp, Homo sapiens
tcctggctcggggtaaaaagt

SEQ ID NO: 1491289 - DNA, 12 bp, Homo sapiens
tcctggctgcgg

SEQ ID NO: 1491290 - DNA, 21 bp, Homo sapiens
tcctggctgtgcccagcaggc

SEQ ID NO: 1491291 - DNA, 22 bp, Homo sapiens
tcctgggaaggagggagctgct

SEQ ID NO: 1491292 - DNA, 16 bp, Homo sapiens
tcctgggaaggccacc

SEQ ID NO: 1491293 - DNA, 21 bp, Homo sapiens
tcctgggaaggccacctccca

SEQ ID NO: 1491294 - DNA, 20 bp, Homo sapiens
tcctgggagaacctcaggct

SEQ ID NO: 1491295 - DNA, 14 bp, Homo sapiens
tcctgggcagcttg

SEQ ID NO: 1491296 - DNA, 15 bp, Homo sapiens
tcctgggcagcttga

SEQ ID NO: 1491297 - DNA, 22 bp, Homo sapiens
tcctgggcaggtgggagctgaa

SEQ ID NO: 1491298 - DNA, 18 bp, Homo sapiens
tcctgggcatgggtccag

SEQ ID NO: 1491299 - DNA, 22 bp, Homo sapiens
tcctgggcatgggtccagggcc

SEQ ID NO: 1491300 - DNA, 20 bp, Homo sapiens
tcctgggccagggatctctc

SEQ ID NO: 1491301 - DNA, 15 bp, Homo sapiens
tcctgggcctgcccc

SEQ ID NO: 1491302 - DNA, 18 bp, Homo sapiens
tcctgggcctttgcaaga

SEQ ID NO: 1491303 - DNA, 23 bp, Homo sapiens
tcctgggctcaaatgatcctccc

SEQ ID NO: 1491304 - DNA, 15 bp, Homo sapiens
tcctggggccccgct

SEQ ID NO: 1491305 - DNA, 17 bp, Homo sapiens
tcctggggccccgctgg

SEQ ID NO: 1491306 - DNA, 15 bp, Homo sapiens
tcctggggctccctt

SEQ ID NO: 1491307 - DNA, 16 bp, Homo sapiens
tcctggggctcccttc

SEQ ID NO: 1491308 - DNA, 18 bp, Homo sapiens
tcctggggctctgtgcag

SEQ ID NO: 1491309 - DNA, 19 bp, Homo sapiens
tcctggggctctgtgcagg

SEQ ID NO: 1491310 - DNA, 16 bp, Homo sapiens
tcctgggtgggtgggg

SEQ ID NO: 1491311 - DNA, 20 bp, Homo sapiens
tcctgggtttcatgttctgt

SEQ ID NO: 1491312 - DNA, 14 bp, Homo sapiens
tcctggtcctgatg

SEQ ID NO: 1491313 - DNA, 15 bp, Homo sapiens
tcctggtcctggctg

SEQ ID NO: 1491314 - DNA, 13 bp, Homo sapiens
tcctggtctgtga

SEQ ID NO: 1491315 - DNA, 13 bp, Homo sapiens
tcctggtgagaac

SEQ ID NO: 1491316 - DNA, 21 bp, Homo sapiens
tcctggtgagaactgaggagc

SEQ ID NO: 1491317 - DNA, 21 bp, Homo sapiens
tcctggtgccaatttcaagtt

SEQ ID NO: 1491318 - DNA, 15 bp, Homo sapiens
tcctggtggctgggc

SEQ ID NO: 1491319 - DNA, 17 bp, Homo sapiens
tcctggtggctgggccc

SEQ ID NO: 1491320 - DNA, 23 bp, Homo sapiens
tcctggtggctgggcccagcagg

SEQ ID NO: 1491321 - DNA, 16 bp, Homo sapiens
tcctggtggggctgag

SEQ ID NO: 1491322 - DNA, 18 bp, Homo sapiens
tcctggtggggctgagcc

SEQ ID NO: 1491323 - DNA, 16 bp, Homo sapiens
tcctggtgggtcagcc

SEQ ID NO: 1491324 - DNA, 19 bp, Homo sapiens
tcctggtgggtcagcccag

SEQ ID NO: 1491325 - DNA, 21 bp, Homo sapiens
tcctggttcccgtttctccac

SEQ ID NO: 1491326 - DNA, 19 bp, Homo sapiens
tcctggttgttcctgcatc

SEQ ID NO: 1491327 - DNA, 14 bp, Homo sapiens
tcctgtaaataaga

SEQ ID NO: 1491328 - DNA, 20 bp, Homo sapiens
tcctgtaaatggtgtacata

SEQ ID NO: 1491329 - DNA, 15 bp, Homo sapiens
tcctgtaacaggtgt

SEQ ID NO: 1491330 - DNA, 21 bp, Homo sapiens
tcctgtaattcctacctccct

SEQ ID NO: 1491331 - DNA, 17 bp, Homo sapiens
tcctgtacactgaatat

SEQ ID NO: 1491332 - DNA, 21 bp, Homo sapiens
tcctgtacactgaatatttat

SEQ ID NO: 1491333 - DNA, 21 bp, Homo sapiens
tcctgtagctttaaaaccaca

SEQ ID NO: 1491334 - DNA, 22 bp, Homo sapiens
tcctgtccactctcggggccct

SEQ ID NO: 1491335 - DNA, 17 bp, Homo sapiens
tcctgtccagctccaac

SEQ ID NO: 1491336 - DNA, 13 bp, Homo sapiens
tcctgtccctcca

SEQ ID NO: 1491337 - DNA, 16 bp, Homo sapiens
tcctgtccctgtagct

SEQ ID NO: 1491338 - DNA, 18 bp, Homo sapiens
tcctgtcccttttccctt

SEQ ID NO: 1491339 - DNA, 24 bp, Homo sapiens
tcctgtcctgctcattatgccact

SEQ ID NO: 1491340 - DNA, 14 bp, Homo sapiens
tcctgtcctggtcc

SEQ ID NO: 1491341 - DNA, 16 bp, Homo sapiens
tcctgtcctggtcctg

SEQ ID NO: 1491342 - DNA, 14 bp, Homo sapiens
tcctgtcctttctt

SEQ ID NO: 1491343 - DNA, 15 bp, Homo sapiens
tcctgtcctttcttg

SEQ ID NO: 1491344 - DNA, 14 bp, Homo sapiens
tcctgtccttttaa

SEQ ID NO: 1491345 - DNA, 22 bp, Homo sapiens
tcctgtcgaaggggaggcacac

SEQ ID NO: 1491346 - DNA, 15 bp, Homo sapiens
tcctgtctctgcctg

SEQ ID NO: 1491347 - DNA, 22 bp, Homo sapiens
tcgaaggggaggcacactttct

SEQ ID NO: 1491348 - DNA, 14 bp, Homo sapiens
tcgaatctctgtgc

SEQ ID NO: 1491349 - DNA, 21 bp, Homo sapiens
tcgaatcttaatttattattt

SEQ ID NO: 1491350 - DNA, 18 bp, Homo sapiens
tcgacagggcctggagcc

SEQ ID NO: 1491351 - DNA, 14 bp, Homo sapiens
tcgacccagaatgg

SEQ ID NO: 1491352 - DNA, 20 bp, Homo sapiens
tcgacccagaatggagcctg

SEQ ID NO: 1491353 - DNA, 20 bp, Homo sapiens
tcgaccctgtgcaggagcta

SEQ ID NO: 1491354 - DNA, 16 bp, Homo sapiens
tcgaccgactttcccc

SEQ ID NO: 1491355 - DNA, 15 bp, Homo sapiens
tcgacggcacgcact

SEQ ID NO: 1491356 - DNA, 16 bp, Homo sapiens
tcgactactgctcctg

SEQ ID NO: 1491357 - DNA, 23 bp, Homo sapiens
tcgactactgctcctgtggcagg

SEQ ID NO: 1491358 - DNA, 16 bp, Homo sapiens
tcgactcaggatccag

SEQ ID NO: 1491359 - DNA, 21 bp, Homo sapiens
tcgactcaggatccagtccct

SEQ ID NO: 1491360 - DNA, 12 bp, Homo sapiens
tcgactctgtgc

SEQ ID NO: 1491361 - DNA, 20 bp, Homo sapiens
tcgagaaagaggcaccagga

SEQ ID NO: 1491362 - DNA, 16 bp, Homo sapiens
tcgagaactttcattt

SEQ ID NO: 1491363 - DNA, 16 bp, Homo sapiens
tcgagacacagtgaag

SEQ ID NO: 1491364 - DNA, 15 bp, Homo sapiens
tcgagaccatcctgg

SEQ ID NO: 1491365 - DNA, 20 bp, Homo sapiens
tcgagaccatcctggccaac

SEQ ID NO: 1491366 - DNA, 18 bp, Homo sapiens
tcgagaccatcctggccc

SEQ ID NO: 1491367 - DNA, 21 bp, Homo sapiens
tcgagaccatcctggcccctc

SEQ ID NO: 1491368 - DNA, 14 bp, Homo sapiens
tcgagagctggcca

SEQ ID NO: 1491369 - DNA, 15 bp, Homo sapiens
tcgagagctggccaa

SEQ ID NO: 1491370 - DNA, 21 bp, Homo sapiens
tcgagatggcagattcccact

SEQ ID NO: 1491371 - DNA, 17 bp, Homo sapiens
tcgagcagtcctgcctc

SEQ ID NO: 1491372 - DNA, 21 bp, Homo sapiens
tcgagcagtcctgcctcagcc

SEQ ID NO: 1491373 - DNA, 22 bp, Homo sapiens
tcgagccccctggatgtcccct

SEQ ID NO: 1491374 - DNA, 19 bp, Homo sapiens
tcgaggcaccggcgctgca

SEQ ID NO: 1491375 - DNA, 10 bp, Homo sapiens
tcgaggcctg

SEQ ID NO: 1491376 - DNA, 12 bp, Homo sapiens
tcgaggcctgaa

SEQ ID NO: 1491377 - DNA, 20 bp, Homo sapiens
tcgaggcctgaagccagctg

SEQ ID NO: 1491378 - DNA, 13 bp, Homo sapiens
tcgaggctagagg

SEQ ID NO: 1491379 - DNA, 16 bp, Homo sapiens
tcgaggctagaggcat

SEQ ID NO: 1491380 - DNA, 16 bp, Homo sapiens
tcgaggctgcagtcag

SEQ ID NO: 1491381 - DNA, 20 bp, Homo sapiens
tcgaggctgcagtcagtcat

SEQ ID NO: 1491382 - DNA, 13 bp, Homo sapiens
tcgagggtttgag

SEQ ID NO: 1491383 - DNA, 17 bp, Homo sapiens
tcgagggtttgaggctt

SEQ ID NO: 1491384 - DNA, 23 bp, Homo sapiens
tcgaggtaggtggatcacctgag

SEQ ID NO: 1491385 - DNA, 16 bp, Homo sapiens
tcgagtgtagctgtga

SEQ ID NO: 1491386 - DNA, 17 bp, Homo sapiens
tcgagtgtagctgtgaa

SEQ ID NO: 1491387 - DNA, 19 bp, Homo sapiens
tcgagtgtagctgtgaaat

SEQ ID NO: 1491388 - DNA, 20 bp, Homo sapiens
tcgatactgcgactttctgc

SEQ ID NO: 1491389 - DNA, 18 bp, Homo sapiens
tcgatcaaaaccttcctt

SEQ ID NO: 1491390 - DNA, 21 bp, Homo sapiens
tcgatcaaaaccttccttccc

SEQ ID NO: 1491391 - DNA, 17 bp, Homo sapiens
tcgatcatatttcccct

SEQ ID NO: 1491392 - DNA, 18 bp, Homo sapiens
tcgatcatatttcccctt

SEQ ID NO: 1491393 - DNA, 19 bp, Homo sapiens
tcgatgaagcccaataaac

SEQ ID NO: 1491394 - DNA, 23 bp, Homo sapiens
tcgattgaaggtgacctctgccc

SEQ ID NO: 1491395 - DNA, 16 bp, Homo sapiens
tcgcaaggcctgtgct

SEQ ID NO: 1491396 - DNA, 19 bp, Homo sapiens
tcgcaaggcctgtgctgca

SEQ ID NO: 1491397 - DNA, 16 bp, Homo sapiens
tcgcacaggccctagc

SEQ ID NO: 1491398 - DNA, 13 bp, Homo sapiens
tcgcaccactgca

SEQ ID NO: 1491399 - DNA, 14 bp, Homo sapiens
tcgcagaccagagc

SEQ ID NO: 1491400 - DNA, 17 bp, Homo sapiens
tcgcagcctgaagcctg

SEQ ID NO: 1491401 - DNA, 17 bp, Homo sapiens
tcgcagctaccctcagc

SEQ ID NO: 1491402 - DNA, 18 bp, Homo sapiens
tcgcagctaccctcagcc

SEQ ID NO: 1491403 - DNA, 19 bp, Homo sapiens
tcgcagctaccctcagcct

SEQ ID NO: 1491404 - DNA, 20 bp, Homo sapiens
tcgcagctaccctcagcctc

SEQ ID NO: 1491405 - DNA, 21 bp, Homo sapiens
tcgcaggatccgctgccacca

SEQ ID NO: 1491406 - DNA, 14 bp, Homo sapiens
tcgcagtcgcagga

SEQ ID NO: 1491407 - DNA, 15 bp, Homo sapiens
tcgcattaagcacac

SEQ ID NO: 1491408 - DNA, 16 bp, Homo sapiens
tcgcattaagcacaca

SEQ ID NO: 1491409 - DNA, 18 bp, Homo sapiens
tcgccacctttcaccctc

SEQ ID NO: 1491410 - DNA, 16 bp, Homo sapiens
tcgccagtcactgctg

SEQ ID NO: 1491411 - DNA, 14 bp, Homo sapiens
tcgcccagcaggag

SEQ ID NO: 1491412 - DNA, 15 bp, Homo sapiens
tcgcccagcaggaga

SEQ ID NO: 1491413 - DNA, 19 bp, Homo sapiens
tcgcccaggctggagtgca

SEQ ID NO: 1491414 - DNA, 20 bp, Homo sapiens
tcgccccagatcaccagccc

SEQ ID NO: 1491415 - DNA, 18 bp, Homo sapiens
tcgcccgcccactgtcct

SEQ ID NO: 1491416 - DNA, 20 bp, Homo sapiens
tcgcccgcccactgtcctgg

SEQ ID NO: 1491417 - DNA, 12 bp, Homo sapiens
tcgccctccttt

SEQ ID NO: 1491418 - DNA, 16 bp, Homo sapiens
tcgccctcctttccct

SEQ ID NO: 1491419 - DNA, 15 bp, Homo sapiens
tcgcccttcagccca

SEQ ID NO: 1491420 - DNA, 20 bp, Homo sapiens
tcgcctgacaaccactggtc

SEQ ID NO: 1491421 - DNA, 12 bp, Homo sapiens
tcgccttaaact

SEQ ID NO: 1491422 - DNA, 20 bp, Homo sapiens
tcgcctttgtcttgtacttc

SEQ ID NO: 1491423 - DNA, 23 bp, Homo sapiens
tcgcctttgtcttgtacttctgt

SEQ ID NO: 1491424 - DNA, 15 bp, Homo sapiens
tcgcgctcagtaaac

SEQ ID NO: 1491425 - DNA, 19 bp, Homo sapiens
tcgcgggcagcgggccagg

SEQ ID NO: 1491426 - DNA, 22 bp, Homo sapiens
tcgcgggcagcgggccaggccc

SEQ ID NO: 1491427 - DNA, 20 bp, Homo sapiens
tcgcgtgccctcgctgcttc

SEQ ID NO: 1491428 - DNA, 17 bp, Homo sapiens
tcgctaagctggctctg

SEQ ID NO: 1491429 - DNA, 16 bp, Homo sapiens
tcgctagggccaaggt

SEQ ID NO: 1491430 - DNA, 14 bp, Homo sapiens
tcgctagtgtttaa

SEQ ID NO: 1491431 - DNA, 19 bp, Homo sapiens
tcgctatgggaggcagccg

SEQ ID NO: 1491432 - DNA, 20 bp, Homo sapiens
tcgctatgtgacttgcgctt

SEQ ID NO: 1491433 - DNA, 23 bp, Homo sapiens
tcgctcaggtgatcaaaataaag

SEQ ID NO: 1491434 - DNA, 15 bp, Homo sapiens
tcgctcccctctgcc

SEQ ID NO: 1491435 - DNA, 19 bp, Homo sapiens
tcgctccctgtagctctgc

SEQ ID NO: 1491436 - DNA, 23 bp, Homo sapiens
tcgctccctgtagctctgcctcc

SEQ ID NO: 1491437 - DNA, 17 bp, Homo sapiens
tcgctctcgctctcgct

SEQ ID NO: 1491438 - DNA, 17 bp, Homo sapiens
tcgctctcgctctctct

SEQ ID NO: 1491439 - DNA, 18 bp, Homo sapiens
tcgctctcgctctctctc

SEQ ID NO: 1491440 - DNA, 22 bp, Homo sapiens
tcgctgatatatgtgtttttca

SEQ ID NO: 1491441 - DNA, 15 bp, Homo sapiens
tcgctgatgcagaca

SEQ ID NO: 1491442 - DNA, 16 bp, Homo sapiens
tcgctgccctgtggac

SEQ ID NO: 1491443 - DNA, 14 bp, Homo sapiens
tcgctgcctccatg

SEQ ID NO: 1491444 - DNA, 21 bp, Homo sapiens
tcgctgcctccatggcagcag

SEQ ID NO: 1491445 - DNA, 24 bp, Homo sapiens
tcgctgcctccatggcagcagcca

SEQ ID NO: 1491446 - DNA, 15 bp, Homo sapiens
tcgctggactattgt

SEQ ID NO: 1491447 - DNA, 17 bp, Homo sapiens
tcgctggactattgtgc

SEQ ID NO: 1491448 - DNA, 14 bp, Homo sapiens
tcgctgggtcagtg

SEQ ID NO: 1491449 - DNA, 14 bp, Homo sapiens
tcgctgtcccctca

SEQ ID NO: 1491450 - DNA, 23 bp, Homo sapiens
tcgctgtgatgcatgagctccct

SEQ ID NO: 1491451 - DNA, 21 bp, Homo sapiens
tcgctgtgtgttagttcccaa

SEQ ID NO: 1491452 - DNA, 17 bp, Homo sapiens
tcgcttcttgcctctgt

SEQ ID NO: 1491453 - DNA, 13 bp, Homo sapiens
tcgcttgagccca

SEQ ID NO: 1491454 - DNA, 14 bp, Homo sapiens
tcgcttgagcccag

SEQ ID NO: 1491455 - DNA, 18 bp, Homo sapiens
tcgcttgagcccaggagt

SEQ ID NO: 1491456 - DNA, 13 bp, Homo sapiens
tcggaaaaataat

SEQ ID NO: 1491457 - DNA, 15 bp, Homo sapiens
tcggaaatcttaaac

SEQ ID NO: 1491458 - DNA, 12 bp, Homo sapiens
tcggaacagctc

SEQ ID NO: 1491459 - DNA, 19 bp, Homo sapiens
tcggaacccaagcttagaa

SEQ ID NO: 1491460 - DNA, 13 bp, Homo sapiens
tcggaagcagtgc

SEQ ID NO: 1491461 - DNA, 16 bp, Homo sapiens
tcggaagcagtgcctt

SEQ ID NO: 1491462 - DNA, 21 bp, Homo sapiens
tctaatgccttttgaatacat

SEQ ID NO: 1491463 - DNA, 17 bp, Homo sapiens
tctaatgtctgcagctc

SEQ ID NO: 1491464 - DNA, 12 bp, Homo sapiens
tctaatgtttgt

SEQ ID NO: 1491465 - DNA, 14 bp, Homo sapiens
tctaatgtttgtga

SEQ ID NO: 1491466 - DNA, 16 bp, Homo sapiens
tctaattcacagtgct

SEQ ID NO: 1491467 - DNA, 19 bp, Homo sapiens
tctaattcccattttgcaa

SEQ ID NO: 1491468 - DNA, 13 bp, Homo sapiens
tctaattcctgtt

SEQ ID NO: 1491469 - DNA, 15 bp, Homo sapiens
tctaattcctgttgc

SEQ ID NO: 1491470 - DNA, 16 bp, Homo sapiens
tctaattcctgtttgt

SEQ ID NO: 1491471 - DNA, 19 bp, Homo sapiens
tctaattctattaaagtgc

SEQ ID NO: 1491472 - DNA, 17 bp, Homo sapiens
tctaattgcatctcaaa

SEQ ID NO: 1491473 - DNA, 19 bp, Homo sapiens
tctaattgcatctcaaaat

SEQ ID NO: 1491474 - DNA, 16 bp, Homo sapiens
tctaattgctgtgtgt

SEQ ID NO: 1491475 - DNA, 15 bp, Homo sapiens
tctaatttttaagaa

SEQ ID NO: 1491476 - DNA, 17 bp, Homo sapiens
tctacaaatttttctgt

SEQ ID NO: 1491477 - DNA, 22 bp, Homo sapiens
tctacaatatatattatatata

SEQ ID NO: 1491478 - DNA, 19 bp, Homo sapiens
tctacaatctctttttgtt

SEQ ID NO: 1491479 - DNA, 22 bp, Homo sapiens
tctacaatctctttttgtttgc

SEQ ID NO: 1491480 - DNA, 16 bp, Homo sapiens
tctacaatgacacaca

SEQ ID NO: 1491481 - DNA, 16 bp, Homo sapiens
tctacacatgtaaaat

SEQ ID NO: 1491482 - DNA, 15 bp, Homo sapiens
tctacactcatctta

SEQ ID NO: 1491483 - DNA, 20 bp, Homo sapiens
tctacagaaagaaaaatgca

SEQ ID NO: 1491484 - DNA, 19 bp, Homo sapiens
tctacagaactacatattt

SEQ ID NO: 1491485 - DNA, 16 bp, Homo sapiens
tctacagacttctcca

SEQ ID NO: 1491486 - DNA, 20 bp, Homo sapiens
tctacagctaatcagcattc

SEQ ID NO: 1491487 - DNA, 13 bp, Homo sapiens
tctacagtggttt

SEQ ID NO: 1491488 - DNA, 21 bp, Homo sapiens
tctacagtggttttatactga

SEQ ID NO: 1491489 - DNA, 20 bp, Homo sapiens
tctacataagtaattcaaga

SEQ ID NO: 1491490 - DNA, 17 bp, Homo sapiens
tctacatcttctgcctt

SEQ ID NO: 1491491 - DNA, 19 bp, Homo sapiens
tctacatcttttttcacaa

SEQ ID NO: 1491492 - DNA, 22 bp, Homo sapiens
tctacatcttttttcacaaatt

SEQ ID NO: 1491493 - DNA, 16 bp, Homo sapiens
tctacattcagattat

SEQ ID NO: 1491494 - DNA, 20 bp, Homo sapiens
tctacattgagcatttgaaa

SEQ ID NO: 1491495 - DNA, 20 bp, Homo sapiens
tctacatttctgcagatctt

SEQ ID NO: 1491496 - DNA, 11 bp, Homo sapiens
tctacatttgt

SEQ ID NO: 1491497 - DNA, 18 bp, Homo sapiens
tctaccatttcagagagg

SEQ ID NO: 1491498 - DNA, 18 bp, Homo sapiens
tctaccccagactagatg

SEQ ID NO: 1491499 - DNA, 21 bp, Homo sapiens
tctaccccagactagatgtag

SEQ ID NO: 1491500 - DNA, 19 bp, Homo sapiens
tctacctcaggcagctcaa

SEQ ID NO: 1491501 - DNA, 16 bp, Homo sapiens
tctacctccaccctgc

SEQ ID NO: 1491502 - DNA, 18 bp, Homo sapiens
tctacctccaccctgcat

SEQ ID NO: 1491503 - DNA, 19 bp, Homo sapiens
tctacgcaattgacaaacc

SEQ ID NO: 1491504 - DNA, 14 bp, Homo sapiens
tctactaaaaagaa

SEQ ID NO: 1491505 - DNA, 20 bp, Homo sapiens
tctactaaaaatacaaaaat

SEQ ID NO: 1491506 - DNA, 16 bp, Homo sapiens
tctactaaaattcaaa

SEQ ID NO: 1491507 - DNA, 22 bp, Homo sapiens
tctactcaacccattgttgtca

SEQ ID NO: 1491508 - DNA, 19 bp, Homo sapiens
tctactcctacctcagcct

SEQ ID NO: 1491509 - DNA, 17 bp, Homo sapiens
tctactcctagaagaac

SEQ ID NO: 1491510 - DNA, 19 bp, Homo sapiens
tctactcctagaagaacca

SEQ ID NO: 1491511 - DNA, 12 bp, Homo sapiens
tctactctagaa

SEQ ID NO: 1491512 - DNA, 16 bp, Homo sapiens
tctactgaattggctt

SEQ ID NO: 1491513 - DNA, 15 bp, Homo sapiens
tctactgccctcccc

SEQ ID NO: 1491514 - DNA, 23 bp, Homo sapiens
tctactgcttggatccatacaaa

SEQ ID NO: 1491515 - DNA, 22 bp, Homo sapiens
tctactggaaaaaaatacaaaa

SEQ ID NO: 1491516 - DNA, 16 bp, Homo sapiens
tctactggtcttgtgg

SEQ ID NO: 1491517 - DNA, 23 bp, Homo sapiens
tctactggtcttgtggaattggg

SEQ ID NO: 1491518 - DNA, 14 bp, Homo sapiens
tctacttacagttg

SEQ ID NO: 1491519 - DNA, 20 bp, Homo sapiens
tctacttctctgttgtcaaa

SEQ ID NO: 1491520 - DNA, 16 bp, Homo sapiens
tctactttcatcttaa

SEQ ID NO: 1491521 - DNA, 17 bp, Homo sapiens
tctactttcatcttaaa

SEQ ID NO: 1491522 - DNA, 15 bp, Homo sapiens
tctacttttaactaa

SEQ ID NO: 1491523 - DNA, 18 bp, Homo sapiens
tctactttttttttaatt

SEQ ID NO: 1491524 - DNA, 19 bp, Homo sapiens
tctagaaagagaaacagtt

SEQ ID NO: 1491525 - DNA, 21 bp, Homo sapiens
tctagaagaggggttacttct

SEQ ID NO: 1491526 - DNA, 17 bp, Homo sapiens
tctagaagatgtgtaaa

SEQ ID NO: 1491527 - DNA, 16 bp, Homo sapiens
tctagaagttgtttgt

SEQ ID NO: 1491528 - DNA, 20 bp, Homo sapiens
tctagaagttgtttgtcatc

SEQ ID NO: 1491529 - DNA, 22 bp, Homo sapiens
tctagaatgtggatttgattca

SEQ ID NO: 1491530 - DNA, 17 bp, Homo sapiens
tctagaattttaagcct

SEQ ID NO: 1491531 - DNA, 19 bp, Homo sapiens
tctagaattttaagccttt

SEQ ID NO: 1491532 - DNA, 14 bp, Homo sapiens
tctagacaagatat

SEQ ID NO: 1491533 - DNA, 23 bp, Homo sapiens
tctagacaagatattgtacataa

SEQ ID NO: 1491534 - DNA, 18 bp, Homo sapiens
tctagacatggaggttct

SEQ ID NO: 1491535 - DNA, 16 bp, Homo sapiens
tctagacgcccctccc

SEQ ID NO: 1491536 - DNA, 12 bp, Homo sapiens
tctagaggcctc

SEQ ID NO: 1491537 - DNA, 13 bp, Homo sapiens
tctagaggcctca

SEQ ID NO: 1491538 - DNA, 15 bp, Homo sapiens
tctagaggcctcagt

SEQ ID NO: 1491539 - DNA, 22 bp, Homo sapiens
tctagagtagaggtataattgt

SEQ ID NO: 1491540 - DNA, 15 bp, Homo sapiens
tctagagtccaaggt

SEQ ID NO: 1491541 - DNA, 14 bp, Homo sapiens
tctagagttcagag

SEQ ID NO: 1491542 - DNA, 16 bp, Homo sapiens
tctagatcagatgctc

SEQ ID NO: 1491543 - DNA, 18 bp, Homo sapiens
tctagatcagatgctcca

SEQ ID NO: 1491544 - DNA, 14 bp, Homo sapiens
tctagatcataagg

SEQ ID NO: 1491545 - DNA, 15 bp, Homo sapiens
tctagatcctgcacc

SEQ ID NO: 1491546 - DNA, 15 bp, Homo sapiens
tctagatctcagcca

SEQ ID NO: 1491547 - DNA, 21 bp, Homo sapiens
tctagattaccccctcattgt

SEQ ID NO: 1491548 - DNA, 22 bp, Homo sapiens
tctagattcaaaggttctaggt

SEQ ID NO: 1491549 - DNA, 22 bp, Homo sapiens
tctagattccattggtccaaga

SEQ ID NO: 1491550 - DNA, 23 bp, Homo sapiens
tctagattccattggtccaagat

SEQ ID NO: 1491551 - DNA, 15 bp, Homo sapiens
tctagattgagagaa

SEQ ID NO: 1491552 - DNA, 15 bp, Homo sapiens
tctagcaattttctt

SEQ ID NO: 1491553 - DNA, 18 bp, Homo sapiens
tctagcatggcatatttt

SEQ ID NO: 1491554 - DNA, 22 bp, Homo sapiens
tctagcatggcatatttttcac

SEQ ID NO: 1491555 - DNA, 21 bp, Homo sapiens
tctagccagcccctcttcccc

SEQ ID NO: 1491556 - DNA, 20 bp, Homo sapiens
tctagccaggagtctgtgct

SEQ ID NO: 1491557 - DNA, 14 bp, Homo sapiens
tctagcctggcaac

SEQ ID NO: 1491558 - DNA, 17 bp, Homo sapiens
tctagcctgggccagag

SEQ ID NO: 1491559 - DNA, 22 bp, Homo sapiens
tctagctataacaactctattt

SEQ ID NO: 1491560 - DNA, 23 bp, Homo sapiens
tctagctataacaactctatttt

SEQ ID NO: 1491561 - DNA, 21 bp, Homo sapiens
tctagctgcagatgcctctgc

SEQ ID NO: 1491562 - DNA, 17 bp, Homo sapiens
tctagctggcaggacac

SEQ ID NO: 1491563 - DNA, 19 bp, Homo sapiens
tctagctgtatgatttgtt

SEQ ID NO: 1491564 - DNA, 19 bp, Homo sapiens
tctagctgttgagctgttt

SEQ ID NO: 1491565 - DNA, 15 bp, Homo sapiens
tctaggaagacattt

SEQ ID NO: 1491566 - DNA, 13 bp, Homo sapiens
tctaggacacagt

SEQ ID NO: 1491567 - DNA, 23 bp, Homo sapiens
tctaggaccatggttaagagtcc

SEQ ID NO: 1491568 - DNA, 19 bp, Homo sapiens
tctaggagacagagccaag

SEQ ID NO: 1491569 - DNA, 16 bp, Homo sapiens
tctaggagctgggagg

SEQ ID NO: 1491570 - DNA, 19 bp, Homo sapiens
tctaggagggagacactgg

SEQ ID NO: 1491571 - DNA, 20 bp, Homo sapiens
tctaggagggagccttgtga

SEQ ID NO: 1491572 - DNA, 13 bp, Homo sapiens
tctaggatgtgga

SEQ ID NO: 1491573 - DNA, 16 bp, Homo sapiens
tctaggatgtggagct

SEQ ID NO: 1491574 - DNA, 22 bp, Homo sapiens
tctaggcactgtagttctaaga

SEQ ID NO: 1491575 - DNA, 20 bp, Homo sapiens
tctaggcccattgtcctcct

SEQ ID NO: 1491576 - DNA, 16 bp, Homo sapiens
tctaggctggaagagc

SEQ ID NO: 1491577 - DNA, 16 bp, Homo sapiens
tctagggcctctccag

SEQ ID NO: 1491578 - DNA, 20 bp, Homo sapiens
tctaggtaggaagagcccgc

SEQ ID NO: 1491579 - DNA, 17 bp, Homo sapiens
tctaggtctcctcaggg

SEQ ID NO: 1491580 - DNA, 17 bp, Homo sapiens
tctaggtgtggctgtga

SEQ ID NO: 1491581 - DNA, 15 bp, Homo sapiens
tctaggtttcaaaga

SEQ ID NO: 1491582 - DNA, 21 bp, Homo sapiens
tctagtaatatatttaaaggg

SEQ ID NO: 1491583 - DNA, 22 bp, Homo sapiens
tctagtattttatctggaacaa

SEQ ID NO: 1491584 - DNA, 15 bp, Homo sapiens
tctagtcaactgctg

SEQ ID NO: 1491585 - DNA, 17 bp, Homo sapiens
tctagtcaactgctgtt

SEQ ID NO: 1491586 - DNA, 21 bp, Homo sapiens
tctagtcaactgctgttttat

SEQ ID NO: 1491587 - DNA, 18 bp, Homo sapiens
tctagtccccaaggcctc

SEQ ID NO: 1491588 - DNA, 19 bp, Homo sapiens
tctagtcctattctattgc

SEQ ID NO: 1491589 - DNA, 22 bp, Homo sapiens
tctagtctcctttgcactgagg

SEQ ID NO: 1491590 - DNA, 12 bp, Homo sapiens
tctagtctctga

SEQ ID NO: 1491591 - DNA, 14 bp, Homo sapiens
tctagtctctgatt

SEQ ID NO: 1491592 - DNA, 17 bp, Homo sapiens
tctagtgcagctgaaat

SEQ ID NO: 1491593 - DNA, 14 bp, Homo sapiens
tctagtgccctcca

SEQ ID NO: 1491594 - DNA, 19 bp, Homo sapiens
tctagtgggacagcccaga

SEQ ID NO: 1491595 - DNA, 17 bp, Homo sapiens
tctagtgtgtcctgtga

SEQ ID NO: 1491596 - DNA, 12 bp, Homo sapiens
tctagttctaga

SEQ ID NO: 1491597 - DNA, 16 bp, Homo sapiens
tctagttctttcctcc

SEQ ID NO: 1491598 - DNA, 22 bp, Homo sapiens
tctagttgccctctacctgact

SEQ ID NO: 1491599 - DNA, 14 bp, Homo sapiens
tctagtttacagaa

SEQ ID NO: 1491600 - DNA, 15 bp, Homo sapiens
tctagtttacagaaa

SEQ ID NO: 1491601 - DNA, 15 bp, Homo sapiens
tctagtttcagtaaa

SEQ ID NO: 1491602 - DNA, 23 bp, Homo sapiens
tctagtttcagtaaataatgaaa

SEQ ID NO: 1491603 - DNA, 14 bp, Homo sapiens
tctagtttcttgtg

SEQ ID NO: 1491604 - DNA, 20 bp, Homo sapiens
tctagtttgcatacttcctg

SEQ ID NO: 1491605 - DNA, 17 bp, Homo sapiens
tctagttttttttgtaa

SEQ ID NO: 1491606 - DNA, 18 bp, Homo sapiens
tctagttttttttgtaaa

SEQ ID NO: 1491607 - DNA, 16 bp, Homo sapiens
tctataaaactctgca

SEQ ID NO: 1491608 - DNA, 17 bp, Homo sapiens
tctataaaatagatata

SEQ ID NO: 1491609 - DNA, 21 bp, Homo sapiens
tctataaactataacctctcc

SEQ ID NO: 1491610 - DNA, 15 bp, Homo sapiens
tctataacatgcatt

SEQ ID NO: 1491611 - DNA, 15 bp, Homo sapiens
tctataagagaatta

SEQ ID NO: 1491612 - DNA, 16 bp, Homo sapiens
tctataagtagtaaat

SEQ ID NO: 1491613 - DNA, 19 bp, Homo sapiens
tctataagtagtaaatcag

SEQ ID NO: 1491614 - DNA, 22 bp, Homo sapiens
tctataagtagtaaatcagaaa

SEQ ID NO: 1491615 - DNA, 20 bp, Homo sapiens
tctataatcccagcactttg

SEQ ID NO: 1491616 - DNA, 21 bp, Homo sapiens
tctataatcccagcactttgg

SEQ ID NO: 1491617 - DNA, 13 bp, Homo sapiens
tctataattgttt

SEQ ID NO: 1491618 - DNA, 16 bp, Homo sapiens
tctataatttacctaa

SEQ ID NO: 1491619 - DNA, 15 bp, Homo sapiens
tctataattttgcct

SEQ ID NO: 1491620 - DNA, 16 bp, Homo sapiens
tctataccaaccaaac

SEQ ID NO: 1491621 - DNA, 15 bp, Homo sapiens
tctatacccacccag

SEQ ID NO: 1491622 - DNA, 16 bp, Homo sapiens
tctatacccacccaga

SEQ ID NO: 1491623 - DNA, 17 bp, Homo sapiens
tctatacccacccagaa

SEQ ID NO: 1491624 - DNA, 12 bp, Homo sapiens
tctatactgttt

SEQ ID NO: 1491625 - DNA, 12 bp, Homo sapiens
tctatactttgt

SEQ ID NO: 1491626 - DNA, 13 bp, Homo sapiens
tctatactttgtt

SEQ ID NO: 1491627 - DNA, 16 bp, Homo sapiens
tctatagactctagga

SEQ ID NO: 1491628 - DNA, 13 bp, Homo sapiens
tctataggcagct

SEQ ID NO: 1491629 - DNA, 16 bp, Homo sapiens
tctataggcagcttct

SEQ ID NO: 1491630 - DNA, 19 bp, Homo sapiens
tctataggcagcttctaag

SEQ ID NO: 1491631 - DNA, 12 bp, Homo sapiens
tctatagttcta

SEQ ID NO: 1491632 - DNA, 15 bp, Homo sapiens
tctatagttctagac

SEQ ID NO: 1491633 - DNA, 20 bp, Homo sapiens
tctatatagttccttgcctt

SEQ ID NO: 1491634 - DNA, 21 bp, Homo sapiens
tctatatagttccttgcctta

SEQ ID NO: 1491635 - DNA, 14 bp, Homo sapiens
tctatatatgtgta

SEQ ID NO: 1491636 - DNA, 19 bp, Homo sapiens
tctatatggttctccaaga

SEQ ID NO: 1491637 - DNA, 15 bp, Homo sapiens
tctatattatgtctt

SEQ ID NO: 1491638 - DNA, 22 bp, Homo sapiens
tctatattatgtcttcttttgt

SEQ ID NO: 1491639 - DNA, 11 bp, Homo sapiens
tctatatttca

SEQ ID NO: 1491640 - DNA, 18 bp, Homo sapiens
tctatatttgtcttccga

SEQ ID NO: 1491641 - DNA, 18 bp, Homo sapiens
tctatattttaatagaaa

SEQ ID NO: 1491642 - DNA, 23 bp, Homo sapiens
tctatcaactttaatcaagttgt

SEQ ID NO: 1491643 - DNA, 20 bp, Homo sapiens
tctatcagaaatacaaaaaa

SEQ ID NO: 1491644 - DNA, 17 bp, Homo sapiens
tctatcagccttgctaa

SEQ ID NO: 1491645 - DNA, 15 bp, Homo sapiens
tctatccccaagctg

SEQ ID NO: 1491646 - DNA, 17 bp, Homo sapiens
tctatccccaagctggc

SEQ ID NO: 1491647 - DNA, 19 bp, Homo sapiens
tctatcctagtcttcacaa

SEQ ID NO: 1491648 - DNA, 16 bp, Homo sapiens
tctatctctaagctgt

SEQ ID NO: 1491649 - DNA, 22 bp, Homo sapiens
tctatgaagcccacccagaaaa

SEQ ID NO: 1491650 - DNA, 11 bp, Homo sapiens
tctatgaagtt

SEQ ID NO: 1491651 - DNA, 17 bp, Homo sapiens
tctatgaagttgctgtt

SEQ ID NO: 1491652 - DNA, 15 bp, Homo sapiens
tctatgacaaattca

SEQ ID NO: 1491653 - DNA, 22 bp, Homo sapiens
tctatgagaacaagtcacagct

SEQ ID NO: 1491654 - DNA, 16 bp, Homo sapiens
tctatgagtctagatg

SEQ ID NO: 1491655 - DNA, 22 bp, Homo sapiens
tctatgatgtttcttttgcaat

SEQ ID NO: 1491656 - DNA, 22 bp, Homo sapiens
tctatgcaaatgcctccaagcc

SEQ ID NO: 1491657 - DNA, 16 bp, Homo sapiens
tctatgccaaagatca

SEQ ID NO: 1491658 - DNA, 14 bp, Homo sapiens
tctatgcctgtatt

SEQ ID NO: 1491659 - DNA, 14 bp, Homo sapiens
tctatggcagtcca

SEQ ID NO: 1491660 - DNA, 22 bp, Homo sapiens
tctatggcagtccagccagctc

SEQ ID NO: 1491661 - DNA, 17 bp, Homo sapiens
tctatggcttatttcta

SEQ ID NO: 1491662 - DNA, 21 bp, Homo sapiens
tctatggcttatttctatgac

SEQ ID NO: 1491663 - DNA, 20 bp, Homo sapiens
tctatgtagaactgttcatt

SEQ ID NO: 1491664 - DNA, 16 bp, Homo sapiens
tctatgtatgttaatt

SEQ ID NO: 1491665 - DNA, 19 bp, Homo sapiens
tctatgtatgttaatttat

SEQ ID NO: 1491666 - DNA, 20 bp, Homo sapiens
tctatgtatgttaatttatt

SEQ ID NO: 1491667 - DNA, 21 bp, Homo sapiens
tctatgtcatttttaatgtat

SEQ ID NO: 1491668 - DNA, 23 bp, Homo sapiens
tctatgtcatttttaatgtatct

SEQ ID NO: 1491669 - DNA, 15 bp, Homo sapiens
tctatgtccaacaga

SEQ ID NO: 1491670 - DNA, 22 bp, Homo sapiens
tctatgtgctctgtactggagg

SEQ ID NO: 1491671 - DNA, 21 bp, Homo sapiens
tctatgtgttgtgtttgtagt

SEQ ID NO: 1491672 - DNA, 14 bp, Homo sapiens
tctatgttcaaaga

SEQ ID NO: 1491673 - DNA, 21 bp, Homo sapiens
tctatgtttgtgtgatttcct

SEQ ID NO: 1491674 - DNA, 15 bp, Homo sapiens
tctattaaaattctg

SEQ ID NO: 1491675 - DNA, 20 bp, Homo sapiens
tctattaaaattctgatgtt

SEQ ID NO: 1491676 - DNA, 18 bp, Homo sapiens
tctattaagatttccaag

SEQ ID NO: 1491677 - DNA, 14 bp, Homo sapiens
tctattaatatcaa

SEQ ID NO: 1491678 - DNA, 21 bp, Homo sapiens
tctattaatatcaactctgaa

SEQ ID NO: 1491679 - DNA, 16 bp, Homo sapiens
tctattaattactgtg

SEQ ID NO: 1491680 - DNA, 18 bp, Homo sapiens
tctattagactttagaaa

SEQ ID NO: 1491681 - DNA, 15 bp, Homo sapiens
tctattatactgtat

SEQ ID NO: 1491682 - DNA, 15 bp, Homo sapiens
tctattatcacatta

SEQ ID NO: 1491683 - DNA, 15 bp, Homo sapiens
tctattatggaaata

SEQ ID NO: 1491684 - DNA, 19 bp, Homo sapiens
tctattattcaaaaaatca

SEQ ID NO: 1491685 - DNA, 14 bp, Homo sapiens
tctattatttggag

SEQ ID NO: 1491686 - DNA, 19 bp, Homo sapiens
tctattctctaaactggca

SEQ ID NO: 1491687 - DNA, 13 bp, Homo sapiens
tctattctgagcc

SEQ ID NO: 1491688 - DNA, 15 bp, Homo sapiens
tctattctgagcctt

SEQ ID NO: 1491689 - DNA, 13 bp, Homo sapiens
tctattctgtcag

SEQ ID NO: 1491690 - DNA, 13 bp, Homo sapiens
tctattgaaaaca

SEQ ID NO: 1491691 - DNA, 11 bp, Homo sapiens
tctcccatccc

SEQ ID NO: 1491692 - DNA, 14 bp, Homo sapiens
tctcccatccccct

SEQ ID NO: 1491693 - DNA, 18 bp, Homo sapiens
tctcccatccccctgccc

SEQ ID NO: 1491694 - DNA, 15 bp, Homo sapiens
tctcccatcctgggg

SEQ ID NO: 1491695 - DNA, 11 bp, Homo sapiens
tctccccacac

SEQ ID NO: 1491696 - DNA, 13 bp, Homo sapiens
tctccccagccag

SEQ ID NO: 1491697 - DNA, 14 bp, Homo sapiens
tctccccagccaga

SEQ ID NO: 1491698 - DNA, 14 bp, Homo sapiens
tctccccagcccag

SEQ ID NO: 1491699 - DNA, 19 bp, Homo sapiens
tctccccaggcctccagcc

SEQ ID NO: 1491700 - DNA, 20 bp, Homo sapiens
tctccccaggcctccagcct

SEQ ID NO: 1491701 - DNA, 20 bp, Homo sapiens
tctccccaggtccagctctg

SEQ ID NO: 1491702 - DNA, 22 bp, Homo sapiens
tctccccaggtccagctctgga

SEQ ID NO: 1491703 - DNA, 19 bp, Homo sapiens
tctcccccaccccctcccc

SEQ ID NO: 1491704 - DNA, 20 bp, Homo sapiens
tctcccccaccccctccccg

SEQ ID NO: 1491705 - DNA, 20 bp, Homo sapiens
tctcccccatcccccactgc

SEQ ID NO: 1491706 - DNA, 19 bp, Homo sapiens
tctcccccgacactgctgc

SEQ ID NO: 1491707 - DNA, 21 bp, Homo sapiens
tctcccccgacactgctgcac

SEQ ID NO: 1491708 - DNA, 12 bp, Homo sapiens
tctccccctggg

SEQ ID NO: 1491709 - DNA, 21 bp, Homo sapiens
tctccccgaggctgccccagg

SEQ ID NO: 1491710 - DNA, 20 bp, Homo sapiens
tctccccgcagcccgcctgc

SEQ ID NO: 1491711 - DNA, 22 bp, Homo sapiens
tctccccgcagcccgcctgccg

SEQ ID NO: 1491712 - DNA, 19 bp, Homo sapiens
tctccccgtgtcctctccc

SEQ ID NO: 1491713 - DNA, 13 bp, Homo sapiens
tctcccctgcact

SEQ ID NO: 1491714 - DNA, 14 bp, Homo sapiens
tctcccctgcactg

SEQ ID NO: 1491715 - DNA, 17 bp, Homo sapiens
tctcccctgcactgtaa

SEQ ID NO: 1491716 - DNA, 23 bp, Homo sapiens
tctcccctgcccccaggactggg

SEQ ID NO: 1491717 - DNA, 14 bp, Homo sapiens
tctcccgcaccagg

SEQ ID NO: 1491718 - DNA, 21 bp, Homo sapiens
tctcccgcaccaggccgggct

SEQ ID NO: 1491719 - DNA, 16 bp, Homo sapiens
tctcccgcctcagcct

SEQ ID NO: 1491720 - DNA, 14 bp, Homo sapiens
tctcccgctgctgc

SEQ ID NO: 1491721 - DNA, 18 bp, Homo sapiens
tctcccgcttcctggcct

SEQ ID NO: 1491722 - DNA, 19 bp, Homo sapiens
tctcccgcttcctggcctc

SEQ ID NO: 1491723 - DNA, 20 bp, Homo sapiens
tctcccgcttcctggcctcc

SEQ ID NO: 1491724 - DNA, 14 bp, Homo sapiens
tctcccggctgcct

SEQ ID NO: 1491725 - DNA, 13 bp, Homo sapiens
tctcccgtcaggg

SEQ ID NO: 1491726 - DNA, 20 bp, Homo sapiens
tctcccgtcagggcccaagt

SEQ ID NO: 1491727 - DNA, 16 bp, Homo sapiens
tctccctaccttgcct

SEQ ID NO: 1491728 - DNA, 20 bp, Homo sapiens
tctccctagctcctcccctt

SEQ ID NO: 1491729 - DNA, 23 bp, Homo sapiens
tctccctcaactgaaggggtgca

SEQ ID NO: 1491730 - DNA, 17 bp, Homo sapiens
tctccctcccctctcag

SEQ ID NO: 1491731 - DNA, 18 bp, Homo sapiens
tctccctcccctctcaga

SEQ ID NO: 1491732 - DNA, 19 bp, Homo sapiens
tctccctcccctctcagaa

SEQ ID NO: 1491733 - DNA, 23 bp, Homo sapiens
tctccctcccctctcagaacata

SEQ ID NO: 1491734 - DNA, 18 bp, Homo sapiens
tctccctcccctgccatt

SEQ ID NO: 1491735 - DNA, 15 bp, Homo sapiens
tctccctctcctgcc

SEQ ID NO: 1491736 - DNA, 12 bp, Homo sapiens
tctccctctggc

SEQ ID NO: 1491737 - DNA, 15 bp, Homo sapiens
tctccctctggccct

SEQ ID NO: 1491738 - DNA, 20 bp, Homo sapiens
tctccctctggccctgcctt

SEQ ID NO: 1491739 - DNA, 12 bp, Homo sapiens
tctccctgcaca

SEQ ID NO: 1491740 - DNA, 21 bp, Homo sapiens
tctccctgcactccctcctgg

SEQ ID NO: 1491741 - DNA, 14 bp, Homo sapiens
tctccctgccaagt

SEQ ID NO: 1491742 - DNA, 13 bp, Homo sapiens
tctccctgccgcc

SEQ ID NO: 1491743 - DNA, 14 bp, Homo sapiens
tctccctgccgcct

SEQ ID NO: 1491744 - DNA, 15 bp, Homo sapiens
tctccctgccgcctc

SEQ ID NO: 1491745 - DNA, 13 bp, Homo sapiens
tctccctgcctgg

SEQ ID NO: 1491746 - DNA, 14 bp, Homo sapiens
tctccctgcctggc

SEQ ID NO: 1491747 - DNA, 13 bp, Homo sapiens
tctccctggccct

SEQ ID NO: 1491748 - DNA, 21 bp, Homo sapiens
tctccctgggaagcctgtgcc

SEQ ID NO: 1491749 - DNA, 17 bp, Homo sapiens
tctccctggtgcctctg

SEQ ID NO: 1491750 - DNA, 20 bp, Homo sapiens
tctccctggtgcctctgtgc

SEQ ID NO: 1491751 - DNA, 11 bp, Homo sapiens
tctccctgtca

SEQ ID NO: 1491752 - DNA, 16 bp, Homo sapiens
tctccctgtcacgctc

SEQ ID NO: 1491753 - DNA, 17 bp, Homo sapiens
tctcccttcctctctcc

SEQ ID NO: 1491754 - DNA, 19 bp, Homo sapiens
tctcccttggcccagagac

SEQ ID NO: 1491755 - DNA, 14 bp, Homo sapiens
tctccgagctctgg

SEQ ID NO: 1491756 - DNA, 18 bp, Homo sapiens
tctccgcatcgcatcctc

SEQ ID NO: 1491757 - DNA, 18 bp, Homo sapiens
tctccgccagcctcctct

SEQ ID NO: 1491758 - DNA, 13 bp, Homo sapiens
tctccgcgcctac

SEQ ID NO: 1491759 - DNA, 16 bp, Homo sapiens
tctccggcgcagacag

SEQ ID NO: 1491760 - DNA, 21 bp, Homo sapiens
tctccggggtctgtgctgtgc

SEQ ID NO: 1491761 - DNA, 18 bp, Homo sapiens
tctccgttagctcctgtg

SEQ ID NO: 1491762 - DNA, 20 bp, Homo sapiens
tctccgttagctcctgtggc

SEQ ID NO: 1491763 - DNA, 14 bp, Homo sapiens
tctccgttccatct

SEQ ID NO: 1491764 - DNA, 19 bp, Homo sapiens
tctcctaacaaaagaacta

SEQ ID NO: 1491765 - DNA, 18 bp, Homo sapiens
tctcctatatatttctat

SEQ ID NO: 1491766 - DNA, 17 bp, Homo sapiens
tctcctatgtggcagct

SEQ ID NO: 1491767 - DNA, 20 bp, Homo sapiens
tctcctatgtggcagctggg

SEQ ID NO: 1491768 - DNA, 17 bp, Homo sapiens
tctcctcaacccacatg

SEQ ID NO: 1491769 - DNA, 12 bp, Homo sapiens
tctcctcagggt

SEQ ID NO: 1491770 - DNA, 16 bp, Homo sapiens
tctcctcagggtgggg

SEQ ID NO: 1491771 - DNA, 18 bp, Homo sapiens
tctcctcagggtgggggg

SEQ ID NO: 1491772 - DNA, 20 bp, Homo sapiens
tctcctcccagcggcctccg

SEQ ID NO: 1491773 - DNA, 22 bp, Homo sapiens
tctcctcccgcccttccatgtg

SEQ ID NO: 1491774 - DNA, 23 bp, Homo sapiens
tctcctcccttccttttccctgc

SEQ ID NO: 1491775 - DNA, 14 bp, Homo sapiens
tctcctcctcccct

SEQ ID NO: 1491776 - DNA, 15 bp, Homo sapiens
tctcctcctcccctc

SEQ ID NO: 1491777 - DNA, 18 bp, Homo sapiens
tctcctcctcccctcctc

SEQ ID NO: 1491778 - DNA, 17 bp, Homo sapiens
tctcctcctctgtcttt

SEQ ID NO: 1491779 - DNA, 21 bp, Homo sapiens
tctcctcggccccctccatcg

SEQ ID NO: 1491780 - DNA, 22 bp, Homo sapiens
tctcctctccattttagcccag

SEQ ID NO: 1491781 - DNA, 22 bp, Homo sapiens
tctcctcttaaaaaataaaaac

SEQ ID NO: 1491782 - DNA, 15 bp, Homo sapiens
tctcctgacccctgc

SEQ ID NO: 1491783 - DNA, 15 bp, Homo sapiens
tctcctgacctcgtg

SEQ ID NO: 1491784 - DNA, 16 bp, Homo sapiens
tctcctgacctcgtga

SEQ ID NO: 1491785 - DNA, 15 bp, Homo sapiens
tctcctgactggtgc

SEQ ID NO: 1491786 - DNA, 11 bp, Homo sapiens
tctcctgccta

SEQ ID NO: 1491787 - DNA, 12 bp, Homo sapiens
tctcctgcctac

SEQ ID NO: 1491788 - DNA, 19 bp, Homo sapiens
tctcctgcctcagcctccc

SEQ ID NO: 1491789 - DNA, 15 bp, Homo sapiens
tctcctgctgccttt

SEQ ID NO: 1491790 - DNA, 14 bp, Homo sapiens
tctcctgcttcctc

SEQ ID NO: 1491791 - DNA, 17 bp, Homo sapiens
tctcctggaccttgaca

SEQ ID NO: 1491792 - DNA, 23 bp, Homo sapiens
tctcctggaccttgacagagcag

SEQ ID NO: 1491793 - DNA, 20 bp, Homo sapiens
tctcctggacgcccccgccc

SEQ ID NO: 1491794 - DNA, 11 bp, Homo sapiens
tctcctggagg

SEQ ID NO: 1491795 - DNA, 21 bp, Homo sapiens
tctcctggcctatccgctgcc

SEQ ID NO: 1491796 - DNA, 19 bp, Homo sapiens
tctcctgtagccactggca

SEQ ID NO: 1491797 - DNA, 14 bp, Homo sapiens
tctcctgtccaacc

SEQ ID NO: 1491798 - DNA, 17 bp, Homo sapiens
tctcctgtctcagcctc

SEQ ID NO: 1491799 - DNA, 19 bp, Homo sapiens
tctcctgtctcagcctcct

SEQ ID NO: 1491800 - DNA, 16 bp, Homo sapiens
tctcctgtctgccctc

SEQ ID NO: 1491801 - DNA, 12 bp, Homo sapiens
tctcctgtgacc

SEQ ID NO: 1491802 - DNA, 10 bp, Homo sapiens
tctcctgtgc

SEQ ID NO: 1491803 - DNA, 11 bp, Homo sapiens
tctcctgtgcc

SEQ ID NO: 1491804 - DNA, 18 bp, Homo sapiens
tctcctgtgcccacatcc

SEQ ID NO: 1491805 - DNA, 20 bp, Homo sapiens
tctccttaagctgcagagat

SEQ ID NO: 1491806 - DNA, 11 bp, Homo sapiens
tctgaaaagaa

SEQ ID NO: 1491807 - DNA, 17 bp, Homo sapiens
tctgaaaagaaatgcta

SEQ ID NO: 1491808 - DNA, 18 bp, Homo sapiens
tctgaaaagaaatgctaa

SEQ ID NO: 1491809 - DNA, 13 bp, Homo sapiens
tctgaaaatgtat

SEQ ID NO: 1491810 - DNA, 23 bp, Homo sapiens
tctgaaaattccagaaaggatat

SEQ ID NO: 1491811 - DNA, 15 bp, Homo sapiens
tctgaaaccttagtt

SEQ ID NO: 1491812 - DNA, 13 bp, Homo sapiens
tctgaaactggct

SEQ ID NO: 1491813 - DNA, 15 bp, Homo sapiens
tctgaaactggcttc

SEQ ID NO: 1491814 - DNA, 12 bp, Homo sapiens
tctgaaagccac

SEQ ID NO: 1491815 - DNA, 15 bp, Homo sapiens
tctgaaagctttata

SEQ ID NO: 1491816 - DNA, 20 bp, Homo sapiens
tctgaaataggaaacaagtg

SEQ ID NO: 1491817 - DNA, 12 bp, Homo sapiens
tctgaaatctga

SEQ ID NO: 1491818 - DNA, 22 bp, Homo sapiens
tctgaaatcttcccatgcattc

SEQ ID NO: 1491819 - DNA, 14 bp, Homo sapiens
tctgaaatgaaaca

SEQ ID NO: 1491820 - DNA, 11 bp, Homo sapiens
tctgaacaaag

SEQ ID NO: 1491821 - DNA, 16 bp, Homo sapiens
tctgaacaaagtgcta

SEQ ID NO: 1491822 - DNA, 12 bp, Homo sapiens
tctgaactcaaa

SEQ ID NO: 1491823 - DNA, 14 bp, Homo sapiens
tctgaactccattt

SEQ ID NO: 1491824 - DNA, 14 bp, Homo sapiens
tctgaactctgaca

SEQ ID NO: 1491825 - DNA, 14 bp, Homo sapiens
tctgaactgttaca

SEQ ID NO: 1491826 - DNA, 19 bp, Homo sapiens
tctgaacttgcattgtgat

SEQ ID NO: 1491827 - DNA, 22 bp, Homo sapiens
tctgaagacctcgagcagatga

SEQ ID NO: 1491828 - DNA, 19 bp, Homo sapiens
tctgaagagtatccttcct

SEQ ID NO: 1491829 - DNA, 22 bp, Homo sapiens
tctgaagagtatccttccttca

SEQ ID NO: 1491830 - DNA, 14 bp, Homo sapiens
tctgaagatggaag

SEQ ID NO: 1491831 - DNA, 19 bp, Homo sapiens
tctgaagatttccatttgt

SEQ ID NO: 1491832 - DNA, 16 bp, Homo sapiens
tctgaagccctcccag

SEQ ID NO: 1491833 - DNA, 18 bp, Homo sapiens
tctgaagccctcccaggt

SEQ ID NO: 1491834 - DNA, 14 bp, Homo sapiens
tctgaagcttgact

SEQ ID NO: 1491835 - DNA, 18 bp, Homo sapiens
tctgaagcttgactccca

SEQ ID NO: 1491836 - DNA, 23 bp, Homo sapiens
tctgaaggaatagccagagagga

SEQ ID NO: 1491837 - DNA, 16 bp, Homo sapiens
tctgaaggacacttcc

SEQ ID NO: 1491838 - DNA, 13 bp, Homo sapiens
tctgaaggagagg

SEQ ID NO: 1491839 - DNA, 15 bp, Homo sapiens
tctgaaggagaggag

SEQ ID NO: 1491840 - DNA, 18 bp, Homo sapiens
tctgaaggcaaatataag

SEQ ID NO: 1491841 - DNA, 17 bp, Homo sapiens
tctgaagtcacatcaca

SEQ ID NO: 1491842 - DNA, 23 bp, Homo sapiens
tctgaagtcacatcacaggacac

SEQ ID NO: 1491843 - DNA, 18 bp, Homo sapiens
tctgaagtcactgcacag

SEQ ID NO: 1491844 - DNA, 17 bp, Homo sapiens
tctgaataaagcaatta

SEQ ID NO: 1491845 - DNA, 20 bp, Homo sapiens
tctgaatttacttccttgca

SEQ ID NO: 1491846 - DNA, 13 bp, Homo sapiens
tctgaattttcag

SEQ ID NO: 1491847 - DNA, 23 bp, Homo sapiens
tctgaattttgcaatgtatttag

SEQ ID NO: 1491848 - DNA, 22 bp, Homo sapiens
tctgacaaaatggggcagaaga

SEQ ID NO: 1491849 - DNA, 18 bp, Homo sapiens
tctgacaaaggtggtaaa

SEQ ID NO: 1491850 - DNA, 12 bp, Homo sapiens
tctgacaagggc

SEQ ID NO: 1491851 - DNA, 23 bp, Homo sapiens
tctgacaagggctgacctgcctc

SEQ ID NO: 1491852 - DNA, 20 bp, Homo sapiens
tctgacagtccacaggggcc

SEQ ID NO: 1491853 - DNA, 15 bp, Homo sapiens
tctgacatcccttcc

SEQ ID NO: 1491854 - DNA, 18 bp, Homo sapiens
tctgacatcccttcctgg

SEQ ID NO: 1491855 - DNA, 19 bp, Homo sapiens
tctgacatcccttcctgga

SEQ ID NO: 1491856 - DNA, 23 bp, Homo sapiens
tctgacatcccttcctggaaaca

SEQ ID NO: 1491857 - DNA, 12 bp, Homo sapiens
tctgacatgtaa

SEQ ID NO: 1491858 - DNA, 18 bp, Homo sapiens
tctgacatgtaagaaaat

SEQ ID NO: 1491859 - DNA, 23 bp, Homo sapiens
tctgacattatgtggttttagat

SEQ ID NO: 1491860 - DNA, 14 bp, Homo sapiens
tctgaccagagaat

SEQ ID NO: 1491861 - DNA, 16 bp, Homo sapiens
tctgaccatctgtgac

SEQ ID NO: 1491862 - DNA, 19 bp, Homo sapiens
tctgaccatctgtgactat

SEQ ID NO: 1491863 - DNA, 22 bp, Homo sapiens
tctgacccatagcactcttgtt

SEQ ID NO: 1491864 - DNA, 21 bp, Homo sapiens
tctgaccctagctctttcctt

SEQ ID NO: 1491865 - DNA, 19 bp, Homo sapiens
tctgaccctgcttcaaata

SEQ ID NO: 1491866 - DNA, 21 bp, Homo sapiens
tctgacctaatatttggagct

SEQ ID NO: 1491867 - DNA, 18 bp, Homo sapiens
tctgacctgcactgggga

SEQ ID NO: 1491868 - DNA, 12 bp, Homo sapiens
tctgacctgcag

SEQ ID NO: 1491869 - DNA, 23 bp, Homo sapiens
tctgacctggcatctaattctga

SEQ ID NO: 1491870 - DNA, 17 bp, Homo sapiens
tctgacgcttgtgacag

SEQ ID NO: 1491871 - DNA, 20 bp, Homo sapiens
tctgacgcttgtgacagtgc

SEQ ID NO: 1491872 - DNA, 17 bp, Homo sapiens
tctgacgtagaaagatc

SEQ ID NO: 1491873 - DNA, 16 bp, Homo sapiens
tctgactcatccccac

SEQ ID NO: 1491874 - DNA, 13 bp, Homo sapiens
tctgactccagag

SEQ ID NO: 1491875 - DNA, 20 bp, Homo sapiens
tctgactccagagtctgagc

SEQ ID NO: 1491876 - DNA, 14 bp, Homo sapiens
tctgactctgagct

SEQ ID NO: 1491877 - DNA, 12 bp, Homo sapiens
tctgactgccaa

SEQ ID NO: 1491878 - DNA, 10 bp, Homo sapiens
tctgactgtt

SEQ ID NO: 1491879 - DNA, 13 bp, Homo sapiens
tctgactgtttat

SEQ ID NO: 1491880 - DNA, 15 bp, Homo sapiens
tctgactgtttattt

SEQ ID NO: 1491881 - DNA, 17 bp, Homo sapiens
tctgactgtttatttaa

SEQ ID NO: 1491882 - DNA, 21 bp, Homo sapiens
tctgactgtttatttaaggat

SEQ ID NO: 1491883 - DNA, 20 bp, Homo sapiens
tctgacttaagcaaaagaaa

SEQ ID NO: 1491884 - DNA, 23 bp, Homo sapiens
tctgacttaagcaaaagaaaaag

SEQ ID NO: 1491885 - DNA, 16 bp, Homo sapiens
tctgacttctgcctgg

SEQ ID NO: 1491886 - DNA, 17 bp, Homo sapiens
tctgacttctgcctgga

SEQ ID NO: 1491887 - DNA, 19 bp, Homo sapiens
tctgacttctgcctggaga

SEQ ID NO: 1491888 - DNA, 18 bp, Homo sapiens
tctgactttacttgtggt

SEQ ID NO: 1491889 - DNA, 12 bp, Homo sapiens
tctgagaaaaca

SEQ ID NO: 1491890 - DNA, 19 bp, Homo sapiens
tctgagaaagactattcaa

SEQ ID NO: 1491891 - DNA, 21 bp, Homo sapiens
tctgagaaagactattcaaac

SEQ ID NO: 1491892 - DNA, 23 bp, Homo sapiens
tctgagaaagactattcaaacag

SEQ ID NO: 1491893 - DNA, 24 bp, Homo sapiens
tctgagaagctctgaagaactctc

SEQ ID NO: 1491894 - DNA, 20 bp, Homo sapiens
tctgagacccttttctcagg

SEQ ID NO: 1491895 - DNA, 19 bp, Homo sapiens
tctgagagacctgtgtgaa

SEQ ID NO: 1491896 - DNA, 20 bp, Homo sapiens
tctgagaggctctccgtgca

SEQ ID NO: 1491897 - DNA, 22 bp, Homo sapiens
tctgagatctgttgattgatga

SEQ ID NO: 1491898 - DNA, 19 bp, Homo sapiens
tctgagcagcctctgccag

SEQ ID NO: 1491899 - DNA, 23 bp, Homo sapiens
tctgagcaggggaacaaaataag

SEQ ID NO: 1491900 - DNA, 22 bp, Homo sapiens
tctgagcagtcagggtgggaag

SEQ ID NO: 1491901 - DNA, 17 bp, Homo sapiens
tctgagccacagtggga

SEQ ID NO: 1491902 - DNA, 18 bp, Homo sapiens
tctgagcccgggctgcct

SEQ ID NO: 1491903 - DNA, 20 bp, Homo sapiens
tctgagcccgggctgcctgg

SEQ ID NO: 1491904 - DNA, 21 bp, Homo sapiens
tctgagcccgggctgcctggg

SEQ ID NO: 1491905 - DNA, 20 bp, Homo sapiens
tctgagccctggtgtgtttc

SEQ ID NO: 1491906 - DNA, 18 bp, Homo sapiens
tctgagcctctctcggtc

SEQ ID NO: 1491907 - DNA, 14 bp, Homo sapiens
tctgagcgcctcca

SEQ ID NO: 1491908 - DNA, 21 bp, Homo sapiens
tctgagcgcctccatccaagg

SEQ ID NO: 1491909 - DNA, 17 bp, Homo sapiens
tctgagcggcgcagagc

SEQ ID NO: 1491910 - DNA, 20 bp, Homo sapiens
tctgagcggcgcagagccct

SEQ ID NO: 1491911 - DNA, 17 bp, Homo sapiens
tctgagctatttcatct

SEQ ID NO: 1491912 - DNA, 22 bp, Homo sapiens
tctgagctatttcatctatttt

SEQ ID NO: 1491913 - DNA, 15 bp, Homo sapiens
tctgagctgtaattt

SEQ ID NO: 1491914 - DNA, 18 bp, Homo sapiens
tctgagcttttcatggaa

SEQ ID NO: 1491915 - DNA, 20 bp, Homo sapiens
tctgagcttttcatggaagt

SEQ ID NO: 1491916 - DNA, 21 bp, Homo sapiens
tctgaggaatcaacagggcag

SEQ ID NO: 1491917 - DNA, 22 bp, Homo sapiens
tctgaggacaccagtgaaagaa

SEQ ID NO: 1491918 - DNA, 19 bp, Homo sapiens
tctgaggacagagcttgaa

SEQ ID NO: 1491919 - DNA, 15 bp, Homo sapiens
tctgaggaccgctga

SEQ ID NO: 1491920 - DNA, 17 bp, Homo sapiens
tctgaggactcctgagg

SEQ ID NO: 1491921 - DNA, 22 bp, Homo sapiens
tctgaggatagtagttaaataa

SEQ ID NO: 1491922 - DNA, 21 bp, Homo sapiens
tctgaggccccttaactcatc

SEQ ID NO: 1491923 - DNA, 12 bp, Homo sapiens
tctgaggcctca

SEQ ID NO: 1491924 - DNA, 14 bp, Homo sapiens
tctgaggcctcatc

SEQ ID NO: 1491925 - DNA, 21 bp, Homo sapiens
tctgaggcctcatccctcgga

SEQ ID NO: 1491926 - DNA, 19 bp, Homo sapiens
tctgaggctctttctgggc

SEQ ID NO: 1491927 - DNA, 22 bp, Homo sapiens
tctgagggaggaggccacctct

SEQ ID NO: 1491928 - DNA, 17 bp, Homo sapiens
tctgaggggaggcacct

SEQ ID NO: 1491929 - DNA, 18 bp, Homo sapiens
tctgaggggaggcacctc

SEQ ID NO: 1491930 - DNA, 21 bp, Homo sapiens
tctgaggggaggcacctccag

SEQ ID NO: 1491931 - DNA, 23 bp, Homo sapiens
tctgaggggaggcacctccaggc

SEQ ID NO: 1491932 - DNA, 16 bp, Homo sapiens
tctgagtcaaatccag

SEQ ID NO: 1491933 - DNA, 19 bp, Homo sapiens
tctgagtcaaatccagtgg

SEQ ID NO: 1491934 - DNA, 20 bp, Homo sapiens
tctgagtcaaatccagtggt

SEQ ID NO: 1491935 - DNA, 24 bp, Homo sapiens
tctgagtcccaggagctgcccaga

SEQ ID NO: 1491936 - DNA, 16 bp, Homo sapiens
tctgagtcctgtctct

SEQ ID NO: 1491937 - DNA, 15 bp, Homo sapiens
tctgagtctatgttc

SEQ ID NO: 1491938 - DNA, 18 bp, Homo sapiens
tctgagtctatgttcaaa

SEQ ID NO: 1491939 - DNA, 13 bp, Homo sapiens
tctgagttcttga

SEQ ID NO: 1491940 - DNA, 17 bp, Homo sapiens
tctgataaagttcctta

SEQ ID NO: 1491941 - DNA, 13 bp, Homo sapiens
tctgatattaatc

SEQ ID NO: 1491942 - DNA, 17 bp, Homo sapiens
tctgatattaatcaaaa

SEQ ID NO: 1491943 - DNA, 17 bp, Homo sapiens
tctgatattccatgaat

SEQ ID NO: 1491944 - DNA, 13 bp, Homo sapiens
tctgatcaagagt

SEQ ID NO: 1491945 - DNA, 21 bp, Homo sapiens
tctgatcacattcttcaaaga

SEQ ID NO: 1491946 - DNA, 20 bp, Homo sapiens
tctgatcttggaaaaacagc

SEQ ID NO: 1491947 - DNA, 15 bp, Homo sapiens
tctgatggccttaat

SEQ ID NO: 1491948 - DNA, 20 bp, Homo sapiens
tctgatggccttaatttcct

SEQ ID NO: 1491949 - DNA, 16 bp, Homo sapiens
tctgatggctgctcca

SEQ ID NO: 1491950 - DNA, 16 bp, Homo sapiens
tctgatggtgagctgg

SEQ ID NO: 1491951 - DNA, 18 bp, Homo sapiens
tctgatggtgagctggga

SEQ ID NO: 1491952 - DNA, 17 bp, Homo sapiens
tctgatgtttctgtgaa

SEQ ID NO: 1491953 - DNA, 19 bp, Homo sapiens
tctgatgtttctgtgaaat

SEQ ID NO: 1491954 - DNA, 15 bp, Homo sapiens
tctgattaaatttaa

SEQ ID NO: 1491955 - DNA, 18 bp, Homo sapiens
tctgattcacctcttcct

SEQ ID NO: 1491956 - DNA, 22 bp, Homo sapiens
tctgattctatgcctgtatttc

SEQ ID NO: 1491957 - DNA, 16 bp, Homo sapiens
tctgattggacatttt

SEQ ID NO: 1491958 - DNA, 21 bp, Homo sapiens
tctgattggacattttcttca

SEQ ID NO: 1491959 - DNA, 23 bp, Homo sapiens
tctgattggacattttcttcaga

SEQ ID NO: 1491960 - DNA, 14 bp, Homo sapiens
tctgatttgcaaat

SEQ ID NO: 1491961 - DNA, 17 bp, Homo sapiens
tctgatttgctgctctt

SEQ ID NO: 1491962 - DNA, 16 bp, Homo sapiens
tctgattttaatgaaa

SEQ ID NO: 1491963 - DNA, 17 bp, Homo sapiens
tctgattttaatgaaat

SEQ ID NO: 1491964 - DNA, 22 bp, Homo sapiens
tctgattttaggagctaaggct

SEQ ID NO: 1491965 - DNA, 14 bp, Homo sapiens
tctgattttggcat

SEQ ID NO: 1491966 - DNA, 14 bp, Homo sapiens
tctgatttttctct

SEQ ID NO: 1491967 - DNA, 16 bp, Homo sapiens
tctgcaaagcatgttt

SEQ ID NO: 1491968 - DNA, 23 bp, Homo sapiens
tctgcaaagcatgttttgcatgt

SEQ ID NO: 1491969 - DNA, 14 bp, Homo sapiens
tctgcaacaagcat

SEQ ID NO: 1491970 - DNA, 18 bp, Homo sapiens
tctgcaactagccaaggc

SEQ ID NO: 1491971 - DNA, 17 bp, Homo sapiens
tctgcaactgctcagct

SEQ ID NO: 1491972 - DNA, 22 bp, Homo sapiens
tctgcaactgctcagctctggt

SEQ ID NO: 1491973 - DNA, 16 bp, Homo sapiens
tctgcaagggcccaga

SEQ ID NO: 1491974 - DNA, 23 bp, Homo sapiens
tctgcaagtatactagggagcca

SEQ ID NO: 1491975 - DNA, 10 bp, Homo sapiens
tctgcacaga

SEQ ID NO: 1491976 - DNA, 19 bp, Homo sapiens
tctgcacagacaagcagcc

SEQ ID NO: 1491977 - DNA, 12 bp, Homo sapiens
tctgcacatgaa

SEQ ID NO: 1491978 - DNA, 12 bp, Homo sapiens
tctgcacatgtc

SEQ ID NO: 1491979 - DNA, 15 bp, Homo sapiens
tctgcacatgtcttg

SEQ ID NO: 1491980 - DNA, 19 bp, Homo sapiens
tctgcacatgtcttgtaca

SEQ ID NO: 1491981 - DNA, 21 bp, Homo sapiens
tctgcacccagtgaacacatt

SEQ ID NO: 1491982 - DNA, 22 bp, Homo sapiens
tctgcaccccttctctcctccc

SEQ ID NO: 1491983 - DNA, 14 bp, Homo sapiens
tctgcaccctccac

SEQ ID NO: 1491984 - DNA, 19 bp, Homo sapiens
tctgcaccctccaccctgt

SEQ ID NO: 1491985 - DNA, 21 bp, Homo sapiens
tctgcaccctccaccctgtcc

SEQ ID NO: 1491986 - DNA, 19 bp, Homo sapiens
tctgcactactcctctgca

SEQ ID NO: 1491987 - DNA, 20 bp, Homo sapiens
tctgcactactcctctgcag

SEQ ID NO: 1491988 - DNA, 23 bp, Homo sapiens
tctgcactactcctctgcagtgc

SEQ ID NO: 1491989 - DNA, 21 bp, Homo sapiens
tctgcactactgacatgtggg

SEQ ID NO: 1491990 - DNA, 13 bp, Homo sapiens
tctgcactccatg

SEQ ID NO: 1491991 - DNA, 21 bp, Homo sapiens
tctgcactcccacctgacaca

SEQ ID NO: 1491992 - DNA, 13 bp, Homo sapiens
tctgcactgaaaa

SEQ ID NO: 1491993 - DNA, 16 bp, Homo sapiens
tctgcactgaaaaggt

SEQ ID NO: 1491994 - DNA, 16 bp, Homo sapiens
tctgcagacttcccag

SEQ ID NO: 1491995 - DNA, 18 bp, Homo sapiens
tctgcagacttcccagct

SEQ ID NO: 1491996 - DNA, 20 bp, Homo sapiens
tctgcagatagaaagcatta

SEQ ID NO: 1491997 - DNA, 16 bp, Homo sapiens
tctgcagatggaaagt

SEQ ID NO: 1491998 - DNA, 12 bp, Homo sapiens
tctgcagcggca

SEQ ID NO: 1491999 - DNA, 12 bp, Homo sapiens
tctgcagctgcc

SEQ ID NO: 1492000 - DNA, 14 bp, Homo sapiens
tctgcagctgccgg

SEQ ID NO: 1492001 - DNA, 19 bp, Homo sapiens
tctgcagctgcttttgcat

SEQ ID NO: 1492002 - DNA, 13 bp, Homo sapiens
tctgcagctgttt

SEQ ID NO: 1492003 - DNA, 21 bp, Homo sapiens
tctgcaggtgggctgctgagg

SEQ ID NO: 1492004 - DNA, 14 bp, Homo sapiens
tctgcagtcctggt

SEQ ID NO: 1492005 - DNA, 16 bp, Homo sapiens
tctgcagtcctggtgg

SEQ ID NO: 1492006 - DNA, 16 bp, Homo sapiens
tctgcagtctcatttc

SEQ ID NO: 1492007 - DNA, 17 bp, Homo sapiens
tctgcagtctcatttct

SEQ ID NO: 1492008 - DNA, 18 bp, Homo sapiens
tctgcagtctcatttctc

SEQ ID NO: 1492009 - DNA, 15 bp, Homo sapiens
tctgcagtgccttgg

SEQ ID NO: 1492010 - DNA, 16 bp, Homo sapiens
tctgcagtgtgccccc

SEQ ID NO: 1492011 - DNA, 17 bp, Homo sapiens
tctgcagtttttcccaa

SEQ ID NO: 1492012 - DNA, 14 bp, Homo sapiens
tctgcatcagctgc

SEQ ID NO: 1492013 - DNA, 12 bp, Homo sapiens
tctgcatggaaa

SEQ ID NO: 1492014 - DNA, 14 bp, Homo sapiens
tctgcattcctgat

SEQ ID NO: 1492015 - DNA, 21 bp, Homo sapiens
tctgcattgctagataaaagc

SEQ ID NO: 1492016 - DNA, 20 bp, Homo sapiens
tctgcattgttattgtggaa

SEQ ID NO: 1492017 - DNA, 17 bp, Homo sapiens
tctgcattttcacccca

SEQ ID NO: 1492018 - DNA, 21 bp, Homo sapiens
tctgcattttcaccccaccct

SEQ ID NO: 1492019 - DNA, 23 bp, Homo sapiens
tctgccaaattgagataatgata

SEQ ID NO: 1492020 - DNA, 16 bp, Homo sapiens
tctgccaacatgagga

SEQ ID NO: 1492021 - DNA, 17 bp, Homo sapiens
tctgccaacatgaggac

SEQ ID NO: 1492022 - DNA, 20 bp, Homo sapiens
tctgccaacatgaggacaga

SEQ ID NO: 1492023 - DNA, 14 bp, Homo sapiens
tctgccaacctaaa

SEQ ID NO: 1492024 - DNA, 22 bp, Homo sapiens
tctgccaatttttgccttcatt

SEQ ID NO: 1492025 - DNA, 22 bp, Homo sapiens
tctgccaccccaggtttttcat

SEQ ID NO: 1492026 - DNA, 16 bp, Homo sapiens
tctgccactgaggaga

SEQ ID NO: 1492027 - DNA, 20 bp, Homo sapiens
tctgccactgaggagacaga

SEQ ID NO: 1492028 - DNA, 16 bp, Homo sapiens
tctgccacttgtcaaa

SEQ ID NO: 1492029 - DNA, 16 bp, Homo sapiens
tctgccagccagcagc

SEQ ID NO: 1492030 - DNA, 12 bp, Homo sapiens
tctgccagggag

SEQ ID NO: 1492031 - DNA, 13 bp, Homo sapiens
tctgccagtgaca

SEQ ID NO: 1492032 - DNA, 23 bp, Homo sapiens
tctgccagtgacagacaggctct

SEQ ID NO: 1492033 - DNA, 18 bp, Homo sapiens
tctgccatctagccagcc

SEQ ID NO: 1492034 - DNA, 15 bp, Homo sapiens
tctgccatgtggcag

SEQ ID NO: 1492035 - DNA, 13 bp, Homo sapiens
tctggctttttct

SEQ ID NO: 1492036 - DNA, 18 bp, Homo sapiens
tctgggaaataagagaga

SEQ ID NO: 1492037 - DNA, 23 bp, Homo sapiens
tctgggaagggagagggcctctg

SEQ ID NO: 1492038 - DNA, 16 bp, Homo sapiens
tctgggaccctttcct

SEQ ID NO: 1492039 - DNA, 20 bp, Homo sapiens
tctgggacctgccaggcagg

SEQ ID NO: 1492040 - DNA, 17 bp, Homo sapiens
tctgggactctcctcct

SEQ ID NO: 1492041 - DNA, 20 bp, Homo sapiens
tctgggactctcctcctccc

SEQ ID NO: 1492042 - DNA, 23 bp, Homo sapiens
tctgggagaaaatcatcaagaag

SEQ ID NO: 1492043 - DNA, 17 bp, Homo sapiens
tctgggaggcaagaaaa

SEQ ID NO: 1492044 - DNA, 18 bp, Homo sapiens
tctgggaggcaagaaaag

SEQ ID NO: 1492045 - DNA, 21 bp, Homo sapiens
tctgggatctgttttctggaa

SEQ ID NO: 1492046 - DNA, 22 bp, Homo sapiens
tctgggatgtagaacttcaaga

SEQ ID NO: 1492047 - DNA, 15 bp, Homo sapiens
tctgggcacagtggg

SEQ ID NO: 1492048 - DNA, 23 bp, Homo sapiens
tctgggcaccacctctgtgggca

SEQ ID NO: 1492049 - DNA, 18 bp, Homo sapiens
tctgggcagtgtggcctc

SEQ ID NO: 1492050 - DNA, 16 bp, Homo sapiens
tctgggccaagttcct

SEQ ID NO: 1492051 - DNA, 14 bp, Homo sapiens
tctgggcctgttct

SEQ ID NO: 1492052 - DNA, 15 bp, Homo sapiens
tctgggctcagggct

SEQ ID NO: 1492053 - DNA, 21 bp, Homo sapiens
tctgggctcctggaaccaatc

SEQ ID NO: 1492054 - DNA, 23 bp, Homo sapiens
tctgggctgtaacgtggcactgg

SEQ ID NO: 1492055 - DNA, 14 bp, Homo sapiens
tctgggcttcattc

SEQ ID NO: 1492056 - DNA, 20 bp, Homo sapiens
tctggggaaagacactgcct

SEQ ID NO: 1492057 - DNA, 21 bp, Homo sapiens
tctggggaaagacactgcctg

SEQ ID NO: 1492058 - DNA, 23 bp, Homo sapiens
tctggggaaagacactgcctggg

SEQ ID NO: 1492059 - DNA, 13 bp, Homo sapiens
tctggggaagagg

SEQ ID NO: 1492060 - DNA, 17 bp, Homo sapiens
tctggggacagcttcct

SEQ ID NO: 1492061 - DNA, 16 bp, Homo sapiens
tctggggagagcggct

SEQ ID NO: 1492062 - DNA, 18 bp, Homo sapiens
tctggggagagcggctgg

SEQ ID NO: 1492063 - DNA, 21 bp, Homo sapiens
tctggggaggcaggcattcct

SEQ ID NO: 1492064 - DNA, 16 bp, Homo sapiens
tctggggatttctggg

SEQ ID NO: 1492065 - DNA, 19 bp, Homo sapiens
tctggggcaggctgggcca

SEQ ID NO: 1492066 - DNA, 15 bp, Homo sapiens
tctggggctctggga

SEQ ID NO: 1492067 - DNA, 23 bp, Homo sapiens
tctggggctgtgttatgaaaata

SEQ ID NO: 1492068 - DNA, 18 bp, Homo sapiens
tctggggggacccagtgc

SEQ ID NO: 1492069 - DNA, 21 bp, Homo sapiens
tctggggggacccagtgcaga

SEQ ID NO: 1492070 - DNA, 14 bp, Homo sapiens
tctgggggtcctct

SEQ ID NO: 1492071 - DNA, 18 bp, Homo sapiens
tctgggggtcctctctga

SEQ ID NO: 1492072 - DNA, 15 bp, Homo sapiens
tctggggtgagggag

SEQ ID NO: 1492073 - DNA, 17 bp, Homo sapiens
tctggggtgggcagttt

SEQ ID NO: 1492074 - DNA, 17 bp, Homo sapiens
tctggggttcagcccct

SEQ ID NO: 1492075 - DNA, 23 bp, Homo sapiens
tctggggttcagcccctcctctg

SEQ ID NO: 1492076 - DNA, 16 bp, Homo sapiens
tctgggtaagaagaaa

SEQ ID NO: 1492077 - DNA, 18 bp, Homo sapiens
tctgggtaagaagaaagc

SEQ ID NO: 1492078 - DNA, 15 bp, Homo sapiens
tctgggtcagaacca

SEQ ID NO: 1492079 - DNA, 13 bp, Homo sapiens
tctgggtcttttg

SEQ ID NO: 1492080 - DNA, 22 bp, Homo sapiens
tctgggtggaagtgcccagccc

SEQ ID NO: 1492081 - DNA, 16 bp, Homo sapiens
tctgggtggtaactgc

SEQ ID NO: 1492082 - DNA, 18 bp, Homo sapiens
tctgggtggtaactgcca

SEQ ID NO: 1492083 - DNA, 18 bp, Homo sapiens
tctgggtttctaagcagt

SEQ ID NO: 1492084 - DNA, 13 bp, Homo sapiens
tctggtcccttgc

SEQ ID NO: 1492085 - DNA, 17 bp, Homo sapiens
tctggtcgctcctgccc

SEQ ID NO: 1492086 - DNA, 20 bp, Homo sapiens
tctggtctataccttaagaa

SEQ ID NO: 1492087 - DNA, 15 bp, Homo sapiens
tctggtgacaaatat

SEQ ID NO: 1492088 - DNA, 16 bp, Homo sapiens
tctggtgacaccagcc

SEQ ID NO: 1492089 - DNA, 17 bp, Homo sapiens
tctggtgagtcaccact

SEQ ID NO: 1492090 - DNA, 13 bp, Homo sapiens
tctggtgcagaat

SEQ ID NO: 1492091 - DNA, 13 bp, Homo sapiens
tctggtgcctcca

SEQ ID NO: 1492092 - DNA, 15 bp, Homo sapiens
tctggtgcctccaga

SEQ ID NO: 1492093 - DNA, 16 bp, Homo sapiens
tctggtgcctccagag

SEQ ID NO: 1492094 - DNA, 14 bp, Homo sapiens
tctggtgctgagga

SEQ ID NO: 1492095 - DNA, 12 bp, Homo sapiens
tctggtggcccc

SEQ ID NO: 1492096 - DNA, 15 bp, Homo sapiens
tctggtggctcctcc

SEQ ID NO: 1492097 - DNA, 19 bp, Homo sapiens
tctggtggggctgtcctgc

SEQ ID NO: 1492098 - DNA, 20 bp, Homo sapiens
tctggtggggctgtcctgct

SEQ ID NO: 1492099 - DNA, 16 bp, Homo sapiens
tctggtggtctgttgg

SEQ ID NO: 1492100 - DNA, 15 bp, Homo sapiens
tctggtggtcttcct

SEQ ID NO: 1492101 - DNA, 16 bp, Homo sapiens
tctggtggtcttcctt

SEQ ID NO: 1492102 - DNA, 18 bp, Homo sapiens
tctggtggtcttccttct

SEQ ID NO: 1492103 - DNA, 17 bp, Homo sapiens
tctggtgtgtggtgagg

SEQ ID NO: 1492104 - DNA, 20 bp, Homo sapiens
tctggtgtttggtttcttca

SEQ ID NO: 1492105 - DNA, 13 bp, Homo sapiens
tctggttccaggg

SEQ ID NO: 1492106 - DNA, 21 bp, Homo sapiens
tctggttccagggtccctctg

SEQ ID NO: 1492107 - DNA, 20 bp, Homo sapiens
tctggttccatttttcctct

SEQ ID NO: 1492108 - DNA, 14 bp, Homo sapiens
tctggttgtatttc

SEQ ID NO: 1492109 - DNA, 15 bp, Homo sapiens
tctggttgtatttct

SEQ ID NO: 1492110 - DNA, 17 bp, Homo sapiens
tctggttgtatttctat

SEQ ID NO: 1492111 - DNA, 18 bp, Homo sapiens
tctggtttggcatggtga

SEQ ID NO: 1492112 - DNA, 13 bp, Homo sapiens
tctgtaaactgtg

SEQ ID NO: 1492113 - DNA, 14 bp, Homo sapiens
tctgtaaactgtgt

SEQ ID NO: 1492114 - DNA, 22 bp, Homo sapiens
tctgtaaactgtgtattccaag

SEQ ID NO: 1492115 - DNA, 13 bp, Homo sapiens
tctgtaaataacc

SEQ ID NO: 1492116 - DNA, 13 bp, Homo sapiens
tctgtaaatttaa

SEQ ID NO: 1492117 - DNA, 23 bp, Homo sapiens
tctgtaactctttctgaggagct

SEQ ID NO: 1492118 - DNA, 17 bp, Homo sapiens
tctgtaagagaaaatat

SEQ ID NO: 1492119 - DNA, 23 bp, Homo sapiens
tctgtaagagaaaatattactta

SEQ ID NO: 1492120 - DNA, 21 bp, Homo sapiens
tctgtaatgtaaataaactat

SEQ ID NO: 1492121 - DNA, 16 bp, Homo sapiens
tctgtaattcaggttt

SEQ ID NO: 1492122 - DNA, 16 bp, Homo sapiens
tctgtacagaatgcta

SEQ ID NO: 1492123 - DNA, 12 bp, Homo sapiens
tctgtaccagtt

SEQ ID NO: 1492124 - DNA, 13 bp, Homo sapiens
tctgtaccagtta

SEQ ID NO: 1492125 - DNA, 22 bp, Homo sapiens
tctgtaccagttaatttttcca

SEQ ID NO: 1492126 - DNA, 18 bp, Homo sapiens
tctgtaccgcccggcagc

SEQ ID NO: 1492127 - DNA, 21 bp, Homo sapiens
tctgtaccgcccggcagcccc

SEQ ID NO: 1492128 - DNA, 14 bp, Homo sapiens
tctgtacttttcat

SEQ ID NO: 1492129 - DNA, 14 bp, Homo sapiens
tctgtagacttctg

SEQ ID NO: 1492130 - DNA, 15 bp, Homo sapiens
tctgtagacttctgg

SEQ ID NO: 1492131 - DNA, 19 bp, Homo sapiens
tctgtagacttctggttgt

SEQ ID NO: 1492132 - DNA, 18 bp, Homo sapiens
tctgtagacttttgaaaa

SEQ ID NO: 1492133 - DNA, 16 bp, Homo sapiens
tctgtagcccaggcca

SEQ ID NO: 1492134 - DNA, 14 bp, Homo sapiens
tctgtagctccctc

SEQ ID NO: 1492135 - DNA, 21 bp, Homo sapiens
tctgtagctccctcctcccat

SEQ ID NO: 1492136 - DNA, 22 bp, Homo sapiens
tctgtagctccctcctcccatc

SEQ ID NO: 1492137 - DNA, 13 bp, Homo sapiens
tctgtagctcctc

SEQ ID NO: 1492138 - DNA, 23 bp, Homo sapiens
tctgtagctcctcaactcaccta

SEQ ID NO: 1492139 - DNA, 17 bp, Homo sapiens
tctgtagcttaaaccaa

SEQ ID NO: 1492140 - DNA, 16 bp, Homo sapiens
tctgtagtaatttatt

SEQ ID NO: 1492141 - DNA, 23 bp, Homo sapiens
tctgtagtactccttaagaacac

SEQ ID NO: 1492142 - DNA, 22 bp, Homo sapiens
tctgtagttgcagctgatgcct

SEQ ID NO: 1492143 - DNA, 23 bp, Homo sapiens
tctgtataaagcctgtattctca

SEQ ID NO: 1492144 - DNA, 15 bp, Homo sapiens
tctgtatacaaccct

SEQ ID NO: 1492145 - DNA, 15 bp, Homo sapiens
tctgtatactcctgt

SEQ ID NO: 1492146 - DNA, 22 bp, Homo sapiens
tctgtatataaaatattttcat

SEQ ID NO: 1492147 - DNA, 21 bp, Homo sapiens
tctgtatatgattctctgtgg

SEQ ID NO: 1492148 - DNA, 20 bp, Homo sapiens
tctgtatatgttgtaataaa

SEQ ID NO: 1492149 - DNA, 18 bp, Homo sapiens
tcttatatatgtgaacat

SEQ ID NO: 1492150 - DNA, 16 bp, Homo sapiens
tcttatcctctctctc

SEQ ID NO: 1492151 - DNA, 20 bp, Homo sapiens
tcttatctcagatatttgca

SEQ ID NO: 1492152 - DNA, 14 bp, Homo sapiens
tcttatctgttcag

SEQ ID NO: 1492153 - DNA, 14 bp, Homo sapiens
tcttatgcaatttc

SEQ ID NO: 1492154 - DNA, 21 bp, Homo sapiens
tcttatgctctcactgtttgt

SEQ ID NO: 1492155 - DNA, 18 bp, Homo sapiens
tcttatggtccagaaact

SEQ ID NO: 1492156 - DNA, 15 bp, Homo sapiens
tcttatgtgaaaaat

SEQ ID NO: 1492157 - DNA, 17 bp, Homo sapiens
tcttatgtgaaaaatta

SEQ ID NO: 1492158 - DNA, 14 bp, Homo sapiens
tcttatgtgtgcct

SEQ ID NO: 1492159 - DNA, 22 bp, Homo sapiens
tcttattaatcatacaaactct

SEQ ID NO: 1492160 - DNA, 20 bp, Homo sapiens
tcttattaatttcagtcttg

SEQ ID NO: 1492161 - DNA, 19 bp, Homo sapiens
tcttattccaggagaaggg

SEQ ID NO: 1492162 - DNA, 21 bp, Homo sapiens
tcttattgcaaggcagtctct

SEQ ID NO: 1492163 - DNA, 22 bp, Homo sapiens
tcttattgcaaggcagtctcta

SEQ ID NO: 1492164 - DNA, 16 bp, Homo sapiens
tcttattgcgctgcta

SEQ ID NO: 1492165 - DNA, 15 bp, Homo sapiens
tcttatttacccttt

SEQ ID NO: 1492166 - DNA, 17 bp, Homo sapiens
tcttatttacccttttc

SEQ ID NO: 1492167 - DNA, 13 bp, Homo sapiens
tcttatttattat

SEQ ID NO: 1492168 - DNA, 13 bp, Homo sapiens
tcttatttcattt

SEQ ID NO: 1492169 - DNA, 15 bp, Homo sapiens
tcttatttcatttct

SEQ ID NO: 1492170 - DNA, 22 bp, Homo sapiens
tcttattttgcattccagaatc

SEQ ID NO: 1492171 - DNA, 19 bp, Homo sapiens
tcttcaaaaagcagagtgg

SEQ ID NO: 1492172 - DNA, 14 bp, Homo sapiens
tcttcaaagccttc

SEQ ID NO: 1492173 - DNA, 12 bp, Homo sapiens
tcttcaaatgtt

SEQ ID NO: 1492174 - DNA, 20 bp, Homo sapiens
tcttcaaattagaagacatt

SEQ ID NO: 1492175 - DNA, 15 bp, Homo sapiens
tcttcaactcctggg

SEQ ID NO: 1492176 - DNA, 17 bp, Homo sapiens
tcttcaagcctgggcgt

SEQ ID NO: 1492177 - DNA, 17 bp, Homo sapiens
tcttcaatatgaatcta

SEQ ID NO: 1492178 - DNA, 18 bp, Homo sapiens
tcttcaatatgaatctat

SEQ ID NO: 1492179 - DNA, 17 bp, Homo sapiens
tcttcaatctctgttct

SEQ ID NO: 1492180 - DNA, 15 bp, Homo sapiens
tcttcacaacagatt

SEQ ID NO: 1492181 - DNA, 16 bp, Homo sapiens
tcttcacactgcgcag

SEQ ID NO: 1492182 - DNA, 18 bp, Homo sapiens
tcttcaccaagtgcaata

SEQ ID NO: 1492183 - DNA, 23 bp, Homo sapiens
tcttcacctaagtctctgtgaat

SEQ ID NO: 1492184 - DNA, 15 bp, Homo sapiens
tcttcacctcttcca

SEQ ID NO: 1492185 - DNA, 21 bp, Homo sapiens
tcttcacctttgtaagacatt

SEQ ID NO: 1492186 - DNA, 22 bp, Homo sapiens
tcttcactaccctgattcttga

SEQ ID NO: 1492187 - DNA, 15 bp, Homo sapiens
tcttcactgcaattt

SEQ ID NO: 1492188 - DNA, 16 bp, Homo sapiens
tcttcactgtggccac

SEQ ID NO: 1492189 - DNA, 19 bp, Homo sapiens
tcttcactgtggccacagc

SEQ ID NO: 1492190 - DNA, 20 bp, Homo sapiens
tcttcactgtggccacagcc

SEQ ID NO: 1492191 - DNA, 13 bp, Homo sapiens
tcttcagaagaca

SEQ ID NO: 1492192 - DNA, 13 bp, Homo sapiens
tcttcagacccag

SEQ ID NO: 1492193 - DNA, 20 bp, Homo sapiens
tcttcagacggagctgcgct

SEQ ID NO: 1492194 - DNA, 11 bp, Homo sapiens
tcttcagagca

SEQ ID NO: 1492195 - DNA, 24 bp, Homo sapiens
tcttcagagcaaaagacttgagcc

SEQ ID NO: 1492196 - DNA, 23 bp, Homo sapiens
tcttcagagtttgtcatatactg

SEQ ID NO: 1492197 - DNA, 12 bp, Homo sapiens
tcttcagcccag

SEQ ID NO: 1492198 - DNA, 12 bp, Homo sapiens
tcttcagcctag

SEQ ID NO: 1492199 - DNA, 23 bp, Homo sapiens
tcttcagcctagccgacctcagc

SEQ ID NO: 1492200 - DNA, 13 bp, Homo sapiens
tcttcaggaggcc

SEQ ID NO: 1492201 - DNA, 22 bp, Homo sapiens
tcttcaggatattggttcttcc

SEQ ID NO: 1492202 - DNA, 15 bp, Homo sapiens
tcttcaggcctccct

SEQ ID NO: 1492203 - DNA, 23 bp, Homo sapiens
tcttcaggtggaaaaacatctga

SEQ ID NO: 1492204 - DNA, 16 bp, Homo sapiens
tcttcaggttctcatg

SEQ ID NO: 1492205 - DNA, 19 bp, Homo sapiens
tcttcagtgactcctgctg

SEQ ID NO: 1492206 - DNA, 19 bp, Homo sapiens
tcttcagtgggagaaaaca

SEQ ID NO: 1492207 - DNA, 17 bp, Homo sapiens
tcttcagtgtaatgtga

SEQ ID NO: 1492208 - DNA, 20 bp, Homo sapiens
tcttcagtgtaatgtgactt

SEQ ID NO: 1492209 - DNA, 16 bp, Homo sapiens
tcttcagttaattctt

SEQ ID NO: 1492210 - DNA, 19 bp, Homo sapiens
tcttcagttttatctttaa

SEQ ID NO: 1492211 - DNA, 17 bp, Homo sapiens
tcttcatcccattccag

SEQ ID NO: 1492212 - DNA, 17 bp, Homo sapiens
tcttcatgcaatgacat

SEQ ID NO: 1492213 - DNA, 15 bp, Homo sapiens
tcttcatgcttgaca

SEQ ID NO: 1492214 - DNA, 22 bp, Homo sapiens
tcttcatggcatcttcaatatg

SEQ ID NO: 1492215 - DNA, 20 bp, Homo sapiens
tcttcattctttactgcact

SEQ ID NO: 1492216 - DNA, 16 bp, Homo sapiens
tcttcatttattttga

SEQ ID NO: 1492217 - DNA, 15 bp, Homo sapiens
tcttcatttctctgc

SEQ ID NO: 1492218 - DNA, 14 bp, Homo sapiens
tcttccaaagcaca

SEQ ID NO: 1492219 - DNA, 13 bp, Homo sapiens
tcttccaaagctc

SEQ ID NO: 1492220 - DNA, 21 bp, Homo sapiens
tcttccaaatgcagttcattg

SEQ ID NO: 1492221 - DNA, 22 bp, Homo sapiens
tcttccaaatgcagttcattgc

SEQ ID NO: 1492222 - DNA, 21 bp, Homo sapiens
tcttccaaccatttatcttga

SEQ ID NO: 1492223 - DNA, 18 bp, Homo sapiens
tcttccaagcaaaggtga

SEQ ID NO: 1492224 - DNA, 11 bp, Homo sapiens
tcttccagcca

SEQ ID NO: 1492225 - DNA, 16 bp, Homo sapiens
tcttccagccacctag

SEQ ID NO: 1492226 - DNA, 21 bp, Homo sapiens
tcttccagtcttcctgacact

SEQ ID NO: 1492227 - DNA, 12 bp, Homo sapiens
tcttccataatg

SEQ ID NO: 1492228 - DNA, 19 bp, Homo sapiens
tcttccatcatcactgtaa

SEQ ID NO: 1492229 - DNA, 20 bp, Homo sapiens
tcttccatcatcactgtaaa

SEQ ID NO: 1492230 - DNA, 22 bp, Homo sapiens
tcttccatgggatggttagtgt

SEQ ID NO: 1492231 - DNA, 19 bp, Homo sapiens
tcttccatgtatcttttga

SEQ ID NO: 1492232 - DNA, 15 bp, Homo sapiens
tcttcccacaggagg

SEQ ID NO: 1492233 - DNA, 22 bp, Homo sapiens
tcttcccagaatctctgagcca

SEQ ID NO: 1492234 - DNA, 16 bp, Homo sapiens
tcttcccatcactgga

SEQ ID NO: 1492235 - DNA, 13 bp, Homo sapiens
tcttcccatgcat

SEQ ID NO: 1492236 - DNA, 17 bp, Homo sapiens
tcttcccatgcattctg

SEQ ID NO: 1492237 - DNA, 14 bp, Homo sapiens
tcttccccttccct

SEQ ID NO: 1492238 - DNA, 15 bp, Homo sapiens
tcttccccttcctgt

SEQ ID NO: 1492239 - DNA, 14 bp, Homo sapiens
tcttcccgctcccc

SEQ ID NO: 1492240 - DNA, 16 bp, Homo sapiens
tcttcccgctccccac

SEQ ID NO: 1492241 - DNA, 18 bp, Homo sapiens
tcttcccgctccccacct

SEQ ID NO: 1492242 - DNA, 19 bp, Homo sapiens
tcttcccgctccccaccta

SEQ ID NO: 1492243 - DNA, 16 bp, Homo sapiens
tcttccctcggggagc

SEQ ID NO: 1492244 - DNA, 12 bp, Homo sapiens
tcttccctctcc

SEQ ID NO: 1492245 - DNA, 15 bp, Homo sapiens
tcttccctctgggcc

SEQ ID NO: 1492246 - DNA, 13 bp, Homo sapiens
tcttccctgcttt

SEQ ID NO: 1492247 - DNA, 14 bp, Homo sapiens
tcttcccttagcct

SEQ ID NO: 1492248 - DNA, 20 bp, Homo sapiens
tcttcccttagcctctccca

SEQ ID NO: 1492249 - DNA, 13 bp, Homo sapiens
tcttcccttccca

SEQ ID NO: 1492250 - DNA, 14 bp, Homo sapiens
tcttcccttcccag

SEQ ID NO: 1492251 - DNA, 18 bp, Homo sapiens
tcttcccttcccagacca

SEQ ID NO: 1492252 - DNA, 21 bp, Homo sapiens
tcttccgaatgggttttctat

SEQ ID NO: 1492253 - DNA, 14 bp, Homo sapiens
tcttccgatgtttg

SEQ ID NO: 1492254 - DNA, 17 bp, Homo sapiens
tcttcctacctatccca

SEQ ID NO: 1492255 - DNA, 14 bp, Homo sapiens
tcttcctatttcag

SEQ ID NO: 1492256 - DNA, 16 bp, Homo sapiens
tcttcctatttcagaa

SEQ ID NO: 1492257 - DNA, 16 bp, Homo sapiens
tcttcctcttccccca

SEQ ID NO: 1492258 - DNA, 14 bp, Homo sapiens
tcttcctcttcttt

SEQ ID NO: 1492259 - DNA, 15 bp, Homo sapiens
tcttcctgacacttt

SEQ ID NO: 1492260 - DNA, 16 bp, Homo sapiens
tcttcctgacacttta

SEQ ID NO: 1492261 - DNA, 15 bp, Homo sapiens
tcttcctgctgctgt

SEQ ID NO: 1492262 - DNA, 21 bp, Homo sapiens
tcttcctgtgtacctctagaa

SEQ ID NO: 1492263 - DNA, 22 bp, Homo sapiens
tcttcctgtgtacctctagaat

SEQ ID NO: 1492264 - DNA, 11 bp, Homo sapiens
tcttccttaaa

SEQ ID NO: 1492265 - DNA, 19 bp, Homo sapiens
tcttccttaaatgactttt

SEQ ID NO: 1492266 - DNA, 23 bp, Homo sapiens
tcttccttaaatgacttttctta

SEQ ID NO: 1492267 - DNA, 14 bp, Homo sapiens
tcttcgctggacta

SEQ ID NO: 1492268 - DNA, 18 bp, Homo sapiens
tcttcgctggactattgt

SEQ ID NO: 1492269 - DNA, 20 bp, Homo sapiens
tcttcgctggactattgtgc

SEQ ID NO: 1492270 - DNA, 21 bp, Homo sapiens
tcttcgctggactattgtgcc

SEQ ID NO: 1492271 - DNA, 22 bp, Homo sapiens
tcttcgctgtgatgcatgagct

SEQ ID NO: 1492272 - DNA, 14 bp, Homo sapiens
tcttcggtttctga

SEQ ID NO: 1492273 - DNA, 14 bp, Homo sapiens
tcttcgtggttgtg

SEQ ID NO: 1492274 - DNA, 16 bp, Homo sapiens
tcttcgtggttgtgtt

SEQ ID NO: 1492275 - DNA, 19 bp, Homo sapiens
tcttcgtggttgtgtttct

SEQ ID NO: 1492276 - DNA, 15 bp, Homo sapiens
tcttctaagaagaca

SEQ ID NO: 1492277 - DNA, 17 bp, Homo sapiens
tcttctaagaagacatt

SEQ ID NO: 1492278 - DNA, 18 bp, Homo sapiens
tcttctaagaagacattt

SEQ ID NO: 1492279 - DNA, 14 bp, Homo sapiens
tcttctagagttca

SEQ ID NO: 1492280 - DNA, 20 bp, Homo sapiens
tcttctaggcccattgtcct

SEQ ID NO: 1492281 - DNA, 21 bp, Homo sapiens
tcttctaggcccattgtcctc

SEQ ID NO: 1492282 - DNA, 17 bp, Homo sapiens
tcttctaggttctaaaa

SEQ ID NO: 1492283 - DNA, 20 bp, Homo sapiens
tcttctattaatcaagagaa

SEQ ID NO: 1492284 - DNA, 13 bp, Homo sapiens
tcttctattttgt

SEQ ID NO: 1492285 - DNA, 11 bp, Homo sapiens
tcttctcaagt

SEQ ID NO: 1492286 - DNA, 18 bp, Homo sapiens
tcttctcaagttctaaga

SEQ ID NO: 1492287 - DNA, 20 bp, Homo sapiens
tcttctcaggctctgccctg

SEQ ID NO: 1492288 - DNA, 19 bp, Homo sapiens
tcttctcatttcacccctc

SEQ ID NO: 1492289 - DNA, 20 bp, Homo sapiens
tcttctcatttcacccctcc

SEQ ID NO: 1492290 - DNA, 12 bp, Homo sapiens
tcttctccactg

SEQ ID NO: 1492291 - DNA, 16 bp, Homo sapiens
tcttctccactggatg

SEQ ID NO: 1492292 - DNA, 14 bp, Homo sapiens
tcttctccatctgg

SEQ ID NO: 1492293 - DNA, 21 bp, Homo sapiens
tcttctcccaaatgtctattt

SEQ ID NO: 1492294 - DNA, 20 bp, Homo sapiens
tcttctccccgaggctgccc

SEQ ID NO: 1492295 - DNA, 16 bp, Homo sapiens
tcttctcccttgtcct

SEQ ID NO: 1492296 - DNA, 14 bp, Homo sapiens
tcttctctccagct

SEQ ID NO: 1492297 - DNA, 16 bp, Homo sapiens
tcttctctctggctca

SEQ ID NO: 1492298 - DNA, 14 bp, Homo sapiens
tcttctctgtgaga

SEQ ID NO: 1492299 - DNA, 14 bp, Homo sapiens
tcttctcttatcct

SEQ ID NO: 1492300 - DNA, 14 bp, Homo sapiens
tcttctcttcctag

SEQ ID NO: 1492301 - DNA, 20 bp, Homo sapiens
tcttctgaagatcagaacat

SEQ ID NO: 1492302 - DNA, 18 bp, Homo sapiens
tcttctgaataaagcaat

SEQ ID NO: 1492303 - DNA, 15 bp, Homo sapiens
tcttctgagcactgt

SEQ ID NO: 1492304 - DNA, 16 bp, Homo sapiens
tcttctgagcactgtt

SEQ ID NO: 1492305 - DNA, 21 bp, Homo sapiens
tcttctgaggaccgctgataa

SEQ ID NO: 1492306 - DNA, 17 bp, Homo sapiens
tcttctgcaacatttga

SEQ ID NO: 1492307 - DNA, 19 bp, Homo sapiens
tcttctgctaatacctctt

SEQ ID NO: 1492308 - DNA, 16 bp, Homo sapiens
tcttctgctccaccct

SEQ ID NO: 1492309 - DNA, 19 bp, Homo sapiens
tcttctgctccacccttgg

SEQ ID NO: 1492310 - DNA, 12 bp, Homo sapiens
tcttctggctca

SEQ ID NO: 1492311 - DNA, 18 bp, Homo sapiens
tcttctggctcaaaaaga

SEQ ID NO: 1492312 - DNA, 21 bp, Homo sapiens
tcttctggctcaaaaagagaa

SEQ ID NO: 1492313 - DNA, 17 bp, Homo sapiens
tcttctgggcacagtgg

SEQ ID NO: 1492314 - DNA, 22 bp, Homo sapiens
tcttctggggcaggctgggcca

SEQ ID NO: 1492315 - DNA, 11 bp, Homo sapiens
tcttctgggta

SEQ ID NO: 1492316 - DNA, 21 bp, Homo sapiens
tcttctgggtagtcccctgtt

SEQ ID NO: 1492317 - DNA, 22 bp, Homo sapiens
tcttctggtactttctgttatg

SEQ ID NO: 1492318 - DNA, 15 bp, Homo sapiens
tcttctgttgacatt

SEQ ID NO: 1492319 - DNA, 13 bp, Homo sapiens
tcttcttaactta

SEQ ID NO: 1492320 - DNA, 22 bp, Homo sapiens
tcttcttaatatgttcttttaa

SEQ ID NO: 1492321 - DNA, 15 bp, Homo sapiens
tcttcttacatgcat

SEQ ID NO: 1492322 - DNA, 12 bp, Homo sapiens
tcttcttatgca

SEQ ID NO: 1492323 - DNA, 15 bp, Homo sapiens
tcttcttattttggt

SEQ ID NO: 1492324 - DNA, 16 bp, Homo sapiens
tcttcttcagaagaca

SEQ ID NO: 1492325 - DNA, 18 bp, Homo sapiens
tcttcttctaagaagaca

SEQ ID NO: 1492326 - DNA, 19 bp, Homo sapiens
tcttcttggggcccagtgc

SEQ ID NO: 1492327 - DNA, 20 bp, Homo sapiens
tcttcttggggcccagtgca

SEQ ID NO: 1492328 - DNA, 20 bp, Homo sapiens
tcttctttagatgccaaacc

SEQ ID NO: 1492329 - DNA, 12 bp, Homo sapiens
tcttctttccct

SEQ ID NO: 1492330 - DNA, 14 bp, Homo sapiens
tcttctttccctgg

SEQ ID NO: 1492331 - DNA, 14 bp, Homo sapiens
tcttctttgtgcct

SEQ ID NO: 1492332 - DNA, 16 bp, Homo sapiens
tcttctttgtgccttt

SEQ ID NO: 1492333 - DNA, 17 bp, Homo sapiens
tcttctttgtgcctttg

SEQ ID NO: 1492334 - DNA, 23 bp, Homo sapiens
tcttctttgtgcctttggcctgg

SEQ ID NO: 1492335 - DNA, 18 bp, Homo sapiens
tcttcttttggcttccat

SEQ ID NO: 1492336 - DNA, 19 bp, Homo sapiens
tcttcttttgtggtgtctt

SEQ ID NO: 1492337 - DNA, 20 bp, Homo sapiens
tcttcttttgtggtgtcttc

SEQ ID NO: 1492338 - DNA, 22 bp, Homo sapiens
tcttcttttgtggtgtcttcca

SEQ ID NO: 1492339 - DNA, 22 bp, Homo sapiens
tcttcttttttaagttgtcaaa

SEQ ID NO: 1492340 - DNA, 14 bp, Homo sapiens
tcttgaaagctgtg

SEQ ID NO: 1492341 - DNA, 16 bp, Homo sapiens
tcttgaaatattcaga

SEQ ID NO: 1492342 - DNA, 15 bp, Homo sapiens
tcttgaaatgaaagg

SEQ ID NO: 1492343 - DNA, 17 bp, Homo sapiens
tcttgaaatgaaaggga

SEQ ID NO: 1492344 - DNA, 21 bp, Homo sapiens
tcttgaaatgaaagggaaact

SEQ ID NO: 1492345 - DNA, 17 bp, Homo sapiens
tcttgaacgagcagccc

SEQ ID NO: 1492346 - DNA, 22 bp, Homo sapiens
tcttgaaggaaaaattcaatag

SEQ ID NO: 1492347 - DNA, 19 bp, Homo sapiens
tcttgaaggaaaatgatac

SEQ ID NO: 1492348 - DNA, 13 bp, Homo sapiens
tcttgaaggtgct

SEQ ID NO: 1492349 - DNA, 16 bp, Homo sapiens
tcttgaagtcagccac

SEQ ID NO: 1492350 - DNA, 17 bp, Homo sapiens
tcttgaagtccaggact

SEQ ID NO: 1492351 - DNA, 18 bp, Homo sapiens
tcttgaagtctgtacaga

SEQ ID NO: 1492352 - DNA, 23 bp, Homo sapiens
tcttgaataaagtattctagtgt

SEQ ID NO: 1492353 - DNA, 12 bp, Homo sapiens
tcttgaataaga

SEQ ID NO: 1492354 - DNA, 15 bp, Homo sapiens
tcttgaatataaaaa

SEQ ID NO: 1492355 - DNA, 16 bp, Homo sapiens
tcttgaatccttccat

SEQ ID NO: 1492356 - DNA, 14 bp, Homo sapiens
tcttgaatgtcttt

SEQ ID NO: 1492357 - DNA, 14 bp, Homo sapiens
tcttgaattagtat

SEQ ID NO: 1492358 - DNA, 18 bp, Homo sapiens
tcttgaatttctaaaaaa

SEQ ID NO: 1492359 - DNA, 14 bp, Homo sapiens
tcttgaatttctga

SEQ ID NO: 1492360 - DNA, 14 bp, Homo sapiens
tcttgaatttttga

SEQ ID NO: 1492361 - DNA, 20 bp, Homo sapiens
tcttgacagtatatttgaaa

SEQ ID NO: 1492362 - DNA, 14 bp, Homo sapiens
tcttgactctaaat

SEQ ID NO: 1492363 - DNA, 15 bp, Homo sapiens
tcttgactcttgcct

SEQ ID NO: 1492364 - DNA, 13 bp, Homo sapiens
tcttgactttctg

SEQ ID NO: 1492365 - DNA, 16 bp, Homo sapiens
tcttgactttctgatt

SEQ ID NO: 1492366 - DNA, 13 bp, Homo sapiens
tcttgagagctgc

SEQ ID NO: 1492367 - DNA, 19 bp, Homo sapiens
tcttgagataaggttttaa

SEQ ID NO: 1492368 - DNA, 16 bp, Homo sapiens
tcttgagatgtcttct

SEQ ID NO: 1492369 - DNA, 14 bp, Homo sapiens
tcttgagcagtggc

SEQ ID NO: 1492370 - DNA, 20 bp, Homo sapiens
tcttgagcatcaatcttgtt

SEQ ID NO: 1492371 - DNA, 21 bp, Homo sapiens
tcttgagccagccaggccctg

SEQ ID NO: 1492372 - DNA, 12 bp, Homo sapiens
tcttgagctggc

SEQ ID NO: 1492373 - DNA, 14 bp, Homo sapiens
tcttgagctggcct

SEQ ID NO: 1492374 - DNA, 15 bp, Homo sapiens
tcttgaggccaggag

SEQ ID NO: 1492375 - DNA, 14 bp, Homo sapiens
tcttgagggagctt

SEQ ID NO: 1492376 - DNA, 21 bp, Homo sapiens
tcttgataattgtgtagtaat

SEQ ID NO: 1492377 - DNA, 18 bp, Homo sapiens
tcttgatcaacatctttt

SEQ ID NO: 1492378 - DNA, 20 bp, Homo sapiens
tcttgatcaacatcttttct

SEQ ID NO: 1492379 - DNA, 20 bp, Homo sapiens
tctttgtaccttttgtagtt

SEQ ID NO: 1492380 - DNA, 13 bp, Homo sapiens
tctttgtataaat

SEQ ID NO: 1492381 - DNA, 14 bp, Homo sapiens
tctttgtataaata

SEQ ID NO: 1492382 - DNA, 21 bp, Homo sapiens
tctttgtatataggcttctca

SEQ ID NO: 1492383 - DNA, 14 bp, Homo sapiens
tctttgtgcctttg

SEQ ID NO: 1492384 - DNA, 21 bp, Homo sapiens
tctttgtgggagggtaagaca

SEQ ID NO: 1492385 - DNA, 20 bp, Homo sapiens
tctttgtgggtttttcatct

SEQ ID NO: 1492386 - DNA, 21 bp, Homo sapiens
tctttgtgggtttttcatctt

SEQ ID NO: 1492387 - DNA, 13 bp, Homo sapiens
tctttgtgtagct

SEQ ID NO: 1492388 - DNA, 15 bp, Homo sapiens
tctttgtgtagcttt

SEQ ID NO: 1492389 - DNA, 18 bp, Homo sapiens
tctttgtgtagctttgct

SEQ ID NO: 1492390 - DNA, 12 bp, Homo sapiens
tctttgtgtttt

SEQ ID NO: 1492391 - DNA, 18 bp, Homo sapiens
tctttgtgttttagggtg

SEQ ID NO: 1492392 - DNA, 23 bp, Homo sapiens
tctttgttcatagcccagtagac

SEQ ID NO: 1492393 - DNA, 15 bp, Homo sapiens
tctttgtttaacaaa

SEQ ID NO: 1492394 - DNA, 20 bp, Homo sapiens
tctttgtttccagcttgcat

SEQ ID NO: 1492395 - DNA, 19 bp, Homo sapiens
tcttttaaagactacctgg

SEQ ID NO: 1492396 - DNA, 18 bp, Homo sapiens
tcttttaagatcttgtta

SEQ ID NO: 1492397 - DNA, 18 bp, Homo sapiens
tcttttaatggcatttct

SEQ ID NO: 1492398 - DNA, 17 bp, Homo sapiens
tcttttagacaactaga

SEQ ID NO: 1492399 - DNA, 17 bp, Homo sapiens
tcttttagctgatgaac

SEQ ID NO: 1492400 - DNA, 18 bp, Homo sapiens
tcttttaggacaattact

SEQ ID NO: 1492401 - DNA, 18 bp, Homo sapiens
tcttttatagacgctctt

SEQ ID NO: 1492402 - DNA, 17 bp, Homo sapiens
tcttttatatctgtaaa

SEQ ID NO: 1492403 - DNA, 13 bp, Homo sapiens
tcttttatatttg

SEQ ID NO: 1492404 - DNA, 22 bp, Homo sapiens
tcttttcacatagctgtctaga

SEQ ID NO: 1492405 - DNA, 18 bp, Homo sapiens
tcttttcagcttgtttct

SEQ ID NO: 1492406 - DNA, 21 bp, Homo sapiens
tcttttcagcttgtttctata

SEQ ID NO: 1492407 - DNA, 19 bp, Homo sapiens
tcttttcccccattaatca

SEQ ID NO: 1492408 - DNA, 13 bp, Homo sapiens
tcttttcctggtg

SEQ ID NO: 1492409 - DNA, 12 bp, Homo sapiens
tcttttctagag

SEQ ID NO: 1492410 - DNA, 23 bp, Homo sapiens
tcttttctgcatcatctgtagat

SEQ ID NO: 1492411 - DNA, 22 bp, Homo sapiens
tcttttctgtcaccaaatttgt

SEQ ID NO: 1492412 - DNA, 13 bp, Homo sapiens
tcttttctgttat

SEQ ID NO: 1492413 - DNA, 16 bp, Homo sapiens
tcttttctgttattgt

SEQ ID NO: 1492414 - DNA, 15 bp, Homo sapiens
tcttttcttctcagg

SEQ ID NO: 1492415 - DNA, 16 bp, Homo sapiens
tcttttcttgcctctg

SEQ ID NO: 1492416 - DNA, 23 bp, Homo sapiens
tcttttgaatattcccaagccca

SEQ ID NO: 1492417 - DNA, 17 bp, Homo sapiens
tcttttgctactaagtt

SEQ ID NO: 1492418 - DNA, 13 bp, Homo sapiens
tcttttgtaattg

SEQ ID NO: 1492419 - DNA, 16 bp, Homo sapiens
tcttttgtatatctaa

SEQ ID NO: 1492420 - DNA, 16 bp, Homo sapiens
tcttttgtttggtaaa

SEQ ID NO: 1492421 - DNA, 14 bp, Homo sapiens
tctttttacagcat

SEQ ID NO: 1492422 - DNA, 13 bp, Homo sapiens
tctttttactgtt

SEQ ID NO: 1492423 - DNA, 16 bp, Homo sapiens
tctttttatactatta

SEQ ID NO: 1492424 - DNA, 18 bp, Homo sapiens
tctttttcgtctatatat

SEQ ID NO: 1492425 - DNA, 12 bp, Homo sapiens
tctttttcttct

SEQ ID NO: 1492426 - DNA, 15 bp, Homo sapiens
tctttttcttcttcc

SEQ ID NO: 1492427 - DNA, 14 bp, Homo sapiens
tctttttctttctt

SEQ ID NO: 1492428 - DNA, 14 bp, Homo sapiens
tctttttgaatctt

SEQ ID NO: 1492429 - DNA, 20 bp, Homo sapiens
tctttttgctctaaaatatt

SEQ ID NO: 1492430 - DNA, 12 bp, Homo sapiens
tctttttgggga

SEQ ID NO: 1492431 - DNA, 15 bp, Homo sapiens
tctttttgtgtgtgt

SEQ ID NO: 1492432 - DNA, 15 bp, Homo sapiens
tctttttgttgtaaa

SEQ ID NO: 1492433 - DNA, 16 bp, Homo sapiens
tctttttgttgtaaaa

SEQ ID NO: 1492434 - DNA, 14 bp, Homo sapiens
tcttttttaaaaac

SEQ ID NO: 1492435 - DNA, 18 bp, Homo sapiens
tcttttttaaaaattact

SEQ ID NO: 1492436 - DNA, 15 bp, Homo sapiens
tcttttttaaaatca

SEQ ID NO: 1492437 - DNA, 20 bp, Homo sapiens
tcttttttagcataaaattt

SEQ ID NO: 1492438 - DNA, 18 bp, Homo sapiens
tcttttttatgttaaaaa

SEQ ID NO: 1492439 - DNA, 22 bp, Homo sapiens
tcttttttatgttaaaaagaaa

SEQ ID NO: 1492440 - DNA, 19 bp, Homo sapiens
tctttttttgagtgacagc

SEQ ID NO: 1492441 - DNA, 15 bp, Homo sapiens
tctttttttttaagt

SEQ ID NO: 1492442 - DNA, 21 bp, Homo sapiens
tctttttttttctttttccag

SEQ ID NO: 1492443 - DNA, 18 bp, Homo sapiens
tgaaaaaaaaaaagaaga

SEQ ID NO: 1492444 - DNA, 19 bp, Homo sapiens
tgaaaaaaaaaaagaagaa

SEQ ID NO: 1492445 - DNA, 20 bp, Homo sapiens
tgaaaaaaaaaaagaagaag

SEQ ID NO: 1492446 - DNA, 21 bp, Homo sapiens
tgaaaaaaggacaatttcaaa

SEQ ID NO: 1492447 - DNA, 11 bp, Homo sapiens
tgaaaaacaag

SEQ ID NO: 1492448 - DNA, 18 bp, Homo sapiens
tgaaaaactgatcaaaaa

SEQ ID NO: 1492449 - DNA, 12 bp, Homo sapiens
tgaaaaacttcc

SEQ ID NO: 1492450 - DNA, 18 bp, Homo sapiens
tgaaaaaggaaatattct

SEQ ID NO: 1492451 - DNA, 19 bp, Homo sapiens
tgaaaaaggaaatattctt

SEQ ID NO: 1492452 - DNA, 14 bp, Homo sapiens
tgaaaaatacttta

SEQ ID NO: 1492453 - DNA, 19 bp, Homo sapiens
tgaaaaatataaaattatg

SEQ ID NO: 1492454 - DNA, 20 bp, Homo sapiens
tgaaaaatataaaattatga

SEQ ID NO: 1492455 - DNA, 22 bp, Homo sapiens
tgaaaaatataaaattatgaga

SEQ ID NO: 1492456 - DNA, 19 bp, Homo sapiens
tgaaaaatcagatgaattg

SEQ ID NO: 1492457 - DNA, 20 bp, Homo sapiens
tgaaaaatcagatgaattga

SEQ ID NO: 1492458 - DNA, 11 bp, Homo sapiens
tgaaaaattaa

SEQ ID NO: 1492459 - DNA, 13 bp, Homo sapiens
tgaaaaattctca

SEQ ID NO: 1492460 - DNA, 18 bp, Homo sapiens
tgaaaacaaaaaaaatgt

SEQ ID NO: 1492461 - DNA, 19 bp, Homo sapiens
tgaaaacaagaaagaaatg

SEQ ID NO: 1492462 - DNA, 13 bp, Homo sapiens
tgaaaacatgtac

SEQ ID NO: 1492463 - DNA, 20 bp, Homo sapiens
tgaaaacatgtactacagct

SEQ ID NO: 1492464 - DNA, 21 bp, Homo sapiens
tgaaaacatgtactacagcta

SEQ ID NO: 1492465 - DNA, 15 bp, Homo sapiens
tgaaaaccaaccctg

SEQ ID NO: 1492466 - DNA, 17 bp, Homo sapiens
tgaaaaccacagtcagt

SEQ ID NO: 1492467 - DNA, 14 bp, Homo sapiens
tgaaaacccagaga

SEQ ID NO: 1492468 - DNA, 16 bp, Homo sapiens
tgaaaacccagagagg

SEQ ID NO: 1492469 - DNA, 20 bp, Homo sapiens
tgaaaacggagctgaacaat

SEQ ID NO: 1492470 - DNA, 16 bp, Homo sapiens
tgaaaactaaggattt

SEQ ID NO: 1492471 - DNA, 17 bp, Homo sapiens
tgaaaactaaggatttt

SEQ ID NO: 1492472 - DNA, 20 bp, Homo sapiens
tgaaaactagggctcatttt

SEQ ID NO: 1492473 - DNA, 16 bp, Homo sapiens
tgaaaacttagccaga

SEQ ID NO: 1492474 - DNA, 17 bp, Homo sapiens
tgaaaacttagccagag

SEQ ID NO: 1492475 - DNA, 17 bp, Homo sapiens
tgaaaacttttctcaga

SEQ ID NO: 1492476 - DNA, 15 bp, Homo sapiens
tgaaaagaaatgcta

SEQ ID NO: 1492477 - DNA, 22 bp, Homo sapiens
tgaaaagaagaaagtctatgct

SEQ ID NO: 1492478 - DNA, 15 bp, Homo sapiens
tgaaaagaaggaaag

SEQ ID NO: 1492479 - DNA, 16 bp, Homo sapiens
tgaaaagaaggaaaga

SEQ ID NO: 1492480 - DNA, 22 bp, Homo sapiens
tgaaaagaaggaatataccttt

SEQ ID NO: 1492481 - DNA, 17 bp, Homo sapiens
tgaaaagactccaaaga

SEQ ID NO: 1492482 - DNA, 14 bp, Homo sapiens
tgaaaagattcttc

SEQ ID NO: 1492483 - DNA, 17 bp, Homo sapiens
tgaaaagattttaacaa

SEQ ID NO: 1492484 - DNA, 19 bp, Homo sapiens
tgaaaagccaaaggtcaaa

SEQ ID NO: 1492485 - DNA, 18 bp, Homo sapiens
tgaaaagggcggaagagt

SEQ ID NO: 1492486 - DNA, 20 bp, Homo sapiens
tgaaaagggcggaagagtta

SEQ ID NO: 1492487 - DNA, 18 bp, Homo sapiens
tgaaaaggtgtccttttc

SEQ ID NO: 1492488 - DNA, 19 bp, Homo sapiens
tgaaaagtgtgtatatatt

SEQ ID NO: 1492489 - DNA, 15 bp, Homo sapiens
tgaaaagtgttctgt

SEQ ID NO: 1492490 - DNA, 13 bp, Homo sapiens
tgaaaagttgaaa

SEQ ID NO: 1492491 - DNA, 13 bp, Homo sapiens
tgaaaagttggaa

SEQ ID NO: 1492492 - DNA, 22 bp, Homo sapiens
tgaaaagttggaaggatctgct

SEQ ID NO: 1492493 - DNA, 23 bp, Homo sapiens
tgaaaagttggaaggatctgctg

SEQ ID NO: 1492494 - DNA, 14 bp, Homo sapiens
tgaaatacatcctt

SEQ ID NO: 1492495 - DNA, 15 bp, Homo sapiens
tgaaatagtatacat

SEQ ID NO: 1492496 - DNA, 22 bp, Homo sapiens
tgaaatagtatacattgtcttg

SEQ ID NO: 1492497 - DNA, 16 bp, Homo sapiens
tgaaatagtctgtgtg

SEQ ID NO: 1492498 - DNA, 14 bp, Homo sapiens
tgaaatatcatgtt

SEQ ID NO: 1492499 - DNA, 12 bp, Homo sapiens
tgaaatatgcat

SEQ ID NO: 1492500 - DNA, 14 bp, Homo sapiens
tgaaatattcagaa

SEQ ID NO: 1492501 - DNA, 15 bp, Homo sapiens
tgaaatattcagaaa

SEQ ID NO: 1492502 - DNA, 19 bp, Homo sapiens
tgaaatatttaagtatata

SEQ ID NO: 1492503 - DNA, 19 bp, Homo sapiens
tgaaatcaatgcaagagtg

SEQ ID NO: 1492504 - DNA, 19 bp, Homo sapiens
tgaaatccataaactaaga

SEQ ID NO: 1492505 - DNA, 22 bp, Homo sapiens
tgaaatccataaactaagagaa

SEQ ID NO: 1492506 - DNA, 23 bp, Homo sapiens
tgaaatccataaactaagagaaa

SEQ ID NO: 1492507 - DNA, 23 bp, Homo sapiens
tgaaatccatatatatgaaatgt

SEQ ID NO: 1492508 - DNA, 18 bp, Homo sapiens
tgaaatcttcccatgcat

SEQ ID NO: 1492509 - DNA, 14 bp, Homo sapiens
tgaaatgaaaacat

SEQ ID NO: 1492510 - DNA, 19 bp, Homo sapiens
tgaaatgaaaacatgtaat

SEQ ID NO: 1492511 - DNA, 15 bp, Homo sapiens
tgaaatgaaagggaa

SEQ ID NO: 1492512 - DNA, 13 bp, Homo sapiens
tgaaatgagtaaa

SEQ ID NO: 1492513 - DNA, 18 bp, Homo sapiens
tgaaatgagtaaaaacta

SEQ ID NO: 1492514 - DNA, 19 bp, Homo sapiens
tgaaatgctcttttgcaca

SEQ ID NO: 1492515 - DNA, 21 bp, Homo sapiens
tgaaatgctcttttgcacaag

SEQ ID NO: 1492516 - DNA, 17 bp, Homo sapiens
tgaaatgctgaaaattg

SEQ ID NO: 1492517 - DNA, 12 bp, Homo sapiens
tgaaatggttgt

SEQ ID NO: 1492518 - DNA, 20 bp, Homo sapiens
tgaaatgtgaatttttattg

SEQ ID NO: 1492519 - DNA, 22 bp, Homo sapiens
tgaaatgtgaatttttattgtt

SEQ ID NO: 1492520 - DNA, 15 bp, Homo sapiens
tgaaatgtgtttctg

SEQ ID NO: 1492521 - DNA, 19 bp, Homo sapiens
tgaaatgtgtttctgtata

SEQ ID NO: 1492522 - DNA, 15 bp, Homo sapiens
tgaaattaaaaataa

SEQ ID NO: 1492523 - DNA, 22 bp, Homo sapiens
tgaaattaaccatagatgtaga

SEQ ID NO: 1492524 - DNA, 19 bp, Homo sapiens
tgaaattaagcattttgaa

SEQ ID NO: 1492525 - DNA, 22 bp, Homo sapiens
tgaaattacttatcatccacat

SEQ ID NO: 1492526 - DNA, 22 bp, Homo sapiens
tgaaattcaggatgctgtgata

SEQ ID NO: 1492527 - DNA, 15 bp, Homo sapiens
tgaaattccaaagtc

SEQ ID NO: 1492528 - DNA, 17 bp, Homo sapiens
tgaaattccaaagtctc

SEQ ID NO: 1492529 - DNA, 16 bp, Homo sapiens
tgaaattctattgaaa

SEQ ID NO: 1492530 - DNA, 19 bp, Homo sapiens
tgaaattctattgaaaaca

SEQ ID NO: 1492531 - DNA, 13 bp, Homo sapiens
tgaaattctattt

SEQ ID NO: 1492532 - DNA, 16 bp, Homo sapiens
tgaaattctcctggag

SEQ ID NO: 1492533 - DNA, 16 bp, Homo sapiens
tgaaattgaaaagtta

SEQ ID NO: 1492534 - DNA, 19 bp, Homo sapiens
tgaaattgactgatgattt

SEQ ID NO: 1492535 - DNA, 23 bp, Homo sapiens
tgaaattgtttaagtgttgtaaa

SEQ ID NO: 1492536 - DNA, 21 bp, Homo sapiens
tgaaatttattcacatatatc

SEQ ID NO: 1492537 - DNA, 19 bp, Homo sapiens
tgaaattttaaaaattgtt

SEQ ID NO: 1492538 - DNA, 22 bp, Homo sapiens
tgaaattttaacctatgatatt

SEQ ID NO: 1492539 - DNA, 19 bp, Homo sapiens
tgaaatttttattaaatta

SEQ ID NO: 1492540 - DNA, 20 bp, Homo sapiens
tgaaatttttattaaattat

SEQ ID NO: 1492541 - DNA, 19 bp, Homo sapiens
tgaaatttttctctttaaa

SEQ ID NO: 1492542 - DNA, 18 bp, Homo sapiens
tgaacaaaataaattgga

SEQ ID NO: 1492543 - DNA, 13 bp, Homo sapiens
tgaacaaacctgt

SEQ ID NO: 1492544 - DNA, 15 bp, Homo sapiens
tgaacaaattcttta

SEQ ID NO: 1492545 - DNA, 17 bp, Homo sapiens
tgaacaaattctttagt

SEQ ID NO: 1492546 - DNA, 18 bp, Homo sapiens
tgaacaagaattggaagc

SEQ ID NO: 1492547 - DNA, 19 bp, Homo sapiens
tgaacaagttgtttcattg

SEQ ID NO: 1492548 - DNA, 22 bp, Homo sapiens
tgaacaagttgtttcattgact

SEQ ID NO: 1492549 - DNA, 23 bp, Homo sapiens
tgaacaatggggactttgttggt

SEQ ID NO: 1492550 - DNA, 21 bp, Homo sapiens
tgaacacaattgatacttcag

SEQ ID NO: 1492551 - DNA, 23 bp, Homo sapiens
tgaacacaattgatacttcaggt

SEQ ID NO: 1492552 - DNA, 21 bp, Homo sapiens
tgaacacacacgctccctgga

SEQ ID NO: 1492553 - DNA, 17 bp, Homo sapiens
tgaacacagtgtctgtt

SEQ ID NO: 1492554 - DNA, 15 bp, Homo sapiens
tgaacacagtttagt

SEQ ID NO: 1492555 - DNA, 12 bp, Homo sapiens
tgaacacatttc

SEQ ID NO: 1492556 - DNA, 22 bp, Homo sapiens
tgaacacgaaagaaatgtacct

SEQ ID NO: 1492557 - DNA, 14 bp, Homo sapiens
tgaacactggggga

SEQ ID NO: 1492558 - DNA, 16 bp, Homo sapiens
tgaacactgggggagg

SEQ ID NO: 1492559 - DNA, 22 bp, Homo sapiens
tgaacactgggggaggggacat

SEQ ID NO: 1492560 - DNA, 16 bp, Homo sapiens
tgaacagaagctctta

SEQ ID NO: 1492561 - DNA, 21 bp, Homo sapiens
tgaacagaagctcttactctt

SEQ ID NO: 1492562 - DNA, 19 bp, Homo sapiens
tgaacagaggccacattac

SEQ ID NO: 1492563 - DNA, 16 bp, Homo sapiens
tgaacagctggtgcca

SEQ ID NO: 1492564 - DNA, 15 bp, Homo sapiens
tgaacagctgtgtct

SEQ ID NO: 1492565 - DNA, 18 bp, Homo sapiens
tgaacagcttgccaggga

SEQ ID NO: 1492566 - DNA, 22 bp, Homo sapiens
tgaacaggaatccttactgata

SEQ ID NO: 1492567 - DNA, 22 bp, Homo sapiens
tgaacatcagggtgtggcattt

SEQ ID NO: 1492568 - DNA, 18 bp, Homo sapiens
tgaacatccttccttccc

SEQ ID NO: 1492569 - DNA, 16 bp, Homo sapiens
tgaacatctcttgaaa

SEQ ID NO: 1492570 - DNA, 18 bp, Homo sapiens
tgaacatgtgccttttct

SEQ ID NO: 1492571 - DNA, 17 bp, Homo sapiens
tgaacatgtttacaggt

SEQ ID NO: 1492572 - DNA, 16 bp, Homo sapiens
tgaacattaaaatata

SEQ ID NO: 1492573 - DNA, 18 bp, Homo sapiens
tgaacattagttgcacta

SEQ ID NO: 1492574 - DNA, 13 bp, Homo sapiens
tgaacattcccag

SEQ ID NO: 1492575 - DNA, 17 bp, Homo sapiens
tgaacattcccagccca

SEQ ID NO: 1492576 - DNA, 18 bp, Homo sapiens
tgaacattcccagcccag

SEQ ID NO: 1492577 - DNA, 19 bp, Homo sapiens
tgaacattgtactgttgct

SEQ ID NO: 1492578 - DNA, 22 bp, Homo sapiens
tgaacattttgtggagtttgta

SEQ ID NO: 1492579 - DNA, 19 bp, Homo sapiens
tgaaccaaaaatagaaatt

SEQ ID NO: 1492580 - DNA, 14 bp, Homo sapiens
tgaaccaaagcctc

SEQ ID NO: 1492581 - DNA, 16 bp, Homo sapiens
tgaaccaacccccatc

SEQ ID NO: 1492582 - DNA, 14 bp, Homo sapiens
tgaaccaagggatc

SEQ ID NO: 1492583 - DNA, 16 bp, Homo sapiens
tgaaccacgcgggggc

SEQ ID NO: 1492584 - DNA, 12 bp, Homo sapiens
tgaaccactgct

SEQ ID NO: 1492585 - DNA, 18 bp, Homo sapiens
tgaaccatagttactgta

SEQ ID NO: 1492586 - DNA, 19 bp, Homo sapiens
tgaaccatagttactgtaa

SEQ ID NO: 1492587 - DNA, 12 bp, Homo sapiens
tgaacccaggag

SEQ ID NO: 1492588 - DNA, 13 bp, Homo sapiens
tgaacccaggagg

SEQ ID NO: 1492589 - DNA, 14 bp, Homo sapiens
tgaacccaggaggt

SEQ ID NO: 1492590 - DNA, 19 bp, Homo sapiens
tgaacccaggaggtggagg

SEQ ID NO: 1492591 - DNA, 20 bp, Homo sapiens
tgaaccccagaggcagaggt

SEQ ID NO: 1492592 - DNA, 20 bp, Homo sapiens
tgaacccccgccatccttca

SEQ ID NO: 1492593 - DNA, 22 bp, Homo sapiens
tgaaccccctccctgtcccagg

SEQ ID NO: 1492594 - DNA, 19 bp, Homo sapiens
tgaacccgggggacagagg

SEQ ID NO: 1492595 - DNA, 14 bp, Homo sapiens
tgaaccctggggcc

SEQ ID NO: 1492596 - DNA, 14 bp, Homo sapiens
tgaacctattttca

SEQ ID NO: 1492597 - DNA, 17 bp, Homo sapiens
tgaacctattttcattt

SEQ ID NO: 1492598 - DNA, 18 bp, Homo sapiens
tgaacctattttcatttg

SEQ ID NO: 1492599 - DNA, 19 bp, Homo sapiens
tgaacctattttcatttgt

SEQ ID NO: 1492600 - DNA, 17 bp, Homo sapiens
tgaaccttgagcaaatt

SEQ ID NO: 1492601 - DNA, 18 bp, Homo sapiens
tgaacctttaaagtaaag

SEQ ID NO: 1492602 - DNA, 13 bp, Homo sapiens
tgaacgagcagcc

SEQ ID NO: 1492603 - DNA, 13 bp, Homo sapiens
tgaacggccttgc

SEQ ID NO: 1492604 - DNA, 16 bp, Homo sapiens
tgaacggggagaaaag

SEQ ID NO: 1492605 - DNA, 13 bp, Homo sapiens
tgaacgttttctt

SEQ ID NO: 1492606 - DNA, 22 bp, Homo sapiens
tgaacgttttcttctttccctg

SEQ ID NO: 1492607 - DNA, 23 bp, Homo sapiens
tgaacgttttcttctttccctgg

SEQ ID NO: 1492608 - DNA, 14 bp, Homo sapiens
tgaatgtatttgat

SEQ ID NO: 1492609 - DNA, 18 bp, Homo sapiens
tgaatgtcaagaaaagga

SEQ ID NO: 1492610 - DNA, 17 bp, Homo sapiens
tgaatgtcacaaattga

SEQ ID NO: 1492611 - DNA, 15 bp, Homo sapiens
tgaatgtcttttgaa

SEQ ID NO: 1492612 - DNA, 12 bp, Homo sapiens
tgaatgtgctgg

SEQ ID NO: 1492613 - DNA, 20 bp, Homo sapiens
tgaatgtgctggtgaacact

SEQ ID NO: 1492614 - DNA, 20 bp, Homo sapiens
tgaatgtggctgaagttgaa

SEQ ID NO: 1492615 - DNA, 12 bp, Homo sapiens
tgaatgtgtcag

SEQ ID NO: 1492616 - DNA, 21 bp, Homo sapiens
tgaatgttaaagggatatttt

SEQ ID NO: 1492617 - DNA, 23 bp, Homo sapiens
tgaatgttcccaagtaggcattc

SEQ ID NO: 1492618 - DNA, 22 bp, Homo sapiens
tgaatgtttacactctttgtaa

SEQ ID NO: 1492619 - DNA, 20 bp, Homo sapiens
tgaattaatgacagagccag

SEQ ID NO: 1492620 - DNA, 13 bp, Homo sapiens
tgaattacagtga

SEQ ID NO: 1492621 - DNA, 17 bp, Homo sapiens
tgaattacctggatgtt

SEQ ID NO: 1492622 - DNA, 16 bp, Homo sapiens
tgaattactgtatata

SEQ ID NO: 1492623 - DNA, 13 bp, Homo sapiens
tgaattaggctaa

SEQ ID NO: 1492624 - DNA, 17 bp, Homo sapiens
tgaattaggctgtaact

SEQ ID NO: 1492625 - DNA, 22 bp, Homo sapiens
tgaattaggctgtaactacttt

SEQ ID NO: 1492626 - DNA, 15 bp, Homo sapiens
tgaattataacagtt

SEQ ID NO: 1492627 - DNA, 16 bp, Homo sapiens
tgaattataacagtta

SEQ ID NO: 1492628 - DNA, 18 bp, Homo sapiens
tgaattataacagttata

SEQ ID NO: 1492629 - DNA, 20 bp, Homo sapiens
tgaattatattcaatgcatt

SEQ ID NO: 1492630 - DNA, 18 bp, Homo sapiens
tgaattatcagcaaagaa

SEQ ID NO: 1492631 - DNA, 18 bp, Homo sapiens
tgaattattatatacata

SEQ ID NO: 1492632 - DNA, 15 bp, Homo sapiens
tgaattattctgatt

SEQ ID NO: 1492633 - DNA, 15 bp, Homo sapiens
tgaattattgacact

SEQ ID NO: 1492634 - DNA, 21 bp, Homo sapiens
tgaattattgacactgaactt

SEQ ID NO: 1492635 - DNA, 11 bp, Homo sapiens
tgaattcactc

SEQ ID NO: 1492636 - DNA, 23 bp, Homo sapiens
tgaattcactccagtcaacagat

SEQ ID NO: 1492637 - DNA, 22 bp, Homo sapiens
tgaattcacttaagtttttcca

SEQ ID NO: 1492638 - DNA, 12 bp, Homo sapiens
tgaattcagtaa

SEQ ID NO: 1492639 - DNA, 13 bp, Homo sapiens
tgaattcataaaa

SEQ ID NO: 1492640 - DNA, 15 bp, Homo sapiens
tgaattcccttttaa

SEQ ID NO: 1492641 - DNA, 12 bp, Homo sapiens
tgaattgaaaaa

SEQ ID NO: 1492642 - DNA, 15 bp, Homo sapiens
tgaattgataaaaga

SEQ ID NO: 1492643 - DNA, 15 bp, Homo sapiens
tgaattgctttatgg

SEQ ID NO: 1492644 - DNA, 17 bp, Homo sapiens
tgaattgctttatgggg

SEQ ID NO: 1492645 - DNA, 12 bp, Homo sapiens
tgaattggaagg

SEQ ID NO: 1492646 - DNA, 16 bp, Homo sapiens
tgaattggcttccaga

SEQ ID NO: 1492647 - DNA, 16 bp, Homo sapiens
tgaattgtatcaattt

SEQ ID NO: 1492648 - DNA, 13 bp, Homo sapiens
tgaatttaaataa

SEQ ID NO: 1492649 - DNA, 13 bp, Homo sapiens
tgaatttatcttt

SEQ ID NO: 1492650 - DNA, 16 bp, Homo sapiens
tgaatttatctttgat

SEQ ID NO: 1492651 - DNA, 23 bp, Homo sapiens
tgaatttctgacctcaagtgatt

SEQ ID NO: 1492652 - DNA, 23 bp, Homo sapiens
tgaatttcttgatttttcagggt

SEQ ID NO: 1492653 - DNA, 17 bp, Homo sapiens
tgaatttgaggagggaa

SEQ ID NO: 1492654 - DNA, 20 bp, Homo sapiens
tgaatttggagactctgtgg

SEQ ID NO: 1492655 - DNA, 16 bp, Homo sapiens
tgaatttgtattaaaa

SEQ ID NO: 1492656 - DNA, 17 bp, Homo sapiens
tgaatttgttcttaaaa

SEQ ID NO: 1492657 - DNA, 16 bp, Homo sapiens
tgaattttaaagtatg

SEQ ID NO: 1492658 - DNA, 19 bp, Homo sapiens
tgaattttataaataaaat

SEQ ID NO: 1492659 - DNA, 16 bp, Homo sapiens
tgaattttatcagcca

SEQ ID NO: 1492660 - DNA, 18 bp, Homo sapiens
tgaattttcaaggccttc

SEQ ID NO: 1492661 - DNA, 18 bp, Homo sapiens
tgaattttccgggaactt

SEQ ID NO: 1492662 - DNA, 22 bp, Homo sapiens
tgaattttctaaaagctttcat

SEQ ID NO: 1492663 - DNA, 19 bp, Homo sapiens
tgaattttctgcagctgtt

SEQ ID NO: 1492664 - DNA, 20 bp, Homo sapiens
tgaattttctgcagctgttt

SEQ ID NO: 1492665 - DNA, 16 bp, Homo sapiens
tgaattttgcaatgta

SEQ ID NO: 1492666 - DNA, 17 bp, Homo sapiens
tgaattttgttctctgg

SEQ ID NO: 1492667 - DNA, 14 bp, Homo sapiens
tgaattttgttgct

SEQ ID NO: 1492668 - DNA, 22 bp, Homo sapiens
tgaatttttaaaacccatttaa

SEQ ID NO: 1492669 - DNA, 13 bp, Homo sapiens
tgaatttttaagc

SEQ ID NO: 1492670 - DNA, 15 bp, Homo sapiens
tgaatttttattgtt

SEQ ID NO: 1492671 - DNA, 21 bp, Homo sapiens
tgaatttttatttctttttaa

SEQ ID NO: 1492672 - DNA, 18 bp, Homo sapiens
tgaatttttgatgtagat

SEQ ID NO: 1492673 - DNA, 15 bp, Homo sapiens
tgaatttttttgtaa

SEQ ID NO: 1492674 - DNA, 18 bp, Homo sapiens
tgaatttttttgtaataa

SEQ ID NO: 1492675 - DNA, 19 bp, Homo sapiens
tgaattttttttaacattc

SEQ ID NO: 1492676 - DNA, 21 bp, Homo sapiens
tgaattttttttaacattcct

SEQ ID NO: 1492677 - DNA, 21 bp, Homo sapiens
tgacaaaatggggcagaagag

SEQ ID NO: 1492678 - DNA, 18 bp, Homo sapiens
tgacaaaatttgttgaaa

SEQ ID NO: 1492679 - DNA, 14 bp, Homo sapiens
tgacaaaccatttc

SEQ ID NO: 1492680 - DNA, 19 bp, Homo sapiens
tgacaaaccatttccaaca

SEQ ID NO: 1492681 - DNA, 15 bp, Homo sapiens
tgacaaagaaaccca

SEQ ID NO: 1492682 - DNA, 20 bp, Homo sapiens
tgacaaagccagaggagaag

SEQ ID NO: 1492683 - DNA, 22 bp, Homo sapiens
tgacaaaggtggtaaattcaga

SEQ ID NO: 1492684 - DNA, 15 bp, Homo sapiens
tgacaaagtgcctca

SEQ ID NO: 1492685 - DNA, 14 bp, Homo sapiens
tgacaaatgtttct

SEQ ID NO: 1492686 - DNA, 19 bp, Homo sapiens
tgacaacagaaaaacaatc

SEQ ID NO: 1492687 - DNA, 19 bp, Homo sapiens
tgacaacatcccacagtgg

SEQ ID NO: 1492688 - DNA, 12 bp, Homo sapiens
tgacaacatctg

SEQ ID NO: 1492689 - DNA, 19 bp, Homo sapiens
tgacaaccatgagaccact

SEQ ID NO: 1492690 - DNA, 21 bp, Homo sapiens
tgacaaccattaaagtcagaa

SEQ ID NO: 1492691 - DNA, 17 bp, Homo sapiens
tgacaaccgagaaggtt

SEQ ID NO: 1492692 - DNA, 18 bp, Homo sapiens
tgacaactgcacatgaaa

SEQ ID NO: 1492693 - DNA, 20 bp, Homo sapiens
tgacaactgcacatgaaagt

SEQ ID NO: 1492694 - DNA, 14 bp, Homo sapiens
tgacaactgtgact

SEQ ID NO: 1492695 - DNA, 15 bp, Homo sapiens
tgacaactgtgactg

SEQ ID NO: 1492696 - DNA, 17 bp, Homo sapiens
tgacaacttagctcagg

SEQ ID NO: 1492697 - DNA, 23 bp, Homo sapiens
tgacaagaatggaatagaaatgt

SEQ ID NO: 1492698 - DNA, 16 bp, Homo sapiens
tgacaagatggtccat

SEQ ID NO: 1492699 - DNA, 13 bp, Homo sapiens
tgacaaggaaaat

SEQ ID NO: 1492700 - DNA, 16 bp, Homo sapiens
tgacaagggctgacct

SEQ ID NO: 1492701 - DNA, 22 bp, Homo sapiens
tgacaagggctgacctgcctct

SEQ ID NO: 1492702 - DNA, 14 bp, Homo sapiens
tgacaagtcatttt

SEQ ID NO: 1492703 - DNA, 17 bp, Homo sapiens
tgacaataatttcaggt

SEQ ID NO: 1492704 - DNA, 13 bp, Homo sapiens
tgacaatgatgat

SEQ ID NO: 1492705 - DNA, 14 bp, Homo sapiens
tgacaatggcagct

SEQ ID NO: 1492706 - DNA, 18 bp, Homo sapiens
tgacaattactcaggttt

SEQ ID NO: 1492707 - DNA, 23 bp, Homo sapiens
tgacaattcctagataaaaagat

SEQ ID NO: 1492708 - DNA, 16 bp, Homo sapiens
tgacaattctgttttt

SEQ ID NO: 1492709 - DNA, 17 bp, Homo sapiens
tgacaatttctggcaga

SEQ ID NO: 1492710 - DNA, 19 bp, Homo sapiens
tgacaattttgtcttaagt

SEQ ID NO: 1492711 - DNA, 17 bp, Homo sapiens
tgacacaaaaaaagttg

SEQ ID NO: 1492712 - DNA, 22 bp, Homo sapiens
tgacacaactgtgtgattaaaa

SEQ ID NO: 1492713 - DNA, 20 bp, Homo sapiens
tgacacaagaggaataagaa

SEQ ID NO: 1492714 - DNA, 16 bp, Homo sapiens
tgacacaagtggacct

SEQ ID NO: 1492715 - DNA, 19 bp, Homo sapiens
tgacacaagtggaccttag

SEQ ID NO: 1492716 - DNA, 18 bp, Homo sapiens
tgacacaatctcggctca

SEQ ID NO: 1492717 - DNA, 19 bp, Homo sapiens
tgacacacagcactctcta

SEQ ID NO: 1492718 - DNA, 23 bp, Homo sapiens
tgacacaccaggcgctaattcaa

SEQ ID NO: 1492719 - DNA, 23 bp, Homo sapiens
tgacacacgtatttatatttgga

SEQ ID NO: 1492720 - DNA, 13 bp, Homo sapiens
tgacacagacatt

SEQ ID NO: 1492721 - DNA, 16 bp, Homo sapiens
tgacacagcagcttca

SEQ ID NO: 1492722 - DNA, 16 bp, Homo sapiens
tgacacaggaaaccaa

SEQ ID NO: 1492723 - DNA, 22 bp, Homo sapiens
tgactcatccccacagctggct

SEQ ID NO: 1492724 - DNA, 22 bp, Homo sapiens
tgactcatttaaagctaaattt

SEQ ID NO: 1492725 - DNA, 18 bp, Homo sapiens
tgactccagagtctgagc

SEQ ID NO: 1492726 - DNA, 21 bp, Homo sapiens
tgactccagagtctgagcccc

SEQ ID NO: 1492727 - DNA, 14 bp, Homo sapiens
tgactcctgctggt

SEQ ID NO: 1492728 - DNA, 22 bp, Homo sapiens
tgactcctgctggtacctgccc

SEQ ID NO: 1492729 - DNA, 12 bp, Homo sapiens
tgactcctgttg

SEQ ID NO: 1492730 - DNA, 22 bp, Homo sapiens
tgactccttagagacatcaaaa

SEQ ID NO: 1492731 - DNA, 16 bp, Homo sapiens
tgactcggtttctcca

SEQ ID NO: 1492732 - DNA, 21 bp, Homo sapiens
tgactctcgtgcatttcaact

SEQ ID NO: 1492733 - DNA, 16 bp, Homo sapiens
tgactctgaaatctga

SEQ ID NO: 1492734 - DNA, 22 bp, Homo sapiens
tgactctgaaatctgaagacct

SEQ ID NO: 1492735 - DNA, 23 bp, Homo sapiens
tgactctgggtggaagtgcccag

SEQ ID NO: 1492736 - DNA, 21 bp, Homo sapiens
tgactgaaaaaaaaaaagaag

SEQ ID NO: 1492737 - DNA, 23 bp, Homo sapiens
tgactgaaaaaaaaaaagaagaa

SEQ ID NO: 1492738 - DNA, 18 bp, Homo sapiens
tgactgaggcctgcttcc

SEQ ID NO: 1492739 - DNA, 22 bp, Homo sapiens
tgactgatagcttacactgagg

SEQ ID NO: 1492740 - DNA, 14 bp, Homo sapiens
tgactgcagccccc

SEQ ID NO: 1492741 - DNA, 16 bp, Homo sapiens
tgactgccaagccaga

SEQ ID NO: 1492742 - DNA, 17 bp, Homo sapiens
tgactgccaagccagat

SEQ ID NO: 1492743 - DNA, 18 bp, Homo sapiens
tgactgcccattcaccaa

SEQ ID NO: 1492744 - DNA, 15 bp, Homo sapiens
tgactgccccaactc

SEQ ID NO: 1492745 - DNA, 16 bp, Homo sapiens
tgactgccccaactcc

SEQ ID NO: 1492746 - DNA, 19 bp, Homo sapiens
tgactgccccaactcctgg

SEQ ID NO: 1492747 - DNA, 19 bp, Homo sapiens
tgactgccctgtttctgtt

SEQ ID NO: 1492748 - DNA, 20 bp, Homo sapiens
tgactgctcagaacttgctg

SEQ ID NO: 1492749 - DNA, 22 bp, Homo sapiens
tgactgctcagaacttgctgct

SEQ ID NO: 1492750 - DNA, 21 bp, Homo sapiens
tgactgcttttaaatgaccaa

SEQ ID NO: 1492751 - DNA, 19 bp, Homo sapiens
tgactggatcttctatcat

SEQ ID NO: 1492752 - DNA, 11 bp, Homo sapiens
tgactggcagg

SEQ ID NO: 1492753 - DNA, 16 bp, Homo sapiens
tgactggcaggtgcag

SEQ ID NO: 1492754 - DNA, 14 bp, Homo sapiens
tgactggctgtctg

SEQ ID NO: 1492755 - DNA, 18 bp, Homo sapiens
tgactggctgtctgcctg

SEQ ID NO: 1492756 - DNA, 17 bp, Homo sapiens
tgactggcttcagcaag

SEQ ID NO: 1492757 - DNA, 17 bp, Homo sapiens
tgactggggagggctgc

SEQ ID NO: 1492758 - DNA, 21 bp, Homo sapiens
tgactgggtttctctgtatag

SEQ ID NO: 1492759 - DNA, 23 bp, Homo sapiens
tgactgggtttctctgtatagta

SEQ ID NO: 1492760 - DNA, 16 bp, Homo sapiens
tgactgtactcctccc

SEQ ID NO: 1492761 - DNA, 18 bp, Homo sapiens
tgactgtactcctcccag

SEQ ID NO: 1492762 - DNA, 16 bp, Homo sapiens
tgactgtatctgtgta

SEQ ID NO: 1492763 - DNA, 18 bp, Homo sapiens
tgactgtatctgtgtaga

SEQ ID NO: 1492764 - DNA, 12 bp, Homo sapiens
tgactgtatggc

SEQ ID NO: 1492765 - DNA, 15 bp, Homo sapiens
tgactgtctttccta

SEQ ID NO: 1492766 - DNA, 14 bp, Homo sapiens
tgactgtgatttat

SEQ ID NO: 1492767 - DNA, 19 bp, Homo sapiens
tgactgtgatttatttgga

SEQ ID NO: 1492768 - DNA, 12 bp, Homo sapiens
tgactgtgctgt

SEQ ID NO: 1492769 - DNA, 21 bp, Homo sapiens
tgactgtgtttgcattgtcta

SEQ ID NO: 1492770 - DNA, 22 bp, Homo sapiens
tgactgtgtttgcattgtctaa

SEQ ID NO: 1492771 - DNA, 15 bp, Homo sapiens
tgactgtttatttaa

SEQ ID NO: 1492772 - DNA, 16 bp, Homo sapiens
tgactgtttatttaag

SEQ ID NO: 1492773 - DNA, 21 bp, Homo sapiens
tgactgtttatttaaggatgg

SEQ ID NO: 1492774 - DNA, 22 bp, Homo sapiens
tgactgtttatttaaggatgga

SEQ ID NO: 1492775 - DNA, 16 bp, Homo sapiens
tgacttaatgtgatta

SEQ ID NO: 1492776 - DNA, 18 bp, Homo sapiens
tgacttattatgcataaa

SEQ ID NO: 1492777 - DNA, 12 bp, Homo sapiens
tgacttatttct

SEQ ID NO: 1492778 - DNA, 18 bp, Homo sapiens
tgacttatttctgctctg

SEQ ID NO: 1492779 - DNA, 20 bp, Homo sapiens
tgacttatttctgctctgga

SEQ ID NO: 1492780 - DNA, 21 bp, Homo sapiens
tgacttatttctgctctggaa

SEQ ID NO: 1492781 - DNA, 20 bp, Homo sapiens
tgacttccctggaggagaag

SEQ ID NO: 1492782 - DNA, 14 bp, Homo sapiens
tgacttctgacaaa

SEQ ID NO: 1492783 - DNA, 19 bp, Homo sapiens
tgacttctgacaaaggtgg

SEQ ID NO: 1492784 - DNA, 23 bp, Homo sapiens
tgacttctgacaaaggtggtaaa

SEQ ID NO: 1492785 - DNA, 15 bp, Homo sapiens
tgacttctgcctgga

SEQ ID NO: 1492786 - DNA, 16 bp, Homo sapiens
tgacttctgcctggag

SEQ ID NO: 1492787 - DNA, 18 bp, Homo sapiens
tgacttctgcctggagac

SEQ ID NO: 1492788 - DNA, 21 bp, Homo sapiens
tgacttcttggtttggggaga

SEQ ID NO: 1492789 - DNA, 15 bp, Homo sapiens
tgacttgctgtccag

SEQ ID NO: 1492790 - DNA, 16 bp, Homo sapiens
tgacttgctgtccagg

SEQ ID NO: 1492791 - DNA, 15 bp, Homo sapiens
tgacttgctttagtt

SEQ ID NO: 1492792 - DNA, 19 bp, Homo sapiens
tgacttggcacttaagtgc

SEQ ID NO: 1492793 - DNA, 20 bp, Homo sapiens
tgacttggcacttaagtgca

SEQ ID NO: 1492794 - DNA, 19 bp, Homo sapiens
tgacttggggagatggagt

SEQ ID NO: 1492795 - DNA, 15 bp, Homo sapiens
tgacttgtgtcccat

SEQ ID NO: 1492796 - DNA, 18 bp, Homo sapiens
tgactttatatggatgat

SEQ ID NO: 1492797 - DNA, 15 bp, Homo sapiens
tgactttatgttgta

SEQ ID NO: 1492798 - DNA, 13 bp, Homo sapiens
tgactttcaggta

SEQ ID NO: 1492799 - DNA, 18 bp, Homo sapiens
tgactttgacaattactc

SEQ ID NO: 1492800 - DNA, 16 bp, Homo sapiens
tgactttgcttgcttt

SEQ ID NO: 1492801 - DNA, 14 bp, Homo sapiens
tgactttggttttt

SEQ ID NO: 1492802 - DNA, 22 bp, Homo sapiens
tgacttttccaaataaacattt

SEQ ID NO: 1492803 - DNA, 19 bp, Homo sapiens
tgacttttctgtaattcag

SEQ ID NO: 1492804 - DNA, 17 bp, Homo sapiens
tgacttttgctttaatt

SEQ ID NO: 1492805 - DNA, 21 bp, Homo sapiens
tgacttttgctttaattccat

SEQ ID NO: 1492806 - DNA, 19 bp, Homo sapiens
tgactttttataaaatggc

SEQ ID NO: 1492807 - DNA, 14 bp, Homo sapiens
tgactttttgcatt

SEQ ID NO: 1492808 - DNA, 17 bp, Homo sapiens
tgactttttgcatttaa

SEQ ID NO: 1492809 - DNA, 19 bp, Homo sapiens
tgactttttttgtatgtgt

SEQ ID NO: 1492810 - DNA, 18 bp, Homo sapiens
tgagaaaaaggaaaaaaa

SEQ ID NO: 1492811 - DNA, 16 bp, Homo sapiens
tgagaaaacttctttt

SEQ ID NO: 1492812 - DNA, 17 bp, Homo sapiens
tgagaaaacttctttta

SEQ ID NO: 1492813 - DNA, 16 bp, Homo sapiens
tgagaaaatgcctcaa

SEQ ID NO: 1492814 - DNA, 15 bp, Homo sapiens
tgagaaacagctcag

SEQ ID NO: 1492815 - DNA, 18 bp, Homo sapiens
tgagaaacccaccagcct

SEQ ID NO: 1492816 - DNA, 12 bp, Homo sapiens
tgagaaactcta

SEQ ID NO: 1492817 - DNA, 11 bp, Homo sapiens
tgagaaactgc

SEQ ID NO: 1492818 - DNA, 21 bp, Homo sapiens
tgagaaagaatttgagacgca

SEQ ID NO: 1492819 - DNA, 16 bp, Homo sapiens
tgagaaagactattca

SEQ ID NO: 1492820 - DNA, 13 bp, Homo sapiens
tgagaaaggacag

SEQ ID NO: 1492821 - DNA, 14 bp, Homo sapiens
tgagaaaggacaga

SEQ ID NO: 1492822 - DNA, 19 bp, Homo sapiens
tgagaaaggacagagccag

SEQ ID NO: 1492823 - DNA, 20 bp, Homo sapiens
tgagaaatagctgaaaaggg

SEQ ID NO: 1492824 - DNA, 13 bp, Homo sapiens
tgagaaatgcata

SEQ ID NO: 1492825 - DNA, 22 bp, Homo sapiens
tgagaaccttggaccactcctg

SEQ ID NO: 1492826 - DNA, 23 bp, Homo sapiens
tgagaactcgttcacctccaagc

SEQ ID NO: 1492827 - DNA, 16 bp, Homo sapiens
tgagaactctctccct

SEQ ID NO: 1492828 - DNA, 20 bp, Homo sapiens
tgagaactctctccctggtc

SEQ ID NO: 1492829 - DNA, 18 bp, Homo sapiens
tgagaactgaggagcgga

SEQ ID NO: 1492830 - DNA, 17 bp, Homo sapiens
tgagaactgcatatgtt

SEQ ID NO: 1492831 - DNA, 19 bp, Homo sapiens
tgagaagaaaaatggaaaa

SEQ ID NO: 1492832 - DNA, 15 bp, Homo sapiens
tgagaagaatgaaaa

SEQ ID NO: 1492833 - DNA, 16 bp, Homo sapiens
tgagaagaatgaaaat

SEQ ID NO: 1492834 - DNA, 21 bp, Homo sapiens
tgagaagagcttgcacagcca

SEQ ID NO: 1492835 - DNA, 15 bp, Homo sapiens
tgagaagagggcctg

SEQ ID NO: 1492836 - DNA, 23 bp, Homo sapiens
tgagaagagggcctgtgggagcc

SEQ ID NO: 1492837 - DNA, 20 bp, Homo sapiens
tgagaagatcggaacagctc

SEQ ID NO: 1492838 - DNA, 12 bp, Homo sapiens
tgagaagccaag

SEQ ID NO: 1492839 - DNA, 20 bp, Homo sapiens
tgagaagccttcagctccag

SEQ ID NO: 1492840 - DNA, 20 bp, Homo sapiens
tgagaagcggtcatgagcac

SEQ ID NO: 1492841 - DNA, 22 bp, Homo sapiens
tgagaaggccagccctccctgg

SEQ ID NO: 1492842 - DNA, 19 bp, Homo sapiens
tgagaaggttactgagtga

SEQ ID NO: 1492843 - DNA, 16 bp, Homo sapiens
tgagaaggtttattgt

SEQ ID NO: 1492844 - DNA, 17 bp, Homo sapiens
tgagaaggtttattgtt

SEQ ID NO: 1492845 - DNA, 19 bp, Homo sapiens
tgagaaggtttattgttaa

SEQ ID NO: 1492846 - DNA, 22 bp, Homo sapiens
tgagaagtcaaacatttcaaag

SEQ ID NO: 1492847 - DNA, 21 bp, Homo sapiens
tgagaagtgaatgctgggact

SEQ ID NO: 1492848 - DNA, 13 bp, Homo sapiens
tgagaagtgtctt

SEQ ID NO: 1492849 - DNA, 19 bp, Homo sapiens
tgagaataagagagtcata

SEQ ID NO: 1492850 - DNA, 12 bp, Homo sapiens
tgagaatagaaa

SEQ ID NO: 1492851 - DNA, 15 bp, Homo sapiens
tgagaatagctttaa

SEQ ID NO: 1492852 - DNA, 18 bp, Homo sapiens
tgagaatagctttaaaag

SEQ ID NO: 1492853 - DNA, 13 bp, Homo sapiens
tgagaatatacct

SEQ ID NO: 1492854 - DNA, 22 bp, Homo sapiens
tgagaatataccttatttattt

SEQ ID NO: 1492855 - DNA, 23 bp, Homo sapiens
tgagaatcacggtggtaaagaaa

SEQ ID NO: 1492856 - DNA, 20 bp, Homo sapiens
tgagaatccagtttctttcc

SEQ ID NO: 1492857 - DNA, 10 bp, Homo sapiens
tgagaatgag

SEQ ID NO: 1492858 - DNA, 15 bp, Homo sapiens
tgagaatgagtggga

SEQ ID NO: 1492859 - DNA, 18 bp, Homo sapiens
tgagaatgagtgggaatc

SEQ ID NO: 1492860 - DNA, 17 bp, Homo sapiens
tgagaatgtttgaaaat

SEQ ID NO: 1492861 - DNA, 13 bp, Homo sapiens
tgagaattttaaa

SEQ ID NO: 1492862 - DNA, 15 bp, Homo sapiens
tgagaattttaaatt

SEQ ID NO: 1492863 - DNA, 9 bp, Homo sapiens
tgagacaaa

SEQ ID NO: 1492864 - DNA, 12 bp, Homo sapiens
tgagacaagccc

SEQ ID NO: 1492865 - DNA, 16 bp, Homo sapiens
tgagacaagccctggc

SEQ ID NO: 1492866 - DNA, 18 bp, Homo sapiens
tgagacaagccctggcaa

SEQ ID NO: 1492867 - DNA, 21 bp, Homo sapiens
tgagacacggagcccagccct

SEQ ID NO: 1492868 - DNA, 13 bp, Homo sapiens
tgagacagaatct

SEQ ID NO: 1492869 - DNA, 14 bp, Homo sapiens
tgagacagaatctc

SEQ ID NO: 1492870 - DNA, 14 bp, Homo sapiens
tgagacagtgaatt

SEQ ID NO: 1492871 - DNA, 17 bp, Homo sapiens
tgagacagtgaatttgg

SEQ ID NO: 1492872 - DNA, 19 bp, Homo sapiens
tgagaccagcctggccaac

SEQ ID NO: 1492873 - DNA, 17 bp, Homo sapiens
tgagaccagcctgggca

SEQ ID NO: 1492874 - DNA, 21 bp, Homo sapiens
tgagaccagttgaataaaagt

SEQ ID NO: 1492875 - DNA, 13 bp, Homo sapiens
tgagacccccaca

SEQ ID NO: 1492876 - DNA, 15 bp, Homo sapiens
tgagacccccacacc

SEQ ID NO: 1492877 - DNA, 16 bp, Homo sapiens
tgagacccccacacct

SEQ ID NO: 1492878 - DNA, 21 bp, Homo sapiens
tgagacccccatctctacaaa

SEQ ID NO: 1492879 - DNA, 15 bp, Homo sapiens
tgagacccctgtctc

SEQ ID NO: 1492880 - DNA, 16 bp, Homo sapiens
tgagacccctgtctcc

SEQ ID NO: 1492881 - DNA, 13 bp, Homo sapiens
tgagaccctactg

SEQ ID NO: 1492882 - DNA, 22 bp, Homo sapiens
tgagaccctactgaagtggctg

SEQ ID NO: 1492883 - DNA, 14 bp, Homo sapiens
tgagaccctgtctc

SEQ ID NO: 1492884 - DNA, 16 bp, Homo sapiens
tgagacccttttctca

SEQ ID NO: 1492885 - DNA, 17 bp, Homo sapiens
tgagacccttttctcag

SEQ ID NO: 1492886 - DNA, 14 bp, Homo sapiens
tgagacctcagcca

SEQ ID NO: 1492887 - DNA, 15 bp, Homo sapiens
tgagacctggaacca

SEQ ID NO: 1492888 - DNA, 17 bp, Homo sapiens
tgagacctggaaccaga

SEQ ID NO: 1492889 - DNA, 18 bp, Homo sapiens
tgagacctgggatttgag

SEQ ID NO: 1492890 - DNA, 23 bp, Homo sapiens
tgagacgaggcaggggctctgct

SEQ ID NO: 1492891 - DNA, 20 bp, Homo sapiens
tgagacggagtcttgctctg

SEQ ID NO: 1492892 - DNA, 16 bp, Homo sapiens
tgagactcgagaactt

SEQ ID NO: 1492893 - DNA, 23 bp, Homo sapiens
tgagactgcgggatggtcctggg

SEQ ID NO: 1492894 - DNA, 18 bp, Homo sapiens
tgagactgggtctcgctt

SEQ ID NO: 1492895 - DNA, 18 bp, Homo sapiens
tgagacttaaaacatggt

SEQ ID NO: 1492896 - DNA, 16 bp, Homo sapiens
tgagactttcccctct

SEQ ID NO: 1492897 - DNA, 15 bp, Homo sapiens
tgagactttgcccag

SEQ ID NO: 1492898 - DNA, 17 bp, Homo sapiens
tgagagaaaaagtgccc

SEQ ID NO: 1492899 - DNA, 16 bp, Homo sapiens
tgagagaaagagagaa

SEQ ID NO: 1492900 - DNA, 21 bp, Homo sapiens
tgagagaaagagagaagccag

SEQ ID NO: 1492901 - DNA, 22 bp, Homo sapiens
tgagagaaagagagaagccagc

SEQ ID NO: 1492902 - DNA, 17 bp, Homo sapiens
tgagagaatctgcctgt

SEQ ID NO: 1492903 - DNA, 18 bp, Homo sapiens
tgagagaattgtatcatt

SEQ ID NO: 1492904 - DNA, 21 bp, Homo sapiens
tgagagacccaaggaggaaaa

SEQ ID NO: 1492905 - DNA, 15 bp, Homo sapiens
tgagagacctgccct

SEQ ID NO: 1492906 - DNA, 17 bp, Homo sapiens
tgagagacctgtgtgaa

SEQ ID NO: 1492907 - DNA, 18 bp, Homo sapiens
tgagagactgccatacat

SEQ ID NO: 1492908 - DNA, 18 bp, Homo sapiens
tgagagagaatgaggaag

SEQ ID NO: 1492909 - DNA, 19 bp, Homo sapiens
tgagagagaatgaggaagc

SEQ ID NO: 1492910 - DNA, 15 bp, Homo sapiens
tgagagagacaagaa

SEQ ID NO: 1492911 - DNA, 13 bp, Homo sapiens
tgagagagcagga

SEQ ID NO: 1492912 - DNA, 14 bp, Homo sapiens
tgagagattctgtg

SEQ ID NO: 1492913 - DNA, 21 bp, Homo sapiens
tgagagattctgtgatctttt

SEQ ID NO: 1492914 - DNA, 18 bp, Homo sapiens
tgagagcaaatgcaaaaa

SEQ ID NO: 1492915 - DNA, 18 bp, Homo sapiens
tgagagcatctcaggagg

SEQ ID NO: 1492916 - DNA, 13 bp, Homo sapiens
tgagagccagcag

SEQ ID NO: 1492917 - DNA, 16 bp, Homo sapiens
tgagagccagcagcaa

SEQ ID NO: 1492918 - DNA, 23 bp, Homo sapiens
tgagagcccattcccaccattct

SEQ ID NO: 1492919 - DNA, 15 bp, Homo sapiens
tgagagccccagctg

SEQ ID NO: 1492920 - DNA, 19 bp, Homo sapiens
tgagagccccagctgacat

SEQ ID NO: 1492921 - DNA, 22 bp, Homo sapiens
tgagagccccagctgacatgga

SEQ ID NO: 1492922 - DNA, 20 bp, Homo sapiens
tgagagccctgaggcctaga

SEQ ID NO: 1492923 - DNA, 20 bp, Homo sapiens
tgagagccctgctgtgggag

SEQ ID NO: 1492924 - DNA, 16 bp, Homo sapiens
tgagagcgacacagac

SEQ ID NO: 1492925 - DNA, 19 bp, Homo sapiens
tgagagctgctgagggacc

SEQ ID NO: 1492926 - DNA, 23 bp, Homo sapiens
tgagagctgctgagggaccttgg

SEQ ID NO: 1492927 - DNA, 18 bp, Homo sapiens
tgagaggagaaatgcaat

SEQ ID NO: 1492928 - DNA, 13 bp, Homo sapiens
tgagaggcaggca

SEQ ID NO: 1492929 - DNA, 13 bp, Homo sapiens
tgagaggcctgga

SEQ ID NO: 1492930 - DNA, 14 bp, Homo sapiens
tgagaggcctggag

SEQ ID NO: 1492931 - DNA, 22 bp, Homo sapiens
tgagagggcaatctttgccttt

SEQ ID NO: 1492932 - DNA, 23 bp, Homo sapiens
tgagagtatttaggcagattgaa

SEQ ID NO: 1492933 - DNA, 14 bp, Homo sapiens
tgagagtcaaagct

SEQ ID NO: 1492934 - DNA, 13 bp, Homo sapiens
tgagagtctagat

SEQ ID NO: 1492935 - DNA, 15 bp, Homo sapiens
tgagagtctagattc

SEQ ID NO: 1492936 - DNA, 16 bp, Homo sapiens
tgagagtctagattct

SEQ ID NO: 1492937 - DNA, 19 bp, Homo sapiens
tgagagttccttctcactt

SEQ ID NO: 1492938 - DNA, 15 bp, Homo sapiens
tgagataaggtttta

SEQ ID NO: 1492939 - DNA, 19 bp, Homo sapiens
tgagataatatctgtgagg

SEQ ID NO: 1492940 - DNA, 14 bp, Homo sapiens
tgagataatatgag

SEQ ID NO: 1492941 - DNA, 19 bp, Homo sapiens
tgagataatatgagatttc

SEQ ID NO: 1492942 - DNA, 16 bp, Homo sapiens
tgagataatgttagag

SEQ ID NO: 1492943 - DNA, 22 bp, Homo sapiens
tgagataccacaaaccctgctg

SEQ ID NO: 1492944 - DNA, 16 bp, Homo sapiens
tgagatactatcatta

SEQ ID NO: 1492945 - DNA, 12 bp, Homo sapiens
tgagatatgtgt

SEQ ID NO: 1492946 - DNA, 15 bp, Homo sapiens
tgagatatttattgt

SEQ ID NO: 1492947 - DNA, 19 bp, Homo sapiens
tgagatcagcattcaaaat

SEQ ID NO: 1492948 - DNA, 11 bp, Homo sapiens
tgagatccagt

SEQ ID NO: 1492949 - DNA, 16 bp, Homo sapiens
tgagatctaaaaataa

SEQ ID NO: 1492950 - DNA, 22 bp, Homo sapiens
tgagatctaaaaataactgtaa

SEQ ID NO: 1492951 - DNA, 22 bp, Homo sapiens
tgagatctaagcctttccataa

SEQ ID NO: 1492952 - DNA, 15 bp, Homo sapiens
tgagtggccccacct

SEQ ID NO: 1492953 - DNA, 17 bp, Homo sapiens
tgagtggccccacctgt

SEQ ID NO: 1492954 - DNA, 17 bp, Homo sapiens
tgagtgggaggcgtgcc

SEQ ID NO: 1492955 - DNA, 14 bp, Homo sapiens
tgagtgtaagtgtg

SEQ ID NO: 1492956 - DNA, 15 bp, Homo sapiens
tgagtgtaagtgtga

SEQ ID NO: 1492957 - DNA, 15 bp, Homo sapiens
tgagtgtgtgtgtgc

SEQ ID NO: 1492958 - DNA, 16 bp, Homo sapiens
tgagtgtgtgtgtgca

SEQ ID NO: 1492959 - DNA, 18 bp, Homo sapiens
tgagtgtgtgtgtgcatg

SEQ ID NO: 1492960 - DNA, 12 bp, Homo sapiens
tgagtgttcatt

SEQ ID NO: 1492961 - DNA, 23 bp, Homo sapiens
tgagtgttcattttagtgactgt

SEQ ID NO: 1492962 - DNA, 21 bp, Homo sapiens
tgagtgttcctttttaaatgt

SEQ ID NO: 1492963 - DNA, 23 bp, Homo sapiens
tgagttacaccagacctgttctg

SEQ ID NO: 1492964 - DNA, 15 bp, Homo sapiens
tgagttactgaaggt

SEQ ID NO: 1492965 - DNA, 18 bp, Homo sapiens
tgagttacttgtctgagg

SEQ ID NO: 1492966 - DNA, 12 bp, Homo sapiens
tgagttaggaac

SEQ ID NO: 1492967 - DNA, 16 bp, Homo sapiens
tgagttataaatattt

SEQ ID NO: 1492968 - DNA, 12 bp, Homo sapiens
tgagttatcatg

SEQ ID NO: 1492969 - DNA, 16 bp, Homo sapiens
tgagttatcatgaatt

SEQ ID NO: 1492970 - DNA, 15 bp, Homo sapiens
tgagttatgatgtaa

SEQ ID NO: 1492971 - DNA, 14 bp, Homo sapiens
tgagttattttaat

SEQ ID NO: 1492972 - DNA, 20 bp, Homo sapiens
tgagttcaagggctgtaggt

SEQ ID NO: 1492973 - DNA, 13 bp, Homo sapiens
tgagttgttctaa

SEQ ID NO: 1492974 - DNA, 19 bp, Homo sapiens
tgagtttaaaaaaataaca

SEQ ID NO: 1492975 - DNA, 21 bp, Homo sapiens
tgagtttaaaaaaataacatc

SEQ ID NO: 1492976 - DNA, 18 bp, Homo sapiens
tgagtttaccatttgtaa

SEQ ID NO: 1492977 - DNA, 20 bp, Homo sapiens
tgagtttcactgtactgcat

SEQ ID NO: 1492978 - DNA, 18 bp, Homo sapiens
tgagtttgagctgccttc

SEQ ID NO: 1492979 - DNA, 21 bp, Homo sapiens
tgagtttgagctgccttccct

SEQ ID NO: 1492980 - DNA, 19 bp, Homo sapiens
tgagtttgtcgctcatgtg

SEQ ID NO: 1492981 - DNA, 18 bp, Homo sapiens
tgagttttattgagaatt

SEQ ID NO: 1492982 - DNA, 13 bp, Homo sapiens
tgagttttctcct

SEQ ID NO: 1492983 - DNA, 19 bp, Homo sapiens
tgagttttgggaagttaaa

SEQ ID NO: 1492984 - DNA, 17 bp, Homo sapiens
tgagttttgtgtttgtt

SEQ ID NO: 1492985 - DNA, 19 bp, Homo sapiens
tgagtttttacaagatgta

SEQ ID NO: 1492986 - DNA, 19 bp, Homo sapiens
tgagtttttgatagcttta

SEQ ID NO: 1492987 - DNA, 14 bp, Homo sapiens
tgataaaaagagga

SEQ ID NO: 1492988 - DNA, 16 bp, Homo sapiens
tgataaacattaaaca

SEQ ID NO: 1492989 - DNA, 13 bp, Homo sapiens
tgataaagcctca

SEQ ID NO: 1492990 - DNA, 13 bp, Homo sapiens
tgataaagtttct

SEQ ID NO: 1492991 - DNA, 22 bp, Homo sapiens
tgataaagtttctcagatcctt

SEQ ID NO: 1492992 - DNA, 21 bp, Homo sapiens
tgataaatattcacacttgaa

SEQ ID NO: 1492993 - DNA, 12 bp, Homo sapiens
tgataacaaaaa

SEQ ID NO: 1492994 - DNA, 22 bp, Homo sapiens
tgataacagggattgattttaa

SEQ ID NO: 1492995 - DNA, 19 bp, Homo sapiens
tgataactgcaattttaat

SEQ ID NO: 1492996 - DNA, 24 bp, Homo sapiens
tgataagcagtcatcctcagatca

SEQ ID NO: 1492997 - DNA, 20 bp, Homo sapiens
tgataaggatcagaacagca

SEQ ID NO: 1492998 - DNA, 20 bp, Homo sapiens
tgataagggaaaagataaag

SEQ ID NO: 1492999 - DNA, 19 bp, Homo sapiens
tgataagggactgatgttt

SEQ ID NO: 1493000 - DNA, 16 bp, Homo sapiens
tgataagtaaatgcta

SEQ ID NO: 1493001 - DNA, 19 bp, Homo sapiens
tgataagttcctttccttt

SEQ ID NO: 1493002 - DNA, 13 bp, Homo sapiens
tgataatagaaga

SEQ ID NO: 1493003 - DNA, 15 bp, Homo sapiens
tgataatagaagagt

SEQ ID NO: 1493004 - DNA, 14 bp, Homo sapiens
tgataatagattct

SEQ ID NO: 1493005 - DNA, 21 bp, Homo sapiens
tgataataggtgggggaaaat

SEQ ID NO: 1493006 - DNA, 14 bp, Homo sapiens
tgataatatatatt

SEQ ID NO: 1493007 - DNA, 23 bp, Homo sapiens
tgataattttatttataaactag

SEQ ID NO: 1493008 - DNA, 16 bp, Homo sapiens
tgatacaagattagaa

SEQ ID NO: 1493009 - DNA, 16 bp, Homo sapiens
tgatacaatgaacact

SEQ ID NO: 1493010 - DNA, 14 bp, Homo sapiens
tgatacactgtatc

SEQ ID NO: 1493011 - DNA, 21 bp, Homo sapiens
tgatacactgtatctaaaaaa

SEQ ID NO: 1493012 - DNA, 13 bp, Homo sapiens
tgataccacctgc

SEQ ID NO: 1493013 - DNA, 17 bp, Homo sapiens
tgataccacctttactg

SEQ ID NO: 1493014 - DNA, 18 bp, Homo sapiens
tgatacccatagcttcca

SEQ ID NO: 1493015 - DNA, 19 bp, Homo sapiens
tgatacccccctctgtctt

SEQ ID NO: 1493016 - DNA, 19 bp, Homo sapiens
tgatacgcaacataattaa

SEQ ID NO: 1493017 - DNA, 15 bp, Homo sapiens
tgatacgtacagcca

SEQ ID NO: 1493018 - DNA, 21 bp, Homo sapiens
tgatactatcatactactgaa

SEQ ID NO: 1493019 - DNA, 17 bp, Homo sapiens
tgatacttcaggtgctt

SEQ ID NO: 1493020 - DNA, 20 bp, Homo sapiens
tgatacttcaggtgcttttg

SEQ ID NO: 1493021 - DNA, 11 bp, Homo sapiens
tgatactttag

SEQ ID NO: 1493022 - DNA, 12 bp, Homo sapiens
tgatactttagc

SEQ ID NO: 1493023 - DNA, 14 bp, Homo sapiens
tgatactttagcca

SEQ ID NO: 1493024 - DNA, 14 bp, Homo sapiens
tgatagaaaagtgt

SEQ ID NO: 1493025 - DNA, 18 bp, Homo sapiens
tgatagaaaatccttcag

SEQ ID NO: 1493026 - DNA, 19 bp, Homo sapiens
tgatagaaaatccttcagc

SEQ ID NO: 1493027 - DNA, 14 bp, Homo sapiens
tgatagaactgtac

SEQ ID NO: 1493028 - DNA, 15 bp, Homo sapiens
tgatagaactgtact

SEQ ID NO: 1493029 - DNA, 21 bp, Homo sapiens
tgatagaaggctatggggata

SEQ ID NO: 1493030 - DNA, 16 bp, Homo sapiens
tgatagaatgatgttt

SEQ ID NO: 1493031 - DNA, 16 bp, Homo sapiens
tgatagcaaaatcaag

SEQ ID NO: 1493032 - DNA, 23 bp, Homo sapiens
tgatagcaagtgaatttttctct

SEQ ID NO: 1493033 - DNA, 23 bp, Homo sapiens
tgatagcatatgacaaatgtttc

SEQ ID NO: 1493034 - DNA, 15 bp, Homo sapiens
tgatagctggggctt

SEQ ID NO: 1493035 - DNA, 18 bp, Homo sapiens
tgataggaactgtctcaa

SEQ ID NO: 1493036 - DNA, 15 bp, Homo sapiens
tgatagggaactggg

SEQ ID NO: 1493037 - DNA, 15 bp, Homo sapiens
tgatagtcacctgct

SEQ ID NO: 1493038 - DNA, 14 bp, Homo sapiens
tgatagttttctag

SEQ ID NO: 1493039 - DNA, 22 bp, Homo sapiens
tgatagttttctagatgacata

SEQ ID NO: 1493040 - DNA, 14 bp, Homo sapiens
tgatatacaaagtg

SEQ ID NO: 1493041 - DNA, 13 bp, Homo sapiens
tgatatacattgt

SEQ ID NO: 1493042 - DNA, 17 bp, Homo sapiens
tgatatacattgtgtga

SEQ ID NO: 1493043 - DNA, 16 bp, Homo sapiens
tgatataccaaattaa

SEQ ID NO: 1493044 - DNA, 17 bp, Homo sapiens
tgatatagaaagctgtt

SEQ ID NO: 1493045 - DNA, 18 bp, Homo sapiens
tgatatagtcagctgcct

SEQ ID NO: 1493046 - DNA, 14 bp, Homo sapiens
tgatatataatggt

SEQ ID NO: 1493047 - DNA, 16 bp, Homo sapiens
tgatatatggataatg

SEQ ID NO: 1493048 - DNA, 14 bp, Homo sapiens
tgatatcacctctc

SEQ ID NO: 1493049 - DNA, 18 bp, Homo sapiens
tgatatcacctctcttca

SEQ ID NO: 1493050 - DNA, 14 bp, Homo sapiens
tgatatccttctag

SEQ ID NO: 1493051 - DNA, 18 bp, Homo sapiens
tgatatctataaaataga

SEQ ID NO: 1493052 - DNA, 23 bp, Homo sapiens
tgatatctataaaatagatataa

SEQ ID NO: 1493053 - DNA, 13 bp, Homo sapiens
tgatattaaattt

SEQ ID NO: 1493054 - DNA, 20 bp, Homo sapiens
tgatattaaatttcaaatgc

SEQ ID NO: 1493055 - DNA, 17 bp, Homo sapiens
tgatattacatttattt

SEQ ID NO: 1493056 - DNA, 15 bp, Homo sapiens
tgatattatattaaa

SEQ ID NO: 1493057 - DNA, 16 bp, Homo sapiens
tgatattatattaaac

SEQ ID NO: 1493058 - DNA, 19 bp, Homo sapiens
tgatattccatgaatgtat

SEQ ID NO: 1493059 - DNA, 12 bp, Homo sapiens
tgatattctaag

SEQ ID NO: 1493060 - DNA, 17 bp, Homo sapiens
tgatattctaagactta

SEQ ID NO: 1493061 - DNA, 14 bp, Homo sapiens
tgatatttcagaaa

SEQ ID NO: 1493062 - DNA, 16 bp, Homo sapiens
tgatatttcagaaata

SEQ ID NO: 1493063 - DNA, 18 bp, Homo sapiens
tgatatttgtatttattc

SEQ ID NO: 1493064 - DNA, 19 bp, Homo sapiens
tgatattttcaacgcagcc

SEQ ID NO: 1493065 - DNA, 23 bp, Homo sapiens
tgatattttcaacgcagccctgc

SEQ ID NO: 1493066 - DNA, 12 bp, Homo sapiens
tgatcaaaaata

SEQ ID NO: 1493067 - DNA, 12 bp, Homo sapiens
tgcaaaagcagc

SEQ ID NO: 1493068 - DNA, 20 bp, Homo sapiens
tgcaaaagcagctaaatgta

SEQ ID NO: 1493069 - DNA, 22 bp, Homo sapiens
tgcaaaaggttcactaaagcag

SEQ ID NO: 1493070 - DNA, 14 bp, Homo sapiens
tgcaaaagttctca

SEQ ID NO: 1493071 - DNA, 17 bp, Homo sapiens
tgcaaaatgagaccctc

SEQ ID NO: 1493072 - DNA, 19 bp, Homo sapiens
tgcaaaattgttttcactt

SEQ ID NO: 1493073 - DNA, 20 bp, Homo sapiens
tgcaaaattgttttcacttg

SEQ ID NO: 1493074 - DNA, 22 bp, Homo sapiens
tgcaaaattgttttcacttgta

SEQ ID NO: 1493075 - DNA, 23 bp, Homo sapiens
tgcaaaattgttttcacttgtat

SEQ ID NO: 1493076 - DNA, 16 bp, Homo sapiens
tgcaaacaatgaagaa

SEQ ID NO: 1493077 - DNA, 23 bp, Homo sapiens
tgcaaacaatgaagaattatgta

SEQ ID NO: 1493078 - DNA, 22 bp, Homo sapiens
tgcaaacaggttgttttctact

SEQ ID NO: 1493079 - DNA, 13 bp, Homo sapiens
tgcaaacattgga

SEQ ID NO: 1493080 - DNA, 18 bp, Homo sapiens
tgcaaacattggaagatt

SEQ ID NO: 1493081 - DNA, 22 bp, Homo sapiens
tgcaaactgggctggaagatat

SEQ ID NO: 1493082 - DNA, 13 bp, Homo sapiens
tgcaaagatctct

SEQ ID NO: 1493083 - DNA, 20 bp, Homo sapiens
tgcaaagatctctagagttt

SEQ ID NO: 1493084 - DNA, 12 bp, Homo sapiens
tgcaaagatctg

SEQ ID NO: 1493085 - DNA, 14 bp, Homo sapiens
tgcaaagccaaggc

SEQ ID NO: 1493086 - DNA, 13 bp, Homo sapiens
tgcaaagctgaag

SEQ ID NO: 1493087 - DNA, 12 bp, Homo sapiens
tgcaaagctttg

SEQ ID NO: 1493088 - DNA, 22 bp, Homo sapiens
tgcaaagtgttttctcagaaca

SEQ ID NO: 1493089 - DNA, 21 bp, Homo sapiens
tgcaaataaggacagcagctg

SEQ ID NO: 1493090 - DNA, 17 bp, Homo sapiens
tgcaaatacaatcagcc

SEQ ID NO: 1493091 - DNA, 17 bp, Homo sapiens
tgcaaatagtttcaaat

SEQ ID NO: 1493092 - DNA, 14 bp, Homo sapiens
tgcaaatgcctcca

SEQ ID NO: 1493093 - DNA, 15 bp, Homo sapiens
tgcaaatgtctaatt

SEQ ID NO: 1493094 - DNA, 15 bp, Homo sapiens
tgcaaattattctag

SEQ ID NO: 1493095 - DNA, 16 bp, Homo sapiens
tgcaaattattctagt

SEQ ID NO: 1493096 - DNA, 17 bp, Homo sapiens
tgcaaattattctagtc

SEQ ID NO: 1493097 - DNA, 21 bp, Homo sapiens
tgcaaattattctagtcaact

SEQ ID NO: 1493098 - DNA, 15 bp, Homo sapiens
tgcaaattcagaact

SEQ ID NO: 1493099 - DNA, 18 bp, Homo sapiens
tgcaacaggggaggaaaa

SEQ ID NO: 1493100 - DNA, 22 bp, Homo sapiens
tgcaaccaattgaaaagtgttc

SEQ ID NO: 1493101 - DNA, 17 bp, Homo sapiens
tgcaaccaggaacagca

SEQ ID NO: 1493102 - DNA, 20 bp, Homo sapiens
tgcaacctcacctcccgggt

SEQ ID NO: 1493103 - DNA, 13 bp, Homo sapiens
tgcaacctccacc

SEQ ID NO: 1493104 - DNA, 16 bp, Homo sapiens
tgcaacggccagggtt

SEQ ID NO: 1493105 - DNA, 19 bp, Homo sapiens
tgcaacgggattgaagggt

SEQ ID NO: 1493106 - DNA, 20 bp, Homo sapiens
tgcaacggtctcctgactgg

SEQ ID NO: 1493107 - DNA, 17 bp, Homo sapiens
tgcaactagccaaggct

SEQ ID NO: 1493108 - DNA, 17 bp, Homo sapiens
tgcaactcaaggacttt

SEQ ID NO: 1493109 - DNA, 20 bp, Homo sapiens
tgcaacttccgcctcctgtg

SEQ ID NO: 1493110 - DNA, 18 bp, Homo sapiens
tgcaacttccgctgaggg

SEQ ID NO: 1493111 - DNA, 15 bp, Homo sapiens
tgcaacttctttctg

SEQ ID NO: 1493112 - DNA, 19 bp, Homo sapiens
tgcaagaaaactaggcaat

SEQ ID NO: 1493113 - DNA, 22 bp, Homo sapiens
tgcaagaacactggacctttgg

SEQ ID NO: 1493114 - DNA, 16 bp, Homo sapiens
tgcaagaccacggagg

SEQ ID NO: 1493115 - DNA, 14 bp, Homo sapiens
tgcaagagaatctg

SEQ ID NO: 1493116 - DNA, 14 bp, Homo sapiens
tgcaagagccaagt

SEQ ID NO: 1493117 - DNA, 17 bp, Homo sapiens
tgcaagaggtgaagttt

SEQ ID NO: 1493118 - DNA, 15 bp, Homo sapiens
tgcaagagtttcttg

SEQ ID NO: 1493119 - DNA, 15 bp, Homo sapiens
tgcaagatgcttggt

SEQ ID NO: 1493120 - DNA, 21 bp, Homo sapiens
tgcaagatggacacgagccac

SEQ ID NO: 1493121 - DNA, 13 bp, Homo sapiens
tgcaagatgtgaa

SEQ ID NO: 1493122 - DNA, 15 bp, Homo sapiens
tgcaagatgtgaatt

SEQ ID NO: 1493123 - DNA, 21 bp, Homo sapiens
tgcaagcagaggaccagggcc

SEQ ID NO: 1493124 - DNA, 16 bp, Homo sapiens
tgcaagccccagggcc

SEQ ID NO: 1493125 - DNA, 18 bp, Homo sapiens
tgcaagccccagggcctg

SEQ ID NO: 1493126 - DNA, 21 bp, Homo sapiens
tgcaagccccagggcctgggg

SEQ ID NO: 1493127 - DNA, 12 bp, Homo sapiens
tgcaagctctgc

SEQ ID NO: 1493128 - DNA, 15 bp, Homo sapiens
tgcaaggaaggaaag

SEQ ID NO: 1493129 - DNA, 17 bp, Homo sapiens
tgcaaggaccaggactc

SEQ ID NO: 1493130 - DNA, 23 bp, Homo sapiens
tgcaaggccgctgttcacccaca

SEQ ID NO: 1493131 - DNA, 21 bp, Homo sapiens
tgcaaggcctggtgtttcttg

SEQ ID NO: 1493132 - DNA, 17 bp, Homo sapiens
tgcaagggcccagagtg

SEQ ID NO: 1493133 - DNA, 16 bp, Homo sapiens
tgcaaggtactctggt

SEQ ID NO: 1493134 - DNA, 16 bp, Homo sapiens
tgcaaggtctttggtt

SEQ ID NO: 1493135 - DNA, 21 bp, Homo sapiens
tgcaaggtggcctctgcctgg

SEQ ID NO: 1493136 - DNA, 17 bp, Homo sapiens
tgcaagtatactaggga

SEQ ID NO: 1493137 - DNA, 14 bp, Homo sapiens
tgcaagtattctca

SEQ ID NO: 1493138 - DNA, 15 bp, Homo sapiens
tgcaagtattctcat

SEQ ID NO: 1493139 - DNA, 21 bp, Homo sapiens
tgcaagtggtagcaagaagtg

SEQ ID NO: 1493140 - DNA, 24 bp, Homo sapiens
tgcaataaaaatgatactgatggt

SEQ ID NO: 1493141 - DNA, 15 bp, Homo sapiens
tgcaataaaatttaa

SEQ ID NO: 1493142 - DNA, 15 bp, Homo sapiens
tgcaataaagtataa

SEQ ID NO: 1493143 - DNA, 20 bp, Homo sapiens
tgcaataaatctgacccagt

SEQ ID NO: 1493144 - DNA, 16 bp, Homo sapiens
tgcaataacttctata

SEQ ID NO: 1493145 - DNA, 14 bp, Homo sapiens
tgcaataatttgta

SEQ ID NO: 1493146 - DNA, 17 bp, Homo sapiens
tgcaataatttgtacaa

SEQ ID NO: 1493147 - DNA, 20 bp, Homo sapiens
tgcaataatttgtacaatgg

SEQ ID NO: 1493148 - DNA, 22 bp, Homo sapiens
tgcaataatttgtacaatggtt

SEQ ID NO: 1493149 - DNA, 14 bp, Homo sapiens
tgcaatagagactg

SEQ ID NO: 1493150 - DNA, 22 bp, Homo sapiens
tgcaatagtgcaacatctctga

SEQ ID NO: 1493151 - DNA, 20 bp, Homo sapiens
tgcaatataagcataaaaga

SEQ ID NO: 1493152 - DNA, 21 bp, Homo sapiens
tgcaatattaatgcctttaaa

SEQ ID NO: 1493153 - DNA, 14 bp, Homo sapiens
tgcaatatttgaat

SEQ ID NO: 1493154 - DNA, 15 bp, Homo sapiens
tgcaatccatttatt

SEQ ID NO: 1493155 - DNA, 17 bp, Homo sapiens
tgcaatggttaacatct

SEQ ID NO: 1493156 - DNA, 21 bp, Homo sapiens
tgcaatgtggtgacacctccc

SEQ ID NO: 1493157 - DNA, 22 bp, Homo sapiens
tgcaattaaacttccaaagaaa

SEQ ID NO: 1493158 - DNA, 14 bp, Homo sapiens
tgcaattcaaaagt

SEQ ID NO: 1493159 - DNA, 18 bp, Homo sapiens
tgcaattcccctctgctg

SEQ ID NO: 1493160 - DNA, 21 bp, Homo sapiens
tgcaattgtaggggtgtgtgt

SEQ ID NO: 1493161 - DNA, 21 bp, Homo sapiens
tgcaattgtcttttttttcct

SEQ ID NO: 1493162 - DNA, 13 bp, Homo sapiens
tgcaatttcaagg

SEQ ID NO: 1493163 - DNA, 17 bp, Homo sapiens
tgcaatttcaaggttct

SEQ ID NO: 1493164 - DNA, 19 bp, Homo sapiens
tgcaatttcaaggttctaa

SEQ ID NO: 1493165 - DNA, 20 bp, Homo sapiens
tgcaatttgtttaaagaata

SEQ ID NO: 1493166 - DNA, 22 bp, Homo sapiens
tgcaatttgtttaaagaataaa

SEQ ID NO: 1493167 - DNA, 15 bp, Homo sapiens
tgcacaaaagcagat

SEQ ID NO: 1493168 - DNA, 14 bp, Homo sapiens
tgcacaaacatgaa

SEQ ID NO: 1493169 - DNA, 14 bp, Homo sapiens
tgcacaagtaacac

SEQ ID NO: 1493170 - DNA, 19 bp, Homo sapiens
tgcacaatattgaactttt

SEQ ID NO: 1493171 - DNA, 13 bp, Homo sapiens
tgcacaattccat

SEQ ID NO: 1493172 - DNA, 12 bp, Homo sapiens
tgcacacacagc

SEQ ID NO: 1493173 - DNA, 16 bp, Homo sapiens
tgcacacacagctcct

SEQ ID NO: 1493174 - DNA, 13 bp, Homo sapiens
tgcacacacctgc

SEQ ID NO: 1493175 - DNA, 14 bp, Homo sapiens
tgcacacacctgcc

SEQ ID NO: 1493176 - DNA, 15 bp, Homo sapiens
tgcacacacctgcct

SEQ ID NO: 1493177 - DNA, 17 bp, Homo sapiens
tgcacacacctgcctgc

SEQ ID NO: 1493178 - DNA, 13 bp, Homo sapiens
tgcacacatatat

SEQ ID NO: 1493179 - DNA, 19 bp, Homo sapiens
tgcacaccttttccccagg

SEQ ID NO: 1493180 - DNA, 22 bp, Homo sapiens
tgcacaccttttccccaggagc

SEQ ID NO: 1493181 - DNA, 23 bp, Homo sapiens
tgcacaccttttccccaggagca

SEQ ID NO: 1493182 - DNA, 20 bp, Homo sapiens
tgcagctgctgaagttctga

SEQ ID NO: 1493183 - DNA, 12 bp, Homo sapiens
tgcagctggccc

SEQ ID NO: 1493184 - DNA, 14 bp, Homo sapiens
tgcagctggcccac

SEQ ID NO: 1493185 - DNA, 23 bp, Homo sapiens
tgcagctggcccactgctggctg

SEQ ID NO: 1493186 - DNA, 19 bp, Homo sapiens
tgcagctgggccccatgct

SEQ ID NO: 1493187 - DNA, 24 bp, Homo sapiens
tgcagctgggccccatgctctgcc

SEQ ID NO: 1493188 - DNA, 13 bp, Homo sapiens
tgcagctgtttca

SEQ ID NO: 1493189 - DNA, 13 bp, Homo sapiens
tgcagctttatgt

SEQ ID NO: 1493190 - DNA, 23 bp, Homo sapiens
tgcaggaacgagcactggccaga

SEQ ID NO: 1493191 - DNA, 14 bp, Homo sapiens
tgcaggaagaggcc

SEQ ID NO: 1493192 - DNA, 15 bp, Homo sapiens
tgcaggaagaggccc

SEQ ID NO: 1493193 - DNA, 17 bp, Homo sapiens
tgcaggaagaggcccac

SEQ ID NO: 1493194 - DNA, 15 bp, Homo sapiens
tgcaggacagctctt

SEQ ID NO: 1493195 - DNA, 13 bp, Homo sapiens
tgcaggacttgag

SEQ ID NO: 1493196 - DNA, 13 bp, Homo sapiens
tgcaggagcttct

SEQ ID NO: 1493197 - DNA, 19 bp, Homo sapiens
tgcaggagtgtcctgccca

SEQ ID NO: 1493198 - DNA, 18 bp, Homo sapiens
tgcaggattcccttctgg

SEQ ID NO: 1493199 - DNA, 19 bp, Homo sapiens
tgcaggattcccttctggg

SEQ ID NO: 1493200 - DNA, 13 bp, Homo sapiens
tgcaggcagcctt

SEQ ID NO: 1493201 - DNA, 14 bp, Homo sapiens
tgcaggcagccttg

SEQ ID NO: 1493202 - DNA, 19 bp, Homo sapiens
tgcaggcaggaacaaacag

SEQ ID NO: 1493203 - DNA, 20 bp, Homo sapiens
tgcaggccaagagcagaggc

SEQ ID NO: 1493204 - DNA, 17 bp, Homo sapiens
tgcaggcccagaggagc

SEQ ID NO: 1493205 - DNA, 16 bp, Homo sapiens
tgcaggccctggcctc

SEQ ID NO: 1493206 - DNA, 21 bp, Homo sapiens
tgcaggcgatggggcaagaca

SEQ ID NO: 1493207 - DNA, 11 bp, Homo sapiens
tgcaggctctg

SEQ ID NO: 1493208 - DNA, 17 bp, Homo sapiens
tgcaggctctgggctca

SEQ ID NO: 1493209 - DNA, 19 bp, Homo sapiens
tgcaggctctgggctcagg

SEQ ID NO: 1493210 - DNA, 20 bp, Homo sapiens
tgcaggctctgggctcaggg

SEQ ID NO: 1493211 - DNA, 21 bp, Homo sapiens
tgcaggctctgggctcagggc

SEQ ID NO: 1493212 - DNA, 15 bp, Homo sapiens
tgcagggaagagggc

SEQ ID NO: 1493213 - DNA, 17 bp, Homo sapiens
tgcagggaagagggcag

SEQ ID NO: 1493214 - DNA, 14 bp, Homo sapiens
tgcagggagccgag

SEQ ID NO: 1493215 - DNA, 24 bp, Homo sapiens
tgcagggaggaggtggcagccctg

SEQ ID NO: 1493216 - DNA, 20 bp, Homo sapiens
tgcagggagggcagttttct

SEQ ID NO: 1493217 - DNA, 19 bp, Homo sapiens
tgcagggattgctgccact

SEQ ID NO: 1493218 - DNA, 10 bp, Homo sapiens
tgcagggcca

SEQ ID NO: 1493219 - DNA, 20 bp, Homo sapiens
tgcagggccgcgagaggccg

SEQ ID NO: 1493220 - DNA, 13 bp, Homo sapiens
tgcagggctccca

SEQ ID NO: 1493221 - DNA, 14 bp, Homo sapiens
tgcagggctcccat

SEQ ID NO: 1493222 - DNA, 14 bp, Homo sapiens
tgcaggggcctctg

SEQ ID NO: 1493223 - DNA, 15 bp, Homo sapiens
tgcaggggcctctgt

SEQ ID NO: 1493224 - DNA, 15 bp, Homo sapiens
tgcagggtcctcttc

SEQ ID NO: 1493225 - DNA, 19 bp, Homo sapiens
tgcagggtcctcttctggg

SEQ ID NO: 1493226 - DNA, 19 bp, Homo sapiens
tgcaggtacttcctcctga

SEQ ID NO: 1493227 - DNA, 23 bp, Homo sapiens
tgcaggtacttcctcctgatggc

SEQ ID NO: 1493228 - DNA, 14 bp, Homo sapiens
tgcaggtcagcctc

SEQ ID NO: 1493229 - DNA, 13 bp, Homo sapiens
tgcaggtcctggt

SEQ ID NO: 1493230 - DNA, 20 bp, Homo sapiens
tgcaggtcctggtgggtcag

SEQ ID NO: 1493231 - DNA, 19 bp, Homo sapiens
tgcaggtgttctgctgata

SEQ ID NO: 1493232 - DNA, 14 bp, Homo sapiens
tgcaggtttctatt

SEQ ID NO: 1493233 - DNA, 18 bp, Homo sapiens
tgcagtaactgtttttta

SEQ ID NO: 1493234 - DNA, 16 bp, Homo sapiens
tgcagtactaaaatta

SEQ ID NO: 1493235 - DNA, 18 bp, Homo sapiens
tgcagtactttgtgcatt

SEQ ID NO: 1493236 - DNA, 19 bp, Homo sapiens
tgcagtagagtcatctcca

SEQ ID NO: 1493237 - DNA, 14 bp, Homo sapiens
tgcagtccagacag

SEQ ID NO: 1493238 - DNA, 16 bp, Homo sapiens
tgcagtcctgaggaga

SEQ ID NO: 1493239 - DNA, 19 bp, Homo sapiens
tgcagtcctggtggggctg

SEQ ID NO: 1493240 - DNA, 14 bp, Homo sapiens
tgcagtctcatttc

SEQ ID NO: 1493241 - DNA, 23 bp, Homo sapiens
tgcagtcttctctctggctcagg

SEQ ID NO: 1493242 - DNA, 18 bp, Homo sapiens
tgcagtgacgtgcacctg

SEQ ID NO: 1493243 - DNA, 19 bp, Homo sapiens
tgcagtgacgtgcacctgt

SEQ ID NO: 1493244 - DNA, 22 bp, Homo sapiens
tgcagtgacgtgcacctgtact

SEQ ID NO: 1493245 - DNA, 15 bp, Homo sapiens
tgcagtgagccaaga

SEQ ID NO: 1493246 - DNA, 13 bp, Homo sapiens
tgcagtgagctga

SEQ ID NO: 1493247 - DNA, 22 bp, Homo sapiens
tgcagtgatacatgtactccag

SEQ ID NO: 1493248 - DNA, 23 bp, Homo sapiens
tgcagtgatggcgcgggaggcac

SEQ ID NO: 1493249 - DNA, 15 bp, Homo sapiens
tgcagtgattcagca

SEQ ID NO: 1493250 - DNA, 19 bp, Homo sapiens
tgcagtgccagctccctcg

SEQ ID NO: 1493251 - DNA, 23 bp, Homo sapiens
tgcagtggcgcaatctcggctca

SEQ ID NO: 1493252 - DNA, 22 bp, Homo sapiens
tgcagtggcgtgatctcagctc

SEQ ID NO: 1493253 - DNA, 12 bp, Homo sapiens
tgcagtgtggag

SEQ ID NO: 1493254 - DNA, 18 bp, Homo sapiens
tgcagttacaaattataa

SEQ ID NO: 1493255 - DNA, 13 bp, Homo sapiens
tgcagttcctggc

SEQ ID NO: 1493256 - DNA, 15 bp, Homo sapiens
tgcagttcctggccc

SEQ ID NO: 1493257 - DNA, 19 bp, Homo sapiens
tgcagttctagtttgcatt

SEQ ID NO: 1493258 - DNA, 19 bp, Homo sapiens
tgcagtttaagagcagaac

SEQ ID NO: 1493259 - DNA, 12 bp, Homo sapiens
tgcagtttcttt

SEQ ID NO: 1493260 - DNA, 16 bp, Homo sapiens
tgcagtttcttttcac

SEQ ID NO: 1493261 - DNA, 23 bp, Homo sapiens
tgcagtttggccctggagccagg

SEQ ID NO: 1493262 - DNA, 16 bp, Homo sapiens
tgcagttttaagaatt

SEQ ID NO: 1493263 - DNA, 14 bp, Homo sapiens
tgcagtttttcaga

SEQ ID NO: 1493264 - DNA, 17 bp, Homo sapiens
tgcataaatgcataatt

SEQ ID NO: 1493265 - DNA, 18 bp, Homo sapiens
tgcataagattaaaggaa

SEQ ID NO: 1493266 - DNA, 14 bp, Homo sapiens
tgcataagttaact

SEQ ID NO: 1493267 - DNA, 18 bp, Homo sapiens
tgcataatgtttctggat

SEQ ID NO: 1493268 - DNA, 14 bp, Homo sapiens
tgcataatttatgg

SEQ ID NO: 1493269 - DNA, 21 bp, Homo sapiens
tgcatacagttttctagcaat

SEQ ID NO: 1493270 - DNA, 22 bp, Homo sapiens
tgcatacggctatattggttta

SEQ ID NO: 1493271 - DNA, 18 bp, Homo sapiens
tgcatactttttaaatgt

SEQ ID NO: 1493272 - DNA, 19 bp, Homo sapiens
tgcatactttttaaatgta

SEQ ID NO: 1493273 - DNA, 23 bp, Homo sapiens
tgcatactttttaaatgtaaaga

SEQ ID NO: 1493274 - DNA, 21 bp, Homo sapiens
tgcatagcgtcctgccctgcc

SEQ ID NO: 1493275 - DNA, 20 bp, Homo sapiens
tgcataggagtttggaggaa

SEQ ID NO: 1493276 - DNA, 13 bp, Homo sapiens
tgcatatatatat

SEQ ID NO: 1493277 - DNA, 20 bp, Homo sapiens
tgcatatcacccttccctgc

SEQ ID NO: 1493278 - DNA, 17 bp, Homo sapiens
tgcatatcctgagccat

SEQ ID NO: 1493279 - DNA, 16 bp, Homo sapiens
tgcatatctgcctccc

SEQ ID NO: 1493280 - DNA, 14 bp, Homo sapiens
tgcatatgcaatgt

SEQ ID NO: 1493281 - DNA, 20 bp, Homo sapiens
tgcatatttgtgccgtaatt

SEQ ID NO: 1493282 - DNA, 15 bp, Homo sapiens
tgcatatttgtttat

SEQ ID NO: 1493283 - DNA, 15 bp, Homo sapiens
tgcatattttgagaa

SEQ ID NO: 1493284 - DNA, 19 bp, Homo sapiens
tgcatattttgagaaactg

SEQ ID NO: 1493285 - DNA, 17 bp, Homo sapiens
tgcatcaaccaggaaga

SEQ ID NO: 1493286 - DNA, 21 bp, Homo sapiens
tgcatcacgtaccccactggg

SEQ ID NO: 1493287 - DNA, 20 bp, Homo sapiens
tgcatcatatatttaacaat

SEQ ID NO: 1493288 - DNA, 16 bp, Homo sapiens
tgcatcatccttgcag

SEQ ID NO: 1493289 - DNA, 16 bp, Homo sapiens
tgcatcatctgtagat

SEQ ID NO: 1493290 - DNA, 14 bp, Homo sapiens
tgcatccagaggca

SEQ ID NO: 1493291 - DNA, 17 bp, Homo sapiens
tgcatccattcctcagg

SEQ ID NO: 1493292 - DNA, 19 bp, Homo sapiens
tgcatccattcctcaggga

SEQ ID NO: 1493293 - DNA, 22 bp, Homo sapiens
tgcatcccaaaccacgcctctt

SEQ ID NO: 1493294 - DNA, 20 bp, Homo sapiens
tgcatcccgatacctcagcc

SEQ ID NO: 1493295 - DNA, 20 bp, Homo sapiens
tgcatccgtagttccctgaa

SEQ ID NO: 1493296 - DNA, 15 bp, Homo sapiens
tgcatcctccaagaa

SEQ ID NO: 1493297 - DNA, 22 bp, Homo sapiens
tgccagcttctctctccagggt

SEQ ID NO: 1493298 - DNA, 22 bp, Homo sapiens
tgccaggaacctgtcctaagga

SEQ ID NO: 1493299 - DNA, 11 bp, Homo sapiens
tgccaggacca

SEQ ID NO: 1493300 - DNA, 18 bp, Homo sapiens
tgccaggacccgccagcc

SEQ ID NO: 1493301 - DNA, 22 bp, Homo sapiens
tgccaggacccgccagccccgc

SEQ ID NO: 1493302 - DNA, 18 bp, Homo sapiens
tgccaggatggaatgatg

SEQ ID NO: 1493303 - DNA, 21 bp, Homo sapiens
tgccaggcacctggcctgctg

SEQ ID NO: 1493304 - DNA, 22 bp, Homo sapiens
tgccaggcacctggcctgctgg

SEQ ID NO: 1493305 - DNA, 12 bp, Homo sapiens
tgccaggcaggg

SEQ ID NO: 1493306 - DNA, 16 bp, Homo sapiens
tgccaggcaggggtgg

SEQ ID NO: 1493307 - DNA, 17 bp, Homo sapiens
tgccaggcaggggtggg

SEQ ID NO: 1493308 - DNA, 18 bp, Homo sapiens
tgccaggcaggggtgggg

SEQ ID NO: 1493309 - DNA, 19 bp, Homo sapiens
tgccaggccagagggcagt

SEQ ID NO: 1493310 - DNA, 22 bp, Homo sapiens
tgccaggcccatctcaggtgcc

SEQ ID NO: 1493311 - DNA, 14 bp, Homo sapiens
tgccaggcccgggg

SEQ ID NO: 1493312 - DNA, 22 bp, Homo sapiens
tgccaggcgttggtgccacttc

SEQ ID NO: 1493313 - DNA, 19 bp, Homo sapiens
tgccaggctccctttctct

SEQ ID NO: 1493314 - DNA, 22 bp, Homo sapiens
tgccaggctgaattacagtgaa

SEQ ID NO: 1493315 - DNA, 20 bp, Homo sapiens
tgccaggctgcctcctgccc

SEQ ID NO: 1493316 - DNA, 12 bp, Homo sapiens
tgccaggctgtt

SEQ ID NO: 1493317 - DNA, 11 bp, Homo sapiens
tgccagggagc

SEQ ID NO: 1493318 - DNA, 12 bp, Homo sapiens
tgccagggagct

SEQ ID NO: 1493319 - DNA, 18 bp, Homo sapiens
tgccagggatgggcagcc

SEQ ID NO: 1493320 - DNA, 21 bp, Homo sapiens
tgccagggatgggcagcccaa

SEQ ID NO: 1493321 - DNA, 16 bp, Homo sapiens
tgccaggggcttgaga

SEQ ID NO: 1493322 - DNA, 17 bp, Homo sapiens
tgccagggtgagcaggg

SEQ ID NO: 1493323 - DNA, 24 bp, Homo sapiens
tgccaggttgcagctgctcttgca

SEQ ID NO: 1493324 - DNA, 18 bp, Homo sapiens
tgccagtatttttaaagg

SEQ ID NO: 1493325 - DNA, 17 bp, Homo sapiens
tgccagtcaagaagaaa

SEQ ID NO: 1493326 - DNA, 13 bp, Homo sapiens
tgccagtcagcaa

SEQ ID NO: 1493327 - DNA, 14 bp, Homo sapiens
tgccagtcctgggg

SEQ ID NO: 1493328 - DNA, 16 bp, Homo sapiens
tgccagtgacagacag

SEQ ID NO: 1493329 - DNA, 22 bp, Homo sapiens
tgccagtgacagacaggctctt

SEQ ID NO: 1493330 - DNA, 16 bp, Homo sapiens
tgccagtgcagccact

SEQ ID NO: 1493331 - DNA, 20 bp, Homo sapiens
tgccagtgccttacctcctg

SEQ ID NO: 1493332 - DNA, 21 bp, Homo sapiens
tgccagtgccttacctcctgc

SEQ ID NO: 1493333 - DNA, 17 bp, Homo sapiens
tgccataaccacattta

SEQ ID NO: 1493334 - DNA, 14 bp, Homo sapiens
tgccataatcagaa

SEQ ID NO: 1493335 - DNA, 16 bp, Homo sapiens
tgccataatcagaaca

SEQ ID NO: 1493336 - DNA, 23 bp, Homo sapiens
tgccataattctaagttatttac

SEQ ID NO: 1493337 - DNA, 22 bp, Homo sapiens
tgccatactttgtctgaaaaat

SEQ ID NO: 1493338 - DNA, 16 bp, Homo sapiens
tgccatagtcacatgg

SEQ ID NO: 1493339 - DNA, 19 bp, Homo sapiens
tgccatagtcacatggcct

SEQ ID NO: 1493340 - DNA, 18 bp, Homo sapiens
tgccatattaaaatctga

SEQ ID NO: 1493341 - DNA, 21 bp, Homo sapiens
tgccatattaaaatctgatgt

SEQ ID NO: 1493342 - DNA, 14 bp, Homo sapiens
tgccatctgtacat

SEQ ID NO: 1493343 - DNA, 13 bp, Homo sapiens
tgccatcttccca

SEQ ID NO: 1493344 - DNA, 15 bp, Homo sapiens
tgccatcttcccagc

SEQ ID NO: 1493345 - DNA, 16 bp, Homo sapiens
tgccatcttcccagca

SEQ ID NO: 1493346 - DNA, 21 bp, Homo sapiens
tgccatcttctccccgaggct

SEQ ID NO: 1493347 - DNA, 12 bp, Homo sapiens
tgccatgaacaa

SEQ ID NO: 1493348 - DNA, 13 bp, Homo sapiens
tgccatgaacaaa

SEQ ID NO: 1493349 - DNA, 19 bp, Homo sapiens
tgccatgcaggaagaggcc

SEQ ID NO: 1493350 - DNA, 23 bp, Homo sapiens
tgccatgcaggaagaggcccact

SEQ ID NO: 1493351 - DNA, 13 bp, Homo sapiens
tgccatgccactg

SEQ ID NO: 1493352 - DNA, 19 bp, Homo sapiens
tgccatgccactgccaggc

SEQ ID NO: 1493353 - DNA, 15 bp, Homo sapiens
tgccatgcctgctcc

SEQ ID NO: 1493354 - DNA, 18 bp, Homo sapiens
tgccatgcctgctccctg

SEQ ID NO: 1493355 - DNA, 20 bp, Homo sapiens
tgccatgcctgctccctgtc

SEQ ID NO: 1493356 - DNA, 20 bp, Homo sapiens
tgccatggatttccactgct

SEQ ID NO: 1493357 - DNA, 17 bp, Homo sapiens
tgccatggcctgtgctg

SEQ ID NO: 1493358 - DNA, 17 bp, Homo sapiens
tgccatggcgtgtccct

SEQ ID NO: 1493359 - DNA, 14 bp, Homo sapiens
tgccatgtaaggtt

SEQ ID NO: 1493360 - DNA, 20 bp, Homo sapiens
tgccatgtaaggttgtgcag

SEQ ID NO: 1493361 - DNA, 16 bp, Homo sapiens
tgccatgtagacccct

SEQ ID NO: 1493362 - DNA, 13 bp, Homo sapiens
tgccatgtagttg

SEQ ID NO: 1493363 - DNA, 13 bp, Homo sapiens
tgccatgtcgctt

SEQ ID NO: 1493364 - DNA, 13 bp, Homo sapiens
tgccatgtctgag

SEQ ID NO: 1493365 - DNA, 22 bp, Homo sapiens
tgccatgtctgcagtgtgcccc

SEQ ID NO: 1493366 - DNA, 14 bp, Homo sapiens
tgccatgtgctggg

SEQ ID NO: 1493367 - DNA, 15 bp, Homo sapiens
tgccatgttgcccct

SEQ ID NO: 1493368 - DNA, 21 bp, Homo sapiens
tgccatgttgcccctttctct

SEQ ID NO: 1493369 - DNA, 18 bp, Homo sapiens
tgccattagactgaattt

SEQ ID NO: 1493370 - DNA, 19 bp, Homo sapiens
tgccattagactgaattta

SEQ ID NO: 1493371 - DNA, 20 bp, Homo sapiens
tgccattatttttgtagtta

SEQ ID NO: 1493372 - DNA, 16 bp, Homo sapiens
tgccattcacttcata

SEQ ID NO: 1493373 - DNA, 20 bp, Homo sapiens
tgccattccaaaatattatg

SEQ ID NO: 1493374 - DNA, 18 bp, Homo sapiens
tgccattctcttgcattg

SEQ ID NO: 1493375 - DNA, 16 bp, Homo sapiens
tgccattcttctggtg

SEQ ID NO: 1493376 - DNA, 19 bp, Homo sapiens
tgccatttagaatctagaa

SEQ ID NO: 1493377 - DNA, 18 bp, Homo sapiens
tgccatttgatttttcta

SEQ ID NO: 1493378 - DNA, 18 bp, Homo sapiens
tgccatttttctataaat

SEQ ID NO: 1493379 - DNA, 21 bp, Homo sapiens
tgccatttttctataaatcag

SEQ ID NO: 1493380 - DNA, 17 bp, Homo sapiens
tgcccaaagtggggagg

SEQ ID NO: 1493381 - DNA, 22 bp, Homo sapiens
tgcccaaagtggggagggacaa

SEQ ID NO: 1493382 - DNA, 20 bp, Homo sapiens
tgcccaacccttccctcacc

SEQ ID NO: 1493383 - DNA, 13 bp, Homo sapiens
tgcccaagccaga

SEQ ID NO: 1493384 - DNA, 14 bp, Homo sapiens
tgcccaagccagag

SEQ ID NO: 1493385 - DNA, 15 bp, Homo sapiens
tgcccaatgaataat

SEQ ID NO: 1493386 - DNA, 12 bp, Homo sapiens
tgcccacacact

SEQ ID NO: 1493387 - DNA, 15 bp, Homo sapiens
tgcccacacactttc

SEQ ID NO: 1493388 - DNA, 18 bp, Homo sapiens
tgcccacacactttccat

SEQ ID NO: 1493389 - DNA, 17 bp, Homo sapiens
tgcccacatttgggctc

SEQ ID NO: 1493390 - DNA, 20 bp, Homo sapiens
tgcccacatttgggctcagg

SEQ ID NO: 1493391 - DNA, 11 bp, Homo sapiens
tgcccaccccc

SEQ ID NO: 1493392 - DNA, 14 bp, Homo sapiens
tgcccaccccctca

SEQ ID NO: 1493393 - DNA, 15 bp, Homo sapiens
tgcccaccccctgcc

SEQ ID NO: 1493394 - DNA, 16 bp, Homo sapiens
tgcccaccccctgccc

SEQ ID NO: 1493395 - DNA, 19 bp, Homo sapiens
tgcccaccccctgccctgc

SEQ ID NO: 1493396 - DNA, 13 bp, Homo sapiens
tgcccacccctca

SEQ ID NO: 1493397 - DNA, 17 bp, Homo sapiens
tgcccacccctcactcc

SEQ ID NO: 1493398 - DNA, 22 bp, Homo sapiens
tgcccaccgttaggattcaggc

SEQ ID NO: 1493399 - DNA, 15 bp, Homo sapiens
tgcccacctcggcct

SEQ ID NO: 1493400 - DNA, 15 bp, Homo sapiens
tgcccacctgcccat

SEQ ID NO: 1493401 - DNA, 20 bp, Homo sapiens
tgcccacgatcccctccccc

SEQ ID NO: 1493402 - DNA, 21 bp, Homo sapiens
tgcccactgcctgcctcccct

SEQ ID NO: 1493403 - DNA, 12 bp, Homo sapiens
tgcccactgttt

SEQ ID NO: 1493404 - DNA, 18 bp, Homo sapiens
tgcccagagatgcctcca

SEQ ID NO: 1493405 - DNA, 20 bp, Homo sapiens
tgcccagagatgcctccacc

SEQ ID NO: 1493406 - DNA, 21 bp, Homo sapiens
tgcccagagatgcctccaccg

SEQ ID NO: 1493407 - DNA, 22 bp, Homo sapiens
tgcccagagatgcctccaccgc

SEQ ID NO: 1493408 - DNA, 21 bp, Homo sapiens
tgcccagaggactcccaaccc

SEQ ID NO: 1493409 - DNA, 17 bp, Homo sapiens
tgcccagcacctggagg

SEQ ID NO: 1493410 - DNA, 15 bp, Homo sapiens
tgcccagcaggccca

SEQ ID NO: 1493411 - DNA, 16 bp, Homo sapiens
tgcccagcaggcccag

SEQ ID NO: 1493412 - DNA, 16 bp, Homo sapiens
tgcctaatggagaaga

SEQ ID NO: 1493413 - DNA, 20 bp, Homo sapiens
tgcctacaaaacctcaaacc

SEQ ID NO: 1493414 - DNA, 19 bp, Homo sapiens
tgcctacaataaaaagaaa

SEQ ID NO: 1493415 - DNA, 22 bp, Homo sapiens
tgcctacagaacttcagaaaga

SEQ ID NO: 1493416 - DNA, 23 bp, Homo sapiens
tgcctacagaacttcagaaagac

SEQ ID NO: 1493417 - DNA, 17 bp, Homo sapiens
tgcctagaaatatcttt

SEQ ID NO: 1493418 - DNA, 15 bp, Homo sapiens
tgcctagactgttac

SEQ ID NO: 1493419 - DNA, 19 bp, Homo sapiens
tgcctagactgttactttg

SEQ ID NO: 1493420 - DNA, 13 bp, Homo sapiens
tgcctagagtgta

SEQ ID NO: 1493421 - DNA, 17 bp, Homo sapiens
tgcctaggaattcccag

SEQ ID NO: 1493422 - DNA, 15 bp, Homo sapiens
tgcctaggagctggc

SEQ ID NO: 1493423 - DNA, 19 bp, Homo sapiens
tgcctaggagctggctggc

SEQ ID NO: 1493424 - DNA, 23 bp, Homo sapiens
tgcctaggagctggctggcaggt

SEQ ID NO: 1493425 - DNA, 13 bp, Homo sapiens
tgcctaggccaaa

SEQ ID NO: 1493426 - DNA, 15 bp, Homo sapiens
tgcctaggtttttcc

SEQ ID NO: 1493427 - DNA, 20 bp, Homo sapiens
tgcctatatctgagagacct

SEQ ID NO: 1493428 - DNA, 16 bp, Homo sapiens
tgcctcaactccagga

SEQ ID NO: 1493429 - DNA, 15 bp, Homo sapiens
tgcctcaatgccagt

SEQ ID NO: 1493430 - DNA, 23 bp, Homo sapiens
tgcctcaatgtgaatcagaccct

SEQ ID NO: 1493431 - DNA, 16 bp, Homo sapiens
tgcctcaccctcccaa

SEQ ID NO: 1493432 - DNA, 17 bp, Homo sapiens
tgcctcaccctcccaag

SEQ ID NO: 1493433 - DNA, 18 bp, Homo sapiens
tgcctcaccctcccaagt

SEQ ID NO: 1493434 - DNA, 16 bp, Homo sapiens
tgcctcagagaccagg

SEQ ID NO: 1493435 - DNA, 18 bp, Homo sapiens
tgcctcagagaccagggc

SEQ ID NO: 1493436 - DNA, 22 bp, Homo sapiens
tgcctcagccagtggcacagga

SEQ ID NO: 1493437 - DNA, 12 bp, Homo sapiens
tgcctcagcccg

SEQ ID NO: 1493438 - DNA, 18 bp, Homo sapiens
tgcctcagcctcccgagt

SEQ ID NO: 1493439 - DNA, 23 bp, Homo sapiens
tgcctcagttttccttctgttaa

SEQ ID NO: 1493440 - DNA, 18 bp, Homo sapiens
tgcctcatattgtcctct

SEQ ID NO: 1493441 - DNA, 12 bp, Homo sapiens
tgcctccaccac

SEQ ID NO: 1493442 - DNA, 14 bp, Homo sapiens
tgcctccaccacca

SEQ ID NO: 1493443 - DNA, 16 bp, Homo sapiens
tgcctccaccaccact

SEQ ID NO: 1493444 - DNA, 19 bp, Homo sapiens
tgcctccaccaccactggc

SEQ ID NO: 1493445 - DNA, 13 bp, Homo sapiens
tgcctccaccagc

SEQ ID NO: 1493446 - DNA, 15 bp, Homo sapiens
tgcctccaccagcaa

SEQ ID NO: 1493447 - DNA, 18 bp, Homo sapiens
tgcctccaccccccagaa

SEQ ID NO: 1493448 - DNA, 11 bp, Homo sapiens
tgcctccaccg

SEQ ID NO: 1493449 - DNA, 18 bp, Homo sapiens
tgcctccaccgagccagc

SEQ ID NO: 1493450 - DNA, 12 bp, Homo sapiens
tgcctccagggc

SEQ ID NO: 1493451 - DNA, 16 bp, Homo sapiens
tgcctccagggctgga

SEQ ID NO: 1493452 - DNA, 19 bp, Homo sapiens
tgcctccagggctggactg

SEQ ID NO: 1493453 - DNA, 23 bp, Homo sapiens
tgcctccagggctggactgaggc

SEQ ID NO: 1493454 - DNA, 17 bp, Homo sapiens
tgcctccaggtgtgcac

SEQ ID NO: 1493455 - DNA, 15 bp, Homo sapiens
tgcctccatggcagc

SEQ ID NO: 1493456 - DNA, 22 bp, Homo sapiens
tgcctccatggcagcagccagg

SEQ ID NO: 1493457 - DNA, 19 bp, Homo sapiens
tgcctcccaaagtgctggg

SEQ ID NO: 1493458 - DNA, 20 bp, Homo sapiens
tgcctcccaaagtgctggga

SEQ ID NO: 1493459 - DNA, 15 bp, Homo sapiens
tgcctcccaggcaag

SEQ ID NO: 1493460 - DNA, 16 bp, Homo sapiens
tgcctcccaggttcca

SEQ ID NO: 1493461 - DNA, 21 bp, Homo sapiens
tgcctccccatttcccatctg

SEQ ID NO: 1493462 - DNA, 22 bp, Homo sapiens
tgcctccccatttcccatctgc

SEQ ID NO: 1493463 - DNA, 21 bp, Homo sapiens
tgcctcccttccgctgcgggc

SEQ ID NO: 1493464 - DNA, 24 bp, Homo sapiens
tgcctcctcacccccagctttgct

SEQ ID NO: 1493465 - DNA, 14 bp, Homo sapiens
tgcctcctgcctgc

SEQ ID NO: 1493466 - DNA, 18 bp, Homo sapiens
tgcctcctgcctgcccct

SEQ ID NO: 1493467 - DNA, 13 bp, Homo sapiens
tgcctcctggctc

SEQ ID NO: 1493468 - DNA, 10 bp, Homo sapiens
tgcctcctgt

SEQ ID NO: 1493469 - DNA, 14 bp, Homo sapiens
tgcctcctgttctg

SEQ ID NO: 1493470 - DNA, 18 bp, Homo sapiens
tgcctcctgttctgccca

SEQ ID NO: 1493471 - DNA, 20 bp, Homo sapiens
tgcctccttggtaaatacaa

SEQ ID NO: 1493472 - DNA, 14 bp, Homo sapiens
tgcctcgaggcacc

SEQ ID NO: 1493473 - DNA, 17 bp, Homo sapiens
tgcctcgaggcaccggc

SEQ ID NO: 1493474 - DNA, 22 bp, Homo sapiens
tgcctcgaggcaccggcgctgc

SEQ ID NO: 1493475 - DNA, 16 bp, Homo sapiens
tgcctcgctcccttca

SEQ ID NO: 1493476 - DNA, 13 bp, Homo sapiens
tgcctctcacaca

SEQ ID NO: 1493477 - DNA, 15 bp, Homo sapiens
tgcctctcacacaca

SEQ ID NO: 1493478 - DNA, 19 bp, Homo sapiens
tgcctctcacacacataga

SEQ ID NO: 1493479 - DNA, 18 bp, Homo sapiens
tgcctctcatcaactgaa

SEQ ID NO: 1493480 - DNA, 18 bp, Homo sapiens
tgcctctgatatgggact

SEQ ID NO: 1493481 - DNA, 21 bp, Homo sapiens
tgcctctgcagtctcatttct

SEQ ID NO: 1493482 - DNA, 14 bp, Homo sapiens
tgcctctgccctgg

SEQ ID NO: 1493483 - DNA, 16 bp, Homo sapiens
tgcctctgcctgcatt

SEQ ID NO: 1493484 - DNA, 14 bp, Homo sapiens
tgcctctgctccct

SEQ ID NO: 1493485 - DNA, 16 bp, Homo sapiens
tgcctctgctccctct

SEQ ID NO: 1493486 - DNA, 17 bp, Homo sapiens
tgcctctgctccctctg

SEQ ID NO: 1493487 - DNA, 14 bp, Homo sapiens
tgcctctgggactg

SEQ ID NO: 1493488 - DNA, 13 bp, Homo sapiens
tgcctctgggcca

SEQ ID NO: 1493489 - DNA, 15 bp, Homo sapiens
tgcctctgtcccctt

SEQ ID NO: 1493490 - DNA, 16 bp, Homo sapiens
tgcctctgtccccttc

SEQ ID NO: 1493491 - DNA, 19 bp, Homo sapiens
tgcctctgtgtagccgccc

SEQ ID NO: 1493492 - DNA, 22 bp, Homo sapiens
tgcctctgtgtagccgccctga

SEQ ID NO: 1493493 - DNA, 23 bp, Homo sapiens
tgcctctgtgtagccgccctgag

SEQ ID NO: 1493494 - DNA, 19 bp, Homo sapiens
tgcctcttaaattatatat

SEQ ID NO: 1493495 - DNA, 14 bp, Homo sapiens
tgcctcttcattct

SEQ ID NO: 1493496 - DNA, 21 bp, Homo sapiens
tgcctcttccagtcttcctga

SEQ ID NO: 1493497 - DNA, 13 bp, Homo sapiens
tgcctcttctttg

SEQ ID NO: 1493498 - DNA, 20 bp, Homo sapiens
tgcctcttctttgtgccttt

SEQ ID NO: 1493499 - DNA, 21 bp, Homo sapiens
tgcctcttctttgtgcctttg

SEQ ID NO: 1493500 - DNA, 13 bp, Homo sapiens
tgcctcttgtctt

SEQ ID NO: 1493501 - DNA, 18 bp, Homo sapiens
tgcctcttgttgcagaga

SEQ ID NO: 1493502 - DNA, 17 bp, Homo sapiens
tgcctctttccctagga

SEQ ID NO: 1493503 - DNA, 14 bp, Homo sapiens
tgcctgaacatcct

SEQ ID NO: 1493504 - DNA, 20 bp, Homo sapiens
tgcctgaacatccttccttc

SEQ ID NO: 1493505 - DNA, 21 bp, Homo sapiens
tgcctgaacatccttccttcc

SEQ ID NO: 1493506 - DNA, 15 bp, Homo sapiens
tgcctgaatatttgt

SEQ ID NO: 1493507 - DNA, 13 bp, Homo sapiens
tgcctgacacact

SEQ ID NO: 1493508 - DNA, 14 bp, Homo sapiens
tgcctgagaggcag

SEQ ID NO: 1493509 - DNA, 19 bp, Homo sapiens
tgcctgagaggcaggcata

SEQ ID NO: 1493510 - DNA, 14 bp, Homo sapiens
tgcctgagattctt

SEQ ID NO: 1493511 - DNA, 23 bp, Homo sapiens
tgcctgagattctttaaggagat

SEQ ID NO: 1493512 - DNA, 18 bp, Homo sapiens
tgcctgagcacctcccag

SEQ ID NO: 1493513 - DNA, 19 bp, Homo sapiens
tgcctgagcacctcccagc

SEQ ID NO: 1493514 - DNA, 20 bp, Homo sapiens
tgcctgagcacctcccagcc

SEQ ID NO: 1493515 - DNA, 18 bp, Homo sapiens
tgcctgagcccaggagct

SEQ ID NO: 1493516 - DNA, 11 bp, Homo sapiens
tgcctgagctg

SEQ ID NO: 1493517 - DNA, 15 bp, Homo sapiens
tgcctgagctgggga

SEQ ID NO: 1493518 - DNA, 17 bp, Homo sapiens
tgcctgagctggggaag

SEQ ID NO: 1493519 - DNA, 21 bp, Homo sapiens
tgcctgaggaggaggacacag

SEQ ID NO: 1493520 - DNA, 14 bp, Homo sapiens
tgcctgagggcccc

SEQ ID NO: 1493521 - DNA, 16 bp, Homo sapiens
tgcctgagggcccctc

SEQ ID NO: 1493522 - DNA, 17 bp, Homo sapiens
tgcctgagggcccctct

SEQ ID NO: 1493523 - DNA, 17 bp, Homo sapiens
tgcctgagttataaata

SEQ ID NO: 1493524 - DNA, 14 bp, Homo sapiens
tgcctgatataaat

SEQ ID NO: 1493525 - DNA, 15 bp, Homo sapiens
tgcctgatataaatg

SEQ ID NO: 1493526 - DNA, 14 bp, Homo sapiens
tgcctgcaccagga

SEQ ID NO: 1493527 - DNA, 15 bp, Homo sapiens
tgctcctgcttttct

SEQ ID NO: 1493528 - DNA, 19 bp, Homo sapiens
tgctcctgcttttctgtcc

SEQ ID NO: 1493529 - DNA, 15 bp, Homo sapiens
tgctcctgtggcagg

SEQ ID NO: 1493530 - DNA, 23 bp, Homo sapiens
tgctcgcccctgttttttgtaga

SEQ ID NO: 1493531 - DNA, 16 bp, Homo sapiens
tgctcgtggactgtgc

SEQ ID NO: 1493532 - DNA, 18 bp, Homo sapiens
tgctcgtggactgtgctg

SEQ ID NO: 1493533 - DNA, 16 bp, Homo sapiens
tgctcgtgtgatttcc

SEQ ID NO: 1493534 - DNA, 14 bp, Homo sapiens
tgctctaaaatatt

SEQ ID NO: 1493535 - DNA, 21 bp, Homo sapiens
tgctctaacacctgcctaggt

SEQ ID NO: 1493536 - DNA, 12 bp, Homo sapiens
tgctctagccag

SEQ ID NO: 1493537 - DNA, 13 bp, Homo sapiens
tgctctagccagg

SEQ ID NO: 1493538 - DNA, 14 bp, Homo sapiens
tgctctagccagga

SEQ ID NO: 1493539 - DNA, 22 bp, Homo sapiens
tgctctagccaggagtctgtgc

SEQ ID NO: 1493540 - DNA, 12 bp, Homo sapiens
tgctctagctgg

SEQ ID NO: 1493541 - DNA, 19 bp, Homo sapiens
tgctctaggaagacatttt

SEQ ID NO: 1493542 - DNA, 18 bp, Homo sapiens
tgctctagtgggacagcc

SEQ ID NO: 1493543 - DNA, 18 bp, Homo sapiens
tgctctccttcctggagc

SEQ ID NO: 1493544 - DNA, 20 bp, Homo sapiens
tgctctctgcagccagccca

SEQ ID NO: 1493545 - DNA, 13 bp, Homo sapiens
tgctctctgggct

SEQ ID NO: 1493546 - DNA, 14 bp, Homo sapiens
tgctctctgggctt

SEQ ID NO: 1493547 - DNA, 14 bp, Homo sapiens
tgctctcttcagga

SEQ ID NO: 1493548 - DNA, 22 bp, Homo sapiens
tgctctcttgtgacgtgcactg

SEQ ID NO: 1493549 - DNA, 15 bp, Homo sapiens
tgctctgcatgttac

SEQ ID NO: 1493550 - DNA, 14 bp, Homo sapiens
tgctctgccatctt

SEQ ID NO: 1493551 - DNA, 18 bp, Homo sapiens
tgctctgccatcttcagg

SEQ ID NO: 1493552 - DNA, 16 bp, Homo sapiens
tgctctgccccaagcc

SEQ ID NO: 1493553 - DNA, 17 bp, Homo sapiens
tgctctgccccaagccc

SEQ ID NO: 1493554 - DNA, 14 bp, Homo sapiens
tgctctgccccttg

SEQ ID NO: 1493555 - DNA, 20 bp, Homo sapiens
tgctctgccccttgggcatc

SEQ ID NO: 1493556 - DNA, 11 bp, Homo sapiens
tgctctgccct

SEQ ID NO: 1493557 - DNA, 13 bp, Homo sapiens
tgctctgcctgga

SEQ ID NO: 1493558 - DNA, 14 bp, Homo sapiens
tgctctgcctggag

SEQ ID NO: 1493559 - DNA, 16 bp, Homo sapiens
tgctctgcttgacaac

SEQ ID NO: 1493560 - DNA, 13 bp, Homo sapiens
tgctctggaagcc

SEQ ID NO: 1493561 - DNA, 12 bp, Homo sapiens
tgctctggaata

SEQ ID NO: 1493562 - DNA, 23 bp, Homo sapiens
tgctctggaataaagttgcagat

SEQ ID NO: 1493563 - DNA, 17 bp, Homo sapiens
tgctctggagcctgcag

SEQ ID NO: 1493564 - DNA, 15 bp, Homo sapiens
tgctctggaggctgc

SEQ ID NO: 1493565 - DNA, 19 bp, Homo sapiens
tgctctggcaccatcagcc

SEQ ID NO: 1493566 - DNA, 13 bp, Homo sapiens
tgctctggcggct

SEQ ID NO: 1493567 - DNA, 16 bp, Homo sapiens
tgctctggcggcttcc

SEQ ID NO: 1493568 - DNA, 21 bp, Homo sapiens
tgctctggcggcttcctgtcc

SEQ ID NO: 1493569 - DNA, 12 bp, Homo sapiens
tgctctgggacg

SEQ ID NO: 1493570 - DNA, 18 bp, Homo sapiens
tgctctgggacgtggaca

SEQ ID NO: 1493571 - DNA, 20 bp, Homo sapiens
tgctctgggacgtggacatg

SEQ ID NO: 1493572 - DNA, 12 bp, Homo sapiens
tgctctggggat

SEQ ID NO: 1493573 - DNA, 20 bp, Homo sapiens
tgctctggggatttctggga

SEQ ID NO: 1493574 - DNA, 22 bp, Homo sapiens
tgctctggtggcttaagtgagc

SEQ ID NO: 1493575 - DNA, 14 bp, Homo sapiens
tgctctgtgtcaag

SEQ ID NO: 1493576 - DNA, 15 bp, Homo sapiens
tgctctgtttcttcc

SEQ ID NO: 1493577 - DNA, 18 bp, Homo sapiens
tgctcttagctgtctgct

SEQ ID NO: 1493578 - DNA, 18 bp, Homo sapiens
tgctcttagtgcccgcct

SEQ ID NO: 1493579 - DNA, 13 bp, Homo sapiens
tgctcttctgtgg

SEQ ID NO: 1493580 - DNA, 15 bp, Homo sapiens
tgctcttctttctga

SEQ ID NO: 1493581 - DNA, 13 bp, Homo sapiens
tgctcttgcatct

SEQ ID NO: 1493582 - DNA, 15 bp, Homo sapiens
tgctcttgcatctgg

SEQ ID NO: 1493583 - DNA, 16 bp, Homo sapiens
tgctcttgcatctggg

SEQ ID NO: 1493584 - DNA, 16 bp, Homo sapiens
tgctcttggctgaccc

SEQ ID NO: 1493585 - DNA, 15 bp, Homo sapiens
tgctcttgtttttat

SEQ ID NO: 1493586 - DNA, 16 bp, Homo sapiens
tgctctttattgcaga

SEQ ID NO: 1493587 - DNA, 18 bp, Homo sapiens
tgctctttcatctctgct

SEQ ID NO: 1493588 - DNA, 12 bp, Homo sapiens
tgctctttctct

SEQ ID NO: 1493589 - DNA, 15 bp, Homo sapiens
tgctctttctctgcc

SEQ ID NO: 1493590 - DNA, 18 bp, Homo sapiens
tgctctttctctgccagt

SEQ ID NO: 1493591 - DNA, 21 bp, Homo sapiens
tgctctttctctgccagtgac

SEQ ID NO: 1493592 - DNA, 22 bp, Homo sapiens
tgctctttctctgccagtgaca

SEQ ID NO: 1493593 - DNA, 13 bp, Homo sapiens
tgctcttttcctg

SEQ ID NO: 1493594 - DNA, 21 bp, Homo sapiens
tgctcttttctcctcactgta

SEQ ID NO: 1493595 - DNA, 21 bp, Homo sapiens
tgctcttttgcacaaggaaat

SEQ ID NO: 1493596 - DNA, 22 bp, Homo sapiens
tgctcttttgcacaaggaaata

SEQ ID NO: 1493597 - DNA, 20 bp, Homo sapiens
tgctcttttggtggggagca

SEQ ID NO: 1493598 - DNA, 15 bp, Homo sapiens
tgctcttttgtgatg

SEQ ID NO: 1493599 - DNA, 17 bp, Homo sapiens
tgctcttttgtgatgaa

SEQ ID NO: 1493600 - DNA, 14 bp, Homo sapiens
tgctcttttttctc

SEQ ID NO: 1493601 - DNA, 17 bp, Homo sapiens
tgctgaaattttatatg

SEQ ID NO: 1493602 - DNA, 17 bp, Homo sapiens
tgctgaacacagtgtct

SEQ ID NO: 1493603 - DNA, 20 bp, Homo sapiens
tgctgaacacagtgtctgtt

SEQ ID NO: 1493604 - DNA, 14 bp, Homo sapiens
tgctgaacattgga

SEQ ID NO: 1493605 - DNA, 22 bp, Homo sapiens
tgctgaacattggagaatctca

SEQ ID NO: 1493606 - DNA, 17 bp, Homo sapiens
tgctgaacgcagaagaa

SEQ ID NO: 1493607 - DNA, 20 bp, Homo sapiens
tgctgaactcagcacattcg

SEQ ID NO: 1493608 - DNA, 17 bp, Homo sapiens
tgctgaagacatgtttc

SEQ ID NO: 1493609 - DNA, 14 bp, Homo sapiens
tgctgaagctgctg

SEQ ID NO: 1493610 - DNA, 18 bp, Homo sapiens
tgctgaatatacagcagg

SEQ ID NO: 1493611 - DNA, 15 bp, Homo sapiens
tgctgaatgcaggga

SEQ ID NO: 1493612 - DNA, 11 bp, Homo sapiens
tgctgaattca

SEQ ID NO: 1493613 - DNA, 16 bp, Homo sapiens
tgctgacaataaagat

SEQ ID NO: 1493614 - DNA, 14 bp, Homo sapiens
tgctgacagacact

SEQ ID NO: 1493615 - DNA, 17 bp, Homo sapiens
tgctgaccaaatggcca

SEQ ID NO: 1493616 - DNA, 20 bp, Homo sapiens
tgctgacggccagggagaag

SEQ ID NO: 1493617 - DNA, 14 bp, Homo sapiens
tgctgactgaacat

SEQ ID NO: 1493618 - DNA, 22 bp, Homo sapiens
tgctgagagacccaaggaggaa

SEQ ID NO: 1493619 - DNA, 19 bp, Homo sapiens
tgctgagaggcgagctcct

SEQ ID NO: 1493620 - DNA, 14 bp, Homo sapiens
tgctgagcctctgc

SEQ ID NO: 1493621 - DNA, 20 bp, Homo sapiens
tgctgagcctctgctcccca

SEQ ID NO: 1493622 - DNA, 16 bp, Homo sapiens
tgctgagcttagcctt

SEQ ID NO: 1493623 - DNA, 18 bp, Homo sapiens
tgctgagcttagccttgt

SEQ ID NO: 1493624 - DNA, 21 bp, Homo sapiens
tgctgagcttagccttgtgcc

SEQ ID NO: 1493625 - DNA, 23 bp, Homo sapiens
tgctgagcttagccttgtgccct

SEQ ID NO: 1493626 - DNA, 24 bp, Homo sapiens
tgctgagcttagccttgtgccctg

SEQ ID NO: 1493627 - DNA, 21 bp, Homo sapiens
tgctgaggaggggcctgggca

SEQ ID NO: 1493628 - DNA, 14 bp, Homo sapiens
tgctgaggcaccgt

SEQ ID NO: 1493629 - DNA, 14 bp, Homo sapiens
tgctgaggccaccc

SEQ ID NO: 1493630 - DNA, 16 bp, Homo sapiens
tgctgaggccacccac

SEQ ID NO: 1493631 - DNA, 13 bp, Homo sapiens
tgctgaggccagg

SEQ ID NO: 1493632 - DNA, 15 bp, Homo sapiens
tgctgaggcctgggc

SEQ ID NO: 1493633 - DNA, 19 bp, Homo sapiens
tgctgagggaccagccaag

SEQ ID NO: 1493634 - DNA, 22 bp, Homo sapiens
tgctgagggaccttggagagct

SEQ ID NO: 1493635 - DNA, 23 bp, Homo sapiens
tgctgagggtgtttcttcctgca

SEQ ID NO: 1493636 - DNA, 17 bp, Homo sapiens
tgctgagggtttgaata

SEQ ID NO: 1493637 - DNA, 19 bp, Homo sapiens
tgctgagtaaggaacacga

SEQ ID NO: 1493638 - DNA, 19 bp, Homo sapiens
tgctgatcagagttcctcc

SEQ ID NO: 1493639 - DNA, 23 bp, Homo sapiens
tgctgatcatcgccagaggtgct

SEQ ID NO: 1493640 - DNA, 17 bp, Homo sapiens
tgctgatcctgctgacc

SEQ ID NO: 1493641 - DNA, 15 bp, Homo sapiens
tgctgatggctgcta

SEQ ID NO: 1493642 - DNA, 21 bp, Homo sapiens
tgctttgtgttcagttttgtg

SEQ ID NO: 1493643 - DNA, 13 bp, Homo sapiens
tgcttttaccatg

SEQ ID NO: 1493644 - DNA, 14 bp, Homo sapiens
tgcttttcaaatgt

SEQ ID NO: 1493645 - DNA, 14 bp, Homo sapiens
tgcttttcatgtag

SEQ ID NO: 1493646 - DNA, 18 bp, Homo sapiens
tgcttttccatctaaaat

SEQ ID NO: 1493647 - DNA, 18 bp, Homo sapiens
tgcttttcctcaagcaat

SEQ ID NO: 1493648 - DNA, 12 bp, Homo sapiens
tgcttttctcca

SEQ ID NO: 1493649 - DNA, 18 bp, Homo sapiens
tgcttttctgccctggct

SEQ ID NO: 1493650 - DNA, 15 bp, Homo sapiens
tgcttttctgtcctg

SEQ ID NO: 1493651 - DNA, 19 bp, Homo sapiens
tgcttttctgtcctgggca

SEQ ID NO: 1493652 - DNA, 13 bp, Homo sapiens
tgcttttctgttt

SEQ ID NO: 1493653 - DNA, 15 bp, Homo sapiens
tgcttttgaaaagtt

SEQ ID NO: 1493654 - DNA, 21 bp, Homo sapiens
tgcttttgaaaagttgaaatg

SEQ ID NO: 1493655 - DNA, 19 bp, Homo sapiens
tgcttttggcaaaactcta

SEQ ID NO: 1493656 - DNA, 10 bp, Homo sapiens
tgcttttgtt

SEQ ID NO: 1493657 - DNA, 21 bp, Homo sapiens
tgcttttgttttcctgctggt

SEQ ID NO: 1493658 - DNA, 14 bp, Homo sapiens
tgctttttcttgtt

SEQ ID NO: 1493659 - DNA, 19 bp, Homo sapiens
tgctttttgcgtacacaga

SEQ ID NO: 1493660 - DNA, 21 bp, Homo sapiens
tgctttttgcgtacacagaga

SEQ ID NO: 1493661 - DNA, 13 bp, Homo sapiens
tgctttttggaaa

SEQ ID NO: 1493662 - DNA, 13 bp, Homo sapiens
tgcttttttgtat

SEQ ID NO: 1493663 - DNA, 17 bp, Homo sapiens
tgcttttttgttttggc

SEQ ID NO: 1493664 - DNA, 18 bp, Homo sapiens
tgctttttttcttaaaag

SEQ ID NO: 1493665 - DNA, 13 bp, Homo sapiens
tgctttttttgaa

SEQ ID NO: 1493666 - DNA, 17 bp, Homo sapiens
tgctttttttgtgtgta

SEQ ID NO: 1493667 - DNA, 20 bp, Homo sapiens
tggaaaaaaacataaaaagc

SEQ ID NO: 1493668 - DNA, 14 bp, Homo sapiens
tggaaaaaaacatc

SEQ ID NO: 1493669 - DNA, 20 bp, Homo sapiens
tggaaaaaaattacaaggca

SEQ ID NO: 1493670 - DNA, 13 bp, Homo sapiens
tggaaaaatagta

SEQ ID NO: 1493671 - DNA, 15 bp, Homo sapiens
tggaaaaatagtaaa

SEQ ID NO: 1493672 - DNA, 18 bp, Homo sapiens
tggaaaaatccagaaaga

SEQ ID NO: 1493673 - DNA, 19 bp, Homo sapiens
tggaaaaatccagaaagaa

SEQ ID NO: 1493674 - DNA, 14 bp, Homo sapiens
tggaaaaatggttg

SEQ ID NO: 1493675 - DNA, 16 bp, Homo sapiens
tggaaaaatggttgat

SEQ ID NO: 1493676 - DNA, 16 bp, Homo sapiens
tggaaaaattccagaa

SEQ ID NO: 1493677 - DNA, 18 bp, Homo sapiens
tggaaaaattgagatgga

SEQ ID NO: 1493678 - DNA, 20 bp, Homo sapiens
tggaaaacagaacacttatg

SEQ ID NO: 1493679 - DNA, 16 bp, Homo sapiens
tggaaaagaagaaact

SEQ ID NO: 1493680 - DNA, 18 bp, Homo sapiens
tggaaaagaagaaacttt

SEQ ID NO: 1493681 - DNA, 21 bp, Homo sapiens
tggaaaagaagaaactttgcc

SEQ ID NO: 1493682 - DNA, 14 bp, Homo sapiens
tggaaaagaataca

SEQ ID NO: 1493683 - DNA, 19 bp, Homo sapiens
tggaaaagaatacagaaag

SEQ ID NO: 1493684 - DNA, 22 bp, Homo sapiens
tggaaaaggaagactagaggct

SEQ ID NO: 1493685 - DNA, 15 bp, Homo sapiens
tggaaaagtttgaaa

SEQ ID NO: 1493686 - DNA, 13 bp, Homo sapiens
tggaaaataaaca

SEQ ID NO: 1493687 - DNA, 14 bp, Homo sapiens
tggaaaataaacat

SEQ ID NO: 1493688 - DNA, 21 bp, Homo sapiens
tggaaaataatttagtggatg

SEQ ID NO: 1493689 - DNA, 15 bp, Homo sapiens
tggaaaattttctcc

SEQ ID NO: 1493690 - DNA, 15 bp, Homo sapiens
tggaaacagcatgaa

SEQ ID NO: 1493691 - DNA, 17 bp, Homo sapiens
tggaaacctaactgcaa

SEQ ID NO: 1493692 - DNA, 16 bp, Homo sapiens
tggaaacctgccctgc

SEQ ID NO: 1493693 - DNA, 21 bp, Homo sapiens
tggaaacctgccctgcctgag

SEQ ID NO: 1493694 - DNA, 23 bp, Homo sapiens
tggaaactaattgttttttttct

SEQ ID NO: 1493695 - DNA, 12 bp, Homo sapiens
tggaaactgaat

SEQ ID NO: 1493696 - DNA, 15 bp, Homo sapiens
tggaaacttttgtta

SEQ ID NO: 1493697 - DNA, 22 bp, Homo sapiens
tggaaacttttgttagggctgc

SEQ ID NO: 1493698 - DNA, 12 bp, Homo sapiens
tggaaagagacc

SEQ ID NO: 1493699 - DNA, 13 bp, Homo sapiens
tggaaagagacca

SEQ ID NO: 1493700 - DNA, 23 bp, Homo sapiens
tggaaagataactaggaaatcca

SEQ ID NO: 1493701 - DNA, 18 bp, Homo sapiens
tggaaagatagagattgt

SEQ ID NO: 1493702 - DNA, 19 bp, Homo sapiens
tggaaagatgttaagcatt

SEQ ID NO: 1493703 - DNA, 22 bp, Homo sapiens
tggaaagatgttaagcatttat

SEQ ID NO: 1493704 - DNA, 12 bp, Homo sapiens
tggaaagcaaag

SEQ ID NO: 1493705 - DNA, 16 bp, Homo sapiens
tggaaagcatcacctc

SEQ ID NO: 1493706 - DNA, 19 bp, Homo sapiens
tggaaagcatcacctcagg

SEQ ID NO: 1493707 - DNA, 15 bp, Homo sapiens
tggaaagcctctgct

SEQ ID NO: 1493708 - DNA, 17 bp, Homo sapiens
tggaaaggaaaaaagaa

SEQ ID NO: 1493709 - DNA, 17 bp, Homo sapiens
tggaaagggagggagga

SEQ ID NO: 1493710 - DNA, 13 bp, Homo sapiens
tggaaaggggaga

SEQ ID NO: 1493711 - DNA, 17 bp, Homo sapiens
tggaaaggggagagcct

SEQ ID NO: 1493712 - DNA, 19 bp, Homo sapiens
tggaaaggggagagcctgc

SEQ ID NO: 1493713 - DNA, 21 bp, Homo sapiens
tggaaaggggagagcctgctg

SEQ ID NO: 1493714 - DNA, 23 bp, Homo sapiens
tggaaaggggagagcctgctggc

SEQ ID NO: 1493715 - DNA, 17 bp, Homo sapiens
tggaaaggggagttgag

SEQ ID NO: 1493716 - DNA, 16 bp, Homo sapiens
tggaaagtagctgcta

SEQ ID NO: 1493717 - DNA, 13 bp, Homo sapiens
tggaaagtcagaa

SEQ ID NO: 1493718 - DNA, 19 bp, Homo sapiens
tggaaagttactgtaaatg

SEQ ID NO: 1493719 - DNA, 15 bp, Homo sapiens
tggaaagttgggccc

SEQ ID NO: 1493720 - DNA, 22 bp, Homo sapiens
tggaaagttgggcccctgagga

SEQ ID NO: 1493721 - DNA, 16 bp, Homo sapiens
tggaaataaactgtgc

SEQ ID NO: 1493722 - DNA, 16 bp, Homo sapiens
tggaaataaagtcaga

SEQ ID NO: 1493723 - DNA, 15 bp, Homo sapiens
tggaaataaatgtat

SEQ ID NO: 1493724 - DNA, 22 bp, Homo sapiens
tggaaatacagttgttggcctc

SEQ ID NO: 1493725 - DNA, 22 bp, Homo sapiens
tggaaatatcagttactcagcc

SEQ ID NO: 1493726 - DNA, 22 bp, Homo sapiens
tggaaatcagttgtgaatacat

SEQ ID NO: 1493727 - DNA, 17 bp, Homo sapiens
tggaaatcataccagtt

SEQ ID NO: 1493728 - DNA, 16 bp, Homo sapiens
tggaaatgtctgctgg

SEQ ID NO: 1493729 - DNA, 18 bp, Homo sapiens
tggaaatttaaatgacat

SEQ ID NO: 1493730 - DNA, 18 bp, Homo sapiens
tggaaatttagagttcta

SEQ ID NO: 1493731 - DNA, 21 bp, Homo sapiens
tggaacaagacagccttcact

SEQ ID NO: 1493732 - DNA, 13 bp, Homo sapiens
tggaacaccctgg

SEQ ID NO: 1493733 - DNA, 22 bp, Homo sapiens
tggaacacctaccaaaaaataa

SEQ ID NO: 1493734 - DNA, 21 bp, Homo sapiens
tggaacataaaatacaatgtt

SEQ ID NO: 1493735 - DNA, 17 bp, Homo sapiens
tggaacatgcttttact

SEQ ID NO: 1493736 - DNA, 21 bp, Homo sapiens
tggaacatgcttttactttat

SEQ ID NO: 1493737 - DNA, 13 bp, Homo sapiens
tggaacattggaa

SEQ ID NO: 1493738 - DNA, 20 bp, Homo sapiens
tggaacattggaatgttctc

SEQ ID NO: 1493739 - DNA, 16 bp, Homo sapiens
tggaacatttgatatt

SEQ ID NO: 1493740 - DNA, 15 bp, Homo sapiens
tggaaccacctggac

SEQ ID NO: 1493741 - DNA, 18 bp, Homo sapiens
tggaaccagggaggagag

SEQ ID NO: 1493742 - DNA, 17 bp, Homo sapiens
tggaacccagactcaga

SEQ ID NO: 1493743 - DNA, 16 bp, Homo sapiens
tggaacctcagcctgg

SEQ ID NO: 1493744 - DNA, 16 bp, Homo sapiens
tggaactatgaagact

SEQ ID NO: 1493745 - DNA, 16 bp, Homo sapiens
tggaactcattcctgc

SEQ ID NO: 1493746 - DNA, 17 bp, Homo sapiens
tggaactcctggccttt

SEQ ID NO: 1493747 - DNA, 13 bp, Homo sapiens
tggaactgacccc

SEQ ID NO: 1493748 - DNA, 21 bp, Homo sapiens
tggaactgaccccctcccctg

SEQ ID NO: 1493749 - DNA, 18 bp, Homo sapiens
tggaagaacaggcctctc

SEQ ID NO: 1493750 - DNA, 16 bp, Homo sapiens
tggaagacacttcaga

SEQ ID NO: 1493751 - DNA, 17 bp, Homo sapiens
tggaagacacttcagat

SEQ ID NO: 1493752 - DNA, 20 bp, Homo sapiens
tggaagacacttcagatctg

SEQ ID NO: 1493753 - DNA, 23 bp, Homo sapiens
tggaagacacttcagatctgagg

SEQ ID NO: 1493754 - DNA, 15 bp, Homo sapiens
tggaagaccccaccc

SEQ ID NO: 1493755 - DNA, 12 bp, Homo sapiens
tggaagagcagc

SEQ ID NO: 1493756 - DNA, 13 bp, Homo sapiens
tggaagagcagcc

SEQ ID NO: 1493757 - DNA, 19 bp, Homo sapiens
tggaggggggtgctggccc

SEQ ID NO: 1493758 - DNA, 17 bp, Homo sapiens
tggaggggtggggagct

SEQ ID NO: 1493759 - DNA, 20 bp, Homo sapiens
tggaggggtggtcctgactc

SEQ ID NO: 1493760 - DNA, 17 bp, Homo sapiens
tggaggggtgtggcagt

SEQ ID NO: 1493761 - DNA, 18 bp, Homo sapiens
tggaggggtgtggcagtg

SEQ ID NO: 1493762 - DNA, 20 bp, Homo sapiens
tggaggtcggtaggttcagc

SEQ ID NO: 1493763 - DNA, 15 bp, Homo sapiens
tggaggtctccaggg

SEQ ID NO: 1493764 - DNA, 18 bp, Homo sapiens
tggaggtctccaggggcc

SEQ ID NO: 1493765 - DNA, 15 bp, Homo sapiens
tggaggtctggctga

SEQ ID NO: 1493766 - DNA, 20 bp, Homo sapiens
tggaggtctggctgagcccc

SEQ ID NO: 1493767 - DNA, 17 bp, Homo sapiens
tggaggtggggttggga

SEQ ID NO: 1493768 - DNA, 17 bp, Homo sapiens
tggagtatagtgcaaat

SEQ ID NO: 1493769 - DNA, 15 bp, Homo sapiens
tggagtatgatttac

SEQ ID NO: 1493770 - DNA, 19 bp, Homo sapiens
tggagtcacatcagtgagg

SEQ ID NO: 1493771 - DNA, 22 bp, Homo sapiens
tggagtcacatcagtgaggagg

SEQ ID NO: 1493772 - DNA, 15 bp, Homo sapiens
tggagtccagctcta

SEQ ID NO: 1493773 - DNA, 13 bp, Homo sapiens
tggagtctgagtc

SEQ ID NO: 1493774 - DNA, 21 bp, Homo sapiens
tggagtgaggcttccaggctc

SEQ ID NO: 1493775 - DNA, 23 bp, Homo sapiens
tggagtgaggcttccaggctctt

SEQ ID NO: 1493776 - DNA, 19 bp, Homo sapiens
tggagtgagtcacctgctc

SEQ ID NO: 1493777 - DNA, 22 bp, Homo sapiens
tggagtgagtcacctgctccag

SEQ ID NO: 1493778 - DNA, 15 bp, Homo sapiens
tggagtgattctaga

SEQ ID NO: 1493779 - DNA, 16 bp, Homo sapiens
tggagtgattctagag

SEQ ID NO: 1493780 - DNA, 17 bp, Homo sapiens
tggagtgcaatgacaca

SEQ ID NO: 1493781 - DNA, 13 bp, Homo sapiens
tggagtgcagtgg

SEQ ID NO: 1493782 - DNA, 15 bp, Homo sapiens
tggagtgcgctcttg

SEQ ID NO: 1493783 - DNA, 17 bp, Homo sapiens
tggagtgcttctggaac

SEQ ID NO: 1493784 - DNA, 13 bp, Homo sapiens
tggagtggaggca

SEQ ID NO: 1493785 - DNA, 14 bp, Homo sapiens
tggagtggaggcat

SEQ ID NO: 1493786 - DNA, 22 bp, Homo sapiens
tggagtggccaaataggaggga

SEQ ID NO: 1493787 - DNA, 17 bp, Homo sapiens
tggagtgtatgactgca

SEQ ID NO: 1493788 - DNA, 19 bp, Homo sapiens
tggagtgtatgactgcaca

SEQ ID NO: 1493789 - DNA, 17 bp, Homo sapiens
tggagtgtcggatcctg

SEQ ID NO: 1493790 - DNA, 18 bp, Homo sapiens
tggagtgtcggatcctgt

SEQ ID NO: 1493791 - DNA, 20 bp, Homo sapiens
tggagtgtcggatcctgtga

SEQ ID NO: 1493792 - DNA, 22 bp, Homo sapiens
tggagtgtcggatcctgtgagt

SEQ ID NO: 1493793 - DNA, 22 bp, Homo sapiens
tggagtgtgcagacagccatgc

SEQ ID NO: 1493794 - DNA, 24 bp, Homo sapiens
tggagtgtttctaataaacttgga

SEQ ID NO: 1493795 - DNA, 15 bp, Homo sapiens
tggagttaaaatgca

SEQ ID NO: 1493796 - DNA, 14 bp, Homo sapiens
tggagttcaccttg

SEQ ID NO: 1493797 - DNA, 14 bp, Homo sapiens
tggagttccttatc

SEQ ID NO: 1493798 - DNA, 23 bp, Homo sapiens
tggagttccttatccctctcttc

SEQ ID NO: 1493799 - DNA, 14 bp, Homo sapiens
tggagttctctcat

SEQ ID NO: 1493800 - DNA, 15 bp, Homo sapiens
tggagttcttgtgcc

SEQ ID NO: 1493801 - DNA, 16 bp, Homo sapiens
tggagttcttgtgcca

SEQ ID NO: 1493802 - DNA, 15 bp, Homo sapiens
tggagttgatctgga

SEQ ID NO: 1493803 - DNA, 17 bp, Homo sapiens
tggagttgatctggaac

SEQ ID NO: 1493804 - DNA, 19 bp, Homo sapiens
tggagtttaatacagtgag

SEQ ID NO: 1493805 - DNA, 13 bp, Homo sapiens
tggagtttctaag

SEQ ID NO: 1493806 - DNA, 23 bp, Homo sapiens
tggagtttgtaaaattgttcctg

SEQ ID NO: 1493807 - DNA, 20 bp, Homo sapiens
tggagtttgtattttgcata

SEQ ID NO: 1493808 - DNA, 20 bp, Homo sapiens
tggagtttgtgtctgttgct

SEQ ID NO: 1493809 - DNA, 16 bp, Homo sapiens
tggataaactgagcct

SEQ ID NO: 1493810 - DNA, 15 bp, Homo sapiens
tggataaagccactg

SEQ ID NO: 1493811 - DNA, 16 bp, Homo sapiens
tggataatcaggaaaa

SEQ ID NO: 1493812 - DNA, 20 bp, Homo sapiens
tggataatcaggaaaaatga

SEQ ID NO: 1493813 - DNA, 18 bp, Homo sapiens
tggatagacttgggatgg

SEQ ID NO: 1493814 - DNA, 20 bp, Homo sapiens
tggatatgttgttaaacacg

SEQ ID NO: 1493815 - DNA, 14 bp, Homo sapiens
tggatattgttacg

SEQ ID NO: 1493816 - DNA, 19 bp, Homo sapiens
tggatatttcaatctttta

SEQ ID NO: 1493817 - DNA, 14 bp, Homo sapiens
tggatcacaaagtg

SEQ ID NO: 1493818 - DNA, 16 bp, Homo sapiens
tggatcacacacatgg

SEQ ID NO: 1493819 - DNA, 20 bp, Homo sapiens
tggatcacacctcagtggga

SEQ ID NO: 1493820 - DNA, 16 bp, Homo sapiens
tggatcaccattatat

SEQ ID NO: 1493821 - DNA, 19 bp, Homo sapiens
tggatcacctgaggtcagg

SEQ ID NO: 1493822 - DNA, 14 bp, Homo sapiens
tggatcagccaagg

SEQ ID NO: 1493823 - DNA, 19 bp, Homo sapiens
tggatcagtcctttgatca

SEQ ID NO: 1493824 - DNA, 20 bp, Homo sapiens
tggatccatacaaaactatc

SEQ ID NO: 1493825 - DNA, 21 bp, Homo sapiens
tggatccatcttgagccacag

SEQ ID NO: 1493826 - DNA, 18 bp, Homo sapiens
tggatcccaaagcaagga

SEQ ID NO: 1493827 - DNA, 14 bp, Homo sapiens
tggatccctgccct

SEQ ID NO: 1493828 - DNA, 16 bp, Homo sapiens
tggatcctgtgtggag

SEQ ID NO: 1493829 - DNA, 22 bp, Homo sapiens
tggatcgagtgtagctgtgaaa

SEQ ID NO: 1493830 - DNA, 18 bp, Homo sapiens
tggatcgctaagctggct

SEQ ID NO: 1493831 - DNA, 15 bp, Homo sapiens
tggatctatcacctg

SEQ ID NO: 1493832 - DNA, 16 bp, Homo sapiens
tggatctatccctgcg

SEQ ID NO: 1493833 - DNA, 14 bp, Homo sapiens
tggatctatttcat

SEQ ID NO: 1493834 - DNA, 19 bp, Homo sapiens
tggatctccttcccttctc

SEQ ID NO: 1493835 - DNA, 21 bp, Homo sapiens
tggatctgggaccctttcctt

SEQ ID NO: 1493836 - DNA, 16 bp, Homo sapiens
tggatcttctatcatt

SEQ ID NO: 1493837 - DNA, 15 bp, Homo sapiens
tggatcttgcctaaa

SEQ ID NO: 1493838 - DNA, 19 bp, Homo sapiens
tggatcttttctaaatgtt

SEQ ID NO: 1493839 - DNA, 21 bp, Homo sapiens
tggatgaaaaatatttctgag

SEQ ID NO: 1493840 - DNA, 22 bp, Homo sapiens
tggatgaagattctcctgtgct

SEQ ID NO: 1493841 - DNA, 21 bp, Homo sapiens
tggatgagaaacagctcagcc

SEQ ID NO: 1493842 - DNA, 20 bp, Homo sapiens
tggatgagacttccaaacct

SEQ ID NO: 1493843 - DNA, 18 bp, Homo sapiens
tggatgattttttaagca

SEQ ID NO: 1493844 - DNA, 22 bp, Homo sapiens
tggatgccagggccgaccagag

SEQ ID NO: 1493845 - DNA, 18 bp, Homo sapiens
tggatgcggccattcaag

SEQ ID NO: 1493846 - DNA, 20 bp, Homo sapiens
tggatggaaggttggatgga

SEQ ID NO: 1493847 - DNA, 17 bp, Homo sapiens
tggatggaatatcagaa

SEQ ID NO: 1493848 - DNA, 20 bp, Homo sapiens
tggatggcacctcaggctga

SEQ ID NO: 1493849 - DNA, 17 bp, Homo sapiens
tggatggccgggctgct

SEQ ID NO: 1493850 - DNA, 20 bp, Homo sapiens
tggatggccgggctgctgct

SEQ ID NO: 1493851 - DNA, 18 bp, Homo sapiens
tggatggccgtggatgcg

SEQ ID NO: 1493852 - DNA, 13 bp, Homo sapiens
tggatggcttcta

SEQ ID NO: 1493853 - DNA, 17 bp, Homo sapiens
tggatgggaatttgtca

SEQ ID NO: 1493854 - DNA, 17 bp, Homo sapiens
tggatgggagtgagaca

SEQ ID NO: 1493855 - DNA, 18 bp, Homo sapiens
tggatgggcaaagcttgt

SEQ ID NO: 1493856 - DNA, 16 bp, Homo sapiens
tggatgggcagtcatt

SEQ ID NO: 1493857 - DNA, 21 bp, Homo sapiens
tggatggggctggcatgtttt

SEQ ID NO: 1493858 - DNA, 18 bp, Homo sapiens
tggatgggggaactcaga

SEQ ID NO: 1493859 - DNA, 22 bp, Homo sapiens
tggatggtttgttgttctgcct

SEQ ID NO: 1493860 - DNA, 14 bp, Homo sapiens
tggatgtaaatcct

SEQ ID NO: 1493861 - DNA, 14 bp, Homo sapiens
tggatgtgtggggc

SEQ ID NO: 1493862 - DNA, 19 bp, Homo sapiens
tggatgttatgaacagctg

SEQ ID NO: 1493863 - DNA, 19 bp, Homo sapiens
tggattaatgttttgtaca

SEQ ID NO: 1493864 - DNA, 20 bp, Homo sapiens
tggattataagttctatttt

SEQ ID NO: 1493865 - DNA, 21 bp, Homo sapiens
tggattatgttatacaaggca

SEQ ID NO: 1493866 - DNA, 22 bp, Homo sapiens
tggattatgttatacaaggcaa

SEQ ID NO: 1493867 - DNA, 17 bp, Homo sapiens
tggattattcatttaaa

SEQ ID NO: 1493868 - DNA, 16 bp, Homo sapiens
tggattattctttctc

SEQ ID NO: 1493869 - DNA, 23 bp, Homo sapiens
tggattcacccccctctgctgcc

SEQ ID NO: 1493870 - DNA, 17 bp, Homo sapiens
tggattcatttcctgcc

SEQ ID NO: 1493871 - DNA, 12 bp, Homo sapiens
tggcctccggcc

SEQ ID NO: 1493872 - DNA, 18 bp, Homo sapiens
tggcctccggcctcccct

SEQ ID NO: 1493873 - DNA, 17 bp, Homo sapiens
tggcctctctatcctct

SEQ ID NO: 1493874 - DNA, 13 bp, Homo sapiens
tggcctctgcctg

SEQ ID NO: 1493875 - DNA, 15 bp, Homo sapiens
tggcctctgcctggg

SEQ ID NO: 1493876 - DNA, 16 bp, Homo sapiens
tggcctctgcctgggg

SEQ ID NO: 1493877 - DNA, 17 bp, Homo sapiens
tggcctctgcctggggc

SEQ ID NO: 1493878 - DNA, 14 bp, Homo sapiens
tggcctctgctgaa

SEQ ID NO: 1493879 - DNA, 18 bp, Homo sapiens
tggcctctgggcagtgtg

SEQ ID NO: 1493880 - DNA, 20 bp, Homo sapiens
tggcctcttgagcagtggct

SEQ ID NO: 1493881 - DNA, 19 bp, Homo sapiens
tggcctgagagtcagctct

SEQ ID NO: 1493882 - DNA, 12 bp, Homo sapiens
tggcctgagctg

SEQ ID NO: 1493883 - DNA, 20 bp, Homo sapiens
tggcctgctgggctctccac

SEQ ID NO: 1493884 - DNA, 15 bp, Homo sapiens
tggcctggacagtat

SEQ ID NO: 1493885 - DNA, 19 bp, Homo sapiens
tggcctggagggactttta

SEQ ID NO: 1493886 - DNA, 21 bp, Homo sapiens
tggcctggattcacgccctct

SEQ ID NO: 1493887 - DNA, 23 bp, Homo sapiens
tggcctggggtgcatctcctccc

SEQ ID NO: 1493888 - DNA, 15 bp, Homo sapiens
tggcctgtagagttg

SEQ ID NO: 1493889 - DNA, 12 bp, Homo sapiens
tggcctgtctca

SEQ ID NO: 1493890 - DNA, 16 bp, Homo sapiens
tggcctgtctcatccc

SEQ ID NO: 1493891 - DNA, 12 bp, Homo sapiens
tggcctgtgctg

SEQ ID NO: 1493892 - DNA, 14 bp, Homo sapiens
tggcctgtggcaca

SEQ ID NO: 1493893 - DNA, 17 bp, Homo sapiens
tggcctgtgtccagcag

SEQ ID NO: 1493894 - DNA, 19 bp, Homo sapiens
tggcctgtgtccagcagct

SEQ ID NO: 1493895 - DNA, 16 bp, Homo sapiens
tggcctgtgtcccatg

SEQ ID NO: 1493896 - DNA, 21 bp, Homo sapiens
tggcctgtgtcccatgaccca

SEQ ID NO: 1493897 - DNA, 22 bp, Homo sapiens
tggcctgtgtcccatgacccac

SEQ ID NO: 1493898 - DNA, 13 bp, Homo sapiens
tggcctgttccct

SEQ ID NO: 1493899 - DNA, 15 bp, Homo sapiens
tggcctgttccctag

SEQ ID NO: 1493900 - DNA, 17 bp, Homo sapiens
tggcctgttccctagag

SEQ ID NO: 1493901 - DNA, 21 bp, Homo sapiens
tggcctgttcttctatgggtt

SEQ ID NO: 1493902 - DNA, 12 bp, Homo sapiens
tggcctgtttga

SEQ ID NO: 1493903 - DNA, 21 bp, Homo sapiens
tggcctgtttgatgtatgtgt

SEQ ID NO: 1493904 - DNA, 13 bp, Homo sapiens
tggccttaagaac

SEQ ID NO: 1493905 - DNA, 15 bp, Homo sapiens
tggccttaatttcct

SEQ ID NO: 1493906 - DNA, 16 bp, Homo sapiens
tggccttaatttcctt

SEQ ID NO: 1493907 - DNA, 18 bp, Homo sapiens
tggccttccatttatatg

SEQ ID NO: 1493908 - DNA, 16 bp, Homo sapiens
tggccttccccagcct

SEQ ID NO: 1493909 - DNA, 17 bp, Homo sapiens
tggccttccccagcctc

SEQ ID NO: 1493910 - DNA, 13 bp, Homo sapiens
tggccttgcagct

SEQ ID NO: 1493911 - DNA, 17 bp, Homo sapiens
tggccttgcagctggcc

SEQ ID NO: 1493912 - DNA, 19 bp, Homo sapiens
tggccttgcagctggccca

SEQ ID NO: 1493913 - DNA, 13 bp, Homo sapiens
tggccttgcccgc

SEQ ID NO: 1493914 - DNA, 13 bp, Homo sapiens
tggccttgggcct

SEQ ID NO: 1493915 - DNA, 22 bp, Homo sapiens
tggcctttaagcctgcattctt

SEQ ID NO: 1493916 - DNA, 16 bp, Homo sapiens
tggcctttcttgggga

SEQ ID NO: 1493917 - DNA, 18 bp, Homo sapiens
tggcctttcttggggaga

SEQ ID NO: 1493918 - DNA, 21 bp, Homo sapiens
tggcctttgcttatgaatatt

SEQ ID NO: 1493919 - DNA, 18 bp, Homo sapiens
tggcgaatctcaaaatta

SEQ ID NO: 1493920 - DNA, 15 bp, Homo sapiens
tggcgacaagagtga

SEQ ID NO: 1493921 - DNA, 18 bp, Homo sapiens
tggcgactctgcagagtc

SEQ ID NO: 1493922 - DNA, 22 bp, Homo sapiens
tggcgagttctctttggaaata

SEQ ID NO: 1493923 - DNA, 13 bp, Homo sapiens
tggcgatgtgtta

SEQ ID NO: 1493924 - DNA, 18 bp, Homo sapiens
tggcgattccctctcacc

SEQ ID NO: 1493925 - DNA, 14 bp, Homo sapiens
tggcgcaagcctgt

SEQ ID NO: 1493926 - DNA, 21 bp, Homo sapiens
tggcgcccatcctagtgggca

SEQ ID NO: 1493927 - DNA, 17 bp, Homo sapiens
tggcgccgtctccaggg

SEQ ID NO: 1493928 - DNA, 18 bp, Homo sapiens
tggcgccgtctccagggg

SEQ ID NO: 1493929 - DNA, 15 bp, Homo sapiens
tggcgccttctcgga

SEQ ID NO: 1493930 - DNA, 16 bp, Homo sapiens
tggcgcgggaggcacc

SEQ ID NO: 1493931 - DNA, 23 bp, Homo sapiens
tggcgcgggaggcaccagctctg

SEQ ID NO: 1493932 - DNA, 19 bp, Homo sapiens
tggcgctatattgtggctg

SEQ ID NO: 1493933 - DNA, 17 bp, Homo sapiens
tggcgctttctcctgtg

SEQ ID NO: 1493934 - DNA, 14 bp, Homo sapiens
tggcggagagtttt

SEQ ID NO: 1493935 - DNA, 13 bp, Homo sapiens
tggcggaggtctc

SEQ ID NO: 1493936 - DNA, 19 bp, Homo sapiens
tggcggaggtctctgggag

SEQ ID NO: 1493937 - DNA, 16 bp, Homo sapiens
tggcggctactcagca

SEQ ID NO: 1493938 - DNA, 22 bp, Homo sapiens
tggcggctactcagcagccctc

SEQ ID NO: 1493939 - DNA, 13 bp, Homo sapiens
tggcggtgcctgg

SEQ ID NO: 1493940 - DNA, 20 bp, Homo sapiens
tggcgtaatgggcctgccca

SEQ ID NO: 1493941 - DNA, 22 bp, Homo sapiens
tggcgtagcagagttaaatctc

SEQ ID NO: 1493942 - DNA, 23 bp, Homo sapiens
tggcgtctgcctaggagctggct

SEQ ID NO: 1493943 - DNA, 14 bp, Homo sapiens
tggcgtctgctctg

SEQ ID NO: 1493944 - DNA, 15 bp, Homo sapiens
tggcgtgctcagacc

SEQ ID NO: 1493945 - DNA, 17 bp, Homo sapiens
tggcgtgggagccagcc

SEQ ID NO: 1493946 - DNA, 14 bp, Homo sapiens
tggctaataaactg

SEQ ID NO: 1493947 - DNA, 17 bp, Homo sapiens
tggctaataaactgtat

SEQ ID NO: 1493948 - DNA, 19 bp, Homo sapiens
tggctaatgtactgcatat

SEQ ID NO: 1493949 - DNA, 17 bp, Homo sapiens
tggctaccattgtcact

SEQ ID NO: 1493950 - DNA, 22 bp, Homo sapiens
tggctacgcctcttctgtccct

SEQ ID NO: 1493951 - DNA, 23 bp, Homo sapiens
tggctactgtctattaaaattct

SEQ ID NO: 1493952 - DNA, 15 bp, Homo sapiens
tggctagagccgagg

SEQ ID NO: 1493953 - DNA, 19 bp, Homo sapiens
tggctagagccgaggggag

SEQ ID NO: 1493954 - DNA, 21 bp, Homo sapiens
tggctagaggccagccccacc

SEQ ID NO: 1493955 - DNA, 23 bp, Homo sapiens
tggctagaggccagccccaccca

SEQ ID NO: 1493956 - DNA, 15 bp, Homo sapiens
tggctagagtttcca

SEQ ID NO: 1493957 - DNA, 17 bp, Homo sapiens
tggctagcgcaagacca

SEQ ID NO: 1493958 - DNA, 19 bp, Homo sapiens
tggctataaatatataaaa

SEQ ID NO: 1493959 - DNA, 18 bp, Homo sapiens
tggctataacatgtcttt

SEQ ID NO: 1493960 - DNA, 23 bp, Homo sapiens
tggctataggtgctacaaaaaca

SEQ ID NO: 1493961 - DNA, 20 bp, Homo sapiens
tggctattgaagatgctgcc

SEQ ID NO: 1493962 - DNA, 16 bp, Homo sapiens
tggctatttaaagaca

SEQ ID NO: 1493963 - DNA, 15 bp, Homo sapiens
tggctatttctgtgt

SEQ ID NO: 1493964 - DNA, 16 bp, Homo sapiens
tggctatttctgtgtc

SEQ ID NO: 1493965 - DNA, 15 bp, Homo sapiens
tggctatttttgaag

SEQ ID NO: 1493966 - DNA, 17 bp, Homo sapiens
tggctcaagacaaggct

SEQ ID NO: 1493967 - DNA, 18 bp, Homo sapiens
tggctcaagacaaggctg

SEQ ID NO: 1493968 - DNA, 14 bp, Homo sapiens
tggctcaagtagaa

SEQ ID NO: 1493969 - DNA, 13 bp, Homo sapiens
tggctcacaaggc

SEQ ID NO: 1493970 - DNA, 16 bp, Homo sapiens
tggctcacaaggccca

SEQ ID NO: 1493971 - DNA, 18 bp, Homo sapiens
tggctcacaaggcccagg

SEQ ID NO: 1493972 - DNA, 19 bp, Homo sapiens
tggctcacaaggcccagga

SEQ ID NO: 1493973 - DNA, 14 bp, Homo sapiens
tggctcacgcctgt

SEQ ID NO: 1493974 - DNA, 12 bp, Homo sapiens
tggctcactact

SEQ ID NO: 1493975 - DNA, 14 bp, Homo sapiens
tggctcactactga

SEQ ID NO: 1493976 - DNA, 17 bp, Homo sapiens
tggctcactactgaaca

SEQ ID NO: 1493977 - DNA, 20 bp, Homo sapiens
tggctcactatgaatctatt

SEQ ID NO: 1493978 - DNA, 19 bp, Homo sapiens
tggctcactgcagcctccg

SEQ ID NO: 1493979 - DNA, 22 bp, Homo sapiens
tggctcagctcggggagcctta

SEQ ID NO: 1493980 - DNA, 20 bp, Homo sapiens
tggctcagcttctaatccca

SEQ ID NO: 1493981 - DNA, 13 bp, Homo sapiens
tggctcaggcaag

SEQ ID NO: 1493982 - DNA, 16 bp, Homo sapiens
tggctcaggcaagccc

SEQ ID NO: 1493983 - DNA, 18 bp, Homo sapiens
tggctcaggcaagcccct

SEQ ID NO: 1493984 - DNA, 22 bp, Homo sapiens
tggctcaggcagacaagagctg

SEQ ID NO: 1493985 - DNA, 12 bp, Homo sapiens
tggctcaggccc

SEQ ID NO: 1493986 - DNA, 21 bp, Homo sapiens
tgggcaggaggccccaggctg

SEQ ID NO: 1493987 - DNA, 19 bp, Homo sapiens
tgggcaggatctcaagcca

SEQ ID NO: 1493988 - DNA, 22 bp, Homo sapiens
tgggcaggatctcaagccagcc

SEQ ID NO: 1493989 - DNA, 23 bp, Homo sapiens
tgggcaggtggccgcccctgagg

SEQ ID NO: 1493990 - DNA, 21 bp, Homo sapiens
tgggcaggtggtggcactgag

SEQ ID NO: 1493991 - DNA, 14 bp, Homo sapiens
tgggcagtcatttt

SEQ ID NO: 1493992 - DNA, 18 bp, Homo sapiens
tgggcagtgtggcctctt

SEQ ID NO: 1493993 - DNA, 17 bp, Homo sapiens
tgggcatcttctggctt

SEQ ID NO: 1493994 - DNA, 15 bp, Homo sapiens
tgggcatcttttgta

SEQ ID NO: 1493995 - DNA, 20 bp, Homo sapiens
tgggcatgggtccagggcct

SEQ ID NO: 1493996 - DNA, 18 bp, Homo sapiens
tgggcattgccatgtgga

SEQ ID NO: 1493997 - DNA, 12 bp, Homo sapiens
tgggcattgctt

SEQ ID NO: 1493998 - DNA, 15 bp, Homo sapiens
tgggcattgggctga

SEQ ID NO: 1493999 - DNA, 19 bp, Homo sapiens
tgggcattgggctgacacc

SEQ ID NO: 1494000 - DNA, 19 bp, Homo sapiens
tgggcattgggttctaaag

SEQ ID NO: 1494001 - DNA, 13 bp, Homo sapiens
tgggcatttcaat

SEQ ID NO: 1494002 - DNA, 17 bp, Homo sapiens
tgggcatttggtgagag

SEQ ID NO: 1494003 - DNA, 23 bp, Homo sapiens
tgggcatttggtgagagtcaaag

SEQ ID NO: 1494004 - DNA, 14 bp, Homo sapiens
tgggcattttttta

SEQ ID NO: 1494005 - DNA, 23 bp, Homo sapiens
tgggccaacaaagaacactaact

SEQ ID NO: 1494006 - DNA, 18 bp, Homo sapiens
tgggccacacctgagcgc

SEQ ID NO: 1494007 - DNA, 22 bp, Homo sapiens
tgggccacaggggacagggctg

SEQ ID NO: 1494008 - DNA, 16 bp, Homo sapiens
tgggccacggaggagg

SEQ ID NO: 1494009 - DNA, 18 bp, Homo sapiens
tgggccagacatgccaca

SEQ ID NO: 1494010 - DNA, 19 bp, Homo sapiens
tgggccagacatgccacaa

SEQ ID NO: 1494011 - DNA, 20 bp, Homo sapiens
tgggccagccctgcagccca

SEQ ID NO: 1494012 - DNA, 13 bp, Homo sapiens
tgggccagggaaa

SEQ ID NO: 1494013 - DNA, 12 bp, Homo sapiens
tgggccaggtct

SEQ ID NO: 1494014 - DNA, 20 bp, Homo sapiens
tgggccagtctgtggatcag

SEQ ID NO: 1494015 - DNA, 23 bp, Homo sapiens
tgggccataatgttgcttctcag

SEQ ID NO: 1494016 - DNA, 17 bp, Homo sapiens
tgggccatgtccaaaga

SEQ ID NO: 1494017 - DNA, 21 bp, Homo sapiens
tgggcccagaccactgtctcc

SEQ ID NO: 1494018 - DNA, 14 bp, Homo sapiens
tgggcccagctggg

SEQ ID NO: 1494019 - DNA, 16 bp, Homo sapiens
tgggcccagctgggct

SEQ ID NO: 1494020 - DNA, 17 bp, Homo sapiens
tgggcccagctgggctc

SEQ ID NO: 1494021 - DNA, 14 bp, Homo sapiens
tgggcccaggacca

SEQ ID NO: 1494022 - DNA, 20 bp, Homo sapiens
tgggcccaggaccagctggg

SEQ ID NO: 1494023 - DNA, 21 bp, Homo sapiens
tgggcccaggaccagctgggg

SEQ ID NO: 1494024 - DNA, 21 bp, Homo sapiens
tgggcccataatagttagccc

SEQ ID NO: 1494025 - DNA, 12 bp, Homo sapiens
tgggccccagct

SEQ ID NO: 1494026 - DNA, 14 bp, Homo sapiens
tgggccccatgctc

SEQ ID NO: 1494027 - DNA, 16 bp, Homo sapiens
tgggccccatgctctg

SEQ ID NO: 1494028 - DNA, 17 bp, Homo sapiens
tgggccccatgctctgc

SEQ ID NO: 1494029 - DNA, 17 bp, Homo sapiens
tgggccccgggctggag

SEQ ID NO: 1494030 - DNA, 18 bp, Homo sapiens
tgggccccgggctggaga

SEQ ID NO: 1494031 - DNA, 19 bp, Homo sapiens
tgggccccgggctggagaa

SEQ ID NO: 1494032 - DNA, 13 bp, Homo sapiens
tgggcccctgagg

SEQ ID NO: 1494033 - DNA, 12 bp, Homo sapiens
tgggcccctggc

SEQ ID NO: 1494034 - DNA, 14 bp, Homo sapiens
tgggcccctggccc

SEQ ID NO: 1494035 - DNA, 13 bp, Homo sapiens
tgggccctctctt

SEQ ID NO: 1494036 - DNA, 17 bp, Homo sapiens
tgggccctctgtccaca

SEQ ID NO: 1494037 - DNA, 21 bp, Homo sapiens
tgggccctgagtctgggcagc

SEQ ID NO: 1494038 - DNA, 14 bp, Homo sapiens
tgggccgctgccac

SEQ ID NO: 1494039 - DNA, 21 bp, Homo sapiens
tgggccggctgagtggcagca

SEQ ID NO: 1494040 - DNA, 21 bp, Homo sapiens
tgggccggcttcatgccagct

SEQ ID NO: 1494041 - DNA, 11 bp, Homo sapiens
tgggcctcagg

SEQ ID NO: 1494042 - DNA, 17 bp, Homo sapiens
tgggcctcaggctctgc

SEQ ID NO: 1494043 - DNA, 19 bp, Homo sapiens
tgggcctcaggctctgcac

SEQ ID NO: 1494044 - DNA, 15 bp, Homo sapiens
tgggcctccatgccc

SEQ ID NO: 1494045 - DNA, 18 bp, Homo sapiens
tgggcctccatgccccag

SEQ ID NO: 1494046 - DNA, 22 bp, Homo sapiens
tgggcctccatgccccagctct

SEQ ID NO: 1494047 - DNA, 16 bp, Homo sapiens
tgggcctcccctgggc

SEQ ID NO: 1494048 - DNA, 18 bp, Homo sapiens
tgggcctccctggcactg

SEQ ID NO: 1494049 - DNA, 20 bp, Homo sapiens
tgggcctcctctgtccaggg

SEQ ID NO: 1494050 - DNA, 14 bp, Homo sapiens
tgggcctcctgcct

SEQ ID NO: 1494051 - DNA, 17 bp, Homo sapiens
tgggcctctcctgccct

SEQ ID NO: 1494052 - DNA, 13 bp, Homo sapiens
tgggcctgcagaa

SEQ ID NO: 1494053 - DNA, 20 bp, Homo sapiens
tgggcctgctccagacctga

SEQ ID NO: 1494054 - DNA, 18 bp, Homo sapiens
tgggcctgcttttccagg

SEQ ID NO: 1494055 - DNA, 20 bp, Homo sapiens
tgggcctgcttttccaggat

SEQ ID NO: 1494056 - DNA, 21 bp, Homo sapiens
tgggcctgcttttccaggatc

SEQ ID NO: 1494057 - DNA, 12 bp, Homo sapiens
tgggcctggagc

SEQ ID NO: 1494058 - DNA, 17 bp, Homo sapiens
tgggcctggccagtctt

SEQ ID NO: 1494059 - DNA, 18 bp, Homo sapiens
tgggcctggccagtcttc

SEQ ID NO: 1494060 - DNA, 23 bp, Homo sapiens
tgggcctggccagtcttcctctt

SEQ ID NO: 1494061 - DNA, 17 bp, Homo sapiens
tgggcctggcctgagct

SEQ ID NO: 1494062 - DNA, 23 bp, Homo sapiens
tgggcctggcctgagctggggcc

SEQ ID NO: 1494063 - DNA, 12 bp, Homo sapiens
tgggcctgggcc

SEQ ID NO: 1494064 - DNA, 16 bp, Homo sapiens
tgggcctgggcctgct

SEQ ID NO: 1494065 - DNA, 17 bp, Homo sapiens
tgggcctgggcctgctt

SEQ ID NO: 1494066 - DNA, 14 bp, Homo sapiens
tgggcctgtccccc

SEQ ID NO: 1494067 - DNA, 22 bp, Homo sapiens
tgggcctgtcgtgccagtcctg

SEQ ID NO: 1494068 - DNA, 13 bp, Homo sapiens
tgggcctgtgcag

SEQ ID NO: 1494069 - DNA, 23 bp, Homo sapiens
tgggcctgtgcagcagcccagct

SEQ ID NO: 1494070 - DNA, 14 bp, Homo sapiens
tgggcctgttctct

SEQ ID NO: 1494071 - DNA, 15 bp, Homo sapiens
tgggccttcaccaag

SEQ ID NO: 1494072 - DNA, 14 bp, Homo sapiens
tgggccttgctttg

SEQ ID NO: 1494073 - DNA, 16 bp, Homo sapiens
tgggccttgctttggg

SEQ ID NO: 1494074 - DNA, 23 bp, Homo sapiens
tgggccttggggctcagccacag

SEQ ID NO: 1494075 - DNA, 20 bp, Homo sapiens
tgggcgagtcccggagcccc

SEQ ID NO: 1494076 - DNA, 20 bp, Homo sapiens
tgggcgcaaaggtgcctcat

SEQ ID NO: 1494077 - DNA, 17 bp, Homo sapiens
tgggcgccctggaagcc

SEQ ID NO: 1494078 - DNA, 20 bp, Homo sapiens
tgggcgccctggaagccggc

SEQ ID NO: 1494079 - DNA, 20 bp, Homo sapiens
tgggcggacggctgtggacc

SEQ ID NO: 1494080 - DNA, 20 bp, Homo sapiens
tgggcggcatccctgcagag

SEQ ID NO: 1494081 - DNA, 17 bp, Homo sapiens
tgggcggcggccacgca

SEQ ID NO: 1494082 - DNA, 18 bp, Homo sapiens
tgggcggctgagagcccc

SEQ ID NO: 1494083 - DNA, 23 bp, Homo sapiens
tgggcgtgctagaggttgcagca

SEQ ID NO: 1494084 - DNA, 20 bp, Homo sapiens
tgggcgtgtgtgacactgat

SEQ ID NO: 1494085 - DNA, 22 bp, Homo sapiens
tgggcgtgtgtgacactgatga

SEQ ID NO: 1494086 - DNA, 16 bp, Homo sapiens
tgggcgttgggagcct

SEQ ID NO: 1494087 - DNA, 23 bp, Homo sapiens
tgggctaaacccagatggtttcc

SEQ ID NO: 1494088 - DNA, 17 bp, Homo sapiens
tgggctaattaaataaa

SEQ ID NO: 1494089 - DNA, 16 bp, Homo sapiens
tgggctactggcagct

SEQ ID NO: 1494090 - DNA, 17 bp, Homo sapiens
tgggctactggcagctc

SEQ ID NO: 1494091 - DNA, 17 bp, Homo sapiens
tgggctattgctgctgc

SEQ ID NO: 1494092 - DNA, 18 bp, Homo sapiens
tgggctattgctgctgcc

SEQ ID NO: 1494093 - DNA, 14 bp, Homo sapiens
tgggctcaaagccc

SEQ ID NO: 1494094 - DNA, 14 bp, Homo sapiens
tgggctcaaatgat

SEQ ID NO: 1494095 - DNA, 22 bp, Homo sapiens
tgggctcaaatgatcctcccac

SEQ ID NO: 1494096 - DNA, 23 bp, Homo sapiens
tgggctcagcctgagcctctgct

SEQ ID NO: 1494097 - DNA, 15 bp, Homo sapiens
tgggctcctggctgc

SEQ ID NO: 1494098 - DNA, 17 bp, Homo sapiens
tgggctcctggctgcca

SEQ ID NO: 1494099 - DNA, 18 bp, Homo sapiens
tgggctcctggctgccag

SEQ ID NO: 1494100 - DNA, 18 bp, Homo sapiens
tgggtcacccctccagga

SEQ ID NO: 1494101 - DNA, 16 bp, Homo sapiens
tgggtcagaacatgtt

SEQ ID NO: 1494102 - DNA, 13 bp, Homo sapiens
tgggtcagcccag

SEQ ID NO: 1494103 - DNA, 14 bp, Homo sapiens
tgggtcagcccagc

SEQ ID NO: 1494104 - DNA, 21 bp, Homo sapiens
tgggtcagcccagcacctgct

SEQ ID NO: 1494105 - DNA, 15 bp, Homo sapiens
tgggtcagggccaga

SEQ ID NO: 1494106 - DNA, 23 bp, Homo sapiens
tgggtcagggccagactggaaga

SEQ ID NO: 1494107 - DNA, 15 bp, Homo sapiens
tgggtccaccatgca

SEQ ID NO: 1494108 - DNA, 18 bp, Homo sapiens
tgggtccaggaaggcagc

SEQ ID NO: 1494109 - DNA, 13 bp, Homo sapiens
tgggtccagggcc

SEQ ID NO: 1494110 - DNA, 18 bp, Homo sapiens
tgggtccccctcagcaag

SEQ ID NO: 1494111 - DNA, 15 bp, Homo sapiens
tgggtccgagaggga

SEQ ID NO: 1494112 - DNA, 23 bp, Homo sapiens
tgggtccgagagggaagctggct

SEQ ID NO: 1494113 - DNA, 17 bp, Homo sapiens
tgggtccgcatccctgc

SEQ ID NO: 1494114 - DNA, 18 bp, Homo sapiens
tgggtcctgggcaggtgg

SEQ ID NO: 1494115 - DNA, 18 bp, Homo sapiens
tgggtccttgatgccaga

SEQ ID NO: 1494116 - DNA, 21 bp, Homo sapiens
tgggtccttgatgccagaggg

SEQ ID NO: 1494117 - DNA, 15 bp, Homo sapiens
tgggtccttgggcct

SEQ ID NO: 1494118 - DNA, 21 bp, Homo sapiens
tgggtctaggacacagttcct

SEQ ID NO: 1494119 - DNA, 22 bp, Homo sapiens
tgggtctaggacacagttcctg

SEQ ID NO: 1494120 - DNA, 23 bp, Homo sapiens
tgggtctcaccggctctcacctg

SEQ ID NO: 1494121 - DNA, 13 bp, Homo sapiens
tgggtctcactcc

SEQ ID NO: 1494122 - DNA, 19 bp, Homo sapiens
tgggtctcagctgctgaca

SEQ ID NO: 1494123 - DNA, 14 bp, Homo sapiens
tgggtctctgaagg

SEQ ID NO: 1494124 - DNA, 12 bp, Homo sapiens
tgggtctctgga

SEQ ID NO: 1494125 - DNA, 16 bp, Homo sapiens
tgggtctctgggcaca

SEQ ID NO: 1494126 - DNA, 13 bp, Homo sapiens
tgggtctgacctg

SEQ ID NO: 1494127 - DNA, 21 bp, Homo sapiens
tgggtctgatattaatcaaaa

SEQ ID NO: 1494128 - DNA, 17 bp, Homo sapiens
tgggtctgattttctca

SEQ ID NO: 1494129 - DNA, 23 bp, Homo sapiens
tgggtctgggatatggctgccca

SEQ ID NO: 1494130 - DNA, 12 bp, Homo sapiens
tgggtctgtgtg

SEQ ID NO: 1494131 - DNA, 12 bp, Homo sapiens
tgggtgagagag

SEQ ID NO: 1494132 - DNA, 15 bp, Homo sapiens
tgggtgagagaggaa

SEQ ID NO: 1494133 - DNA, 12 bp, Homo sapiens
tgggtgagccag

SEQ ID NO: 1494134 - DNA, 17 bp, Homo sapiens
tgggtgattatttttta

SEQ ID NO: 1494135 - DNA, 17 bp, Homo sapiens
tgggtgccattcccagc

SEQ ID NO: 1494136 - DNA, 19 bp, Homo sapiens
tgggtgcgtctccagtcat

SEQ ID NO: 1494137 - DNA, 15 bp, Homo sapiens
tgggtgctggaggat

SEQ ID NO: 1494138 - DNA, 18 bp, Homo sapiens
tgggtggaaaacagggtg

SEQ ID NO: 1494139 - DNA, 19 bp, Homo sapiens
tgggtggaagtgcccagcc

SEQ ID NO: 1494140 - DNA, 20 bp, Homo sapiens
tgggtggaagtgcccagccc

SEQ ID NO: 1494141 - DNA, 12 bp, Homo sapiens
tgggtggagaag

SEQ ID NO: 1494142 - DNA, 22 bp, Homo sapiens
tgggtgggaggggcccacagga

SEQ ID NO: 1494143 - DNA, 15 bp, Homo sapiens
tgggtgggctctgtg

SEQ ID NO: 1494144 - DNA, 21 bp, Homo sapiens
tgggtggggctgctcctccag

SEQ ID NO: 1494145 - DNA, 15 bp, Homo sapiens
tgggtgggtggtggg

SEQ ID NO: 1494146 - DNA, 16 bp, Homo sapiens
tgggtgggtggtgggg

SEQ ID NO: 1494147 - DNA, 17 bp, Homo sapiens
tgggtggtaactgccag

SEQ ID NO: 1494148 - DNA, 22 bp, Homo sapiens
tgggtggtgtcctgaagctgct

SEQ ID NO: 1494149 - DNA, 17 bp, Homo sapiens
tgggtgtcctgcctgtc

SEQ ID NO: 1494150 - DNA, 17 bp, Homo sapiens
tgggtgtctccttaagc

SEQ ID NO: 1494151 - DNA, 20 bp, Homo sapiens
tgggtgtttttcatgtttta

SEQ ID NO: 1494152 - DNA, 14 bp, Homo sapiens
tgggttaacaaatg

SEQ ID NO: 1494153 - DNA, 16 bp, Homo sapiens
tgggttaacaaatgag

SEQ ID NO: 1494154 - DNA, 20 bp, Homo sapiens
tgggttatttttattaaatg

SEQ ID NO: 1494155 - DNA, 20 bp, Homo sapiens
tgggttcacttgccatgcag

SEQ ID NO: 1494156 - DNA, 24 bp, Homo sapiens
tgggttcaggggactcagccctga

SEQ ID NO: 1494157 - DNA, 21 bp, Homo sapiens
tgggttcctcttccccactcc

SEQ ID NO: 1494158 - DNA, 16 bp, Homo sapiens
tgggttctgcctgcca

SEQ ID NO: 1494159 - DNA, 18 bp, Homo sapiens
tgggttctttctgggggg

SEQ ID NO: 1494160 - DNA, 16 bp, Homo sapiens
tgggttctttggaagc

SEQ ID NO: 1494161 - DNA, 20 bp, Homo sapiens
tgggttggtgcacagtgatt

SEQ ID NO: 1494162 - DNA, 16 bp, Homo sapiens
tgggtttctagcccat

SEQ ID NO: 1494163 - DNA, 16 bp, Homo sapiens
tgggtttggttagagg

SEQ ID NO: 1494164 - DNA, 19 bp, Homo sapiens
tgggtttggttagaggaag

SEQ ID NO: 1494165 - DNA, 19 bp, Homo sapiens
tgggtttgtttttcaaagc

SEQ ID NO: 1494166 - DNA, 14 bp, Homo sapiens
tgggttttcttccc

SEQ ID NO: 1494167 - DNA, 15 bp, Homo sapiens
tgggtttttgttacc

SEQ ID NO: 1494168 - DNA, 17 bp, Homo sapiens
tgggtttttttccttta

SEQ ID NO: 1494169 - DNA, 21 bp, Homo sapiens
tggtaaaaacagcagctcata

SEQ ID NO: 1494170 - DNA, 22 bp, Homo sapiens
tggtaaaaagatccagggatgg

SEQ ID NO: 1494171 - DNA, 16 bp, Homo sapiens
tggtaaaaatgctgct

SEQ ID NO: 1494172 - DNA, 18 bp, Homo sapiens
tggtaaaaatgctgctct

SEQ ID NO: 1494173 - DNA, 15 bp, Homo sapiens
tggtaaatgtttctt

SEQ ID NO: 1494174 - DNA, 22 bp, Homo sapiens
tggtaaattcagacaacattat

SEQ ID NO: 1494175 - DNA, 17 bp, Homo sapiens
tggtaacagtaatacat

SEQ ID NO: 1494176 - DNA, 17 bp, Homo sapiens
tggtaacagttcatgtt

SEQ ID NO: 1494177 - DNA, 15 bp, Homo sapiens
tggtaaccaaatatt

SEQ ID NO: 1494178 - DNA, 20 bp, Homo sapiens
tggtaacgctctatctggtt

SEQ ID NO: 1494179 - DNA, 22 bp, Homo sapiens
tggtaagaagccgggaacagac

SEQ ID NO: 1494180 - DNA, 14 bp, Homo sapiens
tggtaagagaaaag

SEQ ID NO: 1494181 - DNA, 18 bp, Homo sapiens
tggtaagcgatttgaaac

SEQ ID NO: 1494182 - DNA, 17 bp, Homo sapiens
tggtaagggggtccctg

SEQ ID NO: 1494183 - DNA, 16 bp, Homo sapiens
tggtaataagggaaaa

SEQ ID NO: 1494184 - DNA, 22 bp, Homo sapiens
tggtaatcagaaataataacct

SEQ ID NO: 1494185 - DNA, 23 bp, Homo sapiens
tggtaatctacaccaatgaaaac

SEQ ID NO: 1494186 - DNA, 22 bp, Homo sapiens
tggtaattattttggtactttt

SEQ ID NO: 1494187 - DNA, 13 bp, Homo sapiens
tggtaattgttgc

SEQ ID NO: 1494188 - DNA, 13 bp, Homo sapiens
tggtaattttgat

SEQ ID NO: 1494189 - DNA, 16 bp, Homo sapiens
tggtaattttgatttc

SEQ ID NO: 1494190 - DNA, 15 bp, Homo sapiens
tggtaatttttgtac

SEQ ID NO: 1494191 - DNA, 17 bp, Homo sapiens
tggtaatttttgtacat

SEQ ID NO: 1494192 - DNA, 15 bp, Homo sapiens
tggtacaacggaggc

SEQ ID NO: 1494193 - DNA, 20 bp, Homo sapiens
tggtacaatctggctcactg

SEQ ID NO: 1494194 - DNA, 15 bp, Homo sapiens
tggtacaggtatatt

SEQ ID NO: 1494195 - DNA, 15 bp, Homo sapiens
tggtacatggccagt

SEQ ID NO: 1494196 - DNA, 15 bp, Homo sapiens
tggtacatggtgttt

SEQ ID NO: 1494197 - DNA, 21 bp, Homo sapiens
tggtaccctcctggctcttga

SEQ ID NO: 1494198 - DNA, 15 bp, Homo sapiens
tggtacctgccctct

SEQ ID NO: 1494199 - DNA, 19 bp, Homo sapiens
tggtacgaatctcatccct

SEQ ID NO: 1494200 - DNA, 22 bp, Homo sapiens
tggtactggcaataagatacac

SEQ ID NO: 1494201 - DNA, 18 bp, Homo sapiens
tggtactgtagcagggga

SEQ ID NO: 1494202 - DNA, 22 bp, Homo sapiens
tggtacttttatgatgtatatt

SEQ ID NO: 1494203 - DNA, 17 bp, Homo sapiens
tggtacttttgagtgtg

SEQ ID NO: 1494204 - DNA, 20 bp, Homo sapiens
tggtagaaaaaggggcctga

SEQ ID NO: 1494205 - DNA, 19 bp, Homo sapiens
tggtagaagtttggctgct

SEQ ID NO: 1494206 - DNA, 14 bp, Homo sapiens
tggtagagaaggag

SEQ ID NO: 1494207 - DNA, 16 bp, Homo sapiens
tggtagagacccccag

SEQ ID NO: 1494208 - DNA, 19 bp, Homo sapiens
tggtagagacccccaggcc

SEQ ID NO: 1494209 - DNA, 20 bp, Homo sapiens
tggtagattcgctgtcccct

SEQ ID NO: 1494210 - DNA, 17 bp, Homo sapiens
tggtagatttcctcctc

SEQ ID NO: 1494211 - DNA, 14 bp, Homo sapiens
tggtagcagcaggc

SEQ ID NO: 1494212 - DNA, 15 bp, Homo sapiens
tggtagcagcctggg

SEQ ID NO: 1494213 - DNA, 20 bp, Homo sapiens
tggtagctgggaaagcataa

SEQ ID NO: 1494214 - DNA, 15 bp, Homo sapiens
tggttctctccagga

SEQ ID NO: 1494215 - DNA, 12 bp, Homo sapiens
tggttctggcca

SEQ ID NO: 1494216 - DNA, 21 bp, Homo sapiens
tggttctgtctagactggcct

SEQ ID NO: 1494217 - DNA, 13 bp, Homo sapiens
tggttctgtgacc

SEQ ID NO: 1494218 - DNA, 16 bp, Homo sapiens
tggttgaaaataaaaa

SEQ ID NO: 1494219 - DNA, 21 bp, Homo sapiens
tggttgaatgaataaaacaat

SEQ ID NO: 1494220 - DNA, 22 bp, Homo sapiens
tggttgagtgtgtggtctctgc

SEQ ID NO: 1494221 - DNA, 12 bp, Homo sapiens
tggttgatggaa

SEQ ID NO: 1494222 - DNA, 16 bp, Homo sapiens
tggttgatggaaaata

SEQ ID NO: 1494223 - DNA, 17 bp, Homo sapiens
tggttgatggaaaataa

SEQ ID NO: 1494224 - DNA, 15 bp, Homo sapiens
tggttgctgtagaaa

SEQ ID NO: 1494225 - DNA, 19 bp, Homo sapiens
tggttggggccctgccctg

SEQ ID NO: 1494226 - DNA, 17 bp, Homo sapiens
tggttgtaaatgctcgt

SEQ ID NO: 1494227 - DNA, 12 bp, Homo sapiens
tggttgtatttc

SEQ ID NO: 1494228 - DNA, 15 bp, Homo sapiens
tggttgtatttctat

SEQ ID NO: 1494229 - DNA, 17 bp, Homo sapiens
tggttgtgccttccctt

SEQ ID NO: 1494230 - DNA, 15 bp, Homo sapiens
tggttgtgttgaggt

SEQ ID NO: 1494231 - DNA, 21 bp, Homo sapiens
tggttgttagttatagatgtc

SEQ ID NO: 1494232 - DNA, 20 bp, Homo sapiens
tggttgtttttgttctttgt

SEQ ID NO: 1494233 - DNA, 15 bp, Homo sapiens
tggtttaaagaaagt

SEQ ID NO: 1494234 - DNA, 17 bp, Homo sapiens
tggtttaaagaaagtgt

SEQ ID NO: 1494235 - DNA, 19 bp, Homo sapiens
tggtttaaagaaagtgtat

SEQ ID NO: 1494236 - DNA, 18 bp, Homo sapiens
tggtttatgcggtgctgt

SEQ ID NO: 1494237 - DNA, 20 bp, Homo sapiens
tggtttcagatgtgcaataa

SEQ ID NO: 1494238 - DNA, 18 bp, Homo sapiens
tggtttccagtcatgagc

SEQ ID NO: 1494239 - DNA, 14 bp, Homo sapiens
tggtttcctctgga

SEQ ID NO: 1494240 - DNA, 16 bp, Homo sapiens
tggtttctagacttgt

SEQ ID NO: 1494241 - DNA, 19 bp, Homo sapiens
tggtttctgcgtgtgtata

SEQ ID NO: 1494242 - DNA, 14 bp, Homo sapiens
tggtttgacaattt

SEQ ID NO: 1494243 - DNA, 20 bp, Homo sapiens
tggtttgacaattttgtctt

SEQ ID NO: 1494244 - DNA, 13 bp, Homo sapiens
tggtttgactcag

SEQ ID NO: 1494245 - DNA, 13 bp, Homo sapiens
tggtttgccatgt

SEQ ID NO: 1494246 - DNA, 17 bp, Homo sapiens
tggtttgccatgtcgct

SEQ ID NO: 1494247 - DNA, 22 bp, Homo sapiens
tggtttggattactattgcaaa

SEQ ID NO: 1494248 - DNA, 14 bp, Homo sapiens
tggtttggggagaa

SEQ ID NO: 1494249 - DNA, 22 bp, Homo sapiens
tggtttgtgtcaaaactggttt

SEQ ID NO: 1494250 - DNA, 15 bp, Homo sapiens
tggttttacacagga

SEQ ID NO: 1494251 - DNA, 13 bp, Homo sapiens
tggttttagattt

SEQ ID NO: 1494252 - DNA, 16 bp, Homo sapiens
tggttttatactgaag

SEQ ID NO: 1494253 - DNA, 13 bp, Homo sapiens
tggttttatttgt

SEQ ID NO: 1494254 - DNA, 21 bp, Homo sapiens
tggttttcaacctctagaatt

SEQ ID NO: 1494255 - DNA, 21 bp, Homo sapiens
tggttttcccctccctgggtt

SEQ ID NO: 1494256 - DNA, 19 bp, Homo sapiens
tggttttgatggctgggtc

SEQ ID NO: 1494257 - DNA, 18 bp, Homo sapiens
tggttttgtgccatctgt

SEQ ID NO: 1494258 - DNA, 22 bp, Homo sapiens
tggttttgtgccatctgtagct

SEQ ID NO: 1494259 - DNA, 18 bp, Homo sapiens
tggtttttactgctctga

SEQ ID NO: 1494260 - DNA, 12 bp, Homo sapiens
tgtaaaaaaagc

SEQ ID NO: 1494261 - DNA, 23 bp, Homo sapiens
tgtaaaaaaagcaaaaatgacaa

SEQ ID NO: 1494262 - DNA, 12 bp, Homo sapiens
tgtaaaaaatgg

SEQ ID NO: 1494263 - DNA, 16 bp, Homo sapiens
tgtaaaaaatggaaaa

SEQ ID NO: 1494264 - DNA, 22 bp, Homo sapiens
tgtaaaaaatgtctcatgtcaa

SEQ ID NO: 1494265 - DNA, 19 bp, Homo sapiens
tgtaaaaacagcattgctt

SEQ ID NO: 1494266 - DNA, 23 bp, Homo sapiens
tgtaaaacaaaaatgtaatgatc

SEQ ID NO: 1494267 - DNA, 22 bp, Homo sapiens
tgtaaaacaggtagaattatct

SEQ ID NO: 1494268 - DNA, 19 bp, Homo sapiens
tgtaaaaccctttaaatgt

SEQ ID NO: 1494269 - DNA, 20 bp, Homo sapiens
tgtaaaaccctttaaatgta

SEQ ID NO: 1494270 - DNA, 17 bp, Homo sapiens
tgtaaaactttggtgca

SEQ ID NO: 1494271 - DNA, 16 bp, Homo sapiens
tgtaaaatagaaaaag

SEQ ID NO: 1494272 - DNA, 18 bp, Homo sapiens
tgtaaaatatacttaaat

SEQ ID NO: 1494273 - DNA, 13 bp, Homo sapiens
tgtaaaatatgta

SEQ ID NO: 1494274 - DNA, 16 bp, Homo sapiens
tgtaaaatcttgtcat

SEQ ID NO: 1494275 - DNA, 18 bp, Homo sapiens
tgtaaaatcttgtcatgt

SEQ ID NO: 1494276 - DNA, 19 bp, Homo sapiens
tgtaaaatcttgtcatgtg

SEQ ID NO: 1494277 - DNA, 13 bp, Homo sapiens
tgtaaaatgcaaa

SEQ ID NO: 1494278 - DNA, 21 bp, Homo sapiens
tgtaaaatgcaaaaaatctta

SEQ ID NO: 1494279 - DNA, 22 bp, Homo sapiens
tgtaaaattgttaaccttgtaa

SEQ ID NO: 1494280 - DNA, 17 bp, Homo sapiens
tgtaaaattgttcctga

SEQ ID NO: 1494281 - DNA, 18 bp, Homo sapiens
tgtaaaatttatttatat

SEQ ID NO: 1494282 - DNA, 19 bp, Homo sapiens
tgtaaaatttatttatatt

SEQ ID NO: 1494283 - DNA, 19 bp, Homo sapiens
tgtaaacagtgcctgctga

SEQ ID NO: 1494284 - DNA, 19 bp, Homo sapiens
tgtaaactgtgtattccaa

SEQ ID NO: 1494285 - DNA, 18 bp, Homo sapiens
tgtaaagatatttttatc

SEQ ID NO: 1494286 - DNA, 22 bp, Homo sapiens
tgtaaagatttgttgacagcaa

SEQ ID NO: 1494287 - DNA, 14 bp, Homo sapiens
tgtaaaggagggag

SEQ ID NO: 1494288 - DNA, 22 bp, Homo sapiens
tgtaaaggagggagatctttcc

SEQ ID NO: 1494289 - DNA, 19 bp, Homo sapiens
tgtaaagtatgtattattt

SEQ ID NO: 1494290 - DNA, 20 bp, Homo sapiens
tgtaaagtcggtgattatat

SEQ ID NO: 1494291 - DNA, 21 bp, Homo sapiens
tgtaaagttatgtatttaaag

SEQ ID NO: 1494292 - DNA, 15 bp, Homo sapiens
tgtaaataaaatgtg

SEQ ID NO: 1494293 - DNA, 17 bp, Homo sapiens
tgtaaataaaatgtgta

SEQ ID NO: 1494294 - DNA, 19 bp, Homo sapiens
tgtaaataaaatgtgtaca

SEQ ID NO: 1494295 - DNA, 21 bp, Homo sapiens
tgtaaataaaatgtgtacagt

SEQ ID NO: 1494296 - DNA, 12 bp, Homo sapiens
tgtaaataaact

SEQ ID NO: 1494297 - DNA, 15 bp, Homo sapiens
tgtaaataaactatt

SEQ ID NO: 1494298 - DNA, 18 bp, Homo sapiens
tgtaaataaactatttat

SEQ ID NO: 1494299 - DNA, 16 bp, Homo sapiens
tgtaaataagagttgc

SEQ ID NO: 1494300 - DNA, 12 bp, Homo sapiens
tgtaaatacata

SEQ ID NO: 1494301 - DNA, 15 bp, Homo sapiens
tgtaaatacccatat

SEQ ID NO: 1494302 - DNA, 19 bp, Homo sapiens
tgtaaatactggactcagg

SEQ ID NO: 1494303 - DNA, 20 bp, Homo sapiens
tgtaaatactggactcagga

SEQ ID NO: 1494304 - DNA, 18 bp, Homo sapiens
tgtaaataggatttttag

SEQ ID NO: 1494305 - DNA, 21 bp, Homo sapiens
tgtaaataggttcagatttta

SEQ ID NO: 1494306 - DNA, 23 bp, Homo sapiens
tgtaaatattctacacatgtaaa

SEQ ID NO: 1494307 - DNA, 19 bp, Homo sapiens
tgtaaatcacttgttttat

SEQ ID NO: 1494308 - DNA, 16 bp, Homo sapiens
tgtaaatcctgccatt

SEQ ID NO: 1494309 - DNA, 12 bp, Homo sapiens
tgtaaatccttt

SEQ ID NO: 1494310 - DNA, 22 bp, Homo sapiens
tgtaaatcctttttctttataa

SEQ ID NO: 1494311 - DNA, 18 bp, Homo sapiens
tgtaaatgagtaaaacat

SEQ ID NO: 1494312 - DNA, 23 bp, Homo sapiens
tgtaaatgcatattaaataataa

SEQ ID NO: 1494313 - DNA, 16 bp, Homo sapiens
tgtaaatgccttgctt

SEQ ID NO: 1494314 - DNA, 14 bp, Homo sapiens
tgtaaatgtttctt

SEQ ID NO: 1494315 - DNA, 16 bp, Homo sapiens
tgtaaattatgtaatg

SEQ ID NO: 1494316 - DNA, 16 bp, Homo sapiens
tgtaaattatttatgt

SEQ ID NO: 1494317 - DNA, 18 bp, Homo sapiens
tgtaaattgcagaattca

SEQ ID NO: 1494318 - DNA, 18 bp, Homo sapiens
tgtaaatttaactgcata

SEQ ID NO: 1494319 - DNA, 20 bp, Homo sapiens
tgtaaatttaactgcatata

SEQ ID NO: 1494320 - DNA, 15 bp, Homo sapiens
tgtaaatttatgtga

SEQ ID NO: 1494321 - DNA, 16 bp, Homo sapiens
tgtaaatttatgtgat

SEQ ID NO: 1494322 - DNA, 18 bp, Homo sapiens
tgtaaatttgtactattt

SEQ ID NO: 1494323 - DNA, 15 bp, Homo sapiens
tgtaacaagaaaaca

SEQ ID NO: 1494324 - DNA, 20 bp, Homo sapiens
tgtaacacagtcattctagg

SEQ ID NO: 1494325 - DNA, 15 bp, Homo sapiens
tgtaacagctgaggt

SEQ ID NO: 1494326 - DNA, 16 bp, Homo sapiens
tgtaacagtcaaatat

SEQ ID NO: 1494327 - DNA, 19 bp, Homo sapiens
tgtaacagttggtgatttt

SEQ ID NO: 1494328 - DNA, 20 bp, Homo sapiens
tgtatattgtggatgtgttc

SEQ ID NO: 1494329 - DNA, 18 bp, Homo sapiens
tgtatatttgtaaagcta

SEQ ID NO: 1494330 - DNA, 18 bp, Homo sapiens
tgtatcacaaatcttaac

SEQ ID NO: 1494331 - DNA, 14 bp, Homo sapiens
tgtatcagtgtcct

SEQ ID NO: 1494332 - DNA, 15 bp, Homo sapiens
tgtatcatagaaatg

SEQ ID NO: 1494333 - DNA, 16 bp, Homo sapiens
tgtatcatagaaatgt

SEQ ID NO: 1494334 - DNA, 18 bp, Homo sapiens
tgtatccaaggaaacatt

SEQ ID NO: 1494335 - DNA, 22 bp, Homo sapiens
tgtatccatccatggggctgat

SEQ ID NO: 1494336 - DNA, 17 bp, Homo sapiens
tgtatccgtgaattgct

SEQ ID NO: 1494337 - DNA, 13 bp, Homo sapiens
tgtatctaaaaaa

SEQ ID NO: 1494338 - DNA, 15 bp, Homo sapiens
tgtatctaaaaaata

SEQ ID NO: 1494339 - DNA, 16 bp, Homo sapiens
tgtatctaaaaaataa

SEQ ID NO: 1494340 - DNA, 23 bp, Homo sapiens
tgtatctaaaaaataactgtgca

SEQ ID NO: 1494341 - DNA, 20 bp, Homo sapiens
tgtatctacatcttttttca

SEQ ID NO: 1494342 - DNA, 17 bp, Homo sapiens
tgtatctatttgtacaa

SEQ ID NO: 1494343 - DNA, 18 bp, Homo sapiens
tgtatctatttgtacaat

SEQ ID NO: 1494344 - DNA, 18 bp, Homo sapiens
tgtatctcatactgtctg

SEQ ID NO: 1494345 - DNA, 21 bp, Homo sapiens
tgtatctgacccactttgtaa

SEQ ID NO: 1494346 - DNA, 14 bp, Homo sapiens
tgtatctgctggat

SEQ ID NO: 1494347 - DNA, 12 bp, Homo sapiens
tgtatctgtgta

SEQ ID NO: 1494348 - DNA, 21 bp, Homo sapiens
tgtatctttatgctgtatttt

SEQ ID NO: 1494349 - DNA, 16 bp, Homo sapiens
tgtatctttattaaaa

SEQ ID NO: 1494350 - DNA, 19 bp, Homo sapiens
tgtatctttattaaaacaa

SEQ ID NO: 1494351 - DNA, 19 bp, Homo sapiens
tgtatctttgtaagagcaa

SEQ ID NO: 1494352 - DNA, 11 bp, Homo sapiens
tgtatgaaaat

SEQ ID NO: 1494353 - DNA, 15 bp, Homo sapiens
tgtatgaaattggtt

SEQ ID NO: 1494354 - DNA, 14 bp, Homo sapiens
tgtatgaaggcttt

SEQ ID NO: 1494355 - DNA, 18 bp, Homo sapiens
tgtatgaataatgaaaat

SEQ ID NO: 1494356 - DNA, 13 bp, Homo sapiens
tgtatgacagtga

SEQ ID NO: 1494357 - DNA, 22 bp, Homo sapiens
tgtatgacagtgaagcagcact

SEQ ID NO: 1494358 - DNA, 14 bp, Homo sapiens
tgtatgactaaaga

SEQ ID NO: 1494359 - DNA, 16 bp, Homo sapiens
tgtatgactgcacatg

SEQ ID NO: 1494360 - DNA, 19 bp, Homo sapiens
tgtatgagatggttaaaaa

SEQ ID NO: 1494361 - DNA, 16 bp, Homo sapiens
tgtatgagtagccagg

SEQ ID NO: 1494362 - DNA, 14 bp, Homo sapiens
tgtatgatactaaa

SEQ ID NO: 1494363 - DNA, 15 bp, Homo sapiens
tgtatgatttataaa

SEQ ID NO: 1494364 - DNA, 21 bp, Homo sapiens
tgtatgcagtactaaaattaa

SEQ ID NO: 1494365 - DNA, 19 bp, Homo sapiens
tgtatgcatggaaacatgg

SEQ ID NO: 1494366 - DNA, 18 bp, Homo sapiens
tgtatggaaataaatgta

SEQ ID NO: 1494367 - DNA, 18 bp, Homo sapiens
tgtatggagttaaataaa

SEQ ID NO: 1494368 - DNA, 21 bp, Homo sapiens
tgtatggtatctttagatatt

SEQ ID NO: 1494369 - DNA, 23 bp, Homo sapiens
tgtatgtaaagttcctgctgtaa

SEQ ID NO: 1494370 - DNA, 19 bp, Homo sapiens
tgtatgtaagtaattgcat

SEQ ID NO: 1494371 - DNA, 13 bp, Homo sapiens
tgtatgtacaata

SEQ ID NO: 1494372 - DNA, 21 bp, Homo sapiens
tgtatgtacaatacaatgtac

SEQ ID NO: 1494373 - DNA, 13 bp, Homo sapiens
tgtatgtacatat

SEQ ID NO: 1494374 - DNA, 17 bp, Homo sapiens
tgtatgtacttagctgt

SEQ ID NO: 1494375 - DNA, 21 bp, Homo sapiens
tgtatgtacttagctgtacta

SEQ ID NO: 1494376 - DNA, 22 bp, Homo sapiens
tgtatgtgggggtctgtgtgtt

SEQ ID NO: 1494377 - DNA, 19 bp, Homo sapiens
tgtatgtgtcactgcatgg

SEQ ID NO: 1494378 - DNA, 17 bp, Homo sapiens
tgtatgtgtggctgtgg

SEQ ID NO: 1494379 - DNA, 15 bp, Homo sapiens
tgtatgttaaagaga

SEQ ID NO: 1494380 - DNA, 14 bp, Homo sapiens
tgtatgttaaagca

SEQ ID NO: 1494381 - DNA, 21 bp, Homo sapiens
tgtatgttattatattccgta

SEQ ID NO: 1494382 - DNA, 16 bp, Homo sapiens
tgtatgtttgcacact

SEQ ID NO: 1494383 - DNA, 19 bp, Homo sapiens
tgtatgtttgctgattatt

SEQ ID NO: 1494384 - DNA, 22 bp, Homo sapiens
tgtattaacactactcaaagca

SEQ ID NO: 1494385 - DNA, 20 bp, Homo sapiens
tgtattaagaaaggaagcat

SEQ ID NO: 1494386 - DNA, 15 bp, Homo sapiens
tgtattaataaagca

SEQ ID NO: 1494387 - DNA, 16 bp, Homo sapiens
tgtattaataaagcat

SEQ ID NO: 1494388 - DNA, 16 bp, Homo sapiens
tgtattaatttctgat

SEQ ID NO: 1494389 - DNA, 18 bp, Homo sapiens
tgtattactgaataatat

SEQ ID NO: 1494390 - DNA, 20 bp, Homo sapiens
tgtattagagcgccagctcc

SEQ ID NO: 1494391 - DNA, 19 bp, Homo sapiens
tgtattatgtgcctaattt

SEQ ID NO: 1494392 - DNA, 16 bp, Homo sapiens
tgtattatttaaatgt

SEQ ID NO: 1494393 - DNA, 14 bp, Homo sapiens
tgtattatttataa

SEQ ID NO: 1494394 - DNA, 21 bp, Homo sapiens
tgtattatttcaccagcagca

SEQ ID NO: 1494395 - DNA, 13 bp, Homo sapiens
tgtattatttcat

SEQ ID NO: 1494396 - DNA, 21 bp, Homo sapiens
tgtattatttcattatgtaaa

SEQ ID NO: 1494397 - DNA, 22 bp, Homo sapiens
tgtattcacgccattggttgga

SEQ ID NO: 1494398 - DNA, 17 bp, Homo sapiens
tgtattcagtgagggtc

SEQ ID NO: 1494399 - DNA, 18 bp, Homo sapiens
tgtattcataagattttt

SEQ ID NO: 1494400 - DNA, 21 bp, Homo sapiens
tgtattccaagacatgtctgt

SEQ ID NO: 1494401 - DNA, 18 bp, Homo sapiens
tgtattcccacccctgga

SEQ ID NO: 1494402 - DNA, 20 bp, Homo sapiens
tgtattcccttgtattttgt

SEQ ID NO: 1494403 - DNA, 19 bp, Homo sapiens
tgtattccttttagcagta

SEQ ID NO: 1494404 - DNA, 20 bp, Homo sapiens
tgtattctagctaatgtaat

SEQ ID NO: 1494405 - DNA, 12 bp, Homo sapiens
tgtattctctgt

SEQ ID NO: 1494406 - DNA, 13 bp, Homo sapiens
tgtattctctgta

SEQ ID NO: 1494407 - DNA, 23 bp, Homo sapiens
tgtattctctttaccttctaaaa

SEQ ID NO: 1494408 - DNA, 18 bp, Homo sapiens
tgtattctgtggattcta

SEQ ID NO: 1494409 - DNA, 19 bp, Homo sapiens
tgtattctgtggattctat

SEQ ID NO: 1494410 - DNA, 18 bp, Homo sapiens
tgtattcttttctcagtg

SEQ ID NO: 1494411 - DNA, 15 bp, Homo sapiens
tgtattgaaaacact

SEQ ID NO: 1494412 - DNA, 16 bp, Homo sapiens
tgtattgaaaacactt

SEQ ID NO: 1494413 - DNA, 22 bp, Homo sapiens
tgtattgactttatgttgtatg

SEQ ID NO: 1494414 - DNA, 20 bp, Homo sapiens
tgtattgagatttcttaaat

SEQ ID NO: 1494415 - DNA, 15 bp, Homo sapiens
tgtattgatgcaata

SEQ ID NO: 1494416 - DNA, 23 bp, Homo sapiens
tgtattgatgcaatataagcata

SEQ ID NO: 1494417 - DNA, 15 bp, Homo sapiens
tgtattgcttatttt

SEQ ID NO: 1494418 - DNA, 14 bp, Homo sapiens
tgtattggcctgga

SEQ ID NO: 1494419 - DNA, 22 bp, Homo sapiens
tgtattgttgaaaaagtttgtt

SEQ ID NO: 1494420 - DNA, 23 bp, Homo sapiens
tgtattgttgaaaaagtttgttt

SEQ ID NO: 1494421 - DNA, 20 bp, Homo sapiens
tgtattgttttcccaagtgt

SEQ ID NO: 1494422 - DNA, 21 bp, Homo sapiens
tgtatttaacagaaattgtat

SEQ ID NO: 1494423 - DNA, 18 bp, Homo sapiens
tgtatttagctacagctt

SEQ ID NO: 1494424 - DNA, 22 bp, Homo sapiens
tgtatttatacccccaggaaac

SEQ ID NO: 1494425 - DNA, 14 bp, Homo sapiens
tgtatttattcttt

SEQ ID NO: 1494426 - DNA, 22 bp, Homo sapiens
tgtatttattggttttgcagaa

SEQ ID NO: 1494427 - DNA, 16 bp, Homo sapiens
tgtatttatttaaaag

SEQ ID NO: 1494428 - DNA, 15 bp, Homo sapiens
tgtatttccagtgca

SEQ ID NO: 1494429 - DNA, 11 bp, Homo sapiens
tgtatttcctt

SEQ ID NO: 1494430 - DNA, 22 bp, Homo sapiens
tgtatttctctattttcataat

SEQ ID NO: 1494431 - DNA, 13 bp, Homo sapiens
tgtatttcttata

SEQ ID NO: 1494432 - DNA, 18 bp, Homo sapiens
tgtatttcttatacgctt

SEQ ID NO: 1494433 - DNA, 15 bp, Homo sapiens
tgtatttgagcatat

SEQ ID NO: 1494434 - DNA, 16 bp, Homo sapiens
tgtatttgagttggct

SEQ ID NO: 1494435 - DNA, 13 bp, Homo sapiens
tgtatttgctaat

SEQ ID NO: 1494436 - DNA, 15 bp, Homo sapiens
tgtatttgtattaat

SEQ ID NO: 1494437 - DNA, 16 bp, Homo sapiens
tgtatttgtattaata

SEQ ID NO: 1494438 - DNA, 17 bp, Homo sapiens
tgtatttgtattaataa

SEQ ID NO: 1494439 - DNA, 19 bp, Homo sapiens
tgtatttgttatatataat

SEQ ID NO: 1494440 - DNA, 21 bp, Homo sapiens
tgtatttgttatatataataa

SEQ ID NO: 1494441 - DNA, 19 bp, Homo sapiens
tgtattttaacactttgta

SEQ ID NO: 1494442 - DNA, 21 bp, Homo sapiens
tgtccctgtcaccaagctcac

SEQ ID NO: 1494443 - DNA, 22 bp, Homo sapiens
tgtcccttgcctcaatgccagt

SEQ ID NO: 1494444 - DNA, 14 bp, Homo sapiens
tgtcccttgcctct

SEQ ID NO: 1494445 - DNA, 14 bp, Homo sapiens
tgtcccttgctgta

SEQ ID NO: 1494446 - DNA, 14 bp, Homo sapiens
tgtccctttcccta

SEQ ID NO: 1494447 - DNA, 17 bp, Homo sapiens
tgtccctttccctacct

SEQ ID NO: 1494448 - DNA, 18 bp, Homo sapiens
tgtccctttcttggccag

SEQ ID NO: 1494449 - DNA, 13 bp, Homo sapiens
tgtcccttttctt

SEQ ID NO: 1494450 - DNA, 21 bp, Homo sapiens
tgtcccttttgcataagatta

SEQ ID NO: 1494451 - DNA, 22 bp, Homo sapiens
tgtccgagaactaaagccaagg

SEQ ID NO: 1494452 - DNA, 19 bp, Homo sapiens
tgtccgatggtatctgggt

SEQ ID NO: 1494453 - DNA, 19 bp, Homo sapiens
tgtccgtccacccttccat

SEQ ID NO: 1494454 - DNA, 13 bp, Homo sapiens
tgtccgtccatgc

SEQ ID NO: 1494455 - DNA, 22 bp, Homo sapiens
tgtccgtctctcttgcttgagg

SEQ ID NO: 1494456 - DNA, 16 bp, Homo sapiens
tgtcctaaggacacac

SEQ ID NO: 1494457 - DNA, 17 bp, Homo sapiens
tgtcctaatatatacat

SEQ ID NO: 1494458 - DNA, 14 bp, Homo sapiens
tgtcctaattcttc

SEQ ID NO: 1494459 - DNA, 23 bp, Homo sapiens
tgtcctacttctgactttacttg

SEQ ID NO: 1494460 - DNA, 21 bp, Homo sapiens
tgtcctatgtcaatttgtata

SEQ ID NO: 1494461 - DNA, 16 bp, Homo sapiens
tgtcctcagaggcgtg

SEQ ID NO: 1494462 - DNA, 21 bp, Homo sapiens
tgtcctcagaggcgtgctggt

SEQ ID NO: 1494463 - DNA, 14 bp, Homo sapiens
tgtcctcagcagct

SEQ ID NO: 1494464 - DNA, 15 bp, Homo sapiens
tgtcctcagcatttc

SEQ ID NO: 1494465 - DNA, 21 bp, Homo sapiens
tgtcctcagccttgccagaga

SEQ ID NO: 1494466 - DNA, 12 bp, Homo sapiens
tgtcctcaggga

SEQ ID NO: 1494467 - DNA, 14 bp, Homo sapiens
tgtcctcagggagc

SEQ ID NO: 1494468 - DNA, 19 bp, Homo sapiens
tgtcctcagggagcaggga

SEQ ID NO: 1494469 - DNA, 15 bp, Homo sapiens
tgtcctccaccatgc

SEQ ID NO: 1494470 - DNA, 20 bp, Homo sapiens
tgtcctccagaagcctctgg

SEQ ID NO: 1494471 - DNA, 21 bp, Homo sapiens
tgtcctccaggagcttcttgt

SEQ ID NO: 1494472 - DNA, 21 bp, Homo sapiens
tgtcctcctcggatcaccgag

SEQ ID NO: 1494473 - DNA, 14 bp, Homo sapiens
tgtcctctccctgc

SEQ ID NO: 1494474 - DNA, 17 bp, Homo sapiens
tgtcctctccctgccaa

SEQ ID NO: 1494475 - DNA, 13 bp, Homo sapiens
tgtcctctgtagt

SEQ ID NO: 1494476 - DNA, 16 bp, Homo sapiens
tgtcctcttccctctc

SEQ ID NO: 1494477 - DNA, 20 bp, Homo sapiens
tgtcctcttctgctcttttc

SEQ ID NO: 1494478 - DNA, 23 bp, Homo sapiens
tgtcctcttgctcaaaaatctgt

SEQ ID NO: 1494479 - DNA, 14 bp, Homo sapiens
tgtcctcttggcca

SEQ ID NO: 1494480 - DNA, 18 bp, Homo sapiens
tgtcctcttggccatcct

SEQ ID NO: 1494481 - DNA, 17 bp, Homo sapiens
tgtcctctttactccct

SEQ ID NO: 1494482 - DNA, 22 bp, Homo sapiens
tgtcctctttactcccttcctg

SEQ ID NO: 1494483 - DNA, 18 bp, Homo sapiens
tgtcctgaagctgctgga

SEQ ID NO: 1494484 - DNA, 20 bp, Homo sapiens
tgtcctgaagctgctggagc

SEQ ID NO: 1494485 - DNA, 19 bp, Homo sapiens
tgtcctgaccaccctcccc

SEQ ID NO: 1494486 - DNA, 21 bp, Homo sapiens
tgtcctgaccaccctcccctc

SEQ ID NO: 1494487 - DNA, 22 bp, Homo sapiens
tgtcctgaccaccctcccctct

SEQ ID NO: 1494488 - DNA, 17 bp, Homo sapiens
tgtcctgacctgtctca

SEQ ID NO: 1494489 - DNA, 22 bp, Homo sapiens
tgtcctgagccccctgcaccca

SEQ ID NO: 1494490 - DNA, 15 bp, Homo sapiens
tgtcctgatttctac

SEQ ID NO: 1494491 - DNA, 18 bp, Homo sapiens
tgtcctgcagcaaacact

SEQ ID NO: 1494492 - DNA, 13 bp, Homo sapiens
tgtcctgccagct

SEQ ID NO: 1494493 - DNA, 17 bp, Homo sapiens
tgtcctgccagctgcct

SEQ ID NO: 1494494 - DNA, 22 bp, Homo sapiens
tgtcctgccagctgccttcctc

SEQ ID NO: 1494495 - DNA, 15 bp, Homo sapiens
tgtcctgcctgtctg

SEQ ID NO: 1494496 - DNA, 21 bp, Homo sapiens
tgtcctgcctgtctgccccag

SEQ ID NO: 1494497 - DNA, 12 bp, Homo sapiens
tgtcctgctcac

SEQ ID NO: 1494498 - DNA, 15 bp, Homo sapiens
tgtcctgctcacctg

SEQ ID NO: 1494499 - DNA, 17 bp, Homo sapiens
tgtcctgctctcttcag

SEQ ID NO: 1494500 - DNA, 19 bp, Homo sapiens
tgtcctgctgccctcccac

SEQ ID NO: 1494501 - DNA, 20 bp, Homo sapiens
tgtcctggcccttcagtctg

SEQ ID NO: 1494502 - DNA, 10 bp, Homo sapiens
tgtcctgggc

SEQ ID NO: 1494503 - DNA, 17 bp, Homo sapiens
tgtcctgggcctgcaga

SEQ ID NO: 1494504 - DNA, 11 bp, Homo sapiens
tgtcctgggcg

SEQ ID NO: 1494505 - DNA, 18 bp, Homo sapiens
tgtcctggtaattcctct

SEQ ID NO: 1494506 - DNA, 20 bp, Homo sapiens
tgtcctggtaattcctctcc

SEQ ID NO: 1494507 - DNA, 23 bp, Homo sapiens
tgtcctggtaattcctctccagg

SEQ ID NO: 1494508 - DNA, 13 bp, Homo sapiens
tgtcctggtgctc

SEQ ID NO: 1494509 - DNA, 22 bp, Homo sapiens
tgtcctggtggctgggcccagc

SEQ ID NO: 1494510 - DNA, 22 bp, Homo sapiens
tgtcctgtaaaggttacaagcc

SEQ ID NO: 1494511 - DNA, 13 bp, Homo sapiens
tgtcctgtagctt

SEQ ID NO: 1494512 - DNA, 13 bp, Homo sapiens
tgtcctgtcctgc

SEQ ID NO: 1494513 - DNA, 15 bp, Homo sapiens
tgtcctgtcctgctc

SEQ ID NO: 1494514 - DNA, 21 bp, Homo sapiens
tgtccttaacccacctctcct

SEQ ID NO: 1494515 - DNA, 15 bp, Homo sapiens
tgtccttcagagctc

SEQ ID NO: 1494516 - DNA, 18 bp, Homo sapiens
tgtccttcagagctcttc

SEQ ID NO: 1494517 - DNA, 22 bp, Homo sapiens
tgtccttcattccgttaggaat

SEQ ID NO: 1494518 - DNA, 16 bp, Homo sapiens
tgtcctttaaaaaaga

SEQ ID NO: 1494519 - DNA, 19 bp, Homo sapiens
tgtcctttaaaaaagaaaa

SEQ ID NO: 1494520 - DNA, 17 bp, Homo sapiens
tgtcctttcaaggggaa

SEQ ID NO: 1494521 - DNA, 15 bp, Homo sapiens
tgtcctttccatctg

SEQ ID NO: 1494522 - DNA, 23 bp, Homo sapiens
tgtcctttcccttcagtaccctc

SEQ ID NO: 1494523 - DNA, 22 bp, Homo sapiens
tgtcgaaaagagtcttccaatt

SEQ ID NO: 1494524 - DNA, 14 bp, Homo sapiens
tgtcgacatgtttt

SEQ ID NO: 1494525 - DNA, 15 bp, Homo sapiens
tgtcgacatgttttt

SEQ ID NO: 1494526 - DNA, 13 bp, Homo sapiens
tgtcgagacactt

SEQ ID NO: 1494527 - DNA, 22 bp, Homo sapiens
tgtcgctcatgtgtgcaacagg

SEQ ID NO: 1494528 - DNA, 16 bp, Homo sapiens
tgtcggatcctgtgag

SEQ ID NO: 1494529 - DNA, 17 bp, Homo sapiens
tgtcggatcctgtgagt

SEQ ID NO: 1494530 - DNA, 23 bp, Homo sapiens
tgtcgtagccaaggtgggctgag

SEQ ID NO: 1494531 - DNA, 16 bp, Homo sapiens
tgtcgtaggtaaacta

SEQ ID NO: 1494532 - DNA, 22 bp, Homo sapiens
tgtcgtatttggcacacagcag

SEQ ID NO: 1494533 - DNA, 22 bp, Homo sapiens
tgtcgtctctcccaccccctcc

SEQ ID NO: 1494534 - DNA, 21 bp, Homo sapiens
tgtcgtcttgaacgagcagcc

SEQ ID NO: 1494535 - DNA, 23 bp, Homo sapiens
tgtcgttaaaaagttgtttgttt

SEQ ID NO: 1494536 - DNA, 20 bp, Homo sapiens
tgtctaaacaatgctgattt

SEQ ID NO: 1494537 - DNA, 20 bp, Homo sapiens
tgtctaactcagaattattt

SEQ ID NO: 1494538 - DNA, 13 bp, Homo sapiens
tgtctaagattct

SEQ ID NO: 1494539 - DNA, 14 bp, Homo sapiens
tgtctaagattcta

SEQ ID NO: 1494540 - DNA, 18 bp, Homo sapiens
tgtctaattgcatctcaa

SEQ ID NO: 1494541 - DNA, 17 bp, Homo sapiens
tgtctacattaaatcac

SEQ ID NO: 1494542 - DNA, 18 bp, Homo sapiens
tgtctactcagcatttga

SEQ ID NO: 1494543 - DNA, 17 bp, Homo sapiens
tgtctactcctagaaga

SEQ ID NO: 1494544 - DNA, 12 bp, Homo sapiens
tgtctactgtgg

SEQ ID NO: 1494545 - DNA, 15 bp, Homo sapiens
tgtctactgtggtga

SEQ ID NO: 1494546 - DNA, 20 bp, Homo sapiens
tgtctaggactgcagtgtgg

SEQ ID NO: 1494547 - DNA, 20 bp, Homo sapiens
tgtctaggctggaagagcca

SEQ ID NO: 1494548 - DNA, 13 bp, Homo sapiens
tgtctagtgtatt

SEQ ID NO: 1494549 - DNA, 16 bp, Homo sapiens
tgtctagtttgcatac

SEQ ID NO: 1494550 - DNA, 21 bp, Homo sapiens
tgtctataatggaaacattta

SEQ ID NO: 1494551 - DNA, 12 bp, Homo sapiens
tgtctatgaagt

SEQ ID NO: 1494552 - DNA, 19 bp, Homo sapiens
tgtctatgaagttgctgtt

SEQ ID NO: 1494553 - DNA, 20 bp, Homo sapiens
tgtctatggatttgccttct

SEQ ID NO: 1494554 - DNA, 13 bp, Homo sapiens
tgtctattcagct

SEQ ID NO: 1494555 - DNA, 18 bp, Homo sapiens
tgtctattctgagccttg

SEQ ID NO: 1494556 - DNA, 16 bp, Homo sapiens
tgtgagtcaatacata

SEQ ID NO: 1494557 - DNA, 16 bp, Homo sapiens
tgtgagtcccagagcc

SEQ ID NO: 1494558 - DNA, 14 bp, Homo sapiens
tgtgagtccctgtg

SEQ ID NO: 1494559 - DNA, 15 bp, Homo sapiens
tgtgagtccctgtga

SEQ ID NO: 1494560 - DNA, 21 bp, Homo sapiens
tgtgagtgccttttgcagaag

SEQ ID NO: 1494561 - DNA, 14 bp, Homo sapiens
tgtgagtggataat

SEQ ID NO: 1494562 - DNA, 17 bp, Homo sapiens
tgtgagtggataatcag

SEQ ID NO: 1494563 - DNA, 18 bp, Homo sapiens
tgtgagtggataatcagg

SEQ ID NO: 1494564 - DNA, 17 bp, Homo sapiens
tgtgagtggcagccatg

SEQ ID NO: 1494565 - DNA, 14 bp, Homo sapiens
tgtgatattaacag

SEQ ID NO: 1494566 - DNA, 13 bp, Homo sapiens
tgtgatattctgt

SEQ ID NO: 1494567 - DNA, 14 bp, Homo sapiens
tgtgatatttcaga

SEQ ID NO: 1494568 - DNA, 23 bp, Homo sapiens
tgtgatcagctttcaaagcattt

SEQ ID NO: 1494569 - DNA, 22 bp, Homo sapiens
tgtgatccggtttctttttgct

SEQ ID NO: 1494570 - DNA, 16 bp, Homo sapiens
tgtgatctcattgttc

SEQ ID NO: 1494571 - DNA, 16 bp, Homo sapiens
tgtgatcttttaaagt

SEQ ID NO: 1494572 - DNA, 18 bp, Homo sapiens
tgtgatgaacatattcat

SEQ ID NO: 1494573 - DNA, 13 bp, Homo sapiens
tgtgatgagctga

SEQ ID NO: 1494574 - DNA, 14 bp, Homo sapiens
tgtgatgagctgat

SEQ ID NO: 1494575 - DNA, 19 bp, Homo sapiens
tgtgatgagggtgagaaaa

SEQ ID NO: 1494576 - DNA, 16 bp, Homo sapiens
tgtgatgcatgagctc

SEQ ID NO: 1494577 - DNA, 19 bp, Homo sapiens
tgtgatgcatgagctccct

SEQ ID NO: 1494578 - DNA, 18 bp, Homo sapiens
tgtgatgtaccagtttgt

SEQ ID NO: 1494579 - DNA, 14 bp, Homo sapiens
tgtgatgtattcta

SEQ ID NO: 1494580 - DNA, 16 bp, Homo sapiens
tgtgatgtattctagc

SEQ ID NO: 1494581 - DNA, 14 bp, Homo sapiens
tgtgatgttctaag

SEQ ID NO: 1494582 - DNA, 19 bp, Homo sapiens
tgtgattaactcttagaag

SEQ ID NO: 1494583 - DNA, 14 bp, Homo sapiens
tgtgattaacttat

SEQ ID NO: 1494584 - DNA, 16 bp, Homo sapiens
tgtgattaacttgctt

SEQ ID NO: 1494585 - DNA, 16 bp, Homo sapiens
tgtgattagacagaac

SEQ ID NO: 1494586 - DNA, 22 bp, Homo sapiens
tgtgattagacagaacacctat

SEQ ID NO: 1494587 - DNA, 13 bp, Homo sapiens
tgtgattagatca

SEQ ID NO: 1494588 - DNA, 17 bp, Homo sapiens
tgtgattatttcacttt

SEQ ID NO: 1494589 - DNA, 14 bp, Homo sapiens
tgtgattcaatctg

SEQ ID NO: 1494590 - DNA, 16 bp, Homo sapiens
tgtgattcaatctgta

SEQ ID NO: 1494591 - DNA, 20 bp, Homo sapiens
tgtgattcaatctgtaaact

SEQ ID NO: 1494592 - DNA, 23 bp, Homo sapiens
tgtgattccttttgatggggaga

SEQ ID NO: 1494593 - DNA, 13 bp, Homo sapiens
tgtgattgaatct

SEQ ID NO: 1494594 - DNA, 14 bp, Homo sapiens
tgtgattggcctgt

SEQ ID NO: 1494595 - DNA, 13 bp, Homo sapiens
tgtgattggctgc

SEQ ID NO: 1494596 - DNA, 14 bp, Homo sapiens
tgtgattggctggt

SEQ ID NO: 1494597 - DNA, 15 bp, Homo sapiens
tgtgatttcctacag

SEQ ID NO: 1494598 - DNA, 15 bp, Homo sapiens
tgtgatttctttctt

SEQ ID NO: 1494599 - DNA, 18 bp, Homo sapiens
tgtgatttttataataca

SEQ ID NO: 1494600 - DNA, 21 bp, Homo sapiens
tgtgcaaacatggagaaatct

SEQ ID NO: 1494601 - DNA, 12 bp, Homo sapiens
tgtgcaaatcct

SEQ ID NO: 1494602 - DNA, 20 bp, Homo sapiens
tgtgcaacagggtatggact

SEQ ID NO: 1494603 - DNA, 19 bp, Homo sapiens
tgtgcaacgccgtgggctg

SEQ ID NO: 1494604 - DNA, 21 bp, Homo sapiens
tgtgcaacggtctcctgactg

SEQ ID NO: 1494605 - DNA, 19 bp, Homo sapiens
tgtgcaataatttgtacaa

SEQ ID NO: 1494606 - DNA, 23 bp, Homo sapiens
tgtgcaataatttgtacaatggt

SEQ ID NO: 1494607 - DNA, 13 bp, Homo sapiens
tgtgcaatacatt

SEQ ID NO: 1494608 - DNA, 20 bp, Homo sapiens
tgtgcaatagacacatacat

SEQ ID NO: 1494609 - DNA, 14 bp, Homo sapiens
tgtgcaataggtga

SEQ ID NO: 1494610 - DNA, 14 bp, Homo sapiens
tgtgcaattgtctt

SEQ ID NO: 1494611 - DNA, 21 bp, Homo sapiens
tgtgcacaagtctttccagag

SEQ ID NO: 1494612 - DNA, 21 bp, Homo sapiens
tgtgcacactcatacacatgt

SEQ ID NO: 1494613 - DNA, 18 bp, Homo sapiens
tgtgcaccctctatccca

SEQ ID NO: 1494614 - DNA, 17 bp, Homo sapiens
tgtgcactagcctgtga

SEQ ID NO: 1494615 - DNA, 18 bp, Homo sapiens
tgtgcactagcctgtgat

SEQ ID NO: 1494616 - DNA, 18 bp, Homo sapiens
tgtgcactgcctgcatga

SEQ ID NO: 1494617 - DNA, 18 bp, Homo sapiens
tgtgcagaaaatatttaa

SEQ ID NO: 1494618 - DNA, 15 bp, Homo sapiens
tgtgcagacagccat

SEQ ID NO: 1494619 - DNA, 14 bp, Homo sapiens
tgtgcagcagccca

SEQ ID NO: 1494620 - DNA, 20 bp, Homo sapiens
tgtgcagcagcccagcttcc

SEQ ID NO: 1494621 - DNA, 23 bp, Homo sapiens
tgtgcagcagcccagcttcctgg

SEQ ID NO: 1494622 - DNA, 16 bp, Homo sapiens
tgtgcaggtgctgcct

SEQ ID NO: 1494623 - DNA, 14 bp, Homo sapiens
tgtgcagtaacttg

SEQ ID NO: 1494624 - DNA, 17 bp, Homo sapiens
tgtgcagtcactggagg

SEQ ID NO: 1494625 - DNA, 21 bp, Homo sapiens
tgtgcatagcgtcctgccctg

SEQ ID NO: 1494626 - DNA, 22 bp, Homo sapiens
tgtgcatagcgtcctgccctgc

SEQ ID NO: 1494627 - DNA, 23 bp, Homo sapiens
tgtgcatagcgtcctgccctgcc

SEQ ID NO: 1494628 - DNA, 20 bp, Homo sapiens
tgtgcatatttagcatccct

SEQ ID NO: 1494629 - DNA, 18 bp, Homo sapiens
tgtgcatgtgtctttata

SEQ ID NO: 1494630 - DNA, 22 bp, Homo sapiens
tgtgcatgtgtgtaagtgtgtg

SEQ ID NO: 1494631 - DNA, 22 bp, Homo sapiens
tgtgcatgtgtgtgtctgtctt

SEQ ID NO: 1494632 - DNA, 13 bp, Homo sapiens
tgtgcattctttg

SEQ ID NO: 1494633 - DNA, 14 bp, Homo sapiens
tgtgcattctttgg

SEQ ID NO: 1494634 - DNA, 16 bp, Homo sapiens
tgtgcattctttggta

SEQ ID NO: 1494635 - DNA, 17 bp, Homo sapiens
tgtgcattctttggtaa

SEQ ID NO: 1494636 - DNA, 19 bp, Homo sapiens
tgtgcattctttggtaatt

SEQ ID NO: 1494637 - DNA, 16 bp, Homo sapiens
tgtgcatttcacctgt

SEQ ID NO: 1494638 - DNA, 21 bp, Homo sapiens
tgtgcatttttgtgaaatgaa

SEQ ID NO: 1494639 - DNA, 21 bp, Homo sapiens
tgtgccaactgccaggctgcc

SEQ ID NO: 1494640 - DNA, 20 bp, Homo sapiens
tgtgccacccaccagggcga

SEQ ID NO: 1494641 - DNA, 13 bp, Homo sapiens
tgtgccactgact

SEQ ID NO: 1494642 - DNA, 21 bp, Homo sapiens
tgtgccagacattgctctcag

SEQ ID NO: 1494643 - DNA, 23 bp, Homo sapiens
tgtgccaggctgaattacagtga

SEQ ID NO: 1494644 - DNA, 16 bp, Homo sapiens
tgtgccatagtcacat

SEQ ID NO: 1494645 - DNA, 12 bp, Homo sapiens
tgtgccatctgt

SEQ ID NO: 1494646 - DNA, 13 bp, Homo sapiens
tgtgccatctgta

SEQ ID NO: 1494647 - DNA, 23 bp, Homo sapiens
tgtgccatctgtacatattactg

SEQ ID NO: 1494648 - DNA, 14 bp, Homo sapiens
tgtgccatgctggg

SEQ ID NO: 1494649 - DNA, 20 bp, Homo sapiens
tgtgccatggatctgatctg

SEQ ID NO: 1494650 - DNA, 18 bp, Homo sapiens
tgtgcccacccagggaag

SEQ ID NO: 1494651 - DNA, 15 bp, Homo sapiens
tgtgcccagcaggcc

SEQ ID NO: 1494652 - DNA, 19 bp, Homo sapiens
tgtgcccagcccggacctt

SEQ ID NO: 1494653 - DNA, 19 bp, Homo sapiens
tgtgcccagggttttgccc

SEQ ID NO: 1494654 - DNA, 13 bp, Homo sapiens
tgtgccccaccac

SEQ ID NO: 1494655 - DNA, 17 bp, Homo sapiens
tgtgccccactccagcc

SEQ ID NO: 1494656 - DNA, 14 bp, Homo sapiens
tgtgccccatgcct

SEQ ID NO: 1494657 - DNA, 15 bp, Homo sapiens
tgtgccccatgcctg

SEQ ID NO: 1494658 - DNA, 19 bp, Homo sapiens
tgtgccccatgcctgtcca

SEQ ID NO: 1494659 - DNA, 21 bp, Homo sapiens
tgtgcccctgatgcagcctgt

SEQ ID NO: 1494660 - DNA, 20 bp, Homo sapiens
tgtgccccttcactcatttt

SEQ ID NO: 1494661 - DNA, 14 bp, Homo sapiens
tgtgccctggtgga

SEQ ID NO: 1494662 - DNA, 16 bp, Homo sapiens
tgtgcctaattttcta

SEQ ID NO: 1494663 - DNA, 14 bp, Homo sapiens
tgtgcctcagagac

SEQ ID NO: 1494664 - DNA, 15 bp, Homo sapiens
tgtgcctcaggccag

SEQ ID NO: 1494665 - DNA, 15 bp, Homo sapiens
tgtgcctcccttccg

SEQ ID NO: 1494666 - DNA, 15 bp, Homo sapiens
tgtgcctcctcaccc

SEQ ID NO: 1494667 - DNA, 16 bp, Homo sapiens
tgtgcctcctcacccc

SEQ ID NO: 1494668 - DNA, 17 bp, Homo sapiens
tgtgcctctgggactgg

SEQ ID NO: 1494669 - DNA, 15 bp, Homo sapiens
tgtgcctgaccctac

SEQ ID NO: 1494670 - DNA, 14 bp, Homo sapiens
tgtgcctgcaccag

SEQ ID NO: 1494671 - DNA, 15 bp, Homo sapiens
tgtgtttattcttga

SEQ ID NO: 1494672 - DNA, 20 bp, Homo sapiens
tgtgtttattcttgatgaaa

SEQ ID NO: 1494673 - DNA, 23 bp, Homo sapiens
tgtgtttattcttgatgaaaagc

SEQ ID NO: 1494674 - DNA, 20 bp, Homo sapiens
tgtgtttcgcattaagcaca

SEQ ID NO: 1494675 - DNA, 18 bp, Homo sapiens
tgtgtttctaaaactatg

SEQ ID NO: 1494676 - DNA, 20 bp, Homo sapiens
tgtgtttctatgtgacaatt

SEQ ID NO: 1494677 - DNA, 17 bp, Homo sapiens
tgtgtttgtatgtctgt

SEQ ID NO: 1494678 - DNA, 18 bp, Homo sapiens
tgtgttttcttgtaaatg

SEQ ID NO: 1494679 - DNA, 15 bp, Homo sapiens
tgtgtttttaataaa

SEQ ID NO: 1494680 - DNA, 20 bp, Homo sapiens
tgtgtttttaataaagacag

SEQ ID NO: 1494681 - DNA, 14 bp, Homo sapiens
tgtgtttttctttt

SEQ ID NO: 1494682 - DNA, 18 bp, Homo sapiens
tgtgtttttctttttcca

SEQ ID NO: 1494683 - DNA, 20 bp, Homo sapiens
tgtgtttttgggaagaagaa

SEQ ID NO: 1494684 - DNA, 16 bp, Homo sapiens
tgtgttttttaagata

SEQ ID NO: 1494685 - DNA, 18 bp, Homo sapiens
tgttaaaaagaaatccag

SEQ ID NO: 1494686 - DNA, 13 bp, Homo sapiens
tgttaaaaataaa

SEQ ID NO: 1494687 - DNA, 9 bp, Homo sapiens
tgttaaaac

SEQ ID NO: 1494688 - DNA, 12 bp, Homo sapiens
tgttaaaacaac

SEQ ID NO: 1494689 - DNA, 20 bp, Homo sapiens
tgttaaaagttttatatgct

SEQ ID NO: 1494690 - DNA, 12 bp, Homo sapiens
tgttaaaataac

SEQ ID NO: 1494691 - DNA, 16 bp, Homo sapiens
tgttaaaatgtacact

SEQ ID NO: 1494692 - DNA, 18 bp, Homo sapiens
tgttaaaatgtacactgg

SEQ ID NO: 1494693 - DNA, 13 bp, Homo sapiens
tgttaaacaaatg

SEQ ID NO: 1494694 - DNA, 14 bp, Homo sapiens
tgttaaacaaatga

SEQ ID NO: 1494695 - DNA, 19 bp, Homo sapiens
tgttaaagctggaacattt

SEQ ID NO: 1494696 - DNA, 21 bp, Homo sapiens
tgttaaagctggaacatttga

SEQ ID NO: 1494697 - DNA, 22 bp, Homo sapiens
tgttaaagctggaacatttgat

SEQ ID NO: 1494698 - DNA, 18 bp, Homo sapiens
tgttaaatacaggaaaca

SEQ ID NO: 1494699 - DNA, 16 bp, Homo sapiens
tgttaacattccaaga

SEQ ID NO: 1494700 - DNA, 15 bp, Homo sapiens
tgttaacctcagtgt

SEQ ID NO: 1494701 - DNA, 19 bp, Homo sapiens
tgttaacctcagtgtcatt

SEQ ID NO: 1494702 - DNA, 18 bp, Homo sapiens
tgttaaccttgtaagatg

SEQ ID NO: 1494703 - DNA, 19 bp, Homo sapiens
tgttaacgtgatgtgccac

SEQ ID NO: 1494704 - DNA, 20 bp, Homo sapiens
tgttaagaatgaagttctgc

SEQ ID NO: 1494705 - DNA, 23 bp, Homo sapiens
tgttaagataacttactgtatat

SEQ ID NO: 1494706 - DNA, 15 bp, Homo sapiens
tgttaagcatttatt

SEQ ID NO: 1494707 - DNA, 15 bp, Homo sapiens
tgttaagtatgtgta

SEQ ID NO: 1494708 - DNA, 13 bp, Homo sapiens
tgttaagtgtaaa

SEQ ID NO: 1494709 - DNA, 17 bp, Homo sapiens
tgttaagttatagtgaa

SEQ ID NO: 1494710 - DNA, 21 bp, Homo sapiens
tgttaagttatagtgaatact

SEQ ID NO: 1494711 - DNA, 17 bp, Homo sapiens
tgttaatacaaggtata

SEQ ID NO: 1494712 - DNA, 15 bp, Homo sapiens
tgttaatacacagta

SEQ ID NO: 1494713 - DNA, 18 bp, Homo sapiens
tgttaatacacagtactt

SEQ ID NO: 1494714 - DNA, 20 bp, Homo sapiens
tgttaatacacagtacttta

SEQ ID NO: 1494715 - DNA, 15 bp, Homo sapiens
tgttaatatttctaa

SEQ ID NO: 1494716 - DNA, 17 bp, Homo sapiens
tgttaatatttctaaaa

SEQ ID NO: 1494717 - DNA, 16 bp, Homo sapiens
tgttaatgtcattgct

SEQ ID NO: 1494718 - DNA, 17 bp, Homo sapiens
tgttaatgtcattgcta

SEQ ID NO: 1494719 - DNA, 20 bp, Homo sapiens
tgttaattcagcactgattt

SEQ ID NO: 1494720 - DNA, 16 bp, Homo sapiens
tgttaattttgctaac

SEQ ID NO: 1494721 - DNA, 17 bp, Homo sapiens
tgttaattttgctaact

SEQ ID NO: 1494722 - DNA, 19 bp, Homo sapiens
tgttaattttgctaactgg

SEQ ID NO: 1494723 - DNA, 21 bp, Homo sapiens
tgttaattttgctaactgggt

SEQ ID NO: 1494724 - DNA, 23 bp, Homo sapiens
tgttaattttgctaactgggtta

SEQ ID NO: 1494725 - DNA, 12 bp, Homo sapiens
tgttacaaaaga

SEQ ID NO: 1494726 - DNA, 18 bp, Homo sapiens
tgttacaaaagaaaaaag

SEQ ID NO: 1494727 - DNA, 20 bp, Homo sapiens
tgttacaacttgtatttcca

SEQ ID NO: 1494728 - DNA, 13 bp, Homo sapiens
tgttacaagtgtt

SEQ ID NO: 1494729 - DNA, 15 bp, Homo sapiens
tgttacaagtgttct

SEQ ID NO: 1494730 - DNA, 19 bp, Homo sapiens
tgttacaagtttatatata

SEQ ID NO: 1494731 - DNA, 20 bp, Homo sapiens
tgttacactaatttgaataa

SEQ ID NO: 1494732 - DNA, 20 bp, Homo sapiens
tgttacataaggatgacttt

SEQ ID NO: 1494733 - DNA, 18 bp, Homo sapiens
tgttacatgtaatatatt

SEQ ID NO: 1494734 - DNA, 15 bp, Homo sapiens
tgttaccattcacaa

SEQ ID NO: 1494735 - DNA, 20 bp, Homo sapiens
tgttacccagggctctgcag

SEQ ID NO: 1494736 - DNA, 18 bp, Homo sapiens
tgttaccctcctgtaaat

SEQ ID NO: 1494737 - DNA, 16 bp, Homo sapiens
tgttacctaattatta

SEQ ID NO: 1494738 - DNA, 20 bp, Homo sapiens
tgttactaaatccttttgtt

SEQ ID NO: 1494739 - DNA, 14 bp, Homo sapiens
tgttactatggtaa

SEQ ID NO: 1494740 - DNA, 15 bp, Homo sapiens
tgttactattttcta

SEQ ID NO: 1494741 - DNA, 18 bp, Homo sapiens
tgttactattttctacaa

SEQ ID NO: 1494742 - DNA, 20 bp, Homo sapiens
tgttactattttctacaatt

SEQ ID NO: 1494743 - DNA, 18 bp, Homo sapiens
tgttactccctgttattt

SEQ ID NO: 1494744 - DNA, 17 bp, Homo sapiens
tgttactgctgattctt

SEQ ID NO: 1494745 - DNA, 13 bp, Homo sapiens
tgttactgtattt

SEQ ID NO: 1494746 - DNA, 14 bp, Homo sapiens
tgttacttacctaa

SEQ ID NO: 1494747 - DNA, 15 bp, Homo sapiens
tgttactttatacag

SEQ ID NO: 1494748 - DNA, 19 bp, Homo sapiens
tgttagaaaatggacactg

SEQ ID NO: 1494749 - DNA, 17 bp, Homo sapiens
tgttagaatcaaatact

SEQ ID NO: 1494750 - DNA, 20 bp, Homo sapiens
tgttagaggttttaaagtga

SEQ ID NO: 1494751 - DNA, 19 bp, Homo sapiens
tgttagatatttttcataa

SEQ ID NO: 1494752 - DNA, 20 bp, Homo sapiens
tgttagatatttttcataaa

SEQ ID NO: 1494753 - DNA, 12 bp, Homo sapiens
tgttagcaaaga

SEQ ID NO: 1494754 - DNA, 13 bp, Homo sapiens
tgttagcaaagat

SEQ ID NO: 1494755 - DNA, 19 bp, Homo sapiens
tgttagcccttcagattgt

SEQ ID NO: 1494756 - DNA, 18 bp, Homo sapiens
tgttagcttttaccttaa

SEQ ID NO: 1494757 - DNA, 16 bp, Homo sapiens
tgttaggaaaaaattg

SEQ ID NO: 1494758 - DNA, 13 bp, Homo sapiens
tgttagggctgct

SEQ ID NO: 1494759 - DNA, 14 bp, Homo sapiens
tgttagtgctggtc

SEQ ID NO: 1494760 - DNA, 23 bp, Homo sapiens
tgttagtgtgtgtgcatgtgtgt

SEQ ID NO: 1494761 - DNA, 20 bp, Homo sapiens
tgttagttaccttatagtta

SEQ ID NO: 1494762 - DNA, 16 bp, Homo sapiens
tgttagtttagtgtgt

SEQ ID NO: 1494763 - DNA, 17 bp, Homo sapiens
tgttataactctgcact

SEQ ID NO: 1494764 - DNA, 16 bp, Homo sapiens
tgttatacaatacaga

SEQ ID NO: 1494765 - DNA, 18 bp, Homo sapiens
tgttatagatttagctat

SEQ ID NO: 1494766 - DNA, 19 bp, Homo sapiens
tgttataggtcctttagaa

SEQ ID NO: 1494767 - DNA, 15 bp, Homo sapiens
tgttatatataataa

SEQ ID NO: 1494768 - DNA, 17 bp, Homo sapiens
tgttatatcatatgtat

SEQ ID NO: 1494769 - DNA, 16 bp, Homo sapiens
tgttatattaagcaga

SEQ ID NO: 1494770 - DNA, 20 bp, Homo sapiens
tgttatcaaaactttctttt

SEQ ID NO: 1494771 - DNA, 18 bp, Homo sapiens
tgttatcggattactgaa

SEQ ID NO: 1494772 - DNA, 15 bp, Homo sapiens
tgttatgaacatcca

SEQ ID NO: 1494773 - DNA, 19 bp, Homo sapiens
tgttatgcactgtggtttc

SEQ ID NO: 1494774 - DNA, 20 bp, Homo sapiens
tgttatgcactgtggtttca

SEQ ID NO: 1494775 - DNA, 20 bp, Homo sapiens
tgttatgtactagtgttctg

SEQ ID NO: 1494776 - DNA, 20 bp, Homo sapiens
tgttattatagagcagaaat

SEQ ID NO: 1494777 - DNA, 22 bp, Homo sapiens
tgttattatagagcagaaattc

SEQ ID NO: 1494778 - DNA, 23 bp, Homo sapiens
tgttattatctgggcttatatct

SEQ ID NO: 1494779 - DNA, 16 bp, Homo sapiens
tgttattattagataa

SEQ ID NO: 1494780 - DNA, 16 bp, Homo sapiens
tgttattctttgcact

SEQ ID NO: 1494781 - DNA, 14 bp, Homo sapiens
tgttattgtattta

SEQ ID NO: 1494782 - DNA, 19 bp, Homo sapiens
tgttatttaacccatttgt

SEQ ID NO: 1494783 - DNA, 15 bp, Homo sapiens
tgttatttacactgg

SEQ ID NO: 1494784 - DNA, 19 bp, Homo sapiens
tgttatttacactggtcta

SEQ ID NO: 1494785 - DNA, 17 bp, Homo sapiens
tgttatttagactcatc

SEQ ID NO: 1494786 - DNA, 11 bp, Homo sapiens
tgtttaataaa

SEQ ID NO: 1494787 - DNA, 15 bp, Homo sapiens
tgtttaataaaggct

SEQ ID NO: 1494788 - DNA, 14 bp, Homo sapiens
tgtttaatctgtta

SEQ ID NO: 1494789 - DNA, 14 bp, Homo sapiens
tgtttaatcttttt

SEQ ID NO: 1494790 - DNA, 16 bp, Homo sapiens
tgtttacactctttgt

SEQ ID NO: 1494791 - DNA, 19 bp, Homo sapiens
tgtttacactctttgtaag

SEQ ID NO: 1494792 - DNA, 21 bp, Homo sapiens
tgtttacagaggacagtattt

SEQ ID NO: 1494793 - DNA, 21 bp, Homo sapiens
tgtttacagcactactctgtg

SEQ ID NO: 1494794 - DNA, 22 bp, Homo sapiens
tgtttacagcactactctgtgc

SEQ ID NO: 1494795 - DNA, 15 bp, Homo sapiens
tgtttaccaaagaag

SEQ ID NO: 1494796 - DNA, 12 bp, Homo sapiens
tgtttactgaaa

SEQ ID NO: 1494797 - DNA, 13 bp, Homo sapiens
tgtttactgtaaa

SEQ ID NO: 1494798 - DNA, 17 bp, Homo sapiens
tgtttacttaaagattt

SEQ ID NO: 1494799 - DNA, 23 bp, Homo sapiens
tgtttacttaaagatttatcaaa

SEQ ID NO: 1494800 - DNA, 18 bp, Homo sapiens
tgtttagaaacagaaata

SEQ ID NO: 1494801 - DNA, 19 bp, Homo sapiens
tgtttagaagaagtgtgtc

SEQ ID NO: 1494802 - DNA, 19 bp, Homo sapiens
tgtttagagagcctgtcac

SEQ ID NO: 1494803 - DNA, 15 bp, Homo sapiens
tgtttagattttgtg

SEQ ID NO: 1494804 - DNA, 17 bp, Homo sapiens
tgtttagattttgtgtt

SEQ ID NO: 1494805 - DNA, 20 bp, Homo sapiens
tgtttagattttgtgtttat

SEQ ID NO: 1494806 - DNA, 19 bp, Homo sapiens
tgtttagcctgaaaacctt

SEQ ID NO: 1494807 - DNA, 14 bp, Homo sapiens
tgtttagttgcaga

SEQ ID NO: 1494808 - DNA, 23 bp, Homo sapiens
tgtttataaaatataaacaaaga

SEQ ID NO: 1494809 - DNA, 15 bp, Homo sapiens
tgtttataatgttat

SEQ ID NO: 1494810 - DNA, 21 bp, Homo sapiens
tgtttatatacagtacacaga

SEQ ID NO: 1494811 - DNA, 17 bp, Homo sapiens
tgtttatcccttaagaa

SEQ ID NO: 1494812 - DNA, 14 bp, Homo sapiens
tgtttatgagccag

SEQ ID NO: 1494813 - DNA, 16 bp, Homo sapiens
tgtttatgagccagac

SEQ ID NO: 1494814 - DNA, 17 bp, Homo sapiens
tgtttatggccacattt

SEQ ID NO: 1494815 - DNA, 15 bp, Homo sapiens
tgtttatggcctcag

SEQ ID NO: 1494816 - DNA, 11 bp, Homo sapiens
tgtttatgtaa

SEQ ID NO: 1494817 - DNA, 20 bp, Homo sapiens
tgtttatgtaaacaaatctt

SEQ ID NO: 1494818 - DNA, 15 bp, Homo sapiens
tgtttattaaatgct

SEQ ID NO: 1494819 - DNA, 16 bp, Homo sapiens
tgtttattaactactg

SEQ ID NO: 1494820 - DNA, 13 bp, Homo sapiens
tgtttattacaat

SEQ ID NO: 1494821 - DNA, 18 bp, Homo sapiens
tgtttattcaaactgaaa

SEQ ID NO: 1494822 - DNA, 13 bp, Homo sapiens
tgtttattcctga

SEQ ID NO: 1494823 - DNA, 17 bp, Homo sapiens
tgtttattcttccagaa

SEQ ID NO: 1494824 - DNA, 16 bp, Homo sapiens
tgtttattcttctaga

SEQ ID NO: 1494825 - DNA, 20 bp, Homo sapiens
tgtttatttaaggatggatg

SEQ ID NO: 1494826 - DNA, 21 bp, Homo sapiens
tgtttatttaaggatggatgg

SEQ ID NO: 1494827 - DNA, 14 bp, Homo sapiens
tgtttatttataga

SEQ ID NO: 1494828 - DNA, 12 bp, Homo sapiens
tgtttattttga

SEQ ID NO: 1494829 - DNA, 14 bp, Homo sapiens
tgtttcaaaaaaat

SEQ ID NO: 1494830 - DNA, 19 bp, Homo sapiens
tgtttcaaaaaattatatg

SEQ ID NO: 1494831 - DNA, 14 bp, Homo sapiens
tgtttcaaaaccat

SEQ ID NO: 1494832 - DNA, 17 bp, Homo sapiens
tgtttcaaacacaaatg

SEQ ID NO: 1494833 - DNA, 19 bp, Homo sapiens
tgtttcaaggcactctaga

SEQ ID NO: 1494834 - DNA, 21 bp, Homo sapiens
tgtttcacagagtgtgctgct

SEQ ID NO: 1494835 - DNA, 22 bp, Homo sapiens
tgtttcactgaaatgtttggat

SEQ ID NO: 1494836 - DNA, 22 bp, Homo sapiens
tgtttcaggttcagtattatgt

SEQ ID NO: 1494837 - DNA, 16 bp, Homo sapiens
tgtttccaacttgtct

SEQ ID NO: 1494838 - DNA, 23 bp, Homo sapiens
tgtttccagacttccttgagaca

SEQ ID NO: 1494839 - DNA, 14 bp, Homo sapiens
tgtttccagctgcc

SEQ ID NO: 1494840 - DNA, 22 bp, Homo sapiens
tgtttcccaggcccactgtgcc

SEQ ID NO: 1494841 - DNA, 14 bp, Homo sapiens
tgtttccctcgtcc

SEQ ID NO: 1494842 - DNA, 19 bp, Homo sapiens
tgtttccctcgtccgtctg

SEQ ID NO: 1494843 - DNA, 18 bp, Homo sapiens
tgtttcctatttaataca

SEQ ID NO: 1494844 - DNA, 18 bp, Homo sapiens
tgtttcctttttcagata

SEQ ID NO: 1494845 - DNA, 19 bp, Homo sapiens
tgtttcgcattaagcacac

SEQ ID NO: 1494846 - DNA, 15 bp, Homo sapiens
tgtttctaaaactat

SEQ ID NO: 1494847 - DNA, 21 bp, Homo sapiens
tgtttctaataaagaaagcag

SEQ ID NO: 1494848 - DNA, 20 bp, Homo sapiens
tgtttctaccggagagagaa

SEQ ID NO: 1494849 - DNA, 15 bp, Homo sapiens
tgtttctagggaaat

SEQ ID NO: 1494850 - DNA, 12 bp, Homo sapiens
tgtttctcaaaa

SEQ ID NO: 1494851 - DNA, 15 bp, Homo sapiens
tgtttctcaaaagag

SEQ ID NO: 1494852 - DNA, 19 bp, Homo sapiens
tgtttctcgtgctgcatcc

SEQ ID NO: 1494853 - DNA, 23 bp, Homo sapiens
tgtttctcgtgctgcatccctgt

SEQ ID NO: 1494854 - DNA, 13 bp, Homo sapiens
tgtttctgaaaat

SEQ ID NO: 1494855 - DNA, 14 bp, Homo sapiens
tgtttctgaaaatt

SEQ ID NO: 1494856 - DNA, 16 bp, Homo sapiens
tgtttctgacccactg

SEQ ID NO: 1494857 - DNA, 17 bp, Homo sapiens
tgtttctgacccactga

SEQ ID NO: 1494858 - DNA, 22 bp, Homo sapiens
tgtttctggacccttataaaat

SEQ ID NO: 1494859 - DNA, 12 bp, Homo sapiens
tgtttctggagt

SEQ ID NO: 1494860 - DNA, 22 bp, Homo sapiens
tgtttctggagtgattctagag

SEQ ID NO: 1494861 - DNA, 20 bp, Homo sapiens
tgtttctgggtcctgaagaa

SEQ ID NO: 1494862 - DNA, 23 bp, Homo sapiens
tgtttctgtgaaattctcagagt

SEQ ID NO: 1494863 - DNA, 17 bp, Homo sapiens
tgtttcttccaaagcac

SEQ ID NO: 1494864 - DNA, 19 bp, Homo sapiens
tgtttcttccaaagcacat

SEQ ID NO: 1494865 - DNA, 13 bp, Homo sapiens
tgtttcttcctgc

SEQ ID NO: 1494866 - DNA, 15 bp, Homo sapiens
tgtttctttcttcct

SEQ ID NO: 1494867 - DNA, 12 bp, Homo sapiens
tgtttctttgat

SEQ ID NO: 1494868 - DNA, 15 bp, Homo sapiens
tgtttcttttcacat

SEQ ID NO: 1494869 - DNA, 18 bp, Homo sapiens
tgtttcttttgtttggta

SEQ ID NO: 1494870 - DNA, 23 bp, Homo sapiens
tgtttctttttacagcattgtct

SEQ ID NO: 1494871 - DNA, 13 bp, Homo sapiens
tgtttgaaagtag

SEQ ID NO: 1494872 - DNA, 13 bp, Homo sapiens
tgtttgagctcag

SEQ ID NO: 1494873 - DNA, 17 bp, Homo sapiens
tgtttgcagcctgctct

SEQ ID NO: 1494874 - DNA, 16 bp, Homo sapiens
tgtttgccaggacatg

SEQ ID NO: 1494875 - DNA, 19 bp, Homo sapiens
tgtttgccaggacatgcaa

SEQ ID NO: 1494876 - DNA, 15 bp, Homo sapiens
tgtttgccatacttt

SEQ ID NO: 1494877 - DNA, 12 bp, Homo sapiens
tgtttgcccaaa

SEQ ID NO: 1494878 - DNA, 20 bp, Homo sapiens
tgtttgccttctacttttaa

SEQ ID NO: 1494879 - DNA, 16 bp, Homo sapiens
tgtttgctcaaaattg

SEQ ID NO: 1494880 - DNA, 14 bp, Homo sapiens
tgtttgctctcccg

SEQ ID NO: 1494881 - DNA, 13 bp, Homo sapiens
tgtttgctgctat

SEQ ID NO: 1494882 - DNA, 12 bp, Homo sapiens
tgtttgcttctt

SEQ ID NO: 1494883 - DNA, 22 bp, Homo sapiens
tgtttgcttcttgccatcactg

SEQ ID NO: 1494884 - DNA, 20 bp, Homo sapiens
tgtttggaaaaaactctgaa

SEQ ID NO: 1494885 - DNA, 22 bp, Homo sapiens
tgtttggaaaaaactctgaagg

SEQ ID NO: 1494886 - DNA, 15 bp, Homo sapiens
tgtttggcaatgcta

SEQ ID NO: 1494887 - DNA, 19 bp, Homo sapiens
tgtttggcacttgtattta

SEQ ID NO: 1494888 - DNA, 17 bp, Homo sapiens
tgtttgggatgaccagg

SEQ ID NO: 1494889 - DNA, 18 bp, Homo sapiens
tgtttgggtatcctgccc

SEQ ID NO: 1494890 - DNA, 22 bp, Homo sapiens
tgtttgggttgttggtctgtgt

SEQ ID NO: 1494891 - DNA, 22 bp, Homo sapiens
tgtttggttgtaaatgctcgtg

SEQ ID NO: 1494892 - DNA, 21 bp, Homo sapiens
tgtttgtaaataagagatttg

SEQ ID NO: 1494893 - DNA, 13 bp, Homo sapiens
tgtttgtaaatta

SEQ ID NO: 1494894 - DNA, 16 bp, Homo sapiens
tgtttgtaaattaata

SEQ ID NO: 1494895 - DNA, 17 bp, Homo sapiens
tgtttgtaagtgaagtg

SEQ ID NO: 1494896 - DNA, 19 bp, Homo sapiens
tgtttgtaagtttgaattt

SEQ ID NO: 1494897 - DNA, 13 bp, Homo sapiens
tgtttgtatgtct

SEQ ID NO: 1494898 - DNA, 15 bp, Homo sapiens
tgtttgtatgtctgt

SEQ ID NO: 1494899 - DNA, 14 bp, Homo sapiens
tgtttgtcagcatc

SEQ ID NO: 1494900 - DNA, 16 bp, Homo sapiens
tgtttgtcagcatctg

SEQ ID NO: 1494901 - DNA, 21 bp, Homo sapiens
ttaaatatgttagcaaagagt

SEQ ID NO: 1494902 - DNA, 22 bp, Homo sapiens
ttaaatatttcaagacattaaa

SEQ ID NO: 1494903 - DNA, 13 bp, Homo sapiens
ttaaatattttct

SEQ ID NO: 1494904 - DNA, 18 bp, Homo sapiens
ttaaatattttctatttt

SEQ ID NO: 1494905 - DNA, 22 bp, Homo sapiens
ttaaatattttctattttaaga

SEQ ID NO: 1494906 - DNA, 15 bp, Homo sapiens
ttaaatattttgcta

SEQ ID NO: 1494907 - DNA, 16 bp, Homo sapiens
ttaaatattttgctaa

SEQ ID NO: 1494908 - DNA, 20 bp, Homo sapiens
ttaaatcaaggaaaggctca

SEQ ID NO: 1494909 - DNA, 22 bp, Homo sapiens
ttaaatccaactttcacagtga

SEQ ID NO: 1494910 - DNA, 21 bp, Homo sapiens
ttaaatctatgaagtatataa

SEQ ID NO: 1494911 - DNA, 15 bp, Homo sapiens
ttaaatctgctttag

SEQ ID NO: 1494912 - DNA, 16 bp, Homo sapiens
ttaaatgaaagaaaat

SEQ ID NO: 1494913 - DNA, 16 bp, Homo sapiens
ttaaatgaggattatt

SEQ ID NO: 1494914 - DNA, 17 bp, Homo sapiens
ttaaatgcaacagtttt

SEQ ID NO: 1494915 - DNA, 20 bp, Homo sapiens
ttaaatgccttgtataaaat

SEQ ID NO: 1494916 - DNA, 22 bp, Homo sapiens
ttaaatgctcattttctggttt

SEQ ID NO: 1494917 - DNA, 15 bp, Homo sapiens
ttaaatgtaatataa

SEQ ID NO: 1494918 - DNA, 23 bp, Homo sapiens
ttaaatgtaatataatgtatttt

SEQ ID NO: 1494919 - DNA, 20 bp, Homo sapiens
ttaaatgtagacagatattt

SEQ ID NO: 1494920 - DNA, 13 bp, Homo sapiens
ttaaatgttatta

SEQ ID NO: 1494921 - DNA, 15 bp, Homo sapiens
ttaaattacaatttt

SEQ ID NO: 1494922 - DNA, 18 bp, Homo sapiens
ttaaattatatatttatt

SEQ ID NO: 1494923 - DNA, 14 bp, Homo sapiens
ttaaattcagtaat

SEQ ID NO: 1494924 - DNA, 20 bp, Homo sapiens
ttaaattgcaatatataaga

SEQ ID NO: 1494925 - DNA, 19 bp, Homo sapiens
ttaaattgcttttgttgtg

SEQ ID NO: 1494926 - DNA, 15 bp, Homo sapiens
ttaaattgtgtttta

SEQ ID NO: 1494927 - DNA, 19 bp, Homo sapiens
ttaaatttcaaatgcagaa

SEQ ID NO: 1494928 - DNA, 14 bp, Homo sapiens
ttaaatttcttatg

SEQ ID NO: 1494929 - DNA, 22 bp, Homo sapiens
ttaaatttcttatgtgacatta

SEQ ID NO: 1494930 - DNA, 15 bp, Homo sapiens
ttaaattttaattta

SEQ ID NO: 1494931 - DNA, 15 bp, Homo sapiens
ttaacaaaagcaaga

SEQ ID NO: 1494932 - DNA, 15 bp, Homo sapiens
ttaacaactgggtca

SEQ ID NO: 1494933 - DNA, 14 bp, Homo sapiens
ttaacaagaacttt

SEQ ID NO: 1494934 - DNA, 12 bp, Homo sapiens
ttaacaaggaat

SEQ ID NO: 1494935 - DNA, 17 bp, Homo sapiens
ttaacaataataaaaag

SEQ ID NO: 1494936 - DNA, 15 bp, Homo sapiens
ttaacaatctaacaa

SEQ ID NO: 1494937 - DNA, 17 bp, Homo sapiens
ttaacaatctaacaata

SEQ ID NO: 1494938 - DNA, 21 bp, Homo sapiens
ttaacacactggccattctta

SEQ ID NO: 1494939 - DNA, 15 bp, Homo sapiens
ttaacactactcaaa

SEQ ID NO: 1494940 - DNA, 17 bp, Homo sapiens
ttaacactactcaaagc

SEQ ID NO: 1494941 - DNA, 15 bp, Homo sapiens
ttaacactttgtatt

SEQ ID NO: 1494942 - DNA, 21 bp, Homo sapiens
ttaacagaaattgtatattgt

SEQ ID NO: 1494943 - DNA, 17 bp, Homo sapiens
ttaacaggcaaacattt

SEQ ID NO: 1494944 - DNA, 23 bp, Homo sapiens
ttaacaggcaaacattttctctt

SEQ ID NO: 1494945 - DNA, 16 bp, Homo sapiens
ttaacatacaagaaaa

SEQ ID NO: 1494946 - DNA, 20 bp, Homo sapiens
ttaacatacaagaaaatgta

SEQ ID NO: 1494947 - DNA, 21 bp, Homo sapiens
ttaacatacaagaaaatgtat

SEQ ID NO: 1494948 - DNA, 17 bp, Homo sapiens
ttaacatagtcctgtta

SEQ ID NO: 1494949 - DNA, 14 bp, Homo sapiens
ttaacattccaaga

SEQ ID NO: 1494950 - DNA, 17 bp, Homo sapiens
ttaacattccaagactc

SEQ ID NO: 1494951 - DNA, 21 bp, Homo sapiens
ttaacattctttttctgttga

SEQ ID NO: 1494952 - DNA, 21 bp, Homo sapiens
ttaacattgaccaagaactgc

SEQ ID NO: 1494953 - DNA, 22 bp, Homo sapiens
ttaacattgaccaagaactgca

SEQ ID NO: 1494954 - DNA, 20 bp, Homo sapiens
ttaacattgcataaacactt

SEQ ID NO: 1494955 - DNA, 12 bp, Homo sapiens
ttaacatttctc

SEQ ID NO: 1494956 - DNA, 21 bp, Homo sapiens
ttaaccccttggtactgaaaa

SEQ ID NO: 1494957 - DNA, 14 bp, Homo sapiens
ttaaccctcccctt

SEQ ID NO: 1494958 - DNA, 15 bp, Homo sapiens
ttaacccttcatctt

SEQ ID NO: 1494959 - DNA, 20 bp, Homo sapiens
ttaacctatgatattttctg

SEQ ID NO: 1494960 - DNA, 19 bp, Homo sapiens
ttaacctcagtgtcattta

SEQ ID NO: 1494961 - DNA, 15 bp, Homo sapiens
ttaacctctgcacta

SEQ ID NO: 1494962 - DNA, 23 bp, Homo sapiens
ttaaccttaaaattaagatttcc

SEQ ID NO: 1494963 - DNA, 18 bp, Homo sapiens
ttaacgatgtccaacccg

SEQ ID NO: 1494964 - DNA, 17 bp, Homo sapiens
ttaacggctccaggatt

SEQ ID NO: 1494965 - DNA, 15 bp, Homo sapiens
ttaacggtgctaaaa

SEQ ID NO: 1494966 - DNA, 17 bp, Homo sapiens
ttaactaaattttaaag

SEQ ID NO: 1494967 - DNA, 15 bp, Homo sapiens
ttaactaatttgaat

SEQ ID NO: 1494968 - DNA, 19 bp, Homo sapiens
ttaactactatattgattg

SEQ ID NO: 1494969 - DNA, 20 bp, Homo sapiens
ttaactagatacagaataat

SEQ ID NO: 1494970 - DNA, 16 bp, Homo sapiens
ttaactatttcacatg

SEQ ID NO: 1494971 - DNA, 15 bp, Homo sapiens
ttaactcaaaagttg

SEQ ID NO: 1494972 - DNA, 21 bp, Homo sapiens
ttaactcttagaagtgttgta

SEQ ID NO: 1494973 - DNA, 16 bp, Homo sapiens
ttaactcttttggaca

SEQ ID NO: 1494974 - DNA, 19 bp, Homo sapiens
ttaactgccgtaatttaac

SEQ ID NO: 1494975 - DNA, 17 bp, Homo sapiens
ttaactgctcagtgttt

SEQ ID NO: 1494976 - DNA, 13 bp, Homo sapiens
ttaactgtggata

SEQ ID NO: 1494977 - DNA, 15 bp, Homo sapiens
ttaactgtggatatt

SEQ ID NO: 1494978 - DNA, 19 bp, Homo sapiens
ttaactgtgtatgtacata

SEQ ID NO: 1494979 - DNA, 16 bp, Homo sapiens
ttaacttagctacttt

SEQ ID NO: 1494980 - DNA, 14 bp, Homo sapiens
ttaacttagttttg

SEQ ID NO: 1494981 - DNA, 17 bp, Homo sapiens
ttaacttagttttgcat

SEQ ID NO: 1494982 - DNA, 18 bp, Homo sapiens
ttaacttagttttgcata

SEQ ID NO: 1494983 - DNA, 14 bp, Homo sapiens
ttaacttcttgctt

SEQ ID NO: 1494984 - DNA, 17 bp, Homo sapiens
ttaacttcttgcttctt

SEQ ID NO: 1494985 - DNA, 16 bp, Homo sapiens
ttaactttaatacagc

SEQ ID NO: 1494986 - DNA, 22 bp, Homo sapiens
ttaactttttttcttctacttt

SEQ ID NO: 1494987 - DNA, 20 bp, Homo sapiens
ttaacttttttttctctctt

SEQ ID NO: 1494988 - DNA, 17 bp, Homo sapiens
ttaagaaaaacatgtca

SEQ ID NO: 1494989 - DNA, 19 bp, Homo sapiens
ttaagaaaaacatgtcatg

SEQ ID NO: 1494990 - DNA, 14 bp, Homo sapiens
ttaagaaaacattt

SEQ ID NO: 1494991 - DNA, 18 bp, Homo sapiens
ttaagaaaatacaataaa

SEQ ID NO: 1494992 - DNA, 22 bp, Homo sapiens
ttaagaaagactatctaaatgt

SEQ ID NO: 1494993 - DNA, 23 bp, Homo sapiens
ttaagaaagcacttaaacagaag

SEQ ID NO: 1494994 - DNA, 21 bp, Homo sapiens
ttaagaaatctggcccagggt

SEQ ID NO: 1494995 - DNA, 16 bp, Homo sapiens
ttaagaactgtgtctg

SEQ ID NO: 1494996 - DNA, 18 bp, Homo sapiens
ttaagaatgagtttctta

SEQ ID NO: 1494997 - DNA, 20 bp, Homo sapiens
ttaagaatgagtttcttaga

SEQ ID NO: 1494998 - DNA, 13 bp, Homo sapiens
ttaagacaaatgg

SEQ ID NO: 1494999 - DNA, 14 bp, Homo sapiens
ttaagacagtgtac

SEQ ID NO: 1495000 - DNA, 16 bp, Homo sapiens
ttaagacagtgtacaa

SEQ ID NO: 1495001 - DNA, 22 bp, Homo sapiens
ttaagacagtgtacaaaactgt

SEQ ID NO: 1495002 - DNA, 18 bp, Homo sapiens
ttaagacctactgttcta

SEQ ID NO: 1495003 - DNA, 20 bp, Homo sapiens
ttaagacctactgttctaaa

SEQ ID NO: 1495004 - DNA, 21 bp, Homo sapiens
ttaagacctactgttctaaag

SEQ ID NO: 1495005 - DNA, 18 bp, Homo sapiens
ttaagagacagagaatct

SEQ ID NO: 1495006 - DNA, 19 bp, Homo sapiens
ttaagataacttactgtat

SEQ ID NO: 1495007 - DNA, 14 bp, Homo sapiens
ttaagataattata

SEQ ID NO: 1495008 - DNA, 14 bp, Homo sapiens
ttaagatacaaatt

SEQ ID NO: 1495009 - DNA, 20 bp, Homo sapiens
ttaagatacaaattaatttt

SEQ ID NO: 1495010 - DNA, 13 bp, Homo sapiens
ttaagatattgaa

SEQ ID NO: 1495011 - DNA, 15 bp, Homo sapiens
ttaagatccagaaat

SEQ ID NO: 1495012 - DNA, 18 bp, Homo sapiens
ttaagatccagaaatact

SEQ ID NO: 1495013 - DNA, 13 bp, Homo sapiens
ttaagatgtgaaa

SEQ ID NO: 1495014 - DNA, 17 bp, Homo sapiens
ttaagatgtgaaaatta

SEQ ID NO: 1495015 - DNA, 18 bp, Homo sapiens
ttacagaaaaagacttta

SEQ ID NO: 1495016 - DNA, 13 bp, Homo sapiens
ttacagaaaattg

SEQ ID NO: 1495017 - DNA, 21 bp, Homo sapiens
ttacagagaggatacatttaa

SEQ ID NO: 1495018 - DNA, 21 bp, Homo sapiens
ttacagaggtattaaaactaa

SEQ ID NO: 1495019 - DNA, 20 bp, Homo sapiens
ttacagatgaatgtatttat

SEQ ID NO: 1495020 - DNA, 18 bp, Homo sapiens
ttacagatgtttttaatt

SEQ ID NO: 1495021 - DNA, 16 bp, Homo sapiens
ttacagattgcctcct

SEQ ID NO: 1495022 - DNA, 11 bp, Homo sapiens
ttacagatttc

SEQ ID NO: 1495023 - DNA, 15 bp, Homo sapiens
ttacagcattgtctt

SEQ ID NO: 1495024 - DNA, 19 bp, Homo sapiens
ttacagctcattaaacttt

SEQ ID NO: 1495025 - DNA, 15 bp, Homo sapiens
ttacagctctgtagt

SEQ ID NO: 1495026 - DNA, 21 bp, Homo sapiens
ttacaggaaaaaaaattctgt

SEQ ID NO: 1495027 - DNA, 22 bp, Homo sapiens
ttacaggaaaaaaaattctgtt

SEQ ID NO: 1495028 - DNA, 18 bp, Homo sapiens
ttacaggcaccgagaatg

SEQ ID NO: 1495029 - DNA, 24 bp, Homo sapiens
ttacaggcaccgagaatgttgtat

SEQ ID NO: 1495030 - DNA, 15 bp, Homo sapiens
ttacagggaagtggt

SEQ ID NO: 1495031 - DNA, 17 bp, Homo sapiens
ttacagtgtagcttgcc

SEQ ID NO: 1495032 - DNA, 13 bp, Homo sapiens
ttacagtgtttta

SEQ ID NO: 1495033 - DNA, 21 bp, Homo sapiens
ttacagttacaattgttacag

SEQ ID NO: 1495034 - DNA, 19 bp, Homo sapiens
ttacagttagggttttgca

SEQ ID NO: 1495035 - DNA, 11 bp, Homo sapiens
ttacagttctg

SEQ ID NO: 1495036 - DNA, 14 bp, Homo sapiens
ttacagttctttcc

SEQ ID NO: 1495037 - DNA, 15 bp, Homo sapiens
ttacagttctttcct

SEQ ID NO: 1495038 - DNA, 22 bp, Homo sapiens
ttacagttctttcctctttctg

SEQ ID NO: 1495039 - DNA, 13 bp, Homo sapiens
ttacagttgatgt

SEQ ID NO: 1495040 - DNA, 17 bp, Homo sapiens
ttacataagagaaagag

SEQ ID NO: 1495041 - DNA, 20 bp, Homo sapiens
ttacataagataaatgtgct

SEQ ID NO: 1495042 - DNA, 22 bp, Homo sapiens
ttacataaggatgactttttta

SEQ ID NO: 1495043 - DNA, 17 bp, Homo sapiens
ttacataatcaaagcta

SEQ ID NO: 1495044 - DNA, 13 bp, Homo sapiens
ttacatcatttct

SEQ ID NO: 1495045 - DNA, 13 bp, Homo sapiens
ttacatcattttt

SEQ ID NO: 1495046 - DNA, 18 bp, Homo sapiens
ttacatcatttttgtatc

SEQ ID NO: 1495047 - DNA, 20 bp, Homo sapiens
ttacatcatttttgtatcta

SEQ ID NO: 1495048 - DNA, 13 bp, Homo sapiens
ttacatctaatgc

SEQ ID NO: 1495049 - DNA, 21 bp, Homo sapiens
ttacatctgttttaaatttat

SEQ ID NO: 1495050 - DNA, 16 bp, Homo sapiens
ttacatcttttctaat

SEQ ID NO: 1495051 - DNA, 16 bp, Homo sapiens
ttacatgctactaaat

SEQ ID NO: 1495052 - DNA, 17 bp, Homo sapiens
ttacatgtattatttca

SEQ ID NO: 1495053 - DNA, 12 bp, Homo sapiens
ttacatgttttc

SEQ ID NO: 1495054 - DNA, 15 bp, Homo sapiens
ttacattattaaacg

SEQ ID NO: 1495055 - DNA, 22 bp, Homo sapiens
ttacattcaacttttctaagaa

SEQ ID NO: 1495056 - DNA, 18 bp, Homo sapiens
ttacattcctaactagaa

SEQ ID NO: 1495057 - DNA, 15 bp, Homo sapiens
ttacattgtcattta

SEQ ID NO: 1495058 - DNA, 15 bp, Homo sapiens
ttacattgtcctgta

SEQ ID NO: 1495059 - DNA, 17 bp, Homo sapiens
ttacattgtttgtctgt

SEQ ID NO: 1495060 - DNA, 19 bp, Homo sapiens
ttacatttaatacagataa

SEQ ID NO: 1495061 - DNA, 13 bp, Homo sapiens
ttacatttgtaat

SEQ ID NO: 1495062 - DNA, 18 bp, Homo sapiens
ttacatttgtaatttaag

SEQ ID NO: 1495063 - DNA, 12 bp, Homo sapiens
ttacattttata

SEQ ID NO: 1495064 - DNA, 17 bp, Homo sapiens
ttacatttttacaataa

SEQ ID NO: 1495065 - DNA, 17 bp, Homo sapiens
ttaccaaaaaccatgtt

SEQ ID NO: 1495066 - DNA, 23 bp, Homo sapiens
ttaccaaagtgtcttttgacatt

SEQ ID NO: 1495067 - DNA, 13 bp, Homo sapiens
ttaccaacctgtt

SEQ ID NO: 1495068 - DNA, 16 bp, Homo sapiens
ttaccaaggatgaatt

SEQ ID NO: 1495069 - DNA, 21 bp, Homo sapiens
ttaccagacggttcaccagcc

SEQ ID NO: 1495070 - DNA, 22 bp, Homo sapiens
ttaccagacggttcaccagcct

SEQ ID NO: 1495071 - DNA, 17 bp, Homo sapiens
ttaccagtcctattttt

SEQ ID NO: 1495072 - DNA, 14 bp, Homo sapiens
ttaccagttgcctt

SEQ ID NO: 1495073 - DNA, 15 bp, Homo sapiens
ttaccatcatctctg

SEQ ID NO: 1495074 - DNA, 16 bp, Homo sapiens
ttaccatcatctctga

SEQ ID NO: 1495075 - DNA, 11 bp, Homo sapiens
ttaccatgaga

SEQ ID NO: 1495076 - DNA, 13 bp, Homo sapiens
ttaccattcacaa

SEQ ID NO: 1495077 - DNA, 15 bp, Homo sapiens
ttaccattcacaata

SEQ ID NO: 1495078 - DNA, 18 bp, Homo sapiens
ttacccactgccatgcac

SEQ ID NO: 1495079 - DNA, 20 bp, Homo sapiens
ttacccagattgtgtacata

SEQ ID NO: 1495080 - DNA, 13 bp, Homo sapiens
ttacccataaaca

SEQ ID NO: 1495081 - DNA, 21 bp, Homo sapiens
ttacccctatacctgagcctc

SEQ ID NO: 1495082 - DNA, 17 bp, Homo sapiens
ttaccctctttgctgca

SEQ ID NO: 1495083 - DNA, 19 bp, Homo sapiens
ttaccctgaggtcactgct

SEQ ID NO: 1495084 - DNA, 17 bp, Homo sapiens
ttaccctgatctggacc

SEQ ID NO: 1495085 - DNA, 21 bp, Homo sapiens
ttaccgtgagtgacatagcct

SEQ ID NO: 1495086 - DNA, 17 bp, Homo sapiens
ttacctaaacagatata

SEQ ID NO: 1495087 - DNA, 19 bp, Homo sapiens
ttacctaaacagatataaa

SEQ ID NO: 1495088 - DNA, 18 bp, Homo sapiens
ttacctaagattacaaat

SEQ ID NO: 1495089 - DNA, 23 bp, Homo sapiens
ttacctactttgactttttgcat

SEQ ID NO: 1495090 - DNA, 13 bp, Homo sapiens
ttacctccatcca

SEQ ID NO: 1495091 - DNA, 14 bp, Homo sapiens
ttacctccatccat

SEQ ID NO: 1495092 - DNA, 12 bp, Homo sapiens
ttacctgccaat

SEQ ID NO: 1495093 - DNA, 18 bp, Homo sapiens
ttacctgccaattgctac

SEQ ID NO: 1495094 - DNA, 21 bp, Homo sapiens
ttacctggaatgtattttaac

SEQ ID NO: 1495095 - DNA, 18 bp, Homo sapiens
ttacctgggcattcttgt

SEQ ID NO: 1495096 - DNA, 22 bp, Homo sapiens
ttacctgtacactgacttgaga

SEQ ID NO: 1495097 - DNA, 18 bp, Homo sapiens
ttacctgtatacagtgca

SEQ ID NO: 1495098 - DNA, 19 bp, Homo sapiens
ttacctgtatacagtgcag

SEQ ID NO: 1495099 - DNA, 20 bp, Homo sapiens
ttacctgtcattttgcactg

SEQ ID NO: 1495100 - DNA, 20 bp, Homo sapiens
ttacctgtggatatttgtat

SEQ ID NO: 1495101 - DNA, 14 bp, Homo sapiens
ttacctttctctct

SEQ ID NO: 1495102 - DNA, 19 bp, Homo sapiens
ttaccttttaattaatgaa

SEQ ID NO: 1495103 - DNA, 18 bp, Homo sapiens
ttaccttttctgttgtac

SEQ ID NO: 1495104 - DNA, 17 bp, Homo sapiens
ttaccttttttgataaa

SEQ ID NO: 1495105 - DNA, 13 bp, Homo sapiens
ttacgtttgtcct

SEQ ID NO: 1495106 - DNA, 17 bp, Homo sapiens
ttactaaaaaaaagatg

SEQ ID NO: 1495107 - DNA, 22 bp, Homo sapiens
ttactaaagaaaatatctgaaa

SEQ ID NO: 1495108 - DNA, 22 bp, Homo sapiens
ttactaaagaaagattacttag

SEQ ID NO: 1495109 - DNA, 15 bp, Homo sapiens
ttactaaattgtata

SEQ ID NO: 1495110 - DNA, 23 bp, Homo sapiens
ttactaagtcaggagtgtagttg

SEQ ID NO: 1495111 - DNA, 14 bp, Homo sapiens
ttactaatatatat

SEQ ID NO: 1495112 - DNA, 14 bp, Homo sapiens
ttactacaaaattt

SEQ ID NO: 1495113 - DNA, 17 bp, Homo sapiens
ttactactgagggaaat

SEQ ID NO: 1495114 - DNA, 17 bp, Homo sapiens
ttactagtactatttct

SEQ ID NO: 1495115 - DNA, 20 bp, Homo sapiens
ttactataatttgacttgaa

SEQ ID NO: 1495116 - DNA, 17 bp, Homo sapiens
ttactatctgttgaaaa

SEQ ID NO: 1495117 - DNA, 14 bp, Homo sapiens
ttactattaagcag

SEQ ID NO: 1495118 - DNA, 21 bp, Homo sapiens
ttactattaggaaaataaaca

SEQ ID NO: 1495119 - DNA, 21 bp, Homo sapiens
ttactattttctacaattaat

SEQ ID NO: 1495120 - DNA, 15 bp, Homo sapiens
ttactcaaaatctgt

SEQ ID NO: 1495121 - DNA, 15 bp, Homo sapiens
ttactcagcccagct

SEQ ID NO: 1495122 - DNA, 13 bp, Homo sapiens
ttactcagccctg

SEQ ID NO: 1495123 - DNA, 16 bp, Homo sapiens
ttactccataaacaga

SEQ ID NO: 1495124 - DNA, 21 bp, Homo sapiens
ttactccttaggtgcccagaa

SEQ ID NO: 1495125 - DNA, 20 bp, Homo sapiens
ttactcgatcaaaaccttcc

SEQ ID NO: 1495126 - DNA, 21 bp, Homo sapiens
ttactctaagatcttagattc

SEQ ID NO: 1495127 - DNA, 15 bp, Homo sapiens
ttactctcattcttt

SEQ ID NO: 1495128 - DNA, 18 bp, Homo sapiens
ttactgaaggtaaaattg

SEQ ID NO: 1495129 - DNA, 20 bp, Homo sapiens
ttactgaataatatcaaata

SEQ ID NO: 1495130 - DNA, 15 bp, Homo sapiens
ttatatgaagaaaat

SEQ ID NO: 1495131 - DNA, 22 bp, Homo sapiens
ttatatgaccatatttactctt

SEQ ID NO: 1495132 - DNA, 20 bp, Homo sapiens
ttatatgctttattaatgtt

SEQ ID NO: 1495133 - DNA, 12 bp, Homo sapiens
ttatatgctttt

SEQ ID NO: 1495134 - DNA, 15 bp, Homo sapiens
ttatatggaagaaag

SEQ ID NO: 1495135 - DNA, 20 bp, Homo sapiens
ttatatggatgattcagaaa

SEQ ID NO: 1495136 - DNA, 22 bp, Homo sapiens
ttatatggatgattcagaaatt

SEQ ID NO: 1495137 - DNA, 15 bp, Homo sapiens
ttatattaaaatatg

SEQ ID NO: 1495138 - DNA, 16 bp, Homo sapiens
ttatattaaagtaaat

SEQ ID NO: 1495139 - DNA, 15 bp, Homo sapiens
ttatattactctcat

SEQ ID NO: 1495140 - DNA, 18 bp, Homo sapiens
ttatattcaatgcattta

SEQ ID NO: 1495141 - DNA, 13 bp, Homo sapiens
ttatattcacaga

SEQ ID NO: 1495142 - DNA, 22 bp, Homo sapiens
ttatattgaagacaatttgata

SEQ ID NO: 1495143 - DNA, 20 bp, Homo sapiens
ttatattgcagattgaatat

SEQ ID NO: 1495144 - DNA, 19 bp, Homo sapiens
ttatatttaaaaattgttt

SEQ ID NO: 1495145 - DNA, 16 bp, Homo sapiens
ttatatttcctttatg

SEQ ID NO: 1495146 - DNA, 21 bp, Homo sapiens
ttatatttcctttatgtgaat

SEQ ID NO: 1495147 - DNA, 22 bp, Homo sapiens
ttatatttcctttatgtgaatt

SEQ ID NO: 1495148 - DNA, 14 bp, Homo sapiens
ttatatttggaaag

SEQ ID NO: 1495149 - DNA, 16 bp, Homo sapiens
ttatattttatgaaca

SEQ ID NO: 1495150 - DNA, 23 bp, Homo sapiens
ttatattttatgaacattgtact

SEQ ID NO: 1495151 - DNA, 17 bp, Homo sapiens
ttatattttgaaagaag

SEQ ID NO: 1495152 - DNA, 18 bp, Homo sapiens
ttatattttgaaagaagc

SEQ ID NO: 1495153 - DNA, 14 bp, Homo sapiens
ttatcaaaaagtat

SEQ ID NO: 1495154 - DNA, 16 bp, Homo sapiens
ttatcaaaactttctt

SEQ ID NO: 1495155 - DNA, 13 bp, Homo sapiens
ttatcaaatcagt

SEQ ID NO: 1495156 - DNA, 19 bp, Homo sapiens
ttatcaattacaacagtga

SEQ ID NO: 1495157 - DNA, 13 bp, Homo sapiens
ttatcaatttttc

SEQ ID NO: 1495158 - DNA, 18 bp, Homo sapiens
ttatcaatttttcccagt

SEQ ID NO: 1495159 - DNA, 18 bp, Homo sapiens
ttatcacattatttgcat

SEQ ID NO: 1495160 - DNA, 22 bp, Homo sapiens
ttatcaccacagtaagttccta

SEQ ID NO: 1495161 - DNA, 14 bp, Homo sapiens
ttatcagccatgtt

SEQ ID NO: 1495162 - DNA, 17 bp, Homo sapiens
ttatcagccatgtttgg

SEQ ID NO: 1495163 - DNA, 16 bp, Homo sapiens
ttatcagtaaataact

SEQ ID NO: 1495164 - DNA, 21 bp, Homo sapiens
ttatcagtcataactaaataa

SEQ ID NO: 1495165 - DNA, 16 bp, Homo sapiens
ttatcagtgacagagt

SEQ ID NO: 1495166 - DNA, 18 bp, Homo sapiens
ttatcatccacattgttt

SEQ ID NO: 1495167 - DNA, 16 bp, Homo sapiens
ttatcattaaaaatta

SEQ ID NO: 1495168 - DNA, 18 bp, Homo sapiens
ttatcattaaaaattacc

SEQ ID NO: 1495169 - DNA, 12 bp, Homo sapiens
ttatcattgctc

SEQ ID NO: 1495170 - DNA, 19 bp, Homo sapiens
ttatcattgctcccctgat

SEQ ID NO: 1495171 - DNA, 12 bp, Homo sapiens
ttatcattttca

SEQ ID NO: 1495172 - DNA, 15 bp, Homo sapiens
ttatccaaaatgtgt

SEQ ID NO: 1495173 - DNA, 17 bp, Homo sapiens
ttatccaaaatgtgtat

SEQ ID NO: 1495174 - DNA, 22 bp, Homo sapiens
ttatccaaaatgtgtatttctt

SEQ ID NO: 1495175 - DNA, 15 bp, Homo sapiens
ttatccctctcttcc

SEQ ID NO: 1495176 - DNA, 16 bp, Homo sapiens
ttatccctctcttccc

SEQ ID NO: 1495177 - DNA, 23 bp, Homo sapiens
ttatccctctcttccccttccct

SEQ ID NO: 1495178 - DNA, 15 bp, Homo sapiens
ttatcccttaagaat

SEQ ID NO: 1495179 - DNA, 23 bp, Homo sapiens
ttatcccttccttttagcctagt

SEQ ID NO: 1495180 - DNA, 16 bp, Homo sapiens
ttatcctgaaatttca

SEQ ID NO: 1495181 - DNA, 17 bp, Homo sapiens
ttatcctgaaatttcag

SEQ ID NO: 1495182 - DNA, 22 bp, Homo sapiens
ttatcctgaactcttctgcaaa

SEQ ID NO: 1495183 - DNA, 15 bp, Homo sapiens
ttatcggaagcagtg

SEQ ID NO: 1495184 - DNA, 14 bp, Homo sapiens
ttatcgggaacagt

SEQ ID NO: 1495185 - DNA, 19 bp, Homo sapiens
ttatcgggagcagtgtctt

SEQ ID NO: 1495186 - DNA, 17 bp, Homo sapiens
ttatctagcaagaagat

SEQ ID NO: 1495187 - DNA, 23 bp, Homo sapiens
ttatctatgtggaaaacacaata

SEQ ID NO: 1495188 - DNA, 11 bp, Homo sapiens
ttatctcaaaa

SEQ ID NO: 1495189 - DNA, 14 bp, Homo sapiens
ttatctcaacggaa

SEQ ID NO: 1495190 - DNA, 19 bp, Homo sapiens
ttatctcagatatttgcac

SEQ ID NO: 1495191 - DNA, 20 bp, Homo sapiens
ttatctcttttatatttgta

SEQ ID NO: 1495192 - DNA, 14 bp, Homo sapiens
ttatctgcctggcc

SEQ ID NO: 1495193 - DNA, 22 bp, Homo sapiens
ttatctggaacaacttgtagca

SEQ ID NO: 1495194 - DNA, 12 bp, Homo sapiens
ttatctgtcaca

SEQ ID NO: 1495195 - DNA, 17 bp, Homo sapiens
ttatctgtggagttcct

SEQ ID NO: 1495196 - DNA, 22 bp, Homo sapiens
ttatctgtttcctgacattgtc

SEQ ID NO: 1495197 - DNA, 14 bp, Homo sapiens
ttatctgttttcta

SEQ ID NO: 1495198 - DNA, 18 bp, Homo sapiens
ttatctgttttctacctc

SEQ ID NO: 1495199 - DNA, 14 bp, Homo sapiens
ttatcttatctagc

SEQ ID NO: 1495200 - DNA, 18 bp, Homo sapiens
ttatcttgaaggaaaaat

SEQ ID NO: 1495201 - DNA, 17 bp, Homo sapiens
ttatcttggactgacat

SEQ ID NO: 1495202 - DNA, 14 bp, Homo sapiens
ttatcttgggactg

SEQ ID NO: 1495203 - DNA, 13 bp, Homo sapiens
ttatctttaccaa

SEQ ID NO: 1495204 - DNA, 24 bp, Homo sapiens
ttatctttcgtgataaactttgct

SEQ ID NO: 1495205 - DNA, 15 bp, Homo sapiens
ttatctttctaaaac

SEQ ID NO: 1495206 - DNA, 11 bp, Homo sapiens
ttatctttgat

SEQ ID NO: 1495207 - DNA, 21 bp, Homo sapiens
ttatcttttgtatatctaaga

SEQ ID NO: 1495208 - DNA, 23 bp, Homo sapiens
ttatgaaaaaatatgaacctatt

SEQ ID NO: 1495209 - DNA, 19 bp, Homo sapiens
ttatgaaatgccactggga

SEQ ID NO: 1495210 - DNA, 15 bp, Homo sapiens
ttatgaacattgtac

SEQ ID NO: 1495211 - DNA, 21 bp, Homo sapiens
ttatgaacattgtactgttgc

SEQ ID NO: 1495212 - DNA, 23 bp, Homo sapiens
ttatgaagaaaaagtacaatgaa

SEQ ID NO: 1495213 - DNA, 22 bp, Homo sapiens
ttatgaagaaaatacttaaatg

SEQ ID NO: 1495214 - DNA, 22 bp, Homo sapiens
ttatgaagttaacagtctcatt

SEQ ID NO: 1495215 - DNA, 17 bp, Homo sapiens
ttatgaatatttataac

SEQ ID NO: 1495216 - DNA, 22 bp, Homo sapiens
ttatgaatatttataacagcat

SEQ ID NO: 1495217 - DNA, 11 bp, Homo sapiens
ttatgaatcaa

SEQ ID NO: 1495218 - DNA, 16 bp, Homo sapiens
ttatgaatccaacgtg

SEQ ID NO: 1495219 - DNA, 22 bp, Homo sapiens
ttatgaatccaacgtgtaacca

SEQ ID NO: 1495220 - DNA, 18 bp, Homo sapiens
ttatgacctaagtcaggt

SEQ ID NO: 1495221 - DNA, 13 bp, Homo sapiens
ttatgagaaactt

SEQ ID NO: 1495222 - DNA, 20 bp, Homo sapiens
ttatgagattggttttcctg

SEQ ID NO: 1495223 - DNA, 18 bp, Homo sapiens
ttatgagctacaacaaaa

SEQ ID NO: 1495224 - DNA, 16 bp, Homo sapiens
ttatgagtctttgaga

SEQ ID NO: 1495225 - DNA, 13 bp, Homo sapiens
ttatgagtttttg

SEQ ID NO: 1495226 - DNA, 18 bp, Homo sapiens
ttatgataatagattctc

SEQ ID NO: 1495227 - DNA, 12 bp, Homo sapiens
ttatgatagatt

SEQ ID NO: 1495228 - DNA, 14 bp, Homo sapiens
ttatgatctaataa

SEQ ID NO: 1495229 - DNA, 17 bp, Homo sapiens
ttatgatgcatacagtt

SEQ ID NO: 1495230 - DNA, 13 bp, Homo sapiens
ttatgatgctaag

SEQ ID NO: 1495231 - DNA, 19 bp, Homo sapiens
ttatgatggagcaactgaa

SEQ ID NO: 1495232 - DNA, 20 bp, Homo sapiens
ttatgatggagcaactgaaa

SEQ ID NO: 1495233 - DNA, 20 bp, Homo sapiens
ttatgatggttttaaacttt

SEQ ID NO: 1495234 - DNA, 16 bp, Homo sapiens
ttatgatgtatattta

SEQ ID NO: 1495235 - DNA, 22 bp, Homo sapiens
ttatgcaaaagcagctaaatgt

SEQ ID NO: 1495236 - DNA, 16 bp, Homo sapiens
ttatgcactgcctgcc

SEQ ID NO: 1495237 - DNA, 12 bp, Homo sapiens
ttatgcactgtg

SEQ ID NO: 1495238 - DNA, 23 bp, Homo sapiens
ttatgcagaagcatattttgctg

SEQ ID NO: 1495239 - DNA, 15 bp, Homo sapiens
ttatgcagaatttga

SEQ ID NO: 1495240 - DNA, 18 bp, Homo sapiens
ttatgcagcaaatatatg

SEQ ID NO: 1495241 - DNA, 17 bp, Homo sapiens
ttatgcatgaaatgaat

SEQ ID NO: 1495242 - DNA, 15 bp, Homo sapiens
ttatgcatttcattc

SEQ ID NO: 1495243 - DNA, 13 bp, Homo sapiens
ttatgccactgct

SEQ ID NO: 1495244 - DNA, 16 bp, Homo sapiens
ttatgcctgagttata

SEQ ID NO: 1495245 - DNA, 23 bp, Homo sapiens
ttcacgcctgtaatcccagcact

SEQ ID NO: 1495246 - DNA, 21 bp, Homo sapiens
ttcacgggaactctccaaata

SEQ ID NO: 1495247 - DNA, 20 bp, Homo sapiens
ttcacgtaagatacaagttt

SEQ ID NO: 1495248 - DNA, 23 bp, Homo sapiens
ttcacgtacaaaactctgtataa

SEQ ID NO: 1495249 - DNA, 14 bp, Homo sapiens
ttcactaaagcagt

SEQ ID NO: 1495250 - DNA, 21 bp, Homo sapiens
ttcactaccctgattcttgat

SEQ ID NO: 1495251 - DNA, 18 bp, Homo sapiens
ttcactccagtcaacaga

SEQ ID NO: 1495252 - DNA, 22 bp, Homo sapiens
ttcactccggtgtgcctgcagc

SEQ ID NO: 1495253 - DNA, 23 bp, Homo sapiens
ttcactccggtgtgcctgcagcc

SEQ ID NO: 1495254 - DNA, 10 bp, Homo sapiens
ttcactctcc

SEQ ID NO: 1495255 - DNA, 14 bp, Homo sapiens
ttcactcttccaga

SEQ ID NO: 1495256 - DNA, 18 bp, Homo sapiens
ttcactgaaatgtttgga

SEQ ID NO: 1495257 - DNA, 22 bp, Homo sapiens
ttcactgaccagcggctgctca

SEQ ID NO: 1495258 - DNA, 23 bp, Homo sapiens
ttcactgaccagcggctgctcaa

SEQ ID NO: 1495259 - DNA, 20 bp, Homo sapiens
ttcactgccttcctctctct

SEQ ID NO: 1495260 - DNA, 15 bp, Homo sapiens
ttcactgctggctgc

SEQ ID NO: 1495261 - DNA, 17 bp, Homo sapiens
ttcactggaagatttat

SEQ ID NO: 1495262 - DNA, 19 bp, Homo sapiens
ttcactggagttacattaa

SEQ ID NO: 1495263 - DNA, 13 bp, Homo sapiens
ttcactggcgcct

SEQ ID NO: 1495264 - DNA, 16 bp, Homo sapiens
ttcactggcgccttct

SEQ ID NO: 1495265 - DNA, 17 bp, Homo sapiens
ttcactggcgccttctc

SEQ ID NO: 1495266 - DNA, 11 bp, Homo sapiens
ttcactgtata

SEQ ID NO: 1495267 - DNA, 15 bp, Homo sapiens
ttcactgtatataaa

SEQ ID NO: 1495268 - DNA, 16 bp, Homo sapiens
ttcactgtatataaac

SEQ ID NO: 1495269 - DNA, 17 bp, Homo sapiens
ttcactgtatataaaca

SEQ ID NO: 1495270 - DNA, 20 bp, Homo sapiens
ttcactgtcaccaccctgct

SEQ ID NO: 1495271 - DNA, 22 bp, Homo sapiens
ttcactgtcaggaagaaatcac

SEQ ID NO: 1495272 - DNA, 16 bp, Homo sapiens
ttcactgtcatcttca

SEQ ID NO: 1495273 - DNA, 17 bp, Homo sapiens
ttcactgtcatcttcaa

SEQ ID NO: 1495274 - DNA, 20 bp, Homo sapiens
ttcactgtgctccaacctga

SEQ ID NO: 1495275 - DNA, 13 bp, Homo sapiens
ttcacttaagttt

SEQ ID NO: 1495276 - DNA, 13 bp, Homo sapiens
ttcacttcaaagc

SEQ ID NO: 1495277 - DNA, 20 bp, Homo sapiens
ttcacttcagtttaatgtct

SEQ ID NO: 1495278 - DNA, 12 bp, Homo sapiens
ttcacttcttcc

SEQ ID NO: 1495279 - DNA, 19 bp, Homo sapiens
ttcacttgagcaagatgat

SEQ ID NO: 1495280 - DNA, 21 bp, Homo sapiens
ttcacttgatgatacaatgaa

SEQ ID NO: 1495281 - DNA, 12 bp, Homo sapiens
ttcacttgtatt

SEQ ID NO: 1495282 - DNA, 21 bp, Homo sapiens
ttcacttgtattgactttatg

SEQ ID NO: 1495283 - DNA, 10 bp, Homo sapiens
ttcactttga

SEQ ID NO: 1495284 - DNA, 14 bp, Homo sapiens
ttcactttgaaaaa

SEQ ID NO: 1495285 - DNA, 19 bp, Homo sapiens
ttcagaaagcctttcattt

SEQ ID NO: 1495286 - DNA, 20 bp, Homo sapiens
ttcagaaagcctttcatttt

SEQ ID NO: 1495287 - DNA, 19 bp, Homo sapiens
ttcagaaatacagataaat

SEQ ID NO: 1495288 - DNA, 15 bp, Homo sapiens
ttcagaaatataaca

SEQ ID NO: 1495289 - DNA, 20 bp, Homo sapiens
ttcagaaatataacacattt

SEQ ID NO: 1495290 - DNA, 16 bp, Homo sapiens
ttcagaaatgctgcct

SEQ ID NO: 1495291 - DNA, 18 bp, Homo sapiens
ttcagaaatgctgcctgc

SEQ ID NO: 1495292 - DNA, 21 bp, Homo sapiens
ttcagaaattggaacagaatg

SEQ ID NO: 1495293 - DNA, 22 bp, Homo sapiens
ttcagaacaactgcaaagaaag

SEQ ID NO: 1495294 - DNA, 23 bp, Homo sapiens
ttcagaacacacagactttctgt

SEQ ID NO: 1495295 - DNA, 15 bp, Homo sapiens
ttcagaacctcttcc

SEQ ID NO: 1495296 - DNA, 16 bp, Homo sapiens
ttcagaacctcttccc

SEQ ID NO: 1495297 - DNA, 18 bp, Homo sapiens
ttcagaacctcttcccca

SEQ ID NO: 1495298 - DNA, 22 bp, Homo sapiens
ttcagaactgagggctctgttt

SEQ ID NO: 1495299 - DNA, 13 bp, Homo sapiens
ttcagaagaaatt

SEQ ID NO: 1495300 - DNA, 16 bp, Homo sapiens
ttcagaagacactgca

SEQ ID NO: 1495301 - DNA, 22 bp, Homo sapiens
ttcagaagtgagctttgctgct

SEQ ID NO: 1495302 - DNA, 15 bp, Homo sapiens
ttcagaagttagttt

SEQ ID NO: 1495303 - DNA, 20 bp, Homo sapiens
ttcagaagttagtttgtata

SEQ ID NO: 1495304 - DNA, 24 bp, Homo sapiens
ttcagaatggcagtcctggaggca

SEQ ID NO: 1495305 - DNA, 16 bp, Homo sapiens
ttcagaattaaacttt

SEQ ID NO: 1495306 - DNA, 17 bp, Homo sapiens
ttcagaattaagcagaa

SEQ ID NO: 1495307 - DNA, 13 bp, Homo sapiens
ttcagacaacatt

SEQ ID NO: 1495308 - DNA, 22 bp, Homo sapiens
ttcagacaacattatgatctaa

SEQ ID NO: 1495309 - DNA, 15 bp, Homo sapiens
ttcagacaagcaaca

SEQ ID NO: 1495310 - DNA, 20 bp, Homo sapiens
ttcagacaagcaacaggttt

SEQ ID NO: 1495311 - DNA, 21 bp, Homo sapiens
ttcagacaagcaacaggtttt

SEQ ID NO: 1495312 - DNA, 15 bp, Homo sapiens
ttcagacactttgga

SEQ ID NO: 1495313 - DNA, 10 bp, Homo sapiens
ttcagacagg

SEQ ID NO: 1495314 - DNA, 12 bp, Homo sapiens
ttcagacatttt

SEQ ID NO: 1495315 - DNA, 15 bp, Homo sapiens
ttcagaccccagcgg

SEQ ID NO: 1495316 - DNA, 23 bp, Homo sapiens
ttcagacccccccatttcccgca

SEQ ID NO: 1495317 - DNA, 18 bp, Homo sapiens
ttcagacccctgcctgga

SEQ ID NO: 1495318 - DNA, 13 bp, Homo sapiens
ttcagactcagac

SEQ ID NO: 1495319 - DNA, 23 bp, Homo sapiens
ttcagagaaggccttacagaaaa

SEQ ID NO: 1495320 - DNA, 21 bp, Homo sapiens
ttcagagactcagggccccag

SEQ ID NO: 1495321 - DNA, 19 bp, Homo sapiens
ttcagagagctaaattaca

SEQ ID NO: 1495322 - DNA, 16 bp, Homo sapiens
ttcagagcaagttcct

SEQ ID NO: 1495323 - DNA, 22 bp, Homo sapiens
ttcagagccagtgaaggagcca

SEQ ID NO: 1495324 - DNA, 16 bp, Homo sapiens
ttcagaggctgaggtg

SEQ ID NO: 1495325 - DNA, 14 bp, Homo sapiens
ttcagaggctgcag

SEQ ID NO: 1495326 - DNA, 19 bp, Homo sapiens
ttcagaggctgcaggactt

SEQ ID NO: 1495327 - DNA, 18 bp, Homo sapiens
ttcagagttgtacactgt

SEQ ID NO: 1495328 - DNA, 16 bp, Homo sapiens
ttcagagtttgtgtgt

SEQ ID NO: 1495329 - DNA, 15 bp, Homo sapiens
ttcagatatcaaaat

SEQ ID NO: 1495330 - DNA, 15 bp, Homo sapiens
ttcagatcactgaat

SEQ ID NO: 1495331 - DNA, 16 bp, Homo sapiens
ttcagatcactgaatt

SEQ ID NO: 1495332 - DNA, 17 bp, Homo sapiens
ttcagatcagtgcttga

SEQ ID NO: 1495333 - DNA, 15 bp, Homo sapiens
ttcagatgcttctgg

SEQ ID NO: 1495334 - DNA, 17 bp, Homo sapiens
ttcagatgtcttctgcc

SEQ ID NO: 1495335 - DNA, 20 bp, Homo sapiens
ttcagatgtcttctgcctgt

SEQ ID NO: 1495336 - DNA, 23 bp, Homo sapiens
ttcagatgtcttctgcctgttat

SEQ ID NO: 1495337 - DNA, 13 bp, Homo sapiens
ttcagatgtgcat

SEQ ID NO: 1495338 - DNA, 14 bp, Homo sapiens
ttcagatgtgcatt

SEQ ID NO: 1495339 - DNA, 17 bp, Homo sapiens
ttcagatgtgcatttca

SEQ ID NO: 1495340 - DNA, 21 bp, Homo sapiens
ttcagattttactgtctatgg

SEQ ID NO: 1495341 - DNA, 23 bp, Homo sapiens
ttcagcaacaagactgccaggtg

SEQ ID NO: 1495342 - DNA, 19 bp, Homo sapiens
ttcagcaagttagaactag

SEQ ID NO: 1495343 - DNA, 10 bp, Homo sapiens
ttcagcacac

SEQ ID NO: 1495344 - DNA, 22 bp, Homo sapiens
ttcagcacaggaattctcaaga

SEQ ID NO: 1495345 - DNA, 22 bp, Homo sapiens
ttcagcaccctgggtgccattc

SEQ ID NO: 1495346 - DNA, 16 bp, Homo sapiens
ttcagcactgtccctt

SEQ ID NO: 1495347 - DNA, 13 bp, Homo sapiens
ttcagcagtgcct

SEQ ID NO: 1495348 - DNA, 23 bp, Homo sapiens
ttcagcatccgcaggtgctggtc

SEQ ID NO: 1495349 - DNA, 13 bp, Homo sapiens
ttcagcatgtcca

SEQ ID NO: 1495350 - DNA, 22 bp, Homo sapiens
ttcagcattaagctgttcctgt

SEQ ID NO: 1495351 - DNA, 18 bp, Homo sapiens
ttcagcatttgatttcca

SEQ ID NO: 1495352 - DNA, 17 bp, Homo sapiens
ttcagccactgagggac

SEQ ID NO: 1495353 - DNA, 15 bp, Homo sapiens
ttcagccagcttaaa

SEQ ID NO: 1495354 - DNA, 14 bp, Homo sapiens
ttcagcccccacca

SEQ ID NO: 1495355 - DNA, 21 bp, Homo sapiens
ttcagcccccatcacccaagc

SEQ ID NO: 1495356 - DNA, 14 bp, Homo sapiens
ttcagcccctcctc

SEQ ID NO: 1495357 - DNA, 15 bp, Homo sapiens
ttcagcccctcctct

SEQ ID NO: 1495358 - DNA, 23 bp, Homo sapiens
ttcagcccctcctctgccacctc

SEQ ID NO: 1495359 - DNA, 19 bp, Homo sapiens
ttcccaacgtgcaaagcca

SEQ ID NO: 1495360 - DNA, 23 bp, Homo sapiens
ttcccaagccttcgggcgtctgt

SEQ ID NO: 1495361 - DNA, 17 bp, Homo sapiens
ttcccaagtatgcctta

SEQ ID NO: 1495362 - DNA, 16 bp, Homo sapiens
ttcccaataaaagtga

SEQ ID NO: 1495363 - DNA, 12 bp, Homo sapiens
ttcccaataaat

SEQ ID NO: 1495364 - DNA, 23 bp, Homo sapiens
ttcccaatagcaacgtagcttct

SEQ ID NO: 1495365 - DNA, 17 bp, Homo sapiens
ttcccaatcagcactga

SEQ ID NO: 1495366 - DNA, 18 bp, Homo sapiens
ttcccaatcagcactgaa

SEQ ID NO: 1495367 - DNA, 16 bp, Homo sapiens
ttcccacacctgcctg

SEQ ID NO: 1495368 - DNA, 15 bp, Homo sapiens
ttcccaccagctccc

SEQ ID NO: 1495369 - DNA, 18 bp, Homo sapiens
ttcccaccaggctgctca

SEQ ID NO: 1495370 - DNA, 13 bp, Homo sapiens
ttcccactcacct

SEQ ID NO: 1495371 - DNA, 10 bp, Homo sapiens
ttcccactgc

SEQ ID NO: 1495372 - DNA, 19 bp, Homo sapiens
ttcccactgcactccagcc

SEQ ID NO: 1495373 - DNA, 22 bp, Homo sapiens
ttcccagagacaggaaaatcct

SEQ ID NO: 1495374 - DNA, 14 bp, Homo sapiens
ttcccagaggcaga

SEQ ID NO: 1495375 - DNA, 21 bp, Homo sapiens
ttcccagcagtgggggtcaga

SEQ ID NO: 1495376 - DNA, 12 bp, Homo sapiens
ttcccaggaccc

SEQ ID NO: 1495377 - DNA, 13 bp, Homo sapiens
ttcccaggaccct

SEQ ID NO: 1495378 - DNA, 19 bp, Homo sapiens
ttcccaggaccctgaaggg

SEQ ID NO: 1495379 - DNA, 13 bp, Homo sapiens
ttcccaggagaaa

SEQ ID NO: 1495380 - DNA, 19 bp, Homo sapiens
ttcccaggagaaagatgaa

SEQ ID NO: 1495381 - DNA, 21 bp, Homo sapiens
ttcccaggatctgctccaaca

SEQ ID NO: 1495382 - DNA, 19 bp, Homo sapiens
ttcccaggcccactgtgcc

SEQ ID NO: 1495383 - DNA, 22 bp, Homo sapiens
ttcccaggcccactgtgcctca

SEQ ID NO: 1495384 - DNA, 14 bp, Homo sapiens
ttcccaggcccttt

SEQ ID NO: 1495385 - DNA, 13 bp, Homo sapiens
ttcccatcctacc

SEQ ID NO: 1495386 - DNA, 22 bp, Homo sapiens
ttcccatctggctttttctgcc

SEQ ID NO: 1495387 - DNA, 13 bp, Homo sapiens
ttcccatttagaa

SEQ ID NO: 1495388 - DNA, 14 bp, Homo sapiens
ttcccatttagaat

SEQ ID NO: 1495389 - DNA, 15 bp, Homo sapiens
ttcccatttcagctg

SEQ ID NO: 1495390 - DNA, 14 bp, Homo sapiens
ttcccatttcttcc

SEQ ID NO: 1495391 - DNA, 17 bp, Homo sapiens
ttcccatttgtgccaga

SEQ ID NO: 1495392 - DNA, 19 bp, Homo sapiens
ttcccattttgcaaaattt

SEQ ID NO: 1495393 - DNA, 15 bp, Homo sapiens
ttccccactcccccg

SEQ ID NO: 1495394 - DNA, 16 bp, Homo sapiens
ttccccagacttgcac

SEQ ID NO: 1495395 - DNA, 17 bp, Homo sapiens
ttccccagacttgcact

SEQ ID NO: 1495396 - DNA, 15 bp, Homo sapiens
ttccccaggcccacc

SEQ ID NO: 1495397 - DNA, 16 bp, Homo sapiens
ttccccagggaaggaa

SEQ ID NO: 1495398 - DNA, 18 bp, Homo sapiens
ttcccccaccggtccagc

SEQ ID NO: 1495399 - DNA, 22 bp, Homo sapiens
ttcccccaccggtccagctggc

SEQ ID NO: 1495400 - DNA, 14 bp, Homo sapiens
ttcccccactaccg

SEQ ID NO: 1495401 - DNA, 17 bp, Homo sapiens
ttcccccacttcccctc

SEQ ID NO: 1495402 - DNA, 15 bp, Homo sapiens
ttcccccagcccaat

SEQ ID NO: 1495403 - DNA, 19 bp, Homo sapiens
ttccccctcttcttctgaa

SEQ ID NO: 1495404 - DNA, 13 bp, Homo sapiens
ttcccccttccca

SEQ ID NO: 1495405 - DNA, 17 bp, Homo sapiens
ttcccccttcccatttc

SEQ ID NO: 1495406 - DNA, 23 bp, Homo sapiens
ttcccccttgaggattgtggaaa

SEQ ID NO: 1495407 - DNA, 20 bp, Homo sapiens
ttccccgaagagtcagcccc

SEQ ID NO: 1495408 - DNA, 18 bp, Homo sapiens
ttccccgcaacccacagc

SEQ ID NO: 1495409 - DNA, 16 bp, Homo sapiens
ttccccggtcccttga

SEQ ID NO: 1495410 - DNA, 15 bp, Homo sapiens
ttcccctaagtggat

SEQ ID NO: 1495411 - DNA, 13 bp, Homo sapiens
ttcccctccacca

SEQ ID NO: 1495412 - DNA, 23 bp, Homo sapiens
ttcccctcccaatcctctctccc

SEQ ID NO: 1495413 - DNA, 15 bp, Homo sapiens
ttcccctcccacctc

SEQ ID NO: 1495414 - DNA, 21 bp, Homo sapiens
ttcccctcccccactcctcta

SEQ ID NO: 1495415 - DNA, 21 bp, Homo sapiens
ttcccctcccgattgagcctt

SEQ ID NO: 1495416 - DNA, 17 bp, Homo sapiens
ttcccctccctggctcc

SEQ ID NO: 1495417 - DNA, 17 bp, Homo sapiens
ttcccctccttctccct

SEQ ID NO: 1495418 - DNA, 18 bp, Homo sapiens
ttcccctctgctgctgtc

SEQ ID NO: 1495419 - DNA, 18 bp, Homo sapiens
ttcccctgcacctggcct

SEQ ID NO: 1495420 - DNA, 12 bp, Homo sapiens
ttcccctgggca

SEQ ID NO: 1495421 - DNA, 11 bp, Homo sapiens
ttcccctgtgt

SEQ ID NO: 1495422 - DNA, 12 bp, Homo sapiens
ttcccctgtgtc

SEQ ID NO: 1495423 - DNA, 18 bp, Homo sapiens
ttcccctttactcagccc

SEQ ID NO: 1495424 - DNA, 14 bp, Homo sapiens
ttcccctttcccca

SEQ ID NO: 1495425 - DNA, 17 bp, Homo sapiens
ttcccctttccccactc

SEQ ID NO: 1495426 - DNA, 15 bp, Homo sapiens
ttcccctttcctgtc

SEQ ID NO: 1495427 - DNA, 19 bp, Homo sapiens
ttcccctttcctgtcccac

SEQ ID NO: 1495428 - DNA, 13 bp, Homo sapiens
ttcccgcacatgg

SEQ ID NO: 1495429 - DNA, 14 bp, Homo sapiens
ttcccgcctcggct

SEQ ID NO: 1495430 - DNA, 15 bp, Homo sapiens
ttcccgctcagccct

SEQ ID NO: 1495431 - DNA, 21 bp, Homo sapiens
ttcccgctcagccctccctgc

SEQ ID NO: 1495432 - DNA, 12 bp, Homo sapiens
ttcccgctcccc

SEQ ID NO: 1495433 - DNA, 14 bp, Homo sapiens
ttcccgctccccac

SEQ ID NO: 1495434 - DNA, 21 bp, Homo sapiens
ttcccgctgcacatggacaga

SEQ ID NO: 1495435 - DNA, 17 bp, Homo sapiens
ttcccggagcacagccc

SEQ ID NO: 1495436 - DNA, 20 bp, Homo sapiens
ttcccggagcacagccctgg

SEQ ID NO: 1495437 - DNA, 20 bp, Homo sapiens
ttcccgggataaactgagcc

SEQ ID NO: 1495438 - DNA, 13 bp, Homo sapiens
ttcccgtctcaga

SEQ ID NO: 1495439 - DNA, 23 bp, Homo sapiens
ttccctaaacaaaagcaaagatg

SEQ ID NO: 1495440 - DNA, 21 bp, Homo sapiens
ttccctcaccttggcaccaga

SEQ ID NO: 1495441 - DNA, 12 bp, Homo sapiens
ttccctcagtga

SEQ ID NO: 1495442 - DNA, 11 bp, Homo sapiens
ttccctccccc

SEQ ID NO: 1495443 - DNA, 22 bp, Homo sapiens
ttccctccccctccttgtgcct

SEQ ID NO: 1495444 - DNA, 16 bp, Homo sapiens
ttccctctcagctgct

SEQ ID NO: 1495445 - DNA, 11 bp, Homo sapiens
ttccctctccc

SEQ ID NO: 1495446 - DNA, 14 bp, Homo sapiens
ttccctctcctgct

SEQ ID NO: 1495447 - DNA, 21 bp, Homo sapiens
ttccctctctcataccctccc

SEQ ID NO: 1495448 - DNA, 17 bp, Homo sapiens
ttccctgaaaacccaga

SEQ ID NO: 1495449 - DNA, 19 bp, Homo sapiens
ttccctgaaaacccagaga

SEQ ID NO: 1495450 - DNA, 20 bp, Homo sapiens
ttccctgaaaacccagagag

SEQ ID NO: 1495451 - DNA, 18 bp, Homo sapiens
ttccctgaacgttttctt

SEQ ID NO: 1495452 - DNA, 13 bp, Homo sapiens
ttccctgaatctg

SEQ ID NO: 1495453 - DNA, 21 bp, Homo sapiens
ttccctgaatctgtgcctgca

SEQ ID NO: 1495454 - DNA, 11 bp, Homo sapiens
ttccctgcacc

SEQ ID NO: 1495455 - DNA, 12 bp, Homo sapiens
ttccctgccact

SEQ ID NO: 1495456 - DNA, 14 bp, Homo sapiens
ttccctgcctctca

SEQ ID NO: 1495457 - DNA, 18 bp, Homo sapiens
ttccctgccttgctgaca

SEQ ID NO: 1495458 - DNA, 17 bp, Homo sapiens
ttccctgctttgcatct

SEQ ID NO: 1495459 - DNA, 18 bp, Homo sapiens
ttccctgctttgcatctt

SEQ ID NO: 1495460 - DNA, 21 bp, Homo sapiens
ttccctggaactcctggcctt

SEQ ID NO: 1495461 - DNA, 19 bp, Homo sapiens
ttccctggaggagaagtat

SEQ ID NO: 1495462 - DNA, 24 bp, Homo sapiens
ttccctggctacttcccttcctcc

SEQ ID NO: 1495463 - DNA, 17 bp, Homo sapiens
ttccctgggctgtgcta

SEQ ID NO: 1495464 - DNA, 20 bp, Homo sapiens
ttccctgggctgtgctacct

SEQ ID NO: 1495465 - DNA, 16 bp, Homo sapiens
ttccctggtccctctg

SEQ ID NO: 1495466 - DNA, 14 bp, Homo sapiens
ttccctgtcagagg

SEQ ID NO: 1495467 - DNA, 16 bp, Homo sapiens
ttccctgtcagaggct

SEQ ID NO: 1495468 - DNA, 13 bp, Homo sapiens
ttccctgttgaat

SEQ ID NO: 1495469 - DNA, 15 bp, Homo sapiens
ttcccttaaatacag

SEQ ID NO: 1495470 - DNA, 17 bp, Homo sapiens
ttcccttaactccaaga

SEQ ID NO: 1495471 - DNA, 14 bp, Homo sapiens
ttcccttagcctct

SEQ ID NO: 1495472 - DNA, 21 bp, Homo sapiens
ttcccttagcctctcccaccc

SEQ ID NO: 1495473 - DNA, 14 bp, Homo sapiens
ttcccttattgcct

SEQ ID NO: 1495474 - DNA, 21 bp, Homo sapiens
ttcccttattgcctcccaggc

SEQ ID NO: 1495475 - DNA, 18 bp, Homo sapiens
ttcgtatgatcagtactg

SEQ ID NO: 1495476 - DNA, 21 bp, Homo sapiens
ttcgtatgcactcccttgagg

SEQ ID NO: 1495477 - DNA, 16 bp, Homo sapiens
ttcgtcactcaaatga

SEQ ID NO: 1495478 - DNA, 12 bp, Homo sapiens
ttcgtctgtccc

SEQ ID NO: 1495479 - DNA, 13 bp, Homo sapiens
ttcgtctgtccca

SEQ ID NO: 1495480 - DNA, 14 bp, Homo sapiens
ttcgtcttctaatt

SEQ ID NO: 1495481 - DNA, 16 bp, Homo sapiens
ttcgtcttctaatttc

SEQ ID NO: 1495482 - DNA, 18 bp, Homo sapiens
ttcgtgaacatagagttt

SEQ ID NO: 1495483 - DNA, 20 bp, Homo sapiens
ttcgtgaacatagagtttgg

SEQ ID NO: 1495484 - DNA, 18 bp, Homo sapiens
ttcgtgaagtatactgta

SEQ ID NO: 1495485 - DNA, 15 bp, Homo sapiens
ttcgtgcactctgct

SEQ ID NO: 1495486 - DNA, 13 bp, Homo sapiens
ttcgtgcattttt

SEQ ID NO: 1495487 - DNA, 17 bp, Homo sapiens
ttcgtggtgatcaatta

SEQ ID NO: 1495488 - DNA, 20 bp, Homo sapiens
ttcgtgtagtggaagagcag

SEQ ID NO: 1495489 - DNA, 17 bp, Homo sapiens
ttcgtgtctctcccacc

SEQ ID NO: 1495490 - DNA, 17 bp, Homo sapiens
ttcgttctgtactgtta

SEQ ID NO: 1495491 - DNA, 20 bp, Homo sapiens
ttcgttgtgttttttaagat

SEQ ID NO: 1495492 - DNA, 20 bp, Homo sapiens
ttcgtttccatcatgtctgt

SEQ ID NO: 1495493 - DNA, 14 bp, Homo sapiens
ttcgtttctgtata

SEQ ID NO: 1495494 - DNA, 16 bp, Homo sapiens
ttcgtttctgtataca

SEQ ID NO: 1495495 - DNA, 19 bp, Homo sapiens
ttctaaaacttgtatgttt

SEQ ID NO: 1495496 - DNA, 13 bp, Homo sapiens
ttctaaaagccat

SEQ ID NO: 1495497 - DNA, 14 bp, Homo sapiens
ttctaaaagccatt

SEQ ID NO: 1495498 - DNA, 18 bp, Homo sapiens
ttctaaaatcatgaaact

SEQ ID NO: 1495499 - DNA, 21 bp, Homo sapiens
ttctaaaatcttatagttcta

SEQ ID NO: 1495500 - DNA, 15 bp, Homo sapiens
ttctaaaatgtgatg

SEQ ID NO: 1495501 - DNA, 12 bp, Homo sapiens
ttctaaacattt

SEQ ID NO: 1495502 - DNA, 14 bp, Homo sapiens
ttctaaacattttt

SEQ ID NO: 1495503 - DNA, 14 bp, Homo sapiens
ttctaaactgtttt

SEQ ID NO: 1495504 - DNA, 19 bp, Homo sapiens
ttctaaactgttttcatgt

SEQ ID NO: 1495505 - DNA, 12 bp, Homo sapiens
ttctaaagatag

SEQ ID NO: 1495506 - DNA, 12 bp, Homo sapiens
ttctaaagattc

SEQ ID NO: 1495507 - DNA, 13 bp, Homo sapiens
ttctaaagattct

SEQ ID NO: 1495508 - DNA, 14 bp, Homo sapiens
ttctaaagattcta

SEQ ID NO: 1495509 - DNA, 22 bp, Homo sapiens
ttctaaagattctatagttcta

SEQ ID NO: 1495510 - DNA, 16 bp, Homo sapiens
ttctaaagctctgaca

SEQ ID NO: 1495511 - DNA, 17 bp, Homo sapiens
ttctaaagctctgacat

SEQ ID NO: 1495512 - DNA, 22 bp, Homo sapiens
ttctaaaggtaccaaacaagga

SEQ ID NO: 1495513 - DNA, 12 bp, Homo sapiens
ttctaaagttct

SEQ ID NO: 1495514 - DNA, 13 bp, Homo sapiens
ttctaaagttcta

SEQ ID NO: 1495515 - DNA, 14 bp, Homo sapiens
ttctaaagttctaa

SEQ ID NO: 1495516 - DNA, 16 bp, Homo sapiens
ttctaaagttctaaga

SEQ ID NO: 1495517 - DNA, 18 bp, Homo sapiens
ttctaaataaaaatatgt

SEQ ID NO: 1495518 - DNA, 20 bp, Homo sapiens
ttctaaataaatttcccagt

SEQ ID NO: 1495519 - DNA, 13 bp, Homo sapiens
ttctaaatagcaa

SEQ ID NO: 1495520 - DNA, 22 bp, Homo sapiens
ttctaaatccgacttgaatatt

SEQ ID NO: 1495521 - DNA, 18 bp, Homo sapiens
ttctaaatgaatgtttac

SEQ ID NO: 1495522 - DNA, 13 bp, Homo sapiens
ttctaaatgcata

SEQ ID NO: 1495523 - DNA, 23 bp, Homo sapiens
ttctaaatgcatatcctgagcca

SEQ ID NO: 1495524 - DNA, 15 bp, Homo sapiens
ttctaaatgttatta

SEQ ID NO: 1495525 - DNA, 22 bp, Homo sapiens
ttctaaatgttattacttgtaa

SEQ ID NO: 1495526 - DNA, 23 bp, Homo sapiens
ttctaaatgttattacttgtaaa

SEQ ID NO: 1495527 - DNA, 12 bp, Homo sapiens
ttctaagaagac

SEQ ID NO: 1495528 - DNA, 14 bp, Homo sapiens
ttctaagaagacat

SEQ ID NO: 1495529 - DNA, 13 bp, Homo sapiens
ttctaagactcaa

SEQ ID NO: 1495530 - DNA, 20 bp, Homo sapiens
ttctaagacttactctaaga

SEQ ID NO: 1495531 - DNA, 21 bp, Homo sapiens
ttctaagacttactctaagat

SEQ ID NO: 1495532 - DNA, 18 bp, Homo sapiens
ttctaagagaagttattt

SEQ ID NO: 1495533 - DNA, 23 bp, Homo sapiens
ttctaagatgtgatattctaaga

SEQ ID NO: 1495534 - DNA, 14 bp, Homo sapiens
ttctaagattctaa

SEQ ID NO: 1495535 - DNA, 16 bp, Homo sapiens
ttctaagattctaaag

SEQ ID NO: 1495536 - DNA, 19 bp, Homo sapiens
ttctaagattctaatgatg

SEQ ID NO: 1495537 - DNA, 19 bp, Homo sapiens
ttctaagcaatgcaaatgt

SEQ ID NO: 1495538 - DNA, 13 bp, Homo sapiens
ttctaagccctgt

SEQ ID NO: 1495539 - DNA, 14 bp, Homo sapiens
ttctaagcttattt

SEQ ID NO: 1495540 - DNA, 22 bp, Homo sapiens
ttctaaggaaatggagaagctc

SEQ ID NO: 1495541 - DNA, 22 bp, Homo sapiens
ttctaaggacctgaaattccaa

SEQ ID NO: 1495542 - DNA, 15 bp, Homo sapiens
ttctaaggcctagga

SEQ ID NO: 1495543 - DNA, 20 bp, Homo sapiens
ttctaaggctctgagagtct

SEQ ID NO: 1495544 - DNA, 23 bp, Homo sapiens
ttctaaggtccggtgttctaaga

SEQ ID NO: 1495545 - DNA, 18 bp, Homo sapiens
ttctaagttatttacttt

SEQ ID NO: 1495546 - DNA, 19 bp, Homo sapiens
ttctaagttatttactttt

SEQ ID NO: 1495547 - DNA, 13 bp, Homo sapiens
ttctaagtttcta

SEQ ID NO: 1495548 - DNA, 17 bp, Homo sapiens
ttctaagtttctaagat

SEQ ID NO: 1495549 - DNA, 21 bp, Homo sapiens
ttctaagtttctaagattcta

SEQ ID NO: 1495550 - DNA, 19 bp, Homo sapiens
ttctaatacactctaaatt

SEQ ID NO: 1495551 - DNA, 15 bp, Homo sapiens
ttctaatccttttcc

SEQ ID NO: 1495552 - DNA, 13 bp, Homo sapiens
ttctaatgatgat

SEQ ID NO: 1495553 - DNA, 18 bp, Homo sapiens
ttctaatgccttttgaat

SEQ ID NO: 1495554 - DNA, 17 bp, Homo sapiens
ttctaatggaatggttt

SEQ ID NO: 1495555 - DNA, 13 bp, Homo sapiens
ttctaattaaaga

SEQ ID NO: 1495556 - DNA, 23 bp, Homo sapiens
ttctaattccacaggtcatcaga

SEQ ID NO: 1495557 - DNA, 22 bp, Homo sapiens
ttctaattggtttttactgaaa

SEQ ID NO: 1495558 - DNA, 21 bp, Homo sapiens
ttctaatttcaaaaatataac

SEQ ID NO: 1495559 - DNA, 15 bp, Homo sapiens
ttctaatttttaaga

SEQ ID NO: 1495560 - DNA, 17 bp, Homo sapiens
ttctacaattaatagtt

SEQ ID NO: 1495561 - DNA, 13 bp, Homo sapiens
ttctacacagtaa

SEQ ID NO: 1495562 - DNA, 21 bp, Homo sapiens
ttctacagtggttttatactg

SEQ ID NO: 1495563 - DNA, 15 bp, Homo sapiens
ttctacataattgtg

SEQ ID NO: 1495564 - DNA, 14 bp, Homo sapiens
ttctacatttcacc

SEQ ID NO: 1495565 - DNA, 19 bp, Homo sapiens
ttctaccgtggatttgtac

SEQ ID NO: 1495566 - DNA, 13 bp, Homo sapiens
ttctacctgccct

SEQ ID NO: 1495567 - DNA, 23 bp, Homo sapiens
ttctacctgtacacattcctgca

SEQ ID NO: 1495568 - DNA, 22 bp, Homo sapiens
ttctacgcaattgacaaacccg

SEQ ID NO: 1495569 - DNA, 20 bp, Homo sapiens
ttctacggatcatcaacaag

SEQ ID NO: 1495570 - DNA, 22 bp, Homo sapiens
ttctacggatcatcaacaagat

SEQ ID NO: 1495571 - DNA, 12 bp, Homo sapiens
ttctactcccct

SEQ ID NO: 1495572 - DNA, 13 bp, Homo sapiens
ttctactgctctc

SEQ ID NO: 1495573 - DNA, 20 bp, Homo sapiens
ttctactgctctcctccacc

SEQ ID NO: 1495574 - DNA, 22 bp, Homo sapiens
ttctactttgcccctttcagta

SEQ ID NO: 1495575 - DNA, 18 bp, Homo sapiens
ttctagaagcacatgtgt

SEQ ID NO: 1495576 - DNA, 20 bp, Homo sapiens
ttctagaaggtctccaagac

SEQ ID NO: 1495577 - DNA, 20 bp, Homo sapiens
ttctagacatggaggttcta

SEQ ID NO: 1495578 - DNA, 22 bp, Homo sapiens
ttctagacatggaggttctaag

SEQ ID NO: 1495579 - DNA, 17 bp, Homo sapiens
ttctagacgcccctccc

SEQ ID NO: 1495580 - DNA, 21 bp, Homo sapiens
ttctagacgcccctcccaagc

SEQ ID NO: 1495581 - DNA, 22 bp, Homo sapiens
ttctagactcaaaacctggaga

SEQ ID NO: 1495582 - DNA, 11 bp, Homo sapiens
ttctagagaca

SEQ ID NO: 1495583 - DNA, 14 bp, Homo sapiens
ttctagagacacat

SEQ ID NO: 1495584 - DNA, 22 bp, Homo sapiens
ttctagagttttatagcctgga

SEQ ID NO: 1495585 - DNA, 12 bp, Homo sapiens
ttctagatgatt

SEQ ID NO: 1495586 - DNA, 17 bp, Homo sapiens
ttctagcaccttatcta

SEQ ID NO: 1495587 - DNA, 14 bp, Homo sapiens
ttctagcagagtga

SEQ ID NO: 1495588 - DNA, 18 bp, Homo sapiens
ttctagcatggcatattt

SEQ ID NO: 1495589 - DNA, 16 bp, Homo sapiens
ttctagctagaaatat

SEQ ID NO: 1495590 - DNA, 22 bp, Homo sapiens
ttctgcaagcacatctgcattt

SEQ ID NO: 1495591 - DNA, 13 bp, Homo sapiens
ttctgcaccctcc

SEQ ID NO: 1495592 - DNA, 15 bp, Homo sapiens
ttctgcactgaaaag

SEQ ID NO: 1495593 - DNA, 14 bp, Homo sapiens
ttctgcagctgttt

SEQ ID NO: 1495594 - DNA, 15 bp, Homo sapiens
ttctgcagctgtttc

SEQ ID NO: 1495595 - DNA, 16 bp, Homo sapiens
ttctgcatcagctgct

SEQ ID NO: 1495596 - DNA, 19 bp, Homo sapiens
ttctgcatggattcagcat

SEQ ID NO: 1495597 - DNA, 20 bp, Homo sapiens
ttctgcattgctagataaaa

SEQ ID NO: 1495598 - DNA, 22 bp, Homo sapiens
ttctgcattgctagataaaagc

SEQ ID NO: 1495599 - DNA, 16 bp, Homo sapiens
ttctgccactgaggag

SEQ ID NO: 1495600 - DNA, 10 bp, Homo sapiens
ttctgccagc

SEQ ID NO: 1495601 - DNA, 16 bp, Homo sapiens
ttctgccagggagctt

SEQ ID NO: 1495602 - DNA, 23 bp, Homo sapiens
ttctgcccacgatcccctccccc

SEQ ID NO: 1495603 - DNA, 16 bp, Homo sapiens
ttctgccctgcctgag

SEQ ID NO: 1495604 - DNA, 17 bp, Homo sapiens
ttctgccctgcctgagg

SEQ ID NO: 1495605 - DNA, 19 bp, Homo sapiens
ttctgccctggctgctgcc

SEQ ID NO: 1495606 - DNA, 16 bp, Homo sapiens
ttctgccgtgtgccct

SEQ ID NO: 1495607 - DNA, 17 bp, Homo sapiens
ttctgcctgagattctt

SEQ ID NO: 1495608 - DNA, 18 bp, Homo sapiens
ttctgcctgagattcttt

SEQ ID NO: 1495609 - DNA, 16 bp, Homo sapiens
ttctgcctgccagctg

SEQ ID NO: 1495610 - DNA, 14 bp, Homo sapiens
ttctgccttctcat

SEQ ID NO: 1495611 - DNA, 20 bp, Homo sapiens
ttctgcctttagcctggacc

SEQ ID NO: 1495612 - DNA, 15 bp, Homo sapiens
ttctgcctttgatgt

SEQ ID NO: 1495613 - DNA, 18 bp, Homo sapiens
ttctgcgctgtgtacaat

SEQ ID NO: 1495614 - DNA, 17 bp, Homo sapiens
ttctgctaagttctccc

SEQ ID NO: 1495615 - DNA, 16 bp, Homo sapiens
ttctgctacctcactg

SEQ ID NO: 1495616 - DNA, 22 bp, Homo sapiens
ttctgctacttcactgtcatct

SEQ ID NO: 1495617 - DNA, 17 bp, Homo sapiens
ttctgctccacccttgg

SEQ ID NO: 1495618 - DNA, 18 bp, Homo sapiens
ttctgctccacccttggc

SEQ ID NO: 1495619 - DNA, 15 bp, Homo sapiens
ttctgctctgccatc

SEQ ID NO: 1495620 - DNA, 13 bp, Homo sapiens
ttctgctctggaa

SEQ ID NO: 1495621 - DNA, 21 bp, Homo sapiens
ttctgctcttccaaagctcct

SEQ ID NO: 1495622 - DNA, 16 bp, Homo sapiens
ttctgctcttttcctg

SEQ ID NO: 1495623 - DNA, 13 bp, Homo sapiens
ttctgctgcccct

SEQ ID NO: 1495624 - DNA, 13 bp, Homo sapiens
ttctgctggataa

SEQ ID NO: 1495625 - DNA, 18 bp, Homo sapiens
ttctgcttgtgttaagta

SEQ ID NO: 1495626 - DNA, 13 bp, Homo sapiens
ttctgcttttctg

SEQ ID NO: 1495627 - DNA, 18 bp, Homo sapiens
ttctgcttttctgccctg

SEQ ID NO: 1495628 - DNA, 17 bp, Homo sapiens
ttctggaaatccagata

SEQ ID NO: 1495629 - DNA, 15 bp, Homo sapiens
ttctggaactgtctg

SEQ ID NO: 1495630 - DNA, 18 bp, Homo sapiens
ttctggaaggctggctga

SEQ ID NO: 1495631 - DNA, 17 bp, Homo sapiens
ttctggaatacatgaaa

SEQ ID NO: 1495632 - DNA, 22 bp, Homo sapiens
ttctggaatgtaatcaatgttt

SEQ ID NO: 1495633 - DNA, 18 bp, Homo sapiens
ttctggaatttgttcaag

SEQ ID NO: 1495634 - DNA, 21 bp, Homo sapiens
ttctggaatttgttcaagttt

SEQ ID NO: 1495635 - DNA, 12 bp, Homo sapiens
ttctggacattc

SEQ ID NO: 1495636 - DNA, 20 bp, Homo sapiens
ttctggactacacccaagcc

SEQ ID NO: 1495637 - DNA, 16 bp, Homo sapiens
ttctggactctgcccc

SEQ ID NO: 1495638 - DNA, 17 bp, Homo sapiens
ttctggactctgcccca

SEQ ID NO: 1495639 - DNA, 18 bp, Homo sapiens
ttctggacttggtcttga

SEQ ID NO: 1495640 - DNA, 17 bp, Homo sapiens
ttctggagatggaagct

SEQ ID NO: 1495641 - DNA, 22 bp, Homo sapiens
ttctggagatggaagcttgttg

SEQ ID NO: 1495642 - DNA, 21 bp, Homo sapiens
ttctggagcagaactttccag

SEQ ID NO: 1495643 - DNA, 10 bp, Homo sapiens
ttctggagcc

SEQ ID NO: 1495644 - DNA, 20 bp, Homo sapiens
ttctggagctgggagacaaa

SEQ ID NO: 1495645 - DNA, 23 bp, Homo sapiens
ttctggagtcacatcagtgagga

SEQ ID NO: 1495646 - DNA, 13 bp, Homo sapiens
ttctggatccatg

SEQ ID NO: 1495647 - DNA, 18 bp, Homo sapiens
ttctggatctcctgctgc

SEQ ID NO: 1495648 - DNA, 22 bp, Homo sapiens
ttctggatggccgggctgctgc

SEQ ID NO: 1495649 - DNA, 15 bp, Homo sapiens
ttctggcaaacgttt

SEQ ID NO: 1495650 - DNA, 16 bp, Homo sapiens
ttctggccagtgttta

SEQ ID NO: 1495651 - DNA, 14 bp, Homo sapiens
ttctggcctgcctt

SEQ ID NO: 1495652 - DNA, 16 bp, Homo sapiens
ttctggctctcccatt

SEQ ID NO: 1495653 - DNA, 19 bp, Homo sapiens
ttctggctgaacactggca

SEQ ID NO: 1495654 - DNA, 20 bp, Homo sapiens
ttctggctgccccaacctgc

SEQ ID NO: 1495655 - DNA, 16 bp, Homo sapiens
ttctggcttcagcccc

SEQ ID NO: 1495656 - DNA, 18 bp, Homo sapiens
ttctggctttaagccttc

SEQ ID NO: 1495657 - DNA, 21 bp, Homo sapiens
ttctggcttttttgtggggtt

SEQ ID NO: 1495658 - DNA, 16 bp, Homo sapiens
ttctgggaactctcct

SEQ ID NO: 1495659 - DNA, 22 bp, Homo sapiens
ttctgggaagcttgagcctccc

SEQ ID NO: 1495660 - DNA, 16 bp, Homo sapiens
ttctgggatgtcacag

SEQ ID NO: 1495661 - DNA, 15 bp, Homo sapiens
ttctgggcctgacca

SEQ ID NO: 1495662 - DNA, 16 bp, Homo sapiens
ttctgggcttcatctg

SEQ ID NO: 1495663 - DNA, 19 bp, Homo sapiens
ttctggggcaggctgggcc

SEQ ID NO: 1495664 - DNA, 16 bp, Homo sapiens
ttctggggctgtgtta

SEQ ID NO: 1495665 - DNA, 20 bp, Homo sapiens
ttctggggggacccagtgca

SEQ ID NO: 1495666 - DNA, 21 bp, Homo sapiens
ttctgggggtaggatgaagag

SEQ ID NO: 1495667 - DNA, 19 bp, Homo sapiens
ttctgggtggggcagtggg

SEQ ID NO: 1495668 - DNA, 17 bp, Homo sapiens
ttctggtactttctgtt

SEQ ID NO: 1495669 - DNA, 22 bp, Homo sapiens
ttctggtcaagggctgtcattg

SEQ ID NO: 1495670 - DNA, 22 bp, Homo sapiens
ttctggtgctactccatgcagg

SEQ ID NO: 1495671 - DNA, 19 bp, Homo sapiens
ttctggtggggctgtcctg

SEQ ID NO: 1495672 - DNA, 23 bp, Homo sapiens
ttctggtggggctgtcctgctgc

SEQ ID NO: 1495673 - DNA, 17 bp, Homo sapiens
ttctggtgtgttaacat

SEQ ID NO: 1495674 - DNA, 13 bp, Homo sapiens
ttctggtgttcct

SEQ ID NO: 1495675 - DNA, 14 bp, Homo sapiens
ttctggttccattt

SEQ ID NO: 1495676 - DNA, 18 bp, Homo sapiens
ttctggttgtatttctat

SEQ ID NO: 1495677 - DNA, 23 bp, Homo sapiens
ttctgtaactattgggtgaatat

SEQ ID NO: 1495678 - DNA, 16 bp, Homo sapiens
ttctgtaatgtaaata

SEQ ID NO: 1495679 - DNA, 13 bp, Homo sapiens
ttctgtaattgtg

SEQ ID NO: 1495680 - DNA, 12 bp, Homo sapiens
ttctgtaccagt

SEQ ID NO: 1495681 - DNA, 14 bp, Homo sapiens
ttctgtaccagtta

SEQ ID NO: 1495682 - DNA, 18 bp, Homo sapiens
ttctgtagcctaaaacga

SEQ ID NO: 1495683 - DNA, 16 bp, Homo sapiens
ttctgtaggttctgtg

SEQ ID NO: 1495684 - DNA, 18 bp, Homo sapiens
ttctgtaggtttctctct

SEQ ID NO: 1495685 - DNA, 20 bp, Homo sapiens
ttctgtagtactccttaaga

SEQ ID NO: 1495686 - DNA, 21 bp, Homo sapiens
ttctgtagtactccttaagaa

SEQ ID NO: 1495687 - DNA, 15 bp, Homo sapiens
ttctgtagttgcagc

SEQ ID NO: 1495688 - DNA, 21 bp, Homo sapiens
ttctgtataaagcctgtattc

SEQ ID NO: 1495689 - DNA, 21 bp, Homo sapiens
ttctgtatacaaccctggcat

SEQ ID NO: 1495690 - DNA, 23 bp, Homo sapiens
ttctgtatacaaccctggcatta

SEQ ID NO: 1495691 - DNA, 22 bp, Homo sapiens
ttctgtatatgattctctgtgg

SEQ ID NO: 1495692 - DNA, 22 bp, Homo sapiens
ttctgtatccgtgaattgcttt

SEQ ID NO: 1495693 - DNA, 20 bp, Homo sapiens
ttctgtatttttttttctaa

SEQ ID NO: 1495694 - DNA, 22 bp, Homo sapiens
ttctgtatttttttttctaaga

SEQ ID NO: 1495695 - DNA, 13 bp, Homo sapiens
ttctgtcctgggc

SEQ ID NO: 1495696 - DNA, 23 bp, Homo sapiens
ttctgtccttttggcactgagat

SEQ ID NO: 1495697 - DNA, 18 bp, Homo sapiens
ttctgtctagactggcct

SEQ ID NO: 1495698 - DNA, 15 bp, Homo sapiens
ttctgtctcccttct

SEQ ID NO: 1495699 - DNA, 22 bp, Homo sapiens
ttctgtctctaaccattcaaat

SEQ ID NO: 1495700 - DNA, 17 bp, Homo sapiens
ttctgtcttctacagat

SEQ ID NO: 1495701 - DNA, 21 bp, Homo sapiens
ttctgtcttgttcattttgag

SEQ ID NO: 1495702 - DNA, 22 bp, Homo sapiens
ttctgtcttgttcattttgagt

SEQ ID NO: 1495703 - DNA, 14 bp, Homo sapiens
ttctgtgaaattct

SEQ ID NO: 1495704 - DNA, 15 bp, Homo sapiens
ttgatgtatgtgtga

SEQ ID NO: 1495705 - DNA, 11 bp, Homo sapiens
ttgatgtgttt

SEQ ID NO: 1495706 - DNA, 20 bp, Homo sapiens
ttgatgtgtttatttataga

SEQ ID NO: 1495707 - DNA, 23 bp, Homo sapiens
ttgatgttaacaagaggggaaaa

SEQ ID NO: 1495708 - DNA, 14 bp, Homo sapiens
ttgatgttacagat

SEQ ID NO: 1495709 - DNA, 14 bp, Homo sapiens
ttgatgttccttcc

SEQ ID NO: 1495710 - DNA, 16 bp, Homo sapiens
ttgatgtttgtggcct

SEQ ID NO: 1495711 - DNA, 14 bp, Homo sapiens
ttgattaacaatgt

SEQ ID NO: 1495712 - DNA, 20 bp, Homo sapiens
ttgattatcttcagcccagg

SEQ ID NO: 1495713 - DNA, 17 bp, Homo sapiens
ttgattcagcaaaaatc

SEQ ID NO: 1495714 - DNA, 14 bp, Homo sapiens
ttgattcagcctgt

SEQ ID NO: 1495715 - DNA, 16 bp, Homo sapiens
ttgattcattttcctg

SEQ ID NO: 1495716 - DNA, 18 bp, Homo sapiens
ttgattcctggtttgact

SEQ ID NO: 1495717 - DNA, 23 bp, Homo sapiens
ttgattcggtatccccccatctt

SEQ ID NO: 1495718 - DNA, 13 bp, Homo sapiens
ttgattctccttc

SEQ ID NO: 1495719 - DNA, 17 bp, Homo sapiens
ttgattgggaaaacatt

SEQ ID NO: 1495720 - DNA, 14 bp, Homo sapiens
ttgatttcaaagtt

SEQ ID NO: 1495721 - DNA, 14 bp, Homo sapiens
ttgatttccatctt

SEQ ID NO: 1495722 - DNA, 15 bp, Homo sapiens
ttgatttccatctta

SEQ ID NO: 1495723 - DNA, 15 bp, Homo sapiens
ttgattttaaaatgt

SEQ ID NO: 1495724 - DNA, 18 bp, Homo sapiens
ttgattttaaaatgtaca

SEQ ID NO: 1495725 - DNA, 23 bp, Homo sapiens
ttgattttacaattgaaatgact

SEQ ID NO: 1495726 - DNA, 20 bp, Homo sapiens
ttgattttcaagctttcaaa

SEQ ID NO: 1495727 - DNA, 20 bp, Homo sapiens
ttgatttttctcttcatttt

SEQ ID NO: 1495728 - DNA, 13 bp, Homo sapiens
ttgcaaatacctc

SEQ ID NO: 1495729 - DNA, 15 bp, Homo sapiens
ttgcaaattattcta

SEQ ID NO: 1495730 - DNA, 18 bp, Homo sapiens
ttgcaaattattctagtc

SEQ ID NO: 1495731 - DNA, 13 bp, Homo sapiens
ttgcaacaaaata

SEQ ID NO: 1495732 - DNA, 21 bp, Homo sapiens
ttgcaacagactgttgagtta

SEQ ID NO: 1495733 - DNA, 22 bp, Homo sapiens
ttgcaacaggggaggaaaaaag

SEQ ID NO: 1495734 - DNA, 23 bp, Homo sapiens
ttgcaacaggggaggaaaaaaga

SEQ ID NO: 1495735 - DNA, 12 bp, Homo sapiens
ttgcaaccactg

SEQ ID NO: 1495736 - DNA, 18 bp, Homo sapiens
ttgcaaccaggaacagca

SEQ ID NO: 1495737 - DNA, 18 bp, Homo sapiens
ttgcaacctctttgctca

SEQ ID NO: 1495738 - DNA, 20 bp, Homo sapiens
ttgcaactcgaactgctttc

SEQ ID NO: 1495739 - DNA, 14 bp, Homo sapiens
ttgcaagatgtgaa

SEQ ID NO: 1495740 - DNA, 15 bp, Homo sapiens
ttgcaagatgtgaat

SEQ ID NO: 1495741 - DNA, 14 bp, Homo sapiens
ttgcaaggccgctg

SEQ ID NO: 1495742 - DNA, 17 bp, Homo sapiens
ttgcaaggccgctgttc

SEQ ID NO: 1495743 - DNA, 14 bp, Homo sapiens
ttgcaataacttct

SEQ ID NO: 1495744 - DNA, 15 bp, Homo sapiens
ttgcaataacttcta

SEQ ID NO: 1495745 - DNA, 15 bp, Homo sapiens
ttgcaataccaagta

SEQ ID NO: 1495746 - DNA, 20 bp, Homo sapiens
ttgcacaatattgaactttt

SEQ ID NO: 1495747 - DNA, 21 bp, Homo sapiens
ttgcacaatattgaacttttt

SEQ ID NO: 1495748 - DNA, 21 bp, Homo sapiens
ttgcacaccttttccccagga

SEQ ID NO: 1495749 - DNA, 17 bp, Homo sapiens
ttgcacacttccccatc

SEQ ID NO: 1495750 - DNA, 13 bp, Homo sapiens
ttgcacacttgtg

SEQ ID NO: 1495751 - DNA, 19 bp, Homo sapiens
ttgcacagccaaatttaaa

SEQ ID NO: 1495752 - DNA, 21 bp, Homo sapiens
ttgcacagtcactgctcttca

SEQ ID NO: 1495753 - DNA, 13 bp, Homo sapiens
ttgcacagtgtgt

SEQ ID NO: 1495754 - DNA, 12 bp, Homo sapiens
ttgcaccaaaga

SEQ ID NO: 1495755 - DNA, 16 bp, Homo sapiens
ttgcaccatctgcttg

SEQ ID NO: 1495756 - DNA, 22 bp, Homo sapiens
ttgcaccccaaagctttcctgc

SEQ ID NO: 1495757 - DNA, 12 bp, Homo sapiens
ttgcacccctcc

SEQ ID NO: 1495758 - DNA, 13 bp, Homo sapiens
ttgcacccctccc

SEQ ID NO: 1495759 - DNA, 14 bp, Homo sapiens
ttgcacccctccca

SEQ ID NO: 1495760 - DNA, 16 bp, Homo sapiens
ttgcaccgcctgccct

SEQ ID NO: 1495761 - DNA, 17 bp, Homo sapiens
ttgcaccgtcctcagca

SEQ ID NO: 1495762 - DNA, 17 bp, Homo sapiens
ttgcacctacctcacag

SEQ ID NO: 1495763 - DNA, 16 bp, Homo sapiens
ttgcacctgcaggctt

SEQ ID NO: 1495764 - DNA, 15 bp, Homo sapiens
ttgcactaactgctg

SEQ ID NO: 1495765 - DNA, 12 bp, Homo sapiens
ttgcactgaggg

SEQ ID NO: 1495766 - DNA, 21 bp, Homo sapiens
ttgcactgagggccacactat

SEQ ID NO: 1495767 - DNA, 20 bp, Homo sapiens
ttgcactgtaatgaggaaaa

SEQ ID NO: 1495768 - DNA, 19 bp, Homo sapiens
ttgcacttaaaaattagca

SEQ ID NO: 1495769 - DNA, 22 bp, Homo sapiens
ttgcacttaatggctgttgagg

SEQ ID NO: 1495770 - DNA, 21 bp, Homo sapiens
ttgcacttcaaaaaagcttaa

SEQ ID NO: 1495771 - DNA, 16 bp, Homo sapiens
ttgcacttctgtaaac

SEQ ID NO: 1495772 - DNA, 22 bp, Homo sapiens
ttgcactttttcttaatcattt

SEQ ID NO: 1495773 - DNA, 21 bp, Homo sapiens
ttgcagaaaagcacctgccga

SEQ ID NO: 1495774 - DNA, 15 bp, Homo sapiens
ttgcagaaacatttt

SEQ ID NO: 1495775 - DNA, 15 bp, Homo sapiens
ttgcagaagagggtg

SEQ ID NO: 1495776 - DNA, 21 bp, Homo sapiens
ttgcagaagagggtgtgtttg

SEQ ID NO: 1495777 - DNA, 21 bp, Homo sapiens
ttgcagaattaactataacaa

SEQ ID NO: 1495778 - DNA, 19 bp, Homo sapiens
ttgcagactcagtttgtca

SEQ ID NO: 1495779 - DNA, 18 bp, Homo sapiens
ttgcagatatctgcatgt

SEQ ID NO: 1495780 - DNA, 16 bp, Homo sapiens
ttgcagatgttcaaat

SEQ ID NO: 1495781 - DNA, 18 bp, Homo sapiens
ttgcagattcatttttct

SEQ ID NO: 1495782 - DNA, 13 bp, Homo sapiens
ttgcagcatgaga

SEQ ID NO: 1495783 - DNA, 16 bp, Homo sapiens
ttgcagcatgagactt

SEQ ID NO: 1495784 - DNA, 18 bp, Homo sapiens
ttgcagcatttactatgc

SEQ ID NO: 1495785 - DNA, 20 bp, Homo sapiens
ttgcagccggcacagggtct

SEQ ID NO: 1495786 - DNA, 15 bp, Homo sapiens
ttgcagcctgctcta

SEQ ID NO: 1495787 - DNA, 17 bp, Homo sapiens
ttgcagctcactgctgc

SEQ ID NO: 1495788 - DNA, 17 bp, Homo sapiens
ttgcagctgctcttgca

SEQ ID NO: 1495789 - DNA, 14 bp, Homo sapiens
ttgcagctttatgt

SEQ ID NO: 1495790 - DNA, 18 bp, Homo sapiens
ttgcagctttatgttcat

SEQ ID NO: 1495791 - DNA, 23 bp, Homo sapiens
ttgcaggaccttgggcacatctg

SEQ ID NO: 1495792 - DNA, 14 bp, Homo sapiens
ttgcaggattccct

SEQ ID NO: 1495793 - DNA, 19 bp, Homo sapiens
ttgcaggattcccttctgg

SEQ ID NO: 1495794 - DNA, 13 bp, Homo sapiens
ttgcaggctctgg

SEQ ID NO: 1495795 - DNA, 17 bp, Homo sapiens
ttgcaggctctgggctc

SEQ ID NO: 1495796 - DNA, 18 bp, Homo sapiens
ttgcaggctctgggctca

SEQ ID NO: 1495797 - DNA, 20 bp, Homo sapiens
ttgcaggctctgggctcagg

SEQ ID NO: 1495798 - DNA, 21 bp, Homo sapiens
ttgcaggctctgggctcaggg

SEQ ID NO: 1495799 - DNA, 16 bp, Homo sapiens
ttgcagtatgatggca

SEQ ID NO: 1495800 - DNA, 16 bp, Homo sapiens
ttgcagttagccccag

SEQ ID NO: 1495801 - DNA, 19 bp, Homo sapiens
ttgcagttggactctcagg

SEQ ID NO: 1495802 - DNA, 13 bp, Homo sapiens
ttgcataagagct

SEQ ID NO: 1495803 - DNA, 18 bp, Homo sapiens
ttgcataagattaaagga

SEQ ID NO: 1495804 - DNA, 15 bp, Homo sapiens
ttgcataataagcta

SEQ ID NO: 1495805 - DNA, 21 bp, Homo sapiens
ttgcataataagctaaagagg

SEQ ID NO: 1495806 - DNA, 18 bp, Homo sapiens
ttgcatagattccctgag

SEQ ID NO: 1495807 - DNA, 18 bp, Homo sapiens
ttgcatatcacccttccc

SEQ ID NO: 1495808 - DNA, 19 bp, Homo sapiens
ttgcatatgagcctgccct

SEQ ID NO: 1495809 - DNA, 22 bp, Homo sapiens
ttgcatattttgagaaactgct

SEQ ID NO: 1495810 - DNA, 20 bp, Homo sapiens
ttgcatccattgttgtgtct

SEQ ID NO: 1495811 - DNA, 21 bp, Homo sapiens
ttgcatccattgttgtgtctg

SEQ ID NO: 1495812 - DNA, 14 bp, Homo sapiens
ttgcatctgggcca

SEQ ID NO: 1495813 - DNA, 23 bp, Homo sapiens
ttgcatgaaattgtatctcagtc

SEQ ID NO: 1495814 - DNA, 15 bp, Homo sapiens
ttgcatgcaatttga

SEQ ID NO: 1495815 - DNA, 15 bp, Homo sapiens
ttgcatgcatgcaaa

SEQ ID NO: 1495816 - DNA, 20 bp, Homo sapiens
ttgcatggctccagaaatgt

SEQ ID NO: 1495817 - DNA, 19 bp, Homo sapiens
ttgcatgtagtaacactaa

SEQ ID NO: 1495818 - DNA, 14 bp, Homo sapiens
ttgcattccagaat

SEQ ID NO: 1495819 - DNA, 13 bp, Homo sapiens
ttgctttctgaaa

SEQ ID NO: 1495820 - DNA, 15 bp, Homo sapiens
ttgctttctgaaatt

SEQ ID NO: 1495821 - DNA, 21 bp, Homo sapiens
ttgctttgaagtagctctttt

SEQ ID NO: 1495822 - DNA, 19 bp, Homo sapiens
ttgctttgccaaaatacca

SEQ ID NO: 1495823 - DNA, 23 bp, Homo sapiens
ttgctttgggctttgcaggctct

SEQ ID NO: 1495824 - DNA, 14 bp, Homo sapiens
ttgctttggggggt

SEQ ID NO: 1495825 - DNA, 21 bp, Homo sapiens
ttgctttggggggtgtgctga

SEQ ID NO: 1495826 - DNA, 21 bp, Homo sapiens
ttgcttttcatgtagaactca

SEQ ID NO: 1495827 - DNA, 19 bp, Homo sapiens
ttgcttttgaaaagttgaa

SEQ ID NO: 1495828 - DNA, 15 bp, Homo sapiens
ttgcttttgagagaa

SEQ ID NO: 1495829 - DNA, 13 bp, Homo sapiens
ttgcttttgtgaa

SEQ ID NO: 1495830 - DNA, 14 bp, Homo sapiens
ttgcttttttgact

SEQ ID NO: 1495831 - DNA, 15 bp, Homo sapiens
ttggaaaaaactctg

SEQ ID NO: 1495832 - DNA, 21 bp, Homo sapiens
ttggaaaaatccagaaagaaa

SEQ ID NO: 1495833 - DNA, 22 bp, Homo sapiens
ttggaaaagaatacagaaagat

SEQ ID NO: 1495834 - DNA, 18 bp, Homo sapiens
ttggaaaccacagtcagt

SEQ ID NO: 1495835 - DNA, 14 bp, Homo sapiens
ttggaaagagacca

SEQ ID NO: 1495836 - DNA, 21 bp, Homo sapiens
ttggaaagatgttaagcattt

SEQ ID NO: 1495837 - DNA, 17 bp, Homo sapiens
ttggaaatgtctgctgg

SEQ ID NO: 1495838 - DNA, 11 bp, Homo sapiens
ttggaaattcc

SEQ ID NO: 1495839 - DNA, 13 bp, Homo sapiens
ttggaacagaatg

SEQ ID NO: 1495840 - DNA, 22 bp, Homo sapiens
ttggaacattggaatgttctca

SEQ ID NO: 1495841 - DNA, 23 bp, Homo sapiens
ttggaacatttctttcttgctgg

SEQ ID NO: 1495842 - DNA, 16 bp, Homo sapiens
ttggaagaaaaaatct

SEQ ID NO: 1495843 - DNA, 23 bp, Homo sapiens
ttggaagagacaaagatttcttc

SEQ ID NO: 1495844 - DNA, 21 bp, Homo sapiens
ttggaagctgtttggaaaaga

SEQ ID NO: 1495845 - DNA, 13 bp, Homo sapiens
ttggaaggagcag

SEQ ID NO: 1495846 - DNA, 17 bp, Homo sapiens
ttggaaggatctgctga

SEQ ID NO: 1495847 - DNA, 15 bp, Homo sapiens
ttggaagggaaaaaa

SEQ ID NO: 1495848 - DNA, 22 bp, Homo sapiens
ttggaagggggagacaggaagt

SEQ ID NO: 1495849 - DNA, 21 bp, Homo sapiens
ttggaagtgttcaagaaataa

SEQ ID NO: 1495850 - DNA, 13 bp, Homo sapiens
ttggaataaagag

SEQ ID NO: 1495851 - DNA, 13 bp, Homo sapiens
ttggaatatttta

SEQ ID NO: 1495852 - DNA, 11 bp, Homo sapiens
ttggaatgtta

SEQ ID NO: 1495853 - DNA, 24 bp, Homo sapiens
ttggaatttttttttcctggaatt

SEQ ID NO: 1495854 - DNA, 20 bp, Homo sapiens
ttggacaaatcacatatttt

SEQ ID NO: 1495855 - DNA, 16 bp, Homo sapiens
ttggacaactgcatgg

SEQ ID NO: 1495856 - DNA, 13 bp, Homo sapiens
ttggacagctgct

SEQ ID NO: 1495857 - DNA, 14 bp, Homo sapiens
ttggacatcctcct

SEQ ID NO: 1495858 - DNA, 18 bp, Homo sapiens
ttggacatggaaagaaaa

SEQ ID NO: 1495859 - DNA, 12 bp, Homo sapiens
ttggaccagggc

SEQ ID NO: 1495860 - DNA, 19 bp, Homo sapiens
ttggaccccagctgggagg

SEQ ID NO: 1495861 - DNA, 19 bp, Homo sapiens
ttggacctaaatggcctca

SEQ ID NO: 1495862 - DNA, 13 bp, Homo sapiens
ttggactccaggc

SEQ ID NO: 1495863 - DNA, 14 bp, Homo sapiens
ttggactccaggcc

SEQ ID NO: 1495864 - DNA, 16 bp, Homo sapiens
ttggactgatttgtgg

SEQ ID NO: 1495865 - DNA, 22 bp, Homo sapiens
ttggacttcagtcttgcctagg

SEQ ID NO: 1495866 - DNA, 20 bp, Homo sapiens
ttggacttttcgttaacatt

SEQ ID NO: 1495867 - DNA, 18 bp, Homo sapiens
ttggagaaggttatcaaa

SEQ ID NO: 1495868 - DNA, 16 bp, Homo sapiens
ttggagaagtctcagc

SEQ ID NO: 1495869 - DNA, 18 bp, Homo sapiens
ttggagaagtctcagcta

SEQ ID NO: 1495870 - DNA, 18 bp, Homo sapiens
ttggagacacaactattt

SEQ ID NO: 1495871 - DNA, 20 bp, Homo sapiens
ttggagacacaactattttt

SEQ ID NO: 1495872 - DNA, 15 bp, Homo sapiens
ttggagagcagcagg

SEQ ID NO: 1495873 - DNA, 13 bp, Homo sapiens
ttggagagggaag

SEQ ID NO: 1495874 - DNA, 16 bp, Homo sapiens
ttggagagtttcctga

SEQ ID NO: 1495875 - DNA, 22 bp, Homo sapiens
ttggagagtttgcctgttctat

SEQ ID NO: 1495876 - DNA, 22 bp, Homo sapiens
ttggagatgctgagggtgtttc

SEQ ID NO: 1495877 - DNA, 14 bp, Homo sapiens
ttggagcaatcaga

SEQ ID NO: 1495878 - DNA, 22 bp, Homo sapiens
ttggagcaggggttggtcaagg

SEQ ID NO: 1495879 - DNA, 12 bp, Homo sapiens
ttggagccactc

SEQ ID NO: 1495880 - DNA, 16 bp, Homo sapiens
ttggagctattcaaga

SEQ ID NO: 1495881 - DNA, 11 bp, Homo sapiens
ttggagctgag

SEQ ID NO: 1495882 - DNA, 20 bp, Homo sapiens
ttggagctgagatgagcccc

SEQ ID NO: 1495883 - DNA, 16 bp, Homo sapiens
ttggagggaagggaga

SEQ ID NO: 1495884 - DNA, 23 bp, Homo sapiens
ttggagtaaatatatatgtcaat

SEQ ID NO: 1495885 - DNA, 23 bp, Homo sapiens
ttggagtcccctcacctcctcta

SEQ ID NO: 1495886 - DNA, 23 bp, Homo sapiens
ttggagtgataatattgtttccc

SEQ ID NO: 1495887 - DNA, 15 bp, Homo sapiens
ttggagtgcatttga

SEQ ID NO: 1495888 - DNA, 19 bp, Homo sapiens
ttggagtggaggcattgtt

SEQ ID NO: 1495889 - DNA, 21 bp, Homo sapiens
ttggataagtttctattctgt

SEQ ID NO: 1495890 - DNA, 22 bp, Homo sapiens
ttggataatgctgttgcctcat

SEQ ID NO: 1495891 - DNA, 18 bp, Homo sapiens
ttggatcctcagaactct

SEQ ID NO: 1495892 - DNA, 17 bp, Homo sapiens
ttggatctatcacctgt

SEQ ID NO: 1495893 - DNA, 19 bp, Homo sapiens
ttggatctatcacctgtca

SEQ ID NO: 1495894 - DNA, 20 bp, Homo sapiens
ttggatgggagtgagacaga

SEQ ID NO: 1495895 - DNA, 16 bp, Homo sapiens
ttggatgttgagaggt

SEQ ID NO: 1495896 - DNA, 13 bp, Homo sapiens
ttggattattcat

SEQ ID NO: 1495897 - DNA, 23 bp, Homo sapiens
ttggattctcttagctactgtat

SEQ ID NO: 1495898 - DNA, 20 bp, Homo sapiens
ttggatttgaacttgctctt

SEQ ID NO: 1495899 - DNA, 19 bp, Homo sapiens
ttggatttgctcattgctg

SEQ ID NO: 1495900 - DNA, 13 bp, Homo sapiens
ttggcaaggaaag

SEQ ID NO: 1495901 - DNA, 14 bp, Homo sapiens
ttggcaatgctaat

SEQ ID NO: 1495902 - DNA, 16 bp, Homo sapiens
ttggcaatttcctggc

SEQ ID NO: 1495903 - DNA, 20 bp, Homo sapiens
ttggcaatttcctggccctc

SEQ ID NO: 1495904 - DNA, 15 bp, Homo sapiens
ttggcacagaaacac

SEQ ID NO: 1495905 - DNA, 16 bp, Homo sapiens
ttggcacagaaacaca

SEQ ID NO: 1495906 - DNA, 13 bp, Homo sapiens
ttggcaccagaca

SEQ ID NO: 1495907 - DNA, 17 bp, Homo sapiens
ttggcaccagacaccca

SEQ ID NO: 1495908 - DNA, 21 bp, Homo sapiens
ttggcaccagacacccaggac

SEQ ID NO: 1495909 - DNA, 14 bp, Homo sapiens
ttggcactcacaga

SEQ ID NO: 1495910 - DNA, 22 bp, Homo sapiens
ttggcactcacagacctggagc

SEQ ID NO: 1495911 - DNA, 22 bp, Homo sapiens
ttggcactgagatatttattgt

SEQ ID NO: 1495912 - DNA, 20 bp, Homo sapiens
ttggcactttgttttcaaga

SEQ ID NO: 1495913 - DNA, 16 bp, Homo sapiens
ttggcagaaaggatgt

SEQ ID NO: 1495914 - DNA, 18 bp, Homo sapiens
ttggcagagaaggcctct

SEQ ID NO: 1495915 - DNA, 13 bp, Homo sapiens
ttggcaggcccac

SEQ ID NO: 1495916 - DNA, 11 bp, Homo sapiens
ttggcagtgtt

SEQ ID NO: 1495917 - DNA, 15 bp, Homo sapiens
ttggcataagacaga

SEQ ID NO: 1495918 - DNA, 15 bp, Homo sapiens
ttggcatacaaaata

SEQ ID NO: 1495919 - DNA, 14 bp, Homo sapiens
ttggcattgctgca

SEQ ID NO: 1495920 - DNA, 22 bp, Homo sapiens
ttggcattggaattctactgga

SEQ ID NO: 1495921 - DNA, 13 bp, Homo sapiens
ttggcatttctat

SEQ ID NO: 1495922 - DNA, 14 bp, Homo sapiens
ttggcatttctata

SEQ ID NO: 1495923 - DNA, 16 bp, Homo sapiens
ttggccaaacatcaga

SEQ ID NO: 1495924 - DNA, 14 bp, Homo sapiens
ttggccactccgag

SEQ ID NO: 1495925 - DNA, 22 bp, Homo sapiens
ttggccactccgagaggtgggc

SEQ ID NO: 1495926 - DNA, 22 bp, Homo sapiens
ttggccagccaactctgggaat

SEQ ID NO: 1495927 - DNA, 19 bp, Homo sapiens
ttggccatgcagaaagcat

SEQ ID NO: 1495928 - DNA, 23 bp, Homo sapiens
ttggcccaggagctctgcgccag

SEQ ID NO: 1495929 - DNA, 23 bp, Homo sapiens
ttggcccccaaagatagacaggt

SEQ ID NO: 1495930 - DNA, 10 bp, Homo sapiens
ttggccctgg

SEQ ID NO: 1495931 - DNA, 15 bp, Homo sapiens
ttggccctggagcca

SEQ ID NO: 1495932 - DNA, 16 bp, Homo sapiens
ttggccctggagccag

SEQ ID NO: 1495933 - DNA, 12 bp, Homo sapiens
ttggcctggagg

SEQ ID NO: 1495934 - DNA, 16 bp, Homo sapiens
ttgtctattttaaaat

SEQ ID NO: 1495935 - DNA, 17 bp, Homo sapiens
ttgtctatttttgtctt

SEQ ID NO: 1495936 - DNA, 23 bp, Homo sapiens
ttgtctccactaaatgagctcct

SEQ ID NO: 1495937 - DNA, 15 bp, Homo sapiens
ttgtctccatgtgta

SEQ ID NO: 1495938 - DNA, 18 bp, Homo sapiens
ttgtctcctttccactgc

SEQ ID NO: 1495939 - DNA, 14 bp, Homo sapiens
ttgtctctactttt

SEQ ID NO: 1495940 - DNA, 19 bp, Homo sapiens
ttgtctctatgccagctca

SEQ ID NO: 1495941 - DNA, 12 bp, Homo sapiens
ttgtctctgggc

SEQ ID NO: 1495942 - DNA, 21 bp, Homo sapiens
ttgtctgaggcctcatccctc

SEQ ID NO: 1495943 - DNA, 13 bp, Homo sapiens
ttgtctgcgcctg

SEQ ID NO: 1495944 - DNA, 16 bp, Homo sapiens
ttgtctgcgcctgaaa

SEQ ID NO: 1495945 - DNA, 18 bp, Homo sapiens
ttgtctgctagtagtgtt

SEQ ID NO: 1495946 - DNA, 20 bp, Homo sapiens
ttgtctggcaaggactttgt

SEQ ID NO: 1495947 - DNA, 11 bp, Homo sapiens
ttgtctgtctc

SEQ ID NO: 1495948 - DNA, 17 bp, Homo sapiens
ttgtctgtctccctccc

SEQ ID NO: 1495949 - DNA, 21 bp, Homo sapiens
ttgtctgtctccctcccctct

SEQ ID NO: 1495950 - DNA, 20 bp, Homo sapiens
ttgtctgtttgtttcaagaa

SEQ ID NO: 1495951 - DNA, 14 bp, Homo sapiens
ttgtcttaagtgtt

SEQ ID NO: 1495952 - DNA, 18 bp, Homo sapiens
ttgtcttaagtgtttctc

SEQ ID NO: 1495953 - DNA, 13 bp, Homo sapiens
ttgtcttatatat

SEQ ID NO: 1495954 - DNA, 21 bp, Homo sapiens
ttgtcttatgtgaaaaattaa

SEQ ID NO: 1495955 - DNA, 13 bp, Homo sapiens
ttgtcttgtactt

SEQ ID NO: 1495956 - DNA, 14 bp, Homo sapiens
ttgtcttgtacttc

SEQ ID NO: 1495957 - DNA, 17 bp, Homo sapiens
ttgtcttgtacttctgt

SEQ ID NO: 1495958 - DNA, 23 bp, Homo sapiens
ttgtcttgtacttctgtgttcat

SEQ ID NO: 1495959 - DNA, 15 bp, Homo sapiens
ttgtcttttagacaa

SEQ ID NO: 1495960 - DNA, 19 bp, Homo sapiens
ttgtcttttttttcctttg

SEQ ID NO: 1495961 - DNA, 19 bp, Homo sapiens
ttgtgaactggaagaaagc

SEQ ID NO: 1495962 - DNA, 22 bp, Homo sapiens
ttgtgaagaactattttattct

SEQ ID NO: 1495963 - DNA, 18 bp, Homo sapiens
ttgtgaagtattcacaaa

SEQ ID NO: 1495964 - DNA, 14 bp, Homo sapiens
ttgtgaataattac

SEQ ID NO: 1495965 - DNA, 19 bp, Homo sapiens
ttgtgacagtgcctcttcc

SEQ ID NO: 1495966 - DNA, 16 bp, Homo sapiens
ttgtgaccaagttata

SEQ ID NO: 1495967 - DNA, 15 bp, Homo sapiens
ttgtgaccaatacat

SEQ ID NO: 1495968 - DNA, 18 bp, Homo sapiens
ttgtgaccaatacatttg

SEQ ID NO: 1495969 - DNA, 22 bp, Homo sapiens
ttgtgaccaatacatttgtatt

SEQ ID NO: 1495970 - DNA, 16 bp, Homo sapiens
ttgtgacccctttcac

SEQ ID NO: 1495971 - DNA, 17 bp, Homo sapiens
ttgtgactgtgtttgca

SEQ ID NO: 1495972 - DNA, 15 bp, Homo sapiens
ttgtgacttcactgt

SEQ ID NO: 1495973 - DNA, 16 bp, Homo sapiens
ttgtgacttcactgta

SEQ ID NO: 1495974 - DNA, 20 bp, Homo sapiens
ttgtgagacttctgtttgat

SEQ ID NO: 1495975 - DNA, 18 bp, Homo sapiens
ttgtgagccaccacgtcc

SEQ ID NO: 1495976 - DNA, 21 bp, Homo sapiens
ttgtgagctctggttattttt

SEQ ID NO: 1495977 - DNA, 20 bp, Homo sapiens
ttgtgatgaacatattcatg

SEQ ID NO: 1495978 - DNA, 21 bp, Homo sapiens
ttgtgatgaatctacatttgt

SEQ ID NO: 1495979 - DNA, 23 bp, Homo sapiens
ttgtgatgaatctacatttgttt

SEQ ID NO: 1495980 - DNA, 19 bp, Homo sapiens
ttgtgatgtaaggcactgt

SEQ ID NO: 1495981 - DNA, 18 bp, Homo sapiens
ttgtgattagacagaaca

SEQ ID NO: 1495982 - DNA, 19 bp, Homo sapiens
ttgtgattagacagaacac

SEQ ID NO: 1495983 - DNA, 17 bp, Homo sapiens
ttgtgattatttcactt

SEQ ID NO: 1495984 - DNA, 22 bp, Homo sapiens
ttgtgattatttcactttagat

SEQ ID NO: 1495985 - DNA, 23 bp, Homo sapiens
ttgtgattcaatctgtaaactgt

SEQ ID NO: 1495986 - DNA, 22 bp, Homo sapiens
ttgtgcaaacatggagaaatct

SEQ ID NO: 1495987 - DNA, 15 bp, Homo sapiens
ttgtgcaacggccag

SEQ ID NO: 1495988 - DNA, 17 bp, Homo sapiens
ttgtgcaattgtctttt

SEQ ID NO: 1495989 - DNA, 14 bp, Homo sapiens
ttgtgcagaatctc

SEQ ID NO: 1495990 - DNA, 13 bp, Homo sapiens
ttgtgcagggtgt

SEQ ID NO: 1495991 - DNA, 20 bp, Homo sapiens
ttgtgcagtaacttgggagt

SEQ ID NO: 1495992 - DNA, 20 bp, Homo sapiens
ttgtgcatatctgcctcccc

SEQ ID NO: 1495993 - DNA, 16 bp, Homo sapiens
ttgtgccaactgccag

SEQ ID NO: 1495994 - DNA, 17 bp, Homo sapiens
ttgtgccctgcctccac

SEQ ID NO: 1495995 - DNA, 14 bp, Homo sapiens
ttgtgccttccctt

SEQ ID NO: 1495996 - DNA, 14 bp, Homo sapiens
ttgtgctacagatg

SEQ ID NO: 1495997 - DNA, 16 bp, Homo sapiens
ttgtgctcaaggaatc

SEQ ID NO: 1495998 - DNA, 15 bp, Homo sapiens
ttgtgctcagcatga

SEQ ID NO: 1495999 - DNA, 20 bp, Homo sapiens
ttgtgctcctcttgattcct

SEQ ID NO: 1496000 - DNA, 22 bp, Homo sapiens
ttgtgctgatcgtgctaaattt

SEQ ID NO: 1496001 - DNA, 12 bp, Homo sapiens
ttgtgctgccat

SEQ ID NO: 1496002 - DNA, 16 bp, Homo sapiens
ttgtgcttcacagtag

SEQ ID NO: 1496003 - DNA, 19 bp, Homo sapiens
ttgtgcttgtcattccaga

SEQ ID NO: 1496004 - DNA, 14 bp, Homo sapiens
ttgtggagtttgta

SEQ ID NO: 1496005 - DNA, 18 bp, Homo sapiens
ttgtggattataaaaaat

SEQ ID NO: 1496006 - DNA, 20 bp, Homo sapiens
ttgtggattataaaaaatgt

SEQ ID NO: 1496007 - DNA, 21 bp, Homo sapiens
ttgtggattataaaaaatgta

SEQ ID NO: 1496008 - DNA, 12 bp, Homo sapiens
ttgtggcctcag

SEQ ID NO: 1496009 - DNA, 18 bp, Homo sapiens
ttgtggctcctatctgtg

SEQ ID NO: 1496010 - DNA, 19 bp, Homo sapiens
ttgtggctcctatctgtgt

SEQ ID NO: 1496011 - DNA, 14 bp, Homo sapiens
ttgtggctgggggc

SEQ ID NO: 1496012 - DNA, 14 bp, Homo sapiens
ttgtggggccagga

SEQ ID NO: 1496013 - DNA, 15 bp, Homo sapiens
ttgtggtaatctaca

SEQ ID NO: 1496014 - DNA, 17 bp, Homo sapiens
ttgtggtaatctacacc

SEQ ID NO: 1496015 - DNA, 16 bp, Homo sapiens
ttgtggtgttcctgaa

SEQ ID NO: 1496016 - DNA, 17 bp, Homo sapiens
ttgtggtgttcctgaag

SEQ ID NO: 1496017 - DNA, 15 bp, Homo sapiens
ttgtgtaaaaaatgg

SEQ ID NO: 1496018 - DNA, 15 bp, Homo sapiens
ttgtgtaatatgaaa

SEQ ID NO: 1496019 - DNA, 23 bp, Homo sapiens
ttgtgtaatgaaaatgaatatct

SEQ ID NO: 1496020 - DNA, 18 bp, Homo sapiens
ttgtgtaatttaagtgac

SEQ ID NO: 1496021 - DNA, 15 bp, Homo sapiens
ttgtgtacagtgtgt

SEQ ID NO: 1496022 - DNA, 17 bp, Homo sapiens
ttgtgtacatagagcaa

SEQ ID NO: 1496023 - DNA, 20 bp, Homo sapiens
ttgtgtactgataaaatact

SEQ ID NO: 1496024 - DNA, 13 bp, Homo sapiens
ttgtgtagccttt

SEQ ID NO: 1496025 - DNA, 11 bp, Homo sapiens
ttgtgtagtat

SEQ ID NO: 1496026 - DNA, 23 bp, Homo sapiens
ttgtgtatgtacttagctgtact

SEQ ID NO: 1496027 - DNA, 16 bp, Homo sapiens
ttgtgtattgatgcaa

SEQ ID NO: 1496028 - DNA, 13 bp, Homo sapiens
ttgtgtcatacca

SEQ ID NO: 1496029 - DNA, 19 bp, Homo sapiens
ttgtgtcctccaggagctt

SEQ ID NO: 1496030 - DNA, 14 bp, Homo sapiens
ttgtgtctgtacac

SEQ ID NO: 1496031 - DNA, 23 bp, Homo sapiens
ttgtgtgaaaaaagaaaatggct

SEQ ID NO: 1496032 - DNA, 21 bp, Homo sapiens
ttgtgtgatatttcagaaata

SEQ ID NO: 1496033 - DNA, 13 bp, Homo sapiens
ttgtgtgattgaa

SEQ ID NO: 1496034 - DNA, 19 bp, Homo sapiens
ttgtgtgcgctgcctggcc

SEQ ID NO: 1496035 - DNA, 14 bp, Homo sapiens
ttgtgtgtatttgc

SEQ ID NO: 1496036 - DNA, 16 bp, Homo sapiens
ttgtgtgtatttgcta

SEQ ID NO: 1496037 - DNA, 23 bp, Homo sapiens
ttgtgtgtcaggccctctgcctg

SEQ ID NO: 1496038 - DNA, 13 bp, Homo sapiens
ttgtgtgtcttaa

SEQ ID NO: 1496039 - DNA, 20 bp, Homo sapiens
ttgtgtgttatttaaatgag

SEQ ID NO: 1496040 - DNA, 13 bp, Homo sapiens
ttgtgtgttgtct

SEQ ID NO: 1496041 - DNA, 12 bp, Homo sapiens
ttgtgttcctgg

SEQ ID NO: 1496042 - DNA, 15 bp, Homo sapiens
ttgtgttcctggctg

SEQ ID NO: 1496043 - DNA, 20 bp, Homo sapiens
ttgtgttcctggctgatgat

SEQ ID NO: 1496044 - DNA, 12 bp, Homo sapiens
ttgtgttgaaga

SEQ ID NO: 1496045 - DNA, 13 bp, Homo sapiens
ttgtgttgtgaat

SEQ ID NO: 1496046 - DNA, 21 bp, Homo sapiens
ttgtgtttattcttgatgaaa

SEQ ID NO: 1496047 - DNA, 11 bp, Homo sapiens
ttgtgttttct

SEQ ID NO: 1496048 - DNA, 13 bp, Homo sapiens
ttgtgttttcttg

SEQ ID NO: 1496049 - DNA, 16 bp, Homo sapiens
tttacctgtgaaatag

SEQ ID NO: 1496050 - DNA, 21 bp, Homo sapiens
tttacctgtgcgttactaatt

SEQ ID NO: 1496051 - DNA, 13 bp, Homo sapiens
tttaccttctaaa

SEQ ID NO: 1496052 - DNA, 19 bp, Homo sapiens
tttaccttctaaaagccat

SEQ ID NO: 1496053 - DNA, 17 bp, Homo sapiens
tttactaatatatattt

SEQ ID NO: 1496054 - DNA, 19 bp, Homo sapiens
tttactaattttctagatt

SEQ ID NO: 1496055 - DNA, 21 bp, Homo sapiens
tttactacaatatgtacattt

SEQ ID NO: 1496056 - DNA, 22 bp, Homo sapiens
tttactacataattaaatttta

SEQ ID NO: 1496057 - DNA, 13 bp, Homo sapiens
tttactcttatga

SEQ ID NO: 1496058 - DNA, 21 bp, Homo sapiens
tttactgagcttctctgtgaa

SEQ ID NO: 1496059 - DNA, 21 bp, Homo sapiens
tttactgcactcagatttaag

SEQ ID NO: 1496060 - DNA, 17 bp, Homo sapiens
tttactgctctgagaat

SEQ ID NO: 1496061 - DNA, 16 bp, Homo sapiens
tttactgcttttcatt

SEQ ID NO: 1496062 - DNA, 19 bp, Homo sapiens
tttactgcttttcattagc

SEQ ID NO: 1496063 - DNA, 18 bp, Homo sapiens
tttactgtaactgtcagt

SEQ ID NO: 1496064 - DNA, 12 bp, Homo sapiens
tttactgtgttt

SEQ ID NO: 1496065 - DNA, 17 bp, Homo sapiens
tttactgttatttaatt

SEQ ID NO: 1496066 - DNA, 14 bp, Homo sapiens
tttactgtttgtta

SEQ ID NO: 1496067 - DNA, 20 bp, Homo sapiens
tttactgttttaattgtagt

SEQ ID NO: 1496068 - DNA, 22 bp, Homo sapiens
tttactgttttgaaatcaatgc

SEQ ID NO: 1496069 - DNA, 15 bp, Homo sapiens
tttacttaaagattt

SEQ ID NO: 1496070 - DNA, 16 bp, Homo sapiens
tttacttaaagattta

SEQ ID NO: 1496071 - DNA, 20 bp, Homo sapiens
tttacttaaagatttatcaa

SEQ ID NO: 1496072 - DNA, 22 bp, Homo sapiens
tttacttaaagatttatcaaat

SEQ ID NO: 1496073 - DNA, 13 bp, Homo sapiens
tttacttaattca

SEQ ID NO: 1496074 - DNA, 22 bp, Homo sapiens
tttacttatctctcaaaacaat

SEQ ID NO: 1496075 - DNA, 13 bp, Homo sapiens
tttacttcttata

SEQ ID NO: 1496076 - DNA, 17 bp, Homo sapiens
tttacttgtggtgtgac

SEQ ID NO: 1496077 - DNA, 17 bp, Homo sapiens
tttactttcttcaccaa

SEQ ID NO: 1496078 - DNA, 12 bp, Homo sapiens
tttactttggcc

SEQ ID NO: 1496079 - DNA, 17 bp, Homo sapiens
tttacttttcacactgt

SEQ ID NO: 1496080 - DNA, 18 bp, Homo sapiens
tttacttttcacactgtc

SEQ ID NO: 1496081 - DNA, 13 bp, Homo sapiens
tttagaaaaaaca

SEQ ID NO: 1496082 - DNA, 23 bp, Homo sapiens
tttagaaaaaagtttacaacata

SEQ ID NO: 1496083 - DNA, 16 bp, Homo sapiens
tttagaaacagaaata

SEQ ID NO: 1496084 - DNA, 11 bp, Homo sapiens
tttagaaatat

SEQ ID NO: 1496085 - DNA, 14 bp, Homo sapiens
tttagaaatataat

SEQ ID NO: 1496086 - DNA, 22 bp, Homo sapiens
tttagaactctagagagcctta

SEQ ID NO: 1496087 - DNA, 17 bp, Homo sapiens
tttagaagaagtgtgtc

SEQ ID NO: 1496088 - DNA, 14 bp, Homo sapiens
tttagaagccaact

SEQ ID NO: 1496089 - DNA, 23 bp, Homo sapiens
tttagaataaggaggaggaggga

SEQ ID NO: 1496090 - DNA, 11 bp, Homo sapiens
tttagaatcta

SEQ ID NO: 1496091 - DNA, 15 bp, Homo sapiens
tttagaatctagaaa

SEQ ID NO: 1496092 - DNA, 17 bp, Homo sapiens
tttagaatctagaaatg

SEQ ID NO: 1496093 - DNA, 20 bp, Homo sapiens
tttagaatggtgattttaaa

SEQ ID NO: 1496094 - DNA, 21 bp, Homo sapiens
tttagaatggtgattttaaat

SEQ ID NO: 1496095 - DNA, 13 bp, Homo sapiens
tttagaattaaaa

SEQ ID NO: 1496096 - DNA, 21 bp, Homo sapiens
tttagacaaccatagaactgt

SEQ ID NO: 1496097 - DNA, 18 bp, Homo sapiens
tttagacaacctgaaatt

SEQ ID NO: 1496098 - DNA, 22 bp, Homo sapiens
tttagacaagagatgggaatga

SEQ ID NO: 1496099 - DNA, 22 bp, Homo sapiens
tttagactcatcaatcaaataa

SEQ ID NO: 1496100 - DNA, 15 bp, Homo sapiens
tttagactgtagcct

SEQ ID NO: 1496101 - DNA, 18 bp, Homo sapiens
tttagagaactgtggccg

SEQ ID NO: 1496102 - DNA, 14 bp, Homo sapiens
tttagagagcctgt

SEQ ID NO: 1496103 - DNA, 22 bp, Homo sapiens
tttagagagcctgtcaccagag

SEQ ID NO: 1496104 - DNA, 18 bp, Homo sapiens
tttagaggcattgttagt

SEQ ID NO: 1496105 - DNA, 18 bp, Homo sapiens
tttagagtagcatgagag

SEQ ID NO: 1496106 - DNA, 14 bp, Homo sapiens
tttagatatttgcc

SEQ ID NO: 1496107 - DNA, 22 bp, Homo sapiens
tttagatcccatgtcacctcag

SEQ ID NO: 1496108 - DNA, 11 bp, Homo sapiens
tttagatgctg

SEQ ID NO: 1496109 - DNA, 22 bp, Homo sapiens
tttagcatgttcctccttttct

SEQ ID NO: 1496110 - DNA, 19 bp, Homo sapiens
tttagcattttaattctct

SEQ ID NO: 1496111 - DNA, 13 bp, Homo sapiens
tttagctacagct

SEQ ID NO: 1496112 - DNA, 20 bp, Homo sapiens
tttagctacagcttgtttaa

SEQ ID NO: 1496113 - DNA, 17 bp, Homo sapiens
tttagctagtatcttca

SEQ ID NO: 1496114 - DNA, 13 bp, Homo sapiens
tttagctatttat

SEQ ID NO: 1496115 - DNA, 23 bp, Homo sapiens
tttagctgatgaacttattctgt

SEQ ID NO: 1496116 - DNA, 13 bp, Homo sapiens
tttagcttttcct

SEQ ID NO: 1496117 - DNA, 15 bp, Homo sapiens
tttaggaacttcaga

SEQ ID NO: 1496118 - DNA, 13 bp, Homo sapiens
tttaggaagtgtt

SEQ ID NO: 1496119 - DNA, 10 bp, Homo sapiens
tttaggagaa

SEQ ID NO: 1496120 - DNA, 11 bp, Homo sapiens
tttaggagaaa

SEQ ID NO: 1496121 - DNA, 18 bp, Homo sapiens
tttaggctatttgtaaat

SEQ ID NO: 1496122 - DNA, 13 bp, Homo sapiens
tttaggtgcttta

SEQ ID NO: 1496123 - DNA, 15 bp, Homo sapiens
tttaggttctaaagt

SEQ ID NO: 1496124 - DNA, 14 bp, Homo sapiens
tttagtaagtatgt

SEQ ID NO: 1496125 - DNA, 23 bp, Homo sapiens
tttagtaagtatgttttttatgt

SEQ ID NO: 1496126 - DNA, 18 bp, Homo sapiens
tttagtacaataatctct

SEQ ID NO: 1496127 - DNA, 17 bp, Homo sapiens
tttagtactcaatgttt

SEQ ID NO: 1496128 - DNA, 16 bp, Homo sapiens
tttagtatacgtataa

SEQ ID NO: 1496129 - DNA, 14 bp, Homo sapiens
tttagtatgtaaat

SEQ ID NO: 1496130 - DNA, 15 bp, Homo sapiens
tttagtattatcaaa

SEQ ID NO: 1496131 - DNA, 21 bp, Homo sapiens
tttagtattcattctgcattg

SEQ ID NO: 1496132 - DNA, 16 bp, Homo sapiens
tttagtctttagaact

SEQ ID NO: 1496133 - DNA, 13 bp, Homo sapiens
tttagtgtctgac

SEQ ID NO: 1496134 - DNA, 19 bp, Homo sapiens
tttagttagcatgcgcgct

SEQ ID NO: 1496135 - DNA, 14 bp, Homo sapiens
tttagttctgttga

SEQ ID NO: 1496136 - DNA, 16 bp, Homo sapiens
tttagttgccaacagt

SEQ ID NO: 1496137 - DNA, 17 bp, Homo sapiens
tttagttgccaacagtt

SEQ ID NO: 1496138 - DNA, 17 bp, Homo sapiens
tttagttgtatctcttt

SEQ ID NO: 1496139 - DNA, 13 bp, Homo sapiens
tttagtttttcat

SEQ ID NO: 1496140 - DNA, 16 bp, Homo sapiens
tttagtttttcattaa

SEQ ID NO: 1496141 - DNA, 16 bp, Homo sapiens
tttataaaatggctgt

SEQ ID NO: 1496142 - DNA, 17 bp, Homo sapiens
tttataaaattttgctt

SEQ ID NO: 1496143 - DNA, 23 bp, Homo sapiens
tttataaacagaaatggaaagca

SEQ ID NO: 1496144 - DNA, 22 bp, Homo sapiens
tttataaacagacaatatgtga

SEQ ID NO: 1496145 - DNA, 12 bp, Homo sapiens
tttataaagcat

SEQ ID NO: 1496146 - DNA, 24 bp, Homo sapiens
tttataaagtacccatctagtact

SEQ ID NO: 1496147 - DNA, 20 bp, Homo sapiens
tttataaatactgcaaatca

SEQ ID NO: 1496148 - DNA, 17 bp, Homo sapiens
tttataacatctttatt

SEQ ID NO: 1496149 - DNA, 16 bp, Homo sapiens
tttataactcatcata

SEQ ID NO: 1496150 - DNA, 19 bp, Homo sapiens
tttataactcatcataaaa

SEQ ID NO: 1496151 - DNA, 20 bp, Homo sapiens
tttataagcagatttaacaa

SEQ ID NO: 1496152 - DNA, 13 bp, Homo sapiens
tttataaggtttt

SEQ ID NO: 1496153 - DNA, 21 bp, Homo sapiens
tttataagtgactttaaactt

SEQ ID NO: 1496154 - DNA, 18 bp, Homo sapiens
tttataatagcaactttt

SEQ ID NO: 1496155 - DNA, 18 bp, Homo sapiens
tttataataggaatttgt

SEQ ID NO: 1496156 - DNA, 20 bp, Homo sapiens
tttataattctcattaaaag

SEQ ID NO: 1496157 - DNA, 15 bp, Homo sapiens
tttataattgtacaa

SEQ ID NO: 1496158 - DNA, 16 bp, Homo sapiens
tttatacaatatcatc

SEQ ID NO: 1496159 - DNA, 18 bp, Homo sapiens
tttatacaatggaataaa

SEQ ID NO: 1496160 - DNA, 22 bp, Homo sapiens
tttatacacagattctgccttg

SEQ ID NO: 1496161 - DNA, 18 bp, Homo sapiens
tttatacagctgtattgt

SEQ ID NO: 1496162 - DNA, 22 bp, Homo sapiens
tttatacagctgtattgtctga

SEQ ID NO: 1496163 - DNA, 15 bp, Homo sapiens
tttatacaggtcata

SEQ ID NO: 1496164 - DNA, 18 bp, Homo sapiens
tttattgtacagactgtt

SEQ ID NO: 1496165 - DNA, 21 bp, Homo sapiens
tttattgtacagactgtttta

SEQ ID NO: 1496166 - DNA, 19 bp, Homo sapiens
tttattgtctgtctacatt

SEQ ID NO: 1496167 - DNA, 14 bp, Homo sapiens
tttattgttagaaa

SEQ ID NO: 1496168 - DNA, 22 bp, Homo sapiens
tttatttaaaagattcattttt

SEQ ID NO: 1496169 - DNA, 12 bp, Homo sapiens
tttatttaagga

SEQ ID NO: 1496170 - DNA, 18 bp, Homo sapiens
tttatttaaggatggatg

SEQ ID NO: 1496171 - DNA, 19 bp, Homo sapiens
tttatttaaggatggatgg

SEQ ID NO: 1496172 - DNA, 20 bp, Homo sapiens
tttatttacagatgaatgta

SEQ ID NO: 1496173 - DNA, 14 bp, Homo sapiens
tttatttacatttt

SEQ ID NO: 1496174 - DNA, 22 bp, Homo sapiens
tttatttatccagaaaactgtg

SEQ ID NO: 1496175 - DNA, 14 bp, Homo sapiens
tttatttatgtact

SEQ ID NO: 1496176 - DNA, 15 bp, Homo sapiens
tttatttatgtactt

SEQ ID NO: 1496177 - DNA, 14 bp, Homo sapiens
tttatttattcact

SEQ ID NO: 1496178 - DNA, 16 bp, Homo sapiens
tttatttattcactgt

SEQ ID NO: 1496179 - DNA, 14 bp, Homo sapiens
tttatttatttaca

SEQ ID NO: 1496180 - DNA, 14 bp, Homo sapiens
tttatttgtaaagt

SEQ ID NO: 1496181 - DNA, 13 bp, Homo sapiens
tttatttgtatta

SEQ ID NO: 1496182 - DNA, 20 bp, Homo sapiens
tttattttaaaatttcatag

SEQ ID NO: 1496183 - DNA, 13 bp, Homo sapiens
tttattttacaca

SEQ ID NO: 1496184 - DNA, 14 bp, Homo sapiens
tttattttactatt

SEQ ID NO: 1496185 - DNA, 18 bp, Homo sapiens
tttattttattctatgta

SEQ ID NO: 1496186 - DNA, 13 bp, Homo sapiens
tttattttggaac

SEQ ID NO: 1496187 - DNA, 23 bp, Homo sapiens
tttattttggaactatgaagact

SEQ ID NO: 1496188 - DNA, 14 bp, Homo sapiens
tttatttttgacag

SEQ ID NO: 1496189 - DNA, 17 bp, Homo sapiens
tttattttttaagtatt

SEQ ID NO: 1496190 - DNA, 15 bp, Homo sapiens
tttattttttacatt

SEQ ID NO: 1496191 - DNA, 17 bp, Homo sapiens
tttattttttcttttgt

SEQ ID NO: 1496192 - DNA, 13 bp, Homo sapiens
tttcaaaaacatt

SEQ ID NO: 1496193 - DNA, 17 bp, Homo sapiens
tttcaaaaatataactt

SEQ ID NO: 1496194 - DNA, 20 bp, Homo sapiens
tttcaaaaggtattatacat

SEQ ID NO: 1496195 - DNA, 21 bp, Homo sapiens
tttcaaaataagtatttctga

SEQ ID NO: 1496196 - DNA, 18 bp, Homo sapiens
tttcaaaatccaaaaaga

SEQ ID NO: 1496197 - DNA, 19 bp, Homo sapiens
tttcaaaatccaaaaagaa

SEQ ID NO: 1496198 - DNA, 19 bp, Homo sapiens
tttcaaacaatcaagttga

SEQ ID NO: 1496199 - DNA, 16 bp, Homo sapiens
tttcaaacacaaatgc

SEQ ID NO: 1496200 - DNA, 22 bp, Homo sapiens
tttcaaacatcagctgaattca

SEQ ID NO: 1496201 - DNA, 17 bp, Homo sapiens
tttcaaactgaatttgt

SEQ ID NO: 1496202 - DNA, 13 bp, Homo sapiens
tttcaaacttaaa

SEQ ID NO: 1496203 - DNA, 14 bp, Homo sapiens
tttcaaagatgctg

SEQ ID NO: 1496204 - DNA, 12 bp, Homo sapiens
tttcaaagcaca

SEQ ID NO: 1496205 - DNA, 14 bp, Homo sapiens
tttcaaagccctgc

SEQ ID NO: 1496206 - DNA, 18 bp, Homo sapiens
tttcaaagccctgcctct

SEQ ID NO: 1496207 - DNA, 19 bp, Homo sapiens
tttcaaagccctgcctctg

SEQ ID NO: 1496208 - DNA, 21 bp, Homo sapiens
tttcaaagtgatagaaaagtg

SEQ ID NO: 1496209 - DNA, 20 bp, Homo sapiens
tttcaaagttttgttgtact

SEQ ID NO: 1496210 - DNA, 20 bp, Homo sapiens
tttcaaatagggtctaactc

SEQ ID NO: 1496211 - DNA, 23 bp, Homo sapiens
tttcaaatgagtttaaaaaaata

SEQ ID NO: 1496212 - DNA, 21 bp, Homo sapiens
tttcaaatgcagaatacttga

SEQ ID NO: 1496213 - DNA, 21 bp, Homo sapiens
tttcaacatttttttttctcc

SEQ ID NO: 1496214 - DNA, 16 bp, Homo sapiens
tttcaacgcagccctg

SEQ ID NO: 1496215 - DNA, 20 bp, Homo sapiens
tttcaacgcagccctgcttt

SEQ ID NO: 1496216 - DNA, 21 bp, Homo sapiens
tttcaacgcagccctgctttg

SEQ ID NO: 1496217 - DNA, 15 bp, Homo sapiens
tttcaacggaaagtg

SEQ ID NO: 1496218 - DNA, 23 bp, Homo sapiens
tttcaacggaaagtgctgtctta

SEQ ID NO: 1496219 - DNA, 22 bp, Homo sapiens
tttcaactaatgtgtattatgt

SEQ ID NO: 1496220 - DNA, 15 bp, Homo sapiens
tttcaactactcttt

SEQ ID NO: 1496221 - DNA, 20 bp, Homo sapiens
tttcaactagaaaattctaa

SEQ ID NO: 1496222 - DNA, 22 bp, Homo sapiens
tttcaagcagtcgtgcctgtgt

SEQ ID NO: 1496223 - DNA, 18 bp, Homo sapiens
tttcaagctttcaaatcc

SEQ ID NO: 1496224 - DNA, 20 bp, Homo sapiens
tttcaaggcactctagattc

SEQ ID NO: 1496225 - DNA, 21 bp, Homo sapiens
tttcaaggcatttattgccat

SEQ ID NO: 1496226 - DNA, 12 bp, Homo sapiens
tttcaaggcctt

SEQ ID NO: 1496227 - DNA, 21 bp, Homo sapiens
tttcaaggccttcagtttatt

SEQ ID NO: 1496228 - DNA, 14 bp, Homo sapiens
tttcaaggttctaa

SEQ ID NO: 1496229 - DNA, 22 bp, Homo sapiens
tttcaagttccaagttgctaat

SEQ ID NO: 1496230 - DNA, 16 bp, Homo sapiens
tttcaagttgtaaata

SEQ ID NO: 1496231 - DNA, 18 bp, Homo sapiens
tttcaatcaactttactg

SEQ ID NO: 1496232 - DNA, 19 bp, Homo sapiens
tttcaatcaactttactgt

SEQ ID NO: 1496233 - DNA, 22 bp, Homo sapiens
tttcaatcaactttactgtaat

SEQ ID NO: 1496234 - DNA, 15 bp, Homo sapiens
tttcaatcttctact

SEQ ID NO: 1496235 - DNA, 16 bp, Homo sapiens
tttcaatcttttaaat

SEQ ID NO: 1496236 - DNA, 14 bp, Homo sapiens
tttcaatgacattt

SEQ ID NO: 1496237 - DNA, 23 bp, Homo sapiens
tttcaatgcgttttgttgtagat

SEQ ID NO: 1496238 - DNA, 20 bp, Homo sapiens
tttcaattatattgttagtg

SEQ ID NO: 1496239 - DNA, 16 bp, Homo sapiens
tttcacaatgtgaaac

SEQ ID NO: 1496240 - DNA, 23 bp, Homo sapiens
tttcacaattccatttccagttc

SEQ ID NO: 1496241 - DNA, 14 bp, Homo sapiens
tttcacactgtctt

SEQ ID NO: 1496242 - DNA, 17 bp, Homo sapiens
tttcacactgtcttccc

SEQ ID NO: 1496243 - DNA, 23 bp, Homo sapiens
tttcacagagcacgcctgccatc

SEQ ID NO: 1496244 - DNA, 15 bp, Homo sapiens
tttcacatatctagt

SEQ ID NO: 1496245 - DNA, 22 bp, Homo sapiens
tttcacatatctagtatgaaat

SEQ ID NO: 1496246 - DNA, 17 bp, Homo sapiens
tttcacattaggctgtt

SEQ ID NO: 1496247 - DNA, 16 bp, Homo sapiens
tttcacattcttggct

SEQ ID NO: 1496248 - DNA, 19 bp, Homo sapiens
tttcacattgtttgctgct

SEQ ID NO: 1496249 - DNA, 14 bp, Homo sapiens
tttcacatttttaa

SEQ ID NO: 1496250 - DNA, 19 bp, Homo sapiens
tttcaccaaaatttctaca

SEQ ID NO: 1496251 - DNA, 15 bp, Homo sapiens
tttcacccctccctt

SEQ ID NO: 1496252 - DNA, 18 bp, Homo sapiens
tttcacccctccctttct

SEQ ID NO: 1496253 - DNA, 17 bp, Homo sapiens
tttcacctactttgtaa

SEQ ID NO: 1496254 - DNA, 13 bp, Homo sapiens
tttcacctgtaaa

SEQ ID NO: 1496255 - DNA, 14 bp, Homo sapiens
tttcacctgtaaac

SEQ ID NO: 1496256 - DNA, 16 bp, Homo sapiens
tttcacctgtgacaaa

SEQ ID NO: 1496257 - DNA, 22 bp, Homo sapiens
tttcacgggaactctccaaata

SEQ ID NO: 1496258 - DNA, 15 bp, Homo sapiens
tttcacgggagattt

SEQ ID NO: 1496259 - DNA, 15 bp, Homo sapiens
tttcactatttcctt

SEQ ID NO: 1496260 - DNA, 20 bp, Homo sapiens
tttcactgctggctgcctta

SEQ ID NO: 1496261 - DNA, 24 bp, Homo sapiens
tttcactgctggctgccttagaac

SEQ ID NO: 1496262 - DNA, 17 bp, Homo sapiens
tttcactggagttacat

SEQ ID NO: 1496263 - DNA, 18 bp, Homo sapiens
tttcactggagttacatt

SEQ ID NO: 1496264 - DNA, 12 bp, Homo sapiens
tttcactgtact

SEQ ID NO: 1496265 - DNA, 13 bp, Homo sapiens
tttcacttcttcc

SEQ ID NO: 1496266 - DNA, 15 bp, Homo sapiens
tttcacttgaaagat

SEQ ID NO: 1496267 - DNA, 12 bp, Homo sapiens
tttcacttgtat

SEQ ID NO: 1496268 - DNA, 19 bp, Homo sapiens
tttcacttgtattgacttt

SEQ ID NO: 1496269 - DNA, 17 bp, Homo sapiens
tttcactttagatgctg

SEQ ID NO: 1496270 - DNA, 15 bp, Homo sapiens
tttcactttattgct

SEQ ID NO: 1496271 - DNA, 17 bp, Homo sapiens
tttcactttgtgattat

SEQ ID NO: 1496272 - DNA, 16 bp, Homo sapiens
tttcagaaaatgaaaa

SEQ ID NO: 1496273 - DNA, 16 bp, Homo sapiens
tttcagaaagcctttc

SEQ ID NO: 1496274 - DNA, 14 bp, Homo sapiens
tttcagaaatataa

SEQ ID NO: 1496275 - DNA, 20 bp, Homo sapiens
tttcagaaatataacacatt

SEQ ID NO: 1496276 - DNA, 20 bp, Homo sapiens
tttcagaaatatgtggtttc

SEQ ID NO: 1496277 - DNA, 19 bp, Homo sapiens
tttcagaacctcttcccca

SEQ ID NO: 1496278 - DNA, 23 bp, Homo sapiens
tttcagaacctcttccccagaaa

SEQ ID NO: 1496279 - DNA, 13 bp, Homo sapiens
tttctttcaactt

SEQ ID NO: 1496280 - DNA, 19 bp, Homo sapiens
tttctttcccatgtatttg

SEQ ID NO: 1496281 - DNA, 13 bp, Homo sapiens
tttctttcttcct

SEQ ID NO: 1496282 - DNA, 14 bp, Homo sapiens
tttctttgaccaga

SEQ ID NO: 1496283 - DNA, 18 bp, Homo sapiens
tttctttgcaccaaagac

SEQ ID NO: 1496284 - DNA, 20 bp, Homo sapiens
tttctttgcaccaaagacat

SEQ ID NO: 1496285 - DNA, 11 bp, Homo sapiens
tttctttgcct

SEQ ID NO: 1496286 - DNA, 14 bp, Homo sapiens
tttctttggctgca

SEQ ID NO: 1496287 - DNA, 16 bp, Homo sapiens
tttctttgtgtagtat

SEQ ID NO: 1496288 - DNA, 16 bp, Homo sapiens
tttcttttgtaaatgt

SEQ ID NO: 1496289 - DNA, 16 bp, Homo sapiens
tttcttttgtaattgt

SEQ ID NO: 1496290 - DNA, 17 bp, Homo sapiens
tttctttttacagcatt

SEQ ID NO: 1496291 - DNA, 18 bp, Homo sapiens
tttctttttactgttgaa

SEQ ID NO: 1496292 - DNA, 20 bp, Homo sapiens
tttctttttgaatctttaat

SEQ ID NO: 1496293 - DNA, 18 bp, Homo sapiens
tttctttttttctttaat

SEQ ID NO: 1496294 - DNA, 21 bp, Homo sapiens
tttgaaaaaaaagtttttaat

SEQ ID NO: 1496295 - DNA, 12 bp, Homo sapiens
tttgaaaaatat

SEQ ID NO: 1496296 - DNA, 13 bp, Homo sapiens
tttgaaaaatata

SEQ ID NO: 1496297 - DNA, 21 bp, Homo sapiens
tttgaaaaatataaaattatg

SEQ ID NO: 1496298 - DNA, 15 bp, Homo sapiens
tttgaaaagttgaaa

SEQ ID NO: 1496299 - DNA, 14 bp, Homo sapiens
tttgaaaagttgga

SEQ ID NO: 1496300 - DNA, 17 bp, Homo sapiens
tttgaaaagttggaagg

SEQ ID NO: 1496301 - DNA, 11 bp, Homo sapiens
tttgaaaatgg

SEQ ID NO: 1496302 - DNA, 24 bp, Homo sapiens
tttgaaaattatgcaaaagcagct

SEQ ID NO: 1496303 - DNA, 20 bp, Homo sapiens
tttgaaacaaagtactcttt

SEQ ID NO: 1496304 - DNA, 14 bp, Homo sapiens
tttgaaagaaaaat

SEQ ID NO: 1496305 - DNA, 13 bp, Homo sapiens
tttgaaagaagca

SEQ ID NO: 1496306 - DNA, 17 bp, Homo sapiens
tttgaaagattatgatg

SEQ ID NO: 1496307 - DNA, 15 bp, Homo sapiens
tttgaaatataattt

SEQ ID NO: 1496308 - DNA, 16 bp, Homo sapiens
tttgaaatatcatgtt

SEQ ID NO: 1496309 - DNA, 20 bp, Homo sapiens
tttgaaatgctgaaaattgc

SEQ ID NO: 1496310 - DNA, 21 bp, Homo sapiens
tttgaacacgaaagaaatgta

SEQ ID NO: 1496311 - DNA, 22 bp, Homo sapiens
tttgaacatgtgccttttctga

SEQ ID NO: 1496312 - DNA, 17 bp, Homo sapiens
tttgaaccaacatcttt

SEQ ID NO: 1496313 - DNA, 20 bp, Homo sapiens
tttgaacccccgccatcctt

SEQ ID NO: 1496314 - DNA, 13 bp, Homo sapiens
tttgaacgtgctt

SEQ ID NO: 1496315 - DNA, 14 bp, Homo sapiens
tttgaacgtgcttc

SEQ ID NO: 1496316 - DNA, 14 bp, Homo sapiens
tttgaactcttcaa

SEQ ID NO: 1496317 - DNA, 22 bp, Homo sapiens
tttgaagatgccgcatttggat

SEQ ID NO: 1496318 - DNA, 17 bp, Homo sapiens
tttgaagtaacttattt

SEQ ID NO: 1496319 - DNA, 22 bp, Homo sapiens
tttgaagtccctgtttgggaat

SEQ ID NO: 1496320 - DNA, 16 bp, Homo sapiens
tttgaagtgctgttta

SEQ ID NO: 1496321 - DNA, 20 bp, Homo sapiens
tttgaagtgctgtttattaa

SEQ ID NO: 1496322 - DNA, 23 bp, Homo sapiens
tttgaataaactctcccctttct

SEQ ID NO: 1496323 - DNA, 23 bp, Homo sapiens
tttgaataccattaaaactgctt

SEQ ID NO: 1496324 - DNA, 21 bp, Homo sapiens
tttgaatctcataatttatac

SEQ ID NO: 1496325 - DNA, 15 bp, Homo sapiens
tttgaatctttaatt

SEQ ID NO: 1496326 - DNA, 17 bp, Homo sapiens
tttgaatgcagaagcaa

SEQ ID NO: 1496327 - DNA, 17 bp, Homo sapiens
tttgaatggtttaacaa

SEQ ID NO: 1496328 - DNA, 16 bp, Homo sapiens
tttgaatgtatttgat

SEQ ID NO: 1496329 - DNA, 21 bp, Homo sapiens
tttgaatgtatttgatttata

SEQ ID NO: 1496330 - DNA, 21 bp, Homo sapiens
tttgaatgtgtgaattcaata

SEQ ID NO: 1496331 - DNA, 22 bp, Homo sapiens
tttgaattatccacatgaaaat

SEQ ID NO: 1496332 - DNA, 20 bp, Homo sapiens
tttgaattcctcctctattt

SEQ ID NO: 1496333 - DNA, 16 bp, Homo sapiens
tttgaattctgtgata

SEQ ID NO: 1496334 - DNA, 19 bp, Homo sapiens
tttgaatttaaataaagtt

SEQ ID NO: 1496335 - DNA, 14 bp, Homo sapiens
tttgaattttgttt

SEQ ID NO: 1496336 - DNA, 17 bp, Homo sapiens
tttgaattttgttttta

SEQ ID NO: 1496337 - DNA, 20 bp, Homo sapiens
tttgacaacgtttcagcgac

SEQ ID NO: 1496338 - DNA, 17 bp, Homo sapiens
tttgacaaggaaaatct

SEQ ID NO: 1496339 - DNA, 16 bp, Homo sapiens
tttgacacaaagcttc

SEQ ID NO: 1496340 - DNA, 22 bp, Homo sapiens
tttgacactgaaagttttgtaa

SEQ ID NO: 1496341 - DNA, 15 bp, Homo sapiens
tttgacactgctcta

SEQ ID NO: 1496342 - DNA, 19 bp, Homo sapiens
tttgacagaatatgtttca

SEQ ID NO: 1496343 - DNA, 21 bp, Homo sapiens
tttgacagaatatgtttcaaa

SEQ ID NO: 1496344 - DNA, 17 bp, Homo sapiens
tttgacatgggtatttt

SEQ ID NO: 1496345 - DNA, 21 bp, Homo sapiens
tttgaccagatctttctcttc

SEQ ID NO: 1496346 - DNA, 16 bp, Homo sapiens
tttgaccccgatatat

SEQ ID NO: 1496347 - DNA, 17 bp, Homo sapiens
tttgactaaagctatgt

SEQ ID NO: 1496348 - DNA, 20 bp, Homo sapiens
tttgactaaagctatgttac

SEQ ID NO: 1496349 - DNA, 17 bp, Homo sapiens
tttgactaattttacat

SEQ ID NO: 1496350 - DNA, 21 bp, Homo sapiens
tttgactagggattcaggctg

SEQ ID NO: 1496351 - DNA, 13 bp, Homo sapiens
tttgactgaaaaa

SEQ ID NO: 1496352 - DNA, 14 bp, Homo sapiens
tttgacttaatgtg

SEQ ID NO: 1496353 - DNA, 13 bp, Homo sapiens
tttgacttttctg

SEQ ID NO: 1496354 - DNA, 14 bp, Homo sapiens
tttgacttttctgt

SEQ ID NO: 1496355 - DNA, 17 bp, Homo sapiens
tttgacttttctgtaat

SEQ ID NO: 1496356 - DNA, 18 bp, Homo sapiens
tttgagaagaaaacatct

SEQ ID NO: 1496357 - DNA, 12 bp, Homo sapiens
tttgagaagttc

SEQ ID NO: 1496358 - DNA, 21 bp, Homo sapiens
tttgagaagttctcagaataa

SEQ ID NO: 1496359 - DNA, 16 bp, Homo sapiens
tttgagacaagccctg

SEQ ID NO: 1496360 - DNA, 17 bp, Homo sapiens
tttgagacaagccctgg

SEQ ID NO: 1496361 - DNA, 18 bp, Homo sapiens
tttgagacaagccctggc

SEQ ID NO: 1496362 - DNA, 14 bp, Homo sapiens
tttgagaccagcct

SEQ ID NO: 1496363 - DNA, 15 bp, Homo sapiens
tttgagagactgcca

SEQ ID NO: 1496364 - DNA, 13 bp, Homo sapiens
tttgagagttcta

SEQ ID NO: 1496365 - DNA, 17 bp, Homo sapiens
tttgagatctaaaaata

SEQ ID NO: 1496366 - DNA, 18 bp, Homo sapiens
tttgagattaagaatgcc

SEQ ID NO: 1496367 - DNA, 22 bp, Homo sapiens
tttgaggagaagggggtctctg

SEQ ID NO: 1496368 - DNA, 23 bp, Homo sapiens
tttgaggagaagggggtctctgt

SEQ ID NO: 1496369 - DNA, 19 bp, Homo sapiens
tttgaggagctggaggggt

SEQ ID NO: 1496370 - DNA, 15 bp, Homo sapiens
tttgaggatatattt

SEQ ID NO: 1496371 - DNA, 12 bp, Homo sapiens
tttgaggcaaat

SEQ ID NO: 1496372 - DNA, 14 bp, Homo sapiens
tttgagtacagata

SEQ ID NO: 1496373 - DNA, 19 bp, Homo sapiens
tttgagtcaaagacttaaa

SEQ ID NO: 1496374 - DNA, 20 bp, Homo sapiens
tttgagtcctaggacttaaa

SEQ ID NO: 1496375 - DNA, 20 bp, Homo sapiens
tttgagtctatcctagtctt

SEQ ID NO: 1496376 - DNA, 20 bp, Homo sapiens
tttgagtcttggtgctatca

SEQ ID NO: 1496377 - DNA, 18 bp, Homo sapiens
tttgagtgtgtgtgtgca

SEQ ID NO: 1496378 - DNA, 14 bp, Homo sapiens
tttgataaacattc

SEQ ID NO: 1496379 - DNA, 19 bp, Homo sapiens
tttgataaagtttctcaga

SEQ ID NO: 1496380 - DNA, 14 bp, Homo sapiens
tttgataacaaaaa

SEQ ID NO: 1496381 - DNA, 13 bp, Homo sapiens
tttgatacataat

SEQ ID NO: 1496382 - DNA, 17 bp, Homo sapiens
tttgatacataataaaa

SEQ ID NO: 1496383 - DNA, 13 bp, Homo sapiens
tttgatcatgaat

SEQ ID NO: 1496384 - DNA, 14 bp, Homo sapiens
tttgatctttttat

SEQ ID NO: 1496385 - DNA, 21 bp, Homo sapiens
tttgatgaggtattttttcct

SEQ ID NO: 1496386 - DNA, 17 bp, Homo sapiens
tttgatgcatgtctttt

SEQ ID NO: 1496387 - DNA, 20 bp, Homo sapiens
tttgatgctatttatgcaag

SEQ ID NO: 1496388 - DNA, 15 bp, Homo sapiens
tttgatgctgtttga

SEQ ID NO: 1496389 - DNA, 12 bp, Homo sapiens
tttgatggctgg

SEQ ID NO: 1496390 - DNA, 20 bp, Homo sapiens
tttgatggtgccagagaggg

SEQ ID NO: 1496391 - DNA, 10 bp, Homo sapiens
tttgatgtat

SEQ ID NO: 1496392 - DNA, 23 bp, Homo sapiens
tttgatgtatgtgtgaaacaatg

SEQ ID NO: 1496393 - DNA, 17 bp, Homo sapiens
tttgatgtttgtggcct

SEQ ID NO: 1496394 - DNA, 12 bp, Homo sapiens
tttgttcctgga

SEQ ID NO: 1496395 - DNA, 14 bp, Homo sapiens
tttgttctacatga

SEQ ID NO: 1496396 - DNA, 13 bp, Homo sapiens
tttgttctgtttt

SEQ ID NO: 1496397 - DNA, 23 bp, Homo sapiens
tttgttcttaaaaaaataaaata

SEQ ID NO: 1496398 - DNA, 21 bp, Homo sapiens
tttgttgacagcaaaatgttg

SEQ ID NO: 1496399 - DNA, 19 bp, Homo sapiens
tttgttgcaagatgtgaat

SEQ ID NO: 1496400 - DNA, 12 bp, Homo sapiens
tttgttgtaaaa

SEQ ID NO: 1496401 - DNA, 15 bp, Homo sapiens
tttgttgtaaaacaa

SEQ ID NO: 1496402 - DNA, 12 bp, Homo sapiens
tttgttgtagat

SEQ ID NO: 1496403 - DNA, 15 bp, Homo sapiens
tttgttgtagatgct

SEQ ID NO: 1496404 - DNA, 22 bp, Homo sapiens
tttgttgtctacattaaatcac

SEQ ID NO: 1496405 - DNA, 13 bp, Homo sapiens
tttgttgtgactt

SEQ ID NO: 1496406 - DNA, 13 bp, Homo sapiens
tttgtttaaagaa

SEQ ID NO: 1496407 - DNA, 15 bp, Homo sapiens
tttgtttcctttgtt

SEQ ID NO: 1496408 - DNA, 12 bp, Homo sapiens
tttgtttctgta

SEQ ID NO: 1496409 - DNA, 13 bp, Homo sapiens
tttgtttctgtat

SEQ ID NO: 1496410 - DNA, 18 bp, Homo sapiens
tttgtttgtaagtttgaa

SEQ ID NO: 1496411 - DNA, 13 bp, Homo sapiens
tttgtttgttctt

SEQ ID NO: 1496412 - DNA, 16 bp, Homo sapiens
tttgtttgttcttgtt

SEQ ID NO: 1496413 - DNA, 14 bp, Homo sapiens
tttgttttcaagat

SEQ ID NO: 1496414 - DNA, 14 bp, Homo sapiens
tttgttttttcctt

SEQ ID NO: 1496415 - DNA, 15 bp, Homo sapiens
tttgttttttggtga

SEQ ID NO: 1496416 - DNA, 21 bp, Homo sapiens
tttgtttttttgcagaattaa

SEQ ID NO: 1496417 - DNA, 19 bp, Homo sapiens
tttgttttttttgactaaa

SEQ ID NO: 1496418 - DNA, 22 bp, Homo sapiens
ttttaaaaaaactggatatttc

SEQ ID NO: 1496419 - DNA, 21 bp, Homo sapiens
ttttaaaaaaagctaaattac

SEQ ID NO: 1496420 - DNA, 21 bp, Homo sapiens
ttttaaaaaaatttttataaa

SEQ ID NO: 1496421 - DNA, 14 bp, Homo sapiens
ttttaaaaaataac

SEQ ID NO: 1496422 - DNA, 23 bp, Homo sapiens
ttttaaaaaataacatattcttg

SEQ ID NO: 1496423 - DNA, 22 bp, Homo sapiens
ttttaaaaaatgttttctgggg

SEQ ID NO: 1496424 - DNA, 20 bp, Homo sapiens
ttttaaaaacataacataaa

SEQ ID NO: 1496425 - DNA, 19 bp, Homo sapiens
ttttaaaaacctgtatctg

SEQ ID NO: 1496426 - DNA, 22 bp, Homo sapiens
ttttaaaaagaaacaagatgct

SEQ ID NO: 1496427 - DNA, 18 bp, Homo sapiens
ttttaaaagccttggcct

SEQ ID NO: 1496428 - DNA, 18 bp, Homo sapiens
ttttaaaagtaaatgtac

SEQ ID NO: 1496429 - DNA, 22 bp, Homo sapiens
ttttaaaagttactccttttag

SEQ ID NO: 1496430 - DNA, 16 bp, Homo sapiens
ttttaaaatagaaatt

SEQ ID NO: 1496431 - DNA, 21 bp, Homo sapiens
ttttaaaatgtacatgtatta

SEQ ID NO: 1496432 - DNA, 13 bp, Homo sapiens
ttttaaaatgtca

SEQ ID NO: 1496433 - DNA, 11 bp, Homo sapiens
ttttaaaattt

SEQ ID NO: 1496434 - DNA, 15 bp, Homo sapiens
ttttaaaatttgttc

SEQ ID NO: 1496435 - DNA, 19 bp, Homo sapiens
ttttaaacagtgagcctga

SEQ ID NO: 1496436 - DNA, 17 bp, Homo sapiens
ttttaaacttgaaatat

SEQ ID NO: 1496437 - DNA, 19 bp, Homo sapiens
ttttaaagaaaaatatgat

SEQ ID NO: 1496438 - DNA, 11 bp, Homo sapiens
ttttaaagaat

SEQ ID NO: 1496439 - DNA, 13 bp, Homo sapiens
ttttaaagtgatt

SEQ ID NO: 1496440 - DNA, 18 bp, Homo sapiens
ttttaaagttcattgcaa

SEQ ID NO: 1496441 - DNA, 17 bp, Homo sapiens
ttttaaataaaagcaca

SEQ ID NO: 1496442 - DNA, 21 bp, Homo sapiens
ttttaaataaaagcacaagta

SEQ ID NO: 1496443 - DNA, 14 bp, Homo sapiens
ttttaaatataaat

SEQ ID NO: 1496444 - DNA, 17 bp, Homo sapiens
ttttaaatattttctat

SEQ ID NO: 1496445 - DNA, 14 bp, Homo sapiens
ttttaaatcaagga

SEQ ID NO: 1496446 - DNA, 14 bp, Homo sapiens
ttttaaatcttgac

SEQ ID NO: 1496447 - DNA, 20 bp, Homo sapiens
ttttaaatgtgtgagtgcat

SEQ ID NO: 1496448 - DNA, 20 bp, Homo sapiens
ttttaacaaaagcaagactg

SEQ ID NO: 1496449 - DNA, 14 bp, Homo sapiens
ttttaacattcctc

SEQ ID NO: 1496450 - DNA, 17 bp, Homo sapiens
ttttaaccctaatcttt

SEQ ID NO: 1496451 - DNA, 18 bp, Homo sapiens
ttttaactcttttggaca

SEQ ID NO: 1496452 - DNA, 13 bp, Homo sapiens
ttttaactttaat

SEQ ID NO: 1496453 - DNA, 15 bp, Homo sapiens
ttttaagatagtgta

SEQ ID NO: 1496454 - DNA, 23 bp, Homo sapiens
ttttaagatagtgtaacttgctt

SEQ ID NO: 1496455 - DNA, 12 bp, Homo sapiens
ttttaagatctt

SEQ ID NO: 1496456 - DNA, 16 bp, Homo sapiens
ttttaagctaaaatgt

SEQ ID NO: 1496457 - DNA, 17 bp, Homo sapiens
ttttaagctaaaatgtt

SEQ ID NO: 1496458 - DNA, 21 bp, Homo sapiens
ttttaagctgcaaatctgatg

SEQ ID NO: 1496459 - DNA, 15 bp, Homo sapiens
ttttaagggggaaaa

SEQ ID NO: 1496460 - DNA, 17 bp, Homo sapiens
ttttaaggtctttcagt

SEQ ID NO: 1496461 - DNA, 19 bp, Homo sapiens
ttttaaggttgcacacagt

SEQ ID NO: 1496462 - DNA, 22 bp, Homo sapiens
ttttaaggtttgcaaattaaaa

SEQ ID NO: 1496463 - DNA, 15 bp, Homo sapiens
ttttaagtgagtcct

SEQ ID NO: 1496464 - DNA, 19 bp, Homo sapiens
ttttaagtgctttgtaatg

SEQ ID NO: 1496465 - DNA, 17 bp, Homo sapiens
ttttaagtgtatcttaa

SEQ ID NO: 1496466 - DNA, 15 bp, Homo sapiens
ttttaagttgtcaaa

SEQ ID NO: 1496467 - DNA, 16 bp, Homo sapiens
ttttaagttgtttgca

SEQ ID NO: 1496468 - DNA, 15 bp, Homo sapiens
ttttaatagcactaa

SEQ ID NO: 1496469 - DNA, 12 bp, Homo sapiens
ttttaatcatga

SEQ ID NO: 1496470 - DNA, 12 bp, Homo sapiens
ttttaatcttaa

SEQ ID NO: 1496471 - DNA, 17 bp, Homo sapiens
ttttaatgaaatcaaat

SEQ ID NO: 1496472 - DNA, 18 bp, Homo sapiens
ttttaatgaaatcaaatg

SEQ ID NO: 1496473 - DNA, 21 bp, Homo sapiens
ttttaatgaatattgatgtta

SEQ ID NO: 1496474 - DNA, 22 bp, Homo sapiens
ttttaatgatctcggatgacca

SEQ ID NO: 1496475 - DNA, 20 bp, Homo sapiens
ttttaatgctatttgaacaa

SEQ ID NO: 1496476 - DNA, 14 bp, Homo sapiens
ttttaatgtacaag

SEQ ID NO: 1496477 - DNA, 20 bp, Homo sapiens
ttttaatgtacaagttttgt

SEQ ID NO: 1496478 - DNA, 22 bp, Homo sapiens
ttttaatgtctgtttattaact

SEQ ID NO: 1496479 - DNA, 11 bp, Homo sapiens
ttttaatgtga

SEQ ID NO: 1496480 - DNA, 14 bp, Homo sapiens
ttttaatgtgaaga

SEQ ID NO: 1496481 - DNA, 19 bp, Homo sapiens
ttttaatgtgaagacattt

SEQ ID NO: 1496482 - DNA, 20 bp, Homo sapiens
ttttaatgtgaagacatttt

SEQ ID NO: 1496483 - DNA, 11 bp, Homo sapiens
ttttaattatt

SEQ ID NO: 1496484 - DNA, 16 bp, Homo sapiens
ttttaattattattct

SEQ ID NO: 1496485 - DNA, 19 bp, Homo sapiens
ttttaattcacgtgctttg

SEQ ID NO: 1496486 - DNA, 12 bp, Homo sapiens
ttttaattcatt

SEQ ID NO: 1496487 - DNA, 15 bp, Homo sapiens
ttttaattgattatt

SEQ ID NO: 1496488 - DNA, 12 bp, Homo sapiens
ttttaatttaac

SEQ ID NO: 1496489 - DNA, 13 bp, Homo sapiens
ttttaatttcagg

SEQ ID NO: 1496490 - DNA, 21 bp, Homo sapiens
ttttaatttcaggaaaatgta

SEQ ID NO: 1496491 - DNA, 11 bp, Homo sapiens
ttttaatttga

SEQ ID NO: 1496492 - DNA, 14 bp, Homo sapiens
ttttaattttaacc

SEQ ID NO: 1496493 - DNA, 23 bp, Homo sapiens
ttttaattttgatatacattgtg

SEQ ID NO: 1496494 - DNA, 14 bp, Homo sapiens
ttttacaattgaaa

SEQ ID NO: 1496495 - DNA, 15 bp, Homo sapiens
ttttacacagaaaca

SEQ ID NO: 1496496 - DNA, 23 bp, Homo sapiens
ttttacagagaggatacatttaa

SEQ ID NO: 1496497 - DNA, 16 bp, Homo sapiens
ttttacagatccagaa

SEQ ID NO: 1496498 - DNA, 21 bp, Homo sapiens
ttttacagcattgtctttgct

SEQ ID NO: 1496499 - DNA, 22 bp, Homo sapiens
ttttacagttagggttttgcaa

SEQ ID NO: 1496500 - DNA, 18 bp, Homo sapiens
ttttacatgtttataaat

SEQ ID NO: 1496501 - DNA, 18 bp, Homo sapiens
ttttacattccatttcat

SEQ ID NO: 1496502 - DNA, 12 bp, Homo sapiens
ttttacatttca

SEQ ID NO: 1496503 - DNA, 16 bp, Homo sapiens
ttttacatttcataca

SEQ ID NO: 1496504 - DNA, 13 bp, Homo sapiens
ttttaccaaagca

SEQ ID NO: 1496505 - DNA, 14 bp, Homo sapiens
ttttaccagctccc

SEQ ID NO: 1496506 - DNA, 19 bp, Homo sapiens
ttttacctaccacagtgtc

SEQ ID NO: 1496507 - DNA, 20 bp, Homo sapiens
ttttacctaccacagtgtct

SEQ ID NO: 1496508 - DNA, 21 bp, Homo sapiens
ttttactaatatatattttaa

SEQ ID NO: 1496509 - DNA, 22 bp, Homo sapiens
ttttactccaggttattgcaat

SEQ ID NO: 1496510 - DNA, 19 bp, Homo sapiens
tttttactaatatatattt

SEQ ID NO: 1496511 - DNA, 15 bp, Homo sapiens
tttttactgaaacat

SEQ ID NO: 1496512 - DNA, 15 bp, Homo sapiens
tttttactgctctga

SEQ ID NO: 1496513 - DNA, 22 bp, Homo sapiens
tttttacttttcacactgtctt

SEQ ID NO: 1496514 - DNA, 14 bp, Homo sapiens
tttttagatgtatt

SEQ ID NO: 1496515 - DNA, 19 bp, Homo sapiens
tttttagattgagaaatgt

SEQ ID NO: 1496516 - DNA, 23 bp, Homo sapiens
tttttagtatttatttatgtact

SEQ ID NO: 1496517 - DNA, 12 bp, Homo sapiens
tttttagttaaa

SEQ ID NO: 1496518 - DNA, 12 bp, Homo sapiens
tttttagttttt

SEQ ID NO: 1496519 - DNA, 19 bp, Homo sapiens
tttttataaaagcaaaaga

SEQ ID NO: 1496520 - DNA, 18 bp, Homo sapiens
tttttataaactaccaaa

SEQ ID NO: 1496521 - DNA, 23 bp, Homo sapiens
tttttataacatctttattgaaa

SEQ ID NO: 1496522 - DNA, 13 bp, Homo sapiens
tttttataattgt

SEQ ID NO: 1496523 - DNA, 13 bp, Homo sapiens
tttttatacaaaa

SEQ ID NO: 1496524 - DNA, 15 bp, Homo sapiens
tttttataccattca

SEQ ID NO: 1496525 - DNA, 12 bp, Homo sapiens
tttttatactcc

SEQ ID NO: 1496526 - DNA, 21 bp, Homo sapiens
tttttatactccatacataac

SEQ ID NO: 1496527 - DNA, 14 bp, Homo sapiens
tttttatatataca

SEQ ID NO: 1496528 - DNA, 15 bp, Homo sapiens
tttttatattaatgt

SEQ ID NO: 1496529 - DNA, 22 bp, Homo sapiens
tttttatatttcctttatgtga

SEQ ID NO: 1496530 - DNA, 19 bp, Homo sapiens
tttttatgaagaaaaagta

SEQ ID NO: 1496531 - DNA, 15 bp, Homo sapiens
tttttatgcagacag

SEQ ID NO: 1496532 - DNA, 16 bp, Homo sapiens
tttttatgtgatcaat

SEQ ID NO: 1496533 - DNA, 13 bp, Homo sapiens
tttttattaaatg

SEQ ID NO: 1496534 - DNA, 13 bp, Homo sapiens
tttttatttacat

SEQ ID NO: 1496535 - DNA, 14 bp, Homo sapiens
tttttcaagagatc

SEQ ID NO: 1496536 - DNA, 23 bp, Homo sapiens
tttttcaaggcatttattgccat

SEQ ID NO: 1496537 - DNA, 17 bp, Homo sapiens
tttttcaagttgtaaat

SEQ ID NO: 1496538 - DNA, 16 bp, Homo sapiens
tttttcaatatttatt

SEQ ID NO: 1496539 - DNA, 20 bp, Homo sapiens
tttttcaatcaactttactg

SEQ ID NO: 1496540 - DNA, 21 bp, Homo sapiens
tttttcaatcaactttactgt

SEQ ID NO: 1496541 - DNA, 12 bp, Homo sapiens
tttttcatttgt

SEQ ID NO: 1496542 - DNA, 13 bp, Homo sapiens
tttttcatttgtt

SEQ ID NO: 1496543 - DNA, 15 bp, Homo sapiens
tttttccaaaacctc

SEQ ID NO: 1496544 - DNA, 16 bp, Homo sapiens
tttttccaaaacctca

SEQ ID NO: 1496545 - DNA, 20 bp, Homo sapiens
tttttccaaccaaggaattt

SEQ ID NO: 1496546 - DNA, 12 bp, Homo sapiens
tttttccaggct

SEQ ID NO: 1496547 - DNA, 18 bp, Homo sapiens
tttttcctagccctctca

SEQ ID NO: 1496548 - DNA, 17 bp, Homo sapiens
tttttcctcatgtaaca

SEQ ID NO: 1496549 - DNA, 11 bp, Homo sapiens
tttttcctgca

SEQ ID NO: 1496550 - DNA, 16 bp, Homo sapiens
tttttctaagagaagt

SEQ ID NO: 1496551 - DNA, 21 bp, Homo sapiens
tttttctaccataagtgacac

SEQ ID NO: 1496552 - DNA, 22 bp, Homo sapiens
tttttctacctgtacacattcc

SEQ ID NO: 1496553 - DNA, 21 bp, Homo sapiens
tttttctagtttcagtaaata

SEQ ID NO: 1496554 - DNA, 13 bp, Homo sapiens
tttttctgataaa

SEQ ID NO: 1496555 - DNA, 17 bp, Homo sapiens
tttttctgcctgagatt

SEQ ID NO: 1496556 - DNA, 18 bp, Homo sapiens
tttttctgcctgagattc

SEQ ID NO: 1496557 - DNA, 16 bp, Homo sapiens
tttttctgtaccagtt

SEQ ID NO: 1496558 - DNA, 16 bp, Homo sapiens
tttttcttaaaagtac

SEQ ID NO: 1496559 - DNA, 21 bp, Homo sapiens
tttttcttaaaagtactttaa

SEQ ID NO: 1496560 - DNA, 19 bp, Homo sapiens
tttttcttaaatatgtata

SEQ ID NO: 1496561 - DNA, 13 bp, Homo sapiens
tttttcttaatca

SEQ ID NO: 1496562 - DNA, 21 bp, Homo sapiens
tttttcttcaaatgtttaaac

SEQ ID NO: 1496563 - DNA, 11 bp, Homo sapiens
tttttcttccc

SEQ ID NO: 1496564 - DNA, 13 bp, Homo sapiens
tttttcttccctt

SEQ ID NO: 1496565 - DNA, 14 bp, Homo sapiens
tttttcttcgctgg

SEQ ID NO: 1496566 - DNA, 21 bp, Homo sapiens
tttttcttttcggaaatctta

SEQ ID NO: 1496567 - DNA, 19 bp, Homo sapiens
tttttctttttccagtgtt

SEQ ID NO: 1496568 - DNA, 13 bp, Homo sapiens
tttttgaaaacat

SEQ ID NO: 1496569 - DNA, 14 bp, Homo sapiens
tttttgaaataata

SEQ ID NO: 1496570 - DNA, 17 bp, Homo sapiens
tttttgaaatgctgaaa

SEQ ID NO: 1496571 - DNA, 20 bp, Homo sapiens
tttttgaaatgctgaaaatt

SEQ ID NO: 1496572 - DNA, 18 bp, Homo sapiens
tttttgaaccaacatctt

SEQ ID NO: 1496573 - DNA, 19 bp, Homo sapiens
tttttgaatttaaataaag

SEQ ID NO: 1496574 - DNA, 12 bp, Homo sapiens
tttttgacagaa

SEQ ID NO: 1496575 - DNA, 16 bp, Homo sapiens
tttttgactcccagat

SEQ ID NO: 1496576 - DNA, 12 bp, Homo sapiens
tttttgactttt

SEQ ID NO: 1496577 - DNA, 20 bp, Homo sapiens
tttttgactttttttgtatg

SEQ ID NO: 1496578 - DNA, 16 bp, Homo sapiens
tttttgagacagagtc

SEQ ID NO: 1496579 - DNA, 11 bp, Homo sapiens
tttttgcaaat

SEQ ID NO: 1496580 - DNA, 21 bp, Homo sapiens
tttttgcacaattgtaattga

SEQ ID NO: 1496581 - DNA, 20 bp, Homo sapiens
tttttgcacatgtttcctct

SEQ ID NO: 1496582 - DNA, 16 bp, Homo sapiens
tttttgcagtaactgt

SEQ ID NO: 1496583 - DNA, 16 bp, Homo sapiens
tttttgccacagcttt

SEQ ID NO: 1496584 - DNA, 14 bp, Homo sapiens
tttttgccttcatt

SEQ ID NO: 1496585 - DNA, 16 bp, Homo sapiens
tttttgctataatcat

SEQ ID NO: 1496586 - DNA, 23 bp, Homo sapiens
tttttgctgctgcctctttccct

SEQ ID NO: 1496587 - DNA, 15 bp, Homo sapiens
tttttgcttctactt

SEQ ID NO: 1496588 - DNA, 18 bp, Homo sapiens
tttttgcttctactttca

SEQ ID NO: 1496589 - DNA, 12 bp, Homo sapiens
tttttggacttc

SEQ ID NO: 1496590 - DNA, 16 bp, Homo sapiens
tttttggcctgtttga

SEQ ID NO: 1496591 - DNA, 20 bp, Homo sapiens
tttttggcctgtttgatgta

SEQ ID NO: 1496592 - DNA, 20 bp, Homo sapiens
tttttggcgtggctgactta

SEQ ID NO: 1496593 - DNA, 19 bp, Homo sapiens
tttttggggcatcctggat

SEQ ID NO: 1496594 - DNA, 21 bp, Homo sapiens
tttttggggggttttcttgcc

SEQ ID NO: 1496595 - DNA, 22 bp, Homo sapiens
tttttggtcgaggagtaacaat

SEQ ID NO: 1496596 - DNA, 22 bp, Homo sapiens
tttttggtcttctgttgacatt

SEQ ID NO: 1496597 - DNA, 14 bp, Homo sapiens
tttttggttgggaa

SEQ ID NO: 1496598 - DNA, 18 bp, Homo sapiens
tttttggttgtcaatatt

SEQ ID NO: 1496599 - DNA, 14 bp, Homo sapiens
tttttgtaaagatt

SEQ ID NO: 1496600 - DNA, 19 bp, Homo sapiens
tttttgtaaagatttctgt

SEQ ID NO: 1496601 - DNA, 15 bp, Homo sapiens
tttttgtaactacaa

SEQ ID NO: 1496602 - DNA, 17 bp, Homo sapiens
tttttgtacattacact

SEQ ID NO: 1496603 - DNA, 14 bp, Homo sapiens
tttttgtaccattt

SEQ ID NO: 1496604 - DNA, 23 bp, Homo sapiens
tttttgtaccattttaaagttag

SEQ ID NO: 1496605 - DNA, 19 bp, Homo sapiens
tttttgtagcactgacaga

SEQ ID NO: 1496606 - DNA, 15 bp, Homo sapiens
tttttgtatattaca

SEQ ID NO: 1496607 - DNA, 16 bp, Homo sapiens
tttttgtatgcttaaa

SEQ ID NO: 1496608 - DNA, 14 bp, Homo sapiens
tttttgtatgtgtg

SEQ ID NO: 1496609 - DNA, 12 bp, Homo sapiens
tttttgtatttt

SEQ ID NO: 1496610 - DNA, 21 bp, Homo sapiens
tttttgtcccccaacttgaga

SEQ ID NO: 1496611 - DNA, 13 bp, Homo sapiens
tttttgtctcaat

SEQ ID NO: 1496612 - DNA, 18 bp, Homo sapiens
tttttgtgtatgtactta

SEQ ID NO: 1496613 - DNA, 15 bp, Homo sapiens
tttttgtgtgtattt

SEQ ID NO: 1496614 - DNA, 18 bp, Homo sapiens
tttttgtgtgtatttgct

SEQ ID NO: 1496615 - DNA, 22 bp, Homo sapiens
tttttgttccacaagttaaata

SEQ ID NO: 1496616 - DNA, 11 bp, Homo sapiens
tttttgtttgg

SEQ ID NO: 1496617 - DNA, 16 bp, Homo sapiens
tttttgttttttgtaa

SEQ ID NO: 1496618 - DNA, 17 bp, Homo sapiens
ttttttaaaaaatttgc

SEQ ID NO: 1496619 - DNA, 12 bp, Homo sapiens
ttttttaacatt

SEQ ID NO: 1496620 - DNA, 17 bp, Homo sapiens
ttttttaagaatatctg

SEQ ID NO: 1496621 - DNA, 17 bp, Homo sapiens
ttttttaagtatttata

SEQ ID NO: 1496622 - DNA, 17 bp, Homo sapiens
ttttttaggacatctta

SEQ ID NO: 1496623 - DNA, 21 bp, Homo sapiens
ttttttagtatttatttatgt

SEQ ID NO: 1496624 - DNA, 13 bp, Homo sapiens
ttttttagttgaa

SEQ ID NO: 1496625 - DNA, 12 bp, Homo sapiens
ttttttatgaag

SEQ ID NO: 1496626 - DNA, 14 bp, Homo sapiens
tttttaataaaaat

SEQ ID NO: 1496627 - DNA, 21 bp, Homo sapiens
tttttaatagcactaaccaat

SEQ ID NO: 1496628 - DNA, 17 bp, Homo sapiens
tttttaatcatgaaatt

SEQ ID NO: 1496629 - DNA, 13 bp, Homo sapiens
tttttaatgctat

SEQ ID NO: 1496630 - DNA, 12 bp, Homo sapiens
tttttaatgtat

SEQ ID NO: 1496631 - DNA, 12 bp, Homo sapiens
tttttaattatt

SEQ ID NO: 1496632 - DNA, 14 bp, Homo sapiens
tttttaatttaaac

SEQ ID NO: 1496633 - DNA, 20 bp, Homo sapiens
tttttaatttgatgaaagct

SEQ ID NO: 1496634 - DNA, 18 bp, Homo sapiens
tttttacaagttttaaat

SEQ ID NO: 1496635 - DNA, 13 bp, Homo sapiens
tttttacaataaa

SEQ ID NO: 1496636 - DNA, 21 bp, Homo sapiens
tttttacagcattgtctttgc

SEQ ID NO: 1496637 - DNA, 18 bp, Homo sapiens
tttttaccacttctgttt

SEQ ID NO: 1496638 - DNA, 13 bp, Homo sapiens
tttttacctaatc

SEQ ID NO: 1496639 - DNA, 17 bp, Homo sapiens
tttttactacataatta

SEQ ID NO: 1496640 - DNA, 18 bp, Homo sapiens
tttttactgtgttttata

SEQ ID NO: 1496641 - DNA, 17 bp, Homo sapiens
tttttagaaatgtgaag

SEQ ID NO: 1496642 - DNA, 20 bp, Homo sapiens
tttttagattgagaaatgtg

SEQ ID NO: 1496643 - DNA, 12 bp, Homo sapiens
tttttagttgaa

SEQ ID NO: 1496644 - DNA, 15 bp, Homo sapiens
tttttagttgaattt

SEQ ID NO: 1496645 - DNA, 23 bp, Homo sapiens
tttttagttgccaacagttgtat

SEQ ID NO: 1496646 - DNA, 21 bp, Homo sapiens
tttttataaagtctaagcaag

SEQ ID NO: 1496647 - DNA, 12 bp, Homo sapiens
tttttatactgc

SEQ ID NO: 1496648 - DNA, 23 bp, Homo sapiens
tttttatactgcacagtggcaca

SEQ ID NO: 1496649 - DNA, 12 bp, Homo sapiens
tttttatacttt

SEQ ID NO: 1496650 - DNA, 17 bp, Homo sapiens
tttttatcatgcatgtc

SEQ ID NO: 1496651 - DNA, 22 bp, Homo sapiens
tttttatcatgtcgtaggtaaa

SEQ ID NO: 1496652 - DNA, 17 bp, Homo sapiens
tttttatcttgggactg

SEQ ID NO: 1496653 - DNA, 17 bp, Homo sapiens
tttttatgcagacagtc

SEQ ID NO: 1496654 - DNA, 13 bp, Homo sapiens
tttttatgctctt

SEQ ID NO: 1496655 - DNA, 14 bp, Homo sapiens
tttttatgtgctat

SEQ ID NO: 1496656 - DNA, 16 bp, Homo sapiens
tttttatgttttgaaa

SEQ ID NO: 1496657 - DNA, 21 bp, Homo sapiens
tttttattaaagcatttccta

SEQ ID NO: 1496658 - DNA, 14 bp, Homo sapiens
tttttattaattta

SEQ ID NO: 1496659 - DNA, 14 bp, Homo sapiens
tttttattatgcat

SEQ ID NO: 1496660 - DNA, 19 bp, Homo sapiens
tttttcaaagatgtgttgc

SEQ ID NO: 1496661 - DNA, 17 bp, Homo sapiens
tttttcaatatattgaa

SEQ ID NO: 1496662 - DNA, 19 bp, Homo sapiens
tttttcaatatattgaact

SEQ ID NO: 1496663 - DNA, 20 bp, Homo sapiens
tttttcaatatattgaactt

SEQ ID NO: 1496664 - DNA, 18 bp, Homo sapiens
tttttcacaatgtgaaac

SEQ ID NO: 1496665 - DNA, 19 bp, Homo sapiens
tttttcacaatgtgaaact

SEQ ID NO: 1496666 - DNA, 22 bp, Homo sapiens
tttttcacataaagggaacaaa

SEQ ID NO: 1496667 - DNA, 13 bp, Homo sapiens
tttggtagatgtt

SEQ ID NO: 1496668 - DNA, 17 bp, Homo sapiens
tttggtaggtaaatcta

SEQ ID NO: 1496669 - DNA, 13 bp, Homo sapiens
tttggtcatgccc

SEQ ID NO: 1496670 - DNA, 16 bp, Homo sapiens
tttggtcgaggagtaa

SEQ ID NO: 1496671 - DNA, 15 bp, Homo sapiens
tttggtctgccagaa

SEQ ID NO: 1496672 - DNA, 12 bp, Homo sapiens
tttggtgttttg

SEQ ID NO: 1496673 - DNA, 12 bp, Homo sapiens
tttggttaatat

SEQ ID NO: 1496674 - DNA, 19 bp, Homo sapiens
tttggttaatatgtctttt

SEQ ID NO: 1496675 - DNA, 17 bp, Homo sapiens
tttggttctctccagga

SEQ ID NO: 1496676 - DNA, 20 bp, Homo sapiens
tttggttgtaaatgctcgtg

SEQ ID NO: 1496677 - DNA, 21 bp, Homo sapiens
tttggtttatgcggtgctgtc

SEQ ID NO: 1496678 - DNA, 15 bp, Homo sapiens
tttggtttcttcatt

SEQ ID NO: 1496679 - DNA, 21 bp, Homo sapiens
tttggttttccttaactaaat

SEQ ID NO: 1496680 - DNA, 15 bp, Homo sapiens
tttggttttgttccc

SEQ ID NO: 1496681 - DNA, 21 bp, Homo sapiens
tttggttttgttcccctcctc

SEQ ID NO: 1496682 - DNA, 18 bp, Homo sapiens
tttgtaaaacaatgccat

SEQ ID NO: 1496683 - DNA, 23 bp, Homo sapiens
tttgtaaaagaacagtaaacatt

SEQ ID NO: 1496684 - DNA, 18 bp, Homo sapiens
tttgtaaactacaaagta

SEQ ID NO: 1496685 - DNA, 17 bp, Homo sapiens
tttgtaaactcaaaata

SEQ ID NO: 1496686 - DNA, 17 bp, Homo sapiens
tttgtaaactgtatcaa

SEQ ID NO: 1496687 - DNA, 15 bp, Homo sapiens
tttgtaaataagaga

SEQ ID NO: 1496688 - DNA, 15 bp, Homo sapiens
tttgtaaatctgcca

SEQ ID NO: 1496689 - DNA, 17 bp, Homo sapiens
tttgtaaatctgccaca

SEQ ID NO: 1496690 - DNA, 21 bp, Homo sapiens
tttgtaaatgcctcttaaatt

SEQ ID NO: 1496691 - DNA, 16 bp, Homo sapiens
tttgtaaatgtactgg

SEQ ID NO: 1496692 - DNA, 17 bp, Homo sapiens
tttgtaaatttatgtga

SEQ ID NO: 1496693 - DNA, 22 bp, Homo sapiens
tttgtaactacaaagctttgct

SEQ ID NO: 1496694 - DNA, 21 bp, Homo sapiens
tttgtaagacatttgtatatt

SEQ ID NO: 1496695 - DNA, 20 bp, Homo sapiens
tttgtaagtgtaaaaaatgt

SEQ ID NO: 1496696 - DNA, 21 bp, Homo sapiens
tttgtaataaaggtctttgca

SEQ ID NO: 1496697 - DNA, 23 bp, Homo sapiens
tttgtaataagcaatcaaggtta

SEQ ID NO: 1496698 - DNA, 14 bp, Homo sapiens
tttgtaatatacag

SEQ ID NO: 1496699 - DNA, 16 bp, Homo sapiens
tttgtaatatttttgt

SEQ ID NO: 1496700 - DNA, 16 bp, Homo sapiens
tttgtaattgtgtaaa

SEQ ID NO: 1496701 - DNA, 21 bp, Homo sapiens
tttgtaattttaaaagtctat

SEQ ID NO: 1496702 - DNA, 19 bp, Homo sapiens
tttgtacaaggtaattgtt

SEQ ID NO: 1496703 - DNA, 20 bp, Homo sapiens
tttgtacaaggtaattgttt

SEQ ID NO: 1496704 - DNA, 12 bp, Homo sapiens
tttgtacactta

SEQ ID NO: 1496705 - DNA, 19 bp, Homo sapiens
tttgtacatatgtaaaata

SEQ ID NO: 1496706 - DNA, 11 bp, Homo sapiens
tttgtacatgt

SEQ ID NO: 1496707 - DNA, 19 bp, Homo sapiens
tttgtacattacactaaat

SEQ ID NO: 1496708 - DNA, 19 bp, Homo sapiens
tttgtaccattttaaagtt

SEQ ID NO: 1496709 - DNA, 14 bp, Homo sapiens
tttgtacctctaag

SEQ ID NO: 1496710 - DNA, 20 bp, Homo sapiens
tttgtaccttttgtagtttt

SEQ ID NO: 1496711 - DNA, 15 bp, Homo sapiens
tttgtactgaatttt

SEQ ID NO: 1496712 - DNA, 16 bp, Homo sapiens
tttgtactgaattttt

SEQ ID NO: 1496713 - DNA, 15 bp, Homo sapiens
tttgtacttcttatt

SEQ ID NO: 1496714 - DNA, 21 bp, Homo sapiens
tttgtacttgctccttttgct

SEQ ID NO: 1496715 - DNA, 20 bp, Homo sapiens
tttgtacttggaagtgtttc

SEQ ID NO: 1496716 - DNA, 16 bp, Homo sapiens
tttgtactttctgtta

SEQ ID NO: 1496717 - DNA, 17 bp, Homo sapiens
tttgtactttctgttaa

SEQ ID NO: 1496718 - DNA, 16 bp, Homo sapiens
tttgtagaatctcttc

SEQ ID NO: 1496719 - DNA, 12 bp, Homo sapiens
tttgtagatggc

SEQ ID NO: 1496720 - DNA, 21 bp, Homo sapiens
tttgtaggagaaactcccatg

SEQ ID NO: 1496721 - DNA, 14 bp, Homo sapiens
tttgtagtaaaagt

SEQ ID NO: 1496722 - DNA, 19 bp, Homo sapiens
tttgtagttttatttgtat

SEQ ID NO: 1496723 - DNA, 12 bp, Homo sapiens
tttgtagttttt

SEQ ID NO: 1496724 - DNA, 12 bp, Homo sapiens
tttgtataaaat

SEQ ID NO: 1496725 - DNA, 17 bp, Homo sapiens
tttgtataaagaaactg

SEQ ID NO: 1496726 - DNA, 18 bp, Homo sapiens
tttgtatagaccaaagca

SEQ ID NO: 1496727 - DNA, 16 bp, Homo sapiens
tttgtatagtaaagtg

SEQ ID NO: 1496728 - DNA, 15 bp, Homo sapiens
tttgtatagttgctt

SEQ ID NO: 1496729 - DNA, 21 bp, Homo sapiens
tttgtatagttgcttgcctga

SEQ ID NO: 1496730 - DNA, 16 bp, Homo sapiens
tttgtatattgtagga

SEQ ID NO: 1496731 - DNA, 13 bp, Homo sapiens
tttgtatctttat

SEQ ID NO: 1496732 - DNA, 16 bp, Homo sapiens
tttgtatctttatgct

SEQ ID NO: 1496733 - DNA, 22 bp, Homo sapiens
tttgtatgaaattataatctgt

SEQ ID NO: 1496734 - DNA, 15 bp, Homo sapiens
tttgtatgagatggt

SEQ ID NO: 1496735 - DNA, 17 bp, Homo sapiens
tttgtatgagatggtta

SEQ ID NO: 1496736 - DNA, 21 bp, Homo sapiens
tttgtatgagatggttaaaaa

SEQ ID NO: 1496737 - DNA, 23 bp, Homo sapiens
tttgtatgagatggttaaaaagg

SEQ ID NO: 1496738 - DNA, 22 bp, Homo sapiens
tttgtatgtctgtgtatgtata

SEQ ID NO: 1496739 - DNA, 13 bp, Homo sapiens
tttgtatgtgtgt

SEQ ID NO: 1496740 - DNA, 16 bp, Homo sapiens
tttgtatgttaaagag

SEQ ID NO: 1496741 - DNA, 21 bp, Homo sapiens
tttgtattcatgaacttggct

SEQ ID NO: 1496742 - DNA, 12 bp, Homo sapiens
tttgtattctgt

SEQ ID NO: 1496743 - DNA, 21 bp, Homo sapiens
tttgtattctttactaaagat

SEQ ID NO: 1496744 - DNA, 16 bp, Homo sapiens
tttgtatttattcttt

SEQ ID NO: 1496745 - DNA, 20 bp, Homo sapiens
tttgtatttctcttgtcctt

SEQ ID NO: 1496746 - DNA, 10 bp, Homo sapiens
tttgtatttt

SEQ ID NO: 1496747 - DNA, 14 bp, Homo sapiens
tttgtattttcatg

SEQ ID NO: 1496748 - DNA, 17 bp, Homo sapiens
tttgtattttgcatact

SEQ ID NO: 1496749 - DNA, 16 bp, Homo sapiens
tttgtatttttagtag

SEQ ID NO: 1496750 - DNA, 20 bp, Homo sapiens
tttgtcaaaaagtaatgatt

SEQ ID NO: 1496751 - DNA, 23 bp, Homo sapiens
tttgtcaaactgtagaaatgatg

SEQ ID NO: 1496752 - DNA, 17 bp, Homo sapiens
tttgtcaatgacagttt

SEQ ID NO: 1496753 - DNA, 15 bp, Homo sapiens
tttgtcaattgctaa

SEQ ID NO: 1496754 - DNA, 23 bp, Homo sapiens
tttgtcacaatcctaacacatta

SEQ ID NO: 1496755 - DNA, 13 bp, Homo sapiens
tttgtcactgaat

SEQ ID NO: 1496756 - DNA, 13 bp, Homo sapiens
tttgtcagaaaag

SEQ ID NO: 1496757 - DNA, 15 bp, Homo sapiens
tttgtcagacttcca

SEQ ID NO: 1496758 - DNA, 21 bp, Homo sapiens
tttgtcagcatctgaccatct

SEQ ID NO: 1496759 - DNA, 19 bp, Homo sapiens
tttgtcagtatttttgccg

SEQ ID NO: 1496760 - DNA, 13 bp, Homo sapiens
tttgtcccagcct

SEQ ID NO: 1496761 - DNA, 18 bp, Homo sapiens
tttgtcccagtcagaaat

SEQ ID NO: 1496762 - DNA, 16 bp, Homo sapiens
tttgtccccagggccc

SEQ ID NO: 1496763 - DNA, 14 bp, Homo sapiens
tttgtcccccaact

SEQ ID NO: 1496764 - DNA, 16 bp, Homo sapiens
tttgtcccccaacttg

SEQ ID NO: 1496765 - DNA, 17 bp, Homo sapiens
tttgtcccccaacttga

SEQ ID NO: 1496766 - DNA, 22 bp, Homo sapiens
tttgtcctttttcactttgaaa

SEQ ID NO: 1496767 - DNA, 21 bp, Homo sapiens
tttgtcgggcaccagccagcg

SEQ ID NO: 1496768 - DNA, 17 bp, Homo sapiens
tttgtctcctttccact

SEQ ID NO: 1496769 - DNA, 14 bp, Homo sapiens
tttgtctgaaaaat

SEQ ID NO: 1496770 - DNA, 13 bp, Homo sapiens
tttgtctgtcgtg

SEQ ID NO: 1496771 - DNA, 14 bp, Homo sapiens
tttgtcttatatat

SEQ ID NO: 1496772 - DNA, 19 bp, Homo sapiens
tttgtcttgtacttctgtg

SEQ ID NO: 1496773 - DNA, 20 bp, Homo sapiens
tttgtcttgtacttctgtgt

SEQ ID NO: 1496774 - DNA, 18 bp, Homo sapiens
tttgtgaactggaagaaa

SEQ ID NO: 1496775 - DNA, 23 bp, Homo sapiens
tttgtgaagtgaaggatttgtgt

SEQ ID NO: 1496776 - DNA, 21 bp, Homo sapiens
tttgtgatgaatctacatttg

SEQ ID NO: 1496777 - DNA, 22 bp, Homo sapiens
tttgtgatgaatctacatttgt

SEQ ID NO: 1496778 - DNA, 12 bp, Homo sapiens
tttgtgattcca

SEQ ID NO: 1496779 - DNA, 14 bp, Homo sapiens
tttgtgcagaatct

SEQ ID NO: 1496780 - DNA, 18 bp, Homo sapiens
tttgtgcattctttggta

SEQ ID NO: 1496781 - DNA, 16 bp, Homo sapiens
tttgtgcctttggcct

SEQ ID NO: 1496782 - DNA, 14 bp, Homo sapiens
tttgtgctcattta

SEQ ID NO: 1496783 - DNA, 16 bp, Homo sapiens
tttgtgctccattttt

SEQ ID NO: 1496784 - DNA, 16 bp, Homo sapiens
ttaaattttacccttt

SEQ ID NO: 1496785 - DNA, 23 bp, Homo sapiens
ttaaattttaccctttagactgt

SEQ ID NO: 1496786 - DNA, 15 bp, Homo sapiens
ttaaattttgagttc

SEQ ID NO: 1496787 - DNA, 20 bp, Homo sapiens
ttaaattttgagttctacat

SEQ ID NO: 1496788 - DNA, 18 bp, Homo sapiens
ttaacaaactcttcagtt

SEQ ID NO: 1496789 - DNA, 14 bp, Homo sapiens
ttaacaaatctaat

SEQ ID NO: 1496790 - DNA, 20 bp, Homo sapiens
ttaacaaatctaatctctta

SEQ ID NO: 1496791 - DNA, 11 bp, Homo sapiens
ttaacaaatga

SEQ ID NO: 1496792 - DNA, 12 bp, Homo sapiens
ttaacaataata

SEQ ID NO: 1496793 - DNA, 13 bp, Homo sapiens
ttaacaatgacaa

SEQ ID NO: 1496794 - DNA, 16 bp, Homo sapiens
ttaacacaatgtgaat

SEQ ID NO: 1496795 - DNA, 17 bp, Homo sapiens
ttaacacaatgtgaatt

SEQ ID NO: 1496796 - DNA, 13 bp, Homo sapiens
ttaacacatcaaa

SEQ ID NO: 1496797 - DNA, 15 bp, Homo sapiens
ttaacagaaattgta

SEQ ID NO: 1496798 - DNA, 14 bp, Homo sapiens
ttaacagagacaga

SEQ ID NO: 1496799 - DNA, 18 bp, Homo sapiens
ttaacagcagtcctttgt

SEQ ID NO: 1496800 - DNA, 18 bp, Homo sapiens
ttaacaggcaaacatttt

SEQ ID NO: 1496801 - DNA, 22 bp, Homo sapiens
ttaacatgaacacccttagaaa

SEQ ID NO: 1496802 - DNA, 19 bp, Homo sapiens
ttaacatgggctcttcact

SEQ ID NO: 1496803 - DNA, 15 bp, Homo sapiens
ttaacattcatagag

SEQ ID NO: 1496804 - DNA, 23 bp, Homo sapiens
ttaacattcctcatgaatgtaaa

SEQ ID NO: 1496805 - DNA, 14 bp, Homo sapiens
ttaacattgaccaa

SEQ ID NO: 1496806 - DNA, 20 bp, Homo sapiens
ttaacattgaccaagaactg

SEQ ID NO: 1496807 - DNA, 19 bp, Homo sapiens
ttaacattgacttcttggt

SEQ ID NO: 1496808 - DNA, 13 bp, Homo sapiens
ttaaccagaataa

SEQ ID NO: 1496809 - DNA, 17 bp, Homo sapiens
ttaaccccatgtcctca

SEQ ID NO: 1496810 - DNA, 13 bp, Homo sapiens
ttaaccctctctt

SEQ ID NO: 1496811 - DNA, 21 bp, Homo sapiens
ttaacccttcatcttcctgtg

SEQ ID NO: 1496812 - DNA, 17 bp, Homo sapiens
ttaacctaatatcactt

SEQ ID NO: 1496813 - DNA, 17 bp, Homo sapiens
ttaacctagatgtttaa

SEQ ID NO: 1496814 - DNA, 15 bp, Homo sapiens
ttaaccttaaaatta

SEQ ID NO: 1496815 - DNA, 19 bp, Homo sapiens
ttaacggctccaggatttt

SEQ ID NO: 1496816 - DNA, 13 bp, Homo sapiens
ttaactaaatgat

SEQ ID NO: 1496817 - DNA, 18 bp, Homo sapiens
ttaactaaattttaaagc

SEQ ID NO: 1496818 - DNA, 12 bp, Homo sapiens
ttaactagaatt

SEQ ID NO: 1496819 - DNA, 14 bp, Homo sapiens
ttaactagaattta

SEQ ID NO: 1496820 - DNA, 19 bp, Homo sapiens
ttaactataaggtgcctca

SEQ ID NO: 1496821 - DNA, 21 bp, Homo sapiens
ttaactatatgtgaaacattt

SEQ ID NO: 1496822 - DNA, 23 bp, Homo sapiens
ttaactcatctgttatcctgcta

SEQ ID NO: 1496823 - DNA, 12 bp, Homo sapiens
ttaactccctcc

SEQ ID NO: 1496824 - DNA, 13 bp, Homo sapiens
ttaactccctcca

SEQ ID NO: 1496825 - DNA, 16 bp, Homo sapiens
ttaactccctccacca

SEQ ID NO: 1496826 - DNA, 19 bp, Homo sapiens
ttaactccctccaccagcc

SEQ ID NO: 1496827 - DNA, 22 bp, Homo sapiens
ttaactccctccaccagcctgc

SEQ ID NO: 1496828 - DNA, 17 bp, Homo sapiens
ttaactgccaatcctta

SEQ ID NO: 1496829 - DNA, 21 bp, Homo sapiens
ttaactgccaatccttaaata

SEQ ID NO: 1496830 - DNA, 22 bp, Homo sapiens
ttaactggtaagcgatttgaaa

SEQ ID NO: 1496831 - DNA, 12 bp, Homo sapiens
ttaactgtggat

SEQ ID NO: 1496832 - DNA, 14 bp, Homo sapiens
ttaacttgaatttg

SEQ ID NO: 1496833 - DNA, 19 bp, Homo sapiens
ttaacttgtttggtagtta

SEQ ID NO: 1496834 - DNA, 16 bp, Homo sapiens
ttaactttaacttttg

SEQ ID NO: 1496835 - DNA, 12 bp, Homo sapiens
ttaacttttaaa

SEQ ID NO: 1496836 - DNA, 20 bp, Homo sapiens
ttaagaaaaaataacacaca

SEQ ID NO: 1496837 - DNA, 15 bp, Homo sapiens
ttaagaaaaacatgt

SEQ ID NO: 1496838 - DNA, 12 bp, Homo sapiens
ttaagaaacact

SEQ ID NO: 1496839 - DNA, 12 bp, Homo sapiens
ttaagaaacctt

SEQ ID NO: 1496840 - DNA, 21 bp, Homo sapiens
ttaagaaaccttgctctcctc

SEQ ID NO: 1496841 - DNA, 20 bp, Homo sapiens
ttaagaatatctgtaatggt

SEQ ID NO: 1496842 - DNA, 18 bp, Homo sapiens
ttaagaatgaagttctgc

SEQ ID NO: 1496843 - DNA, 23 bp, Homo sapiens
ttaagaatgcagattcctgggcc

SEQ ID NO: 1496844 - DNA, 16 bp, Homo sapiens
ttaagaatttcacaag

SEQ ID NO: 1496845 - DNA, 18 bp, Homo sapiens
ttaagacaaatgggactg

SEQ ID NO: 1496846 - DNA, 23 bp, Homo sapiens
ttaagacagtgtacaaaactgta

SEQ ID NO: 1496847 - DNA, 14 bp, Homo sapiens
ttaagaccagcctg

SEQ ID NO: 1496848 - DNA, 11 bp, Homo sapiens
ttaagacctgg

SEQ ID NO: 1496849 - DNA, 14 bp, Homo sapiens
ttaagacctggcag

SEQ ID NO: 1496850 - DNA, 18 bp, Homo sapiens
ttaagacctggcagctct

SEQ ID NO: 1496851 - DNA, 15 bp, Homo sapiens
ttaagacggaagtaa

SEQ ID NO: 1496852 - DNA, 13 bp, Homo sapiens
ttaagactagata

SEQ ID NO: 1496853 - DNA, 13 bp, Homo sapiens
ttaagactgataa

SEQ ID NO: 1496854 - DNA, 21 bp, Homo sapiens
ttaagactgataacaaccttt

SEQ ID NO: 1496855 - DNA, 19 bp, Homo sapiens
ttaagagacagagaatctt

SEQ ID NO: 1496856 - DNA, 22 bp, Homo sapiens
ttaagagccatataagtttgaa

SEQ ID NO: 1496857 - DNA, 23 bp, Homo sapiens
ttaagagccatataagtttgaag

SEQ ID NO: 1496858 - DNA, 13 bp, Homo sapiens
ttaagagtccaag

SEQ ID NO: 1496859 - DNA, 19 bp, Homo sapiens
ttaagagtccaagaatcca

SEQ ID NO: 1496860 - DNA, 12 bp, Homo sapiens
ttaagagtgaaa

SEQ ID NO: 1496861 - DNA, 13 bp, Homo sapiens
ttaagataactta

SEQ ID NO: 1496862 - DNA, 23 bp, Homo sapiens
tttaaaaagttgtagcagattgt

SEQ ID NO: 1496863 - DNA, 21 bp, Homo sapiens
tttaaaaataagtcaacagta

SEQ ID NO: 1496864 - DNA, 17 bp, Homo sapiens
tttaaaaatatttcaga

SEQ ID NO: 1496865 - DNA, 23 bp, Homo sapiens
tttaaaacacatgtttttataca

SEQ ID NO: 1496866 - DNA, 16 bp, Homo sapiens
tttaaaacatgtaata

SEQ ID NO: 1496867 - DNA, 13 bp, Homo sapiens
tttaaaacatttt

SEQ ID NO: 1496868 - DNA, 16 bp, Homo sapiens
tttaaaactggacctg

SEQ ID NO: 1496869 - DNA, 11 bp, Homo sapiens
tttaaaactgt

SEQ ID NO: 1496870 - DNA, 15 bp, Homo sapiens
tttaaaactgttatt

SEQ ID NO: 1496871 - DNA, 22 bp, Homo sapiens
tttaaaagagagagagagaaaa

SEQ ID NO: 1496872 - DNA, 23 bp, Homo sapiens
tttaaaagagagagagagaaaaa

SEQ ID NO: 1496873 - DNA, 16 bp, Homo sapiens
tttaaaagattcattt

SEQ ID NO: 1496874 - DNA, 17 bp, Homo sapiens
tttaaaaggatgtataa

SEQ ID NO: 1496875 - DNA, 19 bp, Homo sapiens
tttaaaaggtattttgaat

SEQ ID NO: 1496876 - DNA, 14 bp, Homo sapiens
tttaaaagtctatt

SEQ ID NO: 1496877 - DNA, 13 bp, Homo sapiens
tttaaaatagaaa

SEQ ID NO: 1496878 - DNA, 14 bp, Homo sapiens
tttaaaatatttaa

SEQ ID NO: 1496879 - DNA, 20 bp, Homo sapiens
tttaaaatatttgtctttaa

SEQ ID NO: 1496880 - DNA, 22 bp, Homo sapiens
tttaaaatcagctattttgtga

SEQ ID NO: 1496881 - DNA, 16 bp, Homo sapiens
tttaaaatcatttctg

SEQ ID NO: 1496882 - DNA, 12 bp, Homo sapiens
tttaaaatgatt

SEQ ID NO: 1496883 - DNA, 22 bp, Homo sapiens
tttaaaatgtaatttaaatgaa

SEQ ID NO: 1496884 - DNA, 13 bp, Homo sapiens
tttaaaatgtaca

SEQ ID NO: 1496885 - DNA, 12 bp, Homo sapiens
tttaaaatgtca

SEQ ID NO: 1496886 - DNA, 16 bp, Homo sapiens
tttaaaattaatcttg

SEQ ID NO: 1496887 - DNA, 10 bp, Homo sapiens
tttaaaattt

SEQ ID NO: 1496888 - DNA, 16 bp, Homo sapiens
tttaaaatttgttctt

SEQ ID NO: 1496889 - DNA, 12 bp, Homo sapiens
tttaaacaaatt

SEQ ID NO: 1496890 - DNA, 23 bp, Homo sapiens
tttaaacaaattcatattctgtc

SEQ ID NO: 1496891 - DNA, 21 bp, Homo sapiens
tttaaacaggcccagcattgc

SEQ ID NO: 1496892 - DNA, 15 bp, Homo sapiens
tttaaacattaatag

SEQ ID NO: 1496893 - DNA, 16 bp, Homo sapiens
tttaaacctttttctt

SEQ ID NO: 1496894 - DNA, 21 bp, Homo sapiens
tttaaactctgaatttatctt

SEQ ID NO: 1496895 - DNA, 14 bp, Homo sapiens
tttaaactgtgtac

SEQ ID NO: 1496896 - DNA, 14 bp, Homo sapiens
tttaaacttgaaat

SEQ ID NO: 1496897 - DNA, 17 bp, Homo sapiens
tttaaacttgaaatata

SEQ ID NO: 1496898 - DNA, 11 bp, Homo sapiens
tttaaactttc

SEQ ID NO: 1496899 - DNA, 18 bp, Homo sapiens
tttaaagaaacatggttt

SEQ ID NO: 1496900 - DNA, 13 bp, Homo sapiens
tttaaagaatgct

SEQ ID NO: 1496901 - DNA, 13 bp, Homo sapiens
tttaaagagtcta

SEQ ID NO: 1496902 - DNA, 18 bp, Homo sapiens
tttaaagagtctagattc

SEQ ID NO: 1496903 - DNA, 21 bp, Homo sapiens
tttaaagagtctagattcaaa

SEQ ID NO: 1496904 - DNA, 14 bp, Homo sapiens
tttaaagatctttt

SEQ ID NO: 1496905 - DNA, 11 bp, Homo sapiens
tttaaagcctt

SEQ ID NO: 1496906 - DNA, 17 bp, Homo sapiens
tttaaagctcaggaggg

SEQ ID NO: 1496907 - DNA, 22 bp, Homo sapiens
tttaaagtatatgtgcagtctt

SEQ ID NO: 1496908 - DNA, 21 bp, Homo sapiens
tttaaagtatgcattattaaa

SEQ ID NO: 1496909 - DNA, 19 bp, Homo sapiens
tttaaagtgaacacacaca

SEQ ID NO: 1496910 - DNA, 16 bp, Homo sapiens
tttaaagttcttattt

SEQ ID NO: 1496911 - DNA, 19 bp, Homo sapiens
tttaaataaaagtgatcaa

SEQ ID NO: 1496912 - DNA, 15 bp, Homo sapiens
tttaaataaaattta

SEQ ID NO: 1496913 - DNA, 19 bp, Homo sapiens
tttaaataaacctataata

SEQ ID NO: 1496914 - DNA, 14 bp, Homo sapiens
tttaaatagcctaa

SEQ ID NO: 1496915 - DNA, 15 bp, Homo sapiens
tttaaatagcctaaa

SEQ ID NO: 1496916 - DNA, 13 bp, Homo sapiens
tttaaatataatt

SEQ ID NO: 1496917 - DNA, 16 bp, Homo sapiens
tttaaatataattctg

SEQ ID NO: 1496918 - DNA, 22 bp, Homo sapiens
tttaaatcaaggaaaggctcat

SEQ ID NO: 1496919 - DNA, 14 bp, Homo sapiens
tttaaatctgtgat

SEQ ID NO: 1496920 - DNA, 12 bp, Homo sapiens
tttaaatgccat

SEQ ID NO: 1496921 - DNA, 13 bp, Homo sapiens
tttaaatgtgaat

SEQ ID NO: 1496922 - DNA, 17 bp, Homo sapiens
tttaaatgtgaattttt

SEQ ID NO: 1496923 - DNA, 24 bp, Homo sapiens
tttaaatgtgaatttttatttctt

SEQ ID NO: 1496924 - DNA, 20 bp, Homo sapiens
tttaaattataacttaaaat

SEQ ID NO: 1496925 - DNA, 20 bp, Homo sapiens
tttaattattttaaaatatt

SEQ ID NO: 1496926 - DNA, 14 bp, Homo sapiens
tttaattcatgttt

SEQ ID NO: 1496927 - DNA, 13 bp, Homo sapiens
tttaattgtagtt

SEQ ID NO: 1496928 - DNA, 13 bp, Homo sapiens
tttaattgtataa

SEQ ID NO: 1496929 - DNA, 14 bp, Homo sapiens
tttaattgtataag

SEQ ID NO: 1496930 - DNA, 16 bp, Homo sapiens
tttaatttcaggaaaa

SEQ ID NO: 1496931 - DNA, 12 bp, Homo sapiens
tttaatttgatg

SEQ ID NO: 1496932 - DNA, 21 bp, Homo sapiens
tttaatttgatgaaagctgat

SEQ ID NO: 1496933 - DNA, 13 bp, Homo sapiens
tttaattttagag

SEQ ID NO: 1496934 - DNA, 19 bp, Homo sapiens
tttaattttagagaaactt

SEQ ID NO: 1496935 - DNA, 16 bp, Homo sapiens
tttaattttcttgttt

SEQ ID NO: 1496936 - DNA, 19 bp, Homo sapiens
tttaattttgatatacatt

SEQ ID NO: 1496937 - DNA, 14 bp, Homo sapiens
tttaattttttact

SEQ ID NO: 1496938 - DNA, 13 bp, Homo sapiens
tttacaaaagatg

SEQ ID NO: 1496939 - DNA, 21 bp, Homo sapiens
tttacaaaagatttattgtaa

SEQ ID NO: 1496940 - DNA, 14 bp, Homo sapiens
tttacaaaatattc

SEQ ID NO: 1496941 - DNA, 12 bp, Homo sapiens
tttacacagaaa

SEQ ID NO: 1496942 - DNA, 20 bp, Homo sapiens
tttacacagaaacactgcct

SEQ ID NO: 1496943 - DNA, 13 bp, Homo sapiens
tttacacaggaag

SEQ ID NO: 1496944 - DNA, 23 bp, Homo sapiens
tttacaccaatttggtaaaaatg

SEQ ID NO: 1496945 - DNA, 22 bp, Homo sapiens
tttacactcaggctttcactat

SEQ ID NO: 1496946 - DNA, 21 bp, Homo sapiens
tttacagagaggatacattta

SEQ ID NO: 1496947 - DNA, 17 bp, Homo sapiens
tttacagatgaatgtat

SEQ ID NO: 1496948 - DNA, 17 bp, Homo sapiens
tttacagcattgtcttt

SEQ ID NO: 1496949 - DNA, 20 bp, Homo sapiens
tttacagcctcacttgaatg

SEQ ID NO: 1496950 - DNA, 21 bp, Homo sapiens
tttacagctcattaaactttt

SEQ ID NO: 1496951 - DNA, 20 bp, Homo sapiens
tttacagctttcatgattag

SEQ ID NO: 1496952 - DNA, 23 bp, Homo sapiens
tttacaggaaaaaaaattctgtt

SEQ ID NO: 1496953 - DNA, 15 bp, Homo sapiens
tttacaggtttgaat

SEQ ID NO: 1496954 - DNA, 17 bp, Homo sapiens
tttacaggtttgaatta

SEQ ID NO: 1496955 - DNA, 19 bp, Homo sapiens
tttacagtatgatgaaaat

SEQ ID NO: 1496956 - DNA, 18 bp, Homo sapiens
tttacataaggatacact

SEQ ID NO: 1496957 - DNA, 17 bp, Homo sapiens
tttacatgctactaaat

SEQ ID NO: 1496958 - DNA, 20 bp, Homo sapiens
tttacattgtaaatagtatt

SEQ ID NO: 1496959 - DNA, 15 bp, Homo sapiens
tttacattgtcctgt

SEQ ID NO: 1496960 - DNA, 18 bp, Homo sapiens
tttacattgtcctgtagc

SEQ ID NO: 1496961 - DNA, 19 bp, Homo sapiens
tttacatttaatacagata

SEQ ID NO: 1496962 - DNA, 10 bp, Homo sapiens
tttacatttc

SEQ ID NO: 1496963 - DNA, 13 bp, Homo sapiens
tttacattttata

SEQ ID NO: 1496964 - DNA, 23 bp, Homo sapiens
tttaccatttgtaataaagtata

SEQ ID NO: 1496965 - DNA, 16 bp, Homo sapiens
tttaccctctttgctg

SEQ ID NO: 1496966 - DNA, 21 bp, Homo sapiens
tttaccctgaggtcactgcta

SEQ ID NO: 1496967 - DNA, 13 bp, Homo sapiens
tttacccttttcc

SEQ ID NO: 1496968 - DNA, 22 bp, Homo sapiens
tttacccttttcccccttccca

SEQ ID NO: 1496969 - DNA, 14 bp, Homo sapiens
tttacctagagaac

SEQ ID NO: 1496970 - DNA, 16 bp, Homo sapiens
tttacctgcaaaaaat

SEQ ID NO: 1496971 - DNA, 16 bp, Homo sapiens
tttacctgcaggctcc

SEQ ID NO: 1496972 - DNA, 14 bp, Homo sapiens
tttaccttctaaaa

SEQ ID NO: 1496973 - DNA, 18 bp, Homo sapiens
tttaccttttatgcaaaa

SEQ ID NO: 1496974 - DNA, 17 bp, Homo sapiens
tttaccttttctgttgt

SEQ ID NO: 1496975 - DNA, 17 bp, Homo sapiens
tttacgttcatcacctg

SEQ ID NO: 1496976 - DNA, 12 bp, Homo sapiens
tttactaatata

SEQ ID NO: 1496977 - DNA, 13 bp, Homo sapiens
tttactaatatat

SEQ ID NO: 1496978 - DNA, 12 bp, Homo sapiens
tttactactgtg

SEQ ID NO: 1496979 - DNA, 15 bp, Homo sapiens
tttactactgtggaa

SEQ ID NO: 1496980 - DNA, 14 bp, Homo sapiens
tttactattgctat

SEQ ID NO: 1496981 - DNA, 22 bp, Homo sapiens
tttactccaggttattgcaata

SEQ ID NO: 1496982 - DNA, 12 bp, Homo sapiens
tttactctgcct

SEQ ID NO: 1496983 - DNA, 17 bp, Homo sapiens
tttactctggtaggaat

SEQ ID NO: 1496984 - DNA, 14 bp, Homo sapiens
tttactctttctaa

SEQ ID NO: 1496985 - DNA, 19 bp, Homo sapiens
tttactgcactcagattta

SEQ ID NO: 1496986 - DNA, 22 bp, Homo sapiens
tttactgccaaagggaaatatc

SEQ ID NO: 1496987 - DNA, 22 bp, Homo sapiens
ttgttagaaaacaaaattttat

SEQ ID NO: 1496988 - DNA, 16 bp, Homo sapiens
ttgttagcaaatgaca

SEQ ID NO: 1496989 - DNA, 19 bp, Homo sapiens
ttgttaggaaaaaattgaa

SEQ ID NO: 1496990 - DNA, 18 bp, Homo sapiens
ttgttagtggacttgttt

SEQ ID NO: 1496991 - DNA, 14 bp, Homo sapiens
ttgttatatataat

SEQ ID NO: 1496992 - DNA, 22 bp, Homo sapiens
ttgttatatataataaatactc

SEQ ID NO: 1496993 - DNA, 21 bp, Homo sapiens
ttgttattattagataatatt

SEQ ID NO: 1496994 - DNA, 23 bp, Homo sapiens
ttgttattgggcaagtgattgaa

SEQ ID NO: 1496995 - DNA, 14 bp, Homo sapiens
ttgttattgtggaa

SEQ ID NO: 1496996 - DNA, 14 bp, Homo sapiens
ttgttatttataac

SEQ ID NO: 1496997 - DNA, 20 bp, Homo sapiens
ttgttcaataataaatattt

SEQ ID NO: 1496998 - DNA, 13 bp, Homo sapiens
ttgttcatacata

SEQ ID NO: 1496999 - DNA, 15 bp, Homo sapiens
ttgttcatctgtaac

SEQ ID NO: 1497000 - DNA, 23 bp, Homo sapiens
ttgttccacttgtttgcactgtg

SEQ ID NO: 1497001 - DNA, 18 bp, Homo sapiens
ttgttcccctaagtggat

SEQ ID NO: 1497002 - DNA, 19 bp, Homo sapiens
ttgttcccctcctccactc

SEQ ID NO: 1497003 - DNA, 19 bp, Homo sapiens
ttgttcccttcctcttcct

SEQ ID NO: 1497004 - DNA, 11 bp, Homo sapiens
ttgttcctcta

SEQ ID NO: 1497005 - DNA, 21 bp, Homo sapiens
ttgttcctctatactttgttc

SEQ ID NO: 1497006 - DNA, 11 bp, Homo sapiens
ttgttctagag

SEQ ID NO: 1497007 - DNA, 20 bp, Homo sapiens
ttgttctctgggagaaaatc

SEQ ID NO: 1497008 - DNA, 15 bp, Homo sapiens
ttgttctgttgtctg

SEQ ID NO: 1497009 - DNA, 22 bp, Homo sapiens
ttgttcttaaaaaaataaaata

SEQ ID NO: 1497010 - DNA, 15 bp, Homo sapiens
ttgttcttgttttta

SEQ ID NO: 1497011 - DNA, 20 bp, Homo sapiens
ttgttcttgtttttaagttt

SEQ ID NO: 1497012 - DNA, 12 bp, Homo sapiens
ttgttctttgtg

SEQ ID NO: 1497013 - DNA, 14 bp, Homo sapiens
ttgttctttgtttc

SEQ ID NO: 1497014 - DNA, 15 bp, Homo sapiens
ttgttgaaaatggtt

SEQ ID NO: 1497015 - DNA, 21 bp, Homo sapiens
ttgttgaaaatggtttcaagt

SEQ ID NO: 1497016 - DNA, 18 bp, Homo sapiens
ttgttgacagttctgaag

SEQ ID NO: 1497017 - DNA, 15 bp, Homo sapiens
ttgttgactgtgatt

SEQ ID NO: 1497018 - DNA, 17 bp, Homo sapiens
ttgttgactgtgattag

SEQ ID NO: 1497019 - DNA, 24 bp, Homo sapiens
ttgttgactgtgattagatcacat

SEQ ID NO: 1497020 - DNA, 22 bp, Homo sapiens
ttgttgagcatgacagcctgca

SEQ ID NO: 1497021 - DNA, 20 bp, Homo sapiens
ttgttgataaattccactgg

SEQ ID NO: 1497022 - DNA, 18 bp, Homo sapiens
ttgttgcaagatgtgaat

SEQ ID NO: 1497023 - DNA, 19 bp, Homo sapiens
ttgttgcaagtactgctgt

SEQ ID NO: 1497024 - DNA, 20 bp, Homo sapiens
ttgttgccatgtgcaccttg

SEQ ID NO: 1497025 - DNA, 12 bp, Homo sapiens
ttgttgcctgca

SEQ ID NO: 1497026 - DNA, 20 bp, Homo sapiens
ttgttgcctgcacccttccc

SEQ ID NO: 1497027 - DNA, 16 bp, Homo sapiens
ttgttgctgctgtttg

SEQ ID NO: 1497028 - DNA, 20 bp, Homo sapiens
ttgttggagtgtttctaata

SEQ ID NO: 1497029 - DNA, 12 bp, Homo sapiens
ttgttggcctcc

SEQ ID NO: 1497030 - DNA, 18 bp, Homo sapiens
ttgttggcctccggcctc

SEQ ID NO: 1497031 - DNA, 17 bp, Homo sapiens
ttgttgggaaaggaaca

SEQ ID NO: 1497032 - DNA, 22 bp, Homo sapiens
ttgttgggattcctgacccagg

SEQ ID NO: 1497033 - DNA, 14 bp, Homo sapiens
ttgttggtctgtgt

SEQ ID NO: 1497034 - DNA, 18 bp, Homo sapiens
ttgttggtgaattttcaa

SEQ ID NO: 1497035 - DNA, 20 bp, Homo sapiens
ttgttggtgaattttcaagg

SEQ ID NO: 1497036 - DNA, 15 bp, Homo sapiens
ttgttgtaacctgct

SEQ ID NO: 1497037 - DNA, 12 bp, Homo sapiens
ttgttgtactta

SEQ ID NO: 1497038 - DNA, 23 bp, Homo sapiens
ttgttgtagattgattgtattgt

SEQ ID NO: 1497039 - DNA, 12 bp, Homo sapiens
ttgttgtctaca

SEQ ID NO: 1497040 - DNA, 14 bp, Homo sapiens
ttgttgttgctgct

SEQ ID NO: 1497041 - DNA, 15 bp, Homo sapiens
ttgtttaaaatgtaa

SEQ ID NO: 1497042 - DNA, 16 bp, Homo sapiens
ttgtttaaacccaagt

SEQ ID NO: 1497043 - DNA, 22 bp, Homo sapiens
ttgtttaaacccaagtgctgca

SEQ ID NO: 1497044 - DNA, 21 bp, Homo sapiens
ttgtttaaagaagctctccag

SEQ ID NO: 1497045 - DNA, 18 bp, Homo sapiens
ttgtttaaagaataaagt

SEQ ID NO: 1497046 - DNA, 14 bp, Homo sapiens
ttgtttaacaaaag

SEQ ID NO: 1497047 - DNA, 16 bp, Homo sapiens
ttgtttaataaaggct

SEQ ID NO: 1497048 - DNA, 13 bp, Homo sapiens
ttgtttaatcttt

SEQ ID NO: 1497049 - DNA, 22 bp, Homo sapiens
ttgtttacagcactactctgtg

SEQ ID NO: 1497050 - DNA, 19 bp, Homo sapiens
ttgtttagattttgtgttt

SEQ ID NO: 1497051 - DNA, 13 bp, Homo sapiens
ttgtttatcaact

SEQ ID NO: 1497052 - DNA, 18 bp, Homo sapiens
ttgtttatgatatttctt

SEQ ID NO: 1497053 - DNA, 20 bp, Homo sapiens
ttgtttatgtaaatgtttgt

SEQ ID NO: 1497054 - DNA, 14 bp, Homo sapiens
ttgtttcaagaacc

SEQ ID NO: 1497055 - DNA, 14 bp, Homo sapiens
tttagttgaatttt

SEQ ID NO: 1497056 - DNA, 19 bp, Homo sapiens
tttagttgcagactcagtt

SEQ ID NO: 1497057 - DNA, 20 bp, Homo sapiens
tttagttgtatctcttttga

SEQ ID NO: 1497058 - DNA, 12 bp, Homo sapiens
tttagtttttca

SEQ ID NO: 1497059 - DNA, 15 bp, Homo sapiens
tttagtttttcatta

SEQ ID NO: 1497060 - DNA, 23 bp, Homo sapiens
tttataaaagaataaaattgcac

SEQ ID NO: 1497061 - DNA, 22 bp, Homo sapiens
tttataaaagtgttcattgttt

SEQ ID NO: 1497062 - DNA, 16 bp, Homo sapiens
tttataaacagaaatg

SEQ ID NO: 1497063 - DNA, 18 bp, Homo sapiens
tttataaacagacaatat

SEQ ID NO: 1497064 - DNA, 20 bp, Homo sapiens
tttataaaccacttgagcct

SEQ ID NO: 1497065 - DNA, 22 bp, Homo sapiens
tttataaccttgttctctgctt

SEQ ID NO: 1497066 - DNA, 22 bp, Homo sapiens
tttataactcatcataaaataa

SEQ ID NO: 1497067 - DNA, 12 bp, Homo sapiens
tttataagaaaa

SEQ ID NO: 1497068 - DNA, 14 bp, Homo sapiens
tttataagaaaaac

SEQ ID NO: 1497069 - DNA, 19 bp, Homo sapiens
tttataaggttgtctgttt

SEQ ID NO: 1497070 - DNA, 13 bp, Homo sapiens
tttataataggaa

SEQ ID NO: 1497071 - DNA, 14 bp, Homo sapiens
tttataattggctt

SEQ ID NO: 1497072 - DNA, 12 bp, Homo sapiens
tttatacaaaat

SEQ ID NO: 1497073 - DNA, 20 bp, Homo sapiens
tttatacaatggaataaatt

SEQ ID NO: 1497074 - DNA, 21 bp, Homo sapiens
tttatacaatggaataaatta

SEQ ID NO: 1497075 - DNA, 23 bp, Homo sapiens
tttatacaatggaataaattatg

SEQ ID NO: 1497076 - DNA, 21 bp, Homo sapiens
tttatacagctgtattgtctg

SEQ ID NO: 1497077 - DNA, 14 bp, Homo sapiens
tttataccagctta

SEQ ID NO: 1497078 - DNA, 16 bp, Homo sapiens
tttatactgtttactg

SEQ ID NO: 1497079 - DNA, 17 bp, Homo sapiens
tttatactttattgaaa

SEQ ID NO: 1497080 - DNA, 18 bp, Homo sapiens
tttatagaaggaatttgt

SEQ ID NO: 1497081 - DNA, 13 bp, Homo sapiens
tttatagagataa

SEQ ID NO: 1497082 - DNA, 16 bp, Homo sapiens
tttataggtgagaaaa

SEQ ID NO: 1497083 - DNA, 15 bp, Homo sapiens
tttataggttttata

SEQ ID NO: 1497084 - DNA, 20 bp, Homo sapiens
tttatatacctggcttttac

SEQ ID NO: 1497085 - DNA, 23 bp, Homo sapiens
tttatatactgggttcttgtttt

SEQ ID NO: 1497086 - DNA, 14 bp, Homo sapiens
tttatatatatgca

SEQ ID NO: 1497087 - DNA, 17 bp, Homo sapiens
tttatatcccattttta

SEQ ID NO: 1497088 - DNA, 20 bp, Homo sapiens
tttatattccatttacataa

SEQ ID NO: 1497089 - DNA, 21 bp, Homo sapiens
tttatattctaagccagtttt

SEQ ID NO: 1497090 - DNA, 16 bp, Homo sapiens
tttatatttagtaact

SEQ ID NO: 1497091 - DNA, 19 bp, Homo sapiens
tttatatttattgttagaa

SEQ ID NO: 1497092 - DNA, 13 bp, Homo sapiens
tttatatttcctt

SEQ ID NO: 1497093 - DNA, 17 bp, Homo sapiens
tttatatttcctttatg

SEQ ID NO: 1497094 - DNA, 18 bp, Homo sapiens
tttatatttcctttatgt

SEQ ID NO: 1497095 - DNA, 18 bp, Homo sapiens
tttatatttggaaagaga

SEQ ID NO: 1497096 - DNA, 23 bp, Homo sapiens
tttatatttttgtacatattgtt

SEQ ID NO: 1497097 - DNA, 21 bp, Homo sapiens
tttatcaaaccctagccttgc

SEQ ID NO: 1497098 - DNA, 18 bp, Homo sapiens
tttatcaatcagtataat

SEQ ID NO: 1497099 - DNA, 15 bp, Homo sapiens
tttatcacacttctg

SEQ ID NO: 1497100 - DNA, 19 bp, Homo sapiens
tttatcacctcattctgaa

SEQ ID NO: 1497101 - DNA, 17 bp, Homo sapiens
tttatcagccttgcttt

SEQ ID NO: 1497102 - DNA, 17 bp, Homo sapiens
tttatcatgaatgcttt

SEQ ID NO: 1497103 - DNA, 22 bp, Homo sapiens
tttatcatgtcgtaggtaaact

SEQ ID NO: 1497104 - DNA, 18 bp, Homo sapiens
tttatccaaaatgtgtat

SEQ ID NO: 1497105 - DNA, 16 bp, Homo sapiens
tttatcccaaagttgt

SEQ ID NO: 1497106 - DNA, 15 bp, Homo sapiens
tttatcctagtattc

SEQ ID NO: 1497107 - DNA, 18 bp, Homo sapiens
tttatcctgaaatttcag

SEQ ID NO: 1497108 - DNA, 23 bp, Homo sapiens
tttatcctgtattcttgtttgaa

SEQ ID NO: 1497109 - DNA, 14 bp, Homo sapiens
tttatcgtttttgt

SEQ ID NO: 1497110 - DNA, 20 bp, Homo sapiens
tttatctataatttacctaa

SEQ ID NO: 1497111 - DNA, 17 bp, Homo sapiens
tttatctgggattatgg

SEQ ID NO: 1497112 - DNA, 19 bp, Homo sapiens
tttatctgtagtaaactat

SEQ ID NO: 1497113 - DNA, 13 bp, Homo sapiens
tttatctgttctt

SEQ ID NO: 1497114 - DNA, 14 bp, Homo sapiens
tttatctgtttcct

SEQ ID NO: 1497115 - DNA, 12 bp, Homo sapiens
tttatctttata

SEQ ID NO: 1497116 - DNA, 15 bp, Homo sapiens
tttatgaacagaaat

SEQ ID NO: 1497117 - DNA, 17 bp, Homo sapiens
tttatgaacattgtact

SEQ ID NO: 1497118 - DNA, 21 bp, Homo sapiens
tttatgaagaaaaagtacaat

SEQ ID NO: 1497119 - DNA, 16 bp, Homo sapiens
tttatgaagaaaatac

SEQ ID NO: 1497120 - DNA, 17 bp, Homo sapiens
tttatgaaggcaaaaaa

SEQ ID NO: 1497121 - DNA, 19 bp, Homo sapiens
tttattcccaagtatgcct

SEQ ID NO: 1497122 - DNA, 22 bp, Homo sapiens
tttattcctatatagtttattg

SEQ ID NO: 1497123 - DNA, 16 bp, Homo sapiens
tttattcctgtatgtt

SEQ ID NO: 1497124 - DNA, 14 bp, Homo sapiens
tttattcttccaga

SEQ ID NO: 1497125 - DNA, 16 bp, Homo sapiens
tttattcttccagaat

SEQ ID NO: 1497126 - DNA, 14 bp, Homo sapiens
tttattcttctaga

SEQ ID NO: 1497127 - DNA, 12 bp, Homo sapiens
tttattcttgat

SEQ ID NO: 1497128 - DNA, 12 bp, Homo sapiens
tttattgacaat

SEQ ID NO: 1497129 - DNA, 16 bp, Homo sapiens
tttattgactgtcttt

SEQ ID NO: 1497130 - DNA, 12 bp, Homo sapiens
tttattgagtac

SEQ ID NO: 1497131 - DNA, 21 bp, Homo sapiens
tttattgagtacctactgtgt

SEQ ID NO: 1497132 - DNA, 23 bp, Homo sapiens
tttattgccatattaaaatctga

SEQ ID NO: 1497133 - DNA, 19 bp, Homo sapiens
tttattgctgtgtaacact

SEQ ID NO: 1497134 - DNA, 15 bp, Homo sapiens
tttattggttttgca

SEQ ID NO: 1497135 - DNA, 20 bp, Homo sapiens
tttattgttaactcttgtct

SEQ ID NO: 1497136 - DNA, 14 bp, Homo sapiens
tttatttaaaagat

SEQ ID NO: 1497137 - DNA, 17 bp, Homo sapiens
tttatttaaaagattca

SEQ ID NO: 1497138 - DNA, 19 bp, Homo sapiens
tttatttaaattacaattt

SEQ ID NO: 1497139 - DNA, 14 bp, Homo sapiens
tttatttaaggatg

SEQ ID NO: 1497140 - DNA, 23 bp, Homo sapiens
tttatttaaggatggatggcacc

SEQ ID NO: 1497141 - DNA, 15 bp, Homo sapiens
tttatttacatttta

SEQ ID NO: 1497142 - DNA, 18 bp, Homo sapiens
tttatttacattttatat

SEQ ID NO: 1497143 - DNA, 11 bp, Homo sapiens
tttatttacta

SEQ ID NO: 1497144 - DNA, 15 bp, Homo sapiens
tttatttagttttta

SEQ ID NO: 1497145 - DNA, 15 bp, Homo sapiens
tttatttatactatt

SEQ ID NO: 1497146 - DNA, 14 bp, Homo sapiens
tttatttatcagtg

SEQ ID NO: 1497147 - DNA, 21 bp, Homo sapiens
tttatttatccagaaaactgt

SEQ ID NO: 1497148 - DNA, 20 bp, Homo sapiens
tttatttcatttttcaatag

SEQ ID NO: 1497149 - DNA, 15 bp, Homo sapiens
tttatttgtaatttt

SEQ ID NO: 1497150 - DNA, 17 bp, Homo sapiens
tttatttgtattactag

SEQ ID NO: 1497151 - DNA, 18 bp, Homo sapiens
tttattttacacagaaac

SEQ ID NO: 1497152 - DNA, 19 bp, Homo sapiens
tttattttacagctcatta

SEQ ID NO: 1497153 - DNA, 17 bp, Homo sapiens
tttattttactattgga

SEQ ID NO: 1497154 - DNA, 23 bp, Homo sapiens
tttattttcagtcccctctctct

SEQ ID NO: 1497155 - DNA, 12 bp, Homo sapiens
tttattttccta

SEQ ID NO: 1497156 - DNA, 21 bp, Homo sapiens
tttattttcttttgtaaatgt

SEQ ID NO: 1497157 - DNA, 18 bp, Homo sapiens
tttattttggaactatga

SEQ ID NO: 1497158 - DNA, 15 bp, Homo sapiens
tttatttttctaaaa

SEQ ID NO: 1497159 - DNA, 13 bp, Homo sapiens
tttatttttgaac

SEQ ID NO: 1497160 - DNA, 19 bp, Homo sapiens
tttatttttgtgtaggtgt

SEQ ID NO: 1497161 - DNA, 17 bp, Homo sapiens
tttattttttaaatgta

SEQ ID NO: 1497162 - DNA, 13 bp, Homo sapiens
tttattttttggt

SEQ ID NO: 1497163 - DNA, 21 bp, Homo sapiens
tttcaaaaggtattatacatg

SEQ ID NO: 1497164 - DNA, 22 bp, Homo sapiens
tttcaaaatatattttcagtac

SEQ ID NO: 1497165 - DNA, 21 bp, Homo sapiens
tttcaaaatccaaaaagaaat

SEQ ID NO: 1497166 - DNA, 22 bp, Homo sapiens
tttcaaacaatcaagttgactc

SEQ ID NO: 1497167 - DNA, 16 bp, Homo sapiens
tttcaaacttactatt

SEQ ID NO: 1497168 - DNA, 22 bp, Homo sapiens
tttcaaacttactattttgaca

SEQ ID NO: 1497169 - DNA, 14 bp, Homo sapiens
tttcaaactttgga

SEQ ID NO: 1497170 - DNA, 13 bp, Homo sapiens
tttcaaagatgct

SEQ ID NO: 1497171 - DNA, 21 bp, Homo sapiens
tttcaaagccctgcctctgtg

SEQ ID NO: 1497172 - DNA, 18 bp, Homo sapiens
tttcaaaggaacattgtg

SEQ ID NO: 1497173 - DNA, 11 bp, Homo sapiens
tttcaaatgag

SEQ ID NO: 1497174 - DNA, 19 bp, Homo sapiens
tttcaaatgagtttaaaaa

SEQ ID NO: 1497175 - DNA, 11 bp, Homo sapiens
tttcaaatgca

SEQ ID NO: 1497176 - DNA, 14 bp, Homo sapiens
tttcaaatgcagaa

SEQ ID NO: 1497177 - DNA, 20 bp, Homo sapiens
tttcaaccaactatttttga

SEQ ID NO: 1497178 - DNA, 19 bp, Homo sapiens
tttcaaccataaaagaagt

SEQ ID NO: 1497179 - DNA, 14 bp, Homo sapiens
tttcaagaacctgg

SEQ ID NO: 1497180 - DNA, 16 bp, Homo sapiens
tttcaagaacctggaa

SEQ ID NO: 1497181 - DNA, 21 bp, Homo sapiens
tttcaagagtctaatagtctt

SEQ ID NO: 1497182 - DNA, 22 bp, Homo sapiens
tttcaagagtctaatagtcttt

SEQ ID NO: 1497183 - DNA, 12 bp, Homo sapiens
tttcaagattct

SEQ ID NO: 1497184 - DNA, 16 bp, Homo sapiens
tttcaagattctaaag

SEQ ID NO: 1497185 - DNA, 23 bp, Homo sapiens
tttcaagcagtcgtgcctgtgtc

SEQ ID NO: 1497186 - DNA, 12 bp, Homo sapiens
tttcaagctgca

SEQ ID NO: 1497187 - DNA, 15 bp, Homo sapiens
tttcaaggaaagtga

SEQ ID NO: 1497188 - DNA, 19 bp, Homo sapiens
tttcaaggcactctagatt

SEQ ID NO: 1497189 - DNA, 22 bp, Homo sapiens
tttcaaggcactctagattcca

SEQ ID NO: 1497190 - DNA, 13 bp, Homo sapiens
tttcaaggttcta

SEQ ID NO: 1497191 - DNA, 13 bp, Homo sapiens
tttcaagtgccta

SEQ ID NO: 1497192 - DNA, 19 bp, Homo sapiens
tttcaagtgcctagactgt

SEQ ID NO: 1497193 - DNA, 18 bp, Homo sapiens
tttcaagttattcaaatt

SEQ ID NO: 1497194 - DNA, 17 bp, Homo sapiens
tttcaataccagggaag

SEQ ID NO: 1497195 - DNA, 15 bp, Homo sapiens
tttcaatagcacata

SEQ ID NO: 1497196 - DNA, 17 bp, Homo sapiens
tttcaatatattgaact

SEQ ID NO: 1497197 - DNA, 22 bp, Homo sapiens
tttcaatatattgaacttttgt

SEQ ID NO: 1497198 - DNA, 20 bp, Homo sapiens
tttcaatcaactttactgta

SEQ ID NO: 1497199 - DNA, 13 bp, Homo sapiens
tttcaatctttta

SEQ ID NO: 1497200 - DNA, 22 bp, Homo sapiens
tttcaattccacctgcaatcaa

SEQ ID NO: 1497201 - DNA, 20 bp, Homo sapiens
tttcacaaatccttcaaaat

SEQ ID NO: 1497202 - DNA, 16 bp, Homo sapiens
tttcacaaccttctgt

SEQ ID NO: 1497203 - DNA, 22 bp, Homo sapiens
tttcacaaccttctgtggctca

SEQ ID NO: 1497204 - DNA, 18 bp, Homo sapiens
tttcacaatgtgaaactg

SEQ ID NO: 1497205 - DNA, 19 bp, Homo sapiens
tttcacaatgtgaaactga

SEQ ID NO: 1497206 - DNA, 18 bp, Homo sapiens
tttcacacatctgggtgc

SEQ ID NO: 1497207 - DNA, 13 bp, Homo sapiens
tttcacactggat

SEQ ID NO: 1497208 - DNA, 19 bp, Homo sapiens
tttcacactgtcttcccga

SEQ ID NO: 1497209 - DNA, 17 bp, Homo sapiens
tttcacagaaaataagg

SEQ ID NO: 1497210 - DNA, 21 bp, Homo sapiens
tttcacatatctagtatgaaa

SEQ ID NO: 1497211 - DNA, 13 bp, Homo sapiens
tttcacattagat

SEQ ID NO: 1497212 - DNA, 15 bp, Homo sapiens
tttcacattgtttgc

SEQ ID NO: 1497213 - DNA, 18 bp, Homo sapiens
tttcacatttaaatggtt

SEQ ID NO: 1497214 - DNA, 13 bp, Homo sapiens
tttcacattttcc

SEQ ID NO: 1497215 - DNA, 14 bp, Homo sapiens
tttcacattttcct

SEQ ID NO: 1497216 - DNA, 13 bp, Homo sapiens
tttcaccaatgag

SEQ ID NO: 1497217 - DNA, 17 bp, Homo sapiens
tttcaccagatttgcta

SEQ ID NO: 1497218 - DNA, 22 bp, Homo sapiens
tttcaccccacccttcccctcc

SEQ ID NO: 1497219 - DNA, 17 bp, Homo sapiens
tttcacccctccctttc

SEQ ID NO: 1497220 - DNA, 20 bp, Homo sapiens
tttcacccctccctttctcc

SEQ ID NO: 1497221 - DNA, 16 bp, Homo sapiens
tttcaccttttcagga

SEQ ID NO: 1497222 - DNA, 18 bp, Homo sapiens
tttcacgggaactctcca

SEQ ID NO: 1497223 - DNA, 19 bp, Homo sapiens
tttcactaggactcagaaa

SEQ ID NO: 1497224 - DNA, 17 bp, Homo sapiens
tttcactgctggctgcc

SEQ ID NO: 1497225 - DNA, 22 bp, Homo sapiens
tttcactgctggctgccttaga

SEQ ID NO: 1497226 - DNA, 19 bp, Homo sapiens
tttcactggagttacatta

SEQ ID NO: 1497227 - DNA, 13 bp, Homo sapiens
tttcactgtactg

SEQ ID NO: 1497228 - DNA, 22 bp, Homo sapiens
tttcacttaataatttttacct

SEQ ID NO: 1497229 - DNA, 23 bp, Homo sapiens
tttcacttagaacctttctgtgt

SEQ ID NO: 1497230 - DNA, 15 bp, Homo sapiens
tttcacttcttccta

SEQ ID NO: 1497231 - DNA, 19 bp, Homo sapiens
tttccactattttcaaaga

SEQ ID NO: 1497232 - DNA, 18 bp, Homo sapiens
tttccactgaacaaaacc

SEQ ID NO: 1497233 - DNA, 12 bp, Homo sapiens
tttccactgaag

SEQ ID NO: 1497234 - DNA, 19 bp, Homo sapiens
tttccagacttccttgaga

SEQ ID NO: 1497235 - DNA, 20 bp, Homo sapiens
tttccagaggagtttcttaa

SEQ ID NO: 1497236 - DNA, 21 bp, Homo sapiens
tttccagcagaagacaaaaag

SEQ ID NO: 1497237 - DNA, 23 bp, Homo sapiens
tttccagcagaagacaaaaagac

SEQ ID NO: 1497238 - DNA, 15 bp, Homo sapiens
tttccagcttgcatt

SEQ ID NO: 1497239 - DNA, 17 bp, Homo sapiens
tttccaggaaaaaataa

SEQ ID NO: 1497240 - DNA, 22 bp, Homo sapiens
tttccaggaaaaaataaaaaga

SEQ ID NO: 1497241 - DNA, 19 bp, Homo sapiens
tttccaggatcctgcagga

SEQ ID NO: 1497242 - DNA, 21 bp, Homo sapiens
tttccagtggtcatgctcagc

SEQ ID NO: 1497243 - DNA, 15 bp, Homo sapiens
tttccataaatttgg

SEQ ID NO: 1497244 - DNA, 15 bp, Homo sapiens
tttccataaggaatg

SEQ ID NO: 1497245 - DNA, 17 bp, Homo sapiens
tttccatcaactcccaa

SEQ ID NO: 1497246 - DNA, 11 bp, Homo sapiens
tttccatctct

SEQ ID NO: 1497247 - DNA, 15 bp, Homo sapiens
tttccatctctgcct

SEQ ID NO: 1497248 - DNA, 11 bp, Homo sapiens
tttccatctta

SEQ ID NO: 1497249 - DNA, 21 bp, Homo sapiens
tttccatgcagactcctcaga

SEQ ID NO: 1497250 - DNA, 22 bp, Homo sapiens
tttccatgggccccaccattta

SEQ ID NO: 1497251 - DNA, 15 bp, Homo sapiens
tttccattagaacaa

SEQ ID NO: 1497252 - DNA, 19 bp, Homo sapiens
tttccattgaccagctctc

SEQ ID NO: 1497253 - DNA, 20 bp, Homo sapiens
tttccattgaccagctctct

SEQ ID NO: 1497254 - DNA, 21 bp, Homo sapiens
tttccattggtttacctgtga

SEQ ID NO: 1497255 - DNA, 14 bp, Homo sapiens
tttccatttctcaa

SEQ ID NO: 1497256 - DNA, 15 bp, Homo sapiens
tttccatttgtatta

SEQ ID NO: 1497257 - DNA, 13 bp, Homo sapiens
tttcccaccagct

SEQ ID NO: 1497258 - DNA, 21 bp, Homo sapiens
tttcccactgtttaaggagtt

SEQ ID NO: 1497259 - DNA, 11 bp, Homo sapiens
tttcccaggac

SEQ ID NO: 1497260 - DNA, 12 bp, Homo sapiens
tttcccataatt

SEQ ID NO: 1497261 - DNA, 16 bp, Homo sapiens
tttcccatggggaggg

SEQ ID NO: 1497262 - DNA, 14 bp, Homo sapiens
tttcccatgtattt

SEQ ID NO: 1497263 - DNA, 16 bp, Homo sapiens
tttcccatgtatttgt

SEQ ID NO: 1497264 - DNA, 19 bp, Homo sapiens
tttccccaggggaaaatga

SEQ ID NO: 1497265 - DNA, 20 bp, Homo sapiens
tttcccccacagttttaata

SEQ ID NO: 1497266 - DNA, 19 bp, Homo sapiens
tttccccccactctcccca

SEQ ID NO: 1497267 - DNA, 18 bp, Homo sapiens
tttccccctagcctgcct

SEQ ID NO: 1497268 - DNA, 12 bp, Homo sapiens
tttcccccttcc

SEQ ID NO: 1497269 - DNA, 13 bp, Homo sapiens
tttcccccttccc

SEQ ID NO: 1497270 - DNA, 14 bp, Homo sapiens
tttcccccttccca

SEQ ID NO: 1497271 - DNA, 22 bp, Homo sapiens
tttcccccttcccatttcttcc

SEQ ID NO: 1497272 - DNA, 15 bp, Homo sapiens
tttcccccttgagga

SEQ ID NO: 1497273 - DNA, 23 bp, Homo sapiens
tttcccccttgaggattgtggaa

SEQ ID NO: 1497274 - DNA, 13 bp, Homo sapiens
tttcccctccctg

SEQ ID NO: 1497275 - DNA, 13 bp, Homo sapiens
tttcccctggcct

SEQ ID NO: 1497276 - DNA, 14 bp, Homo sapiens
tttcccctggcctc

SEQ ID NO: 1497277 - DNA, 23 bp, Homo sapiens
tttccccttggtcccaagcctga

SEQ ID NO: 1497278 - DNA, 13 bp, Homo sapiens
tttcccctttcct

SEQ ID NO: 1497279 - DNA, 15 bp, Homo sapiens
tttcccctttcctgt

SEQ ID NO: 1497280 - DNA, 17 bp, Homo sapiens
tttcccgccttgggctt

SEQ ID NO: 1497281 - DNA, 14 bp, Homo sapiens
tttccctatcttct

SEQ ID NO: 1497282 - DNA, 13 bp, Homo sapiens
tttccctgacctc

SEQ ID NO: 1497283 - DNA, 16 bp, Homo sapiens
tttccctgaggaatga

SEQ ID NO: 1497284 - DNA, 11 bp, Homo sapiens
tttccctgctg

SEQ ID NO: 1497285 - DNA, 22 bp, Homo sapiens
tttccctggaactcctggcctt

SEQ ID NO: 1497286 - DNA, 13 bp, Homo sapiens
tttcccttccaaa

SEQ ID NO: 1497287 - DNA, 14 bp, Homo sapiens
tttcccttccaaag

SEQ ID NO: 1497288 - DNA, 20 bp, Homo sapiens
tttcccttctggacactgag

SEQ ID NO: 1497289 - DNA, 18 bp, Homo sapiens
tttcccttggctgttaag

SEQ ID NO: 1497290 - DNA, 23 bp, Homo sapiens
tttccctttgaggttgctttgtt

SEQ ID NO: 1497291 - DNA, 21 bp, Homo sapiens
tttccggccaaggtgccacca

SEQ ID NO: 1497292 - DNA, 23 bp, Homo sapiens
tttccgtttttttttttttattg

SEQ ID NO: 1497293 - DNA, 18 bp, Homo sapiens
tttcctaaacataattgt

SEQ ID NO: 1497294 - DNA, 22 bp, Homo sapiens
tttcctaaacataattgtggat

SEQ ID NO: 1497295 - DNA, 23 bp, Homo sapiens
tttcctaaacataattgtggatt

SEQ ID NO: 1497296 - DNA, 14 bp, Homo sapiens
tttcctaaggcatg

SEQ ID NO: 1497297 - DNA, 12 bp, Homo sapiens
tttcctaatact

SEQ ID NO: 1497298 - DNA, 16 bp, Homo sapiens
tttcctactgtcctca

SEQ ID NO: 1497299 - DNA, 23 bp, Homo sapiens
tttcctagccctctcacatttat

SEQ ID NO: 1497300 - DNA, 17 bp, Homo sapiens
tttcctatagactgtaa

SEQ ID NO: 1497301 - DNA, 23 bp, Homo sapiens
tttcctatagctacatgttcttt

SEQ ID NO: 1497302 - DNA, 20 bp, Homo sapiens
tttcctcaagcaataattgt

SEQ ID NO: 1497303 - DNA, 21 bp, Homo sapiens
tttcctcaagtatcttctatt

SEQ ID NO: 1497304 - DNA, 22 bp, Homo sapiens
tttcctcaagtatcttctattt

SEQ ID NO: 1497305 - DNA, 19 bp, Homo sapiens
tttcctcacgtgcaggaca

SEQ ID NO: 1497306 - DNA, 11 bp, Homo sapiens
tttcctcagtg

SEQ ID NO: 1497307 - DNA, 18 bp, Homo sapiens
tttcctcatgtaacattg

SEQ ID NO: 1497308 - DNA, 13 bp, Homo sapiens
tttcctccctcag

SEQ ID NO: 1497309 - DNA, 20 bp, Homo sapiens
tttcctctattgatgtacag

SEQ ID NO: 1497310 - DNA, 18 bp, Homo sapiens
tttcctctgagattctaa

SEQ ID NO: 1497311 - DNA, 18 bp, Homo sapiens
tttcctcttgtcctggcc

SEQ ID NO: 1497312 - DNA, 18 bp, Homo sapiens
tttcctgaacctggaaat

SEQ ID NO: 1497313 - DNA, 15 bp, Homo sapiens
tttcctgaagcattt

SEQ ID NO: 1497314 - DNA, 17 bp, Homo sapiens
tttgccaataaagcttt

SEQ ID NO: 1497315 - DNA, 15 bp, Homo sapiens
tttgccacagctttt

SEQ ID NO: 1497316 - DNA, 23 bp, Homo sapiens
tttgccacatacatagatcttca

SEQ ID NO: 1497317 - DNA, 18 bp, Homo sapiens
tttgccactaattttagt

SEQ ID NO: 1497318 - DNA, 21 bp, Homo sapiens
tttgccactaattttagtatt

SEQ ID NO: 1497319 - DNA, 13 bp, Homo sapiens
tttgccagagcag

SEQ ID NO: 1497320 - DNA, 10 bp, Homo sapiens
tttgccagca

SEQ ID NO: 1497321 - DNA, 23 bp, Homo sapiens
tttgccagtgaagacttcttggg

SEQ ID NO: 1497322 - DNA, 14 bp, Homo sapiens
tttgcccacccctc

SEQ ID NO: 1497323 - DNA, 16 bp, Homo sapiens
tttgccccctcccttc

SEQ ID NO: 1497324 - DNA, 17 bp, Homo sapiens
tttgccccgggatatta

SEQ ID NO: 1497325 - DNA, 22 bp, Homo sapiens
tttgcctaaatccaaagaaaaa

SEQ ID NO: 1497326 - DNA, 20 bp, Homo sapiens
tttgcctcttctttgtgcct

SEQ ID NO: 1497327 - DNA, 22 bp, Homo sapiens
tttgcctcttctttgtgccttt

SEQ ID NO: 1497328 - DNA, 20 bp, Homo sapiens
tttgcctcttttctctgtgc

SEQ ID NO: 1497329 - DNA, 12 bp, Homo sapiens
tttgcctggctg

SEQ ID NO: 1497330 - DNA, 13 bp, Homo sapiens
tttgcctggctgt

SEQ ID NO: 1497331 - DNA, 15 bp, Homo sapiens
tttgcctgtaagaaa

SEQ ID NO: 1497332 - DNA, 14 bp, Homo sapiens
tttgcctttaacag

SEQ ID NO: 1497333 - DNA, 13 bp, Homo sapiens
tttgctaactggg

SEQ ID NO: 1497334 - DNA, 15 bp, Homo sapiens
tttgctaactgggtt

SEQ ID NO: 1497335 - DNA, 17 bp, Homo sapiens
tttgctaactgggttaa

SEQ ID NO: 1497336 - DNA, 21 bp, Homo sapiens
tttgctaatttttattaattt

SEQ ID NO: 1497337 - DNA, 14 bp, Homo sapiens
tttgctactaagtt

SEQ ID NO: 1497338 - DNA, 21 bp, Homo sapiens
tttgctagactctagacaaga

SEQ ID NO: 1497339 - DNA, 15 bp, Homo sapiens
tttgctagatggaat

SEQ ID NO: 1497340 - DNA, 20 bp, Homo sapiens
tttgctagcagtaaaagatg

SEQ ID NO: 1497341 - DNA, 18 bp, Homo sapiens
tttgctaggagccccagc

SEQ ID NO: 1497342 - DNA, 14 bp, Homo sapiens
tttgctataatcat

SEQ ID NO: 1497343 - DNA, 15 bp, Homo sapiens
tttgctataatcatt

SEQ ID NO: 1497344 - DNA, 19 bp, Homo sapiens
tttgctcaaaattgcttct

SEQ ID NO: 1497345 - DNA, 14 bp, Homo sapiens
tttgctcagtgtcc

SEQ ID NO: 1497346 - DNA, 20 bp, Homo sapiens
tttgctctcccggttcttcc

SEQ ID NO: 1497347 - DNA, 18 bp, Homo sapiens
tttgctcttcagatgcca

SEQ ID NO: 1497348 - DNA, 20 bp, Homo sapiens
tttgctcttcagatgccact

SEQ ID NO: 1497349 - DNA, 18 bp, Homo sapiens
tttgctgaacattggaga

SEQ ID NO: 1497350 - DNA, 11 bp, Homo sapiens
tttgctgaatt

SEQ ID NO: 1497351 - DNA, 18 bp, Homo sapiens
tttgctgagttgttctaa

SEQ ID NO: 1497352 - DNA, 22 bp, Homo sapiens
tttgctgcacaaacatgaaaat

SEQ ID NO: 1497353 - DNA, 19 bp, Homo sapiens
tttgctgcactttttactt

SEQ ID NO: 1497354 - DNA, 23 bp, Homo sapiens
tttgctgctatgaaaatgagcat

SEQ ID NO: 1497355 - DNA, 13 bp, Homo sapiens
tttgctgctcttc

SEQ ID NO: 1497356 - DNA, 21 bp, Homo sapiens
tttgctgtactcttgctgatg

SEQ ID NO: 1497357 - DNA, 14 bp, Homo sapiens
tttgctgtctctta

SEQ ID NO: 1497358 - DNA, 21 bp, Homo sapiens
tttgctgtctttctctaaata

SEQ ID NO: 1497359 - DNA, 15 bp, Homo sapiens
tttgctgtgaacaat

SEQ ID NO: 1497360 - DNA, 17 bp, Homo sapiens
tttgctgtgaggctgtc

SEQ ID NO: 1497361 - DNA, 20 bp, Homo sapiens
tttgcttaaatcagttggag

SEQ ID NO: 1497362 - DNA, 10 bp, Homo sapiens
tttgcttccg

SEQ ID NO: 1497363 - DNA, 16 bp, Homo sapiens
tttgctttaattgctt

SEQ ID NO: 1497364 - DNA, 15 bp, Homo sapiens
tttgctttctgaatt

SEQ ID NO: 1497365 - DNA, 12 bp, Homo sapiens
tttggaaaataa

SEQ ID NO: 1497366 - DNA, 15 bp, Homo sapiens
tttggaaactgcaaa

SEQ ID NO: 1497367 - DNA, 23 bp, Homo sapiens
tttggaaagagcaccctcgagaa

SEQ ID NO: 1497368 - DNA, 20 bp, Homo sapiens
tttggaacactgtttaggta

SEQ ID NO: 1497369 - DNA, 23 bp, Homo sapiens
tttggaacatttctttcttgctg

SEQ ID NO: 1497370 - DNA, 22 bp, Homo sapiens
tttggaagcagccccctgtggc

SEQ ID NO: 1497371 - DNA, 13 bp, Homo sapiens
tttggaataaagt

SEQ ID NO: 1497372 - DNA, 17 bp, Homo sapiens
tttggaataatttctat

SEQ ID NO: 1497373 - DNA, 15 bp, Homo sapiens
tttggaatattaaaa

SEQ ID NO: 1497374 - DNA, 13 bp, Homo sapiens
tttggacagttta

SEQ ID NO: 1497375 - DNA, 16 bp, Homo sapiens
tttggacagtttacca

SEQ ID NO: 1497376 - DNA, 18 bp, Homo sapiens
tttggactccatctctca

SEQ ID NO: 1497377 - DNA, 21 bp, Homo sapiens
tttggagaaatgtcataaatt

SEQ ID NO: 1497378 - DNA, 17 bp, Homo sapiens
tttggagcctgccaaga

SEQ ID NO: 1497379 - DNA, 21 bp, Homo sapiens
tttggaggctgagttctggtt

SEQ ID NO: 1497380 - DNA, 20 bp, Homo sapiens
tttggagtcccctcacctcc

SEQ ID NO: 1497381 - DNA, 21 bp, Homo sapiens
tttggagtggaggcattgttt

SEQ ID NO: 1497382 - DNA, 23 bp, Homo sapiens
tttggattctcttagctactgta

SEQ ID NO: 1497383 - DNA, 18 bp, Homo sapiens
tttggattgactctgcat

SEQ ID NO: 1497384 - DNA, 22 bp, Homo sapiens
tttggattggatgaattccaaa

SEQ ID NO: 1497385 - DNA, 14 bp, Homo sapiens
tttggattttatgg

SEQ ID NO: 1497386 - DNA, 19 bp, Homo sapiens
tttggcaaacgctaaagag

SEQ ID NO: 1497387 - DNA, 14 bp, Homo sapiens
tttggcaaggaaag

SEQ ID NO: 1497388 - DNA, 14 bp, Homo sapiens
tttggcacttgtat

SEQ ID NO: 1497389 - DNA, 16 bp, Homo sapiens
tttggcacttgtattt

SEQ ID NO: 1497390 - DNA, 19 bp, Homo sapiens
tttggcacttgtatttaat

SEQ ID NO: 1497391 - DNA, 13 bp, Homo sapiens
tttggccccactt

SEQ ID NO: 1497392 - DNA, 12 bp, Homo sapiens
tttggccctgga

SEQ ID NO: 1497393 - DNA, 17 bp, Homo sapiens
tttggcctgcactaatt

SEQ ID NO: 1497394 - DNA, 15 bp, Homo sapiens
tttggccttaagaac

SEQ ID NO: 1497395 - DNA, 14 bp, Homo sapiens
tttggctctttcag

SEQ ID NO: 1497396 - DNA, 22 bp, Homo sapiens
tttggctgaaattctcctggag

SEQ ID NO: 1497397 - DNA, 14 bp, Homo sapiens
tttggcttccatga

SEQ ID NO: 1497398 - DNA, 16 bp, Homo sapiens
tttggcttctcctgtg

SEQ ID NO: 1497399 - DNA, 17 bp, Homo sapiens
tttggcttctcctgtga

SEQ ID NO: 1497400 - DNA, 14 bp, Homo sapiens
tttgggacttctac

SEQ ID NO: 1497401 - DNA, 17 bp, Homo sapiens
tttgggaggccaaggca

SEQ ID NO: 1497402 - DNA, 17 bp, Homo sapiens
tttgggaggctgaggtg

SEQ ID NO: 1497403 - DNA, 20 bp, Homo sapiens
tttgggccagttatagctta

SEQ ID NO: 1497404 - DNA, 21 bp, Homo sapiens
tttgggcttagtatttctcag

SEQ ID NO: 1497405 - DNA, 19 bp, Homo sapiens
tttggggatcgatgtgctc

SEQ ID NO: 1497406 - DNA, 17 bp, Homo sapiens
tttggggcatcctggat

SEQ ID NO: 1497407 - DNA, 21 bp, Homo sapiens
tttgggggcgccctctctgct

SEQ ID NO: 1497408 - DNA, 21 bp, Homo sapiens
tttgggggctcatttttgctg

SEQ ID NO: 1497409 - DNA, 19 bp, Homo sapiens
tttggggggtgtgctgaca

SEQ ID NO: 1497410 - DNA, 20 bp, Homo sapiens
tttggggggttttcttgcct

SEQ ID NO: 1497411 - DNA, 21 bp, Homo sapiens
tttgggtgtttttcatgtttt

SEQ ID NO: 1497412 - DNA, 14 bp, Homo sapiens
tttgggttctgcct

SEQ ID NO: 1497413 - DNA, 16 bp, Homo sapiens
tttgggttctgcctgc

SEQ ID NO: 1497414 - DNA, 16 bp, Homo sapiens
tttgggtttttttcct

SEQ ID NO: 1497415 - DNA, 16 bp, Homo sapiens
tttggtaaaaatgctg

SEQ ID NO: 1497416 - DNA, 13 bp, Homo sapiens
tttggtaaatgtt

SEQ ID NO: 1497417 - DNA, 23 bp, Homo sapiens
tttggtacttttgagtgtgtgtg

SEQ ID NO: 1497418 - DNA, 22 bp, Homo sapiens
tttgacacaaagcttctaaagc

SEQ ID NO: 1497419 - DNA, 18 bp, Homo sapiens
tttgacactatatctgta

SEQ ID NO: 1497420 - DNA, 12 bp, Homo sapiens
tttgacactgaa

SEQ ID NO: 1497421 - DNA, 13 bp, Homo sapiens
tttgacactgaaa

SEQ ID NO: 1497422 - DNA, 14 bp, Homo sapiens
tttgacacttccca

SEQ ID NO: 1497423 - DNA, 18 bp, Homo sapiens
tttgacagaatatgtttc

SEQ ID NO: 1497424 - DNA, 20 bp, Homo sapiens
tttgacagaatatgtttcaa

SEQ ID NO: 1497425 - DNA, 19 bp, Homo sapiens
tttgacagtgttgaaaatg

SEQ ID NO: 1497426 - DNA, 21 bp, Homo sapiens
tttgaccccgatatattttag

SEQ ID NO: 1497427 - DNA, 18 bp, Homo sapiens
tttgacctcacagtgacc

SEQ ID NO: 1497428 - DNA, 21 bp, Homo sapiens
tttgactaattttacatgttt

SEQ ID NO: 1497429 - DNA, 13 bp, Homo sapiens
tttgactccttac

SEQ ID NO: 1497430 - DNA, 12 bp, Homo sapiens
tttgactctttt

SEQ ID NO: 1497431 - DNA, 15 bp, Homo sapiens
tttgactgaaaaaaa

SEQ ID NO: 1497432 - DNA, 15 bp, Homo sapiens
tttgactgtgattta

SEQ ID NO: 1497433 - DNA, 16 bp, Homo sapiens
tttgacttaatgtgat

SEQ ID NO: 1497434 - DNA, 12 bp, Homo sapiens
tttgactttgta

SEQ ID NO: 1497435 - DNA, 20 bp, Homo sapiens
tttgagaaaaaggaaaaaaa

SEQ ID NO: 1497436 - DNA, 14 bp, Homo sapiens
tttgagaagaaaac

SEQ ID NO: 1497437 - DNA, 15 bp, Homo sapiens
tttgagacaagccct

SEQ ID NO: 1497438 - DNA, 19 bp, Homo sapiens
tttgagacaagccctggca

SEQ ID NO: 1497439 - DNA, 16 bp, Homo sapiens
tttgagaccagcctgg

SEQ ID NO: 1497440 - DNA, 19 bp, Homo sapiens
tttgagaccaggctgggca

SEQ ID NO: 1497441 - DNA, 14 bp, Homo sapiens
tttgagagttctaa

SEQ ID NO: 1497442 - DNA, 16 bp, Homo sapiens
tttgagagttctaaat

SEQ ID NO: 1497443 - DNA, 14 bp, Homo sapiens
tttgagatctaaaa

SEQ ID NO: 1497444 - DNA, 18 bp, Homo sapiens
tttgagatctaaaaataa

SEQ ID NO: 1497445 - DNA, 13 bp, Homo sapiens
tttgagcatgcac

SEQ ID NO: 1497446 - DNA, 23 bp, Homo sapiens
tttgagcatgcacagctgcttgt

SEQ ID NO: 1497447 - DNA, 16 bp, Homo sapiens
tttgagcctgggaaat

SEQ ID NO: 1497448 - DNA, 19 bp, Homo sapiens
tttgagctgaaatgctgca

SEQ ID NO: 1497449 - DNA, 12 bp, Homo sapiens
tttgagctgcct

SEQ ID NO: 1497450 - DNA, 18 bp, Homo sapiens
tttgaggaaatttgcagc

SEQ ID NO: 1497451 - DNA, 20 bp, Homo sapiens
tttgaggatatattttcact

SEQ ID NO: 1497452 - DNA, 21 bp, Homo sapiens
tttgaggatatattttcactt

SEQ ID NO: 1497453 - DNA, 20 bp, Homo sapiens
tttgaggtcaagtaagaaga

SEQ ID NO: 1497454 - DNA, 23 bp, Homo sapiens
tttgaggtcaagtaagaagacat

SEQ ID NO: 1497455 - DNA, 21 bp, Homo sapiens
tttgaggttttgtaaaactgt

SEQ ID NO: 1497456 - DNA, 20 bp, Homo sapiens
tttgagtacagatactgtga

SEQ ID NO: 1497457 - DNA, 13 bp, Homo sapiens
tttgagtgacagc

SEQ ID NO: 1497458 - DNA, 21 bp, Homo sapiens
tttgagtgccaatttcttact

SEQ ID NO: 1497459 - DNA, 20 bp, Homo sapiens
tttgagtggatgatgtttcg

SEQ ID NO: 1497460 - DNA, 21 bp, Homo sapiens
tttgagtggatgatgtttcgt

SEQ ID NO: 1497461 - DNA, 14 bp, Homo sapiens
tttgagtgttttaa

SEQ ID NO: 1497462 - DNA, 13 bp, Homo sapiens
tttgagttctaca

SEQ ID NO: 1497463 - DNA, 18 bp, Homo sapiens
tttgataaagtttctcag

SEQ ID NO: 1497464 - DNA, 13 bp, Homo sapiens
tttgataaattta

SEQ ID NO: 1497465 - DNA, 16 bp, Homo sapiens
tttgatataccaaatt

SEQ ID NO: 1497466 - DNA, 20 bp, Homo sapiens
tttgatatgcatatttgttt

SEQ ID NO: 1497467 - DNA, 14 bp, Homo sapiens
tttgatcaagaatg

SEQ ID NO: 1497468 - DNA, 16 bp, Homo sapiens
tttgatctcacatttt

SEQ ID NO: 1497469 - DNA, 14 bp, Homo sapiens
tttgatgagaaaaa

SEQ ID NO: 1497470 - DNA, 16 bp, Homo sapiens
tttgatgcatgtcttt

SEQ ID NO: 1497471 - DNA, 19 bp, Homo sapiens
tttgatgcctgtgaagaac

SEQ ID NO: 1497472 - DNA, 20 bp, Homo sapiens
tttgatggagggtggaaata

SEQ ID NO: 1497473 - DNA, 18 bp, Homo sapiens
tttgatggctgggtcctt

SEQ ID NO: 1497474 - DNA, 13 bp, Homo sapiens
tttgatggggaga

SEQ ID NO: 1497475 - DNA, 12 bp, Homo sapiens
tttgatgtacat

SEQ ID NO: 1497476 - DNA, 15 bp, Homo sapiens
tttgattaacatttg

SEQ ID NO: 1497477 - DNA, 20 bp, Homo sapiens
tttgattaatgtttcttaaa

SEQ ID NO: 1497478 - DNA, 13 bp, Homo sapiens
tttgattcatttt

SEQ ID NO: 1497479 - DNA, 14 bp, Homo sapiens
tttgatttcattaa

SEQ ID NO: 1497480 - DNA, 22 bp, Homo sapiens
tttgcaaaaatccaaatattgt

SEQ ID NO: 1497481 - DNA, 23 bp, Homo sapiens
tttgcaacaggggaggaaaaaag

SEQ ID NO: 1497482 - DNA, 17 bp, Homo sapiens
tttgcaacttaatactc

SEQ ID NO: 1497483 - DNA, 23 bp, Homo sapiens
tttgcaacttcaagggacaagta

SEQ ID NO: 1497484 - DNA, 18 bp, Homo sapiens
tttgcaataaaaatgata

SEQ ID NO: 1497485 - DNA, 19 bp, Homo sapiens
tttgcaataacttctatat

SEQ ID NO: 1497486 - DNA, 12 bp, Homo sapiens
tttgcacagctc

SEQ ID NO: 1497487 - DNA, 17 bp, Homo sapiens
tttgcaccgcctgccct

SEQ ID NO: 1497488 - DNA, 20 bp, Homo sapiens
tttgcacggtttggataatc

SEQ ID NO: 1497489 - DNA, 21 bp, Homo sapiens
tttgcactcaaatcttaagaa

SEQ ID NO: 1497490 - DNA, 17 bp, Homo sapiens
tttgcactgagggccac

SEQ ID NO: 1497491 - DNA, 22 bp, Homo sapiens
tttgcactgagggccacactat

SEQ ID NO: 1497492 - DNA, 20 bp, Homo sapiens
tttgcactggagttctatgc

SEQ ID NO: 1497493 - DNA, 12 bp, Homo sapiens
tttgcactgtaa

SEQ ID NO: 1497494 - DNA, 13 bp, Homo sapiens
tttgcactgtgtg

SEQ ID NO: 1497495 - DNA, 14 bp, Homo sapiens
tttgcactgtgtgc

SEQ ID NO: 1497496 - DNA, 16 bp, Homo sapiens
tttgcactgtgtgctg

SEQ ID NO: 1497497 - DNA, 13 bp, Homo sapiens
tttgcactgtttt

SEQ ID NO: 1497498 - DNA, 15 bp, Homo sapiens
tttgcacttctgtaa

SEQ ID NO: 1497499 - DNA, 21 bp, Homo sapiens
tttgcagatgttcaaatattg

SEQ ID NO: 1497500 - DNA, 22 bp, Homo sapiens
tttgcagatgttcaaatattgt

SEQ ID NO: 1497501 - DNA, 15 bp, Homo sapiens
tttgcagctgtgaga

SEQ ID NO: 1497502 - DNA, 15 bp, Homo sapiens
tttgcagcttccaat

SEQ ID NO: 1497503 - DNA, 12 bp, Homo sapiens
tttgcaggctct

SEQ ID NO: 1497504 - DNA, 14 bp, Homo sapiens
tttgcaggctctgg

SEQ ID NO: 1497505 - DNA, 16 bp, Homo sapiens
tttgcaggctctgggc

SEQ ID NO: 1497506 - DNA, 17 bp, Homo sapiens
tttgcaggctctgggct

SEQ ID NO: 1497507 - DNA, 21 bp, Homo sapiens
tttgcagtagagtcatctcca

SEQ ID NO: 1497508 - DNA, 20 bp, Homo sapiens
tttgcagttggactctcagg

SEQ ID NO: 1497509 - DNA, 21 bp, Homo sapiens
tttgcatacttcctggatttt

SEQ ID NO: 1497510 - DNA, 20 bp, Homo sapiens
tttgcatattttgagaaact

SEQ ID NO: 1497511 - DNA, 22 bp, Homo sapiens
tttgcatattttgagaaactgc

SEQ ID NO: 1497512 - DNA, 24 bp, Homo sapiens
tttgcatattttgagaaactgctg

SEQ ID NO: 1497513 - DNA, 13 bp, Homo sapiens
tttgcatctttgt

SEQ ID NO: 1497514 - DNA, 12 bp, Homo sapiens
tttgcatgaaat

SEQ ID NO: 1497515 - DNA, 20 bp, Homo sapiens
tttgtgcttgtcattccaga

SEQ ID NO: 1497516 - DNA, 14 bp, Homo sapiens
tttgtggcctcaga

SEQ ID NO: 1497517 - DNA, 15 bp, Homo sapiens
tttgtggcctcagaa

SEQ ID NO: 1497518 - DNA, 20 bp, Homo sapiens
tttgtgggctggttgctgta

SEQ ID NO: 1497519 - DNA, 21 bp, Homo sapiens
tttgtgggctggttgctgtag

SEQ ID NO: 1497520 - DNA, 20 bp, Homo sapiens
tttgtgggtttctctgtgct

SEQ ID NO: 1497521 - DNA, 14 bp, Homo sapiens
tttgtggtcacagc

SEQ ID NO: 1497522 - DNA, 14 bp, Homo sapiens
tttgtggtgtcttc

SEQ ID NO: 1497523 - DNA, 13 bp, Homo sapiens
tttgtgtatgtac

SEQ ID NO: 1497524 - DNA, 12 bp, Homo sapiens
tttgtgtattct

SEQ ID NO: 1497525 - DNA, 22 bp, Homo sapiens
tttgtgtattctgtggattcta

SEQ ID NO: 1497526 - DNA, 22 bp, Homo sapiens
tttgtgtgagacttaaaacatg

SEQ ID NO: 1497527 - DNA, 17 bp, Homo sapiens
tttgtgtgttgtcttga

SEQ ID NO: 1497528 - DNA, 15 bp, Homo sapiens
tttgtgttcagtttt

SEQ ID NO: 1497529 - DNA, 19 bp, Homo sapiens
tttgtgttctgtttgttaa

SEQ ID NO: 1497530 - DNA, 20 bp, Homo sapiens
tttgtgttgttggaaaaagt

SEQ ID NO: 1497531 - DNA, 14 bp, Homo sapiens
tttgttaaaaataa

SEQ ID NO: 1497532 - DNA, 21 bp, Homo sapiens
tttgttaaagctggaacattt

SEQ ID NO: 1497533 - DNA, 22 bp, Homo sapiens
tttgttaaagctggaacatttg

SEQ ID NO: 1497534 - DNA, 22 bp, Homo sapiens
tttgttacataaggatgacttt

SEQ ID NO: 1497535 - DNA, 13 bp, Homo sapiens
tttgttaccttta

SEQ ID NO: 1497536 - DNA, 21 bp, Homo sapiens
tttgttactttaggtttgttc

SEQ ID NO: 1497537 - DNA, 15 bp, Homo sapiens
tttgttagcaaagat

SEQ ID NO: 1497538 - DNA, 20 bp, Homo sapiens
tttgttagcaaagattaaat

SEQ ID NO: 1497539 - DNA, 15 bp, Homo sapiens
tttgttagggctgct

SEQ ID NO: 1497540 - DNA, 19 bp, Homo sapiens
tttgttatatataataaat

SEQ ID NO: 1497541 - DNA, 21 bp, Homo sapiens
tttgttatatataataaatac

SEQ ID NO: 1497542 - DNA, 18 bp, Homo sapiens
tttgttatttacactggt

SEQ ID NO: 1497543 - DNA, 23 bp, Homo sapiens
tttgttcaagttttgggtatgtt

SEQ ID NO: 1497544 - DNA, 19 bp, Homo sapiens
tttgttcactgaaggtgat

SEQ ID NO: 1497545 - DNA, 19 bp, Homo sapiens
tttgttcataataaaagtg

SEQ ID NO: 1497546 - DNA, 16 bp, Homo sapiens
tttgttcatacatatt

SEQ ID NO: 1497547 - DNA, 12 bp, Homo sapiens
tttgttcatctg

SEQ ID NO: 1497548 - DNA, 16 bp, Homo sapiens
tttgttcccctcctcc

SEQ ID NO: 1497549 - DNA, 11 bp, Homo sapiens
tttgttcctgg

SEQ ID NO: 1497550 - DNA, 12 bp, Homo sapiens
tttgttctagac

SEQ ID NO: 1497551 - DNA, 13 bp, Homo sapiens
tttgttctgttgt

SEQ ID NO: 1497552 - DNA, 14 bp, Homo sapiens
tttgttgctgtttt

SEQ ID NO: 1497553 - DNA, 18 bp, Homo sapiens
tttgttgctttcttacct

SEQ ID NO: 1497554 - DNA, 19 bp, Homo sapiens
tttgttggagtgtttctaa

SEQ ID NO: 1497555 - DNA, 13 bp, Homo sapiens
tttgttgtctaca

SEQ ID NO: 1497556 - DNA, 15 bp, Homo sapiens
tttgttgtgtgtgca

SEQ ID NO: 1497557 - DNA, 23 bp, Homo sapiens
tttgttgttcctctatactttgt

SEQ ID NO: 1497558 - DNA, 12 bp, Homo sapiens
tttgttgtttat

SEQ ID NO: 1497559 - DNA, 16 bp, Homo sapiens
tttgtttaaagaataa

SEQ ID NO: 1497560 - DNA, 17 bp, Homo sapiens
tttgtttaaagaataaa

SEQ ID NO: 1497561 - DNA, 21 bp, Homo sapiens
tttgtttatggtaaaaaattt

SEQ ID NO: 1497562 - DNA, 21 bp, Homo sapiens
tttgtttcaagaacctggaaa

SEQ ID NO: 1497563 - DNA, 13 bp, Homo sapiens
tttgtttccccta

SEQ ID NO: 1497564 - DNA, 12 bp, Homo sapiens
tttgtttcccta

SEQ ID NO: 1497565 - DNA, 17 bp, Homo sapiens
tttgtttcctctgttca

SEQ ID NO: 1497566 - DNA, 14 bp, Homo sapiens
tttgtttcctttgt

SEQ ID NO: 1497567 - DNA, 16 bp, Homo sapiens
tttgtttctgaaaatt

SEQ ID NO: 1497568 - DNA, 13 bp, Homo sapiens
tttgtttcttaag

SEQ ID NO: 1497569 - DNA, 16 bp, Homo sapiens
tttgtttcttccaaag

SEQ ID NO: 1497570 - DNA, 12 bp, Homo sapiens
tttgtttgtatt

SEQ ID NO: 1497571 - DNA, 15 bp, Homo sapiens
tttgtttgtttgggt

SEQ ID NO: 1497572 - DNA, 15 bp, Homo sapiens
tttgttttaaaatta

SEQ ID NO: 1497573 - DNA, 15 bp, Homo sapiens
tttgttttagaacca

SEQ ID NO: 1497574 - DNA, 13 bp, Homo sapiens
tttgttttagcat

SEQ ID NO: 1497575 - DNA, 14 bp, Homo sapiens
tttgttttgtgcta

SEQ ID NO: 1497576 - DNA, 14 bp, Homo sapiens
tttgttttgttgga

SEQ ID NO: 1497577 - DNA, 19 bp, Homo sapiens
tttgttttttgtaactaca

SEQ ID NO: 1497578 - DNA, 21 bp, Homo sapiens
ttttaaaaaaaaaaacaaagc

SEQ ID NO: 1497579 - DNA, 23 bp, Homo sapiens
ttttaaaaaaagctaaattacat

SEQ ID NO: 1497580 - DNA, 22 bp, Homo sapiens
ttttaaaaaaatttttataaat

SEQ ID NO: 1497581 - DNA, 17 bp, Homo sapiens
ttttaaaaaactctttg

SEQ ID NO: 1497582 - DNA, 23 bp, Homo sapiens
ttttaaaaaatactctgctattt

SEQ ID NO: 1497583 - DNA, 18 bp, Homo sapiens
ttttaaaaaatattttct

SEQ ID NO: 1497584 - DNA, 19 bp, Homo sapiens
ttttaaaaacatagaaaaa

SEQ ID NO: 1497585 - DNA, 21 bp, Homo sapiens
ttttaaaaagagtaatttcat

SEQ ID NO: 1497586 - DNA, 21 bp, Homo sapiens
ttttaaaaatctaagcagctt

SEQ ID NO: 1497587 - DNA, 14 bp, Homo sapiens
ttttaaaaatgttt

SEQ ID NO: 1497588 - DNA, 15 bp, Homo sapiens
ttttaaaaatgtttg

SEQ ID NO: 1497589 - DNA, 20 bp, Homo sapiens
ttttaaaaattgttaatttt

SEQ ID NO: 1497590 - DNA, 20 bp, Homo sapiens
ttttaaaacacatgttttta

SEQ ID NO: 1497591 - DNA, 15 bp, Homo sapiens
ttttaaaactggacc

SEQ ID NO: 1497592 - DNA, 13 bp, Homo sapiens
ttttaaaagaaca

SEQ ID NO: 1497593 - DNA, 23 bp, Homo sapiens
ttttaaaagccttggcctcagag

SEQ ID NO: 1497594 - DNA, 21 bp, Homo sapiens
ttttaaaaggatgtataaatt

SEQ ID NO: 1497595 - DNA, 17 bp, Homo sapiens
ttttaaaagtctatttt

SEQ ID NO: 1497596 - DNA, 22 bp, Homo sapiens
ttttaaaatcagctattttgtg

SEQ ID NO: 1497597 - DNA, 14 bp, Homo sapiens
ttttaaaatgtaca

SEQ ID NO: 1497598 - DNA, 17 bp, Homo sapiens
ttttaaaatgtcaagac

SEQ ID NO: 1497599 - DNA, 17 bp, Homo sapiens
ttttaaacgtggattgt

SEQ ID NO: 1497600 - DNA, 20 bp, Homo sapiens
ttttaaactgtgtacataac

SEQ ID NO: 1497601 - DNA, 13 bp, Homo sapiens
ttttaaacttgaa

SEQ ID NO: 1497602 - DNA, 12 bp, Homo sapiens
ttttaaagcctt

SEQ ID NO: 1497603 - DNA, 17 bp, Homo sapiens
ttttaaaggaataaact

SEQ ID NO: 1497604 - DNA, 13 bp, Homo sapiens
ttttaaaggcatt

SEQ ID NO: 1497605 - DNA, 16 bp, Homo sapiens
ttttaaaggtggattt

SEQ ID NO: 1497606 - DNA, 13 bp, Homo sapiens
ttttaaagtgcaa

SEQ ID NO: 1497607 - DNA, 17 bp, Homo sapiens
ttttaaagttagtatct

SEQ ID NO: 1497608 - DNA, 16 bp, Homo sapiens
ttttaaataaaagcac

SEQ ID NO: 1497609 - DNA, 22 bp, Homo sapiens
ttttaaataattgcatcagttc

SEQ ID NO: 1497610 - DNA, 15 bp, Homo sapiens
ttttaaatattaact

SEQ ID NO: 1497611 - DNA, 16 bp, Homo sapiens
ttttaaatattaactc

SEQ ID NO: 1497612 - DNA, 15 bp, Homo sapiens
ttttaaatattttct

SEQ ID NO: 1497613 - DNA, 14 bp, Homo sapiens
ttttaaatctaaat

SEQ ID NO: 1497614 - DNA, 21 bp, Homo sapiens
ttttaaatctaaatctattta

SEQ ID NO: 1497615 - DNA, 12 bp, Homo sapiens
ttttaaatgacc

SEQ ID NO: 1497616 - DNA, 14 bp, Homo sapiens
ttttaaatgcagtt

SEQ ID NO: 1497617 - DNA, 20 bp, Homo sapiens
ttttaaatgcagttacaaat

SEQ ID NO: 1497618 - DNA, 13 bp, Homo sapiens
ttttaaatgtgaa

SEQ ID NO: 1497619 - DNA, 21 bp, Homo sapiens
ttttaaattataacttaaaat

SEQ ID NO: 1497620 - DNA, 20 bp, Homo sapiens
ttttaaattcccgttttgtc

SEQ ID NO: 1497621 - DNA, 15 bp, Homo sapiens
ttttaaattcttact

SEQ ID NO: 1497622 - DNA, 13 bp, Homo sapiens
ttttaaattgcaa

SEQ ID NO: 1497623 - DNA, 18 bp, Homo sapiens
ttttaaattgtcataatt

SEQ ID NO: 1497624 - DNA, 16 bp, Homo sapiens
ttttaacaaaagcaag

SEQ ID NO: 1497625 - DNA, 12 bp, Homo sapiens
ttttaactttct

SEQ ID NO: 1497626 - DNA, 17 bp, Homo sapiens
ttttaagaaaaacatgt

SEQ ID NO: 1497627 - DNA, 19 bp, Homo sapiens
ttttaagaaaaacatgtca

SEQ ID NO: 1497628 - DNA, 22 bp, Homo sapiens
ttttaagaaaaacatgtcatgt

SEQ ID NO: 1497629 - DNA, 19 bp, Homo sapiens
ttttaagaattgagtaatg

SEQ ID NO: 1497630 - DNA, 20 bp, Homo sapiens
ttttaagagaattagacaaa

SEQ ID NO: 1497631 - DNA, 22 bp, Homo sapiens
ttttaagataaattataagtta

SEQ ID NO: 1497632 - DNA, 13 bp, Homo sapiens
ttttaagatagtg

SEQ ID NO: 1497633 - DNA, 16 bp, Homo sapiens
ttttaagatagtgtaa

SEQ ID NO: 1497634 - DNA, 18 bp, Homo sapiens
ttttaagatccagaaata

SEQ ID NO: 1497635 - DNA, 15 bp, Homo sapiens
ttttaagatttgtgt

SEQ ID NO: 1497636 - DNA, 16 bp, Homo sapiens
ttttaagcagactcag

SEQ ID NO: 1497637 - DNA, 18 bp, Homo sapiens
ttttaagcagactcagct

SEQ ID NO: 1497638 - DNA, 22 bp, Homo sapiens
ttttaagcagactcagctgcta

SEQ ID NO: 1497639 - DNA, 23 bp, Homo sapiens
ttttaagcagactcagctgctat

SEQ ID NO: 1497640 - DNA, 19 bp, Homo sapiens
ttttaagcctttgttgaac

SEQ ID NO: 1497641 - DNA, 20 bp, Homo sapiens
ttttaagcctttgttgaact

SEQ ID NO: 1497642 - DNA, 15 bp, Homo sapiens
ttttaagtatttagg

SEQ ID NO: 1497643 - DNA, 17 bp, Homo sapiens
ttttaagtatttatata

SEQ ID NO: 1497644 - DNA, 13 bp, Homo sapiens
ttttaagttctta

SEQ ID NO: 1497645 - DNA, 18 bp, Homo sapiens
ttttaagttgtttgcatg

SEQ ID NO: 1497646 - DNA, 21 bp, Homo sapiens
ttttaagtttaaaatgtgtat

SEQ ID NO: 1497647 - DNA, 19 bp, Homo sapiens
ttttaagtttctctgcaga

SEQ ID NO: 1497648 - DNA, 15 bp, Homo sapiens
ttttaagtttgcact

SEQ ID NO: 1497649 - DNA, 16 bp, Homo sapiens
ttttaagtttgcactc

SEQ ID NO: 1497650 - DNA, 14 bp, Homo sapiens
ttttaataaattga

SEQ ID NO: 1497651 - DNA, 21 bp, Homo sapiens
ttttaataacatatctaaagt

SEQ ID NO: 1497652 - DNA, 15 bp, Homo sapiens
ttttaataagaacag

SEQ ID NO: 1497653 - DNA, 12 bp, Homo sapiens
ttttaatacagg

SEQ ID NO: 1497654 - DNA, 23 bp, Homo sapiens
ttttaatagaaataaattcctaa

SEQ ID NO: 1497655 - DNA, 21 bp, Homo sapiens
ttttaatagaatataattatc

SEQ ID NO: 1497656 - DNA, 18 bp, Homo sapiens
ttttaatagtgctttttt

SEQ ID NO: 1497657 - DNA, 15 bp, Homo sapiens
ttttaatattactgt

SEQ ID NO: 1497658 - DNA, 18 bp, Homo sapiens
ttttaatattactgtctt

SEQ ID NO: 1497659 - DNA, 14 bp, Homo sapiens
ttttaatcatgaaa

SEQ ID NO: 1497660 - DNA, 16 bp, Homo sapiens
ttttaatcttagcttt

SEQ ID NO: 1497661 - DNA, 19 bp, Homo sapiens
ttttaatgaaatcaaatgt

SEQ ID NO: 1497662 - DNA, 15 bp, Homo sapiens
ttttaatgatgacaa

SEQ ID NO: 1497663 - DNA, 17 bp, Homo sapiens
ttttaatgatgacaaaa

SEQ ID NO: 1497664 - DNA, 18 bp, Homo sapiens
ttttaatgctgtttctaa

SEQ ID NO: 1497665 - DNA, 21 bp, Homo sapiens
ttttaatgctgtttctaagaa

SEQ ID NO: 1497666 - DNA, 22 bp, Homo sapiens
ttttaatgggggtagcagctgg

SEQ ID NO: 1497667 - DNA, 23 bp, Homo sapiens
ttttaatgggggtagcagctgga

SEQ ID NO: 1497668 - DNA, 20 bp, Homo sapiens
ttttaatgtacttgaaaaat

SEQ ID NO: 1497669 - DNA, 13 bp, Homo sapiens
ttttaatgtatct

SEQ ID NO: 1497670 - DNA, 21 bp, Homo sapiens
ttttaatgtatctatttgtac

SEQ ID NO: 1497671 - DNA, 20 bp, Homo sapiens
ttttaattattatttatata

SEQ ID NO: 1497672 - DNA, 23 bp, Homo sapiens
ttttaattattatttatatatgt

SEQ ID NO: 1497673 - DNA, 20 bp, Homo sapiens
ttttaattcaccaaagtatt

SEQ ID NO: 1497674 - DNA, 21 bp, Homo sapiens
ttttaattcacgtgctttgtg

SEQ ID NO: 1497675 - DNA, 12 bp, Homo sapiens
ttttacaataaa

SEQ ID NO: 1497676 - DNA, 17 bp, Homo sapiens
ttttacacagaaacact

SEQ ID NO: 1497677 - DNA, 21 bp, Homo sapiens
ttttacacagaaacactgcct

SEQ ID NO: 1497678 - DNA, 16 bp, Homo sapiens
ttttacatactgctgt

SEQ ID NO: 1497679 - DNA, 14 bp, Homo sapiens
ttttaccaaagcat

SEQ ID NO: 1497680 - DNA, 15 bp, Homo sapiens
ttttaccaaagcatc

SEQ ID NO: 1497681 - DNA, 17 bp, Homo sapiens
ttttaccaaagcatcaa

SEQ ID NO: 1497682 - DNA, 18 bp, Homo sapiens
ttttaccaccgtctgtct

SEQ ID NO: 1497683 - DNA, 16 bp, Homo sapiens
ttttaccataatctta

SEQ ID NO: 1497684 - DNA, 21 bp, Homo sapiens
ttttaccctgaggtcactgct

SEQ ID NO: 1497685 - DNA, 21 bp, Homo sapiens
ttttacctaccacagtgtctg

SEQ ID NO: 1497686 - DNA, 16 bp, Homo sapiens
ttttactctgcctaca

SEQ ID NO: 1497687 - DNA, 22 bp, Homo sapiens
ttttactctgcctacagaactt

SEQ ID NO: 1497688 - DNA, 15 bp, Homo sapiens
ttttactgtgtttta

SEQ ID NO: 1497689 - DNA, 18 bp, Homo sapiens
ttttacttttaaactgtg

SEQ ID NO: 1497690 - DNA, 20 bp, Homo sapiens
ttttacttttaaactgtgta

SEQ ID NO: 1497691 - DNA, 17 bp, Homo sapiens
ttttacttttcacactg

SEQ ID NO: 1497692 - DNA, 16 bp, Homo sapiens
ttttagaaatgcatat

SEQ ID NO: 1497693 - DNA, 11 bp, Homo sapiens
ttttagaacag

SEQ ID NO: 1497694 - DNA, 21 bp, Homo sapiens
ttttagagaatgtgtttcaaa

SEQ ID NO: 1497695 - DNA, 18 bp, Homo sapiens
ttttagagcttccaaatg

SEQ ID NO: 1497696 - DNA, 18 bp, Homo sapiens
ttttagatactttgctag

SEQ ID NO: 1497697 - DNA, 16 bp, Homo sapiens
ttttagatttctttga

SEQ ID NO: 1497698 - DNA, 16 bp, Homo sapiens
ttttagcattacctaa

SEQ ID NO: 1497699 - DNA, 20 bp, Homo sapiens
ttttagcccagtgttttctt

SEQ ID NO: 1497700 - DNA, 22 bp, Homo sapiens
ttttagctggtggcaataaata

SEQ ID NO: 1497701 - DNA, 20 bp, Homo sapiens
ttttaggaaaatcactttgt

SEQ ID NO: 1497702 - DNA, 15 bp, Homo sapiens
ttttaggcaagtttt

SEQ ID NO: 1497703 - DNA, 20 bp, Homo sapiens
ttttaggccaaaaaaatgta

SEQ ID NO: 1497704 - DNA, 12 bp, Homo sapiens
ttttaggttcta

SEQ ID NO: 1497705 - DNA, 13 bp, Homo sapiens
ttttaggttctaa

SEQ ID NO: 1497706 - DNA, 16 bp, Homo sapiens
ttttaggttctaaagt

SEQ ID NO: 1497707 - DNA, 23 bp, Homo sapiens
ttttaggttctaaagttctaaga

SEQ ID NO: 1497708 - DNA, 23 bp, Homo sapiens
ttttagtatttatttatgtactt

SEQ ID NO: 1497709 - DNA, 20 bp, Homo sapiens
ttttagtgtaaaattgttaa

SEQ ID NO: 1497710 - DNA, 19 bp, Homo sapiens
ttttagtgtattaatcata

SEQ ID NO: 1497711 - DNA, 15 bp, Homo sapiens
ttttagtgtctgacc

SEQ ID NO: 1497712 - DNA, 17 bp, Homo sapiens
ttttagtgtctgaccta

SEQ ID NO: 1497713 - DNA, 19 bp, Homo sapiens
ttttagtgtgtgcataata

SEQ ID NO: 1497714 - DNA, 12 bp, Homo sapiens
ttttagttgaat

SEQ ID NO: 1497715 - DNA, 19 bp, Homo sapiens
ttttagtttctaaagccaa

SEQ ID NO: 1497716 - DNA, 13 bp, Homo sapiens
ttttagttttagt

SEQ ID NO: 1497717 - DNA, 17 bp, Homo sapiens
ttttataaaattttgct

SEQ ID NO: 1497718 - DNA, 15 bp, Homo sapiens
ttttataaagcatgt

SEQ ID NO: 1497719 - DNA, 18 bp, Homo sapiens
ttttataaataaactgtt

SEQ ID NO: 1497720 - DNA, 17 bp, Homo sapiens
ttttataaccttgttct

SEQ ID NO: 1497721 - DNA, 16 bp, Homo sapiens
ttttataagaaaaact

SEQ ID NO: 1497722 - DNA, 17 bp, Homo sapiens
ttttataagaaaaactt

SEQ ID NO: 1497723 - DNA, 13 bp, Homo sapiens
ttttataatgtta

SEQ ID NO: 1497724 - DNA, 16 bp, Homo sapiens
ttttataatgttgtat

SEQ ID NO: 1497725 - DNA, 20 bp, Homo sapiens
ttttatactccatacataac

SEQ ID NO: 1497726 - DNA, 19 bp, Homo sapiens
ttttatactgcacagtggc

SEQ ID NO: 1497727 - DNA, 15 bp, Homo sapiens
ttttctccacactcc

SEQ ID NO: 1497728 - DNA, 20 bp, Homo sapiens
ttttctcccaagaaacctga

SEQ ID NO: 1497729 - DNA, 12 bp, Homo sapiens
ttttctctcttt

SEQ ID NO: 1497730 - DNA, 21 bp, Homo sapiens
ttttctctgcataagtaatta

SEQ ID NO: 1497731 - DNA, 18 bp, Homo sapiens
ttttctctgtacttttca

SEQ ID NO: 1497732 - DNA, 21 bp, Homo sapiens
ttttctcttagaacattgtat

SEQ ID NO: 1497733 - DNA, 12 bp, Homo sapiens
ttttctctttct

SEQ ID NO: 1497734 - DNA, 16 bp, Homo sapiens
ttttctgaattcataa

SEQ ID NO: 1497735 - DNA, 21 bp, Homo sapiens
ttttctgaattcataaaaata

SEQ ID NO: 1497736 - DNA, 22 bp, Homo sapiens
ttttctgaggatagtagttaaa

SEQ ID NO: 1497737 - DNA, 23 bp, Homo sapiens
ttttctgaggtccttatgtcctg

SEQ ID NO: 1497738 - DNA, 13 bp, Homo sapiens
ttttctgcagctg

SEQ ID NO: 1497739 - DNA, 19 bp, Homo sapiens
ttttctgccactgaggaga

SEQ ID NO: 1497740 - DNA, 11 bp, Homo sapiens
ttttctgccct

SEQ ID NO: 1497741 - DNA, 12 bp, Homo sapiens
ttttctgccctg

SEQ ID NO: 1497742 - DNA, 16 bp, Homo sapiens
ttttctgcctgagatt

SEQ ID NO: 1497743 - DNA, 10 bp, Homo sapiens
ttttctgggt

SEQ ID NO: 1497744 - DNA, 23 bp, Homo sapiens
ttttctggtggggctgtcctgct

SEQ ID NO: 1497745 - DNA, 14 bp, Homo sapiens
ttttctggttctaa

SEQ ID NO: 1497746 - DNA, 17 bp, Homo sapiens
ttttctggttctaacat

SEQ ID NO: 1497747 - DNA, 21 bp, Homo sapiens
ttttctgtaagagaaaatatt

SEQ ID NO: 1497748 - DNA, 19 bp, Homo sapiens
ttttctgtaatgtaaataa

SEQ ID NO: 1497749 - DNA, 21 bp, Homo sapiens
ttttctgtaccagttaatttt

SEQ ID NO: 1497750 - DNA, 14 bp, Homo sapiens
ttttctgtcctggg

SEQ ID NO: 1497751 - DNA, 23 bp, Homo sapiens
ttttctgttgaagtttacaatca

SEQ ID NO: 1497752 - DNA, 11 bp, Homo sapiens
ttttcttaaaa

SEQ ID NO: 1497753 - DNA, 14 bp, Homo sapiens
ttttcttaagaaat

SEQ ID NO: 1497754 - DNA, 13 bp, Homo sapiens
ttttcttatttca

SEQ ID NO: 1497755 - DNA, 14 bp, Homo sapiens
ttttcttccctgac

SEQ ID NO: 1497756 - DNA, 18 bp, Homo sapiens
ttttcttgcctctgtccc

SEQ ID NO: 1497757 - DNA, 23 bp, Homo sapiens
ttttcttgggaattgaaaaaaat

SEQ ID NO: 1497758 - DNA, 19 bp, Homo sapiens
ttttcttgggatgcttatt

SEQ ID NO: 1497759 - DNA, 19 bp, Homo sapiens
ttttcttgtaaatgtttct

SEQ ID NO: 1497760 - DNA, 12 bp, Homo sapiens
ttttctttactt

SEQ ID NO: 1497761 - DNA, 17 bp, Homo sapiens
ttttctttacttatctc

SEQ ID NO: 1497762 - DNA, 15 bp, Homo sapiens
ttttctttctatgta

SEQ ID NO: 1497763 - DNA, 22 bp, Homo sapiens
ttttctttctatgtagaactgt

SEQ ID NO: 1497764 - DNA, 19 bp, Homo sapiens
ttttctttgaccagatctt

SEQ ID NO: 1497765 - DNA, 14 bp, Homo sapiens
ttttctttgtgttt

SEQ ID NO: 1497766 - DNA, 17 bp, Homo sapiens
ttttctttttcttaaga

SEQ ID NO: 1497767 - DNA, 14 bp, Homo sapiens
ttttgaaaagttga

SEQ ID NO: 1497768 - DNA, 18 bp, Homo sapiens
ttttgaaaattatgcaaa

SEQ ID NO: 1497769 - DNA, 23 bp, Homo sapiens
ttttgaaatcaatgcaagagtga

SEQ ID NO: 1497770 - DNA, 16 bp, Homo sapiens
ttttgaaatgctgaaa

SEQ ID NO: 1497771 - DNA, 18 bp, Homo sapiens
ttttgaaccaacatcttt

SEQ ID NO: 1497772 - DNA, 20 bp, Homo sapiens
ttttgaactaataaaagcat

SEQ ID NO: 1497773 - DNA, 14 bp, Homo sapiens
ttttgaacttgtca

SEQ ID NO: 1497774 - DNA, 21 bp, Homo sapiens
ttttgaagcagtcttgctctg

SEQ ID NO: 1497775 - DNA, 12 bp, Homo sapiens
ttttgaagctgt

SEQ ID NO: 1497776 - DNA, 14 bp, Homo sapiens
ttttgaagctgttg

SEQ ID NO: 1497777 - DNA, 13 bp, Homo sapiens
ttttgaatacatt

SEQ ID NO: 1497778 - DNA, 14 bp, Homo sapiens
ttttgaatctttaa

SEQ ID NO: 1497779 - DNA, 17 bp, Homo sapiens
ttttgaatgtcacaaat

SEQ ID NO: 1497780 - DNA, 20 bp, Homo sapiens
ttttgaatttaaataaagtt

SEQ ID NO: 1497781 - DNA, 14 bp, Homo sapiens
ttttgacactgaaa

SEQ ID NO: 1497782 - DNA, 20 bp, Homo sapiens
ttttgacagactatttgcta

SEQ ID NO: 1497783 - DNA, 23 bp, Homo sapiens
ttttgacagactatttgctaatg

SEQ ID NO: 1497784 - DNA, 24 bp, Homo sapiens
ttttgacagtgttgaaaatgttca

SEQ ID NO: 1497785 - DNA, 15 bp, Homo sapiens
ttttgacatggaaat

SEQ ID NO: 1497786 - DNA, 15 bp, Homo sapiens
ttttgacggatgatt

SEQ ID NO: 1497787 - DNA, 17 bp, Homo sapiens
ttttgacttaaagcaga

SEQ ID NO: 1497788 - DNA, 15 bp, Homo sapiens
ttttgacttaatgtg

SEQ ID NO: 1497789 - DNA, 17 bp, Homo sapiens
ttttgagacagaatctc

SEQ ID NO: 1497790 - DNA, 18 bp, Homo sapiens
ttttgagggcatgaagct

SEQ ID NO: 1497791 - DNA, 22 bp, Homo sapiens
ttttgaggttttgtaaaactgt

SEQ ID NO: 1497792 - DNA, 18 bp, Homo sapiens
ttttgagtggatgatgtt

SEQ ID NO: 1497793 - DNA, 16 bp, Homo sapiens
ttttgatatacattgt

SEQ ID NO: 1497794 - DNA, 14 bp, Homo sapiens
ttttgatggggaga

SEQ ID NO: 1497795 - DNA, 17 bp, Homo sapiens
ttttgatgtatatatct

SEQ ID NO: 1497796 - DNA, 21 bp, Homo sapiens
ttttgatgtatatatctatta

SEQ ID NO: 1497797 - DNA, 12 bp, Homo sapiens
ttttgatgtgaa

SEQ ID NO: 1497798 - DNA, 22 bp, Homo sapiens
ttttgatgtttgtggcctcaga

SEQ ID NO: 1497799 - DNA, 19 bp, Homo sapiens
ttttgattaatgtttctta

SEQ ID NO: 1497800 - DNA, 22 bp, Homo sapiens
ttttgattattttttttttctt

SEQ ID NO: 1497801 - DNA, 13 bp, Homo sapiens
ttttgatttggtg

SEQ ID NO: 1497802 - DNA, 21 bp, Homo sapiens
ttttgcaaccaggaacagcaa

SEQ ID NO: 1497803 - DNA, 21 bp, Homo sapiens
ttttgcaaggtaaaattttag

SEQ ID NO: 1497804 - DNA, 19 bp, Homo sapiens
ttttgcaataacttctata

SEQ ID NO: 1497805 - DNA, 15 bp, Homo sapiens
ttttgcacattttgt

SEQ ID NO: 1497806 - DNA, 16 bp, Homo sapiens
ttttgcacccctccca

SEQ ID NO: 1497807 - DNA, 12 bp, Homo sapiens
ttttgcactgta

SEQ ID NO: 1497808 - DNA, 12 bp, Homo sapiens
ttttgcactttt

SEQ ID NO: 1497809 - DNA, 14 bp, Homo sapiens
ttttgcagcagtga

SEQ ID NO: 1497810 - DNA, 9 bp, Homo sapiens
ttttgcagt

SEQ ID NO: 1497811 - DNA, 13 bp, Homo sapiens
ttttgcatgaaat

SEQ ID NO: 1497812 - DNA, 15 bp, Homo sapiens
ttttgcattccagaa

SEQ ID NO: 1497813 - DNA, 16 bp, Homo sapiens
ttttgcattccagaat

SEQ ID NO: 1497814 - DNA, 13 bp, Homo sapiens
cgtcaagacattt

SEQ ID NO: 1497815 - DNA, 16 bp, Homo sapiens
cgtcaagacatttgct

SEQ ID NO: 1497816 - DNA, 15 bp, Homo sapiens
cgtcacactcttcag

SEQ ID NO: 1497817 - DNA, 18 bp, Homo sapiens
cgtcaccacgactggcca

SEQ ID NO: 1497818 - DNA, 15 bp, Homo sapiens
cgtcactccagtgct

SEQ ID NO: 1497819 - DNA, 20 bp, Homo sapiens
cgtcactccagtgctcagct

SEQ ID NO: 1497820 - DNA, 18 bp, Homo sapiens
cgtcagcgcaccaaaact

SEQ ID NO: 1497821 - DNA, 22 bp, Homo sapiens
cgtcagggagaggtcaccagct

SEQ ID NO: 1497822 - DNA, 12 bp, Homo sapiens
cgtcatctcagg

SEQ ID NO: 1497823 - DNA, 20 bp, Homo sapiens
cgtcatgcacagtatttgta

SEQ ID NO: 1497824 - DNA, 20 bp, Homo sapiens
cgtcatggcttaatgtttat

SEQ ID NO: 1497825 - DNA, 20 bp, Homo sapiens
cgtcattgctgctgctacca

SEQ ID NO: 1497826 - DNA, 17 bp, Homo sapiens
cgtccacaggggcaggc

SEQ ID NO: 1497827 - DNA, 22 bp, Homo sapiens
cgtccacaggggcaggcctggg

SEQ ID NO: 1497828 - DNA, 23 bp, Homo sapiens
cgtccacaggggcaggcctggga

SEQ ID NO: 1497829 - DNA, 14 bp, Homo sapiens
cgtccacccaggct

SEQ ID NO: 1497830 - DNA, 13 bp, Homo sapiens
cgtccagcctgcc

SEQ ID NO: 1497831 - DNA, 13 bp, Homo sapiens
cgtccatctccct

SEQ ID NO: 1497832 - DNA, 15 bp, Homo sapiens
cgtcccagggctctg

SEQ ID NO: 1497833 - DNA, 14 bp, Homo sapiens
cgtccccactccct

SEQ ID NO: 1497834 - DNA, 16 bp, Homo sapiens
cgtcccccgccgcgcc

SEQ ID NO: 1497835 - DNA, 19 bp, Homo sapiens
cgtcccccgccgcgccagt

SEQ ID NO: 1497836 - DNA, 13 bp, Homo sapiens
cgtccccctgggg

SEQ ID NO: 1497837 - DNA, 15 bp, Homo sapiens
cgtcccctccgccgt

SEQ ID NO: 1497838 - DNA, 14 bp, Homo sapiens
cgtcccgctgctgt

SEQ ID NO: 1497839 - DNA, 14 bp, Homo sapiens
cgtccctgcccaga

SEQ ID NO: 1497840 - DNA, 23 bp, Homo sapiens
cgtccctttttctccacactcca

SEQ ID NO: 1497841 - DNA, 23 bp, Homo sapiens
cgtccgcgggtcccggccgcgcc

SEQ ID NO: 1497842 - DNA, 20 bp, Homo sapiens
cgtccggggtggtggacagg

SEQ ID NO: 1497843 - DNA, 21 bp, Homo sapiens
cgtccggggtggtggacaggg

SEQ ID NO: 1497844 - DNA, 15 bp, Homo sapiens
cgtcctccccctgcc

SEQ ID NO: 1497845 - DNA, 14 bp, Homo sapiens
cgtcctcccgggcc

SEQ ID NO: 1497846 - DNA, 16 bp, Homo sapiens
cgtcctcccgggccct

SEQ ID NO: 1497847 - DNA, 17 bp, Homo sapiens
cgtcctcctcacctcat

SEQ ID NO: 1497848 - DNA, 16 bp, Homo sapiens
cgtcctcgagcaactg

SEQ ID NO: 1497849 - DNA, 21 bp, Homo sapiens
cgtcctgcagaggaccacagt

SEQ ID NO: 1497850 - DNA, 13 bp, Homo sapiens
cgtcctgccctgc

SEQ ID NO: 1497851 - DNA, 17 bp, Homo sapiens
cgtcctttcacacatct

SEQ ID NO: 1497852 - DNA, 13 bp, Homo sapiens
cgtcggagctgcc

SEQ ID NO: 1497853 - DNA, 18 bp, Homo sapiens
cgtcggagctgcctgcag

SEQ ID NO: 1497854 - DNA, 21 bp, Homo sapiens
cgtcggagctgcctgcagcac

SEQ ID NO: 1497855 - DNA, 11 bp, Homo sapiens
cgtctcagtgt

SEQ ID NO: 1497856 - DNA, 22 bp, Homo sapiens
cgtctcattttgtccatgtccc

SEQ ID NO: 1497857 - DNA, 14 bp, Homo sapiens
cgtctccaggggct

SEQ ID NO: 1497858 - DNA, 16 bp, Homo sapiens
cgtctccagtcatctg

SEQ ID NO: 1497859 - DNA, 17 bp, Homo sapiens
cgtctccctggtgcctc

SEQ ID NO: 1497860 - DNA, 21 bp, Homo sapiens
cgtctccctggtgcctctgtg

SEQ ID NO: 1497861 - DNA, 18 bp, Homo sapiens
cgtctcccttggcccaga

SEQ ID NO: 1497862 - DNA, 13 bp, Homo sapiens
cgtctcctccctc

SEQ ID NO: 1497863 - DNA, 17 bp, Homo sapiens
cgtctcctcctcgaagc

SEQ ID NO: 1497864 - DNA, 19 bp, Homo sapiens
cgtctctaatgtctgcagc

SEQ ID NO: 1497865 - DNA, 20 bp, Homo sapiens
cgtctctcccaccccctccc

SEQ ID NO: 1497866 - DNA, 19 bp, Homo sapiens
cgtctctctttctccctca

SEQ ID NO: 1497867 - DNA, 15 bp, Homo sapiens
cgtctgactccagag

SEQ ID NO: 1497868 - DNA, 16 bp, Homo sapiens
cgtctgactccagagt

SEQ ID NO: 1497869 - DNA, 18 bp, Homo sapiens
cgtctgactccagagtct

SEQ ID NO: 1497870 - DNA, 23 bp, Homo sapiens
cgtctgactccagagtctgagcc

SEQ ID NO: 1497871 - DNA, 13 bp, Homo sapiens
cgtctgagctggg

SEQ ID NO: 1497872 - DNA, 16 bp, Homo sapiens
cgtctgccaggcccat

SEQ ID NO: 1497873 - DNA, 14 bp, Homo sapiens
cgtctgccttggca

SEQ ID NO: 1497874 - DNA, 23 bp, Homo sapiens
cgtctgctaacttggagccccag

SEQ ID NO: 1497875 - DNA, 13 bp, Homo sapiens
cgtctggctccct

SEQ ID NO: 1497876 - DNA, 16 bp, Homo sapiens
cgtctggctccctgcc

SEQ ID NO: 1497877 - DNA, 19 bp, Homo sapiens
cgtctggggttcagcccct

SEQ ID NO: 1497878 - DNA, 23 bp, Homo sapiens
cgtctggggttcagcccctcctc

SEQ ID NO: 1497879 - DNA, 11 bp, Homo sapiens
cgtctgtgtgc

SEQ ID NO: 1497880 - DNA, 21 bp, Homo sapiens
cgtctgtgtggtggagccagg

SEQ ID NO: 1497881 - DNA, 17 bp, Homo sapiens
cgtcttcaatctctgtt

SEQ ID NO: 1497882 - DNA, 19 bp, Homo sapiens
cgtcttcaatctctgttct

SEQ ID NO: 1497883 - DNA, 13 bp, Homo sapiens
cgtcttcacactg

SEQ ID NO: 1497884 - DNA, 16 bp, Homo sapiens
cgtcttcacactgcgc

SEQ ID NO: 1497885 - DNA, 13 bp, Homo sapiens
cgtcttgcccagc

SEQ ID NO: 1497886 - DNA, 15 bp, Homo sapiens
cgtcttgcccagcag

SEQ ID NO: 1497887 - DNA, 23 bp, Homo sapiens
cgtcttgcccagcagctcaagaa

SEQ ID NO: 1497888 - DNA, 18 bp, Homo sapiens
cgtcttgctatttgagca

SEQ ID NO: 1497889 - DNA, 22 bp, Homo sapiens
cgtcttggtgtaatttgaagat

SEQ ID NO: 1497890 - DNA, 21 bp, Homo sapiens
cgtgaaaaccaaccctgtggg

SEQ ID NO: 1497891 - DNA, 23 bp, Homo sapiens
cgtgaaaaccaaccctgtgggct

SEQ ID NO: 1497892 - DNA, 15 bp, Homo sapiens
cgtgaaaacggagct

SEQ ID NO: 1497893 - DNA, 11 bp, Homo sapiens
cgtgaaatact

SEQ ID NO: 1497894 - DNA, 13 bp, Homo sapiens
cgtgaaattctat

SEQ ID NO: 1497895 - DNA, 15 bp, Homo sapiens
cgtgaagcagtgcct

SEQ ID NO: 1497896 - DNA, 17 bp, Homo sapiens
cgtgacagtgcctggga

SEQ ID NO: 1497897 - DNA, 14 bp, Homo sapiens
cgtgacccttcagg

SEQ ID NO: 1497898 - DNA, 20 bp, Homo sapiens
cgtgacccttcagggccaga

SEQ ID NO: 1497899 - DNA, 20 bp, Homo sapiens
cgtgaccggacttttctgca

SEQ ID NO: 1497900 - DNA, 20 bp, Homo sapiens
cgtgacctattcaccctcca

SEQ ID NO: 1497901 - DNA, 23 bp, Homo sapiens
cgtgacctattcaccctccactt

SEQ ID NO: 1497902 - DNA, 16 bp, Homo sapiens
cgtgactcacccaagc

SEQ ID NO: 1497903 - DNA, 17 bp, Homo sapiens
cgtgactgccccaactc

SEQ ID NO: 1497904 - DNA, 22 bp, Homo sapiens
cgtgactgccccaactcctgga

SEQ ID NO: 1497905 - DNA, 22 bp, Homo sapiens
cgtgagaaatagctgaaaaggg

SEQ ID NO: 1497906 - DNA, 17 bp, Homo sapiens
cgtgagagaaagagaga

SEQ ID NO: 1497907 - DNA, 20 bp, Homo sapiens
cgtgagagaaagagagaagc

SEQ ID NO: 1497908 - DNA, 14 bp, Homo sapiens
ctgttggataatta

SEQ ID NO: 1497909 - DNA, 19 bp, Homo sapiens
ctgttggatttgtttaaaa

SEQ ID NO: 1497910 - DNA, 21 bp, Homo sapiens
ctgttggcactcacagacctg

SEQ ID NO: 1497911 - DNA, 20 bp, Homo sapiens
ctgttggcaggcccactccc

SEQ ID NO: 1497912 - DNA, 16 bp, Homo sapiens
ctgttggcaggctggc

SEQ ID NO: 1497913 - DNA, 18 bp, Homo sapiens
ctgttggcaggctggcca

SEQ ID NO: 1497914 - DNA, 15 bp, Homo sapiens
ctgttggctgctccc

SEQ ID NO: 1497915 - DNA, 13 bp, Homo sapiens
ctgttggctgctg

SEQ ID NO: 1497916 - DNA, 14 bp, Homo sapiens
ctgttggctgctgc

SEQ ID NO: 1497917 - DNA, 17 bp, Homo sapiens
ctgttggctgctgcggc

SEQ ID NO: 1497918 - DNA, 17 bp, Homo sapiens
ctgttgggaacagcatg

SEQ ID NO: 1497919 - DNA, 20 bp, Homo sapiens
ctgttgggagaaagcaatac

SEQ ID NO: 1497920 - DNA, 21 bp, Homo sapiens
ctgttgtaagaattctgattg

SEQ ID NO: 1497921 - DNA, 21 bp, Homo sapiens
ctgttgtacgtaaagcttaaa

SEQ ID NO: 1497922 - DNA, 17 bp, Homo sapiens
ctgttgtcaataaattt

SEQ ID NO: 1497923 - DNA, 15 bp, Homo sapiens
ctgttgtcctcccct

SEQ ID NO: 1497924 - DNA, 20 bp, Homo sapiens
ctgttgtcctccccttgggc

SEQ ID NO: 1497925 - DNA, 19 bp, Homo sapiens
ctgttgtctgcgcctgaaa

SEQ ID NO: 1497926 - DNA, 18 bp, Homo sapiens
ctgttgtgagctttgaag

SEQ ID NO: 1497927 - DNA, 20 bp, Homo sapiens
ctgttgtgagctttgaagta

SEQ ID NO: 1497928 - DNA, 17 bp, Homo sapiens
ctgttgttgttaatgaa

SEQ ID NO: 1497929 - DNA, 19 bp, Homo sapiens
ctgtttaaagtcacatccc

SEQ ID NO: 1497930 - DNA, 21 bp, Homo sapiens
ctgtttaaagtcacatccctg

SEQ ID NO: 1497931 - DNA, 23 bp, Homo sapiens
ctgtttaaagtcacatccctgta

SEQ ID NO: 1497932 - DNA, 22 bp, Homo sapiens
ctgtttaaatatttcaagacat

SEQ ID NO: 1497933 - DNA, 14 bp, Homo sapiens
ctgtttaaattgct

SEQ ID NO: 1497934 - DNA, 13 bp, Homo sapiens
ctgtttactgctt

SEQ ID NO: 1497935 - DNA, 15 bp, Homo sapiens
ctgtttactgctttt

SEQ ID NO: 1497936 - DNA, 22 bp, Homo sapiens
ctgtttactgcttttcattagc

SEQ ID NO: 1497937 - DNA, 18 bp, Homo sapiens
ctgtttaggttcccctgt

SEQ ID NO: 1497938 - DNA, 19 bp, Homo sapiens
ctgtttatcccttaagaat

SEQ ID NO: 1497939 - DNA, 14 bp, Homo sapiens
ctgtttatggcctc

SEQ ID NO: 1497940 - DNA, 15 bp, Homo sapiens
cttaggccagcacca

SEQ ID NO: 1497941 - DNA, 15 bp, Homo sapiens
cttaggccttcctct

SEQ ID NO: 1497942 - DNA, 17 bp, Homo sapiens
cttaggccttcctctct

SEQ ID NO: 1497943 - DNA, 20 bp, Homo sapiens
cttaggcttggctgccctgt

SEQ ID NO: 1497944 - DNA, 16 bp, Homo sapiens
cttaggctttgtatga

SEQ ID NO: 1497945 - DNA, 14 bp, Homo sapiens
cttagggaaagatg

SEQ ID NO: 1497946 - DNA, 13 bp, Homo sapiens
cttagggaagctg

SEQ ID NO: 1497947 - DNA, 20 bp, Homo sapiens
cttagggaagctggcctgag

SEQ ID NO: 1497948 - DNA, 14 bp, Homo sapiens
cttagggcaggaaa

SEQ ID NO: 1497949 - DNA, 18 bp, Homo sapiens
cttagggtggctttaatt

SEQ ID NO: 1497950 - DNA, 21 bp, Homo sapiens
cttagggtggctttaattgta

SEQ ID NO: 1497951 - DNA, 14 bp, Homo sapiens
cttaggtcaggagt

SEQ ID NO: 1497952 - DNA, 23 bp, Homo sapiens
cttaggtcctcacttctgtctcc

SEQ ID NO: 1497953 - DNA, 20 bp, Homo sapiens
cttaggtggctctgggaatg

SEQ ID NO: 1497954 - DNA, 17 bp, Homo sapiens
cttaggttattttgctt

SEQ ID NO: 1497955 - DNA, 13 bp, Homo sapiens
cttaggtttactg

SEQ ID NO: 1497956 - DNA, 14 bp, Homo sapiens
cttaggtttactgt

SEQ ID NO: 1497957 - DNA, 15 bp, Homo sapiens
cttaggtttactgtg

SEQ ID NO: 1497958 - DNA, 14 bp, Homo sapiens
cttagtactgagtt

SEQ ID NO: 1497959 - DNA, 13 bp, Homo sapiens
cttagtatgcagt

SEQ ID NO: 1497960 - DNA, 21 bp, Homo sapiens
cttagtatgcagttgataaga

SEQ ID NO: 1497961 - DNA, 17 bp, Homo sapiens
cttagtatggttctcag

SEQ ID NO: 1497962 - DNA, 23 bp, Homo sapiens
cttagtcactgcctgcagaggtc

SEQ ID NO: 1497963 - DNA, 19 bp, Homo sapiens
cttagtgcccgcctaggag

SEQ ID NO: 1497964 - DNA, 23 bp, Homo sapiens
cttagtgcccgcctaggagttga

SEQ ID NO: 1497965 - DNA, 15 bp, Homo sapiens
cttagtgctatgtgt

SEQ ID NO: 1497966 - DNA, 20 bp, Homo sapiens
cttagtgcttcagagtttgt

SEQ ID NO: 1497967 - DNA, 15 bp, Homo sapiens
cttagtggtatgtct

SEQ ID NO: 1497968 - DNA, 16 bp, Homo sapiens
cttagtggtatgtctc

SEQ ID NO: 1497969 - DNA, 19 bp, Homo sapiens
cttagttggctttgcccac

SEQ ID NO: 1497970 - DNA, 22 bp, Homo sapiens
cttagtttggattcttatgtag

SEQ ID NO: 1497971 - DNA, 17 bp, Homo sapiens
cttataacctagttaaa

SEQ ID NO: 1497972 - DNA, 21 bp, Homo sapiens
cttataattgttctcagaatc

SEQ ID NO: 1497973 - DNA, 15 bp, Homo sapiens
cttatacatttgata

SEQ ID NO: 1497974 - DNA, 19 bp, Homo sapiens
cttatacgcttttctttgt

SEQ ID NO: 1497975 - DNA, 21 bp, Homo sapiens
cttatagaataaaagctataa

SEQ ID NO: 1497976 - DNA, 13 bp, Homo sapiens
cttatagaatatt

SEQ ID NO: 1497977 - DNA, 15 bp, Homo sapiens
cttatagaatattta

SEQ ID NO: 1497978 - DNA, 19 bp, Homo sapiens
cttatagacacttgctccc

SEQ ID NO: 1497979 - DNA, 21 bp, Homo sapiens
cttatagttactgtgtaatta

SEQ ID NO: 1497980 - DNA, 16 bp, Homo sapiens
cttatatctggcctct

SEQ ID NO: 1497981 - DNA, 22 bp, Homo sapiens
cttatatctggcctctgctttc

SEQ ID NO: 1497982 - DNA, 16 bp, Homo sapiens
cttatattgaagacaa

SEQ ID NO: 1497983 - DNA, 18 bp, Homo sapiens
cttatattgaagacaatt

SEQ ID NO: 1497984 - DNA, 16 bp, Homo sapiens
cttatattttatgaac

SEQ ID NO: 1497985 - DNA, 21 bp, Homo sapiens
cttatattttatgaacattgt

SEQ ID NO: 1497986 - DNA, 20 bp, Homo sapiens
cttatcacccccttgttgta

SEQ ID NO: 1497987 - DNA, 14 bp, Homo sapiens
cttcacctcttcca

SEQ ID NO: 1497988 - DNA, 19 bp, Homo sapiens
cttcacctttggtgcagag

SEQ ID NO: 1497989 - DNA, 22 bp, Homo sapiens
cttcacctttggtgcagaggtt

SEQ ID NO: 1497990 - DNA, 19 bp, Homo sapiens
cttcactgcaattttgtgt

SEQ ID NO: 1497991 - DNA, 16 bp, Homo sapiens
cttcactggcgccttc

SEQ ID NO: 1497992 - DNA, 17 bp, Homo sapiens
cttcactggcgccttct

SEQ ID NO: 1497993 - DNA, 17 bp, Homo sapiens
cttcactgtatataaac

SEQ ID NO: 1497994 - DNA, 18 bp, Homo sapiens
cttcactgtatataaaca

SEQ ID NO: 1497995 - DNA, 12 bp, Homo sapiens
cttcactgtcac

SEQ ID NO: 1497996 - DNA, 22 bp, Homo sapiens
cttcactgtgaggggaaggcct

SEQ ID NO: 1497997 - DNA, 21 bp, Homo sapiens
cttcactgtgctccaacctga

SEQ ID NO: 1497998 - DNA, 17 bp, Homo sapiens
cttcactgtggccacag

SEQ ID NO: 1497999 - DNA, 21 bp, Homo sapiens
cttcactgtggccacagcccc

SEQ ID NO: 1498000 - DNA, 13 bp, Homo sapiens
cttcactgttccc

SEQ ID NO: 1498001 - DNA, 18 bp, Homo sapiens
cttcactgttccctctgg

SEQ ID NO: 1498002 - DNA, 16 bp, Homo sapiens
cttcagaacacacaga

SEQ ID NO: 1498003 - DNA, 18 bp, Homo sapiens
cttcagacacatgctatg

SEQ ID NO: 1498004 - DNA, 14 bp, Homo sapiens
cttcagacccagag

SEQ ID NO: 1498005 - DNA, 14 bp, Homo sapiens
cttcagactggccc

SEQ ID NO: 1498006 - DNA, 15 bp, Homo sapiens
cttcagactggccct

SEQ ID NO: 1498007 - DNA, 14 bp, Homo sapiens
cttcagactttgct

SEQ ID NO: 1498008 - DNA, 15 bp, Homo sapiens
cttcagactttgctt

SEQ ID NO: 1498009 - DNA, 18 bp, Homo sapiens
cttcagactttgcttccc

SEQ ID NO: 1498010 - DNA, 19 bp, Homo sapiens
cttcagactttgcttccca

SEQ ID NO: 1498011 - DNA, 18 bp, Homo sapiens
cttcagagataggcctgt

SEQ ID NO: 1498012 - DNA, 14 bp, Homo sapiens
cttcagagcctagc

SEQ ID NO: 1498013 - DNA, 17 bp, Homo sapiens
cttcagagcctagccac

SEQ ID NO: 1498014 - DNA, 20 bp, Homo sapiens
cttcagagcctagccacctc

SEQ ID NO: 1498015 - DNA, 21 bp, Homo sapiens
cttcagagcctagccacctcc

SEQ ID NO: 1498016 - DNA, 21 bp, Homo sapiens
cttcagagctcttcaagctgt

SEQ ID NO: 1498017 - DNA, 14 bp, Homo sapiens
cttcagagtgaaga

SEQ ID NO: 1498018 - DNA, 15 bp, Homo sapiens
cttcagatcagtgct

SEQ ID NO: 1498019 - DNA, 16 bp, Homo sapiens
cttcagatctgaggtt

SEQ ID NO: 1498020 - DNA, 13 bp, Homo sapiens
cttcagcacagga

SEQ ID NO: 1498021 - DNA, 20 bp, Homo sapiens
cttcagcagcagctcacacc

SEQ ID NO: 1498022 - DNA, 17 bp, Homo sapiens
cttcagcccaccaccct

SEQ ID NO: 1498023 - DNA, 16 bp, Homo sapiens
cttcagcccaggcttt

SEQ ID NO: 1498024 - DNA, 19 bp, Homo sapiens
cttcagccctcacccctgg

SEQ ID NO: 1498025 - DNA, 13 bp, Homo sapiens
cttcagcctagcc

SEQ ID NO: 1498026 - DNA, 15 bp, Homo sapiens
cttcagcctgaggct

SEQ ID NO: 1498027 - DNA, 22 bp, Homo sapiens
cttcagcctgaggctgagactg

SEQ ID NO: 1498028 - DNA, 21 bp, Homo sapiens
cttcagctagcttttaggaaa

SEQ ID NO: 1498029 - DNA, 23 bp, Homo sapiens
cttcagctccagggaatccaagc

SEQ ID NO: 1498030 - DNA, 23 bp, Homo sapiens
cttcaggaacaagtaatgtatta

SEQ ID NO: 1498031 - DNA, 20 bp, Homo sapiens
cttcaggatattggttcttc

SEQ ID NO: 1498032 - DNA, 22 bp, Homo sapiens
cttcaggatattggttcttccc

SEQ ID NO: 1498033 - DNA, 17 bp, Homo sapiens
cttcaggatcaagtcct

SEQ ID NO: 1498034 - DNA, 18 bp, Homo sapiens
cttcagggcagggctctg

SEQ ID NO: 1498035 - DNA, 20 bp, Homo sapiens
cttcagggcagggctctgat

SEQ ID NO: 1498036 - DNA, 21 bp, Homo sapiens
cttcagggccagaaggagggc

SEQ ID NO: 1498037 - DNA, 23 bp, Homo sapiens
cttcagggccagaaggagggcag

SEQ ID NO: 1498038 - DNA, 13 bp, Homo sapiens
cttcaggtgcttt

SEQ ID NO: 1498039 - DNA, 20 bp, Homo sapiens
cttcaggtgtgactctagca

SEQ ID NO: 1498040 - DNA, 15 bp, Homo sapiens
cttcaggttcttagt

SEQ ID NO: 1498041 - DNA, 19 bp, Homo sapiens
cttcaggttcttagtgtca

SEQ ID NO: 1498042 - DNA, 18 bp, Homo sapiens
cttcaggttggtttaatc

SEQ ID NO: 1498043 - DNA, 11 bp, Homo sapiens
cttcaggtttt

SEQ ID NO: 1498044 - DNA, 22 bp, Homo sapiens
cttcagtaaatgtgattcacct

SEQ ID NO: 1498045 - DNA, 23 bp, Homo sapiens
cttcagtaccctctcagctccag

SEQ ID NO: 1498046 - DNA, 14 bp, Homo sapiens
cttcagtctcacag

SEQ ID NO: 1498047 - DNA, 21 bp, Homo sapiens
cttcagtctctataccaataa

SEQ ID NO: 1498048 - DNA, 23 bp, Homo sapiens
cttcagtctctataccaataaag

SEQ ID NO: 1498049 - DNA, 16 bp, Homo sapiens
cttcccacacctgcct

SEQ ID NO: 1498050 - DNA, 18 bp, Homo sapiens
cttcccacacctgcctgc

SEQ ID NO: 1498051 - DNA, 13 bp, Homo sapiens
cttcccactgggg

SEQ ID NO: 1498052 - DNA, 17 bp, Homo sapiens
cttcccagaatctctga

SEQ ID NO: 1498053 - DNA, 18 bp, Homo sapiens
cttcccagaatctctgag

SEQ ID NO: 1498054 - DNA, 10 bp, Homo sapiens
cttcccagac

SEQ ID NO: 1498055 - DNA, 12 bp, Homo sapiens
cttcccagacca

SEQ ID NO: 1498056 - DNA, 16 bp, Homo sapiens
cttcccagaggcagag

SEQ ID NO: 1498057 - DNA, 16 bp, Homo sapiens
cttcccagctaggaag

SEQ ID NO: 1498058 - DNA, 14 bp, Homo sapiens
cttcccagctctcc

SEQ ID NO: 1498059 - DNA, 15 bp, Homo sapiens
cttcccagctctccc

SEQ ID NO: 1498060 - DNA, 20 bp, Homo sapiens
cttcccagctctccctctgg

SEQ ID NO: 1498061 - DNA, 21 bp, Homo sapiens
cttcccagctctccctctggc

SEQ ID NO: 1498062 - DNA, 12 bp, Homo sapiens
cttcccaggagg

SEQ ID NO: 1498063 - DNA, 13 bp, Homo sapiens
cttcccaggccct

SEQ ID NO: 1498064 - DNA, 14 bp, Homo sapiens
cttcccaggccctt

SEQ ID NO: 1498065 - DNA, 11 bp, Homo sapiens
cttcccatcac

SEQ ID NO: 1498066 - DNA, 16 bp, Homo sapiens
cttcccatcactggag

SEQ ID NO: 1498067 - DNA, 15 bp, Homo sapiens
cttcccatcgctgtc

SEQ ID NO: 1498068 - DNA, 13 bp, Homo sapiens
cttcccatgcatt

SEQ ID NO: 1498069 - DNA, 15 bp, Homo sapiens
cttcccatgcctgtc

SEQ ID NO: 1498070 - DNA, 16 bp, Homo sapiens
cttcccatgtcccacc

SEQ ID NO: 1498071 - DNA, 21 bp, Homo sapiens
cttcccattctgccccagagt

SEQ ID NO: 1498072 - DNA, 18 bp, Homo sapiens
cttcccatttctctacac

SEQ ID NO: 1498073 - DNA, 16 bp, Homo sapiens
cttccccaaataatat

SEQ ID NO: 1498074 - DNA, 12 bp, Homo sapiens
cttccccacaga

SEQ ID NO: 1498075 - DNA, 13 bp, Homo sapiens
cttccccacagaa

SEQ ID NO: 1498076 - DNA, 22 bp, Homo sapiens
cttccccaccccagtttttgtt

SEQ ID NO: 1498077 - DNA, 19 bp, Homo sapiens
cttccccagaaaggagact

SEQ ID NO: 1498078 - DNA, 12 bp, Homo sapiens
cttccccagact

SEQ ID NO: 1498079 - DNA, 17 bp, Homo sapiens
cttccccagacttgcac

SEQ ID NO: 1498080 - DNA, 14 bp, Homo sapiens
cttccccagcctct

SEQ ID NO: 1498081 - DNA, 14 bp, Homo sapiens
cttccccagcgtcc

SEQ ID NO: 1498082 - DNA, 18 bp, Homo sapiens
cttccccaggcccaccat

SEQ ID NO: 1498083 - DNA, 16 bp, Homo sapiens
cttcccccaccaccaa

SEQ ID NO: 1498084 - DNA, 19 bp, Homo sapiens
cttcccccacccctccacg

SEQ ID NO: 1498085 - DNA, 15 bp, Homo sapiens
cttcccccagcccaa

SEQ ID NO: 1498086 - DNA, 16 bp, Homo sapiens
cttcccccagcccaat

SEQ ID NO: 1498087 - DNA, 19 bp, Homo sapiens
cttcccccagcccaataaa

SEQ ID NO: 1498088 - DNA, 22 bp, Homo sapiens
cttccccctccccctcctgctg

SEQ ID NO: 1498089 - DNA, 20 bp, Homo sapiens
cttccccctcttcttctgaa

SEQ ID NO: 1498090 - DNA, 18 bp, Homo sapiens
cttcccccttttttgtcc

SEQ ID NO: 1498091 - DNA, 16 bp, Homo sapiens
cttcccctccaagacc

SEQ ID NO: 1498092 - DNA, 22 bp, Homo sapiens
cttcccctcccccactcctcta

SEQ ID NO: 1498093 - DNA, 14 bp, Homo sapiens
cttcccctccctgg

SEQ ID NO: 1498094 - DNA, 18 bp, Homo sapiens
cttcccctccctggctcc

SEQ ID NO: 1498095 - DNA, 20 bp, Homo sapiens
cttcccctccctggctccca

SEQ ID NO: 1498096 - DNA, 18 bp, Homo sapiens
cttcccctgcacctggcc

SEQ ID NO: 1498097 - DNA, 13 bp, Homo sapiens
cttccccttcctg

SEQ ID NO: 1498098 - DNA, 14 bp, Homo sapiens
cttccccttcctgt

SEQ ID NO: 1498099 - DNA, 15 bp, Homo sapiens
cttccccttcctgtt

SEQ ID NO: 1498100 - DNA, 19 bp, Homo sapiens
cttccccttgcccagggct

SEQ ID NO: 1498101 - DNA, 17 bp, Homo sapiens
cttcccctttactcagc

SEQ ID NO: 1498102 - DNA, 16 bp, Homo sapiens
cttccccttttgcctg

SEQ ID NO: 1498103 - DNA, 19 bp, Homo sapiens
cttcccgcctccctctcag

SEQ ID NO: 1498104 - DNA, 15 bp, Homo sapiens
cttcccgccttccaa

SEQ ID NO: 1498105 - DNA, 15 bp, Homo sapiens
cttcccgctcagccc

SEQ ID NO: 1498106 - DNA, 23 bp, Homo sapiens
cttcccgctcagccctccctgcc

SEQ ID NO: 1498107 - DNA, 14 bp, Homo sapiens
cttcccgctcccca

SEQ ID NO: 1498108 - DNA, 16 bp, Homo sapiens
cttcccgctccccacc

SEQ ID NO: 1498109 - DNA, 15 bp, Homo sapiens
cttcccgctgcacat

SEQ ID NO: 1498110 - DNA, 22 bp, Homo sapiens
cttcccgggataaactgagcct

SEQ ID NO: 1498111 - DNA, 15 bp, Homo sapiens
cttcccgtcccatat

SEQ ID NO: 1498112 - DNA, 19 bp, Homo sapiens
cttcccgtcccatatcctg

SEQ ID NO: 1498113 - DNA, 15 bp, Homo sapiens
cttcccgtctcagaa

SEQ ID NO: 1498114 - DNA, 23 bp, Homo sapiens
cttccctattttgaatgcagaaa

SEQ ID NO: 1498115 - DNA, 15 bp, Homo sapiens
cttccctcacaccgc

SEQ ID NO: 1498116 - DNA, 17 bp, Homo sapiens
cttccctccctgaggca

SEQ ID NO: 1498117 - DNA, 12 bp, Homo sapiens
cttccctctcct

SEQ ID NO: 1498118 - DNA, 18 bp, Homo sapiens
cttccctcttccctctcc

SEQ ID NO: 1498119 - DNA, 13 bp, Homo sapiens
cttccctgccact

SEQ ID NO: 1498120 - DNA, 21 bp, Homo sapiens
cttccctgccacttcaacccc

SEQ ID NO: 1498121 - DNA, 16 bp, Homo sapiens
cttccctgctcccacc

SEQ ID NO: 1498122 - DNA, 15 bp, Homo sapiens
cttccctgctttgca

SEQ ID NO: 1498123 - DNA, 16 bp, Homo sapiens
cttccctgctttgcat

SEQ ID NO: 1498124 - DNA, 18 bp, Homo sapiens
cttccctgctttgcatct

SEQ ID NO: 1498125 - DNA, 13 bp, Homo sapiens
cttccctggaagc

SEQ ID NO: 1498126 - DNA, 23 bp, Homo sapiens
cttccctggaagctctccgagct

SEQ ID NO: 1498127 - DNA, 12 bp, Homo sapiens
cttccctggagg

SEQ ID NO: 1498128 - DNA, 17 bp, Homo sapiens
cttccctggaggagaag

SEQ ID NO: 1498129 - DNA, 11 bp, Homo sapiens
cttccctggct

SEQ ID NO: 1498130 - DNA, 22 bp, Homo sapiens
cttccctggctacttcccttcc

SEQ ID NO: 1498131 - DNA, 15 bp, Homo sapiens
cttcccttaactcca

SEQ ID NO: 1498132 - DNA, 17 bp, Homo sapiens
cttcccttaactccaag

SEQ ID NO: 1498133 - DNA, 18 bp, Homo sapiens
cttcccttaactccaaga

SEQ ID NO: 1498134 - DNA, 19 bp, Homo sapiens
cttcccttaactccaagaa

SEQ ID NO: 1498135 - DNA, 17 bp, Homo sapiens
cttcccttacctcaaag

SEQ ID NO: 1498136 - DNA, 11 bp, Homo sapiens
cttcccttccc

SEQ ID NO: 1498137 - DNA, 12 bp, Homo sapiens
cttcccttccca

SEQ ID NO: 1498138 - DNA, 15 bp, Homo sapiens
cttcccttcccagac

SEQ ID NO: 1498139 - DNA, 16 bp, Homo sapiens
cttcccttcccagacc

SEQ ID NO: 1498140 - DNA, 14 bp, Homo sapiens
cttcccttcctccc

SEQ ID NO: 1498141 - DNA, 16 bp, Homo sapiens
cttcccttctccccag

SEQ ID NO: 1498142 - DNA, 17 bp, Homo sapiens
cttcccttctccccagc

SEQ ID NO: 1498143 - DNA, 19 bp, Homo sapiens
cttcccttctccccagcca

SEQ ID NO: 1498144 - DNA, 12 bp, Homo sapiens
cttcccttctct

SEQ ID NO: 1498145 - DNA, 23 bp, Homo sapiens
cttcccttctctggtctccttga

SEQ ID NO: 1498146 - DNA, 19 bp, Homo sapiens
cttccgatgacagtgctct

SEQ ID NO: 1498147 - DNA, 12 bp, Homo sapiens
cttccgccactc

SEQ ID NO: 1498148 - DNA, 14 bp, Homo sapiens
cttccgctgagggg

SEQ ID NO: 1498149 - DNA, 21 bp, Homo sapiens
cttccgctgaggggtctcgga

SEQ ID NO: 1498150 - DNA, 22 bp, Homo sapiens
cttccgctgaggggtctcggat

SEQ ID NO: 1498151 - DNA, 20 bp, Homo sapiens
cttccgctttgaaagaagca

SEQ ID NO: 1498152 - DNA, 23 bp, Homo sapiens
cttccgctttgaaagaagcaaga

SEQ ID NO: 1498153 - DNA, 13 bp, Homo sapiens
cttccgtagtttg

SEQ ID NO: 1498154 - DNA, 22 bp, Homo sapiens
cttccgtggtcagagtgccact

SEQ ID NO: 1498155 - DNA, 21 bp, Homo sapiens
cttcctacaagagcagcctgt

SEQ ID NO: 1498156 - DNA, 14 bp, Homo sapiens
cttcctacctctgg

SEQ ID NO: 1498157 - DNA, 21 bp, Homo sapiens
cttcctagaagttactgaatg

SEQ ID NO: 1498158 - DNA, 18 bp, Homo sapiens
cttcctagatctgcaggc

SEQ ID NO: 1498159 - DNA, 23 bp, Homo sapiens
cttcctagatctgcaggctgcac

SEQ ID NO: 1498160 - DNA, 14 bp, Homo sapiens
cttcctatttcaga

SEQ ID NO: 1498161 - DNA, 15 bp, Homo sapiens
cttcctcacacccct

SEQ ID NO: 1498162 - DNA, 19 bp, Homo sapiens
cttgaatattcctggactt

SEQ ID NO: 1498163 - DNA, 17 bp, Homo sapiens
cttgaatccattgaaag

SEQ ID NO: 1498164 - DNA, 15 bp, Homo sapiens
cttgaatccttccat

SEQ ID NO: 1498165 - DNA, 20 bp, Homo sapiens
cttgaatccttccattccac

SEQ ID NO: 1498166 - DNA, 10 bp, Homo sapiens
cttgaatgtc

SEQ ID NO: 1498167 - DNA, 19 bp, Homo sapiens
cttgaatgtccccattcta

SEQ ID NO: 1498168 - DNA, 20 bp, Homo sapiens
cttgaatgtccccattctat

SEQ ID NO: 1498169 - DNA, 13 bp, Homo sapiens
cttgaatgtcttt

SEQ ID NO: 1498170 - DNA, 15 bp, Homo sapiens
cttgaatgtgtcagg

SEQ ID NO: 1498171 - DNA, 13 bp, Homo sapiens
cttgaatgtttgt

SEQ ID NO: 1498172 - DNA, 22 bp, Homo sapiens
cttgaattgtgtattgatgcaa

SEQ ID NO: 1498173 - DNA, 13 bp, Homo sapiens
cttgaatttcaaa

SEQ ID NO: 1498174 - DNA, 22 bp, Homo sapiens
cttgacaagctgacttggcact

SEQ ID NO: 1498175 - DNA, 22 bp, Homo sapiens
cttgacaagttgcgacggagag

SEQ ID NO: 1498176 - DNA, 12 bp, Homo sapiens
cttgacaccact

SEQ ID NO: 1498177 - DNA, 19 bp, Homo sapiens
cttgacataatttcactga

SEQ ID NO: 1498178 - DNA, 18 bp, Homo sapiens
cttgaccaacagaaacct

SEQ ID NO: 1498179 - DNA, 17 bp, Homo sapiens
cttgaccaggcttggcc

SEQ ID NO: 1498180 - DNA, 13 bp, Homo sapiens
cttgacctagctc

SEQ ID NO: 1498181 - DNA, 12 bp, Homo sapiens
cttgacctccta

SEQ ID NO: 1498182 - DNA, 20 bp, Homo sapiens
cttgacctgaggctgtggtc

SEQ ID NO: 1498183 - DNA, 23 bp, Homo sapiens
cttgacctgaggctgtggtcaca

SEQ ID NO: 1498184 - DNA, 21 bp, Homo sapiens
cttgacgtttcttctttctag

SEQ ID NO: 1498185 - DNA, 18 bp, Homo sapiens
cttgactcatggcagctg

SEQ ID NO: 1498186 - DNA, 16 bp, Homo sapiens
cttgactctaaatgca

SEQ ID NO: 1498187 - DNA, 17 bp, Homo sapiens
cttgactctaaatgcag

SEQ ID NO: 1498188 - DNA, 18 bp, Homo sapiens
cttgactctaaatgcagt

SEQ ID NO: 1498189 - DNA, 22 bp, Homo sapiens
cttgactgccccttctatgctg

SEQ ID NO: 1498190 - DNA, 14 bp, Homo sapiens
cttgactttctgat

SEQ ID NO: 1498191 - DNA, 23 bp, Homo sapiens
cttgagaagacctcacctagaaa

SEQ ID NO: 1498192 - DNA, 19 bp, Homo sapiens
cttgagaatcctctccttt

SEQ ID NO: 1498193 - DNA, 18 bp, Homo sapiens
cttgagacctcagccatg

SEQ ID NO: 1498194 - DNA, 22 bp, Homo sapiens
cttgagagaaaaagtgcccctt

SEQ ID NO: 1498195 - DNA, 15 bp, Homo sapiens
cttgagagctgctga

SEQ ID NO: 1498196 - DNA, 20 bp, Homo sapiens
cttgagagtagatggtttga

SEQ ID NO: 1498197 - DNA, 17 bp, Homo sapiens
cttgagataaggtttta

SEQ ID NO: 1498198 - DNA, 18 bp, Homo sapiens
cttgagataaggttttaa

SEQ ID NO: 1498199 - DNA, 16 bp, Homo sapiens
cttgagatgggaaagc

SEQ ID NO: 1498200 - DNA, 16 bp, Homo sapiens
cttgagatggtgaggc

SEQ ID NO: 1498201 - DNA, 16 bp, Homo sapiens
cttgagcagtggctgg

SEQ ID NO: 1498202 - DNA, 19 bp, Homo sapiens
cttgagcatcaatcttgtt

SEQ ID NO: 1498203 - DNA, 20 bp, Homo sapiens
cttgagcatcaatcttgtta

SEQ ID NO: 1498204 - DNA, 11 bp, Homo sapiens
cttgagcccag

SEQ ID NO: 1498205 - DNA, 14 bp, Homo sapiens
cttgagcccaggag

SEQ ID NO: 1498206 - DNA, 20 bp, Homo sapiens
cttgagcccaggagtttgag

SEQ ID NO: 1498207 - DNA, 13 bp, Homo sapiens
cttgagccctggc

SEQ ID NO: 1498208 - DNA, 20 bp, Homo sapiens
cttgagccgggcccctgggc

SEQ ID NO: 1498209 - DNA, 12 bp, Homo sapiens
cttgagcctccc

SEQ ID NO: 1498210 - DNA, 14 bp, Homo sapiens
cttgagcggagccc

SEQ ID NO: 1498211 - DNA, 19 bp, Homo sapiens
cttgagcggagcccgatat

SEQ ID NO: 1498212 - DNA, 22 bp, Homo sapiens
cttgagctcccctggagccagc

SEQ ID NO: 1498213 - DNA, 16 bp, Homo sapiens
cttgagctggcctctc

SEQ ID NO: 1498214 - DNA, 20 bp, Homo sapiens
cttgagctgttgtgagcttt

SEQ ID NO: 1498215 - DNA, 21 bp, Homo sapiens
cttgagctgttgtgagctttg

SEQ ID NO: 1498216 - DNA, 12 bp, Homo sapiens
cttgagcttggc

SEQ ID NO: 1498217 - DNA, 20 bp, Homo sapiens
cttgagcttggcagctgaac

SEQ ID NO: 1498218 - DNA, 14 bp, Homo sapiens
cttgaggagtgtga

SEQ ID NO: 1498219 - DNA, 16 bp, Homo sapiens
cttgaggattgtggaa

SEQ ID NO: 1498220 - DNA, 17 bp, Homo sapiens
cttgaggcctgatctgc

SEQ ID NO: 1498221 - DNA, 21 bp, Homo sapiens
cttgaggcctgatctgcccat

SEQ ID NO: 1498222 - DNA, 15 bp, Homo sapiens
cttgaggggctaggt

SEQ ID NO: 1498223 - DNA, 17 bp, Homo sapiens
cttgagtgagaagagct

SEQ ID NO: 1498224 - DNA, 19 bp, Homo sapiens
cttgagtgagaagagcttg

SEQ ID NO: 1498225 - DNA, 14 bp, Homo sapiens
cttgagtgttcctt

SEQ ID NO: 1498226 - DNA, 17 bp, Homo sapiens
cttgagttcccagatgg

SEQ ID NO: 1498227 - DNA, 21 bp, Homo sapiens
cttgagttggagtactatatt

SEQ ID NO: 1498228 - DNA, 21 bp, Homo sapiens
cttgagttggggccattgctt

SEQ ID NO: 1498229 - DNA, 12 bp, Homo sapiens
cttgagtttgtc

SEQ ID NO: 1498230 - DNA, 13 bp, Homo sapiens
cttgagtttgtcg

SEQ ID NO: 1498231 - DNA, 18 bp, Homo sapiens
cttgataatatataaaca

SEQ ID NO: 1498232 - DNA, 17 bp, Homo sapiens
cttgataatattagtga

SEQ ID NO: 1498233 - DNA, 23 bp, Homo sapiens
cttgataatattagtgattctga

SEQ ID NO: 1498234 - DNA, 20 bp, Homo sapiens
cttgatacccccctctgtct

SEQ ID NO: 1498235 - DNA, 17 bp, Homo sapiens
cttgatataaaaaatct

SEQ ID NO: 1498236 - DNA, 14 bp, Homo sapiens
cttgatatgtaagt

SEQ ID NO: 1498237 - DNA, 18 bp, Homo sapiens
cttgatcagtagtttgca

SEQ ID NO: 1498238 - DNA, 21 bp, Homo sapiens
cttgatcagtagtttgcattt

SEQ ID NO: 1498239 - DNA, 16 bp, Homo sapiens
cttgatctctcttgtc

SEQ ID NO: 1498240 - DNA, 22 bp, Homo sapiens
cttgatctctcttgtcctcttc

SEQ ID NO: 1498241 - DNA, 23 bp, Homo sapiens
cttgatctctcttgtcctcttct

SEQ ID NO: 1498242 - DNA, 23 bp, Homo sapiens
cttggaaaggggaggagcttctc

SEQ ID NO: 1498243 - DNA, 16 bp, Homo sapiens
cttggaaatgtctgct

SEQ ID NO: 1498244 - DNA, 16 bp, Homo sapiens
cttggaacaccttggg

SEQ ID NO: 1498245 - DNA, 16 bp, Homo sapiens
cttggaacattggaat

SEQ ID NO: 1498246 - DNA, 13 bp, Homo sapiens
cttggaagccagg

SEQ ID NO: 1498247 - DNA, 14 bp, Homo sapiens
cttggaagccaggt

SEQ ID NO: 1498248 - DNA, 12 bp, Homo sapiens
cttggaagggcg

SEQ ID NO: 1498249 - DNA, 13 bp, Homo sapiens
cttggacactgta

SEQ ID NO: 1498250 - DNA, 16 bp, Homo sapiens
cttggacatcctcctc

SEQ ID NO: 1498251 - DNA, 17 bp, Homo sapiens
cttggacatcctcctcc

SEQ ID NO: 1498252 - DNA, 20 bp, Homo sapiens
cttggacatcctcctcccac

SEQ ID NO: 1498253 - DNA, 21 bp, Homo sapiens
cttggacatcctcctcccacc

SEQ ID NO: 1498254 - DNA, 22 bp, Homo sapiens
cttggacatcctcctcccaccc

SEQ ID NO: 1498255 - DNA, 21 bp, Homo sapiens
cttggaccactcctgtccctg

SEQ ID NO: 1498256 - DNA, 23 bp, Homo sapiens
cttggaccactcctgtccctgta

SEQ ID NO: 1498257 - DNA, 14 bp, Homo sapiens
cttggaccagggca

SEQ ID NO: 1498258 - DNA, 18 bp, Homo sapiens
cttggactacacaataca

SEQ ID NO: 1498259 - DNA, 14 bp, Homo sapiens
cttggactattata

SEQ ID NO: 1498260 - DNA, 22 bp, Homo sapiens
cttggactattataatttaatg

SEQ ID NO: 1498261 - DNA, 19 bp, Homo sapiens
cttggactgagaaattata

SEQ ID NO: 1498262 - DNA, 14 bp, Homo sapiens
cttggacttcctgg

SEQ ID NO: 1498263 - DNA, 18 bp, Homo sapiens
cttggacttcctggggcc

SEQ ID NO: 1498264 - DNA, 18 bp, Homo sapiens
cttggagaagtctcagct

SEQ ID NO: 1498265 - DNA, 15 bp, Homo sapiens
cttggagagctcagg

SEQ ID NO: 1498266 - DNA, 21 bp, Homo sapiens
cttggagaggagagtggcagg

SEQ ID NO: 1498267 - DNA, 22 bp, Homo sapiens
cttggagccaatggagactgtc

SEQ ID NO: 1498268 - DNA, 13 bp, Homo sapiens
cttggagccccag

SEQ ID NO: 1498269 - DNA, 18 bp, Homo sapiens
cttggagccccagtgcca

SEQ ID NO: 1498270 - DNA, 13 bp, Homo sapiens
cttggagctgaga

SEQ ID NO: 1498271 - DNA, 14 bp, Homo sapiens
cttggagctgagat

SEQ ID NO: 1498272 - DNA, 13 bp, Homo sapiens
cttggagctgccg

SEQ ID NO: 1498273 - DNA, 22 bp, Homo sapiens
cttggagctgccgtgcctgtgt

SEQ ID NO: 1498274 - DNA, 15 bp, Homo sapiens
cttggagctttggaa

SEQ ID NO: 1498275 - DNA, 15 bp, Homo sapiens
cttggaggctgtctt

SEQ ID NO: 1498276 - DNA, 18 bp, Homo sapiens
cttggagtattggggtct

SEQ ID NO: 1498277 - DNA, 22 bp, Homo sapiens
cttggagtattggggtctgacc

SEQ ID NO: 1498278 - DNA, 18 bp, Homo sapiens
cttggataatgctgttgc

SEQ ID NO: 1498279 - DNA, 22 bp, Homo sapiens
cttggataatgctgttgcctca

SEQ ID NO: 1498280 - DNA, 14 bp, Homo sapiens
cttggatcccaaag

SEQ ID NO: 1498281 - DNA, 16 bp, Homo sapiens
cttggatcccaaagca

SEQ ID NO: 1498282 - DNA, 15 bp, Homo sapiens
cttggatcctcagaa

SEQ ID NO: 1498283 - DNA, 13 bp, Homo sapiens
cttggatcctggg

SEQ ID NO: 1498284 - DNA, 16 bp, Homo sapiens
cttggatcctgggctg

SEQ ID NO: 1498285 - DNA, 17 bp, Homo sapiens
cttggatcctgggctgg

SEQ ID NO: 1498286 - DNA, 21 bp, Homo sapiens
cttggatgagttttgggaagt

SEQ ID NO: 1498287 - DNA, 18 bp, Homo sapiens
cttggattctctgagaaa

SEQ ID NO: 1498288 - DNA, 20 bp, Homo sapiens
cttggattctctgagaaatg

SEQ ID NO: 1498289 - DNA, 22 bp, Homo sapiens
cttggattggacaggagatcag

SEQ ID NO: 1498290 - DNA, 16 bp, Homo sapiens
cttggcaccagacacc

SEQ ID NO: 1498291 - DNA, 21 bp, Homo sapiens
cttggcacttaagtgcacttt

SEQ ID NO: 1498292 - DNA, 16 bp, Homo sapiens
cttggcaggtgcctgt

SEQ ID NO: 1498293 - DNA, 13 bp, Homo sapiens
cttggcatacaaa

SEQ ID NO: 1498294 - DNA, 19 bp, Homo sapiens
cttggcatcacagggcaga

SEQ ID NO: 1498295 - DNA, 13 bp, Homo sapiens
cttggcatttcta

SEQ ID NO: 1498296 - DNA, 19 bp, Homo sapiens
cttggcatttctatacttt

SEQ ID NO: 1498297 - DNA, 12 bp, Homo sapiens
cttggcccagga

SEQ ID NO: 1498298 - DNA, 18 bp, Homo sapiens
cttggcccaggagctctg

SEQ ID NO: 1498299 - DNA, 19 bp, Homo sapiens
cttggcccaggagctctgc

SEQ ID NO: 1498300 - DNA, 21 bp, Homo sapiens
cttggcccaggagctctgcgc

SEQ ID NO: 1498301 - DNA, 23 bp, Homo sapiens
cttggcccaggagctctgcgcca

SEQ ID NO: 1498302 - DNA, 24 bp, Homo sapiens
cttggcccaggagctctgcgccag

SEQ ID NO: 1498303 - DNA, 16 bp, Homo sapiens
cttggccccagacgca

SEQ ID NO: 1498304 - DNA, 23 bp, Homo sapiens
cttggcctcagaattcacaaaat

SEQ ID NO: 1498305 - DNA, 13 bp, Homo sapiens
cttggcctcagag

SEQ ID NO: 1498306 - DNA, 15 bp, Homo sapiens
cttggcctcatgctg

SEQ ID NO: 1498307 - DNA, 14 bp, Homo sapiens
cttggcctcccaga

SEQ ID NO: 1498308 - DNA, 12 bp, Homo sapiens
cttggcctgctg

SEQ ID NO: 1498309 - DNA, 19 bp, Homo sapiens
cttggccttgcagctggcc

SEQ ID NO: 1498310 - DNA, 14 bp, Homo sapiens
cttggccttgggct

SEQ ID NO: 1498311 - DNA, 17 bp, Homo sapiens
cttggcggcagcagcca

SEQ ID NO: 1498312 - DNA, 18 bp, Homo sapiens
cttggcggcagcagccat

SEQ ID NO: 1498313 - DNA, 14 bp, Homo sapiens
cttggcgtggagcc

SEQ ID NO: 1498314 - DNA, 17 bp, Homo sapiens
cttggcgtggagccagg

SEQ ID NO: 1498315 - DNA, 22 bp, Homo sapiens
cttggctattgaagatgctgcc

SEQ ID NO: 1498316 - DNA, 17 bp, Homo sapiens
cttggctatttctgtgt

SEQ ID NO: 1498317 - DNA, 21 bp, Homo sapiens
cttggctatttctgtgtccag

SEQ ID NO: 1498318 - DNA, 19 bp, Homo sapiens
cttggctcacaaggcccag

SEQ ID NO: 1498319 - DNA, 20 bp, Homo sapiens
cttggctcacaaggcccagg

SEQ ID NO: 1498320 - DNA, 21 bp, Homo sapiens
cttggctcacaaggcccagga

SEQ ID NO: 1498321 - DNA, 14 bp, Homo sapiens
cttggctcagacat

SEQ ID NO: 1498322 - DNA, 22 bp, Homo sapiens
cttggctcgaatctctgtgcct

SEQ ID NO: 1498323 - DNA, 16 bp, Homo sapiens
cttggctcgttctctt

SEQ ID NO: 1498324 - DNA, 19 bp, Homo sapiens
cttggctcttggtacctgt

SEQ ID NO: 1498325 - DNA, 21 bp, Homo sapiens
cttggctgccctgtctggaac

SEQ ID NO: 1498326 - DNA, 21 bp, Homo sapiens
cttggctgcctgtgggcttcc

SEQ ID NO: 1498327 - DNA, 17 bp, Homo sapiens
cttggctgtaatcagtt

SEQ ID NO: 1498328 - DNA, 14 bp, Homo sapiens
cttggcttaatcat

SEQ ID NO: 1498329 - DNA, 17 bp, Homo sapiens
cttggcttctgtgatga

SEQ ID NO: 1498330 - DNA, 20 bp, Homo sapiens
cttggctttatgcaaataca

SEQ ID NO: 1498331 - DNA, 20 bp, Homo sapiens
cttggctttcagagccagcc

SEQ ID NO: 1498332 - DNA, 16 bp, Homo sapiens
cttaaaaatgtaaata

SEQ ID NO: 1498333 - DNA, 20 bp, Homo sapiens
cttaaaaattaatagtttta

SEQ ID NO: 1498334 - DNA, 12 bp, Homo sapiens
cttaaaacactt

SEQ ID NO: 1498335 - DNA, 13 bp, Homo sapiens
cttaaaacatggt

SEQ ID NO: 1498336 - DNA, 14 bp, Homo sapiens
cttaaaaccaaaga

SEQ ID NO: 1498337 - DNA, 14 bp, Homo sapiens
cttaaaaggggccc

SEQ ID NO: 1498338 - DNA, 15 bp, Homo sapiens
cttaaaaggggccca

SEQ ID NO: 1498339 - DNA, 13 bp, Homo sapiens
cttaaaagtactt

SEQ ID NO: 1498340 - DNA, 22 bp, Homo sapiens
cttaaaagtactttaaaaagga

SEQ ID NO: 1498341 - DNA, 22 bp, Homo sapiens
cttaaaataggggatatttaag

SEQ ID NO: 1498342 - DNA, 19 bp, Homo sapiens
cttaaaatatctctaaaat

SEQ ID NO: 1498343 - DNA, 14 bp, Homo sapiens
cttaaaatatttta

SEQ ID NO: 1498344 - DNA, 18 bp, Homo sapiens
cttaaaattcaagaaaat

SEQ ID NO: 1498345 - DNA, 18 bp, Homo sapiens
cttaaaattgatattata

SEQ ID NO: 1498346 - DNA, 19 bp, Homo sapiens
cttaaacactcaccttcta

SEQ ID NO: 1498347 - DNA, 14 bp, Homo sapiens
cttaaaccattttt

SEQ ID NO: 1498348 - DNA, 17 bp, Homo sapiens
cttaaacccatacaatg

SEQ ID NO: 1498349 - DNA, 18 bp, Homo sapiens
cttaaacccatacaatgt

SEQ ID NO: 1498350 - DNA, 20 bp, Homo sapiens
cttaaacccatacaatgtat

SEQ ID NO: 1498351 - DNA, 19 bp, Homo sapiens
cttaaacgaagagttccct

SEQ ID NO: 1498352 - DNA, 14 bp, Homo sapiens
cttaaactaaatgt

SEQ ID NO: 1498353 - DNA, 14 bp, Homo sapiens
cttaaactggaaag

SEQ ID NO: 1498354 - DNA, 17 bp, Homo sapiens
cttaaagaaacagcttt

SEQ ID NO: 1498355 - DNA, 22 bp, Homo sapiens
cttaaagaaacagctttcaagt

SEQ ID NO: 1498356 - DNA, 20 bp, Homo sapiens
cttaaagcatcctcctcctg

SEQ ID NO: 1498357 - DNA, 15 bp, Homo sapiens
cttaaaggcctggaa

SEQ ID NO: 1498358 - DNA, 16 bp, Homo sapiens
cttaaaggcctggaac

SEQ ID NO: 1498359 - DNA, 21 bp, Homo sapiens
cttaaaggctgtggtagtact

SEQ ID NO: 1498360 - DNA, 22 bp, Homo sapiens
cttaaagggcccaatgaattat

SEQ ID NO: 1498361 - DNA, 19 bp, Homo sapiens
cttaaataacaaaactgtg

SEQ ID NO: 1498362 - DNA, 12 bp, Homo sapiens
cttaaatacaga

SEQ ID NO: 1498363 - DNA, 22 bp, Homo sapiens
cttaaatacagataattcattt

SEQ ID NO: 1498364 - DNA, 12 bp, Homo sapiens
cttaaatatgta

SEQ ID NO: 1498365 - DNA, 18 bp, Homo sapiens
cttaaatgcccccctccc

SEQ ID NO: 1498366 - DNA, 18 bp, Homo sapiens
cttaaatgctcattttct

SEQ ID NO: 1498367 - DNA, 17 bp, Homo sapiens
cttaaatgttatgtata

SEQ ID NO: 1498368 - DNA, 16 bp, Homo sapiens
cttaaattcatttcta

SEQ ID NO: 1498369 - DNA, 18 bp, Homo sapiens
cttaaattcatttctaga

SEQ ID NO: 1498370 - DNA, 22 bp, Homo sapiens
cttaaattcatttctagactca

SEQ ID NO: 1498371 - DNA, 14 bp, Homo sapiens
cttgggaggctgag

SEQ ID NO: 1498372 - DNA, 17 bp, Homo sapiens
cttgggaggctgaggca

SEQ ID NO: 1498373 - DNA, 22 bp, Homo sapiens
cttgggaggttttattctgact

SEQ ID NO: 1498374 - DNA, 20 bp, Homo sapiens
cttgggagtgtggtttcttt

SEQ ID NO: 1498375 - DNA, 22 bp, Homo sapiens
cttgggatagtgttctgctcct

SEQ ID NO: 1498376 - DNA, 13 bp, Homo sapiens
cttgggcagagct

SEQ ID NO: 1498377 - DNA, 18 bp, Homo sapiens
cttgggcagagctggctc

SEQ ID NO: 1498378 - DNA, 13 bp, Homo sapiens
cttgggccacccc

SEQ ID NO: 1498379 - DNA, 17 bp, Homo sapiens
cttgggccacccctcct

SEQ ID NO: 1498380 - DNA, 15 bp, Homo sapiens
cttgggccagaagta

SEQ ID NO: 1498381 - DNA, 21 bp, Homo sapiens
cttgggcccagctgggctctg

SEQ ID NO: 1498382 - DNA, 16 bp, Homo sapiens
cttgggccctgcattg

SEQ ID NO: 1498383 - DNA, 16 bp, Homo sapiens
cttgggccctttttcc

SEQ ID NO: 1498384 - DNA, 17 bp, Homo sapiens
cttgggcctcaggctct

SEQ ID NO: 1498385 - DNA, 15 bp, Homo sapiens
cttgggcctggccag

SEQ ID NO: 1498386 - DNA, 21 bp, Homo sapiens
cttgggcctggccagtcttcc

SEQ ID NO: 1498387 - DNA, 22 bp, Homo sapiens
cttgggcctggccagtcttcct

SEQ ID NO: 1498388 - DNA, 13 bp, Homo sapiens
cttgggctactgg

SEQ ID NO: 1498389 - DNA, 24 bp, Homo sapiens
ctttccatgggagccagctgcttt

SEQ ID NO: 1498390 - DNA, 18 bp, Homo sapiens
ctttccatgttgctgcca

SEQ ID NO: 1498391 - DNA, 21 bp, Homo sapiens
ctttccatttttttctttact

SEQ ID NO: 1498392 - DNA, 22 bp, Homo sapiens
ctttccatttttttctttactt

SEQ ID NO: 1498393 - DNA, 13 bp, Homo sapiens
ctttcccaggaga

SEQ ID NO: 1498394 - DNA, 14 bp, Homo sapiens
ctttcccaggagaa

SEQ ID NO: 1498395 - DNA, 18 bp, Homo sapiens
ctttcccatgtatttgtt

SEQ ID NO: 1498396 - DNA, 11 bp, Homo sapiens
ctttccccaga

SEQ ID NO: 1498397 - DNA, 22 bp, Homo sapiens
ctttccccagcagtttctgtcc

SEQ ID NO: 1498398 - DNA, 15 bp, Homo sapiens
ctttcccccttcccg

SEQ ID NO: 1498399 - DNA, 17 bp, Homo sapiens
ctttcccccttctctta

SEQ ID NO: 1498400 - DNA, 22 bp, Homo sapiens
ctttccccgggggaggaagggg

SEQ ID NO: 1498401 - DNA, 17 bp, Homo sapiens
ctttcccctgtggggat

SEQ ID NO: 1498402 - DNA, 17 bp, Homo sapiens
ctttccctaaagaccct

SEQ ID NO: 1498403 - DNA, 12 bp, Homo sapiens
ctttccctggac

SEQ ID NO: 1498404 - DNA, 20 bp, Homo sapiens
ctttcccttattgcctccca

SEQ ID NO: 1498405 - DNA, 22 bp, Homo sapiens
ctttcccttattgcctcccagg

SEQ ID NO: 1498406 - DNA, 23 bp, Homo sapiens
ctttcccttattgcctcccaggc

SEQ ID NO: 1498407 - DNA, 18 bp, Homo sapiens
ctttcccttgtgtcaaga

SEQ ID NO: 1498408 - DNA, 20 bp, Homo sapiens
ctttcctcaagtatcttcta

SEQ ID NO: 1498409 - DNA, 22 bp, Homo sapiens
ctttcctcaagtatcttctatt

SEQ ID NO: 1498410 - DNA, 12 bp, Homo sapiens
ctttcctccacc

SEQ ID NO: 1498411 - DNA, 13 bp, Homo sapiens
ctttcctccaccc

SEQ ID NO: 1498412 - DNA, 15 bp, Homo sapiens
ctttcctccacccat

SEQ ID NO: 1498413 - DNA, 16 bp, Homo sapiens
ctttcctccccctgca

SEQ ID NO: 1498414 - DNA, 17 bp, Homo sapiens
ctttcctccccctgcaa

SEQ ID NO: 1498415 - DNA, 19 bp, Homo sapiens
ctttcctccccctgcaact

SEQ ID NO: 1498416 - DNA, 13 bp, Homo sapiens
ctttcctcgcctg

SEQ ID NO: 1498417 - DNA, 16 bp, Homo sapiens
ctttcctcgtgaagga

SEQ ID NO: 1498418 - DNA, 20 bp, Homo sapiens
ctttcctctaactcactgcc

SEQ ID NO: 1498419 - DNA, 17 bp, Homo sapiens
ctttcctctgagattct

SEQ ID NO: 1498420 - DNA, 19 bp, Homo sapiens
ctttcctctttctgctctg

SEQ ID NO: 1498421 - DNA, 13 bp, Homo sapiens
ctttcctgagctg

SEQ ID NO: 1498422 - DNA, 12 bp, Homo sapiens
ctttcctgcccc

SEQ ID NO: 1498423 - DNA, 14 bp, Homo sapiens
ctttcctgccccag

SEQ ID NO: 1498424 - DNA, 18 bp, Homo sapiens
ctttcctgggcctttgca

SEQ ID NO: 1498425 - DNA, 17 bp, Homo sapiens
ctttcctggttctgtct

SEQ ID NO: 1498426 - DNA, 22 bp, Homo sapiens
ctttccttagacccgccaggtc

SEQ ID NO: 1498427 - DNA, 15 bp, Homo sapiens
ctttccttccatccc

SEQ ID NO: 1498428 - DNA, 17 bp, Homo sapiens
ctttccttcccaggccc

SEQ ID NO: 1498429 - DNA, 23 bp, Homo sapiens
ctttccttcccaggccctttggc

SEQ ID NO: 1498430 - DNA, 16 bp, Homo sapiens
ctttccttccttccct

SEQ ID NO: 1498431 - DNA, 17 bp, Homo sapiens
ctttccttgagctgttg

SEQ ID NO: 1498432 - DNA, 22 bp, Homo sapiens
ctttccttggctcccattcact

SEQ ID NO: 1498433 - DNA, 21 bp, Homo sapiens
ctttcctttttcccaataaat

SEQ ID NO: 1498434 - DNA, 15 bp, Homo sapiens
ctttcggagctcctg

SEQ ID NO: 1498435 - DNA, 18 bp, Homo sapiens
ctttcgtaatagctcaga

SEQ ID NO: 1498436 - DNA, 23 bp, Homo sapiens
ctttcgttctgctgaccaaatgg

SEQ ID NO: 1498437 - DNA, 15 bp, Homo sapiens
ctttcgttgttatta

SEQ ID NO: 1498438 - DNA, 17 bp, Homo sapiens
ctttctaagagaagcaa

SEQ ID NO: 1498439 - DNA, 15 bp, Homo sapiens
ctttctaatgtttct

SEQ ID NO: 1498440 - DNA, 19 bp, Homo sapiens
ctttctacaactgattgca

SEQ ID NO: 1498441 - DNA, 19 bp, Homo sapiens
ctttctagcaaatatgctg

SEQ ID NO: 1498442 - DNA, 20 bp, Homo sapiens
ctttctagcaaatatgctgt

SEQ ID NO: 1498443 - DNA, 15 bp, Homo sapiens
ctttctatcctgctc

SEQ ID NO: 1498444 - DNA, 20 bp, Homo sapiens
ctttctatgtagaactgttc

SEQ ID NO: 1498445 - DNA, 21 bp, Homo sapiens
ctttctattgttaaacaaatg

SEQ ID NO: 1498446 - DNA, 20 bp, Homo sapiens
ctttctcaaagaaatattaa

SEQ ID NO: 1498447 - DNA, 17 bp, Homo sapiens
ctttctcaatgtcttcc

SEQ ID NO: 1498448 - DNA, 15 bp, Homo sapiens
ctttctcagttttca

SEQ ID NO: 1498449 - DNA, 19 bp, Homo sapiens
ctttctcccaggccaggct

SEQ ID NO: 1498450 - DNA, 21 bp, Homo sapiens
ctttctcccccgacactgctg

SEQ ID NO: 1498451 - DNA, 14 bp, Homo sapiens
ctttctcccctgcc

SEQ ID NO: 1498452 - DNA, 13 bp, Homo sapiens
ctttctccctcac

SEQ ID NO: 1498453 - DNA, 14 bp, Homo sapiens
ctttctccggggtc

SEQ ID NO: 1498454 - DNA, 20 bp, Homo sapiens
ctttctccggggtctgtgct

SEQ ID NO: 1498455 - DNA, 23 bp, Homo sapiens
ctttctcctgatagtcacctgct

SEQ ID NO: 1498456 - DNA, 13 bp, Homo sapiens
ctttctcggggct

SEQ ID NO: 1498457 - DNA, 19 bp, Homo sapiens
ctttctctaaatatgatta

SEQ ID NO: 1498458 - DNA, 14 bp, Homo sapiens
ctttctctcctggc

SEQ ID NO: 1498459 - DNA, 16 bp, Homo sapiens
ctttctctcctggctc

SEQ ID NO: 1498460 - DNA, 21 bp, Homo sapiens
ctttctctcctggctcggggt

SEQ ID NO: 1498461 - DNA, 15 bp, Homo sapiens
ctttctctcctttct

SEQ ID NO: 1498462 - DNA, 16 bp, Homo sapiens
ctttctctcctttctt

SEQ ID NO: 1498463 - DNA, 14 bp, Homo sapiens
ctttctctctccac

SEQ ID NO: 1498464 - DNA, 16 bp, Homo sapiens
ctttctctctccaccc

SEQ ID NO: 1498465 - DNA, 20 bp, Homo sapiens
ctttctctctggcttctctc

SEQ ID NO: 1498466 - DNA, 22 bp, Homo sapiens
ctttctctctttatacagctgt

SEQ ID NO: 1498467 - DNA, 10 bp, Homo sapiens
ctttctctga

SEQ ID NO: 1498468 - DNA, 18 bp, Homo sapiens
ctttctctgacactgtgt

SEQ ID NO: 1498469 - DNA, 13 bp, Homo sapiens
ctttctctgccag

SEQ ID NO: 1498470 - DNA, 18 bp, Homo sapiens
ctttctctgccagtgaca

SEQ ID NO: 1498471 - DNA, 14 bp, Homo sapiens
ctttctctgggctt

SEQ ID NO: 1498472 - DNA, 20 bp, Homo sapiens
ctttctctggtggtcttcct

SEQ ID NO: 1498473 - DNA, 17 bp, Homo sapiens
ctttctcttccccttcc

SEQ ID NO: 1498474 - DNA, 13 bp, Homo sapiens
ctttctcttccct

SEQ ID NO: 1498475 - DNA, 14 bp, Homo sapiens
ctttctcttccctg

SEQ ID NO: 1498476 - DNA, 22 bp, Homo sapiens
ctttctgagagttggctcaggc

SEQ ID NO: 1498477 - DNA, 17 bp, Homo sapiens
ctttctgagcacacttt

SEQ ID NO: 1498478 - DNA, 21 bp, Homo sapiens
ctttctgagcacactttagtg

SEQ ID NO: 1498479 - DNA, 17 bp, Homo sapiens
ctttctgattactgtcc

SEQ ID NO: 1498480 - DNA, 19 bp, Homo sapiens
ctttctgcagtttttcagg

SEQ ID NO: 1498481 - DNA, 20 bp, Homo sapiens
ctttctgcagtttttcagga

SEQ ID NO: 1498482 - DNA, 15 bp, Homo sapiens
ctttctgcctggagt

SEQ ID NO: 1498483 - DNA, 16 bp, Homo sapiens
ctttctgctctgccat

SEQ ID NO: 1498484 - DNA, 22 bp, Homo sapiens
ctttctgctctgccatcttcag

SEQ ID NO: 1498485 - DNA, 11 bp, Homo sapiens
ctttctggcaa

SEQ ID NO: 1498486 - DNA, 13 bp, Homo sapiens
ctttctggctctc

SEQ ID NO: 1498487 - DNA, 12 bp, Homo sapiens
ctttctgggagc

SEQ ID NO: 1498488 - DNA, 21 bp, Homo sapiens
ctttctgggatgtcacagtcc

SEQ ID NO: 1498489 - DNA, 22 bp, Homo sapiens
ctttctgggatgtcacagtcca

SEQ ID NO: 1498490 - DNA, 14 bp, Homo sapiens
ctttctgggccaag

SEQ ID NO: 1498491 - DNA, 22 bp, Homo sapiens
ctttctggggggatatttccta

SEQ ID NO: 1498492 - DNA, 12 bp, Homo sapiens
ctttctgtgcat

SEQ ID NO: 1498493 - DNA, 19 bp, Homo sapiens
ctttctgtgtttattcaaa

SEQ ID NO: 1498494 - DNA, 21 bp, Homo sapiens
ctttctgttgaaaagcacaca

SEQ ID NO: 1498495 - DNA, 22 bp, Homo sapiens
ctttctgttgccagtcagcaac

SEQ ID NO: 1498496 - DNA, 16 bp, Homo sapiens
ctttcttcaccaagtg

SEQ ID NO: 1498497 - DNA, 22 bp, Homo sapiens
ctttcttgacaaaacctaactt

SEQ ID NO: 1498498 - DNA, 19 bp, Homo sapiens
ctttcttgctggctctgag

SEQ ID NO: 1498499 - DNA, 21 bp, Homo sapiens
ctttcttgctggctctgagaa

SEQ ID NO: 1498500 - DNA, 21 bp, Homo sapiens
ctttcttgggatagtgttctg

SEQ ID NO: 1498501 - DNA, 22 bp, Homo sapiens
ctttcttgtttgtcagcatctg

SEQ ID NO: 1498502 - DNA, 23 bp, Homo sapiens
ctttcttgtttgtcagcatctga

SEQ ID NO: 1498503 - DNA, 15 bp, Homo sapiens
ctttctttacctgag

SEQ ID NO: 1498504 - DNA, 17 bp, Homo sapiens
ctttctttacctgagac

SEQ ID NO: 1498505 - DNA, 23 bp, Homo sapiens
cttgtcttctggtactttctgtt

SEQ ID NO: 1498506 - DNA, 14 bp, Homo sapiens
cttgtgaaaatgtg

SEQ ID NO: 1498507 - DNA, 16 bp, Homo sapiens
cttgtgaaaatgtgtt

SEQ ID NO: 1498508 - DNA, 14 bp, Homo sapiens
cttgtgaaacacag

SEQ ID NO: 1498509 - DNA, 13 bp, Homo sapiens
cttgtgacagtgc

SEQ ID NO: 1498510 - DNA, 17 bp, Homo sapiens
cttgtgacagtgcctct

SEQ ID NO: 1498511 - DNA, 18 bp, Homo sapiens
cttgtgacagtgcctctt

SEQ ID NO: 1498512 - DNA, 19 bp, Homo sapiens
cttgtgacagtgcctcttc

SEQ ID NO: 1498513 - DNA, 20 bp, Homo sapiens
cttgtgacagtgcctcttcc

SEQ ID NO: 1498514 - DNA, 14 bp, Homo sapiens
cttgtgactgaagg

SEQ ID NO: 1498515 - DNA, 15 bp, Homo sapiens
cttgtgactgaaggg

SEQ ID NO: 1498516 - DNA, 17 bp, Homo sapiens
cttgtgacttttgcttt

SEQ ID NO: 1498517 - DNA, 19 bp, Homo sapiens
cttgtgacttttgctttaa

SEQ ID NO: 1498518 - DNA, 23 bp, Homo sapiens
cttgtgagagcccattcccacca

SEQ ID NO: 1498519 - DNA, 16 bp, Homo sapiens
ctttctttcacaaaaa

SEQ ID NO: 1498520 - DNA, 21 bp, Homo sapiens
ctttctttccaaaacatttct

SEQ ID NO: 1498521 - DNA, 14 bp, Homo sapiens
ctttctttcttaag

SEQ ID NO: 1498522 - DNA, 18 bp, Homo sapiens
ctttctttgcaccaaaga

SEQ ID NO: 1498523 - DNA, 21 bp, Homo sapiens
ctttctttgcctctgcagtct

SEQ ID NO: 1498524 - DNA, 19 bp, Homo sapiens
ctttcttttaatgatgcca

SEQ ID NO: 1498525 - DNA, 22 bp, Homo sapiens
ctttcttttctggaatgtaatc

SEQ ID NO: 1498526 - DNA, 15 bp, Homo sapiens
ctttctttttcttct

SEQ ID NO: 1498527 - DNA, 20 bp, Homo sapiens
ctttgaaaagttggaaggat

SEQ ID NO: 1498528 - DNA, 22 bp, Homo sapiens
ctttgaaactggaataagtgtt

SEQ ID NO: 1498529 - DNA, 13 bp, Homo sapiens
ctttgaaagaagc

SEQ ID NO: 1498530 - DNA, 20 bp, Homo sapiens
ctttgaaagaagcaagacac

SEQ ID NO: 1498531 - DNA, 19 bp, Homo sapiens
ctttgaaatagtctgtgtg

SEQ ID NO: 1498532 - DNA, 21 bp, Homo sapiens
ctttgaaatagtctgtgtgaa

SEQ ID NO: 1498533 - DNA, 23 bp, Homo sapiens
ctttgaaatgtgtttctgtataa

SEQ ID NO: 1498534 - DNA, 22 bp, Homo sapiens
ctttgaacgtgcttctttgtaa

SEQ ID NO: 1498535 - DNA, 18 bp, Homo sapiens
ctttgaagagtgaaatac

SEQ ID NO: 1498536 - DNA, 12 bp, Homo sapiens
ctttgaagggca

SEQ ID NO: 1498537 - DNA, 13 bp, Homo sapiens
ctttgaagggcaa

SEQ ID NO: 1498538 - DNA, 14 bp, Homo sapiens
ctttgaagggcaag

SEQ ID NO: 1498539 - DNA, 22 bp, Homo sapiens
ctttgaatttcttgatttttca

SEQ ID NO: 1498540 - DNA, 21 bp, Homo sapiens
ctttgacaattactcaggttt

SEQ ID NO: 1498541 - DNA, 22 bp, Homo sapiens
ctttgacaattgggagctgcca

SEQ ID NO: 1498542 - DNA, 23 bp, Homo sapiens
ctttgacaattgggagctgccaa

SEQ ID NO: 1498543 - DNA, 14 bp, Homo sapiens
ctttgacacccagg

SEQ ID NO: 1498544 - DNA, 19 bp, Homo sapiens
ctttgacacccaggctgga

SEQ ID NO: 1498545 - DNA, 23 bp, Homo sapiens
ctttgaccagatctttctcttcc

SEQ ID NO: 1498546 - DNA, 14 bp, Homo sapiens
ctttgactttttgc

SEQ ID NO: 1498547 - DNA, 17 bp, Homo sapiens
ctttgactttttgcatt

SEQ ID NO: 1498548 - DNA, 14 bp, Homo sapiens
ctttgagaggctga

SEQ ID NO: 1498549 - DNA, 17 bp, Homo sapiens
ctttgagaggctgaggt

SEQ ID NO: 1498550 - DNA, 17 bp, Homo sapiens
ctttgagatctaaaaat

SEQ ID NO: 1498551 - DNA, 22 bp, Homo sapiens
ctttgagatctaaaaataactg

SEQ ID NO: 1498552 - DNA, 19 bp, Homo sapiens
ctttgagatctggggaggc

SEQ ID NO: 1498553 - DNA, 19 bp, Homo sapiens
ctttgagcctgggaaataa

SEQ ID NO: 1498554 - DNA, 21 bp, Homo sapiens
ctttgagcttaatctttgaaa

SEQ ID NO: 1498555 - DNA, 21 bp, Homo sapiens
ctttgagtacagatactgtga

SEQ ID NO: 1498556 - DNA, 24 bp, Homo sapiens
ctttgagtacagatactgtgagct

SEQ ID NO: 1498557 - DNA, 19 bp, Homo sapiens
ctttgataacaaaaaataa

SEQ ID NO: 1498558 - DNA, 21 bp, Homo sapiens
ctttgatccttctgagctcca

SEQ ID NO: 1498559 - DNA, 16 bp, Homo sapiens
ctttgattatgcagac

SEQ ID NO: 1498560 - DNA, 15 bp, Homo sapiens
ctttgattctccttc

SEQ ID NO: 1498561 - DNA, 22 bp, Homo sapiens
ctttgattctccttcagccctc

SEQ ID NO: 1498562 - DNA, 19 bp, Homo sapiens
ctttgcaatccaaataaag

SEQ ID NO: 1498563 - DNA, 18 bp, Homo sapiens
ctttgcacagctctccgg

SEQ ID NO: 1498564 - DNA, 17 bp, Homo sapiens
ctttgcacatgtgacca

SEQ ID NO: 1498565 - DNA, 15 bp, Homo sapiens
ctttgcaccaaagac

SEQ ID NO: 1498566 - DNA, 16 bp, Homo sapiens
ctttgcaccaaagaca

SEQ ID NO: 1498567 - DNA, 17 bp, Homo sapiens
ctttgcacctctgctga

SEQ ID NO: 1498568 - DNA, 18 bp, Homo sapiens
ctttgcacctctgctgat

SEQ ID NO: 1498569 - DNA, 16 bp, Homo sapiens
ctttgcacctgagacc

SEQ ID NO: 1498570 - DNA, 14 bp, Homo sapiens
ctttgcactgaggg

SEQ ID NO: 1498571 - DNA, 15 bp, Homo sapiens
ctttgcactgtaatg

SEQ ID NO: 1498572 - DNA, 18 bp, Homo sapiens
ctttgcacttaatggctg

SEQ ID NO: 1498573 - DNA, 14 bp, Homo sapiens
ctttgcagcatacc

SEQ ID NO: 1498574 - DNA, 23 bp, Homo sapiens
ctttgcaggctctgggctcaggg

SEQ ID NO: 1498575 - DNA, 23 bp, Homo sapiens
ctttgcagttggactctcaggga

SEQ ID NO: 1498576 - DNA, 15 bp, Homo sapiens
ctttgcatgtattag

SEQ ID NO: 1498577 - DNA, 15 bp, Homo sapiens
ctttgccaaaatacc

SEQ ID NO: 1498578 - DNA, 23 bp, Homo sapiens
ctttgccaagttgctgtcactgt

SEQ ID NO: 1498579 - DNA, 20 bp, Homo sapiens
ctttgccagagcaggagccc

SEQ ID NO: 1498580 - DNA, 23 bp, Homo sapiens
ctttgccagagcaggagcccctg

SEQ ID NO: 1498581 - DNA, 20 bp, Homo sapiens
ctttgccatttttctataaa

SEQ ID NO: 1498582 - DNA, 15 bp, Homo sapiens
ctttgcccacccctc

SEQ ID NO: 1498583 - DNA, 17 bp, Homo sapiens
ctttgcccacccctcac

SEQ ID NO: 1498584 - DNA, 18 bp, Homo sapiens
ctttgcccacccctcact

SEQ ID NO: 1498585 - DNA, 15 bp, Homo sapiens
ctttgcccagaaaga

SEQ ID NO: 1498586 - DNA, 18 bp, Homo sapiens
ctttgcccagggtcctgt

SEQ ID NO: 1498587 - DNA, 23 bp, Homo sapiens
ctttgcccagggtcctgtgcctg

SEQ ID NO: 1498588 - DNA, 20 bp, Homo sapiens
ctttgcctcaactccaggat

SEQ ID NO: 1498589 - DNA, 14 bp, Homo sapiens
ctttgcctcaagac

SEQ ID NO: 1498590 - DNA, 15 bp, Homo sapiens
ctttgcctcaagact

SEQ ID NO: 1498591 - DNA, 12 bp, Homo sapiens
ctttgcctcttc

SEQ ID NO: 1498592 - DNA, 16 bp, Homo sapiens
ctttgcctcttctttg

SEQ ID NO: 1498593 - DNA, 18 bp, Homo sapiens
ctttgccttgggctgctc

SEQ ID NO: 1498594 - DNA, 22 bp, Homo sapiens
ctttgccttgggctgctcctca

SEQ ID NO: 1498595 - DNA, 15 bp, Homo sapiens
ctttgcgcctgtgac

SEQ ID NO: 1498596 - DNA, 16 bp, Homo sapiens
ctttgctacaaattta

SEQ ID NO: 1498597 - DNA, 20 bp, Homo sapiens
ctttgctagttggagtgctt

SEQ ID NO: 1498598 - DNA, 14 bp, Homo sapiens
ctttgctatgtaag

SEQ ID NO: 1498599 - DNA, 16 bp, Homo sapiens
ctttgctatgtaaggg

SEQ ID NO: 1498600 - DNA, 15 bp, Homo sapiens
ctttgctcagtgtcc

SEQ ID NO: 1498601 - DNA, 13 bp, Homo sapiens
ctttgctccgctc

SEQ ID NO: 1498602 - DNA, 21 bp, Homo sapiens
ctttgctctggaggaagttct

SEQ ID NO: 1498603 - DNA, 12 bp, Homo sapiens
ctttgctcttgc

SEQ ID NO: 1498604 - DNA, 11 bp, Homo sapiens
ctttgctgcag

SEQ ID NO: 1498605 - DNA, 11 bp, Homo sapiens
ctttgctgcca

SEQ ID NO: 1498606 - DNA, 14 bp, Homo sapiens
ctttgctgccttaa

SEQ ID NO: 1498607 - DNA, 11 bp, Homo sapiens
ctttgctgcta

SEQ ID NO: 1498608 - DNA, 22 bp, Homo sapiens
ctttgctgctatgaaaatgagc

SEQ ID NO: 1498609 - DNA, 22 bp, Homo sapiens
ctttgctgtgaggctgtcctgt

SEQ ID NO: 1498610 - DNA, 15 bp, Homo sapiens
ctttgcttcccattg

SEQ ID NO: 1498611 - DNA, 19 bp, Homo sapiens
ctttgcttgctttgaagta

SEQ ID NO: 1498612 - DNA, 18 bp, Homo sapiens
ctttggaaagttactgta

SEQ ID NO: 1498613 - DNA, 22 bp, Homo sapiens
ctttggaacaagacagccttca

SEQ ID NO: 1498614 - DNA, 21 bp, Homo sapiens
ctttggaaccagactcttgcc

SEQ ID NO: 1498615 - DNA, 17 bp, Homo sapiens
ctttggaagaaaaaatc

SEQ ID NO: 1498616 - DNA, 15 bp, Homo sapiens
ctttggaagcagccc

SEQ ID NO: 1498617 - DNA, 23 bp, Homo sapiens
ctttggaagggtctctctccagg

SEQ ID NO: 1498618 - DNA, 19 bp, Homo sapiens
ctttggaatattttatcct

SEQ ID NO: 1498619 - DNA, 20 bp, Homo sapiens
ctttggagaacgccagtctc

SEQ ID NO: 1498620 - DNA, 14 bp, Homo sapiens
ctttggagtcccct

SEQ ID NO: 1498621 - DNA, 20 bp, Homo sapiens
ctttggatgattttttaagc

SEQ ID NO: 1498622 - DNA, 16 bp, Homo sapiens
ctttggcaatttcctg

SEQ ID NO: 1498623 - DNA, 18 bp, Homo sapiens
ctttggcaatttcctggc

SEQ ID NO: 1498624 - DNA, 22 bp, Homo sapiens
ctttggcaatttcctggccctc

SEQ ID NO: 1498625 - DNA, 16 bp, Homo sapiens
ctttggcactctgact

SEQ ID NO: 1498626 - DNA, 18 bp, Homo sapiens
ctttggcactggggcact

SEQ ID NO: 1498627 - DNA, 21 bp, Homo sapiens
ctttggcctggggtgcatctc

SEQ ID NO: 1498628 - DNA, 13 bp, Homo sapiens
ctttggctcccct

SEQ ID NO: 1498629 - DNA, 15 bp, Homo sapiens
ctttggctcccctgt

SEQ ID NO: 1498630 - DNA, 14 bp, Homo sapiens
ctttggctgagacc

SEQ ID NO: 1498631 - DNA, 12 bp, Homo sapiens
ctttggctgcag

SEQ ID NO: 1498632 - DNA, 18 bp, Homo sapiens
ctttggctggtagcagca

SEQ ID NO: 1498633 - DNA, 14 bp, Homo sapiens
ctttggcttctcct

SEQ ID NO: 1498634 - DNA, 18 bp, Homo sapiens
ctttggcttctcctgtga

SEQ ID NO: 1498635 - DNA, 22 bp, Homo sapiens
ctttggcttctgatttttctct

SEQ ID NO: 1498636 - DNA, 23 bp, Homo sapiens
ctttggcttctgatttttctctt

SEQ ID NO: 1498637 - DNA, 12 bp, Homo sapiens
ctttggcttttt

SEQ ID NO: 1498638 - DNA, 18 bp, Homo sapiens
ctttgggaacactggcct

SEQ ID NO: 1498639 - DNA, 17 bp, Homo sapiens
ctttgggaggccaaggc

SEQ ID NO: 1498640 - DNA, 18 bp, Homo sapiens
ctttgggaggccaaggca

SEQ ID NO: 1498641 - DNA, 19 bp, Homo sapiens
ctttgggaggccaaggcag

SEQ ID NO: 1498642 - DNA, 18 bp, Homo sapiens
ctttgggaggctgaggcg

SEQ ID NO: 1498643 - DNA, 17 bp, Homo sapiens
ctttgggaggctgaggt

SEQ ID NO: 1498644 - DNA, 19 bp, Homo sapiens
ctttgggcaggtctgagat

SEQ ID NO: 1498645 - DNA, 21 bp, Homo sapiens
ctttgggctgccctggtgctg

SEQ ID NO: 1498646 - DNA, 22 bp, Homo sapiens
ctttgggcttagtatttctcag

SEQ ID NO: 1498647 - DNA, 12 bp, Homo sapiens
ctttgggctttg

SEQ ID NO: 1498648 - DNA, 19 bp, Homo sapiens
ctttggggacagttggcag

SEQ ID NO: 1498649 - DNA, 22 bp, Homo sapiens
ctttggggacagttggcagaga

SEQ ID NO: 1498650 - DNA, 18 bp, Homo sapiens
ctttggggctaatttaac

SEQ ID NO: 1498651 - DNA, 22 bp, Homo sapiens
ctttgggggagtgggcgcagtg

SEQ ID NO: 1498652 - DNA, 16 bp, Homo sapiens
ctttgggtcctgggca

SEQ ID NO: 1498653 - DNA, 19 bp, Homo sapiens
ctttgggttctttctgggg

SEQ ID NO: 1498654 - DNA, 10 bp, Homo sapiens
ctttggtaat

SEQ ID NO: 1498655 - DNA, 22 bp, Homo sapiens
ctttggtacatggccagtgtga

SEQ ID NO: 1498656 - DNA, 16 bp, Homo sapiens
ctttggtgcacaagta

SEQ ID NO: 1498657 - DNA, 21 bp, Homo sapiens
ctttggtgcgggcacaataaa

SEQ ID NO: 1498658 - DNA, 15 bp, Homo sapiens
ctttggttaaaaatg

SEQ ID NO: 1498659 - DNA, 16 bp, Homo sapiens
ctttggttccttctct

SEQ ID NO: 1498660 - DNA, 13 bp, Homo sapiens
ctttggttctaag

SEQ ID NO: 1498661 - DNA, 15 bp, Homo sapiens
ctttggttctctcca

SEQ ID NO: 1498662 - DNA, 21 bp, Homo sapiens
ctttggttctctccaggaagg

SEQ ID NO: 1498663 - DNA, 14 bp, Homo sapiens
ctttggttctggcc

SEQ ID NO: 1498664 - DNA, 19 bp, Homo sapiens
ctttggttggcagcattcc

SEQ ID NO: 1498665 - DNA, 23 bp, Homo sapiens
ctttggtttgacaattttgtctt

SEQ ID NO: 1498666 - DNA, 17 bp, Homo sapiens
ctttggtttttttcttc

SEQ ID NO: 1498667 - DNA, 12 bp, Homo sapiens
ctttgtaaatag

SEQ ID NO: 1498668 - DNA, 21 bp, Homo sapiens
ctttgtaatgtcaccaccttc

SEQ ID NO: 1498669 - DNA, 22 bp, Homo sapiens
ctttgtaatgtcaccaccttcc

SEQ ID NO: 1498670 - DNA, 13 bp, Homo sapiens
ctttgtaccaaaa

SEQ ID NO: 1498671 - DNA, 19 bp, Homo sapiens
ctttgtaccttttgtagtt

SEQ ID NO: 1498672 - DNA, 13 bp, Homo sapiens
ctttgtagatcct

SEQ ID NO: 1498673 - DNA, 18 bp, Homo sapiens
ctttgtatataggcttct

SEQ ID NO: 1498674 - DNA, 16 bp, Homo sapiens
ctttgtatgacagtga

SEQ ID NO: 1498675 - DNA, 18 bp, Homo sapiens
ctttgtattttgattatt

SEQ ID NO: 1498676 - DNA, 20 bp, Homo sapiens
ctttgtctcaaaataaagca

SEQ ID NO: 1498677 - DNA, 15 bp, Homo sapiens
ctttgtctgaaaaat

SEQ ID NO: 1498678 - DNA, 17 bp, Homo sapiens
ctttgtcttgtacttct

SEQ ID NO: 1498679 - DNA, 13 bp, Homo sapiens
ctttgtgagtcaa

SEQ ID NO: 1498680 - DNA, 19 bp, Homo sapiens
ctttgtgagtcaatacata

SEQ ID NO: 1498681 - DNA, 18 bp, Homo sapiens
ctttgtgattatttcact

SEQ ID NO: 1498682 - DNA, 20 bp, Homo sapiens
ctttgtgattccatggattg

SEQ ID NO: 1498683 - DNA, 22 bp, Homo sapiens
ctttgtgcttgtcattccagag

SEQ ID NO: 1498684 - DNA, 20 bp, Homo sapiens
ctttgtgggagggtaagaca

SEQ ID NO: 1498685 - DNA, 19 bp, Homo sapiens
ctttgtggggaagaggggc

SEQ ID NO: 1498686 - DNA, 20 bp, Homo sapiens
ctttgtgtcagaaaaaggaa

SEQ ID NO: 1498687 - DNA, 15 bp, Homo sapiens
ctttgtgtgtattca

SEQ ID NO: 1498688 - DNA, 20 bp, Homo sapiens
ctttgtgtgtgtgtcagctg

SEQ ID NO: 1498689 - DNA, 15 bp, Homo sapiens
ctttgtgttcatttc

SEQ ID NO: 1498690 - DNA, 18 bp, Homo sapiens
ctttgtgttcatttcatt

SEQ ID NO: 1498691 - DNA, 14 bp, Homo sapiens
ctttgttataccat

SEQ ID NO: 1498692 - DNA, 14 bp, Homo sapiens
ctttgttctgagca

SEQ ID NO: 1498693 - DNA, 23 bp, Homo sapiens
ctttgttctgagcattcgctgta

SEQ ID NO: 1498694 - DNA, 14 bp, Homo sapiens
ctttgttctgttgt

SEQ ID NO: 1498695 - DNA, 19 bp, Homo sapiens
ctttgttgcaagatgtgaa

SEQ ID NO: 1498696 - DNA, 16 bp, Homo sapiens
ctttgttgcccaggct

SEQ ID NO: 1498697 - DNA, 20 bp, Homo sapiens
ctttgttgctcagcaagggg

SEQ ID NO: 1498698 - DNA, 18 bp, Homo sapiens
ctttgttgtctccctctt

SEQ ID NO: 1498699 - DNA, 18 bp, Homo sapiens
ctttgtttaataaaggct

SEQ ID NO: 1498700 - DNA, 17 bp, Homo sapiens
ctttgtttcaaccaagt

SEQ ID NO: 1498701 - DNA, 17 bp, Homo sapiens
ctttgtttctttcttcc

SEQ ID NO: 1498702 - DNA, 13 bp, Homo sapiens
ctttgtttgttct

SEQ ID NO: 1498703 - DNA, 14 bp, Homo sapiens
ctttgtttgttctt

SEQ ID NO: 1498704 - DNA, 16 bp, Homo sapiens
ctttgttttaataaac

SEQ ID NO: 1498705 - DNA, 18 bp, Homo sapiens
ctttgttttattttaata

SEQ ID NO: 1498706 - DNA, 17 bp, Homo sapiens
ctttgttttctgactaa

SEQ ID NO: 1498707 - DNA, 19 bp, Homo sapiens
cttttaaaaaaatttttat

SEQ ID NO: 1498708 - DNA, 22 bp, Homo sapiens
cttttaaaaaaatttttataaa

SEQ ID NO: 1498709 - DNA, 14 bp, Homo sapiens
cttttaaaaatgtt

SEQ ID NO: 1498710 - DNA, 13 bp, Homo sapiens
cttttaaaatgca

SEQ ID NO: 1498711 - DNA, 16 bp, Homo sapiens
cttttaaaattcaaaa

SEQ ID NO: 1498712 - DNA, 12 bp, Homo sapiens
cttttaaactgt

SEQ ID NO: 1498713 - DNA, 22 bp, Homo sapiens
cttttaaagaaaaatatgatac

SEQ ID NO: 1498714 - DNA, 18 bp, Homo sapiens
cttttaaagaccctccta

SEQ ID NO: 1498715 - DNA, 17 bp, Homo sapiens
cttttaaagtgttactt

SEQ ID NO: 1498716 - DNA, 23 bp, Homo sapiens
cttttaaagttttgtcagaaaag

SEQ ID NO: 1498717 - DNA, 14 bp, Homo sapiens
cttttaacaccttt

SEQ ID NO: 1498718 - DNA, 16 bp, Homo sapiens
cttttaatacagggta

SEQ ID NO: 1498719 - DNA, 15 bp, Homo sapiens
cttttaatggcattt

SEQ ID NO: 1498720 - DNA, 14 bp, Homo sapiens
cttttaatgggatt

SEQ ID NO: 1498721 - DNA, 20 bp, Homo sapiens
cttttaattaaataaaagct

SEQ ID NO: 1498722 - DNA, 13 bp, Homo sapiens
cttttaattcatt

SEQ ID NO: 1498723 - DNA, 16 bp, Homo sapiens
cttttaattctcattt

SEQ ID NO: 1498724 - DNA, 14 bp, Homo sapiens
cttttacatactgc

SEQ ID NO: 1498725 - DNA, 16 bp, Homo sapiens
cttttaccatgcccct

SEQ ID NO: 1498726 - DNA, 20 bp, Homo sapiens
cttttaccttttttttttct

SEQ ID NO: 1498727 - DNA, 14 bp, Homo sapiens
cttttactttttta

SEQ ID NO: 1498728 - DNA, 14 bp, Homo sapiens
cttttagaaatgca

SEQ ID NO: 1498729 - DNA, 13 bp, Homo sapiens
cttttagacaact

SEQ ID NO: 1498730 - DNA, 21 bp, Homo sapiens
cttttagacaactagatttgt

SEQ ID NO: 1498731 - DNA, 13 bp, Homo sapiens
cttttagcctagt

SEQ ID NO: 1498732 - DNA, 20 bp, Homo sapiens
cttttagggagctggtctga

SEQ ID NO: 1498733 - DNA, 22 bp, Homo sapiens
cttttagttttagttgcagaaa

SEQ ID NO: 1498734 - DNA, 13 bp, Homo sapiens
cttttataaagca

SEQ ID NO: 1498735 - DNA, 17 bp, Homo sapiens
cttttataagcactcca

SEQ ID NO: 1498736 - DNA, 19 bp, Homo sapiens
cttttataggtgagaaaaa

SEQ ID NO: 1498737 - DNA, 21 bp, Homo sapiens
cttttatataagtgacttgaa

SEQ ID NO: 1498738 - DNA, 23 bp, Homo sapiens
cttttatctattctgagaaaaca

SEQ ID NO: 1498739 - DNA, 17 bp, Homo sapiens
cttttatgatgtatatt

SEQ ID NO: 1498740 - DNA, 19 bp, Homo sapiens
cttttatggctctatcttt

SEQ ID NO: 1498741 - DNA, 22 bp, Homo sapiens
cttttattttacacagaaacac

SEQ ID NO: 1498742 - DNA, 21 bp, Homo sapiens
cttttcaatcttctactttta

SEQ ID NO: 1498743 - DNA, 14 bp, Homo sapiens
cttttcaattatat

SEQ ID NO: 1498744 - DNA, 14 bp, Homo sapiens
cttttcacactgtc

SEQ ID NO: 1498745 - DNA, 20 bp, Homo sapiens
cttttcacattaggctgttg

SEQ ID NO: 1498746 - DNA, 12 bp, Homo sapiens
cttttcacattt

SEQ ID NO: 1498747 - DNA, 19 bp, Homo sapiens
cttttcacatttttaaaag

SEQ ID NO: 1498748 - DNA, 12 bp, Homo sapiens
cttttcacggga

SEQ ID NO: 1498749 - DNA, 12 bp, Homo sapiens
cttttgtttggt

SEQ ID NO: 1498750 - DNA, 14 bp, Homo sapiens
cttttgtttggtaa

SEQ ID NO: 1498751 - DNA, 16 bp, Homo sapiens
cttttgtttggtaaat

SEQ ID NO: 1498752 - DNA, 18 bp, Homo sapiens
cttttgtttggtaaatgt

SEQ ID NO: 1498753 - DNA, 23 bp, Homo sapiens
cttttgtttttggctttcctggt

SEQ ID NO: 1498754 - DNA, 13 bp, Homo sapiens
cttttgttttttt

SEQ ID NO: 1498755 - DNA, 17 bp, Homo sapiens
ctttttaaaacacatgt

SEQ ID NO: 1498756 - DNA, 20 bp, Homo sapiens
ctttttaaatgtaaagatat

SEQ ID NO: 1498757 - DNA, 20 bp, Homo sapiens
gaaaaatgggagacagcctc

SEQ ID NO: 1498758 - DNA, 15 bp, Homo sapiens
gaaaaatgggagcca

SEQ ID NO: 1498759 - DNA, 21 bp, Homo sapiens
gaaaaatggttgatggaaaat

SEQ ID NO: 1498760 - DNA, 22 bp, Homo sapiens
gaaaaattcaatagtaatataa

SEQ ID NO: 1498761 - DNA, 20 bp, Homo sapiens
gaaaaatttttatgtaaaac

SEQ ID NO: 1498762 - DNA, 11 bp, Homo sapiens
gaaaacaaaaa

SEQ ID NO: 1498763 - DNA, 19 bp, Homo sapiens
gaaaacaaaaccaaaagtt

SEQ ID NO: 1498764 - DNA, 18 bp, Homo sapiens
gaaaacaacttggcattt

SEQ ID NO: 1498765 - DNA, 21 bp, Homo sapiens
gaaaacaacttggcatttcta

SEQ ID NO: 1498766 - DNA, 22 bp, Homo sapiens
gaaaacactgttatcatttttt

SEQ ID NO: 1498767 - DNA, 15 bp, Homo sapiens
gaaaacagaacactt

SEQ ID NO: 1498768 - DNA, 21 bp, Homo sapiens
gaaaacagaacatcattagaa

SEQ ID NO: 1498769 - DNA, 12 bp, Homo sapiens
gaaaacagatat

SEQ ID NO: 1498770 - DNA, 14 bp, Homo sapiens
gaaaacagatatta

SEQ ID NO: 1498771 - DNA, 19 bp, Homo sapiens
gaaaacataaagaaaagat

SEQ ID NO: 1498772 - DNA, 15 bp, Homo sapiens
gaaaacatgtaataa

SEQ ID NO: 1498773 - DNA, 20 bp, Homo sapiens
gaaaacatgttaatgacaat

SEQ ID NO: 1498774 - DNA, 22 bp, Homo sapiens
gaaaaccaaccctgtgggctta

SEQ ID NO: 1498775 - DNA, 10 bp, Homo sapiens
gaaaaccaca

SEQ ID NO: 1498776 - DNA, 19 bp, Homo sapiens
gaaaaccacaaacggagcc

SEQ ID NO: 1498777 - DNA, 13 bp, Homo sapiens
gaaaacccagaga

SEQ ID NO: 1498778 - DNA, 20 bp, Homo sapiens
gaaaacctaattaaggaagt

SEQ ID NO: 1498779 - DNA, 13 bp, Homo sapiens
gaaaacctctcct

SEQ ID NO: 1498780 - DNA, 13 bp, Homo sapiens
gaaaacgaagctc

SEQ ID NO: 1498781 - DNA, 16 bp, Homo sapiens
gaaaactaaggatttt

SEQ ID NO: 1498782 - DNA, 19 bp, Homo sapiens
gaaaactcaaccagagtca

SEQ ID NO: 1498783 - DNA, 15 bp, Homo sapiens
gaaaactgtgatttc

SEQ ID NO: 1498784 - DNA, 14 bp, Homo sapiens
gaaaacttagccag

SEQ ID NO: 1498785 - DNA, 16 bp, Homo sapiens
gaaaacttttctcaga

SEQ ID NO: 1498786 - DNA, 16 bp, Homo sapiens
gaaaagaaaacaaaaa

SEQ ID NO: 1498787 - DNA, 13 bp, Homo sapiens
gaaaagaaagaaa

SEQ ID NO: 1498788 - DNA, 15 bp, Homo sapiens
gaaaagaaatgctaa

SEQ ID NO: 1498789 - DNA, 20 bp, Homo sapiens
gaaaagaagaaagtctatgc

SEQ ID NO: 1498790 - DNA, 16 bp, Homo sapiens
gaaaagaatacagaaa

SEQ ID NO: 1498791 - DNA, 14 bp, Homo sapiens
gaaaagaattacag

SEQ ID NO: 1498792 - DNA, 21 bp, Homo sapiens
gaaaagactccaaagaaatgt

SEQ ID NO: 1498793 - DNA, 13 bp, Homo sapiens
gaaaagataaaga

SEQ ID NO: 1498794 - DNA, 18 bp, Homo sapiens
gaaaagcaattgccctgt

SEQ ID NO: 1498795 - DNA, 19 bp, Homo sapiens
gaaaagcagacgcagcagc

SEQ ID NO: 1498796 - DNA, 14 bp, Homo sapiens
gaaaagcattttca

SEQ ID NO: 1498797 - DNA, 22 bp, Homo sapiens
gaaaagcattttcagtcttgta

SEQ ID NO: 1498798 - DNA, 16 bp, Homo sapiens
gaaaagcatttttcaa

SEQ ID NO: 1498799 - DNA, 14 bp, Homo sapiens
gaaaagccaaaggt

SEQ ID NO: 1498800 - DNA, 21 bp, Homo sapiens
gaaaagcctaatcacagtttt

SEQ ID NO: 1498801 - DNA, 22 bp, Homo sapiens
gaaaagctagtgtacctcctct

SEQ ID NO: 1498802 - DNA, 14 bp, Homo sapiens
gaaaagctgaatcc

SEQ ID NO: 1498803 - DNA, 23 bp, Homo sapiens
gaaaagctggaccttttcccttg

SEQ ID NO: 1498804 - DNA, 16 bp, Homo sapiens
gaaaagctttgtttgt

SEQ ID NO: 1498805 - DNA, 15 bp, Homo sapiens
gaaaaggaagactag

SEQ ID NO: 1498806 - DNA, 13 bp, Homo sapiens
gaaaaggaggagg

SEQ ID NO: 1498807 - DNA, 19 bp, Homo sapiens
gaaaaggatctaagggaag

SEQ ID NO: 1498808 - DNA, 21 bp, Homo sapiens
gaaaagggagattcagactgt

SEQ ID NO: 1498809 - DNA, 22 bp, Homo sapiens
gaaaagggcactcccaaccctg

SEQ ID NO: 1498810 - DNA, 16 bp, Homo sapiens
gaaaaggggagagaag

SEQ ID NO: 1498811 - DNA, 19 bp, Homo sapiens
gaaaaggtgataaaatcat

SEQ ID NO: 1498812 - DNA, 19 bp, Homo sapiens
gaaaaggttgaataatata

SEQ ID NO: 1498813 - DNA, 14 bp, Homo sapiens
gaaaagtagagaaa

SEQ ID NO: 1498814 - DNA, 20 bp, Homo sapiens
gaaaagtatattgataacct

SEQ ID NO: 1498815 - DNA, 14 bp, Homo sapiens
gaaaagtgcctgag

SEQ ID NO: 1498816 - DNA, 21 bp, Homo sapiens
gaaaagtgcctgagctgggga

SEQ ID NO: 1498817 - DNA, 18 bp, Homo sapiens
gaaaagtggcaagaccaa

SEQ ID NO: 1498818 - DNA, 23 bp, Homo sapiens
gaaaagtggcgtgggagccagcc

SEQ ID NO: 1498819 - DNA, 19 bp, Homo sapiens
gaaaagttaaactaaaaaa

SEQ ID NO: 1498820 - DNA, 14 bp, Homo sapiens
gaaaagttagtatt

SEQ ID NO: 1498821 - DNA, 22 bp, Homo sapiens
gaaaagttagtattaaaatcta

SEQ ID NO: 1498822 - DNA, 14 bp, Homo sapiens
gaaaagttggaagg

SEQ ID NO: 1498823 - DNA, 13 bp, Homo sapiens
gaaaataaaacac

SEQ ID NO: 1498824 - DNA, 14 bp, Homo sapiens
gaaaataaaacaca

SEQ ID NO: 1498825 - DNA, 18 bp, Homo sapiens
gaaaataaaacacacctc

SEQ ID NO: 1498826 - DNA, 14 bp, Homo sapiens
gaaaataaacacca

SEQ ID NO: 1498827 - DNA, 22 bp, Homo sapiens
gaaaataaacagacaaaaacaa

SEQ ID NO: 1498828 - DNA, 20 bp, Homo sapiens
gaaaataaacatcagtttct

SEQ ID NO: 1498829 - DNA, 11 bp, Homo sapiens
gaaaataattt

SEQ ID NO: 1498830 - DNA, 19 bp, Homo sapiens
gaaaatacctaattgtgga

SEQ ID NO: 1498831 - DNA, 17 bp, Homo sapiens
gaaaatacgctcaggtg

SEQ ID NO: 1498832 - DNA, 20 bp, Homo sapiens
gaaaatagtaaatgctttgt

SEQ ID NO: 1498833 - DNA, 18 bp, Homo sapiens
gaaaatagtttaggagaa

SEQ ID NO: 1498834 - DNA, 16 bp, Homo sapiens
gaaaatataatattta

SEQ ID NO: 1498835 - DNA, 18 bp, Homo sapiens
gaaaatatgtattaacac

SEQ ID NO: 1498836 - DNA, 17 bp, Homo sapiens
gaaaatatgtcccagaa

SEQ ID NO: 1498837 - DNA, 21 bp, Homo sapiens
gaaaatattatgtgtttccat

SEQ ID NO: 1498838 - DNA, 18 bp, Homo sapiens
gaaaatattgctgtgtct

SEQ ID NO: 1498839 - DNA, 21 bp, Homo sapiens
gaaaatatttcctgacttgag

SEQ ID NO: 1498840 - DNA, 17 bp, Homo sapiens
gaaaatatttttttcta

SEQ ID NO: 1498841 - DNA, 19 bp, Homo sapiens
gaaaatcaaatacatactt

SEQ ID NO: 1498842 - DNA, 17 bp, Homo sapiens
gaaaatcactttgtcta

SEQ ID NO: 1498843 - DNA, 15 bp, Homo sapiens
gaaaatcatcaagaa

SEQ ID NO: 1498844 - DNA, 16 bp, Homo sapiens
gaaaatcatcaagaag

SEQ ID NO: 1498845 - DNA, 15 bp, Homo sapiens
gaaaatccaggtcat

SEQ ID NO: 1498846 - DNA, 13 bp, Homo sapiens
gaaaatcctctgg

SEQ ID NO: 1498847 - DNA, 14 bp, Homo sapiens
gaaaatcctctggc

SEQ ID NO: 1498848 - DNA, 14 bp, Homo sapiens
gaaaatccttcagc

SEQ ID NO: 1498849 - DNA, 15 bp, Homo sapiens
gaaaatctatatttg

SEQ ID NO: 1498850 - DNA, 16 bp, Homo sapiens
gaaaatgaattttttc

SEQ ID NO: 1498851 - DNA, 12 bp, Homo sapiens
gaaaatgactta

SEQ ID NO: 1498852 - DNA, 15 bp, Homo sapiens
gaaaatgagaaagga

SEQ ID NO: 1498853 - DNA, 19 bp, Homo sapiens
gaaaatgagaaaggacaga

SEQ ID NO: 1498854 - DNA, 19 bp, Homo sapiens
gaaaatgagtatttggtcc

SEQ ID NO: 1498855 - DNA, 20 bp, Homo sapiens
gaaaatgatacgcaacataa

SEQ ID NO: 1498856 - DNA, 22 bp, Homo sapiens
gaaaatgatctgagtcccagga

SEQ ID NO: 1498857 - DNA, 16 bp, Homo sapiens
gaaaatgcaaaatgaa

SEQ ID NO: 1498858 - DNA, 19 bp, Homo sapiens
gaaaatggacattgagata

SEQ ID NO: 1498859 - DNA, 19 bp, Homo sapiens
gaaagaaaagaccctgaga

SEQ ID NO: 1498860 - DNA, 16 bp, Homo sapiens
gaaagaaagctgagaa

SEQ ID NO: 1498861 - DNA, 23 bp, Homo sapiens
gaaagaactttaaagctcaggag

SEQ ID NO: 1498862 - DNA, 13 bp, Homo sapiens
gaaagaagcaaga

SEQ ID NO: 1498863 - DNA, 14 bp, Homo sapiens
gaaagaagcaagac

SEQ ID NO: 1498864 - DNA, 16 bp, Homo sapiens
gaaagaagcaagacac

SEQ ID NO: 1498865 - DNA, 14 bp, Homo sapiens
gaaagaagggggcc

SEQ ID NO: 1498866 - DNA, 16 bp, Homo sapiens
gaaagaagggggccct

SEQ ID NO: 1498867 - DNA, 23 bp, Homo sapiens
gaaagaagggggccctgctacct

SEQ ID NO: 1498868 - DNA, 16 bp, Homo sapiens
gaaagaagttgctaag

SEQ ID NO: 1498869 - DNA, 13 bp, Homo sapiens
gaaagacactgcc

SEQ ID NO: 1498870 - DNA, 14 bp, Homo sapiens
gaaagacactgcct

SEQ ID NO: 1498871 - DNA, 12 bp, Homo sapiens
gaaagacatcaa

SEQ ID NO: 1498872 - DNA, 13 bp, Homo sapiens
gaaagacatcaat

SEQ ID NO: 1498873 - DNA, 14 bp, Homo sapiens
gaaagacatcaatg

SEQ ID NO: 1498874 - DNA, 16 bp, Homo sapiens
gaaagacatcaatgaa

SEQ ID NO: 1498875 - DNA, 15 bp, Homo sapiens
gaaagactattcaaa

SEQ ID NO: 1498876 - DNA, 17 bp, Homo sapiens
gaaagactattcaaaca

SEQ ID NO: 1498877 - DNA, 19 bp, Homo sapiens
gaaagactattcaaacagt

SEQ ID NO: 1498878 - DNA, 17 bp, Homo sapiens
gaaatcaaatgtatgta

SEQ ID NO: 1498879 - DNA, 16 bp, Homo sapiens
gaaatcaaccctctcc

SEQ ID NO: 1498880 - DNA, 21 bp, Homo sapiens
gaaatcaaccctctcctgtct

SEQ ID NO: 1498881 - DNA, 18 bp, Homo sapiens
gaaatcataccagttgtt

SEQ ID NO: 1498882 - DNA, 17 bp, Homo sapiens
gaaatcatgtccataca

SEQ ID NO: 1498883 - DNA, 22 bp, Homo sapiens
gaaatccataaactaagagaaa

SEQ ID NO: 1498884 - DNA, 23 bp, Homo sapiens
gaaatccataaactaagagaaac

SEQ ID NO: 1498885 - DNA, 15 bp, Homo sapiens
gaaatctagtatttc

SEQ ID NO: 1498886 - DNA, 19 bp, Homo sapiens
gaaatctcctaacaaaaga

SEQ ID NO: 1498887 - DNA, 23 bp, Homo sapiens
gaaatctgaggaatggacatttc

SEQ ID NO: 1498888 - DNA, 18 bp, Homo sapiens
gaaatctggcccagggtg

SEQ ID NO: 1498889 - DNA, 14 bp, Homo sapiens
gaaatcttttaaaa

SEQ ID NO: 1498890 - DNA, 16 bp, Homo sapiens
gaaatgaaaacatgta

SEQ ID NO: 1498891 - DNA, 19 bp, Homo sapiens
gaaatgaaaacatgtaata

SEQ ID NO: 1498892 - DNA, 13 bp, Homo sapiens
gaaatgaaagaaa

SEQ ID NO: 1498893 - DNA, 14 bp, Homo sapiens
gaaatgaataattt

SEQ ID NO: 1498894 - DNA, 19 bp, Homo sapiens
gaaatgaataatttcccaa

SEQ ID NO: 1498895 - DNA, 24 bp, Homo sapiens
gaaatgaccttcattctgagacca

SEQ ID NO: 1498896 - DNA, 23 bp, Homo sapiens
gaaatgacggtgttaattttgct

SEQ ID NO: 1498897 - DNA, 11 bp, Homo sapiens
gaaatgatgtt

SEQ ID NO: 1498898 - DNA, 15 bp, Homo sapiens
gaaatgatgttggtc

SEQ ID NO: 1498899 - DNA, 20 bp, Homo sapiens
gaaatgattcaaattgctgc

SEQ ID NO: 1498900 - DNA, 22 bp, Homo sapiens
gaaatgattcaaattgctgctt

SEQ ID NO: 1498901 - DNA, 17 bp, Homo sapiens
gaaatgcaaaaatctct

SEQ ID NO: 1498902 - DNA, 15 bp, Homo sapiens
gaaatgcatatttgc

SEQ ID NO: 1498903 - DNA, 23 bp, Homo sapiens
gaaatgcatccattcctcaggga

SEQ ID NO: 1498904 - DNA, 21 bp, Homo sapiens
gaaatgctattgttgtgggct

SEQ ID NO: 1498905 - DNA, 14 bp, Homo sapiens
gaaatgctgaaaat

SEQ ID NO: 1498906 - DNA, 13 bp, Homo sapiens
gaaatgctgctgg

SEQ ID NO: 1498907 - DNA, 15 bp, Homo sapiens
gaaatggaaagcaga

SEQ ID NO: 1498908 - DNA, 14 bp, Homo sapiens
gaaatggaatcagg

SEQ ID NO: 1498909 - DNA, 18 bp, Homo sapiens
gaaatggagaagctctgt

SEQ ID NO: 1498910 - DNA, 17 bp, Homo sapiens
gaaatggcgtctgctct

SEQ ID NO: 1498911 - DNA, 12 bp, Homo sapiens
gaaatggctggg

SEQ ID NO: 1498912 - DNA, 15 bp, Homo sapiens
gaaatgggagatggt

SEQ ID NO: 1498913 - DNA, 14 bp, Homo sapiens
gaaatgtagcactt

SEQ ID NO: 1498914 - DNA, 22 bp, Homo sapiens
gaaatgtagcacttacgtaaaa

SEQ ID NO: 1498915 - DNA, 15 bp, Homo sapiens
gaaatgtctgctggt

SEQ ID NO: 1498916 - DNA, 16 bp, Homo sapiens
gaaatgtgtttctgta

SEQ ID NO: 1498917 - DNA, 21 bp, Homo sapiens
gaaatgttattttttaattat

SEQ ID NO: 1498918 - DNA, 19 bp, Homo sapiens
gaaattaacacaaaggaag

SEQ ID NO: 1498919 - DNA, 20 bp, Homo sapiens
gaaattaacttttaaatgtt

SEQ ID NO: 1498920 - DNA, 23 bp, Homo sapiens
gaaattaagactttatgtagttt

SEQ ID NO: 1498921 - DNA, 15 bp, Homo sapiens
gaaattacctgtgga

SEQ ID NO: 1498922 - DNA, 13 bp, Homo sapiens
gaaattagccggg

SEQ ID NO: 1498923 - DNA, 13 bp, Homo sapiens
gaaattagggccc

SEQ ID NO: 1498924 - DNA, 17 bp, Homo sapiens
gaaattatataagtatt

SEQ ID NO: 1498925 - DNA, 23 bp, Homo sapiens
gaaattatataagtattctaaat

SEQ ID NO: 1498926 - DNA, 21 bp, Homo sapiens
gaaattatgtatgtttacata

SEQ ID NO: 1498927 - DNA, 16 bp, Homo sapiens
gaaattcaaagcataa

SEQ ID NO: 1498928 - DNA, 21 bp, Homo sapiens
gaaattccatacttctctcag

SEQ ID NO: 1498929 - DNA, 20 bp, Homo sapiens
gaaattctatttataataca

SEQ ID NO: 1498930 - DNA, 13 bp, Homo sapiens
gaaattctcagag

SEQ ID NO: 1498931 - DNA, 14 bp, Homo sapiens
gaaattctcctgga

SEQ ID NO: 1498932 - DNA, 15 bp, Homo sapiens
gaaattctcctggag

SEQ ID NO: 1498933 - DNA, 17 bp, Homo sapiens
gaaattctcctggaggt

SEQ ID NO: 1498934 - DNA, 13 bp, Homo sapiens
gaaattctgaaaa

SEQ ID NO: 1498935 - DNA, 16 bp, Homo sapiens
gaaattctgaaaactg

SEQ ID NO: 1498936 - DNA, 14 bp, Homo sapiens
gaaattcttatgtt

SEQ ID NO: 1498937 - DNA, 16 bp, Homo sapiens
gaaattgcatactttg

SEQ ID NO: 1498938 - DNA, 19 bp, Homo sapiens
gaaattgcatttcctgaca

SEQ ID NO: 1498939 - DNA, 13 bp, Homo sapiens
gaaattgctattt

SEQ ID NO: 1498940 - DNA, 16 bp, Homo sapiens
gaaattgtgtgtgcaa

SEQ ID NO: 1498941 - DNA, 16 bp, Homo sapiens
gaaatttaattcatgt

SEQ ID NO: 1498942 - DNA, 21 bp, Homo sapiens
gaaatttaattcatgtttctt

SEQ ID NO: 1498943 - DNA, 21 bp, Homo sapiens
gaaatttcagattcccagagc

SEQ ID NO: 1498944 - DNA, 14 bp, Homo sapiens
gaaatttgtttgta

SEQ ID NO: 1498945 - DNA, 14 bp, Homo sapiens
gaaattttagaaat

SEQ ID NO: 1498946 - DNA, 12 bp, Homo sapiens
gaaattttgtaa

SEQ ID NO: 1498947 - DNA, 13 bp, Homo sapiens
gaaattttgtaag

SEQ ID NO: 1498948 - DNA, 14 bp, Homo sapiens
gaaattttgtaaga

SEQ ID NO: 1498949 - DNA, 20 bp, Homo sapiens
gaaattttgtaagaaggcaa

SEQ ID NO: 1498950 - DNA, 18 bp, Homo sapiens
gaaatttttattaaatta

SEQ ID NO: 1498951 - DNA, 17 bp, Homo sapiens
gaaatttttatttttct

SEQ ID NO: 1498952 - DNA, 20 bp, Homo sapiens
gaaatttttcagatgcttct

SEQ ID NO: 1498953 - DNA, 19 bp, Homo sapiens
gaacaaaaatgtttccact

SEQ ID NO: 1498954 - DNA, 23 bp, Homo sapiens
gaacaaacactgcagtttcctgg

SEQ ID NO: 1498955 - DNA, 14 bp, Homo sapiens
gaacaaagacaggc

SEQ ID NO: 1498956 - DNA, 17 bp, Homo sapiens
gaacaaattagaggaga

SEQ ID NO: 1498957 - DNA, 18 bp, Homo sapiens
gaacaaattagaggagac

SEQ ID NO: 1498958 - DNA, 21 bp, Homo sapiens
gaacaactaggcttcagcata

SEQ ID NO: 1498959 - DNA, 16 bp, Homo sapiens
gaacaagatggttcta

SEQ ID NO: 1498960 - DNA, 23 bp, Homo sapiens
gaacaagcatgatcttgttactg

SEQ ID NO: 1498961 - DNA, 16 bp, Homo sapiens
gaacaagtaatgtatt

SEQ ID NO: 1498962 - DNA, 14 bp, Homo sapiens
gaacaagtcacagc

SEQ ID NO: 1498963 - DNA, 16 bp, Homo sapiens
gaacaagtcacagctg

SEQ ID NO: 1498964 - DNA, 19 bp, Homo sapiens
gaacaagtcacagctgcag

SEQ ID NO: 1498965 - DNA, 21 bp, Homo sapiens
gaacaagtgcctcctggactg

SEQ ID NO: 1498966 - DNA, 23 bp, Homo sapiens
gaacaagtgcctcctggactgtt

SEQ ID NO: 1498967 - DNA, 19 bp, Homo sapiens
gaacaagttgtttcattga

SEQ ID NO: 1498968 - DNA, 23 bp, Homo sapiens
gaagcatttcaaagccctgcctc

SEQ ID NO: 1498969 - DNA, 14 bp, Homo sapiens
gaagccaagggaag

SEQ ID NO: 1498970 - DNA, 21 bp, Homo sapiens
gaagccaagtggggtgctggg

SEQ ID NO: 1498971 - DNA, 22 bp, Homo sapiens
gaagccaagtggggtgctggga

SEQ ID NO: 1498972 - DNA, 15 bp, Homo sapiens
gaagccacaggcctg

SEQ ID NO: 1498973 - DNA, 17 bp, Homo sapiens
gaagccacctcaccaag

SEQ ID NO: 1498974 - DNA, 22 bp, Homo sapiens
gaagccactttctacaggccag

SEQ ID NO: 1498975 - DNA, 12 bp, Homo sapiens
gaagccagctgc

SEQ ID NO: 1498976 - DNA, 13 bp, Homo sapiens
gaagccagctgcc

SEQ ID NO: 1498977 - DNA, 22 bp, Homo sapiens
gaagccagctttccctgcctct

SEQ ID NO: 1498978 - DNA, 13 bp, Homo sapiens
gaagccaggctga

SEQ ID NO: 1498979 - DNA, 18 bp, Homo sapiens
gaagccatcacttctccc

SEQ ID NO: 1498980 - DNA, 15 bp, Homo sapiens
gaagccatctttctt

SEQ ID NO: 1498981 - DNA, 23 bp, Homo sapiens
gaagcccagcccctactgctgtg

SEQ ID NO: 1498982 - DNA, 13 bp, Homo sapiens
gaagcccagctcc

SEQ ID NO: 1498983 - DNA, 14 bp, Homo sapiens
gaagcccagctcca

SEQ ID NO: 1498984 - DNA, 20 bp, Homo sapiens
gaagcccagctccagggcca

SEQ ID NO: 1498985 - DNA, 21 bp, Homo sapiens
gaagcccatcctgaccagctg

SEQ ID NO: 1498986 - DNA, 17 bp, Homo sapiens
gaagccccacatgtcca

SEQ ID NO: 1498987 - DNA, 13 bp, Homo sapiens
gaagccccttgga

SEQ ID NO: 1498988 - DNA, 19 bp, Homo sapiens
gaagccccttggagagaga

SEQ ID NO: 1498989 - DNA, 22 bp, Homo sapiens
gaagccctggatttcagaaaga

SEQ ID NO: 1498990 - DNA, 13 bp, Homo sapiens
gaagccgactctg

SEQ ID NO: 1498991 - DNA, 14 bp, Homo sapiens
gaagccgactctgg

SEQ ID NO: 1498992 - DNA, 19 bp, Homo sapiens
gaagccgactctggccctg

SEQ ID NO: 1498993 - DNA, 21 bp, Homo sapiens
gaagccgactctggccctggc

SEQ ID NO: 1498994 - DNA, 17 bp, Homo sapiens
gaagccggacagctgcc

SEQ ID NO: 1498995 - DNA, 19 bp, Homo sapiens
gaagccggacagctgccca

SEQ ID NO: 1498996 - DNA, 15 bp, Homo sapiens
gaagccggcggccca

SEQ ID NO: 1498997 - DNA, 20 bp, Homo sapiens
gaagcctccaagcctgcctc

SEQ ID NO: 1498998 - DNA, 22 bp, Homo sapiens
gaagcctctctccttggccaca

SEQ ID NO: 1498999 - DNA, 19 bp, Homo sapiens
gaagcctctgcctccctag

SEQ ID NO: 1499000 - DNA, 12 bp, Homo sapiens
gaagcctctggc

SEQ ID NO: 1499001 - DNA, 13 bp, Homo sapiens
gaagcctctggct

SEQ ID NO: 1499002 - DNA, 14 bp, Homo sapiens
gaagcctctggcta

SEQ ID NO: 1499003 - DNA, 15 bp, Homo sapiens
gaagcctgaactgag

SEQ ID NO: 1499004 - DNA, 22 bp, Homo sapiens
gaagcctgaactgaggccttgt

SEQ ID NO: 1499005 - DNA, 15 bp, Homo sapiens
gaagcctgcaggagt

SEQ ID NO: 1499006 - DNA, 21 bp, Homo sapiens
gaagcctggactctaagctgg

SEQ ID NO: 1499007 - DNA, 22 bp, Homo sapiens
gaagcctgtaacactcctctgc

SEQ ID NO: 1499008 - DNA, 18 bp, Homo sapiens
gaagcctgtgccagcacc

SEQ ID NO: 1499009 - DNA, 19 bp, Homo sapiens
gaagccttaatttgcacag

SEQ ID NO: 1499010 - DNA, 20 bp, Homo sapiens
gaagccttaatttgcacagt

SEQ ID NO: 1499011 - DNA, 18 bp, Homo sapiens
gaagccttaccacgcagt

SEQ ID NO: 1499012 - DNA, 18 bp, Homo sapiens
gaagcggagagagccaag

SEQ ID NO: 1499013 - DNA, 17 bp, Homo sapiens
gaagcggagcttgcagt

SEQ ID NO: 1499014 - DNA, 19 bp, Homo sapiens
gaagcggagcttgcagtga

SEQ ID NO: 1499015 - DNA, 18 bp, Homo sapiens
gaagcgttatgtgcagta

SEQ ID NO: 1499016 - DNA, 21 bp, Homo sapiens
gaagctagacacatgaaggta

SEQ ID NO: 1499017 - DNA, 23 bp, Homo sapiens
gaagctagacacatgaaggtaaa

SEQ ID NO: 1499018 - DNA, 15 bp, Homo sapiens
gaagctcattcccaa

SEQ ID NO: 1499019 - DNA, 18 bp, Homo sapiens
gaagctcattcccaacgt

SEQ ID NO: 1499020 - DNA, 15 bp, Homo sapiens
gaagctcctgctact

SEQ ID NO: 1499021 - DNA, 21 bp, Homo sapiens
gaagctcctgctacttcccca

SEQ ID NO: 1499022 - DNA, 18 bp, Homo sapiens
gaagctctccgagctctg

SEQ ID NO: 1499023 - DNA, 17 bp, Homo sapiens
gaagctctcttaaaata

SEQ ID NO: 1499024 - DNA, 17 bp, Homo sapiens
gaagctctggccccagg

SEQ ID NO: 1499025 - DNA, 12 bp, Homo sapiens
gaagctctggct

SEQ ID NO: 1499026 - DNA, 22 bp, Homo sapiens
gaagctcttttctcctgcagaa

SEQ ID NO: 1499027 - DNA, 22 bp, Homo sapiens
gaagctgaaaacctaagtcctt

SEQ ID NO: 1499028 - DNA, 21 bp, Homo sapiens
gaagctgaaaggatgatcctg

SEQ ID NO: 1499029 - DNA, 18 bp, Homo sapiens
gaagctgaaccccctcca

SEQ ID NO: 1499030 - DNA, 14 bp, Homo sapiens
gaagctgagctttt

SEQ ID NO: 1499031 - DNA, 20 bp, Homo sapiens
gaagctgatccagtttccgg

SEQ ID NO: 1499032 - DNA, 23 bp, Homo sapiens
gaagctgccatccttgctgcagc

SEQ ID NO: 1499033 - DNA, 12 bp, Homo sapiens
gaagctgctgac

SEQ ID NO: 1499034 - DNA, 15 bp, Homo sapiens
gaagctgctgcagcc

SEQ ID NO: 1499035 - DNA, 19 bp, Homo sapiens
gaagctggcctgagagggg

SEQ ID NO: 1499036 - DNA, 19 bp, Homo sapiens
gaagctgtactcagagcag

SEQ ID NO: 1499037 - DNA, 23 bp, Homo sapiens
gaagctgtgtccttgcacctgca

SEQ ID NO: 1499038 - DNA, 22 bp, Homo sapiens
gaagcttccacaaaattagaaa

SEQ ID NO: 1499039 - DNA, 16 bp, Homo sapiens
gaagcttgagcctccc

SEQ ID NO: 1499040 - DNA, 21 bp, Homo sapiens
gaaggtgcctcagactccgcc

SEQ ID NO: 1499041 - DNA, 14 bp, Homo sapiens
gaaggtgctgagct

SEQ ID NO: 1499042 - DNA, 20 bp, Homo sapiens
gaaggtggaccagaatgaaa

SEQ ID NO: 1499043 - DNA, 15 bp, Homo sapiens
gaaggtggacctggc

SEQ ID NO: 1499044 - DNA, 17 bp, Homo sapiens
gaaggtggacctggcag

SEQ ID NO: 1499045 - DNA, 18 bp, Homo sapiens
gaaggtggggccctgccc

SEQ ID NO: 1499046 - DNA, 19 bp, Homo sapiens
gaaggtggggccctgcccc

SEQ ID NO: 1499047 - DNA, 21 bp, Homo sapiens
gaaggtggtggggctgccgga

SEQ ID NO: 1499048 - DNA, 20 bp, Homo sapiens
gaaggttatcagtgcttccc

SEQ ID NO: 1499049 - DNA, 22 bp, Homo sapiens
gaaggttggtgaatttcacaag

SEQ ID NO: 1499050 - DNA, 23 bp, Homo sapiens
gaaggttggtggggggtccagtc

SEQ ID NO: 1499051 - DNA, 18 bp, Homo sapiens
gaaggttgtatgtaaatc

SEQ ID NO: 1499052 - DNA, 19 bp, Homo sapiens
gaaggttgtatgtaaatct

SEQ ID NO: 1499053 - DNA, 22 bp, Homo sapiens
gaaggtttattgttaatacaag

SEQ ID NO: 1499054 - DNA, 15 bp, Homo sapiens
gaaggtttgtatatt

SEQ ID NO: 1499055 - DNA, 16 bp, Homo sapiens
gaaggtttgtatattg

SEQ ID NO: 1499056 - DNA, 18 bp, Homo sapiens
gaagtaacccctcctggc

SEQ ID NO: 1499057 - DNA, 13 bp, Homo sapiens
gaagtaacttatt

SEQ ID NO: 1499058 - DNA, 23 bp, Homo sapiens
gaagtaagaagaggagcctcaga

SEQ ID NO: 1499059 - DNA, 22 bp, Homo sapiens
gaagtacgagccccacagagca

SEQ ID NO: 1499060 - DNA, 20 bp, Homo sapiens
gaagtagctgtcagatgtca

SEQ ID NO: 1499061 - DNA, 14 bp, Homo sapiens
gaagtatcagcact

SEQ ID NO: 1499062 - DNA, 17 bp, Homo sapiens
gaagtatcagcactaga

SEQ ID NO: 1499063 - DNA, 17 bp, Homo sapiens
gaagtcaaaatatgtaa

SEQ ID NO: 1499064 - DNA, 17 bp, Homo sapiens
gaagtcactcacactgg

SEQ ID NO: 1499065 - DNA, 18 bp, Homo sapiens
gaagtcactgaacaaaac

SEQ ID NO: 1499066 - DNA, 15 bp, Homo sapiens
gaagtcactgcacag

SEQ ID NO: 1499067 - DNA, 17 bp, Homo sapiens
gaagtcagccacactgg

SEQ ID NO: 1499068 - DNA, 18 bp, Homo sapiens
gaagtcagccacactggg

SEQ ID NO: 1499069 - DNA, 21 bp, Homo sapiens
gaagtcagctaattggacttt

SEQ ID NO: 1499070 - DNA, 15 bp, Homo sapiens
gaagtcatgaagccc

SEQ ID NO: 1499071 - DNA, 13 bp, Homo sapiens
gaagtccaggact

SEQ ID NO: 1499072 - DNA, 20 bp, Homo sapiens
gaagtccaggactgggtctg

SEQ ID NO: 1499073 - DNA, 21 bp, Homo sapiens
gaagtcctccctcctgcaggc

SEQ ID NO: 1499074 - DNA, 15 bp, Homo sapiens
gaagtctaggagctg

SEQ ID NO: 1499075 - DNA, 13 bp, Homo sapiens
gaagtctccctgc

SEQ ID NO: 1499076 - DNA, 23 bp, Homo sapiens
gaagtctctttttttggcccagg

SEQ ID NO: 1499077 - DNA, 15 bp, Homo sapiens
gaagtcttagatgta

SEQ ID NO: 1499078 - DNA, 18 bp, Homo sapiens
gaagtcttagatgtatat

SEQ ID NO: 1499079 - DNA, 22 bp, Homo sapiens
gaagtcttatcttctgcagtga

SEQ ID NO: 1499080 - DNA, 15 bp, Homo sapiens
gaagtgaagaatgca

SEQ ID NO: 1499081 - DNA, 14 bp, Homo sapiens
gaagtgaggcccaa

SEQ ID NO: 1499082 - DNA, 20 bp, Homo sapiens
gaagtgaggcccaaggagct

SEQ ID NO: 1499083 - DNA, 19 bp, Homo sapiens
gaagtgagtttgtaaatat

SEQ ID NO: 1499084 - DNA, 20 bp, Homo sapiens
gaagtgagtttgtaaatatt

SEQ ID NO: 1499085 - DNA, 18 bp, Homo sapiens
gaagtgatatggtgaagg

SEQ ID NO: 1499086 - DNA, 22 bp, Homo sapiens
gaagtgatatggtgaagggaag

SEQ ID NO: 1499087 - DNA, 15 bp, Homo sapiens
gaagtgattctaaga

SEQ ID NO: 1499088 - DNA, 18 bp, Homo sapiens
gaagtgattctaagattt

SEQ ID NO: 1499089 - DNA, 16 bp, Homo sapiens
gaagtgcacaggagcc

SEQ ID NO: 1499090 - DNA, 14 bp, Homo sapiens
gaagtgcccagccc

SEQ ID NO: 1499091 - DNA, 17 bp, Homo sapiens
gaagtgcccagcccctg

SEQ ID NO: 1499092 - DNA, 18 bp, Homo sapiens
gaagtgcccagcccctgc

SEQ ID NO: 1499093 - DNA, 12 bp, Homo sapiens
gaagtgctccct

SEQ ID NO: 1499094 - DNA, 20 bp, Homo sapiens
gaagtgctggcaaccactaa

SEQ ID NO: 1499095 - DNA, 20 bp, Homo sapiens
gaagtgctgtttattaatct

SEQ ID NO: 1499096 - DNA, 21 bp, Homo sapiens
gaagtgcttagtgtacttgga

SEQ ID NO: 1499097 - DNA, 19 bp, Homo sapiens
gaagtggggtgttcttctt

SEQ ID NO: 1499098 - DNA, 13 bp, Homo sapiens
gaagtggtccaga

SEQ ID NO: 1499099 - DNA, 23 bp, Homo sapiens
gaagtgtaacagctgaggtctct

SEQ ID NO: 1499100 - DNA, 17 bp, Homo sapiens
gaagtgtctgccagctg

SEQ ID NO: 1499101 - DNA, 18 bp, Homo sapiens
gaagtgtgggtctgtgtg

SEQ ID NO: 1499102 - DNA, 21 bp, Homo sapiens
gaagtgtgggtctgtgtgtgt

SEQ ID NO: 1499103 - DNA, 10 bp, Homo sapiens
gaagtgttca

SEQ ID NO: 1499104 - DNA, 15 bp, Homo sapiens
gaagtgttctctaga

SEQ ID NO: 1499105 - DNA, 18 bp, Homo sapiens
gaagtgttgaagggaggt

SEQ ID NO: 1499106 - DNA, 21 bp, Homo sapiens
gaagttaaaaaacagctgcat

SEQ ID NO: 1499107 - DNA, 12 bp, Homo sapiens
gaagttaaaggg

SEQ ID NO: 1499108 - DNA, 23 bp, Homo sapiens
gaagttacacagaaatgctgctg

SEQ ID NO: 1499109 - DNA, 16 bp, Homo sapiens
gaagttactgaatgca

SEQ ID NO: 1499110 - DNA, 15 bp, Homo sapiens
gaagttagtggaaat

SEQ ID NO: 1499111 - DNA, 14 bp, Homo sapiens
gaagttcatcttgc

SEQ ID NO: 1499112 - DNA, 18 bp, Homo sapiens
gaagttctcagaataact

SEQ ID NO: 1499113 - DNA, 17 bp, Homo sapiens
gaagttctccagcttca

SEQ ID NO: 1499114 - DNA, 13 bp, Homo sapiens
gaagttctgagcc

SEQ ID NO: 1499115 - DNA, 16 bp, Homo sapiens
gaagtttacattgtaa

SEQ ID NO: 1499116 - DNA, 17 bp, Homo sapiens
gaagtttacattgtaaa

SEQ ID NO: 1499117 - DNA, 21 bp, Homo sapiens
gaagtttcaagttttaaagtt

SEQ ID NO: 1499118 - DNA, 22 bp, Homo sapiens
gaagtttcaagttttaaagttc

SEQ ID NO: 1499119 - DNA, 15 bp, Homo sapiens
gaagtttgtagccag

SEQ ID NO: 1499120 - DNA, 21 bp, Homo sapiens
gaagtttgtgttctgtttgtt

SEQ ID NO: 1499121 - DNA, 22 bp, Homo sapiens
gaagttttaactttaatacagc

SEQ ID NO: 1499122 - DNA, 17 bp, Homo sapiens
gaagttttgcatttatg

SEQ ID NO: 1499123 - DNA, 14 bp, Homo sapiens
gaagttttttctac

SEQ ID NO: 1499124 - DNA, 14 bp, Homo sapiens
gaataaaagctata

SEQ ID NO: 1499125 - DNA, 21 bp, Homo sapiens
gaataaaaggcttgaagctgt

SEQ ID NO: 1499126 - DNA, 14 bp, Homo sapiens
gaataaaattccta

SEQ ID NO: 1499127 - DNA, 14 bp, Homo sapiens
gaataaagacacct

SEQ ID NO: 1499128 - DNA, 11 bp, Homo sapiens
gaataaagcaa

SEQ ID NO: 1499129 - DNA, 13 bp, Homo sapiens
gaataaagcaatt

SEQ ID NO: 1499130 - DNA, 15 bp, Homo sapiens
gaataaaggcagttt

SEQ ID NO: 1499131 - DNA, 14 bp, Homo sapiens
gaataaagttctga

SEQ ID NO: 1499132 - DNA, 22 bp, Homo sapiens
gaataaataaagaagaaaataa

SEQ ID NO: 1499133 - DNA, 21 bp, Homo sapiens
gaataaattggattattttct

SEQ ID NO: 1499134 - DNA, 13 bp, Homo sapiens
gaataacactgca

SEQ ID NO: 1499135 - DNA, 13 bp, Homo sapiens
gaataactacctc

SEQ ID NO: 1499136 - DNA, 22 bp, Homo sapiens
gaataagacaagagatctacac

SEQ ID NO: 1499137 - DNA, 19 bp, Homo sapiens
gaataaggaggaggaggga

SEQ ID NO: 1499138 - DNA, 12 bp, Homo sapiens
gaataaggccca

SEQ ID NO: 1499139 - DNA, 14 bp, Homo sapiens
gaataataaatatt

SEQ ID NO: 1499140 - DNA, 22 bp, Homo sapiens
gaataataattatccagagttt

SEQ ID NO: 1499141 - DNA, 15 bp, Homo sapiens
gaataatagaagaac

SEQ ID NO: 1499142 - DNA, 20 bp, Homo sapiens
gaataatgaaaataaaacac

SEQ ID NO: 1499143 - DNA, 14 bp, Homo sapiens
gaataattacagtg

SEQ ID NO: 1499144 - DNA, 21 bp, Homo sapiens
gaataatttcccaattaggaa

SEQ ID NO: 1499145 - DNA, 23 bp, Homo sapiens
gaataatttcccaattaggaagt

SEQ ID NO: 1499146 - DNA, 23 bp, Homo sapiens
gaatacagggcatgcattttgca

SEQ ID NO: 1499147 - DNA, 19 bp, Homo sapiens
gaatacatcagaaaataaa

SEQ ID NO: 1499148 - DNA, 20 bp, Homo sapiens
gaatacatcagaaaataaaa

SEQ ID NO: 1499149 - DNA, 15 bp, Homo sapiens
gaatacattctttgc

SEQ ID NO: 1499150 - DNA, 16 bp, Homo sapiens
gaatacatttgtattt

SEQ ID NO: 1499151 - DNA, 16 bp, Homo sapiens
gaataccacatcaaat

SEQ ID NO: 1499152 - DNA, 14 bp, Homo sapiens
gaatcttctgggta

SEQ ID NO: 1499153 - DNA, 17 bp, Homo sapiens
gaatcttgactttctga

SEQ ID NO: 1499154 - DNA, 13 bp, Homo sapiens
gaatctttaatta

SEQ ID NO: 1499155 - DNA, 18 bp, Homo sapiens
gaatctttaattaaaacc

SEQ ID NO: 1499156 - DNA, 15 bp, Homo sapiens
gaatgaaagctgttc

SEQ ID NO: 1499157 - DNA, 20 bp, Homo sapiens
gaatgaaattaacacaaagg

SEQ ID NO: 1499158 - DNA, 13 bp, Homo sapiens
gaatgaacactat

SEQ ID NO: 1499159 - DNA, 14 bp, Homo sapiens
gaatgaataactaa

SEQ ID NO: 1499160 - DNA, 14 bp, Homo sapiens
gaatgaattaaata

SEQ ID NO: 1499161 - DNA, 17 bp, Homo sapiens
gaatgagagcgacacag

SEQ ID NO: 1499162 - DNA, 18 bp, Homo sapiens
gaatgagagcgacacaga

SEQ ID NO: 1499163 - DNA, 19 bp, Homo sapiens
gaatgagagcgacacagac

SEQ ID NO: 1499164 - DNA, 17 bp, Homo sapiens
gaatgagagttccttct

SEQ ID NO: 1499165 - DNA, 23 bp, Homo sapiens
gaatgaggaaaattcttaaaagg

SEQ ID NO: 1499166 - DNA, 17 bp, Homo sapiens
gaatgaggtcccaggca

SEQ ID NO: 1499167 - DNA, 19 bp, Homo sapiens
gaatgaggtcccaggcaga

SEQ ID NO: 1499168 - DNA, 22 bp, Homo sapiens
gaatgaggtgggaggtggaaga

SEQ ID NO: 1499169 - DNA, 14 bp, Homo sapiens
gaatgagtgggaat

SEQ ID NO: 1499170 - DNA, 23 bp, Homo sapiens
gaatgattctaatttttaagcaa

SEQ ID NO: 1499171 - DNA, 20 bp, Homo sapiens
gaatgatttccaaagagaaa

SEQ ID NO: 1499172 - DNA, 18 bp, Homo sapiens
gaatgcacaagaatggat

SEQ ID NO: 1499173 - DNA, 20 bp, Homo sapiens
gaatgcacaagaatggatca

SEQ ID NO: 1499174 - DNA, 21 bp, Homo sapiens
gaatgcagaaaacagggtctg

SEQ ID NO: 1499175 - DNA, 19 bp, Homo sapiens
gaatgcagattcctgggcc

SEQ ID NO: 1499176 - DNA, 17 bp, Homo sapiens
gaatgcagggaagaggg

SEQ ID NO: 1499177 - DNA, 21 bp, Homo sapiens
gaatgccactgccttcgcttc

SEQ ID NO: 1499178 - DNA, 22 bp, Homo sapiens
gaatgcccacaggcaaatgcat

SEQ ID NO: 1499179 - DNA, 21 bp, Homo sapiens
gaatgcctcgctcccttcaag

SEQ ID NO: 1499180 - DNA, 13 bp, Homo sapiens
gaatgcctgtgcc

SEQ ID NO: 1499181 - DNA, 15 bp, Homo sapiens
gaatgcctgtgccaa

SEQ ID NO: 1499182 - DNA, 12 bp, Homo sapiens
gaatgctcaggg

SEQ ID NO: 1499183 - DNA, 13 bp, Homo sapiens
gaatgctgggact

SEQ ID NO: 1499184 - DNA, 16 bp, Homo sapiens
gaatgctgggactcag

SEQ ID NO: 1499185 - DNA, 17 bp, Homo sapiens
gaatgctggttttccta

SEQ ID NO: 1499186 - DNA, 13 bp, Homo sapiens
gaatgctgtgtta

SEQ ID NO: 1499187 - DNA, 11 bp, Homo sapiens
gaatgctttgc

SEQ ID NO: 1499188 - DNA, 22 bp, Homo sapiens
gaatggaagggttctggctgcc

SEQ ID NO: 1499189 - DNA, 11 bp, Homo sapiens
gaatggagcag

SEQ ID NO: 1499190 - DNA, 14 bp, Homo sapiens
gaatggaggcaggg

SEQ ID NO: 1499191 - DNA, 22 bp, Homo sapiens
gaatggagggcaacattccaca

SEQ ID NO: 1499192 - DNA, 19 bp, Homo sapiens
gaatggatcacaagatgga

SEQ ID NO: 1499193 - DNA, 15 bp, Homo sapiens
gaatggatggggaga

SEQ ID NO: 1499194 - DNA, 14 bp, Homo sapiens
gaatggcagtcctg

SEQ ID NO: 1499195 - DNA, 18 bp, Homo sapiens
gaatggccctagaactgt

SEQ ID NO: 1499196 - DNA, 21 bp, Homo sapiens
gaatggcctgccttgaagcca

SEQ ID NO: 1499197 - DNA, 22 bp, Homo sapiens
gaatgggagccagaattcacta

SEQ ID NO: 1499198 - DNA, 14 bp, Homo sapiens
gaatggtctttgct

SEQ ID NO: 1499199 - DNA, 19 bp, Homo sapiens
gaatggtctttgctccaga

SEQ ID NO: 1499200 - DNA, 22 bp, Homo sapiens
gaatggtctttgctccagataa

SEQ ID NO: 1499201 - DNA, 20 bp, Homo sapiens
gaatggttccatgcctgagg

SEQ ID NO: 1499202 - DNA, 15 bp, Homo sapiens
gaatgtaactgctga

SEQ ID NO: 1499203 - DNA, 18 bp, Homo sapiens
gaatgtaagaactacaaa

SEQ ID NO: 1499204 - DNA, 13 bp, Homo sapiens
gaatgtaatcaat

SEQ ID NO: 1499205 - DNA, 16 bp, Homo sapiens
gaatgtaatcaatgtt

SEQ ID NO: 1499206 - DNA, 18 bp, Homo sapiens
gaatgtaatcaatgtttc

SEQ ID NO: 1499207 - DNA, 13 bp, Homo sapiens
gaatgtactatgt

SEQ ID NO: 1499208 - DNA, 14 bp, Homo sapiens
gaatgtactctgtt

SEQ ID NO: 1499209 - DNA, 22 bp, Homo sapiens
gacaccttctgagtattctcat

SEQ ID NO: 1499210 - DNA, 20 bp, Homo sapiens
gacacgagccacaagctgca

SEQ ID NO: 1499211 - DNA, 17 bp, Homo sapiens
gacacgccttcccctca

SEQ ID NO: 1499212 - DNA, 14 bp, Homo sapiens
gacacgcgctctcc

SEQ ID NO: 1499213 - DNA, 22 bp, Homo sapiens
gacacgcgctctccaccaccca

SEQ ID NO: 1499214 - DNA, 16 bp, Homo sapiens
gacacggcttcactga

SEQ ID NO: 1499215 - DNA, 17 bp, Homo sapiens
gacacgtggcctcgtga

SEQ ID NO: 1499216 - DNA, 16 bp, Homo sapiens
gacacgtggcctgcac

SEQ ID NO: 1499217 - DNA, 21 bp, Homo sapiens
gacacgtgtggcgggcagtgg

SEQ ID NO: 1499218 - DNA, 20 bp, Homo sapiens
gacactaagttatagtatat

SEQ ID NO: 1499219 - DNA, 14 bp, Homo sapiens
gacactagaaaact

SEQ ID NO: 1499220 - DNA, 13 bp, Homo sapiens
gacactatatctg

SEQ ID NO: 1499221 - DNA, 14 bp, Homo sapiens
gacactctatatgt

SEQ ID NO: 1499222 - DNA, 15 bp, Homo sapiens
gacactctgctctgc

SEQ ID NO: 1499223 - DNA, 20 bp, Homo sapiens
gacactgaaagttttgtaaa

SEQ ID NO: 1499224 - DNA, 20 bp, Homo sapiens
gacactgctctaacagccct

SEQ ID NO: 1499225 - DNA, 21 bp, Homo sapiens
gacactgctctaacagccctc

SEQ ID NO: 1499226 - DNA, 12 bp, Homo sapiens
gacactgctgca

SEQ ID NO: 1499227 - DNA, 16 bp, Homo sapiens
gacactgctgcaccag

SEQ ID NO: 1499228 - DNA, 13 bp, Homo sapiens
gacactggcccct

SEQ ID NO: 1499229 - DNA, 14 bp, Homo sapiens
gacactggcccctc

SEQ ID NO: 1499230 - DNA, 15 bp, Homo sapiens
gacactggcccctca

SEQ ID NO: 1499231 - DNA, 16 bp, Homo sapiens
gacactgggcagcaag

SEQ ID NO: 1499232 - DNA, 17 bp, Homo sapiens
gacactgggcagcaagg

SEQ ID NO: 1499233 - DNA, 19 bp, Homo sapiens
gacactggtttacacttta

SEQ ID NO: 1499234 - DNA, 23 bp, Homo sapiens
gacactggtttacactttatgcc

SEQ ID NO: 1499235 - DNA, 23 bp, Homo sapiens
gacactgtgcccagcccggacct

SEQ ID NO: 1499236 - DNA, 19 bp, Homo sapiens
gacactgtttggcctttct

SEQ ID NO: 1499237 - DNA, 12 bp, Homo sapiens
gacacttcagat

SEQ ID NO: 1499238 - DNA, 14 bp, Homo sapiens
gacacttcagatct

SEQ ID NO: 1499239 - DNA, 15 bp, Homo sapiens
gacactttgaaatgt

SEQ ID NO: 1499240 - DNA, 18 bp, Homo sapiens
gacactttgaaatgtgtt

SEQ ID NO: 1499241 - DNA, 19 bp, Homo sapiens
gacactttgaaatgtgttt

SEQ ID NO: 1499242 - DNA, 21 bp, Homo sapiens
gacagaaaagtgcctgagctg

SEQ ID NO: 1499243 - DNA, 13 bp, Homo sapiens
gacagaaaatatg

SEQ ID NO: 1499244 - DNA, 22 bp, Homo sapiens
gacagaaaatatgtattaacac

SEQ ID NO: 1499245 - DNA, 20 bp, Homo sapiens
gacagaacccctacatgaaa

SEQ ID NO: 1499246 - DNA, 16 bp, Homo sapiens
gacagaaggactggtg

SEQ ID NO: 1499247 - DNA, 18 bp, Homo sapiens
gacagaaggactggtgcg

SEQ ID NO: 1499248 - DNA, 20 bp, Homo sapiens
gacagaattctcccagcgtt

SEQ ID NO: 1499249 - DNA, 14 bp, Homo sapiens
gacagacaggctct

SEQ ID NO: 1499250 - DNA, 21 bp, Homo sapiens
gacagacaggctcttagcagc

SEQ ID NO: 1499251 - DNA, 20 bp, Homo sapiens
gacagacttcacagcgtctg

SEQ ID NO: 1499252 - DNA, 18 bp, Homo sapiens
gacagacttgagaacttg

SEQ ID NO: 1499253 - DNA, 16 bp, Homo sapiens
gacagagacacctgca

SEQ ID NO: 1499254 - DNA, 19 bp, Homo sapiens
gagccagatgcctccccaa

SEQ ID NO: 1499255 - DNA, 18 bp, Homo sapiens
gagccagcagggctgtga

SEQ ID NO: 1499256 - DNA, 16 bp, Homo sapiens
gagccagccctccctg

SEQ ID NO: 1499257 - DNA, 20 bp, Homo sapiens
gagccagccctccctgtcct

SEQ ID NO: 1499258 - DNA, 13 bp, Homo sapiens
gagccagcctggc

SEQ ID NO: 1499259 - DNA, 22 bp, Homo sapiens
gagccagcctggctctgccccc

SEQ ID NO: 1499260 - DNA, 13 bp, Homo sapiens
gagccagctccct

SEQ ID NO: 1499261 - DNA, 23 bp, Homo sapiens
gagccagctgcttgacctagctc

SEQ ID NO: 1499262 - DNA, 21 bp, Homo sapiens
gagccaggagaagctcagctg

SEQ ID NO: 1499263 - DNA, 13 bp, Homo sapiens
gagccaggagacc

SEQ ID NO: 1499264 - DNA, 15 bp, Homo sapiens
gagccaggagtaaga

SEQ ID NO: 1499265 - DNA, 16 bp, Homo sapiens
gagccaggatgcccag

SEQ ID NO: 1499266 - DNA, 19 bp, Homo sapiens
gagccagggaacagcccca

SEQ ID NO: 1499267 - DNA, 23 bp, Homo sapiens
gagccagttgtcctatggacaac

SEQ ID NO: 1499268 - DNA, 19 bp, Homo sapiens
gagccatataagtttgaag

SEQ ID NO: 1499269 - DNA, 18 bp, Homo sapiens
gagccatcactagaagaa

SEQ ID NO: 1499270 - DNA, 21 bp, Homo sapiens
gagccatcactagaagaaaag

SEQ ID NO: 1499271 - DNA, 20 bp, Homo sapiens
gagccatcccttcggagcca

SEQ ID NO: 1499272 - DNA, 20 bp, Homo sapiens
gagcctgcagggtggtgctg

SEQ ID NO: 1499273 - DNA, 12 bp, Homo sapiens
gagcctgccaag

SEQ ID NO: 1499274 - DNA, 17 bp, Homo sapiens
gagcctgctcccccacc

SEQ ID NO: 1499275 - DNA, 11 bp, Homo sapiens
gagcctgctgg

SEQ ID NO: 1499276 - DNA, 15 bp, Homo sapiens
gagcctgctggaagc

SEQ ID NO: 1499277 - DNA, 12 bp, Homo sapiens
gagcctgctggc

SEQ ID NO: 1499278 - DNA, 19 bp, Homo sapiens
gagcctggcacaggactga

SEQ ID NO: 1499279 - DNA, 16 bp, Homo sapiens
gagcctggctgcccat

SEQ ID NO: 1499280 - DNA, 19 bp, Homo sapiens
gagcctgtcaccagagctt

SEQ ID NO: 1499281 - DNA, 19 bp, Homo sapiens
gagcctgtctttcagcatt

SEQ ID NO: 1499282 - DNA, 18 bp, Homo sapiens
gagcctgtgcgtcccagc

SEQ ID NO: 1499283 - DNA, 23 bp, Homo sapiens
gagccttaacttcttaaaccatt

SEQ ID NO: 1499284 - DNA, 13 bp, Homo sapiens
gagccttcaagtg

SEQ ID NO: 1499285 - DNA, 19 bp, Homo sapiens
gagccttcaagtgccaaac

SEQ ID NO: 1499286 - DNA, 21 bp, Homo sapiens
gagccttcagaatgctcctga

SEQ ID NO: 1499287 - DNA, 23 bp, Homo sapiens
gagccttcctttctcctgcccca

SEQ ID NO: 1499288 - DNA, 13 bp, Homo sapiens
gagccttctcaga

SEQ ID NO: 1499289 - DNA, 22 bp, Homo sapiens
gagccttggtgtccacctggcc

SEQ ID NO: 1499290 - DNA, 23 bp, Homo sapiens
gagcctttggttctggccagaat

SEQ ID NO: 1499291 - DNA, 13 bp, Homo sapiens
gagccttttgctc

SEQ ID NO: 1499292 - DNA, 18 bp, Homo sapiens
gagccttttgctctctgt

SEQ ID NO: 1499293 - DNA, 20 bp, Homo sapiens
gagcctttttaaaacacatg

SEQ ID NO: 1499294 - DNA, 21 bp, Homo sapiens
gagcgaagggggtcaaaggaa

SEQ ID NO: 1499295 - DNA, 20 bp, Homo sapiens
gagcgacgtttatttcatct

SEQ ID NO: 1499296 - DNA, 16 bp, Homo sapiens
ctttttaaatgtgaat

SEQ ID NO: 1499297 - DNA, 21 bp, Homo sapiens
ctttttaaccctaatctttca

SEQ ID NO: 1499298 - DNA, 17 bp, Homo sapiens
ctttttaataaaaatac

SEQ ID NO: 1499299 - DNA, 19 bp, Homo sapiens
ctttttaataaaaatacac

SEQ ID NO: 1499300 - DNA, 17 bp, Homo sapiens
ctttttaatagcactaa

SEQ ID NO: 1499301 - DNA, 15 bp, Homo sapiens
ctttttaatatgctt

SEQ ID NO: 1499302 - DNA, 22 bp, Homo sapiens
ctttttaatattgatatgctta

SEQ ID NO: 1499303 - DNA, 19 bp, Homo sapiens
ctttttacagcattgtctt

SEQ ID NO: 1499304 - DNA, 21 bp, Homo sapiens
ctttttacagcattgtctttg

SEQ ID NO: 1499305 - DNA, 13 bp, Homo sapiens
ctttttactgttg

SEQ ID NO: 1499306 - DNA, 14 bp, Homo sapiens
ctttttactgttga

SEQ ID NO: 1499307 - DNA, 16 bp, Homo sapiens
ctttttactgttgaac

SEQ ID NO: 1499308 - DNA, 20 bp, Homo sapiens
ctttttagatgtatttttga

SEQ ID NO: 1499309 - DNA, 15 bp, Homo sapiens
ctttttatgctattt

SEQ ID NO: 1499310 - DNA, 23 bp, Homo sapiens
ctttttatgctatttctgtatat

SEQ ID NO: 1499311 - DNA, 13 bp, Homo sapiens
ctttttatttata

SEQ ID NO: 1499312 - DNA, 14 bp, Homo sapiens
ctttttatttgcat

SEQ ID NO: 1499313 - DNA, 15 bp, Homo sapiens
ctttttcactttgaa

SEQ ID NO: 1499314 - DNA, 15 bp, Homo sapiens
ctttttcatttatct

SEQ ID NO: 1499315 - DNA, 22 bp, Homo sapiens
ctttttcatttttttctctctg

SEQ ID NO: 1499316 - DNA, 13 bp, Homo sapiens
ctttttccagagg

SEQ ID NO: 1499317 - DNA, 16 bp, Homo sapiens
ctttttcccaataaat

SEQ ID NO: 1499318 - DNA, 19 bp, Homo sapiens
ctttttctgaactccattt

SEQ ID NO: 1499319 - DNA, 22 bp, Homo sapiens
ctttttctggactgaagcctgc

SEQ ID NO: 1499320 - DNA, 13 bp, Homo sapiens
ctttttcttccct

SEQ ID NO: 1499321 - DNA, 15 bp, Homo sapiens
ctttttcttcttccc

SEQ ID NO: 1499322 - DNA, 22 bp, Homo sapiens
ctttttgaaatcacctggtatt

SEQ ID NO: 1499323 - DNA, 15 bp, Homo sapiens
ctttttgaatcttta

SEQ ID NO: 1499324 - DNA, 17 bp, Homo sapiens
ctttttgaatctttaat

SEQ ID NO: 1499325 - DNA, 13 bp, Homo sapiens
ctttttgacactg

SEQ ID NO: 1499326 - DNA, 14 bp, Homo sapiens
ctttttgacactga

SEQ ID NO: 1499327 - DNA, 20 bp, Homo sapiens
ctttttgcatgatatcttca

SEQ ID NO: 1499328 - DNA, 23 bp, Homo sapiens
ctttttgccagttttccctggaa

SEQ ID NO: 1499329 - DNA, 16 bp, Homo sapiens
ctttttgctctaaaat

SEQ ID NO: 1499330 - DNA, 17 bp, Homo sapiens
ctttttgcttctacttt

SEQ ID NO: 1499331 - DNA, 18 bp, Homo sapiens
ctttttgcttctactttc

SEQ ID NO: 1499332 - DNA, 12 bp, Homo sapiens
ctttttggaatc

SEQ ID NO: 1499333 - DNA, 18 bp, Homo sapiens
ctttttggaatctttgta

SEQ ID NO: 1499334 - DNA, 18 bp, Homo sapiens
ctttttgtataaaataga

SEQ ID NO: 1499335 - DNA, 15 bp, Homo sapiens
ctttttgtgtttttt

SEQ ID NO: 1499336 - DNA, 13 bp, Homo sapiens
cttttttcaaaat

SEQ ID NO: 1499337 - DNA, 14 bp, Homo sapiens
cttttttcaaaatc

SEQ ID NO: 1499338 - DNA, 22 bp, Homo sapiens
cttttttcaaaatccaaaaaga

SEQ ID NO: 1499339 - DNA, 13 bp, Homo sapiens
cttttttcctaat

SEQ ID NO: 1499340 - DNA, 17 bp, Homo sapiens
cttttttgataaagttt

SEQ ID NO: 1499341 - DNA, 21 bp, Homo sapiens
cttttttgataaagtttctca

SEQ ID NO: 1499342 - DNA, 14 bp, Homo sapiens
cttttttgtctatg

SEQ ID NO: 1499343 - DNA, 19 bp, Homo sapiens
cttttttgtggcaattagt

SEQ ID NO: 1499344 - DNA, 12 bp, Homo sapiens
cttttttgtgta

SEQ ID NO: 1499345 - DNA, 20 bp, Homo sapiens
cttttttgtgtttttaaaag

SEQ ID NO: 1499346 - DNA, 15 bp, Homo sapiens
ctttttttaactggt

SEQ ID NO: 1499347 - DNA, 19 bp, Homo sapiens
ctttttttaactggtgaag

SEQ ID NO: 1499348 - DNA, 16 bp, Homo sapiens
ctttttttacatttca

SEQ ID NO: 1499349 - DNA, 15 bp, Homo sapiens
ctttttttcttaaaa

SEQ ID NO: 1499350 - DNA, 15 bp, Homo sapiens
ctttttttctttggt

SEQ ID NO: 1499351 - DNA, 15 bp, Homo sapiens
ctttttttggcccag

SEQ ID NO: 1499352 - DNA, 16 bp, Homo sapiens
ctttttttggcccagg

SEQ ID NO: 1499353 - DNA, 12 bp, Homo sapiens
ctttttttgtat

SEQ ID NO: 1499354 - DNA, 13 bp, Homo sapiens
ctttttttgtgtg

SEQ ID NO: 1499355 - DNA, 16 bp, Homo sapiens
cttttttttaaaaaaa

SEQ ID NO: 1499356 - DNA, 14 bp, Homo sapiens
cttttttttccttt

SEQ ID NO: 1499357 - DNA, 18 bp, Homo sapiens
cttttttttcctttgaac

SEQ ID NO: 1499358 - DNA, 14 bp, Homo sapiens
ctttttttttaagt

SEQ ID NO: 1499359 - DNA, 17 bp, Homo sapiens
ctttttttttctctttc

SEQ ID NO: 1499360 - DNA, 22 bp, Homo sapiens
ctttttttttctctttctctcc

SEQ ID NO: 1499361 - DNA, 16 bp, Homo sapiens
cttttttttttcttgg

SEQ ID NO: 1499362 - DNA, 17 bp, Homo sapiens
ctttttttttttctgcc

SEQ ID NO: 1499363 - DNA, 18 bp, Homo sapiens
ctttttttttttctgcct

SEQ ID NO: 1499364 - DNA, 19 bp, Homo sapiens
ctttttttttttctgcctg

SEQ ID NO: 1499365 - DNA, 20 bp, Homo sapiens
ctttttttttttctgcctga

SEQ ID NO: 1499366 - DNA, 22 bp, Homo sapiens
ctttttttttttctgcctgaga

SEQ ID NO: 1499367 - DNA, 22 bp, Homo sapiens
ctttttttttttttaaagacag

SEQ ID NO: 1499368 - DNA, 16 bp, Homo sapiens
ctttttttttttttcc

SEQ ID NO: 1499369 - DNA, 17 bp, Homo sapiens
ctttttttttttttccc

SEQ ID NO: 1499370 - DNA, 17 bp, Homo sapiens
gaaaaaaaaaacacttg

SEQ ID NO: 1499371 - DNA, 16 bp, Homo sapiens
gaaaaaaaacagtgga

SEQ ID NO: 1499372 - DNA, 13 bp, Homo sapiens
gaaaaaaaacctt

SEQ ID NO: 1499373 - DNA, 14 bp, Homo sapiens
gaaaaaaaaccttg

SEQ ID NO: 1499374 - DNA, 15 bp, Homo sapiens
gaaaaaaaaccttgt

SEQ ID NO: 1499375 - DNA, 16 bp, Homo sapiens
gaaaaaaaaccttgta

SEQ ID NO: 1499376 - DNA, 20 bp, Homo sapiens
gaaaaaaaagtgtctcaaag

SEQ ID NO: 1499377 - DNA, 22 bp, Homo sapiens
gaaaaaaaagtttcagagaagt

SEQ ID NO: 1499378 - DNA, 20 bp, Homo sapiens
gaaaaaaaataacacagaga

SEQ ID NO: 1499379 - DNA, 14 bp, Homo sapiens
gaaaaaaaatgtag

SEQ ID NO: 1499380 - DNA, 21 bp, Homo sapiens
gaaaaaaaccacacaaagaca

SEQ ID NO: 1499381 - DNA, 17 bp, Homo sapiens
gaaaaaaagggagaata

SEQ ID NO: 1499382 - DNA, 18 bp, Homo sapiens
gaaaaaaagtttgccaga

SEQ ID NO: 1499383 - DNA, 11 bp, Homo sapiens
gaaaaaacaat

SEQ ID NO: 1499384 - DNA, 19 bp, Homo sapiens
gaaaaaagaaccaaaactt

SEQ ID NO: 1499385 - DNA, 17 bp, Homo sapiens
gaaaaaagtccagattg

SEQ ID NO: 1499386 - DNA, 17 bp, Homo sapiens
gaaaaaagttccttcct

SEQ ID NO: 1499387 - DNA, 15 bp, Homo sapiens
gaaaaaataaaaaga

SEQ ID NO: 1499388 - DNA, 12 bp, Homo sapiens
gaaaaaatatat

SEQ ID NO: 1499389 - DNA, 19 bp, Homo sapiens
gaaaaaattgaaagaactt

SEQ ID NO: 1499390 - DNA, 15 bp, Homo sapiens
gaaaaacaattttct

SEQ ID NO: 1499391 - DNA, 15 bp, Homo sapiens
gaaaaacatgtcatg

SEQ ID NO: 1499392 - DNA, 16 bp, Homo sapiens
gaaaaacatgtcatgt

SEQ ID NO: 1499393 - DNA, 23 bp, Homo sapiens
gaaaaactgatcaaaaataaact

SEQ ID NO: 1499394 - DNA, 22 bp, Homo sapiens
gaaaaagaaatgcaaaaatctc

SEQ ID NO: 1499395 - DNA, 23 bp, Homo sapiens
gaaaaagaaggactgaactccat

SEQ ID NO: 1499396 - DNA, 12 bp, Homo sapiens
gaaaaagcatga

SEQ ID NO: 1499397 - DNA, 19 bp, Homo sapiens
gaaaaagccaaaattgtca

SEQ ID NO: 1499398 - DNA, 12 bp, Homo sapiens
gaaaaaggcagt

SEQ ID NO: 1499399 - DNA, 23 bp, Homo sapiens
gaaaaagggattgaggagttgcc

SEQ ID NO: 1499400 - DNA, 19 bp, Homo sapiens
gaaaaagttaaacattgaa

SEQ ID NO: 1499401 - DNA, 16 bp, Homo sapiens
gaaaaataacaactat

SEQ ID NO: 1499402 - DNA, 13 bp, Homo sapiens
gagctggaagggg

SEQ ID NO: 1499403 - DNA, 22 bp, Homo sapiens
gagctggatagacttgggatgg

SEQ ID NO: 1499404 - DNA, 18 bp, Homo sapiens
gagctggcaaccagccag

SEQ ID NO: 1499405 - DNA, 19 bp, Homo sapiens
gagctggccaaagagcctt

SEQ ID NO: 1499406 - DNA, 15 bp, Homo sapiens
gagctggcccagggg

SEQ ID NO: 1499407 - DNA, 23 bp, Homo sapiens
gagctggccccgcttggtggcct

SEQ ID NO: 1499408 - DNA, 21 bp, Homo sapiens
gagctggcctgtggcacagcc

SEQ ID NO: 1499409 - DNA, 14 bp, Homo sapiens
gagctggctggcag

SEQ ID NO: 1499410 - DNA, 15 bp, Homo sapiens
gagctggctggcagg

SEQ ID NO: 1499411 - DNA, 17 bp, Homo sapiens
gagctggctggcaggtg

SEQ ID NO: 1499412 - DNA, 14 bp, Homo sapiens
gagctgggaggaaa

SEQ ID NO: 1499413 - DNA, 16 bp, Homo sapiens
gagctgggcaggaagg

SEQ ID NO: 1499414 - DNA, 13 bp, Homo sapiens
gagctgggcccct

SEQ ID NO: 1499415 - DNA, 16 bp, Homo sapiens
gagctgggcccgacat

SEQ ID NO: 1499416 - DNA, 19 bp, Homo sapiens
gagctgggcccgacatggc

SEQ ID NO: 1499417 - DNA, 23 bp, Homo sapiens
gagctgggcccgacatggctccg

SEQ ID NO: 1499418 - DNA, 21 bp, Homo sapiens
gagctggggaccagcagtctg

SEQ ID NO: 1499419 - DNA, 13 bp, Homo sapiens
gagctggggacct

SEQ ID NO: 1499420 - DNA, 19 bp, Homo sapiens
gagctggggacctggtacc

SEQ ID NO: 1499421 - DNA, 17 bp, Homo sapiens
gagctggggactcaggg

SEQ ID NO: 1499422 - DNA, 19 bp, Homo sapiens
gagctggggactcagggac

SEQ ID NO: 1499423 - DNA, 20 bp, Homo sapiens
gagctgggggaaggcaggag

SEQ ID NO: 1499424 - DNA, 22 bp, Homo sapiens
gagctgggggaaggcaggagcc

SEQ ID NO: 1499425 - DNA, 17 bp, Homo sapiens
gagctgtcgctgcctcc

SEQ ID NO: 1499426 - DNA, 22 bp, Homo sapiens
gagctgtcttcctgtgtacctc

SEQ ID NO: 1499427 - DNA, 11 bp, Homo sapiens
gagctgtgcca

SEQ ID NO: 1499428 - DNA, 22 bp, Homo sapiens
gagctgttcacagccagactgg

SEQ ID NO: 1499429 - DNA, 17 bp, Homo sapiens
gagctgttggaagaaaa

SEQ ID NO: 1499430 - DNA, 14 bp, Homo sapiens
gagctgttgtgagc

SEQ ID NO: 1499431 - DNA, 18 bp, Homo sapiens
gagctgtttatggcctca

SEQ ID NO: 1499432 - DNA, 19 bp, Homo sapiens
gagctgtttatggcctcag

SEQ ID NO: 1499433 - DNA, 20 bp, Homo sapiens
gaggagaggggaagggccag

SEQ ID NO: 1499434 - DNA, 17 bp, Homo sapiens
gaggagcacctgaaccc

SEQ ID NO: 1499435 - DNA, 16 bp, Homo sapiens
gaggagcagagggcag

SEQ ID NO: 1499436 - DNA, 17 bp, Homo sapiens
gaggagcagcccgggga

SEQ ID NO: 1499437 - DNA, 14 bp, Homo sapiens
gaggagcagctctc

SEQ ID NO: 1499438 - DNA, 15 bp, Homo sapiens
gaggagcagcttcct

SEQ ID NO: 1499439 - DNA, 18 bp, Homo sapiens
gaggagccaccagttctc

SEQ ID NO: 1499440 - DNA, 21 bp, Homo sapiens
gaggagccttgctgggccagg

SEQ ID NO: 1499441 - DNA, 22 bp, Homo sapiens
gaggagccttgctgggccaggg

SEQ ID NO: 1499442 - DNA, 11 bp, Homo sapiens
gaggagccttt

SEQ ID NO: 1499443 - DNA, 16 bp, Homo sapiens
gaggagcggactcact

SEQ ID NO: 1499444 - DNA, 16 bp, Homo sapiens
gaggagctctccccct

SEQ ID NO: 1499445 - DNA, 13 bp, Homo sapiens
gaggagctgcctg

SEQ ID NO: 1499446 - DNA, 23 bp, Homo sapiens
gaggagctgcctgcttggcccgg

SEQ ID NO: 1499447 - DNA, 12 bp, Homo sapiens
gaggagctgctg

SEQ ID NO: 1499448 - DNA, 11 bp, Homo sapiens
gaggagctgga

SEQ ID NO: 1499449 - DNA, 14 bp, Homo sapiens
gaggagctggaggg

SEQ ID NO: 1499450 - DNA, 15 bp, Homo sapiens
gaggagctggagggg

SEQ ID NO: 1499451 - DNA, 13 bp, Homo sapiens
gaggagctggcct

SEQ ID NO: 1499452 - DNA, 15 bp, Homo sapiens
gaggagcttggggga

SEQ ID NO: 1499453 - DNA, 14 bp, Homo sapiens
gaggaggaaaagga

SEQ ID NO: 1499454 - DNA, 18 bp, Homo sapiens
gaggaggaaaaggaaaaa

SEQ ID NO: 1499455 - DNA, 15 bp, Homo sapiens
gaggaggagccttgc

SEQ ID NO: 1499456 - DNA, 13 bp, Homo sapiens
gaggaggaggagc

SEQ ID NO: 1499457 - DNA, 14 bp, Homo sapiens
gaggaggagggagg

SEQ ID NO: 1499458 - DNA, 13 bp, Homo sapiens
gaggagggagaag

SEQ ID NO: 1499459 - DNA, 22 bp, Homo sapiens
gaggagggaggccgggcggtca

SEQ ID NO: 1499460 - DNA, 18 bp, Homo sapiens
gaggagggatgctgctcc

SEQ ID NO: 1499461 - DNA, 22 bp, Homo sapiens
gaggagggatgctgctccgccc

SEQ ID NO: 1499462 - DNA, 14 bp, Homo sapiens
gaggaggggaaggg

SEQ ID NO: 1499463 - DNA, 23 bp, Homo sapiens
gaggaggggaaggggctgaggac

SEQ ID NO: 1499464 - DNA, 11 bp, Homo sapiens
gaggaggggag

SEQ ID NO: 1499465 - DNA, 17 bp, Homo sapiens
gaggagggtgggggagg

SEQ ID NO: 1499466 - DNA, 14 bp, Homo sapiens
gaggagtaaaattc

SEQ ID NO: 1499467 - DNA, 21 bp, Homo sapiens
gaggagtaaaattcagttttt

SEQ ID NO: 1499468 - DNA, 12 bp, Homo sapiens
gaggccccagcc

SEQ ID NO: 1499469 - DNA, 14 bp, Homo sapiens
gaggccccaggctg

SEQ ID NO: 1499470 - DNA, 15 bp, Homo sapiens
gaggcccccagccca

SEQ ID NO: 1499471 - DNA, 19 bp, Homo sapiens
gaggcccccagcccagggc

SEQ ID NO: 1499472 - DNA, 18 bp, Homo sapiens
gaggcccctgaggcagcc

SEQ ID NO: 1499473 - DNA, 17 bp, Homo sapiens
gaggcccctggagccag

SEQ ID NO: 1499474 - DNA, 15 bp, Homo sapiens
gaggcccctgggctc

SEQ ID NO: 1499475 - DNA, 16 bp, Homo sapiens
gaggcccctgggctct

SEQ ID NO: 1499476 - DNA, 18 bp, Homo sapiens
gaggcccctgggctctca

SEQ ID NO: 1499477 - DNA, 19 bp, Homo sapiens
gaggcccctgggctctcac

SEQ ID NO: 1499478 - DNA, 24 bp, Homo sapiens
gaggcccctgggtccttctagctt

SEQ ID NO: 1499479 - DNA, 12 bp, Homo sapiens
gaggccctggag

SEQ ID NO: 1499480 - DNA, 13 bp, Homo sapiens
gaggccctggagg

SEQ ID NO: 1499481 - DNA, 14 bp, Homo sapiens
gaggccctggaggt

SEQ ID NO: 1499482 - DNA, 14 bp, Homo sapiens
gaggccctggtgtc

SEQ ID NO: 1499483 - DNA, 20 bp, Homo sapiens
gaggccctggtgtcaggcag

SEQ ID NO: 1499484 - DNA, 21 bp, Homo sapiens
gaggccctggtgtcaggcagg

SEQ ID NO: 1499485 - DNA, 23 bp, Homo sapiens
gaggcccttaagggaagctactg

SEQ ID NO: 1499486 - DNA, 12 bp, Homo sapiens
gaggcccttcct

SEQ ID NO: 1499487 - DNA, 18 bp, Homo sapiens
gaggcccttgtcgtggga

SEQ ID NO: 1499488 - DNA, 20 bp, Homo sapiens
gaggccgaaggtgcctcaga

SEQ ID NO: 1499489 - DNA, 18 bp, Homo sapiens
gaggccgaggaccaccag

SEQ ID NO: 1499490 - DNA, 19 bp, Homo sapiens
gaggccgaggaccaccagc

SEQ ID NO: 1499491 - DNA, 15 bp, Homo sapiens
gaggccgctagaggc

SEQ ID NO: 1499492 - DNA, 19 bp, Homo sapiens
gaggccgggcggtcacagc

SEQ ID NO: 1499493 - DNA, 19 bp, Homo sapiens
gaggccggggtccaggccc

SEQ ID NO: 1499494 - DNA, 15 bp, Homo sapiens
gaggccgtgcagtgg

SEQ ID NO: 1499495 - DNA, 10 bp, Homo sapiens
gaggcctcac

SEQ ID NO: 1499496 - DNA, 16 bp, Homo sapiens
gaggcctcaggtgctg

SEQ ID NO: 1499497 - DNA, 20 bp, Homo sapiens
gaggcctcaggtgctgtcca

SEQ ID NO: 1499498 - DNA, 13 bp, Homo sapiens
gaggcctcatccc

SEQ ID NO: 1499499 - DNA, 19 bp, Homo sapiens
gaggcctcccccagccagg

SEQ ID NO: 1499500 - DNA, 22 bp, Homo sapiens
gaggcctctcattccagaggaa

SEQ ID NO: 1499501 - DNA, 13 bp, Homo sapiens
gaggcctgaagcc

SEQ ID NO: 1499502 - DNA, 20 bp, Homo sapiens
gaggcctgaagccagctgcc

SEQ ID NO: 1499503 - DNA, 22 bp, Homo sapiens
gaggcctgaggatgagctggaa

SEQ ID NO: 1499504 - DNA, 18 bp, Homo sapiens
gaggcctgatgctgcccc

SEQ ID NO: 1499505 - DNA, 21 bp, Homo sapiens
gaggcctgctgccagtgcagc

SEQ ID NO: 1499506 - DNA, 20 bp, Homo sapiens
gaggcctggactttcctgca

SEQ ID NO: 1499507 - DNA, 16 bp, Homo sapiens
gaggcctggccaatgc

SEQ ID NO: 1499508 - DNA, 19 bp, Homo sapiens
gagggacccttcgagatca

SEQ ID NO: 1499509 - DNA, 14 bp, Homo sapiens
gagggaccgagccc

SEQ ID NO: 1499510 - DNA, 22 bp, Homo sapiens
gagggaccttggagagctcagg

SEQ ID NO: 1499511 - DNA, 22 bp, Homo sapiens
gagggacgcggctcccggggca

SEQ ID NO: 1499512 - DNA, 15 bp, Homo sapiens
gagggacggccaaga

SEQ ID NO: 1499513 - DNA, 15 bp, Homo sapiens
gagggactgtcagct

SEQ ID NO: 1499514 - DNA, 12 bp, Homo sapiens
gagggagaagag

SEQ ID NO: 1499515 - DNA, 21 bp, Homo sapiens
gagggagacactggcccctca

SEQ ID NO: 1499516 - DNA, 13 bp, Homo sapiens
gagggagagagag

SEQ ID NO: 1499517 - DNA, 22 bp, Homo sapiens
gagggagagagagagagagagg

SEQ ID NO: 1499518 - DNA, 13 bp, Homo sapiens
gagggagagggag

SEQ ID NO: 1499519 - DNA, 17 bp, Homo sapiens
gagggagccttgtgaga

SEQ ID NO: 1499520 - DNA, 22 bp, Homo sapiens
gagggagcgacacttgaatgta

SEQ ID NO: 1499521 - DNA, 13 bp, Homo sapiens
gagggagctggga

SEQ ID NO: 1499522 - DNA, 13 bp, Homo sapiens
gagggagctgtgg

SEQ ID NO: 1499523 - DNA, 11 bp, Homo sapiens
gagggaggccc

SEQ ID NO: 1499524 - DNA, 16 bp, Homo sapiens
gagggaggccccaggg

SEQ ID NO: 1499525 - DNA, 21 bp, Homo sapiens
gagggaggggaaaagcatttt

SEQ ID NO: 1499526 - DNA, 23 bp, Homo sapiens
gagggagggggcgctcaggaccc

SEQ ID NO: 1499527 - DNA, 20 bp, Homo sapiens
gagggagttagggagagaga

SEQ ID NO: 1499528 - DNA, 21 bp, Homo sapiens
gagggagttttgtctgtctcc

SEQ ID NO: 1499529 - DNA, 14 bp, Homo sapiens
gagggatcacaggg

SEQ ID NO: 1499530 - DNA, 15 bp, Homo sapiens
gagggatgctgcctg

SEQ ID NO: 1499531 - DNA, 19 bp, Homo sapiens
gagggatgctgctccgccc

SEQ ID NO: 1499532 - DNA, 21 bp, Homo sapiens
gagggatgtgggtaagaggag

SEQ ID NO: 1499533 - DNA, 22 bp, Homo sapiens
gagggatgtgggtaagaggagc

SEQ ID NO: 1499534 - DNA, 24 bp, Homo sapiens
gagggatgtgggtaagaggagcag

SEQ ID NO: 1499535 - DNA, 17 bp, Homo sapiens
gagggcacagccctccg

SEQ ID NO: 1499536 - DNA, 17 bp, Homo sapiens
gagggcacatgaacagc

SEQ ID NO: 1499537 - DNA, 21 bp, Homo sapiens
gagggcacattaactccctcc

SEQ ID NO: 1499538 - DNA, 12 bp, Homo sapiens
gagggcactggt

SEQ ID NO: 1499539 - DNA, 18 bp, Homo sapiens
gagggcactggtggcccg

SEQ ID NO: 1499540 - DNA, 14 bp, Homo sapiens
gagggcagagccat

SEQ ID NO: 1499541 - DNA, 15 bp, Homo sapiens
gagggcagaggctgg

SEQ ID NO: 1499542 - DNA, 19 bp, Homo sapiens
gagggcagcagaagggggt

SEQ ID NO: 1499543 - DNA, 21 bp, Homo sapiens
gagggcagcagaagggggtgg

SEQ ID NO: 1499544 - DNA, 13 bp, Homo sapiens
gagggcaggggtg

SEQ ID NO: 1499545 - DNA, 15 bp, Homo sapiens
gagggcagtgccctt

SEQ ID NO: 1499546 - DNA, 18 bp, Homo sapiens
gagggccaagagatctgt

SEQ ID NO: 1499547 - DNA, 16 bp, Homo sapiens
gagggccagggaccca

SEQ ID NO: 1499548 - DNA, 15 bp, Homo sapiens
gagggcccagccagg

SEQ ID NO: 1499549 - DNA, 19 bp, Homo sapiens
gagggcccagcccagagcc

SEQ ID NO: 1499550 - DNA, 20 bp, Homo sapiens
gagggcccagcccagagcca

SEQ ID NO: 1499551 - DNA, 21 bp, Homo sapiens
gagggcccagcccagagccac

SEQ ID NO: 1499552 - DNA, 12 bp, Homo sapiens
gagggcccagct

SEQ ID NO: 1499553 - DNA, 14 bp, Homo sapiens
gagggcccagctgt

SEQ ID NO: 1499554 - DNA, 13 bp, Homo sapiens
gaggtcactgcta

SEQ ID NO: 1499555 - DNA, 15 bp, Homo sapiens
gaggtcactggaaag

SEQ ID NO: 1499556 - DNA, 17 bp, Homo sapiens
gaggtcactggaaaggg

SEQ ID NO: 1499557 - DNA, 18 bp, Homo sapiens
gaggtcactggaaagggg

SEQ ID NO: 1499558 - DNA, 20 bp, Homo sapiens
gaggtcactggaaaggggag

SEQ ID NO: 1499559 - DNA, 22 bp, Homo sapiens
gaggtcaggagttagaggccag

SEQ ID NO: 1499560 - DNA, 12 bp, Homo sapiens
gaggtccaagca

SEQ ID NO: 1499561 - DNA, 14 bp, Homo sapiens
gaggtccagctggg

SEQ ID NO: 1499562 - DNA, 20 bp, Homo sapiens
gaggtcctctggagccctaa

SEQ ID NO: 1499563 - DNA, 21 bp, Homo sapiens
gaggtccttaggcctctgaga

SEQ ID NO: 1499564 - DNA, 20 bp, Homo sapiens
gaggtcgcagctaccctcag

SEQ ID NO: 1499565 - DNA, 21 bp, Homo sapiens
gaggtcgcagctaccctcagc

SEQ ID NO: 1499566 - DNA, 13 bp, Homo sapiens
gaggtctccaggg

SEQ ID NO: 1499567 - DNA, 17 bp, Homo sapiens
gaggtctccaggggcct

SEQ ID NO: 1499568 - DNA, 20 bp, Homo sapiens
gaggtctccaggggcctgca

SEQ ID NO: 1499569 - DNA, 22 bp, Homo sapiens
gaggtctccaggggcctgcaga

SEQ ID NO: 1499570 - DNA, 15 bp, Homo sapiens
gaggtctctgggagc

SEQ ID NO: 1499571 - DNA, 20 bp, Homo sapiens
gaggtctctgggagcccaga

SEQ ID NO: 1499572 - DNA, 14 bp, Homo sapiens
gaggtctgaaatgg

SEQ ID NO: 1499573 - DNA, 15 bp, Homo sapiens
gaggtctgtgctgag

SEQ ID NO: 1499574 - DNA, 19 bp, Homo sapiens
gaggtctgtgctgaggcct

SEQ ID NO: 1499575 - DNA, 18 bp, Homo sapiens
gaggtgaacattaaaata

SEQ ID NO: 1499576 - DNA, 19 bp, Homo sapiens
gaggtgaatactcttgaaa

SEQ ID NO: 1499577 - DNA, 20 bp, Homo sapiens
gaggtgacaaaccatttcca

SEQ ID NO: 1499578 - DNA, 21 bp, Homo sapiens
gaggtgacaaaccatttccaa

SEQ ID NO: 1499579 - DNA, 14 bp, Homo sapiens
gaggtgagaaaact

SEQ ID NO: 1499580 - DNA, 16 bp, Homo sapiens
gaggtgaggagcagag

SEQ ID NO: 1499581 - DNA, 19 bp, Homo sapiens
gaggtgcagagtgcccaga

SEQ ID NO: 1499582 - DNA, 21 bp, Homo sapiens
gaggtgcagagtgcccagaac

SEQ ID NO: 1499583 - DNA, 13 bp, Homo sapiens
gaggtgcctgtcc

SEQ ID NO: 1499584 - DNA, 19 bp, Homo sapiens
gaggtgcgtgttcagcaga

SEQ ID NO: 1499585 - DNA, 17 bp, Homo sapiens
gaggtgctgatgagtga

SEQ ID NO: 1499586 - DNA, 13 bp, Homo sapiens
gaggtggaagaag

SEQ ID NO: 1499587 - DNA, 12 bp, Homo sapiens
gaggtggagaaa

SEQ ID NO: 1499588 - DNA, 15 bp, Homo sapiens
gaggtggagaaaatt

SEQ ID NO: 1499589 - DNA, 20 bp, Homo sapiens
gaggtggaggttgcagtgag

SEQ ID NO: 1499590 - DNA, 20 bp, Homo sapiens
gaggtggatcacagaggctt

SEQ ID NO: 1499591 - DNA, 21 bp, Homo sapiens
gaggtggccatgttatgctgg

SEQ ID NO: 1499592 - DNA, 18 bp, Homo sapiens
gaggtgggaggtggaaga

SEQ ID NO: 1499593 - DNA, 11 bp, Homo sapiens
gaggtgggcag

SEQ ID NO: 1499594 - DNA, 12 bp, Homo sapiens
gaggtgggcagc

SEQ ID NO: 1499595 - DNA, 17 bp, Homo sapiens
gaggtgggcagctgggc

SEQ ID NO: 1499596 - DNA, 19 bp, Homo sapiens
gaggtgggcagctgggccc

SEQ ID NO: 1499597 - DNA, 23 bp, Homo sapiens
gaggtgggcaggtggtggcactg

SEQ ID NO: 1499598 - DNA, 17 bp, Homo sapiens
gaggtgggccagtctgt

SEQ ID NO: 1499599 - DNA, 21 bp, Homo sapiens
gaggtgggccagtctgtggat

SEQ ID NO: 1499600 - DNA, 14 bp, Homo sapiens
gaggtgggcccagg

SEQ ID NO: 1499601 - DNA, 15 bp, Homo sapiens
gaggtggggttggga

SEQ ID NO: 1499602 - DNA, 15 bp, Homo sapiens
gaggtgtctggggtg

SEQ ID NO: 1499603 - DNA, 17 bp, Homo sapiens
gaggtgttacagaggac

SEQ ID NO: 1499604 - DNA, 13 bp, Homo sapiens
gagtcatcttgtg

SEQ ID NO: 1499605 - DNA, 16 bp, Homo sapiens
gagtcatgatctccct

SEQ ID NO: 1499606 - DNA, 14 bp, Homo sapiens
gagtcatggctaat

SEQ ID NO: 1499607 - DNA, 15 bp, Homo sapiens
gagtccaagaatcca

SEQ ID NO: 1499608 - DNA, 13 bp, Homo sapiens
gagtccactttgt

SEQ ID NO: 1499609 - DNA, 13 bp, Homo sapiens
gagtccagtctct

SEQ ID NO: 1499610 - DNA, 18 bp, Homo sapiens
gagtccattctcccaggt

SEQ ID NO: 1499611 - DNA, 20 bp, Homo sapiens
gagtccattctcccaggtac

SEQ ID NO: 1499612 - DNA, 18 bp, Homo sapiens
gagtccatttcccacatc

SEQ ID NO: 1499613 - DNA, 23 bp, Homo sapiens
gagtcccagagcaggaggcccct

SEQ ID NO: 1499614 - DNA, 17 bp, Homo sapiens
gagtcccaggggcagcc

SEQ ID NO: 1499615 - DNA, 22 bp, Homo sapiens
gagtcccaggggcagccacacc

SEQ ID NO: 1499616 - DNA, 17 bp, Homo sapiens
gagtccccggggttccc

SEQ ID NO: 1499617 - DNA, 17 bp, Homo sapiens
gagtcccctactccctc

SEQ ID NO: 1499618 - DNA, 11 bp, Homo sapiens
gagtcccctca

SEQ ID NO: 1499619 - DNA, 16 bp, Homo sapiens
gagtcccctcacctcc

SEQ ID NO: 1499620 - DNA, 18 bp, Homo sapiens
gagtcccctcacctcctc

SEQ ID NO: 1499621 - DNA, 13 bp, Homo sapiens
gagtcccctcctc

SEQ ID NO: 1499622 - DNA, 11 bp, Homo sapiens
gagtccctgct

SEQ ID NO: 1499623 - DNA, 17 bp, Homo sapiens
gagtccggatttctaac

SEQ ID NO: 1499624 - DNA, 17 bp, Homo sapiens
gagtcctcactcccagt

SEQ ID NO: 1499625 - DNA, 16 bp, Homo sapiens
gagtcctctagcaggc

SEQ ID NO: 1499626 - DNA, 18 bp, Homo sapiens
gagtcctggtttcctggc

SEQ ID NO: 1499627 - DNA, 15 bp, Homo sapiens
gagtcctgtctctgc

SEQ ID NO: 1499628 - DNA, 21 bp, Homo sapiens
gagtcgtggggtgtgctggga

SEQ ID NO: 1499629 - DNA, 12 bp, Homo sapiens
gagtctaaagat

SEQ ID NO: 1499630 - DNA, 21 bp, Homo sapiens
gagtctatgttcaaagactgt

SEQ ID NO: 1499631 - DNA, 22 bp, Homo sapiens
gagtctcaaaggtaattctgaa

SEQ ID NO: 1499632 - DNA, 19 bp, Homo sapiens
gagtctcctctctgagact

SEQ ID NO: 1499633 - DNA, 12 bp, Homo sapiens
gagtctcctgtg

SEQ ID NO: 1499634 - DNA, 14 bp, Homo sapiens
gagtctcttctcca

SEQ ID NO: 1499635 - DNA, 17 bp, Homo sapiens
gagtctcttctccactg

SEQ ID NO: 1499636 - DNA, 18 bp, Homo sapiens
gagtctcttctccactgg

SEQ ID NO: 1499637 - DNA, 15 bp, Homo sapiens
gagtctgagtcctgt

SEQ ID NO: 1499638 - DNA, 18 bp, Homo sapiens
gagtctgagtcctgtctc

SEQ ID NO: 1499639 - DNA, 23 bp, Homo sapiens
gagtctgccccacatgtggccat

SEQ ID NO: 1499640 - DNA, 14 bp, Homo sapiens
gagtctgtgctctt

SEQ ID NO: 1499641 - DNA, 15 bp, Homo sapiens
gagtcttcagaccca

SEQ ID NO: 1499642 - DNA, 18 bp, Homo sapiens
gagtcttcagacccagag

SEQ ID NO: 1499643 - DNA, 19 bp, Homo sapiens
gagtcttcagacccagaga

SEQ ID NO: 1499644 - DNA, 13 bp, Homo sapiens
gagtcttgctctg

SEQ ID NO: 1499645 - DNA, 20 bp, Homo sapiens
gagtcttgctctgtagccca

SEQ ID NO: 1499646 - DNA, 20 bp, Homo sapiens
gagtcttgctctgttgccca

SEQ ID NO: 1499647 - DNA, 21 bp, Homo sapiens
gagtcttggcggcagcagcca

SEQ ID NO: 1499648 - DNA, 14 bp, Homo sapiens
gagtcttggtgcta

SEQ ID NO: 1499649 - DNA, 14 bp, Homo sapiens
gagtctttggttct

SEQ ID NO: 1499650 - DNA, 21 bp, Homo sapiens
gagtgaaacctttagggcagc

SEQ ID NO: 1499651 - DNA, 17 bp, Homo sapiens
gagtgaagaggggcagc

SEQ ID NO: 1499652 - DNA, 21 bp, Homo sapiens
gagtgaagaggggcagccctt

SEQ ID NO: 1499653 - DNA, 17 bp, Homo sapiens
gagtgaatttgacctag

SEQ ID NO: 1499654 - DNA, 12 bp, Homo sapiens
gagtgacagctt

SEQ ID NO: 1499655 - DNA, 19 bp, Homo sapiens
gagtgacagctttctggga

SEQ ID NO: 1499656 - DNA, 21 bp, Homo sapiens
gagtgacagctttctgggatg

SEQ ID NO: 1499657 - DNA, 22 bp, Homo sapiens
gagtgacagctttctgggatgt

SEQ ID NO: 1499658 - DNA, 17 bp, Homo sapiens
gataatatgagaatcag

SEQ ID NO: 1499659 - DNA, 23 bp, Homo sapiens
gataatgaaataatcagtgactg

SEQ ID NO: 1499660 - DNA, 20 bp, Homo sapiens
gataatgccggtgagaataa

SEQ ID NO: 1499661 - DNA, 15 bp, Homo sapiens
gataatgctgttgcc

SEQ ID NO: 1499662 - DNA, 16 bp, Homo sapiens
gataattagcagttta

SEQ ID NO: 1499663 - DNA, 14 bp, Homo sapiens
gataattataatat

SEQ ID NO: 1499664 - DNA, 14 bp, Homo sapiens
gataattccttggt

SEQ ID NO: 1499665 - DNA, 21 bp, Homo sapiens
gataattttatttataaacta

SEQ ID NO: 1499666 - DNA, 13 bp, Homo sapiens
gatacaaagtgtt

SEQ ID NO: 1499667 - DNA, 20 bp, Homo sapiens
gatacaacttcaagtgcatg

SEQ ID NO: 1499668 - DNA, 16 bp, Homo sapiens
gatacaagattagaag

SEQ ID NO: 1499669 - DNA, 19 bp, Homo sapiens
gatacaagtttcagacagg

SEQ ID NO: 1499670 - DNA, 13 bp, Homo sapiens
gatacacacacac

SEQ ID NO: 1499671 - DNA, 20 bp, Homo sapiens
gatacactgaagttaacaga

SEQ ID NO: 1499672 - DNA, 22 bp, Homo sapiens
gatacactgaagttaacagaga

SEQ ID NO: 1499673 - DNA, 16 bp, Homo sapiens
gatacagacattcaat

SEQ ID NO: 1499674 - DNA, 16 bp, Homo sapiens
gatacagctcttctca

SEQ ID NO: 1499675 - DNA, 23 bp, Homo sapiens
gatacagggagccggcggcctct

SEQ ID NO: 1499676 - DNA, 20 bp, Homo sapiens
gatacagtagtgtcatcact

SEQ ID NO: 1499677 - DNA, 14 bp, Homo sapiens
gatacataataaaa

SEQ ID NO: 1499678 - DNA, 15 bp, Homo sapiens
gatacataataaaaa

SEQ ID NO: 1499679 - DNA, 16 bp, Homo sapiens
gatacatttaataaaa

SEQ ID NO: 1499680 - DNA, 18 bp, Homo sapiens
gataccacctttactgtg

SEQ ID NO: 1499681 - DNA, 14 bp, Homo sapiens
gataccagaaggga

SEQ ID NO: 1499682 - DNA, 16 bp, Homo sapiens
gataccagaggaagtt

SEQ ID NO: 1499683 - DNA, 19 bp, Homo sapiens
gataccatgctgtaaggat

SEQ ID NO: 1499684 - DNA, 20 bp, Homo sapiens
gatacccatagcttccatga

SEQ ID NO: 1499685 - DNA, 14 bp, Homo sapiens
gatacctcagccct

SEQ ID NO: 1499686 - DNA, 18 bp, Homo sapiens
gatacctcagccctggcc

SEQ ID NO: 1499687 - DNA, 20 bp, Homo sapiens
gatacctcagccctggccct

SEQ ID NO: 1499688 - DNA, 13 bp, Homo sapiens
gatactaaggacg

SEQ ID NO: 1499689 - DNA, 17 bp, Homo sapiens
gatactctgtcagatgg

SEQ ID NO: 1499690 - DNA, 20 bp, Homo sapiens
gatactgcgactttctgcct

SEQ ID NO: 1499691 - DNA, 13 bp, Homo sapiens
gatactgtgagct

SEQ ID NO: 1499692 - DNA, 20 bp, Homo sapiens
gatacttagtggtatgtctc

SEQ ID NO: 1499693 - DNA, 15 bp, Homo sapiens
gatacttcaggtgct

SEQ ID NO: 1499694 - DNA, 19 bp, Homo sapiens
gatagaaagctggactgac

SEQ ID NO: 1499695 - DNA, 23 bp, Homo sapiens
gatagaatgatgttttaaaaaaa

SEQ ID NO: 1499696 - DNA, 16 bp, Homo sapiens
gatagacgggttgaaa

SEQ ID NO: 1499697 - DNA, 20 bp, Homo sapiens
gatagacgggttgaaagaca

SEQ ID NO: 1499698 - DNA, 23 bp, Homo sapiens
gatagacgggttgaaagacatca

SEQ ID NO: 1499699 - DNA, 24 bp, Homo sapiens
gatagacgggttgaaagacatcaa

SEQ ID NO: 1499700 - DNA, 15 bp, Homo sapiens
gatagacttgggatg

SEQ ID NO: 1499701 - DNA, 22 bp, Homo sapiens
gatagaggaaagggatggtaag

SEQ ID NO: 1499702 - DNA, 22 bp, Homo sapiens
gatagatgtgtggacacattgg

SEQ ID NO: 1499703 - DNA, 13 bp, Homo sapiens
gatagcagggcat

SEQ ID NO: 1499704 - DNA, 16 bp, Homo sapiens
gatagcatatgacaaa

SEQ ID NO: 1499705 - DNA, 19 bp, Homo sapiens
gatagctaactgtaaatca

SEQ ID NO: 1499706 - DNA, 23 bp, Homo sapiens
gatagcttacactgaggactgtg

SEQ ID NO: 1499707 - DNA, 14 bp, Homo sapiens
gataggaggaacca

SEQ ID NO: 1499708 - DNA, 20 bp, Homo sapiens
gataggcacatagagaggga

SEQ ID NO: 1499709 - DNA, 12 bp, Homo sapiens
gataggctctgc

SEQ ID NO: 1499710 - DNA, 13 bp, Homo sapiens
gataggctctgca

SEQ ID NO: 1499711 - DNA, 14 bp, Homo sapiens
gatagtaagcatag

SEQ ID NO: 1499712 - DNA, 22 bp, Homo sapiens
gatagtagttaaataactgtgt

SEQ ID NO: 1499713 - DNA, 17 bp, Homo sapiens
gatagtgttctgctcct

SEQ ID NO: 1499714 - DNA, 21 bp, Homo sapiens
gatagtgttctgctcctgctt

SEQ ID NO: 1499715 - DNA, 19 bp, Homo sapiens
gatagttctataagaataa

SEQ ID NO: 1499716 - DNA, 15 bp, Homo sapiens
gatataaaatgaaag

SEQ ID NO: 1499717 - DNA, 19 bp, Homo sapiens
gatataaaatgaaagattt

SEQ ID NO: 1499718 - DNA, 19 bp, Homo sapiens
gatataacattcagttccc

SEQ ID NO: 1499719 - DNA, 18 bp, Homo sapiens
gatatacaaagtgtacca

SEQ ID NO: 1499720 - DNA, 12 bp, Homo sapiens
gagtgtgggaag

SEQ ID NO: 1499721 - DNA, 15 bp, Homo sapiens
gagtgtggtttcttt

SEQ ID NO: 1499722 - DNA, 21 bp, Homo sapiens
gagtgtgtaatttaaaattgt

SEQ ID NO: 1499723 - DNA, 22 bp, Homo sapiens
gagtgtgtaatttaaaattgtg

SEQ ID NO: 1499724 - DNA, 13 bp, Homo sapiens
gagtgtgtctgct

SEQ ID NO: 1499725 - DNA, 15 bp, Homo sapiens
gagtgtgtctgctga

SEQ ID NO: 1499726 - DNA, 18 bp, Homo sapiens
gagtgtgtgggcagggtt

SEQ ID NO: 1499727 - DNA, 10 bp, Homo sapiens
gagtgtgtgt

SEQ ID NO: 1499728 - DNA, 15 bp, Homo sapiens
gagtgtgtgtgtgca

SEQ ID NO: 1499729 - DNA, 17 bp, Homo sapiens
gagttaaaaagggcagg

SEQ ID NO: 1499730 - DNA, 19 bp, Homo sapiens
gagttaaaatgtttactgt

SEQ ID NO: 1499731 - DNA, 21 bp, Homo sapiens
gagttaaacacgaattgattt

SEQ ID NO: 1499732 - DNA, 12 bp, Homo sapiens
gagttaagacct

SEQ ID NO: 1499733 - DNA, 17 bp, Homo sapiens
gagttaagacctggcag

SEQ ID NO: 1499734 - DNA, 19 bp, Homo sapiens
gagttaataggagtatttt

SEQ ID NO: 1499735 - DNA, 16 bp, Homo sapiens
gagttacaatttggag

SEQ ID NO: 1499736 - DNA, 17 bp, Homo sapiens
gagttacattaatgtta

SEQ ID NO: 1499737 - DNA, 19 bp, Homo sapiens
gagttacttgtctgaggcc

SEQ ID NO: 1499738 - DNA, 20 bp, Homo sapiens
gagttagaggccagcctggc

SEQ ID NO: 1499739 - DNA, 11 bp, Homo sapiens
gagttaggaac

SEQ ID NO: 1499740 - DNA, 17 bp, Homo sapiens
gagttaggctattcaca

SEQ ID NO: 1499741 - DNA, 22 bp, Homo sapiens
gagttagggagagagaagcagg

SEQ ID NO: 1499742 - DNA, 16 bp, Homo sapiens
gagttataaatatttt

SEQ ID NO: 1499743 - DNA, 18 bp, Homo sapiens
gagttatcatgaatttta

SEQ ID NO: 1499744 - DNA, 22 bp, Homo sapiens
gagttatgataacaccagtggg

SEQ ID NO: 1499745 - DNA, 21 bp, Homo sapiens
gagttattgaatcttaatttt

SEQ ID NO: 1499746 - DNA, 21 bp, Homo sapiens
gagttatttaactggtaagcg

SEQ ID NO: 1499747 - DNA, 12 bp, Homo sapiens
gagttcaccttg

SEQ ID NO: 1499748 - DNA, 20 bp, Homo sapiens
gagttcaccttggaagggcg

SEQ ID NO: 1499749 - DNA, 21 bp, Homo sapiens
gagttcagagtccttaaaatg

SEQ ID NO: 1499750 - DNA, 14 bp, Homo sapiens
gagttcatccaggc

SEQ ID NO: 1499751 - DNA, 19 bp, Homo sapiens
gagttccaagttgaaggga

SEQ ID NO: 1499752 - DNA, 16 bp, Homo sapiens
gagttccagaaagtaa

SEQ ID NO: 1499753 - DNA, 19 bp, Homo sapiens
gagttccagttcctctttg

SEQ ID NO: 1499754 - DNA, 20 bp, Homo sapiens
gagttccctgcaaccaattg

SEQ ID NO: 1499755 - DNA, 22 bp, Homo sapiens
gagttcccttgaaactttggga

SEQ ID NO: 1499756 - DNA, 13 bp, Homo sapiens
gagttcctgctcc

SEQ ID NO: 1499757 - DNA, 17 bp, Homo sapiens
gagttccttatccctct

SEQ ID NO: 1499758 - DNA, 19 bp, Homo sapiens
gagttcgagaccagcctgg

SEQ ID NO: 1499759 - DNA, 20 bp, Homo sapiens
gagttcgagaccagcctggc

SEQ ID NO: 1499760 - DNA, 21 bp, Homo sapiens
gagttcgagaccagcctggcc

SEQ ID NO: 1499761 - DNA, 21 bp, Homo sapiens
gagttctctcatcggaggccc

SEQ ID NO: 1499762 - DNA, 22 bp, Homo sapiens
gagttgaaagagttaagaatgt

SEQ ID NO: 1499763 - DNA, 14 bp, Homo sapiens
gagttgactctgga

SEQ ID NO: 1499764 - DNA, 14 bp, Homo sapiens
gagttgatctggaa

SEQ ID NO: 1499765 - DNA, 16 bp, Homo sapiens
gagttgatctggaacc

SEQ ID NO: 1499766 - DNA, 20 bp, Homo sapiens
gagttgatctggaacccaga

SEQ ID NO: 1499767 - DNA, 14 bp, Homo sapiens
gagttgctgtgccg

SEQ ID NO: 1499768 - DNA, 20 bp, Homo sapiens
gagttgctttgccagagcag

SEQ ID NO: 1499769 - DNA, 21 bp, Homo sapiens
gagttggaacaacatgttcta

SEQ ID NO: 1499770 - DNA, 12 bp, Homo sapiens
gagttggagaga

SEQ ID NO: 1499771 - DNA, 22 bp, Homo sapiens
gagttggagtactatatttaca

SEQ ID NO: 1499772 - DNA, 16 bp, Homo sapiens
gagttggctcaggcag

SEQ ID NO: 1499773 - DNA, 17 bp, Homo sapiens
gagttggctcaggcaga

SEQ ID NO: 1499774 - DNA, 18 bp, Homo sapiens
gagttggctcaggcagac

SEQ ID NO: 1499775 - DNA, 16 bp, Homo sapiens
gagttgtggaaagcct

SEQ ID NO: 1499776 - DNA, 14 bp, Homo sapiens
gagtttaccatttg

SEQ ID NO: 1499777 - DNA, 23 bp, Homo sapiens
gagtttatacagtgtacatgtac

SEQ ID NO: 1499778 - DNA, 15 bp, Homo sapiens
gatatacattgtgtg

SEQ ID NO: 1499779 - DNA, 14 bp, Homo sapiens
gatataggcatttg

SEQ ID NO: 1499780 - DNA, 17 bp, Homo sapiens
gatatagtcagctgcct

SEQ ID NO: 1499781 - DNA, 24 bp, Homo sapiens
gatatagttttacttttaaactgt

SEQ ID NO: 1499782 - DNA, 22 bp, Homo sapiens
gatatatgtgtttttcacattt

SEQ ID NO: 1499783 - DNA, 17 bp, Homo sapiens
gatatatttttcacagt

SEQ ID NO: 1499784 - DNA, 14 bp, Homo sapiens
gatatcaaaattct

SEQ ID NO: 1499785 - DNA, 17 bp, Homo sapiens
gatatcaaaattctagc

SEQ ID NO: 1499786 - DNA, 15 bp, Homo sapiens
gatatccatcttttt

SEQ ID NO: 1499787 - DNA, 15 bp, Homo sapiens
gatatctataaaata

SEQ ID NO: 1499788 - DNA, 16 bp, Homo sapiens
gatatctgagggagga

SEQ ID NO: 1499789 - DNA, 23 bp, Homo sapiens
gatatctgagggaggaggccacc

SEQ ID NO: 1499790 - DNA, 14 bp, Homo sapiens
gatatctgcatgtg

SEQ ID NO: 1499791 - DNA, 20 bp, Homo sapiens
gatatcttggacaaatcaca

SEQ ID NO: 1499792 - DNA, 17 bp, Homo sapiens
gatatgacccacactgc

SEQ ID NO: 1499793 - DNA, 18 bp, Homo sapiens
gatatggctgcccaggag

SEQ ID NO: 1499794 - DNA, 19 bp, Homo sapiens
gatatggctgcccaggaga

SEQ ID NO: 1499795 - DNA, 20 bp, Homo sapiens
gatatggctgcccaggagac

SEQ ID NO: 1499796 - DNA, 20 bp, Homo sapiens
gatatgggactgagcctggc

SEQ ID NO: 1499797 - DNA, 23 bp, Homo sapiens
gatatgggactgattctgtggct

SEQ ID NO: 1499798 - DNA, 19 bp, Homo sapiens
gatatgtaaacataattct

SEQ ID NO: 1499799 - DNA, 16 bp, Homo sapiens
gatatgtatatataca

SEQ ID NO: 1499800 - DNA, 17 bp, Homo sapiens
gatatgtatgggtaggg

SEQ ID NO: 1499801 - DNA, 13 bp, Homo sapiens
gatattaaaacac

SEQ ID NO: 1499802 - DNA, 18 bp, Homo sapiens
gatattacagcttatttt

SEQ ID NO: 1499803 - DNA, 16 bp, Homo sapiens
gatattatagaaaatt

SEQ ID NO: 1499804 - DNA, 18 bp, Homo sapiens
gatattatattaaacata

SEQ ID NO: 1499805 - DNA, 20 bp, Homo sapiens
gatattatattaaacataca

SEQ ID NO: 1499806 - DNA, 16 bp, Homo sapiens
gatattatggcaagtg

SEQ ID NO: 1499807 - DNA, 18 bp, Homo sapiens
gatattatttcttctctt

SEQ ID NO: 1499808 - DNA, 19 bp, Homo sapiens
gatattcattggcagctca

SEQ ID NO: 1499809 - DNA, 16 bp, Homo sapiens
gatattctgttgcttt

SEQ ID NO: 1499810 - DNA, 21 bp, Homo sapiens
gatattgaaggagaaaataga

SEQ ID NO: 1499811 - DNA, 21 bp, Homo sapiens
gatattgccttatttgtctgt

SEQ ID NO: 1499812 - DNA, 15 bp, Homo sapiens
gatattgctaattgt

SEQ ID NO: 1499813 - DNA, 16 bp, Homo sapiens
gatattggttcttccc

SEQ ID NO: 1499814 - DNA, 13 bp, Homo sapiens
gatattgtacata

SEQ ID NO: 1499815 - DNA, 16 bp, Homo sapiens
gatattgtacataaaa

SEQ ID NO: 1499816 - DNA, 18 bp, Homo sapiens
gatattgtacataaaaga

SEQ ID NO: 1499817 - DNA, 17 bp, Homo sapiens
gatattgtgaagtacat

SEQ ID NO: 1499818 - DNA, 20 bp, Homo sapiens
gatattgttttctgtaaata

SEQ ID NO: 1499819 - DNA, 15 bp, Homo sapiens
gatatttaagaaaat

SEQ ID NO: 1499820 - DNA, 16 bp, Homo sapiens
gatatttaagaaaata

SEQ ID NO: 1499821 - DNA, 13 bp, Homo sapiens
gatatttaattat

SEQ ID NO: 1499822 - DNA, 14 bp, Homo sapiens
gatatttatagaac

SEQ ID NO: 1499823 - DNA, 13 bp, Homo sapiens
gatatttatatat

SEQ ID NO: 1499824 - DNA, 19 bp, Homo sapiens
gatatttatggggggagaa

SEQ ID NO: 1499825 - DNA, 12 bp, Homo sapiens
gatatttcaatc

SEQ ID NO: 1499826 - DNA, 17 bp, Homo sapiens
gatatttcaatctttta

SEQ ID NO: 1499827 - DNA, 11 bp, Homo sapiens
gatatttcaga

SEQ ID NO: 1499828 - DNA, 17 bp, Homo sapiens
gatctgcacagtcagaa

SEQ ID NO: 1499829 - DNA, 13 bp, Homo sapiens
gatctgcccatcg

SEQ ID NO: 1499830 - DNA, 19 bp, Homo sapiens
gatctgcccatcgtgaaga

SEQ ID NO: 1499831 - DNA, 21 bp, Homo sapiens
gatctgcccatcgtgaagaag

SEQ ID NO: 1499832 - DNA, 11 bp, Homo sapiens
gatctgcctgg

SEQ ID NO: 1499833 - DNA, 13 bp, Homo sapiens
gatctgcctgggc

SEQ ID NO: 1499834 - DNA, 16 bp, Homo sapiens
gatctgcctgggcctg

SEQ ID NO: 1499835 - DNA, 20 bp, Homo sapiens
gatctgcctgggcctgtgca

SEQ ID NO: 1499836 - DNA, 17 bp, Homo sapiens
gatctgcggatctcagc

SEQ ID NO: 1499837 - DNA, 18 bp, Homo sapiens
gatctgctagtgctgtaa

SEQ ID NO: 1499838 - DNA, 19 bp, Homo sapiens
gatctgctgggctctgcct

SEQ ID NO: 1499839 - DNA, 12 bp, Homo sapiens
gatctggaaccc

SEQ ID NO: 1499840 - DNA, 12 bp, Homo sapiens
gatctggaacct

SEQ ID NO: 1499841 - DNA, 20 bp, Homo sapiens
gatctggaacctcagcctgg

SEQ ID NO: 1499842 - DNA, 23 bp, Homo sapiens
gatctggaacctcagcctggcca

SEQ ID NO: 1499843 - DNA, 14 bp, Homo sapiens
gatctggcacactc

SEQ ID NO: 1499844 - DNA, 14 bp, Homo sapiens
gatctgggctgtgg

SEQ ID NO: 1499845 - DNA, 18 bp, Homo sapiens
gatctggggagagcggct

SEQ ID NO: 1499846 - DNA, 22 bp, Homo sapiens
gatctggggagagcggctggag

SEQ ID NO: 1499847 - DNA, 17 bp, Homo sapiens
gatctggggctctggga

SEQ ID NO: 1499848 - DNA, 15 bp, Homo sapiens
gatctgtatatacaa

SEQ ID NO: 1499849 - DNA, 15 bp, Homo sapiens
gatctgtcctcagcc

SEQ ID NO: 1499850 - DNA, 16 bp, Homo sapiens
gatctgtcctcagcct

SEQ ID NO: 1499851 - DNA, 19 bp, Homo sapiens
gatctgtgattggctggtt

SEQ ID NO: 1499852 - DNA, 13 bp, Homo sapiens
gatcttaaagatc

SEQ ID NO: 1499853 - DNA, 23 bp, Homo sapiens
gatcttcccacaggagggccagc

SEQ ID NO: 1499854 - DNA, 18 bp, Homo sapiens
gatcttccgtggtcagag

SEQ ID NO: 1499855 - DNA, 19 bp, Homo sapiens
gatcttctatcattccaat

SEQ ID NO: 1499856 - DNA, 12 bp, Homo sapiens
gatcttctgaaa

SEQ ID NO: 1499857 - DNA, 16 bp, Homo sapiens
gatcttctgaaatgaa

SEQ ID NO: 1499858 - DNA, 18 bp, Homo sapiens
gatcttctgaaatgaaac

SEQ ID NO: 1499859 - DNA, 18 bp, Homo sapiens
gatcttgagagctgctga

SEQ ID NO: 1499860 - DNA, 21 bp, Homo sapiens
gatcttgcctaaatcccaaga

SEQ ID NO: 1499861 - DNA, 18 bp, Homo sapiens
gatcttgcctgtctggct

SEQ ID NO: 1499862 - DNA, 16 bp, Homo sapiens
gatcttggaaaaacag

SEQ ID NO: 1499863 - DNA, 19 bp, Homo sapiens
gatcttggctcactgcaac

SEQ ID NO: 1499864 - DNA, 14 bp, Homo sapiens
gatcttgtgctcag

SEQ ID NO: 1499865 - DNA, 14 bp, Homo sapiens
gatctttaaaatac

SEQ ID NO: 1499866 - DNA, 15 bp, Homo sapiens
gatctttcagaaata

SEQ ID NO: 1499867 - DNA, 16 bp, Homo sapiens
gatctttcagaaatat

SEQ ID NO: 1499868 - DNA, 12 bp, Homo sapiens
gatctttcagga

SEQ ID NO: 1499869 - DNA, 15 bp, Homo sapiens
gatctttcaggaaag

SEQ ID NO: 1499870 - DNA, 16 bp, Homo sapiens
gatctttcccaggccg

SEQ ID NO: 1499871 - DNA, 22 bp, Homo sapiens
gatccagtgcagttgtgatttc

SEQ ID NO: 1499872 - DNA, 21 bp, Homo sapiens
gatccagtttccggaaacaaa

SEQ ID NO: 1499873 - DNA, 15 bp, Homo sapiens
gatccatccatctcc

SEQ ID NO: 1499874 - DNA, 15 bp, Homo sapiens
gatccatcttgagcc

SEQ ID NO: 1499875 - DNA, 21 bp, Homo sapiens
gatccatggggggagaagtga

SEQ ID NO: 1499876 - DNA, 16 bp, Homo sapiens
gatccatgtagcagga

SEQ ID NO: 1499877 - DNA, 14 bp, Homo sapiens
gatcccaaagcaag

SEQ ID NO: 1499878 - DNA, 15 bp, Homo sapiens
gatcccacacaggct

SEQ ID NO: 1499879 - DNA, 20 bp, Homo sapiens
gatcccaccccctcctcccc

SEQ ID NO: 1499880 - DNA, 21 bp, Homo sapiens
gatcccaccccctcctccccc

SEQ ID NO: 1499881 - DNA, 22 bp, Homo sapiens
gatcccaccccctcctccccca

SEQ ID NO: 1499882 - DNA, 23 bp, Homo sapiens
gatcccaccccctcctcccccag

SEQ ID NO: 1499883 - DNA, 18 bp, Homo sapiens
gatcccacttcactgtga

SEQ ID NO: 1499884 - DNA, 17 bp, Homo sapiens
gatcccagctcacgtca

SEQ ID NO: 1499885 - DNA, 16 bp, Homo sapiens
gatcccaggccaggga

SEQ ID NO: 1499886 - DNA, 15 bp, Homo sapiens
gatcccagtagaaaa

SEQ ID NO: 1499887 - DNA, 12 bp, Homo sapiens
gatcccatctct

SEQ ID NO: 1499888 - DNA, 21 bp, Homo sapiens
gatcccatgtcacctcagctg

SEQ ID NO: 1499889 - DNA, 21 bp, Homo sapiens
gatccccagggcagcctggat

SEQ ID NO: 1499890 - DNA, 21 bp, Homo sapiens
gatccccgcctggccaggagc

SEQ ID NO: 1499891 - DNA, 21 bp, Homo sapiens
gatcccgcctcttcttcttca

SEQ ID NO: 1499892 - DNA, 20 bp, Homo sapiens
gatcccggccggccctggct

SEQ ID NO: 1499893 - DNA, 21 bp, Homo sapiens
gatcccggccggccctggctt

SEQ ID NO: 1499894 - DNA, 22 bp, Homo sapiens
gatcccggccggccctggcttg

SEQ ID NO: 1499895 - DNA, 12 bp, Homo sapiens
gatccctcctga

SEQ ID NO: 1499896 - DNA, 14 bp, Homo sapiens
gatccctcctgagc

SEQ ID NO: 1499897 - DNA, 19 bp, Homo sapiens
gatccctcctgagctcggg

SEQ ID NO: 1499898 - DNA, 19 bp, Homo sapiens
gatccctgaacccctggcc

SEQ ID NO: 1499899 - DNA, 17 bp, Homo sapiens
gatccctgctctctgag

SEQ ID NO: 1499900 - DNA, 18 bp, Homo sapiens
gatccctgtgttgtctct

SEQ ID NO: 1499901 - DNA, 19 bp, Homo sapiens
gatccctgtgttgtctcta

SEQ ID NO: 1499902 - DNA, 24 bp, Homo sapiens
gatccctgtgttgtctctagagca

SEQ ID NO: 1499903 - DNA, 20 bp, Homo sapiens
gatccgcctacctcagcctc

SEQ ID NO: 1499904 - DNA, 21 bp, Homo sapiens
gatccgcctacctcagcctcc

SEQ ID NO: 1499905 - DNA, 14 bp, Homo sapiens
gatccggaaagaag

SEQ ID NO: 1499906 - DNA, 19 bp, Homo sapiens
gatcctaaaataagcttca

SEQ ID NO: 1499907 - DNA, 15 bp, Homo sapiens
gatcctaagaatttt

SEQ ID NO: 1499908 - DNA, 22 bp, Homo sapiens
gatcctaagaatttttcattct

SEQ ID NO: 1499909 - DNA, 15 bp, Homo sapiens
gatcctagatcctaa

SEQ ID NO: 1499910 - DNA, 13 bp, Homo sapiens
gatcctccacaga

SEQ ID NO: 1499911 - DNA, 15 bp, Homo sapiens
gatcctccacagaga

SEQ ID NO: 1499912 - DNA, 11 bp, Homo sapiens
gatcctcccac

SEQ ID NO: 1499913 - DNA, 16 bp, Homo sapiens
gatcctcctgcagacc

SEQ ID NO: 1499914 - DNA, 21 bp, Homo sapiens
gatcctcctgcagaccacgcc

SEQ ID NO: 1499915 - DNA, 22 bp, Homo sapiens
gatcctcctgcagaccacgccc

SEQ ID NO: 1499916 - DNA, 24 bp, Homo sapiens
gattaactcttagaagtgttgtaa

SEQ ID NO: 1499917 - DNA, 19 bp, Homo sapiens
gattaacttatttagagat

SEQ ID NO: 1499918 - DNA, 13 bp, Homo sapiens
gattaagaaacct

SEQ ID NO: 1499919 - DNA, 22 bp, Homo sapiens
gattaagagatgggtttgacaa

SEQ ID NO: 1499920 - DNA, 13 bp, Homo sapiens
gattaatcaaagg

SEQ ID NO: 1499921 - DNA, 16 bp, Homo sapiens
gattaatggcactgat

SEQ ID NO: 1499922 - DNA, 15 bp, Homo sapiens
gattaatgttttgta

SEQ ID NO: 1499923 - DNA, 20 bp, Homo sapiens
gattacaggcatgagccact

SEQ ID NO: 1499924 - DNA, 14 bp, Homo sapiens
gattacaggcgtga

SEQ ID NO: 1499925 - DNA, 18 bp, Homo sapiens
gattacagggatgagcca

SEQ ID NO: 1499926 - DNA, 22 bp, Homo sapiens
gattacaggtgtgagccaccac

SEQ ID NO: 1499927 - DNA, 18 bp, Homo sapiens
gattactgtcaataaaca

SEQ ID NO: 1499928 - DNA, 12 bp, Homo sapiens
gattacttaaat

SEQ ID NO: 1499929 - DNA, 20 bp, Homo sapiens
gattactttaaaataaaaaa

SEQ ID NO: 1499930 - DNA, 17 bp, Homo sapiens
gattagaagctgaaaac

SEQ ID NO: 1499931 - DNA, 14 bp, Homo sapiens
gattagacagaaca

SEQ ID NO: 1499932 - DNA, 19 bp, Homo sapiens
gattagacagaacacctat

SEQ ID NO: 1499933 - DNA, 18 bp, Homo sapiens
gattagaggcagatctgg

SEQ ID NO: 1499934 - DNA, 19 bp, Homo sapiens
gattagcaagttacagtga

SEQ ID NO: 1499935 - DNA, 23 bp, Homo sapiens
gattagggcatttgagaaatgca

SEQ ID NO: 1499936 - DNA, 15 bp, Homo sapiens
gattataaaaaatgt

SEQ ID NO: 1499937 - DNA, 17 bp, Homo sapiens
gattataacttgtctaa

SEQ ID NO: 1499938 - DNA, 15 bp, Homo sapiens
gattataatatgtgc

SEQ ID NO: 1499939 - DNA, 22 bp, Homo sapiens
gattataatatgtgccttaagt

SEQ ID NO: 1499940 - DNA, 22 bp, Homo sapiens
gattatagattctaaagattct

SEQ ID NO: 1499941 - DNA, 15 bp, Homo sapiens
gattatattcacaga

SEQ ID NO: 1499942 - DNA, 15 bp, Homo sapiens
gattgataattgcat

SEQ ID NO: 1499943 - DNA, 19 bp, Homo sapiens
gattgatagagtgttatca

SEQ ID NO: 1499944 - DNA, 15 bp, Homo sapiens
gattgatcacacagt

SEQ ID NO: 1499945 - DNA, 13 bp, Homo sapiens
gattgatcattct

SEQ ID NO: 1499946 - DNA, 19 bp, Homo sapiens
gattgattcagtcttctgg

SEQ ID NO: 1499947 - DNA, 16 bp, Homo sapiens
gattgattttaaaatg

SEQ ID NO: 1499948 - DNA, 18 bp, Homo sapiens
gattgattttaaaatgta

SEQ ID NO: 1499949 - DNA, 18 bp, Homo sapiens
gattgcaatatctgaagc

SEQ ID NO: 1499950 - DNA, 23 bp, Homo sapiens
gattgcaggagtccctgccatca

SEQ ID NO: 1499951 - DNA, 22 bp, Homo sapiens
gattgcattagaaatagacagt

SEQ ID NO: 1499952 - DNA, 21 bp, Homo sapiens
gattgcccctggctttgcctc

SEQ ID NO: 1499953 - DNA, 23 bp, Homo sapiens
gattgcccctggctttgcctctt

SEQ ID NO: 1499954 - DNA, 17 bp, Homo sapiens
gattgctctggagcagc

SEQ ID NO: 1499955 - DNA, 11 bp, Homo sapiens
gattgctgcca

SEQ ID NO: 1499956 - DNA, 16 bp, Homo sapiens
gattgctgccactttt

SEQ ID NO: 1499957 - DNA, 14 bp, Homo sapiens
gattgctgccaggc

SEQ ID NO: 1499958 - DNA, 14 bp, Homo sapiens
gattgcttctgtag

SEQ ID NO: 1499959 - DNA, 17 bp, Homo sapiens
gattgcttgagctcagg

SEQ ID NO: 1499960 - DNA, 14 bp, Homo sapiens
gattggaccaggcc

SEQ ID NO: 1499961 - DNA, 22 bp, Homo sapiens
gattggatacgcatcagacaga

SEQ ID NO: 1499962 - DNA, 17 bp, Homo sapiens
gattggattattcattt

SEQ ID NO: 1499963 - DNA, 20 bp, Homo sapiens
gattggctcacactgagaat

SEQ ID NO: 1499964 - DNA, 11 bp, Homo sapiens
gattggctgca

SEQ ID NO: 1499965 - DNA, 14 bp, Homo sapiens
gattggctgcagga

SEQ ID NO: 1499966 - DNA, 16 bp, Homo sapiens
gattggctgcaggaag

SEQ ID NO: 1499967 - DNA, 17 bp, Homo sapiens
gattggctgcaggaaga

SEQ ID NO: 1499968 - DNA, 9 bp, Homo sapiens
gattggctt

SEQ ID NO: 1499969 - DNA, 22 bp, Homo sapiens
gattgggaggtgcgtgttcagc

SEQ ID NO: 1499970 - DNA, 20 bp, Homo sapiens
gattggggaagactgtggct

SEQ ID NO: 1499971 - DNA, 22 bp, Homo sapiens
gattggtgttcgtttccatcat

SEQ ID NO: 1499972 - DNA, 15 bp, Homo sapiens
gattgtattgttgaa

SEQ ID NO: 1499973 - DNA, 19 bp, Homo sapiens
gattgtgccagtgcactcc

SEQ ID NO: 1499974 - DNA, 20 bp, Homo sapiens
gattgtgcccacccagggaa

SEQ ID NO: 1499975 - DNA, 18 bp, Homo sapiens
gattgtgctctgcagcga

SEQ ID NO: 1499976 - DNA, 12 bp, Homo sapiens
gattgtgtacat

SEQ ID NO: 1499977 - DNA, 13 bp, Homo sapiens
gattgtgtacata

SEQ ID NO: 1499978 - DNA, 14 bp, Homo sapiens
gattgtgtacatag

SEQ ID NO: 1499979 - DNA, 21 bp, Homo sapiens
gattgttaggagtggttctca

SEQ ID NO: 1499980 - DNA, 13 bp, Homo sapiens
gattgttcatcat

SEQ ID NO: 1499981 - DNA, 20 bp, Homo sapiens
gattgttggtgaattttcaa

SEQ ID NO: 1499982 - DNA, 18 bp, Homo sapiens
gattgtttcctcttccaa

SEQ ID NO: 1499983 - DNA, 17 bp, Homo sapiens
gattgtttgctctgaga

SEQ ID NO: 1499984 - DNA, 22 bp, Homo sapiens
gattgttttttaaaaatggata

SEQ ID NO: 1499985 - DNA, 15 bp, Homo sapiens
gatttaaaacatgta

SEQ ID NO: 1499986 - DNA, 15 bp, Homo sapiens
gatttaaacacacag

SEQ ID NO: 1499987 - DNA, 16 bp, Homo sapiens
gatttaaacacacaga

SEQ ID NO: 1499988 - DNA, 17 bp, Homo sapiens
gatttaaacacacagat

SEQ ID NO: 1499989 - DNA, 13 bp, Homo sapiens
gatttaaactctg

SEQ ID NO: 1499990 - DNA, 17 bp, Homo sapiens
gatttaaactctgaatt

SEQ ID NO: 1499991 - DNA, 19 bp, Homo sapiens
gatttacagcctcacttga

SEQ ID NO: 1499992 - DNA, 13 bp, Homo sapiens
gatttacattcaa

SEQ ID NO: 1499993 - DNA, 17 bp, Homo sapiens
gatttaccttttctgtt

SEQ ID NO: 1499994 - DNA, 16 bp, Homo sapiens
gatttacttaattcag

SEQ ID NO: 1499995 - DNA, 15 bp, Homo sapiens
gatttagctatttat

SEQ ID NO: 1499996 - DNA, 23 bp, Homo sapiens
gatttagctgtggctccctcctc

SEQ ID NO: 1499997 - DNA, 22 bp, Homo sapiens
gatttagtgaaagctagagata

SEQ ID NO: 1499998 - DNA, 12 bp, Homo sapiens
gatttatcaaat

SEQ ID NO: 1499999 - DNA, 15 bp, Homo sapiens
gatttatcaaatcag

SEQ ID NO: 1500000 - DNA, 14 bp, Homo sapiens
gatttattgaaatt

SEQ ID NO: 1500001 - DNA, 15 bp, Homo sapiens
gatttattgtaagca

SEQ ID NO: 1500002 - DNA, 19 bp, Homo sapiens
gatttcactaggactcaga

SEQ ID NO: 1500003 - DNA, 21 bp, Homo sapiens
gatttcactaggactcagaaa

SEQ ID NO: 1500004 - DNA, 21 bp, Homo sapiens
gatttcagaaagagcaagtct

SEQ ID NO: 1500005 - DNA, 20 bp, Homo sapiens
gatttcaggatactctgtca

SEQ ID NO: 1500006 - DNA, 22 bp, Homo sapiens
gatttcaggatactctgtcaga

SEQ ID NO: 1500007 - DNA, 21 bp, Homo sapiens
gatttcagtcatagcaagctt

SEQ ID NO: 1500008 - DNA, 18 bp, Homo sapiens
gatttcagtttttcattt

SEQ ID NO: 1500009 - DNA, 20 bp, Homo sapiens
gatttcagtttttcatttgt

SEQ ID NO: 1500010 - DNA, 12 bp, Homo sapiens
gatttcatctgc

SEQ ID NO: 1500011 - DNA, 17 bp, Homo sapiens
gatttcatcttctggaa

SEQ ID NO: 1500012 - DNA, 16 bp, Homo sapiens
gatttcatgctatctc

SEQ ID NO: 1500013 - DNA, 20 bp, Homo sapiens
gatttcatttcaactgtttg

SEQ ID NO: 1500014 - DNA, 21 bp, Homo sapiens
gatttcatttcaactgtttgc

SEQ ID NO: 1500015 - DNA, 15 bp, Homo sapiens
gatttccagccttct

SEQ ID NO: 1500016 - DNA, 12 bp, Homo sapiens
gatttccaggcc

SEQ ID NO: 1500017 - DNA, 17 bp, Homo sapiens
gatttccaggcccctga

SEQ ID NO: 1500018 - DNA, 19 bp, Homo sapiens
gatttccatattttatttt

SEQ ID NO: 1500019 - DNA, 13 bp, Homo sapiens
gatttccatctta

SEQ ID NO: 1500020 - DNA, 20 bp, Homo sapiens
gatttcccactgcactccag

SEQ ID NO: 1500021 - DNA, 21 bp, Homo sapiens
gatttcccactgcactccagc

SEQ ID NO: 1500022 - DNA, 15 bp, Homo sapiens
gatttccctaaaaat

SEQ ID NO: 1500023 - DNA, 13 bp, Homo sapiens
gatttcctcctcc

SEQ ID NO: 1500024 - DNA, 16 bp, Homo sapiens
gatttctaacagtcct

SEQ ID NO: 1500025 - DNA, 10 bp, Homo sapiens
gatttctaat

SEQ ID NO: 1500026 - DNA, 15 bp, Homo sapiens
gatttctcattgact

SEQ ID NO: 1500027 - DNA, 14 bp, Homo sapiens
gatttctctgaaca

SEQ ID NO: 1500028 - DNA, 15 bp, Homo sapiens
gatttctctgaacag

SEQ ID NO: 1500029 - DNA, 20 bp, Homo sapiens
gatttctgctaagttctccc

SEQ ID NO: 1500030 - DNA, 18 bp, Homo sapiens
gatttgatgctgtttgac

SEQ ID NO: 1500031 - DNA, 15 bp, Homo sapiens
gatttgattcatttt

SEQ ID NO: 1500032 - DNA, 18 bp, Homo sapiens
gatttgattcattttcct

SEQ ID NO: 1500033 - DNA, 21 bp, Homo sapiens
gatttgcaaatgcacatttgt

SEQ ID NO: 1500034 - DNA, 20 bp, Homo sapiens
gatttgcaggattcccttct

SEQ ID NO: 1500035 - DNA, 23 bp, Homo sapiens
gatttgccaaaaactaaaattca

SEQ ID NO: 1500036 - DNA, 15 bp, Homo sapiens
gatttgctgctcttc

SEQ ID NO: 1500037 - DNA, 17 bp, Homo sapiens
gatttggggtgttacag

SEQ ID NO: 1500038 - DNA, 13 bp, Homo sapiens
gatttgtatattt

SEQ ID NO: 1500039 - DNA, 23 bp, Homo sapiens
gatttgtgaaacagttgctgtga

SEQ ID NO: 1500040 - DNA, 16 bp, Homo sapiens
gatttgtgaactggaa

SEQ ID NO: 1500041 - DNA, 21 bp, Homo sapiens
gatttgtgcaaacatggagaa

SEQ ID NO: 1500042 - DNA, 18 bp, Homo sapiens
gatttgttttgaattttg

SEQ ID NO: 1500043 - DNA, 13 bp, Homo sapiens
gattttaaaatgt

SEQ ID NO: 1500044 - DNA, 21 bp, Homo sapiens
gattttaaaatgtacatgtat

SEQ ID NO: 1500045 - DNA, 15 bp, Homo sapiens
gattttaaatgtgtg

SEQ ID NO: 1500046 - DNA, 13 bp, Homo sapiens
gattttaattttg

SEQ ID NO: 1500047 - DNA, 18 bp, Homo sapiens
gattttacaattgaaatg

SEQ ID NO: 1500048 - DNA, 14 bp, Homo sapiens
gattttaccaaagc

SEQ ID NO: 1500049 - DNA, 15 bp, Homo sapiens
gattttattcttgat

SEQ ID NO: 1500050 - DNA, 15 bp, Homo sapiens
gattttattttacta

SEQ ID NO: 1500051 - DNA, 19 bp, Homo sapiens
gattttcaaagctttttcc

SEQ ID NO: 1500052 - DNA, 20 bp, Homo sapiens
gattttcaagattctaaagc

SEQ ID NO: 1500053 - DNA, 16 bp, Homo sapiens
gattttccatctaaaa

SEQ ID NO: 1500054 - DNA, 21 bp, Homo sapiens
gattttccatctaaaaatata

SEQ ID NO: 1500055 - DNA, 16 bp, Homo sapiens
gattttctggttctaa

SEQ ID NO: 1500056 - DNA, 17 bp, Homo sapiens
gattttcttttgccttt

SEQ ID NO: 1500057 - DNA, 11 bp, Homo sapiens
gattttgcaaa

SEQ ID NO: 1500058 - DNA, 17 bp, Homo sapiens
gattttggataataaac

SEQ ID NO: 1500059 - DNA, 12 bp, Homo sapiens
gcaagaccacgg

SEQ ID NO: 1500060 - DNA, 15 bp, Homo sapiens
gcaagaccagttgaa

SEQ ID NO: 1500061 - DNA, 22 bp, Homo sapiens
gcaagacctagtcccctttcct

SEQ ID NO: 1500062 - DNA, 15 bp, Homo sapiens
gcaagacctcatctc

SEQ ID NO: 1500063 - DNA, 23 bp, Homo sapiens
gcaagacctcatctgtggagctg

SEQ ID NO: 1500064 - DNA, 15 bp, Homo sapiens
gcaagacctcttccc

SEQ ID NO: 1500065 - DNA, 22 bp, Homo sapiens
gcaagacctcttccctctgggc

SEQ ID NO: 1500066 - DNA, 17 bp, Homo sapiens
gcaagagatgggacaag

SEQ ID NO: 1500067 - DNA, 15 bp, Homo sapiens
gcaagatatttttga

SEQ ID NO: 1500068 - DNA, 21 bp, Homo sapiens
gcaagatggacacgagccaca

SEQ ID NO: 1500069 - DNA, 21 bp, Homo sapiens
gcaagatgtgaattattgaca

SEQ ID NO: 1500070 - DNA, 16 bp, Homo sapiens
gcaagatgtgggcagt

SEQ ID NO: 1500071 - DNA, 14 bp, Homo sapiens
gcaagatgttttgt

SEQ ID NO: 1500072 - DNA, 15 bp, Homo sapiens
gcaagatgttttgta

SEQ ID NO: 1500073 - DNA, 17 bp, Homo sapiens
gcaagatgttttgtata

SEQ ID NO: 1500074 - DNA, 22 bp, Homo sapiens
gcaagatgttttgtataaaatc

SEQ ID NO: 1500075 - DNA, 14 bp, Homo sapiens
gcaagattgcttaa

SEQ ID NO: 1500076 - DNA, 15 bp, Homo sapiens
gcaagcacagccctt

SEQ ID NO: 1500077 - DNA, 12 bp, Homo sapiens
gcaagcagagga

SEQ ID NO: 1500078 - DNA, 14 bp, Homo sapiens
gcaagcagaggacc

SEQ ID NO: 1500079 - DNA, 16 bp, Homo sapiens
gcaagcagctggtcag

SEQ ID NO: 1500080 - DNA, 13 bp, Homo sapiens
gcaagcagggaaa

SEQ ID NO: 1500081 - DNA, 16 bp, Homo sapiens
gcaagcatgcttgtga

SEQ ID NO: 1500082 - DNA, 20 bp, Homo sapiens
gcaagccaggctcactcaca

SEQ ID NO: 1500083 - DNA, 21 bp, Homo sapiens
gcaagccaggctcactcacag

SEQ ID NO: 1500084 - DNA, 16 bp, Homo sapiens
gcaagccatcatcctc

SEQ ID NO: 1500085 - DNA, 13 bp, Homo sapiens
gcaagccccaggg

SEQ ID NO: 1500086 - DNA, 17 bp, Homo sapiens
gcaagccccagggcctg

SEQ ID NO: 1500087 - DNA, 18 bp, Homo sapiens
gcaagcccctcagccctt

SEQ ID NO: 1500088 - DNA, 23 bp, Homo sapiens
gcaagcccctcagcccttgcccc

SEQ ID NO: 1500089 - DNA, 12 bp, Homo sapiens
gcaagcctggcc

SEQ ID NO: 1500090 - DNA, 18 bp, Homo sapiens
gcaagcgcttctgctgaa

SEQ ID NO: 1500091 - DNA, 21 bp, Homo sapiens
gcaagctaggccccagaggcc

SEQ ID NO: 1500092 - DNA, 22 bp, Homo sapiens
gcaagctaggccccagaggccc

SEQ ID NO: 1500093 - DNA, 20 bp, Homo sapiens
gcaagcttgaggccaagatg

SEQ ID NO: 1500094 - DNA, 9 bp, Homo sapiens
gcaaggaaa

SEQ ID NO: 1500095 - DNA, 10 bp, Homo sapiens
gcaaggaaag

SEQ ID NO: 1500096 - DNA, 19 bp, Homo sapiens
gcaaggagtttaaatgaga

SEQ ID NO: 1500097 - DNA, 21 bp, Homo sapiens
gcaaggccttggtggagcagc

SEQ ID NO: 1500098 - DNA, 22 bp, Homo sapiens
gcaaggccttggtggagcagcc

SEQ ID NO: 1500099 - DNA, 19 bp, Homo sapiens
gcaagggagaaaagagaaa

SEQ ID NO: 1500100 - DNA, 14 bp, Homo sapiens
gcaagggcatcagg

SEQ ID NO: 1500101 - DNA, 14 bp, Homo sapiens
gcaagggcccagag

SEQ ID NO: 1500102 - DNA, 15 bp, Homo sapiens
gcaagggcccagagt

SEQ ID NO: 1500103 - DNA, 10 bp, Homo sapiens
gcaagggctc

SEQ ID NO: 1500104 - DNA, 14 bp, Homo sapiens
gcaagggctccagc

SEQ ID NO: 1500105 - DNA, 20 bp, Homo sapiens
gcaaggggctggctggagtc

SEQ ID NO: 1500106 - DNA, 21 bp, Homo sapiens
gcaagggggtgtcatctgagg

SEQ ID NO: 1500107 - DNA, 18 bp, Homo sapiens
gcaaggtatttctccagt

SEQ ID NO: 1500108 - DNA, 11 bp, Homo sapiens
gcaaggtggcc

SEQ ID NO: 1500109 - DNA, 20 bp, Homo sapiens
gcaagtccctgactctctgt

SEQ ID NO: 1500110 - DNA, 19 bp, Homo sapiens
gcaagtcccttcagactgg

SEQ ID NO: 1500111 - DNA, 18 bp, Homo sapiens
gcaagtctgagggtctgg

SEQ ID NO: 1500112 - DNA, 21 bp, Homo sapiens
gcaagtctgcagcccggcgcc

SEQ ID NO: 1500113 - DNA, 20 bp, Homo sapiens
gcaagtgaatttttctctaa

SEQ ID NO: 1500114 - DNA, 15 bp, Homo sapiens
gcaagtgagcagaga

SEQ ID NO: 1500115 - DNA, 22 bp, Homo sapiens
gcaagtgagcagagatgtactg

SEQ ID NO: 1500116 - DNA, 12 bp, Homo sapiens
gcaagtgcattt

SEQ ID NO: 1500117 - DNA, 15 bp, Homo sapiens
gcaagtgcccagtgg

SEQ ID NO: 1500118 - DNA, 21 bp, Homo sapiens
gcaagtggatgggaatttgtc

SEQ ID NO: 1500119 - DNA, 16 bp, Homo sapiens
gcaagtgtgcactcca

SEQ ID NO: 1500120 - DNA, 18 bp, Homo sapiens
gcaagtttccatcatcta

SEQ ID NO: 1500121 - DNA, 13 bp, Homo sapiens
gcaagtttctgtt

SEQ ID NO: 1500122 - DNA, 19 bp, Homo sapiens
gcaagttttccctgaagtt

SEQ ID NO: 1500123 - DNA, 19 bp, Homo sapiens
gcaataaatctgacccagt

SEQ ID NO: 1500124 - DNA, 16 bp, Homo sapiens
gcaataactctgggag

SEQ ID NO: 1500125 - DNA, 21 bp, Homo sapiens
gcaataacttctatattttaa

SEQ ID NO: 1500126 - DNA, 14 bp, Homo sapiens
gcaataattgtttc

SEQ ID NO: 1500127 - DNA, 13 bp, Homo sapiens
gcaataatttgta

SEQ ID NO: 1500128 - DNA, 12 bp, Homo sapiens
gcaatacatttt

SEQ ID NO: 1500129 - DNA, 23 bp, Homo sapiens
gcaatacgacgtgggaatttcaa

SEQ ID NO: 1500130 - DNA, 15 bp, Homo sapiens
gcaatagagactgta

SEQ ID NO: 1500131 - DNA, 17 bp, Homo sapiens
gcaatagagactgtaga

SEQ ID NO: 1500132 - DNA, 19 bp, Homo sapiens
gcaatagattactgatgtg

SEQ ID NO: 1500133 - DNA, 21 bp, Homo sapiens
gcaatatattaccagcaagaa

SEQ ID NO: 1500134 - DNA, 19 bp, Homo sapiens
gcaatcaaggttataattt

SEQ ID NO: 1500135 - DNA, 13 bp, Homo sapiens
gcaatccatgtta

SEQ ID NO: 1500136 - DNA, 13 bp, Homo sapiens
gcaatccatttat

SEQ ID NO: 1500137 - DNA, 20 bp, Homo sapiens
gcaatcctcccacttcagcc

SEQ ID NO: 1500138 - DNA, 14 bp, Homo sapiens
gcaatcctgtcttt

SEQ ID NO: 1500139 - DNA, 15 bp, Homo sapiens
gcaatctttgaaata

SEQ ID NO: 1500140 - DNA, 15 bp, Homo sapiens
gcaatgaaaaattct

SEQ ID NO: 1500141 - DNA, 18 bp, Homo sapiens
gcaatgaaaggtactata

SEQ ID NO: 1500142 - DNA, 20 bp, Homo sapiens
gcaatgatgacccactaaag

SEQ ID NO: 1500143 - DNA, 17 bp, Homo sapiens
gcaatgatgtccagaag

SEQ ID NO: 1500144 - DNA, 19 bp, Homo sapiens
gcaatgcctgtgaaaaaga

SEQ ID NO: 1500145 - DNA, 15 bp, Homo sapiens
gcaatgctatcactg

SEQ ID NO: 1500146 - DNA, 19 bp, Homo sapiens
gcaatgggtcactcattaa

SEQ ID NO: 1500147 - DNA, 18 bp, Homo sapiens
gcaatggtttgtgtcaaa

SEQ ID NO: 1500148 - DNA, 19 bp, Homo sapiens
gcaatgtggagcagcagcc

SEQ ID NO: 1500149 - DNA, 19 bp, Homo sapiens
gcaatgtggtgacacctcc

SEQ ID NO: 1500150 - DNA, 15 bp, Homo sapiens
gcaatgttggttttt

SEQ ID NO: 1500151 - DNA, 17 bp, Homo sapiens
gcaatgttggtttttta

SEQ ID NO: 1500152 - DNA, 15 bp, Homo sapiens
gcaatgtttatttca

SEQ ID NO: 1500153 - DNA, 22 bp, Homo sapiens
gcaattagtctgaaactggctt

SEQ ID NO: 1500154 - DNA, 14 bp, Homo sapiens
gcaattccaggctg

SEQ ID NO: 1500155 - DNA, 18 bp, Homo sapiens
gcaattccaggctgagcc

SEQ ID NO: 1500156 - DNA, 19 bp, Homo sapiens
gcaattccaggctgagcca

SEQ ID NO: 1500157 - DNA, 24 bp, Homo sapiens
gcaattccaggctgagccatgagg

SEQ ID NO: 1500158 - DNA, 15 bp, Homo sapiens
gcaattccgcattta

SEQ ID NO: 1500159 - DNA, 13 bp, Homo sapiens
gcaattgccctgt

SEQ ID NO: 1500160 - DNA, 16 bp, Homo sapiens
gcaattggaataatca

SEQ ID NO: 1500161 - DNA, 13 bp, Homo sapiens
gcaattgtctatt

SEQ ID NO: 1500162 - DNA, 17 bp, Homo sapiens
gcacaaagctcaagatg

SEQ ID NO: 1500163 - DNA, 16 bp, Homo sapiens
gcacaagaatggatca

SEQ ID NO: 1500164 - DNA, 21 bp, Homo sapiens
gcacaagaggaagagagagac

SEQ ID NO: 1500165 - DNA, 21 bp, Homo sapiens
gcacaagcagagtgcacagct

SEQ ID NO: 1500166 - DNA, 22 bp, Homo sapiens
gcacaagccacaagtcttccag

SEQ ID NO: 1500167 - DNA, 16 bp, Homo sapiens
gcacaaggaaataaag

SEQ ID NO: 1500168 - DNA, 21 bp, Homo sapiens
gcacaaggccttgcctggcct

SEQ ID NO: 1500169 - DNA, 19 bp, Homo sapiens
gcacaaggctgaccaagag

SEQ ID NO: 1500170 - DNA, 14 bp, Homo sapiens
gcacaagggcacat

SEQ ID NO: 1500171 - DNA, 15 bp, Homo sapiens
gcacaagggcacatt

SEQ ID NO: 1500172 - DNA, 16 bp, Homo sapiens
gcacaagggcacattg

SEQ ID NO: 1500173 - DNA, 19 bp, Homo sapiens
gcacaagggcacattgccc

SEQ ID NO: 1500174 - DNA, 19 bp, Homo sapiens
gcacaatattgaacttttt

SEQ ID NO: 1500175 - DNA, 12 bp, Homo sapiens
gcacaatttgca

SEQ ID NO: 1500176 - DNA, 22 bp, Homo sapiens
gcacacacaaacctactgccca

SEQ ID NO: 1500177 - DNA, 20 bp, Homo sapiens
gcacacacacataagcactg

SEQ ID NO: 1500178 - DNA, 13 bp, Homo sapiens
gcacacacagctc

SEQ ID NO: 1500179 - DNA, 11 bp, Homo sapiens
gcacacacagt

SEQ ID NO: 1500180 - DNA, 19 bp, Homo sapiens
gcacacacatctggccctg

SEQ ID NO: 1500181 - DNA, 21 bp, Homo sapiens
gcacacacctgtagtcccagc

SEQ ID NO: 1500182 - DNA, 20 bp, Homo sapiens
gcacacagatcccctggaaa

SEQ ID NO: 1500183 - DNA, 13 bp, Homo sapiens
gcacacagctact

SEQ ID NO: 1500184 - DNA, 15 bp, Homo sapiens
gcacacagctgagca

SEQ ID NO: 1500185 - DNA, 14 bp, Homo sapiens
gcacacagggcccg

SEQ ID NO: 1500186 - DNA, 23 bp, Homo sapiens
gcacacagggcccggccacaccc

SEQ ID NO: 1500187 - DNA, 19 bp, Homo sapiens
gcacacaggtacagcaaca

SEQ ID NO: 1500188 - DNA, 22 bp, Homo sapiens
gcacacaggtacagcaacagga

SEQ ID NO: 1500189 - DNA, 13 bp, Homo sapiens
gcacacatatata

SEQ ID NO: 1500190 - DNA, 12 bp, Homo sapiens
gcacaccactgc

SEQ ID NO: 1500191 - DNA, 15 bp, Homo sapiens
gcacaccactgccct

SEQ ID NO: 1500192 - DNA, 17 bp, Homo sapiens
gcacaccactgccctgc

SEQ ID NO: 1500193 - DNA, 18 bp, Homo sapiens
gcacaccactgccctgcc

SEQ ID NO: 1500194 - DNA, 13 bp, Homo sapiens
gcacaccagccgc

SEQ ID NO: 1500195 - DNA, 14 bp, Homo sapiens
gcacacctcagccc

SEQ ID NO: 1500196 - DNA, 12 bp, Homo sapiens
gcacacctgtgt

SEQ ID NO: 1500197 - DNA, 17 bp, Homo sapiens
gcacaccttttccccag

SEQ ID NO: 1500198 - DNA, 19 bp, Homo sapiens
gcacaccttttccccagga

SEQ ID NO: 1500199 - DNA, 20 bp, Homo sapiens
gcacaccttttccccaggag

SEQ ID NO: 1500200 - DNA, 17 bp, Homo sapiens
gcacactcatacacatg

SEQ ID NO: 1500201 - DNA, 13 bp, Homo sapiens
gcacactggaata

SEQ ID NO: 1500202 - DNA, 13 bp, Homo sapiens
gcacacttcccca

SEQ ID NO: 1500203 - DNA, 14 bp, Homo sapiens
gcacacttccccat

SEQ ID NO: 1500204 - DNA, 22 bp, Homo sapiens
gcacactttacacaagaatcta

SEQ ID NO: 1500205 - DNA, 15 bp, Homo sapiens
gcacactttctggca

SEQ ID NO: 1500206 - DNA, 21 bp, Homo sapiens
gcacagaaacctctactaaaa

SEQ ID NO: 1500207 - DNA, 20 bp, Homo sapiens
gcacagaaggaatctgtgca

SEQ ID NO: 1500208 - DNA, 12 bp, Homo sapiens
gcacagaatatg

SEQ ID NO: 1500209 - DNA, 16 bp, Homo sapiens
gcacagacaagcagcc

SEQ ID NO: 1500210 - DNA, 18 bp, Homo sapiens
gcacagacaagcagccct

SEQ ID NO: 1500211 - DNA, 22 bp, Homo sapiens
gcacagacaagcagcccttgct

SEQ ID NO: 1500212 - DNA, 19 bp, Homo sapiens
gcacagagcgtccttcccc

SEQ ID NO: 1500213 - DNA, 17 bp, Homo sapiens
gcacagagggctaggga

SEQ ID NO: 1500214 - DNA, 19 bp, Homo sapiens
gcacagagggctagggagg

SEQ ID NO: 1500215 - DNA, 16 bp, Homo sapiens
gcacagatatttccat

SEQ ID NO: 1500216 - DNA, 19 bp, Homo sapiens
gcacagcaccgggggagag

SEQ ID NO: 1500217 - DNA, 23 bp, Homo sapiens
gcacagcactttggttttgctga

SEQ ID NO: 1500218 - DNA, 20 bp, Homo sapiens
gcacagcagctgcaggggcc

SEQ ID NO: 1500219 - DNA, 19 bp, Homo sapiens
gcacagccaacgagacaca

SEQ ID NO: 1500220 - DNA, 14 bp, Homo sapiens
gcacagccctccga

SEQ ID NO: 1500221 - DNA, 18 bp, Homo sapiens
gcacagccctgagtgtcc

SEQ ID NO: 1500222 - DNA, 14 bp, Homo sapiens
gcacagccctggga

SEQ ID NO: 1500223 - DNA, 12 bp, Homo sapiens
gcacagcctcta

SEQ ID NO: 1500224 - DNA, 16 bp, Homo sapiens
gcacagcgctgagcat

SEQ ID NO: 1500225 - DNA, 20 bp, Homo sapiens
gcacagctcaggaggcgccc

SEQ ID NO: 1500226 - DNA, 13 bp, Homo sapiens
gcacagctcccgg

SEQ ID NO: 1500227 - DNA, 15 bp, Homo sapiens
gcacagctcctgcca

SEQ ID NO: 1500228 - DNA, 13 bp, Homo sapiens
gcacagctgggca

SEQ ID NO: 1500229 - DNA, 23 bp, Homo sapiens
gcacagctgggcatgccatgtct

SEQ ID NO: 1500230 - DNA, 14 bp, Homo sapiens
gcacagcttgacct

SEQ ID NO: 1500231 - DNA, 19 bp, Homo sapiens
gcacagcttgacctgaggc

SEQ ID NO: 1500232 - DNA, 20 bp, Homo sapiens
gcacagcttgacctgaggct

SEQ ID NO: 1500233 - DNA, 15 bp, Homo sapiens
gcacaggacacctgg

SEQ ID NO: 1500234 - DNA, 16 bp, Homo sapiens
gcacaggactgattct

SEQ ID NO: 1500235 - DNA, 21 bp, Homo sapiens
gcacaggactgattctgggat

SEQ ID NO: 1500236 - DNA, 13 bp, Homo sapiens
gcacaggaggagg

SEQ ID NO: 1500237 - DNA, 20 bp, Homo sapiens
gcacaggaggcaggcatggc

SEQ ID NO: 1500238 - DNA, 22 bp, Homo sapiens
gcacaggaggcaggcatggccc

SEQ ID NO: 1500239 - DNA, 15 bp, Homo sapiens
gcacaggccctgggg

SEQ ID NO: 1500240 - DNA, 19 bp, Homo sapiens
gcacaggcctctgcctgct

SEQ ID NO: 1500241 - DNA, 23 bp, Homo sapiens
gcacagggaaaattgccccatcc

SEQ ID NO: 1500242 - DNA, 14 bp, Homo sapiens
gcacagggcaccag

SEQ ID NO: 1500243 - DNA, 17 bp, Homo sapiens
gcacagggtctgctctt

SEQ ID NO: 1500244 - DNA, 13 bp, Homo sapiens
gcacagtgcatct

SEQ ID NO: 1500245 - DNA, 19 bp, Homo sapiens
gcacagtgcatctcagccc

SEQ ID NO: 1500246 - DNA, 20 bp, Homo sapiens
gcacagtgcatctcagccca

SEQ ID NO: 1500247 - DNA, 21 bp, Homo sapiens
gcacagtgcatctcagcccac

SEQ ID NO: 1500248 - DNA, 14 bp, Homo sapiens
gcacagtgcctgca

SEQ ID NO: 1500249 - DNA, 22 bp, Homo sapiens
gcacagtggcgcatgcctgtaa

SEQ ID NO: 1500250 - DNA, 16 bp, Homo sapiens
gcacagtgggagctga

SEQ ID NO: 1500251 - DNA, 20 bp, Homo sapiens
gcacagtgggagctgagctg

SEQ ID NO: 1500252 - DNA, 21 bp, Homo sapiens
gcacagtgggagctgagctgg

SEQ ID NO: 1500253 - DNA, 22 bp, Homo sapiens
gcacagtgggagctgagctgga

SEQ ID NO: 1500254 - DNA, 18 bp, Homo sapiens
gcacagtgggcctgtgtg

SEQ ID NO: 1500255 - DNA, 17 bp, Homo sapiens
gcacagtgtgtgactta

SEQ ID NO: 1500256 - DNA, 15 bp, Homo sapiens
gcacagttcatggtt

SEQ ID NO: 1500257 - DNA, 19 bp, Homo sapiens
gcacagttgtctattctga

SEQ ID NO: 1500258 - DNA, 23 bp, Homo sapiens
gcacagttgtctattctgagcct

SEQ ID NO: 1500259 - DNA, 19 bp, Homo sapiens
gcacagttttagaataagg

SEQ ID NO: 1500260 - DNA, 23 bp, Homo sapiens
gcacagttttagaataaggagga

SEQ ID NO: 1500261 - DNA, 22 bp, Homo sapiens
gcacagttttctgagaaagact

SEQ ID NO: 1500262 - DNA, 22 bp, Homo sapiens
gcacatacacctcgtcaagagc

SEQ ID NO: 1500263 - DNA, 18 bp, Homo sapiens
gcacatactacctagaag

SEQ ID NO: 1500264 - DNA, 16 bp, Homo sapiens
gcacatactgtgttcc

SEQ ID NO: 1500265 - DNA, 16 bp, Homo sapiens
gcacatagagcttttt

SEQ ID NO: 1500266 - DNA, 21 bp, Homo sapiens
gcacataggctggtggccttg

SEQ ID NO: 1500267 - DNA, 23 bp, Homo sapiens
gcacataggctggtggccttggg

SEQ ID NO: 1500268 - DNA, 19 bp, Homo sapiens
gcacatgcctgtagtccca

SEQ ID NO: 1500269 - DNA, 14 bp, Homo sapiens
gcacatgcgggctc

SEQ ID NO: 1500270 - DNA, 20 bp, Homo sapiens
gcacatgctgtctggccctg

SEQ ID NO: 1500271 - DNA, 22 bp, Homo sapiens
gcacatggaggagcttggggga

SEQ ID NO: 1500272 - DNA, 23 bp, Homo sapiens
gcacatggccatagaggcccagg

SEQ ID NO: 1500273 - DNA, 20 bp, Homo sapiens
gcacatggtttaaatatgaa

SEQ ID NO: 1500274 - DNA, 14 bp, Homo sapiens
gcacatgtaataaa

SEQ ID NO: 1500275 - DNA, 20 bp, Homo sapiens
gcacatgtaataaattcaaa

SEQ ID NO: 1500276 - DNA, 13 bp, Homo sapiens
gcacatgtcttgt

SEQ ID NO: 1500277 - DNA, 21 bp, Homo sapiens
gcacatgtgccacacagtgac

SEQ ID NO: 1500278 - DNA, 17 bp, Homo sapiens
gcacatgtgtatttata

SEQ ID NO: 1500279 - DNA, 12 bp, Homo sapiens
gcacatgtttcc

SEQ ID NO: 1500280 - DNA, 17 bp, Homo sapiens
gcacattcctggccccg

SEQ ID NO: 1500281 - DNA, 22 bp, Homo sapiens
gcacattgcccatggctgggaa

SEQ ID NO: 1500282 - DNA, 17 bp, Homo sapiens
gcacattgcctgttctg

SEQ ID NO: 1500283 - DNA, 16 bp, Homo sapiens
gcacatttctggattg

SEQ ID NO: 1500284 - DNA, 21 bp, Homo sapiens
gcacatttgtcactgaataat

SEQ ID NO: 1500285 - DNA, 14 bp, Homo sapiens
gcacattttgtaca

SEQ ID NO: 1500286 - DNA, 22 bp, Homo sapiens
gcaccaaacctaagtccttcca

SEQ ID NO: 1500287 - DNA, 12 bp, Homo sapiens
gcaccaaagaca

SEQ ID NO: 1500288 - DNA, 14 bp, Homo sapiens
gcaccaagaaagct

SEQ ID NO: 1500289 - DNA, 13 bp, Homo sapiens
gcaccaagagcag

SEQ ID NO: 1500290 - DNA, 14 bp, Homo sapiens
gcaccaccaagcca

SEQ ID NO: 1500291 - DNA, 17 bp, Homo sapiens
gcaccaccaagccaagg

SEQ ID NO: 1500292 - DNA, 13 bp, Homo sapiens
gcaccaccaggag

SEQ ID NO: 1500293 - DNA, 16 bp, Homo sapiens
gcaccaccaggagcag

SEQ ID NO: 1500294 - DNA, 17 bp, Homo sapiens
gcaccaccaggagcagc

SEQ ID NO: 1500295 - DNA, 21 bp, Homo sapiens
gcaccaccaggagcagcagcc

SEQ ID NO: 1500296 - DNA, 11 bp, Homo sapiens
gcaccacccta

SEQ ID NO: 1500297 - DNA, 23 bp, Homo sapiens
gcaccaccctagtcccttcccct

SEQ ID NO: 1500298 - DNA, 18 bp, Homo sapiens
gcaccacctacacaggag

SEQ ID NO: 1500299 - DNA, 19 bp, Homo sapiens
gcaccacctacacaggagt

SEQ ID NO: 1500300 - DNA, 20 bp, Homo sapiens
gcaccacctacacaggagtc

SEQ ID NO: 1500301 - DNA, 19 bp, Homo sapiens
gcaccactgcactccagcc

SEQ ID NO: 1500302 - DNA, 22 bp, Homo sapiens
gcaccactgcactccagcctgg

SEQ ID NO: 1500303 - DNA, 12 bp, Homo sapiens
gcaccactgctt

SEQ ID NO: 1500304 - DNA, 15 bp, Homo sapiens
gcaccagacacccag

SEQ ID NO: 1500305 - DNA, 16 bp, Homo sapiens
gcaccagacacccagg

SEQ ID NO: 1500306 - DNA, 18 bp, Homo sapiens
gcaccagacacccaggac

SEQ ID NO: 1500307 - DNA, 23 bp, Homo sapiens
gcaccagagtgaaagggctatgg

SEQ ID NO: 1500308 - DNA, 13 bp, Homo sapiens
gcaccagccagcg

SEQ ID NO: 1500309 - DNA, 19 bp, Homo sapiens
gcaccagccccctggatgg

SEQ ID NO: 1500310 - DNA, 22 bp, Homo sapiens
gcaccagctctgtggcctgtgt

SEQ ID NO: 1500311 - DNA, 23 bp, Homo sapiens
gcaccagctctgtggcctgtgtc

SEQ ID NO: 1500312 - DNA, 11 bp, Homo sapiens
gcaccagctgc

SEQ ID NO: 1500313 - DNA, 19 bp, Homo sapiens
gcaccagctgctctgcccc

SEQ ID NO: 1500314 - DNA, 21 bp, Homo sapiens
gcaccagctgctctgcccctt

SEQ ID NO: 1500315 - DNA, 15 bp, Homo sapiens
gcaccaggccgggct

SEQ ID NO: 1500316 - DNA, 15 bp, Homo sapiens
gcaccatctgcttgg

SEQ ID NO: 1500317 - DNA, 23 bp, Homo sapiens
gcaccatgctgctggggaagaca

SEQ ID NO: 1500318 - DNA, 20 bp, Homo sapiens
gcaccattctcctgcctcag

SEQ ID NO: 1500319 - DNA, 20 bp, Homo sapiens
gcacccaccgtggaggagga

SEQ ID NO: 1500320 - DNA, 14 bp, Homo sapiens
gcacccacctccac

SEQ ID NO: 1500321 - DNA, 18 bp, Homo sapiens
gcacccacctccaccccc

SEQ ID NO: 1500322 - DNA, 13 bp, Homo sapiens
gcacccacctgtt

SEQ ID NO: 1500323 - DNA, 18 bp, Homo sapiens
gcacccacctgttttctg

SEQ ID NO: 1500324 - DNA, 14 bp, Homo sapiens
gcacccactcacca

SEQ ID NO: 1500325 - DNA, 18 bp, Homo sapiens
gcacccactcaccagggt

SEQ ID NO: 1500326 - DNA, 11 bp, Homo sapiens
gcacccagaac

SEQ ID NO: 1500327 - DNA, 17 bp, Homo sapiens
gcacccaggcctccctg

SEQ ID NO: 1500328 - DNA, 20 bp, Homo sapiens
gcacccaggcctccctgcag

SEQ ID NO: 1500329 - DNA, 21 bp, Homo sapiens
gcacccatgtgggcgcccacc

SEQ ID NO: 1500330 - DNA, 14 bp, Homo sapiens
gcaccccagcattc

SEQ ID NO: 1500331 - DNA, 22 bp, Homo sapiens
gcaccccagcattccagctctg

SEQ ID NO: 1500332 - DNA, 12 bp, Homo sapiens
gcacccccacaa

SEQ ID NO: 1500333 - DNA, 21 bp, Homo sapiens
gcacccccacaagctgtccct

SEQ ID NO: 1500334 - DNA, 22 bp, Homo sapiens
gcacccccacaagctgtccctg

SEQ ID NO: 1500335 - DNA, 14 bp, Homo sapiens
gcaccccccaagct

SEQ ID NO: 1500336 - DNA, 23 bp, Homo sapiens
gcaccccctcccttctgggaaac

SEQ ID NO: 1500337 - DNA, 21 bp, Homo sapiens
gcaccccctgctccaccagca

SEQ ID NO: 1500338 - DNA, 18 bp, Homo sapiens
gcaccccggcctcagggc

SEQ ID NO: 1500339 - DNA, 22 bp, Homo sapiens
gcacccctccccattcacagag

SEQ ID NO: 1500340 - DNA, 15 bp, Homo sapiens
gcacccctccctgct

SEQ ID NO: 1500341 - DNA, 17 bp, Homo sapiens
gcacccctccctgcttg

SEQ ID NO: 1500342 - DNA, 12 bp, Homo sapiens
gcaccccttctc

SEQ ID NO: 1500343 - DNA, 17 bp, Homo sapiens
gcaccccttctctcctc

SEQ ID NO: 1500344 - DNA, 18 bp, Homo sapiens
gcaccccttctctcctcc

SEQ ID NO: 1500345 - DNA, 20 bp, Homo sapiens
gcaccccttctctcctcccc

SEQ ID NO: 1500346 - DNA, 21 bp, Homo sapiens
gcaccccttctctcctcccca

SEQ ID NO: 1500347 - DNA, 22 bp, Homo sapiens
gcaccccttctctcctccccaa

SEQ ID NO: 1500348 - DNA, 16 bp, Homo sapiens
gcaccccttgtttctg

SEQ ID NO: 1500349 - DNA, 21 bp, Homo sapiens
gcaccccttgtttctgttgtt

SEQ ID NO: 1500350 - DNA, 16 bp, Homo sapiens
gcacccgcctctcccg

SEQ ID NO: 1500351 - DNA, 13 bp, Homo sapiens
gcacccggctcgt

SEQ ID NO: 1500352 - DNA, 16 bp, Homo sapiens
gcaccctaggcagcct

SEQ ID NO: 1500353 - DNA, 18 bp, Homo sapiens
gcaccctaggcagcctgc

SEQ ID NO: 1500354 - DNA, 16 bp, Homo sapiens
gcaccctccgccttca

SEQ ID NO: 1500355 - DNA, 18 bp, Homo sapiens
gcaccctgcacctgctgc

SEQ ID NO: 1500356 - DNA, 19 bp, Homo sapiens
gcaccctgcacctgctgcg

SEQ ID NO: 1500357 - DNA, 21 bp, Homo sapiens
gcaccctgcagagcacacagg

SEQ ID NO: 1500358 - DNA, 15 bp, Homo sapiens
gcaccctgcgcctcc

SEQ ID NO: 1500359 - DNA, 17 bp, Homo sapiens
gcaccctgcgcctccag

SEQ ID NO: 1500360 - DNA, 18 bp, Homo sapiens
gcaccctggaaaggggag

SEQ ID NO: 1500361 - DNA, 14 bp, Homo sapiens
gcaccctggaaccg

SEQ ID NO: 1500362 - DNA, 23 bp, Homo sapiens
gcaccctggaaccgggaagggtg

SEQ ID NO: 1500363 - DNA, 22 bp, Homo sapiens
gcaccctgggtgccattcccag

SEQ ID NO: 1500364 - DNA, 12 bp, Homo sapiens
gcacccttccct

SEQ ID NO: 1500365 - DNA, 14 bp, Homo sapiens
gcaccgcctgccct

SEQ ID NO: 1500366 - DNA, 20 bp, Homo sapiens
gcaccgcctgccctcccgca

SEQ ID NO: 1500367 - DNA, 20 bp, Homo sapiens
gcaccgggaccccctcacca

SEQ ID NO: 1500368 - DNA, 21 bp, Homo sapiens
gcaccgggaccccctcaccat

SEQ ID NO: 1500369 - DNA, 22 bp, Homo sapiens
gcaccgggggagagggacactc

SEQ ID NO: 1500370 - DNA, 15 bp, Homo sapiens
gcaccgtccaggccc

SEQ ID NO: 1500371 - DNA, 15 bp, Homo sapiens
gcaccgtcctcagca

SEQ ID NO: 1500372 - DNA, 21 bp, Homo sapiens
gcaccgtcctcagcagtccac

SEQ ID NO: 1500373 - DNA, 14 bp, Homo sapiens
gcacctaaagcagc

SEQ ID NO: 1500374 - DNA, 18 bp, Homo sapiens
gcacctaatccaggcaga

SEQ ID NO: 1500375 - DNA, 21 bp, Homo sapiens
gcacctacatccccaggtctc

SEQ ID NO: 1500376 - DNA, 21 bp, Homo sapiens
gcacctatagtcccagctact

SEQ ID NO: 1500377 - DNA, 22 bp, Homo sapiens
gcacctccaggcaggccaggct

SEQ ID NO: 1500378 - DNA, 16 bp, Homo sapiens
gcacctccaggcctgt

SEQ ID NO: 1500379 - DNA, 20 bp, Homo sapiens
gcacctccaggcctgttgct

SEQ ID NO: 1500380 - DNA, 13 bp, Homo sapiens
gcacctcccccca

SEQ ID NO: 1500381 - DNA, 13 bp, Homo sapiens
gcacctccccgct

SEQ ID NO: 1500382 - DNA, 21 bp, Homo sapiens
gcacctccccgctctccctgt

SEQ ID NO: 1500383 - DNA, 22 bp, Homo sapiens
gcacctccccgctctccctgtc

SEQ ID NO: 1500384 - DNA, 15 bp, Homo sapiens
gcacctccccgctgg

SEQ ID NO: 1500385 - DNA, 19 bp, Homo sapiens
gcacctcccttccctccct

SEQ ID NO: 1500386 - DNA, 22 bp, Homo sapiens
gcacctcggggacaccagagct

SEQ ID NO: 1500387 - DNA, 18 bp, Homo sapiens
gcacctctggctagagcc

SEQ ID NO: 1500388 - DNA, 21 bp, Homo sapiens
gcacctctggctagagccgag

SEQ ID NO: 1500389 - DNA, 19 bp, Homo sapiens
gcacctgaaccccatgggc

SEQ ID NO: 1500390 - DNA, 24 bp, Homo sapiens
gcacctgaaccccatgggcttgga

SEQ ID NO: 1500391 - DNA, 18 bp, Homo sapiens
gcacctgagaccctactg

SEQ ID NO: 1500392 - DNA, 15 bp, Homo sapiens
gcacctgcctccacc

SEQ ID NO: 1500393 - DNA, 19 bp, Homo sapiens
gcacctgcctccaccagca

SEQ ID NO: 1500394 - DNA, 18 bp, Homo sapiens
gcacctgcgcacaggtgg

SEQ ID NO: 1500395 - DNA, 17 bp, Homo sapiens
gcacctgctcccagtgg

SEQ ID NO: 1500396 - DNA, 11 bp, Homo sapiens
gcacctgctgc

SEQ ID NO: 1500397 - DNA, 12 bp, Homo sapiens
gcacctggcctg

SEQ ID NO: 1500398 - DNA, 14 bp, Homo sapiens
gcacctggcctgct

SEQ ID NO: 1500399 - DNA, 15 bp, Homo sapiens
gcacctggcctgctg

SEQ ID NO: 1500400 - DNA, 20 bp, Homo sapiens
gcacctggcctgctgggaac

SEQ ID NO: 1500401 - DNA, 18 bp, Homo sapiens
gcacctggcctgggccac

SEQ ID NO: 1500402 - DNA, 22 bp, Homo sapiens
gcacctggtttctgttctgttg

SEQ ID NO: 1500403 - DNA, 15 bp, Homo sapiens
gcacctgtagtccca

SEQ ID NO: 1500404 - DNA, 16 bp, Homo sapiens
gcacctgtagtcccag

SEQ ID NO: 1500405 - DNA, 20 bp, Homo sapiens
gcacctgtccccaccctcca

SEQ ID NO: 1500406 - DNA, 18 bp, Homo sapiens
gcacctgtgttccagccc

SEQ ID NO: 1500407 - DNA, 12 bp, Homo sapiens
gcaccttcctcc

SEQ ID NO: 1500408 - DNA, 15 bp, Homo sapiens
gcaccttcctcctcc

SEQ ID NO: 1500409 - DNA, 17 bp, Homo sapiens
gcaccttcctcctcccc

SEQ ID NO: 1500410 - DNA, 18 bp, Homo sapiens
gcaccttcctcctccccg

SEQ ID NO: 1500411 - DNA, 14 bp, Homo sapiens
gcaccttggcccag

SEQ ID NO: 1500412 - DNA, 18 bp, Homo sapiens
gcaccttgtcatgtacca

SEQ ID NO: 1500413 - DNA, 22 bp, Homo sapiens
gcaccttgtgtctgtacacgtg

SEQ ID NO: 1500414 - DNA, 22 bp, Homo sapiens
gcaccttttcatggtctctgca

SEQ ID NO: 1500415 - DNA, 16 bp, Homo sapiens
gcacgaacccacctgc

SEQ ID NO: 1500416 - DNA, 15 bp, Homo sapiens
gcacgacgtcagcct

SEQ ID NO: 1500417 - DNA, 20 bp, Homo sapiens
gcacgagtgggaaggacttg

SEQ ID NO: 1500418 - DNA, 11 bp, Homo sapiens
gcacgcacaca

SEQ ID NO: 1500419 - DNA, 12 bp, Homo sapiens
gcacgcacacac

SEQ ID NO: 1500420 - DNA, 13 bp, Homo sapiens
gcacgcacacaca

SEQ ID NO: 1500421 - DNA, 16 bp, Homo sapiens
gcacgcacacacacaa

SEQ ID NO: 1500422 - DNA, 15 bp, Homo sapiens
gcacgcaccactgct

SEQ ID NO: 1500423 - DNA, 18 bp, Homo sapiens
gcacgcaccactgcttcc

SEQ ID NO: 1500424 - DNA, 21 bp, Homo sapiens
gcacgcaccactgcttcccac

SEQ ID NO: 1500425 - DNA, 18 bp, Homo sapiens
gcacgcacttgcctgttg

SEQ ID NO: 1500426 - DNA, 16 bp, Homo sapiens
gcacgcaggcacagca

SEQ ID NO: 1500427 - DNA, 16 bp, Homo sapiens
gcacgcctgcaggctg

SEQ ID NO: 1500428 - DNA, 20 bp, Homo sapiens
gcacgcctgcaggctggaga

SEQ ID NO: 1500429 - DNA, 14 bp, Homo sapiens
gcacgcctgccatc

SEQ ID NO: 1500430 - DNA, 15 bp, Homo sapiens
gcacgcctgccatct

SEQ ID NO: 1500431 - DNA, 18 bp, Homo sapiens
gcacggagccgcgggaca

SEQ ID NO: 1500432 - DNA, 20 bp, Homo sapiens
gcacggcgggatcctccaca

SEQ ID NO: 1500433 - DNA, 16 bp, Homo sapiens
gcacgggtggtccccg

SEQ ID NO: 1500434 - DNA, 18 bp, Homo sapiens
gcacggtgactctgtcca

SEQ ID NO: 1500435 - DNA, 15 bp, Homo sapiens
gcacgtccttgggcg

SEQ ID NO: 1500436 - DNA, 16 bp, Homo sapiens
gcacgtggagagctgg

SEQ ID NO: 1500437 - DNA, 23 bp, Homo sapiens
gcacgtggcatgtggcctgtggc

SEQ ID NO: 1500438 - DNA, 13 bp, Homo sapiens
gcacgtggcctct

SEQ ID NO: 1500439 - DNA, 16 bp, Homo sapiens
gcacgtggggcccact

SEQ ID NO: 1500440 - DNA, 14 bp, Homo sapiens
gcactaaagcagtg

SEQ ID NO: 1500441 - DNA, 19 bp, Homo sapiens
gcactaatttgatgtttac

SEQ ID NO: 1500442 - DNA, 17 bp, Homo sapiens
gcactactcctctgcag

SEQ ID NO: 1500443 - DNA, 19 bp, Homo sapiens
gcactactcctctgcagtg

SEQ ID NO: 1500444 - DNA, 17 bp, Homo sapiens
gcactactgacatgtgg

SEQ ID NO: 1500445 - DNA, 17 bp, Homo sapiens
gcactagtaaaggagga

SEQ ID NO: 1500446 - DNA, 18 bp, Homo sapiens
gcactagtaaaggaggaa

SEQ ID NO: 1500447 - DNA, 23 bp, Homo sapiens
gcactagtttgattattatgttt

SEQ ID NO: 1500448 - DNA, 20 bp, Homo sapiens
gcactataatgtaagctcta

SEQ ID NO: 1500449 - DNA, 15 bp, Homo sapiens
gcactattttatatt

SEQ ID NO: 1500450 - DNA, 16 bp, Homo sapiens
gcactattttatattt

SEQ ID NO: 1500451 - DNA, 18 bp, Homo sapiens
gcactattttatatttaa

SEQ ID NO: 1500452 - DNA, 22 bp, Homo sapiens
gcactcaacaatggttgaatga

SEQ ID NO: 1500453 - DNA, 20 bp, Homo sapiens
gcactcacagacctggagcc

SEQ ID NO: 1500454 - DNA, 13 bp, Homo sapiens
gcactccacacat

SEQ ID NO: 1500455 - DNA, 19 bp, Homo sapiens
gcactccacacatctttct

SEQ ID NO: 1500456 - DNA, 16 bp, Homo sapiens
gcactccagcctgggc

SEQ ID NO: 1500457 - DNA, 16 bp, Homo sapiens
gcactccagcctgggt

SEQ ID NO: 1500458 - DNA, 18 bp, Homo sapiens
gcactccagcctgggtca

SEQ ID NO: 1500459 - DNA, 16 bp, Homo sapiens
gcactccatggccacc

SEQ ID NO: 1500460 - DNA, 18 bp, Homo sapiens
gcactcccacctgacaca

SEQ ID NO: 1500461 - DNA, 14 bp, Homo sapiens
gcactccccagagc

SEQ ID NO: 1500462 - DNA, 18 bp, Homo sapiens
gcactccccagagctgtg

SEQ ID NO: 1500463 - DNA, 19 bp, Homo sapiens
gcactccccagagctgtgc

SEQ ID NO: 1500464 - DNA, 17 bp, Homo sapiens
gcactccctggccttgc

SEQ ID NO: 1500465 - DNA, 18 bp, Homo sapiens
gcactccctggccttgcc

SEQ ID NO: 1500466 - DNA, 23 bp, Homo sapiens
gcactccgcgccgatgccaccgg

SEQ ID NO: 1500467 - DNA, 21 bp, Homo sapiens
gcactcgtgtgcaacagacaa

SEQ ID NO: 1500468 - DNA, 19 bp, Homo sapiens
gcactctctaaatcttcct

SEQ ID NO: 1500469 - DNA, 14 bp, Homo sapiens
gcactctgccccca

SEQ ID NO: 1500470 - DNA, 14 bp, Homo sapiens
gcactctgttattt

SEQ ID NO: 1500471 - DNA, 19 bp, Homo sapiens
gcactctgttatttagact

SEQ ID NO: 1500472 - DNA, 21 bp, Homo sapiens
gcactgaaaacttagccagag

SEQ ID NO: 1500473 - DNA, 14 bp, Homo sapiens
gcactgaaaaggtt

SEQ ID NO: 1500474 - DNA, 22 bp, Homo sapiens
gcactgaaagtcacggctgcgc

SEQ ID NO: 1500475 - DNA, 19 bp, Homo sapiens
gcactgaaccttaggcttt

SEQ ID NO: 1500476 - DNA, 21 bp, Homo sapiens
gcactgaagccggacagctgc

SEQ ID NO: 1500477 - DNA, 22 bp, Homo sapiens
gcactgaagccggacagctgcc

SEQ ID NO: 1500478 - DNA, 12 bp, Homo sapiens
gcactgacagat

SEQ ID NO: 1500479 - DNA, 14 bp, Homo sapiens
gcactgacccttcc

SEQ ID NO: 1500480 - DNA, 16 bp, Homo sapiens
gcactgacccttccag

SEQ ID NO: 1500481 - DNA, 20 bp, Homo sapiens
gcactgacccttccagacat

SEQ ID NO: 1500482 - DNA, 14 bp, Homo sapiens
gcactgactgatag

SEQ ID NO: 1500483 - DNA, 15 bp, Homo sapiens
gcactgacttctaag

SEQ ID NO: 1500484 - DNA, 21 bp, Homo sapiens
gcactgagatatttattgttt

SEQ ID NO: 1500485 - DNA, 14 bp, Homo sapiens
gcactgagcccccc

SEQ ID NO: 1500486 - DNA, 20 bp, Homo sapiens
gcactgagggccacactatt

SEQ ID NO: 1500487 - DNA, 24 bp, Homo sapiens
gcactgagggccacactattacca

SEQ ID NO: 1500488 - DNA, 19 bp, Homo sapiens
gcactgagggtggcactca

SEQ ID NO: 1500489 - DNA, 16 bp, Homo sapiens
gcagctgatgcctgaa

SEQ ID NO: 1500490 - DNA, 18 bp, Homo sapiens
gcagctgatgcctgaatg

SEQ ID NO: 1500491 - DNA, 21 bp, Homo sapiens
gcagctgattcagcagtgcct

SEQ ID NO: 1500492 - DNA, 16 bp, Homo sapiens
gcagctgcccctggca

SEQ ID NO: 1500493 - DNA, 17 bp, Homo sapiens
gcagctgcccctggcac

SEQ ID NO: 1500494 - DNA, 16 bp, Homo sapiens
gcagctgcctctgctc

SEQ ID NO: 1500495 - DNA, 14 bp, Homo sapiens
gcagctgcgggtct

SEQ ID NO: 1500496 - DNA, 19 bp, Homo sapiens
gcagctgcgggtctgaagg

SEQ ID NO: 1500497 - DNA, 13 bp, Homo sapiens
gcagctgctcccc

SEQ ID NO: 1500498 - DNA, 14 bp, Homo sapiens
gcagctgctcccca

SEQ ID NO: 1500499 - DNA, 11 bp, Homo sapiens
gcagctgctct

SEQ ID NO: 1500500 - DNA, 18 bp, Homo sapiens
gcagcaggtgctgggctg

SEQ ID NO: 1500501 - DNA, 19 bp, Homo sapiens
gcagcatcttcacttctaa

SEQ ID NO: 1500502 - DNA, 14 bp, Homo sapiens
gcagcatcttctgg

SEQ ID NO: 1500503 - DNA, 16 bp, Homo sapiens
gcagcatggcatagcc

SEQ ID NO: 1500504 - DNA, 20 bp, Homo sapiens
gcagcatgttgctgaggagt

SEQ ID NO: 1500505 - DNA, 13 bp, Homo sapiens
gcagcatttacta

SEQ ID NO: 1500506 - DNA, 14 bp, Homo sapiens
gcagcatttactat

SEQ ID NO: 1500507 - DNA, 23 bp, Homo sapiens
gcaggctttgggaacactggcct

SEQ ID NO: 1500508 - DNA, 16 bp, Homo sapiens
gcagggaagagggcag

SEQ ID NO: 1500509 - DNA, 17 bp, Homo sapiens
gcagggaagagggcagt

SEQ ID NO: 1500510 - DNA, 18 bp, Homo sapiens
gcagggaagccccacatg

SEQ ID NO: 1500511 - DNA, 21 bp, Homo sapiens
gcagggacaaagaggccttta

SEQ ID NO: 1500512 - DNA, 14 bp, Homo sapiens
gcagggacctgaga

SEQ ID NO: 1500513 - DNA, 13 bp, Homo sapiens
gcagggagcactg

SEQ ID NO: 1500514 - DNA, 22 bp, Homo sapiens
gcagggagccgagatcacgcca

SEQ ID NO: 1500515 - DNA, 22 bp, Homo sapiens
gcagggagctgggcccgacatg

SEQ ID NO: 1500516 - DNA, 18 bp, Homo sapiens
gcagggagggcagttttc

SEQ ID NO: 1500517 - DNA, 19 bp, Homo sapiens
gcagggatgatggcagagc

SEQ ID NO: 1500518 - DNA, 22 bp, Homo sapiens
gcagggatgatggcagagccag

SEQ ID NO: 1500519 - DNA, 14 bp, Homo sapiens
gcagggcatctcct

SEQ ID NO: 1500520 - DNA, 19 bp, Homo sapiens
gcagggcatctcctgtgca

SEQ ID NO: 1500521 - DNA, 21 bp, Homo sapiens
gcagggcatctcctgtgcatg

SEQ ID NO: 1500522 - DNA, 19 bp, Homo sapiens
gcagggccactcaacagag

SEQ ID NO: 1500523 - DNA, 18 bp, Homo sapiens
gcagggccatccactgtg

SEQ ID NO: 1500524 - DNA, 18 bp, Homo sapiens
gcagggccatctgactgc

SEQ ID NO: 1500525 - DNA, 14 bp, Homo sapiens
gcagggcccacgtg

SEQ ID NO: 1500526 - DNA, 23 bp, Homo sapiens
gcagggccgcccgggcccagagg

SEQ ID NO: 1500527 - DNA, 18 bp, Homo sapiens
gcagggccgcgagaggcc

SEQ ID NO: 1500528 - DNA, 12 bp, Homo sapiens
gcagggcctggg

SEQ ID NO: 1500529 - DNA, 21 bp, Homo sapiens
gcagggccttgcccagagatg

SEQ ID NO: 1500530 - DNA, 17 bp, Homo sapiens
gcagggcgggcagaggg

SEQ ID NO: 1500531 - DNA, 13 bp, Homo sapiens
gcagggctgggcc

SEQ ID NO: 1500532 - DNA, 20 bp, Homo sapiens
gcagggctgggccaggtctc

SEQ ID NO: 1500533 - DNA, 14 bp, Homo sapiens
gcagggctttaaaa

SEQ ID NO: 1500534 - DNA, 18 bp, Homo sapiens
gcaggggaattttctctc

SEQ ID NO: 1500535 - DNA, 18 bp, Homo sapiens
gcaggggagacaggagcc

SEQ ID NO: 1500536 - DNA, 15 bp, Homo sapiens
gcaggggcaccttcc

SEQ ID NO: 1500537 - DNA, 14 bp, Homo sapiens
gcaggggctctgct

SEQ ID NO: 1500538 - DNA, 22 bp, Homo sapiens
gcagggggccccgccagggctg

SEQ ID NO: 1500539 - DNA, 23 bp, Homo sapiens
gcagggggccccgccagggctgg

SEQ ID NO: 1500540 - DNA, 18 bp, Homo sapiens
gcaggggggctgtgccaa

SEQ ID NO: 1500541 - DNA, 14 bp, Homo sapiens
gcagggggtgaggg

SEQ ID NO: 1500542 - DNA, 12 bp, Homo sapiens
gcaggggtcccc

SEQ ID NO: 1500543 - DNA, 20 bp, Homo sapiens
gcaggggttggtcaaggcca

SEQ ID NO: 1500544 - DNA, 15 bp, Homo sapiens
gcagggtcaagcctc

SEQ ID NO: 1500545 - DNA, 14 bp, Homo sapiens
gcagggtcaggaga

SEQ ID NO: 1500546 - DNA, 15 bp, Homo sapiens
gcagggtcaggagag

SEQ ID NO: 1500547 - DNA, 16 bp, Homo sapiens
gcagggtcaggagagg

SEQ ID NO: 1500548 - DNA, 15 bp, Homo sapiens
gcagggtccacagct

SEQ ID NO: 1500549 - DNA, 16 bp, Homo sapiens
gcagggtccacgcctc

SEQ ID NO: 1500550 - DNA, 21 bp, Homo sapiens
gcagggtcctcttctgggcct

SEQ ID NO: 1500551 - DNA, 14 bp, Homo sapiens
gcagggtgagaagc

SEQ ID NO: 1500552 - DNA, 17 bp, Homo sapiens
gcagggtggtgctggga

SEQ ID NO: 1500553 - DNA, 18 bp, Homo sapiens
gcagggtggtgctgggac

SEQ ID NO: 1500554 - DNA, 23 bp, Homo sapiens
gcaggtacttcctcctgatggcc

SEQ ID NO: 1500555 - DNA, 17 bp, Homo sapiens
gcaggtcactgtcactg

SEQ ID NO: 1500556 - DNA, 21 bp, Homo sapiens
gcaggtcactgtcactgccga

SEQ ID NO: 1500557 - DNA, 18 bp, Homo sapiens
gcaggtgagaacccagag

SEQ ID NO: 1500558 - DNA, 18 bp, Homo sapiens
gcaggtgattggaccagg

SEQ ID NO: 1500559 - DNA, 21 bp, Homo sapiens
gcaggtgattggaccaggcca

SEQ ID NO: 1500560 - DNA, 17 bp, Homo sapiens
gcaggtgccatgcctgc

SEQ ID NO: 1500561 - DNA, 20 bp, Homo sapiens
gcaggtgccatgcctgctcc

SEQ ID NO: 1500562 - DNA, 16 bp, Homo sapiens
gcaggtgcctccaggt

SEQ ID NO: 1500563 - DNA, 19 bp, Homo sapiens
gcaggtgctgccttgagac

SEQ ID NO: 1500564 - DNA, 21 bp, Homo sapiens
gcaggtggatctatttcatgt

SEQ ID NO: 1500565 - DNA, 15 bp, Homo sapiens
gcaggtggccacagc

SEQ ID NO: 1500566 - DNA, 19 bp, Homo sapiens
gcaggtggccgcccctgag

SEQ ID NO: 1500567 - DNA, 22 bp, Homo sapiens
gcaggtggccgcccctgaggct

SEQ ID NO: 1500568 - DNA, 17 bp, Homo sapiens
gcaggtgggctgcctgc

SEQ ID NO: 1500569 - DNA, 18 bp, Homo sapiens
gcaggtgggctgcctgct

SEQ ID NO: 1500570 - DNA, 21 bp, Homo sapiens
gcaggtggtggcactgagccc

SEQ ID NO: 1500571 - DNA, 22 bp, Homo sapiens
gcaggtggtggcactgagcccc

SEQ ID NO: 1500572 - DNA, 23 bp, Homo sapiens
gcaggtggtggcactgagccccc

SEQ ID NO: 1500573 - DNA, 13 bp, Homo sapiens
gcaggtgtcatat

SEQ ID NO: 1500574 - DNA, 13 bp, Homo sapiens
gcaggtgtggtgg

SEQ ID NO: 1500575 - DNA, 20 bp, Homo sapiens
gcaggtgtggtggctcatgg

SEQ ID NO: 1500576 - DNA, 21 bp, Homo sapiens
gcaggtgtggtggctcatggc

SEQ ID NO: 1500577 - DNA, 16 bp, Homo sapiens
gcaggtgttgggacct

SEQ ID NO: 1500578 - DNA, 20 bp, Homo sapiens
gcaggtgttgggacctgctg

SEQ ID NO: 1500579 - DNA, 21 bp, Homo sapiens
gcaggtgttgggacctgctgc

SEQ ID NO: 1500580 - DNA, 22 bp, Homo sapiens
gcaggtgttgggacctgctgct

SEQ ID NO: 1500581 - DNA, 22 bp, Homo sapiens
gcaggttatgtcagcagctctg

SEQ ID NO: 1500582 - DNA, 12 bp, Homo sapiens
gcaggttcttga

SEQ ID NO: 1500583 - DNA, 14 bp, Homo sapiens
gcaggttcttgatg

SEQ ID NO: 1500584 - DNA, 16 bp, Homo sapiens
gcaggttgaggggctc

SEQ ID NO: 1500585 - DNA, 19 bp, Homo sapiens
gcaggttgaggggctcctg

SEQ ID NO: 1500586 - DNA, 22 bp, Homo sapiens
gcaggttgaggggctcctggaa

SEQ ID NO: 1500587 - DNA, 13 bp, Homo sapiens
gcagtaacttggg

SEQ ID NO: 1500588 - DNA, 15 bp, Homo sapiens
gcagtaagtcttttt

SEQ ID NO: 1500589 - DNA, 13 bp, Homo sapiens
gcagtaataaaaa

SEQ ID NO: 1500590 - DNA, 20 bp, Homo sapiens
gcagtagaaataatatgcat

SEQ ID NO: 1500591 - DNA, 17 bp, Homo sapiens
gcagtagaactccaggc

SEQ ID NO: 1500592 - DNA, 18 bp, Homo sapiens
gcagtagaaggtgccgtg

SEQ ID NO: 1500593 - DNA, 23 bp, Homo sapiens
gcagtagaaggtgccgtgagcag

SEQ ID NO: 1500594 - DNA, 21 bp, Homo sapiens
gcagtagaggctatggacagg

SEQ ID NO: 1500595 - DNA, 18 bp, Homo sapiens
gcagtagagtcatctcca

SEQ ID NO: 1500596 - DNA, 20 bp, Homo sapiens
gcagtagagtcatctccatc

SEQ ID NO: 1500597 - DNA, 20 bp, Homo sapiens
gcagtaggggaacctaggag

SEQ ID NO: 1500598 - DNA, 15 bp, Homo sapiens
gcagtatcacaggcc

SEQ ID NO: 1500599 - DNA, 16 bp, Homo sapiens
gcagtatcacaggcca

SEQ ID NO: 1500600 - DNA, 23 bp, Homo sapiens
gcagtattttgtgtcctccagga

SEQ ID NO: 1500601 - DNA, 21 bp, Homo sapiens
gcagtcaacagttcaaagaag

SEQ ID NO: 1500602 - DNA, 20 bp, Homo sapiens
gcagtcacactgttactcca

SEQ ID NO: 1500603 - DNA, 14 bp, Homo sapiens
gcagtcactggagg

SEQ ID NO: 1500604 - DNA, 17 bp, Homo sapiens
gcagtcagggtgggaag

SEQ ID NO: 1500605 - DNA, 16 bp, Homo sapiens
gcatcacagggcagag

SEQ ID NO: 1500606 - DNA, 17 bp, Homo sapiens
gcatcacctcaggccag

SEQ ID NO: 1500607 - DNA, 16 bp, Homo sapiens
gcatcacctgcctgtt

SEQ ID NO: 1500608 - DNA, 23 bp, Homo sapiens
gcatcacttaacggaccaaagca

SEQ ID NO: 1500609 - DNA, 23 bp, Homo sapiens
gcatcagctgctgaaacaacaaa

SEQ ID NO: 1500610 - DNA, 18 bp, Homo sapiens
gcatcaggctaagaccct

SEQ ID NO: 1500611 - DNA, 15 bp, Homo sapiens
gcatccacccagtgc

SEQ ID NO: 1500612 - DNA, 16 bp, Homo sapiens
gcatccagcctgtgtg

SEQ ID NO: 1500613 - DNA, 17 bp, Homo sapiens
gcatccaggccagggct

SEQ ID NO: 1500614 - DNA, 18 bp, Homo sapiens
gcatccaggccagggctc

SEQ ID NO: 1500615 - DNA, 20 bp, Homo sapiens
gcatccaggccagggctcct

SEQ ID NO: 1500616 - DNA, 13 bp, Homo sapiens
gcatccaggctgg

SEQ ID NO: 1500617 - DNA, 14 bp, Homo sapiens
gcatccaggctggc

SEQ ID NO: 1500618 - DNA, 12 bp, Homo sapiens
gcatccattcct

SEQ ID NO: 1500619 - DNA, 18 bp, Homo sapiens
gcatccattcctcaggga

SEQ ID NO: 1500620 - DNA, 16 bp, Homo sapiens
gcatcccaggggacca

SEQ ID NO: 1500621 - DNA, 21 bp, Homo sapiens
gcatcccaggggaccacacct

SEQ ID NO: 1500622 - DNA, 12 bp, Homo sapiens
gcatccctgaga

SEQ ID NO: 1500623 - DNA, 13 bp, Homo sapiens
gcatccctgcttc

SEQ ID NO: 1500624 - DNA, 16 bp, Homo sapiens
gcatccctgcttctgg

SEQ ID NO: 1500625 - DNA, 19 bp, Homo sapiens
gcatccctgcttctggcgc

SEQ ID NO: 1500626 - DNA, 21 bp, Homo sapiens
gcatccctgtgtccactgaga

SEQ ID NO: 1500627 - DNA, 22 bp, Homo sapiens
gcatccctgtgtccactgagac

SEQ ID NO: 1500628 - DNA, 18 bp, Homo sapiens
gcatccgcaggtgctggt

SEQ ID NO: 1500629 - DNA, 20 bp, Homo sapiens
gcatccgcaggtgctggtcc

SEQ ID NO: 1500630 - DNA, 18 bp, Homo sapiens
gcatccgtagttccctga

SEQ ID NO: 1500631 - DNA, 19 bp, Homo sapiens
gcatcctaaagataaagcc

SEQ ID NO: 1500632 - DNA, 16 bp, Homo sapiens
gcatcctgtgccacta

SEQ ID NO: 1500633 - DNA, 16 bp, Homo sapiens
gcatccttcccagcag

SEQ ID NO: 1500634 - DNA, 14 bp, Homo sapiens
gcatccttcctggg

SEQ ID NO: 1500635 - DNA, 13 bp, Homo sapiens
gcatccttgtctt

SEQ ID NO: 1500636 - DNA, 20 bp, Homo sapiens
gcatccttttctgcagaggg

SEQ ID NO: 1500637 - DNA, 19 bp, Homo sapiens
gcatcgaccacaccagcct

SEQ ID NO: 1500638 - DNA, 20 bp, Homo sapiens
gcatcgggagcacccagagc

SEQ ID NO: 1500639 - DNA, 23 bp, Homo sapiens
gcatcgtcatgcacagtatttgt

SEQ ID NO: 1500640 - DNA, 18 bp, Homo sapiens
gcatcgtgacccttcagg

SEQ ID NO: 1500641 - DNA, 16 bp, Homo sapiens
gcatctacacagcctg

SEQ ID NO: 1500642 - DNA, 17 bp, Homo sapiens
gcatctacacagcctgg

SEQ ID NO: 1500643 - DNA, 20 bp, Homo sapiens
gcatctacacagcctggact

SEQ ID NO: 1500644 - DNA, 21 bp, Homo sapiens
gcatctacacagcctggactt

SEQ ID NO: 1500645 - DNA, 19 bp, Homo sapiens
gcatctactctaaagaaaa

SEQ ID NO: 1500646 - DNA, 14 bp, Homo sapiens
gcatctatctcatc

SEQ ID NO: 1500647 - DNA, 19 bp, Homo sapiens
gcatctcaaaacagagggc

SEQ ID NO: 1500648 - DNA, 16 bp, Homo sapiens
gcatctcacggaaccg

SEQ ID NO: 1500649 - DNA, 14 bp, Homo sapiens
gcatctcagcccac

SEQ ID NO: 1500650 - DNA, 19 bp, Homo sapiens
gcatctcaggaggggcagc

SEQ ID NO: 1500651 - DNA, 17 bp, Homo sapiens
gcatctcccctagctca

SEQ ID NO: 1500652 - DNA, 20 bp, Homo sapiens
gcatctcccctagctcacca

SEQ ID NO: 1500653 - DNA, 23 bp, Homo sapiens
gcatctcctcccgcccttccatg

SEQ ID NO: 1500654 - DNA, 14 bp, Homo sapiens
gcatctcttgaggc

SEQ ID NO: 1500655 - DNA, 16 bp, Homo sapiens
gcatctcttgaggcca

SEQ ID NO: 1500656 - DNA, 18 bp, Homo sapiens
gcatctgaccatctgtga

SEQ ID NO: 1500657 - DNA, 21 bp, Homo sapiens
gcatctgaccatctgtgacta

SEQ ID NO: 1500658 - DNA, 13 bp, Homo sapiens
gcatctgatagaa

SEQ ID NO: 1500659 - DNA, 18 bp, Homo sapiens
gcatctgctaataaaacc

SEQ ID NO: 1500660 - DNA, 13 bp, Homo sapiens
gcatctggctgtc

SEQ ID NO: 1500661 - DNA, 22 bp, Homo sapiens
gcatctggctgtctagaatgtg

SEQ ID NO: 1500662 - DNA, 12 bp, Homo sapiens
gcatctggggcc

SEQ ID NO: 1500663 - DNA, 14 bp, Homo sapiens
gcatcttctccatc

SEQ ID NO: 1500664 - DNA, 17 bp, Homo sapiens
gcatcttgcctccaggt

SEQ ID NO: 1500665 - DNA, 23 bp, Homo sapiens
gcatcttgcctccaggtgcagag

SEQ ID NO: 1500666 - DNA, 22 bp, Homo sapiens
gcatcttgggggggtggccgct

SEQ ID NO: 1500667 - DNA, 22 bp, Homo sapiens
gcatctttgccttgggctgctc

SEQ ID NO: 1500668 - DNA, 19 bp, Homo sapiens
gcatcttttctagagacac

SEQ ID NO: 1500669 - DNA, 23 bp, Homo sapiens
gcatcttttgtattaagaaagga

SEQ ID NO: 1500670 - DNA, 23 bp, Homo sapiens
gcatgaaaaatcatgggccagag

SEQ ID NO: 1500671 - DNA, 19 bp, Homo sapiens
gcatgaaatgaatgtctga

SEQ ID NO: 1500672 - DNA, 20 bp, Homo sapiens
gcatgaaatgtgaattttta

SEQ ID NO: 1500673 - DNA, 24 bp, Homo sapiens
gcatgaaattgtatctcagtctaa

SEQ ID NO: 1500674 - DNA, 18 bp, Homo sapiens
gcatgaataaaacactca

SEQ ID NO: 1500675 - DNA, 21 bp, Homo sapiens
gcatgaataaaacactcatcc

SEQ ID NO: 1500676 - DNA, 14 bp, Homo sapiens
gcatgaatcactgt

SEQ ID NO: 1500677 - DNA, 23 bp, Homo sapiens
gcatgaatcactgtgctcagcca

SEQ ID NO: 1500678 - DNA, 15 bp, Homo sapiens
gcatgaattctgcat

SEQ ID NO: 1500679 - DNA, 15 bp, Homo sapiens
gcatgacagaaaata

SEQ ID NO: 1500680 - DNA, 16 bp, Homo sapiens
gcatgacagcctgcag

SEQ ID NO: 1500681 - DNA, 11 bp, Homo sapiens
gcatgaccaaa

SEQ ID NO: 1500682 - DNA, 15 bp, Homo sapiens
gcatgaccagatgcg

SEQ ID NO: 1500683 - DNA, 21 bp, Homo sapiens
gcatgactaatgctttttaga

SEQ ID NO: 1500684 - DNA, 13 bp, Homo sapiens
gcatgagactttc

SEQ ID NO: 1500685 - DNA, 15 bp, Homo sapiens
gcatgagactttctg

SEQ ID NO: 1500686 - DNA, 21 bp, Homo sapiens
gcatgagctggcaaccagcca

SEQ ID NO: 1500687 - DNA, 22 bp, Homo sapiens
gcatgagctggcaaccagccag

SEQ ID NO: 1500688 - DNA, 19 bp, Homo sapiens
gcatgagggatcacagggc

SEQ ID NO: 1500689 - DNA, 20 bp, Homo sapiens
gcatgagggatcacagggcc

SEQ ID NO: 1500690 - DNA, 21 bp, Homo sapiens
gcatgagggatcacagggccc

SEQ ID NO: 1500691 - DNA, 15 bp, Homo sapiens
gcatgatatcttcaa

SEQ ID NO: 1500692 - DNA, 13 bp, Homo sapiens
gcatgatgggaaa

SEQ ID NO: 1500693 - DNA, 16 bp, Homo sapiens
gcatgatgggaaaata

SEQ ID NO: 1500694 - DNA, 14 bp, Homo sapiens
gcatgattctttaa

SEQ ID NO: 1500695 - DNA, 17 bp, Homo sapiens
gcatttgaaaggtgtgc

SEQ ID NO: 1500696 - DNA, 14 bp, Homo sapiens
gcatttgagaaatg

SEQ ID NO: 1500697 - DNA, 15 bp, Homo sapiens
gcatttgatttccat

SEQ ID NO: 1500698 - DNA, 17 bp, Homo sapiens
gcatttggtctcaggca

SEQ ID NO: 1500699 - DNA, 21 bp, Homo sapiens
gcatttggttttacacaggaa

SEQ ID NO: 1500700 - DNA, 13 bp, Homo sapiens
gcatttgtgaggc

SEQ ID NO: 1500701 - DNA, 20 bp, Homo sapiens
gcatttgtggtaatctacac

SEQ ID NO: 1500702 - DNA, 22 bp, Homo sapiens
gcatttgtggtaatctacacca

SEQ ID NO: 1500703 - DNA, 14 bp, Homo sapiens
gcattttaaggttc

SEQ ID NO: 1500704 - DNA, 18 bp, Homo sapiens
gcattttcaccccaccct

SEQ ID NO: 1500705 - DNA, 21 bp, Homo sapiens
gcattttcagtcgttgtgctt

SEQ ID NO: 1500706 - DNA, 21 bp, Homo sapiens
gcattttgagtgtttatagat

SEQ ID NO: 1500707 - DNA, 22 bp, Homo sapiens
gcattttggagagtttcctgaa

SEQ ID NO: 1500708 - DNA, 23 bp, Homo sapiens
gcattttggagagtttcctgaaa

SEQ ID NO: 1500709 - DNA, 20 bp, Homo sapiens
gcatttttaaacttgaaata

SEQ ID NO: 1500710 - DNA, 21 bp, Homo sapiens
gcatttttaaacttgaaatat

SEQ ID NO: 1500711 - DNA, 18 bp, Homo sapiens
gcatttttattaaagcat

SEQ ID NO: 1500712 - DNA, 20 bp, Homo sapiens
gcatttttcaatatattgaa

SEQ ID NO: 1500713 - DNA, 13 bp, Homo sapiens
gcatttttcttat

SEQ ID NO: 1500714 - DNA, 21 bp, Homo sapiens
gcatttttgtgaaatgaaaac

SEQ ID NO: 1500715 - DNA, 20 bp, Homo sapiens
gccaaaaaggaccaactggc

SEQ ID NO: 1500716 - DNA, 17 bp, Homo sapiens
gccaaaacaagccaaag

SEQ ID NO: 1500717 - DNA, 18 bp, Homo sapiens
gccaaaataccagagcct

SEQ ID NO: 1500718 - DNA, 23 bp, Homo sapiens
gccaaaatggttaatttttcctg

SEQ ID NO: 1500719 - DNA, 17 bp, Homo sapiens
gccaaaattcatttcta

SEQ ID NO: 1500720 - DNA, 23 bp, Homo sapiens
gccaaacaaaaaggttctcaggt

SEQ ID NO: 1500721 - DNA, 16 bp, Homo sapiens
gccaaacattcttatt

SEQ ID NO: 1500722 - DNA, 18 bp, Homo sapiens
gccaaaccacaagactct

SEQ ID NO: 1500723 - DNA, 21 bp, Homo sapiens
gccaaaccaggaccctgtcca

SEQ ID NO: 1500724 - DNA, 19 bp, Homo sapiens
gccaaactcaggcccagaa

SEQ ID NO: 1500725 - DNA, 23 bp, Homo sapiens
gccaaagaaacaagctgtgcagg

SEQ ID NO: 1500726 - DNA, 19 bp, Homo sapiens
gccaaagacttagtatatt

SEQ ID NO: 1500727 - DNA, 13 bp, Homo sapiens
gccaaagataaaa

SEQ ID NO: 1500728 - DNA, 14 bp, Homo sapiens
gccaaagatcactt

SEQ ID NO: 1500729 - DNA, 20 bp, Homo sapiens
gccaaagctagggtggccct

SEQ ID NO: 1500730 - DNA, 15 bp, Homo sapiens
gccaaagctttacta

SEQ ID NO: 1500731 - DNA, 23 bp, Homo sapiens
gccaaagctttactactgtggaa

SEQ ID NO: 1500732 - DNA, 19 bp, Homo sapiens
gccaaagggaaatatcatt

SEQ ID NO: 1500733 - DNA, 20 bp, Homo sapiens
gccaaaggtcaaacaggctg

SEQ ID NO: 1500734 - DNA, 12 bp, Homo sapiens
gccaaagtgtta

SEQ ID NO: 1500735 - DNA, 20 bp, Homo sapiens
gccaaataaatcatcctcat

SEQ ID NO: 1500736 - DNA, 18 bp, Homo sapiens
gccaaataatgtctctgt

SEQ ID NO: 1500737 - DNA, 17 bp, Homo sapiens
gccaaatagccccagac

SEQ ID NO: 1500738 - DNA, 19 bp, Homo sapiens
gccaaatagccccagactg

SEQ ID NO: 1500739 - DNA, 17 bp, Homo sapiens
gccaaatatgtcctggg

SEQ ID NO: 1500740 - DNA, 21 bp, Homo sapiens
gccaaatttaaaactgttgga

SEQ ID NO: 1500741 - DNA, 17 bp, Homo sapiens
gccaacatgaggacaga

SEQ ID NO: 1500742 - DNA, 21 bp, Homo sapiens
gccaacatgaggacagaagga

SEQ ID NO: 1500743 - DNA, 22 bp, Homo sapiens
gccaacatgaggacagaaggac

SEQ ID NO: 1500744 - DNA, 20 bp, Homo sapiens
gccaacatgctgaaaccctg

SEQ ID NO: 1500745 - DNA, 22 bp, Homo sapiens
gccaacatggtgaaactccatc

SEQ ID NO: 1500746 - DNA, 17 bp, Homo sapiens
gccaaccagcccgacag

SEQ ID NO: 1500747 - DNA, 12 bp, Homo sapiens
gccaaccagcct

SEQ ID NO: 1500748 - DNA, 19 bp, Homo sapiens
gccaaccctgggctattgc

SEQ ID NO: 1500749 - DNA, 21 bp, Homo sapiens
gccaacctggacttcctgtca

SEQ ID NO: 1500750 - DNA, 23 bp, Homo sapiens
gccaacgacaaagccaaactctg

SEQ ID NO: 1500751 - DNA, 22 bp, Homo sapiens
gccaacgagacacattgccttc

SEQ ID NO: 1500752 - DNA, 15 bp, Homo sapiens
gccaacgtggacctg

SEQ ID NO: 1500753 - DNA, 18 bp, Homo sapiens
gccaactatgattattaa

SEQ ID NO: 1500754 - DNA, 22 bp, Homo sapiens
gccaactctcccaaagggcaca

SEQ ID NO: 1500755 - DNA, 17 bp, Homo sapiens
gccaactgtttccctgc

SEQ ID NO: 1500756 - DNA, 19 bp, Homo sapiens
gccaactgtttccctgctg

SEQ ID NO: 1500757 - DNA, 15 bp, Homo sapiens
gccaacttgtaaata

SEQ ID NO: 1500758 - DNA, 15 bp, Homo sapiens
gccaagaagcagtgg

SEQ ID NO: 1500759 - DNA, 16 bp, Homo sapiens
gccaagaagcagtggc

SEQ ID NO: 1500760 - DNA, 20 bp, Homo sapiens
gccaagaagcagtggcctta

SEQ ID NO: 1500761 - DNA, 14 bp, Homo sapiens
gccaagaatacttg

SEQ ID NO: 1500762 - DNA, 12 bp, Homo sapiens
gccaagaatgta

SEQ ID NO: 1500763 - DNA, 13 bp, Homo sapiens
gccaagaatgtac

SEQ ID NO: 1500764 - DNA, 17 bp, Homo sapiens
gccaagactcctcaggc

SEQ ID NO: 1500765 - DNA, 16 bp, Homo sapiens
gccaagagatctgtgt

SEQ ID NO: 1500766 - DNA, 23 bp, Homo sapiens
gccaagagatctgtgtggctcct

SEQ ID NO: 1500767 - DNA, 23 bp, Homo sapiens
gccaagcactgctcacgtctctg

SEQ ID NO: 1500768 - DNA, 20 bp, Homo sapiens
gccaagccagattctcttga

SEQ ID NO: 1500769 - DNA, 13 bp, Homo sapiens
gccaagcccaata

SEQ ID NO: 1500770 - DNA, 21 bp, Homo sapiens
gccaagcttcaaccctcagcc

SEQ ID NO: 1500771 - DNA, 21 bp, Homo sapiens
gccaaggacagggctggctcc

SEQ ID NO: 1500772 - DNA, 20 bp, Homo sapiens
gccaaggaggtgaggagcag

SEQ ID NO: 1500773 - DNA, 15 bp, Homo sapiens
gccaaggcagaggcc

SEQ ID NO: 1500774 - DNA, 20 bp, Homo sapiens
gccaaggcagcgaccccagg

SEQ ID NO: 1500775 - DNA, 20 bp, Homo sapiens
gccaaggccagagtggcctg

SEQ ID NO: 1500776 - DNA, 14 bp, Homo sapiens
gccacaccactgcc

SEQ ID NO: 1500777 - DNA, 15 bp, Homo sapiens
gccacaccactgcca

SEQ ID NO: 1500778 - DNA, 16 bp, Homo sapiens
gccacaccctccccat

SEQ ID NO: 1500779 - DNA, 12 bp, Homo sapiens
gccacacctggc

SEQ ID NO: 1500780 - DNA, 20 bp, Homo sapiens
gccacacctggccttaaaga

SEQ ID NO: 1500781 - DNA, 15 bp, Homo sapiens
gccacactcagtccc

SEQ ID NO: 1500782 - DNA, 19 bp, Homo sapiens
gccacactcagtcccccac

SEQ ID NO: 1500783 - DNA, 17 bp, Homo sapiens
gccacactctccatcac

SEQ ID NO: 1500784 - DNA, 14 bp, Homo sapiens
gccacactgatggc

SEQ ID NO: 1500785 - DNA, 16 bp, Homo sapiens
gccacactgggcctgg

SEQ ID NO: 1500786 - DNA, 20 bp, Homo sapiens
gccacacttcaggctcttct

SEQ ID NO: 1500787 - DNA, 23 bp, Homo sapiens
gccacacttcaggctcttctcct

SEQ ID NO: 1500788 - DNA, 15 bp, Homo sapiens
gccacagaccacctg

SEQ ID NO: 1500789 - DNA, 15 bp, Homo sapiens
gccacagcaggactg

SEQ ID NO: 1500790 - DNA, 12 bp, Homo sapiens
gccacagccccc

SEQ ID NO: 1500791 - DNA, 18 bp, Homo sapiens
gccacagcccccttgccc

SEQ ID NO: 1500792 - DNA, 10 bp, Homo sapiens
gccacagctt

SEQ ID NO: 1500793 - DNA, 12 bp, Homo sapiens
gccacagctttt

SEQ ID NO: 1500794 - DNA, 15 bp, Homo sapiens
gccacaggccaaatc

SEQ ID NO: 1500795 - DNA, 15 bp, Homo sapiens
gccacaggcctgaga

SEQ ID NO: 1500796 - DNA, 22 bp, Homo sapiens
gccacaggcctgagatttcatc

SEQ ID NO: 1500797 - DNA, 20 bp, Homo sapiens
gccacagtaatactcattcc

SEQ ID NO: 1500798 - DNA, 16 bp, Homo sapiens
gccacagtacatatgt

SEQ ID NO: 1500799 - DNA, 15 bp, Homo sapiens
gccacatcaaacctt

SEQ ID NO: 1500800 - DNA, 16 bp, Homo sapiens
gccacatcaaaccttt

SEQ ID NO: 1500801 - DNA, 13 bp, Homo sapiens
gccacatggagcc

SEQ ID NO: 1500802 - DNA, 14 bp, Homo sapiens
gccacattgctggc

SEQ ID NO: 1500803 - DNA, 19 bp, Homo sapiens
gccaccaaagctgcccact

SEQ ID NO: 1500804 - DNA, 22 bp, Homo sapiens
gccaccaacataaaacaaaacc

SEQ ID NO: 1500805 - DNA, 19 bp, Homo sapiens
gccaccacctttggctggt

SEQ ID NO: 1500806 - DNA, 15 bp, Homo sapiens
gccaccacgtccagc

SEQ ID NO: 1500807 - DNA, 18 bp, Homo sapiens
gccaccacgtctgccagg

SEQ ID NO: 1500808 - DNA, 20 bp, Homo sapiens
gccaccaggccacctcccca

SEQ ID NO: 1500809 - DNA, 16 bp, Homo sapiens
gccaccaggctggcgc

SEQ ID NO: 1500810 - DNA, 20 bp, Homo sapiens
gccaccaggctggcgcagcc

SEQ ID NO: 1500811 - DNA, 13 bp, Homo sapiens
gccaccagttctc

SEQ ID NO: 1500812 - DNA, 19 bp, Homo sapiens
gccaccagttctcatgggt

SEQ ID NO: 1500813 - DNA, 16 bp, Homo sapiens
gccaccatggccagcc

SEQ ID NO: 1500814 - DNA, 18 bp, Homo sapiens
gccaccatggccagccaa

SEQ ID NO: 1500815 - DNA, 20 bp, Homo sapiens
gccacccaagcctgctggct

SEQ ID NO: 1500816 - DNA, 22 bp, Homo sapiens
gccacccaagcctgctggctgc

SEQ ID NO: 1500817 - DNA, 12 bp, Homo sapiens
gccaccccactt

SEQ ID NO: 1500818 - DNA, 14 bp, Homo sapiens
gccacccccatctt

SEQ ID NO: 1500819 - DNA, 22 bp, Homo sapiens
gccacccccatcttccacctgt

SEQ ID NO: 1500820 - DNA, 14 bp, Homo sapiens
gccacccccatgga

SEQ ID NO: 1500821 - DNA, 17 bp, Homo sapiens
gccacccccttccctgg

SEQ ID NO: 1500822 - DNA, 18 bp, Homo sapiens
gccacccccttccctggg

SEQ ID NO: 1500823 - DNA, 22 bp, Homo sapiens
gccaccccgctgatggagcccc

SEQ ID NO: 1500824 - DNA, 17 bp, Homo sapiens
gccaccccttcctcccc

SEQ ID NO: 1500825 - DNA, 20 bp, Homo sapiens
gccacccgtggggtgctgcc

SEQ ID NO: 1500826 - DNA, 22 bp, Homo sapiens
gccacccgtggggtgctgccct

SEQ ID NO: 1500827 - DNA, 18 bp, Homo sapiens
gccaccctacctgttcag

SEQ ID NO: 1500828 - DNA, 12 bp, Homo sapiens
gccaccctagcc

SEQ ID NO: 1500829 - DNA, 22 bp, Homo sapiens
gccaccctagccaatgtctcct

SEQ ID NO: 1500830 - DNA, 22 bp, Homo sapiens
gccaccctcccctatgctggta

SEQ ID NO: 1500831 - DNA, 18 bp, Homo sapiens
gccaccctgaggcctctg

SEQ ID NO: 1500832 - DNA, 13 bp, Homo sapiens
gccaccctgcccc

SEQ ID NO: 1500833 - DNA, 14 bp, Homo sapiens
gccaccctggcccg

SEQ ID NO: 1500834 - DNA, 15 bp, Homo sapiens
gccaccgcaggggac

SEQ ID NO: 1500835 - DNA, 23 bp, Homo sapiens
gccaccgcaggggactgtctcag

SEQ ID NO: 1500836 - DNA, 22 bp, Homo sapiens
gccaccggcctgtgggtctctg

SEQ ID NO: 1500837 - DNA, 15 bp, Homo sapiens
gccaccgtttcttcc

SEQ ID NO: 1500838 - DNA, 20 bp, Homo sapiens
gccacctcccaccccactcc

SEQ ID NO: 1500839 - DNA, 21 bp, Homo sapiens
gccacctcccactcctgctgc

SEQ ID NO: 1500840 - DNA, 15 bp, Homo sapiens
gccacctcccctatc

SEQ ID NO: 1500841 - DNA, 22 bp, Homo sapiens
gccacctcccctatccacccag

SEQ ID NO: 1500842 - DNA, 12 bp, Homo sapiens
gccacctcctcc

SEQ ID NO: 1500843 - DNA, 13 bp, Homo sapiens
gccacctcctccc

SEQ ID NO: 1500844 - DNA, 16 bp, Homo sapiens
gccacctcctccccct

SEQ ID NO: 1500845 - DNA, 14 bp, Homo sapiens
gccacctctccaag

SEQ ID NO: 1500846 - DNA, 15 bp, Homo sapiens
gccacctctccaagg

SEQ ID NO: 1500847 - DNA, 17 bp, Homo sapiens
gccacctctccaagggc

SEQ ID NO: 1500848 - DNA, 18 bp, Homo sapiens
gccacctctccaagggct

SEQ ID NO: 1500849 - DNA, 17 bp, Homo sapiens
gccacctctttaaaaac

SEQ ID NO: 1500850 - DNA, 19 bp, Homo sapiens
gccacctgaggtgggccca

SEQ ID NO: 1500851 - DNA, 21 bp, Homo sapiens
gccacctgaggtgggcccagg

SEQ ID NO: 1500852 - DNA, 17 bp, Homo sapiens
gccacctgcaagatgga

SEQ ID NO: 1500853 - DNA, 13 bp, Homo sapiens
gccacctggatct

SEQ ID NO: 1500854 - DNA, 12 bp, Homo sapiens
gccaccttccca

SEQ ID NO: 1500855 - DNA, 20 bp, Homo sapiens
gctcagggccatgctgaggc

SEQ ID NO: 1500856 - DNA, 15 bp, Homo sapiens
gctcagggctggagt

SEQ ID NO: 1500857 - DNA, 19 bp, Homo sapiens
gctcagggtcaaagacaga

SEQ ID NO: 1500858 - DNA, 23 bp, Homo sapiens
gctcagggtcaaagacagaatgg

SEQ ID NO: 1500859 - DNA, 19 bp, Homo sapiens
gctcagggtcactgaacca

SEQ ID NO: 1500860 - DNA, 22 bp, Homo sapiens
gctcagggtcactgaaccactg

SEQ ID NO: 1500861 - DNA, 20 bp, Homo sapiens
gctcagggttggccatttgc

SEQ ID NO: 1500862 - DNA, 21 bp, Homo sapiens
gctcaggtgatcaaaataaag

SEQ ID NO: 1500863 - DNA, 11 bp, Homo sapiens
gctcagtattt

SEQ ID NO: 1500864 - DNA, 15 bp, Homo sapiens
gctcagtcatcaaag

SEQ ID NO: 1500865 - DNA, 23 bp, Homo sapiens
gctcagtcccatcagagagcgag

SEQ ID NO: 1500866 - DNA, 21 bp, Homo sapiens
gctcagtctcaggagcatggg

SEQ ID NO: 1500867 - DNA, 14 bp, Homo sapiens
gctctatgtctgcc

SEQ ID NO: 1500868 - DNA, 15 bp, Homo sapiens
gctctatgtctgcct

SEQ ID NO: 1500869 - DNA, 17 bp, Homo sapiens
gctctatgtctgccttc

SEQ ID NO: 1500870 - DNA, 15 bp, Homo sapiens
gctctatgtttacaa

SEQ ID NO: 1500871 - DNA, 16 bp, Homo sapiens
gctctatgtttacaaa

SEQ ID NO: 1500872 - DNA, 17 bp, Homo sapiens
gctctattctctaaact

SEQ ID NO: 1500873 - DNA, 17 bp, Homo sapiens
gctctattgtagcattt

SEQ ID NO: 1500874 - DNA, 13 bp, Homo sapiens
gctctcacccagt

SEQ ID NO: 1500875 - DNA, 13 bp, Homo sapiens
gctctcagaagcc

SEQ ID NO: 1500876 - DNA, 14 bp, Homo sapiens
gctctcagcaagtg

SEQ ID NO: 1500877 - DNA, 20 bp, Homo sapiens
gctctcagcaagtgcccagt

SEQ ID NO: 1500878 - DNA, 21 bp, Homo sapiens
gctctcagcaagtgcccagtg

SEQ ID NO: 1500879 - DNA, 23 bp, Homo sapiens
gctctcagcaagtgcccagtgga

SEQ ID NO: 1500880 - DNA, 10 bp, Homo sapiens
gctctcagcc

SEQ ID NO: 1500881 - DNA, 18 bp, Homo sapiens
gctctcagcctcccacaa

SEQ ID NO: 1500882 - DNA, 21 bp, Homo sapiens
gctctcagtagtttagtacaa

SEQ ID NO: 1500883 - DNA, 16 bp, Homo sapiens
gctctccaaaggggct

SEQ ID NO: 1500884 - DNA, 13 bp, Homo sapiens
gctctccaagtgc

SEQ ID NO: 1500885 - DNA, 18 bp, Homo sapiens
gctctccaagtgccagag

SEQ ID NO: 1500886 - DNA, 11 bp, Homo sapiens
gctctccacca

SEQ ID NO: 1500887 - DNA, 18 bp, Homo sapiens
gctctccacctcagcctt

SEQ ID NO: 1500888 - DNA, 21 bp, Homo sapiens
gctctccacctcagccttgga

SEQ ID NO: 1500889 - DNA, 16 bp, Homo sapiens
gctctccaggccaggt

SEQ ID NO: 1500890 - DNA, 23 bp, Homo sapiens
gctctccccggcaggcctgagaa

SEQ ID NO: 1500891 - DNA, 17 bp, Homo sapiens
gctctcccctcctgctg

SEQ ID NO: 1500892 - DNA, 20 bp, Homo sapiens
gctctcccctcctgctgggc

SEQ ID NO: 1500893 - DNA, 18 bp, Homo sapiens
gctctcccggttcttcca

SEQ ID NO: 1500894 - DNA, 21 bp, Homo sapiens
gctctccctaccttgcctcct

SEQ ID NO: 1500895 - DNA, 15 bp, Homo sapiens
gctctccctctggcc

SEQ ID NO: 1500896 - DNA, 19 bp, Homo sapiens
gctctccctctggccctgc

SEQ ID NO: 1500897 - DNA, 20 bp, Homo sapiens
gctctccctctggccctgcc

SEQ ID NO: 1500898 - DNA, 23 bp, Homo sapiens
gctctccctctggccctgccttc

SEQ ID NO: 1500899 - DNA, 19 bp, Homo sapiens
gctctcctcagaagaaaga

SEQ ID NO: 1500900 - DNA, 16 bp, Homo sapiens
gctctcctcatctcca

SEQ ID NO: 1500901 - DNA, 16 bp, Homo sapiens
gctctcctcccgcccc

SEQ ID NO: 1500902 - DNA, 11 bp, Homo sapiens
gctctccttcc

SEQ ID NO: 1500903 - DNA, 15 bp, Homo sapiens
gctctcgctctcgct

SEQ ID NO: 1500904 - DNA, 15 bp, Homo sapiens
gctctcgctctctct

SEQ ID NO: 1500905 - DNA, 18 bp, Homo sapiens
gctctcgctctctctcgc

SEQ ID NO: 1500906 - DNA, 19 bp, Homo sapiens
gctctcgggtgggggagcc

SEQ ID NO: 1500907 - DNA, 21 bp, Homo sapiens
gctctcgggtgggggagccag

SEQ ID NO: 1500908 - DNA, 19 bp, Homo sapiens
gctctcgggttgtgtgtct

SEQ ID NO: 1500909 - DNA, 18 bp, Homo sapiens
gctctctccgaggggtgg

SEQ ID NO: 1500910 - DNA, 15 bp, Homo sapiens
gctctctctcgctgc

SEQ ID NO: 1500911 - DNA, 13 bp, Homo sapiens
gctctctctgagg

SEQ ID NO: 1500912 - DNA, 14 bp, Homo sapiens
gctctctgcagcca

SEQ ID NO: 1500913 - DNA, 15 bp, Homo sapiens
gctctctgcagccag

SEQ ID NO: 1500914 - DNA, 20 bp, Homo sapiens
gctctctgcagccagcccag

SEQ ID NO: 1500915 - DNA, 22 bp, Homo sapiens
gctctctgcagccagcccagcc

SEQ ID NO: 1500916 - DNA, 11 bp, Homo sapiens
gctctctgcca

SEQ ID NO: 1500917 - DNA, 19 bp, Homo sapiens
gctctctgtgggctggcag

SEQ ID NO: 1500918 - DNA, 12 bp, Homo sapiens
gctctcttcagg

SEQ ID NO: 1500919 - DNA, 14 bp, Homo sapiens
gctctcttcaggag

SEQ ID NO: 1500920 - DNA, 22 bp, Homo sapiens
gctctgaagtcacatcacagga

SEQ ID NO: 1500921 - DNA, 19 bp, Homo sapiens
gctctgaatattttgtaat

SEQ ID NO: 1500922 - DNA, 14 bp, Homo sapiens
gctctgacaagatg

SEQ ID NO: 1500923 - DNA, 14 bp, Homo sapiens
gctctgacatccct

SEQ ID NO: 1500924 - DNA, 16 bp, Homo sapiens
gctctgacatcccttc

SEQ ID NO: 1500925 - DNA, 20 bp, Homo sapiens
gctctgacatcccttcctgg

SEQ ID NO: 1500926 - DNA, 22 bp, Homo sapiens
gctctgacatcccttcctggaa

SEQ ID NO: 1500927 - DNA, 22 bp, Homo sapiens
gctctgaccaagccgagatgcc

SEQ ID NO: 1500928 - DNA, 14 bp, Homo sapiens
gctctgaccacttg

SEQ ID NO: 1500929 - DNA, 15 bp, Homo sapiens
gctctgacgtagaaa

SEQ ID NO: 1500930 - DNA, 21 bp, Homo sapiens
gctctgagacccttttctcag

SEQ ID NO: 1500931 - DNA, 13 bp, Homo sapiens
gctctgagagtct

SEQ ID NO: 1500932 - DNA, 21 bp, Homo sapiens
gctctgagagtctagattctc

SEQ ID NO: 1500933 - DNA, 17 bp, Homo sapiens
gctctgagcgcctccat

SEQ ID NO: 1500934 - DNA, 23 bp, Homo sapiens
gctctgatcacatcccctgtcta

SEQ ID NO: 1500935 - DNA, 16 bp, Homo sapiens
gctctgatctaacaaa

SEQ ID NO: 1500936 - DNA, 18 bp, Homo sapiens
gctctgatctaacaaaat

SEQ ID NO: 1500937 - DNA, 23 bp, Homo sapiens
gctctgcacagacaagcagccct

SEQ ID NO: 1500938 - DNA, 13 bp, Homo sapiens
gctctgcacagat

SEQ ID NO: 1500939 - DNA, 15 bp, Homo sapiens
gctctgcacagatgg

SEQ ID NO: 1500940 - DNA, 13 bp, Homo sapiens
gctctgcaggcca

SEQ ID NO: 1500941 - DNA, 22 bp, Homo sapiens
gctctgccaccctacctgttca

SEQ ID NO: 1500942 - DNA, 18 bp, Homo sapiens
gctctgccccagctctgg

SEQ ID NO: 1500943 - DNA, 19 bp, Homo sapiens
gctctgccccagctctggc

SEQ ID NO: 1500944 - DNA, 20 bp, Homo sapiens
gctctgccccagctctggct

SEQ ID NO: 1500945 - DNA, 22 bp, Homo sapiens
gctctgccccttgggcatccac

SEQ ID NO: 1500946 - DNA, 18 bp, Homo sapiens
gctctgcccttgttccct

SEQ ID NO: 1500947 - DNA, 21 bp, Homo sapiens
gctctgcccttgttccctagg

SEQ ID NO: 1500948 - DNA, 12 bp, Homo sapiens
gctctgcctgga

SEQ ID NO: 1500949 - DNA, 15 bp, Homo sapiens
gctctgcctggagtg

SEQ ID NO: 1500950 - DNA, 14 bp, Homo sapiens
gctctgcctgtctg

SEQ ID NO: 1500951 - DNA, 13 bp, Homo sapiens
gctctgcctgtgg

SEQ ID NO: 1500952 - DNA, 20 bp, Homo sapiens
gctctgccttctcaggcccc

SEQ ID NO: 1500953 - DNA, 15 bp, Homo sapiens
gctctgcgccaggca

SEQ ID NO: 1500954 - DNA, 19 bp, Homo sapiens
gctctgcgccaggcagagc

SEQ ID NO: 1500955 - DNA, 22 bp, Homo sapiens
gctctgcgtggcgcaggtgcca

SEQ ID NO: 1500956 - DNA, 19 bp, Homo sapiens
gctctggacagccccaccc

SEQ ID NO: 1500957 - DNA, 16 bp, Homo sapiens
gctctggacgtgaaat

SEQ ID NO: 1500958 - DNA, 21 bp, Homo sapiens
gctctggacgtgaaatacttc

SEQ ID NO: 1500959 - DNA, 13 bp, Homo sapiens
gctctggagcagc

SEQ ID NO: 1500960 - DNA, 18 bp, Homo sapiens
gctctggcaccatcagcc

SEQ ID NO: 1500961 - DNA, 19 bp, Homo sapiens
gctctggcaccatcagcct

SEQ ID NO: 1500962 - DNA, 20 bp, Homo sapiens
gctctggcaccatcagcctg

SEQ ID NO: 1500963 - DNA, 18 bp, Homo sapiens
gctctggccaccctggcc

SEQ ID NO: 1500964 - DNA, 14 bp, Homo sapiens
gctctggccccagg

SEQ ID NO: 1500965 - DNA, 20 bp, Homo sapiens
gctctggcggcttcctgtcc

SEQ ID NO: 1500966 - DNA, 23 bp, Homo sapiens
gctctggcggcttcctgtccact

SEQ ID NO: 1500967 - DNA, 15 bp, Homo sapiens
gctctggctgaaccc

SEQ ID NO: 1500968 - DNA, 14 bp, Homo sapiens
gctctgggacgtgg

SEQ ID NO: 1500969 - DNA, 22 bp, Homo sapiens
gctctgggacgtggacatgcct

SEQ ID NO: 1500970 - DNA, 11 bp, Homo sapiens
gctctgggcct

SEQ ID NO: 1500971 - DNA, 16 bp, Homo sapiens
gctctgggcctgaggg

SEQ ID NO: 1500972 - DNA, 22 bp, Homo sapiens
gctctgggcctgagggtccacc

SEQ ID NO: 1500973 - DNA, 12 bp, Homo sapiens
gctctgggctca

SEQ ID NO: 1500974 - DNA, 20 bp, Homo sapiens
gctctggggacagcttcctc

SEQ ID NO: 1500975 - DNA, 17 bp, Homo sapiens
gctctggggatttctgg

SEQ ID NO: 1500976 - DNA, 21 bp, Homo sapiens
gctctggggtgggcagttttt

SEQ ID NO: 1500977 - DNA, 22 bp, Homo sapiens
gctctgggtacctgcaagcaga

SEQ ID NO: 1500978 - DNA, 19 bp, Homo sapiens
gctctggtgacaccagcct

SEQ ID NO: 1500979 - DNA, 20 bp, Homo sapiens
gctctggtgacaccagcctt

SEQ ID NO: 1500980 - DNA, 17 bp, Homo sapiens
gctctggttatttttct

SEQ ID NO: 1500981 - DNA, 18 bp, Homo sapiens
gctctgtagcccaggcca

SEQ ID NO: 1500982 - DNA, 22 bp, Homo sapiens
gctctgtggcctgtgtccagca

SEQ ID NO: 1500983 - DNA, 16 bp, Homo sapiens
gctgaccccttcgtgg

SEQ ID NO: 1500984 - DNA, 18 bp, Homo sapiens
gctgacctcacctggtcc

SEQ ID NO: 1500985 - DNA, 16 bp, Homo sapiens
gctgacctcactgtcc

SEQ ID NO: 1500986 - DNA, 21 bp, Homo sapiens
gctgacctcactgtcctgtga

SEQ ID NO: 1500987 - DNA, 14 bp, Homo sapiens
gctgacctctgttg

SEQ ID NO: 1500988 - DNA, 18 bp, Homo sapiens
gctgacctctgttgtcct

SEQ ID NO: 1500989 - DNA, 19 bp, Homo sapiens
gctgacctctgttgtcctc

SEQ ID NO: 1500990 - DNA, 23 bp, Homo sapiens
gctgacctgcctctcacacacat

SEQ ID NO: 1500991 - DNA, 13 bp, Homo sapiens
gctgacggccagg

SEQ ID NO: 1500992 - DNA, 15 bp, Homo sapiens
gctgacggccaggga

SEQ ID NO: 1500993 - DNA, 15 bp, Homo sapiens
gctgactagaagggc

SEQ ID NO: 1500994 - DNA, 16 bp, Homo sapiens
gctgactgaggcctgc

SEQ ID NO: 1500995 - DNA, 18 bp, Homo sapiens
gctgactgatgttgaggg

SEQ ID NO: 1500996 - DNA, 20 bp, Homo sapiens
gctgactgatgttgagggaa

SEQ ID NO: 1500997 - DNA, 17 bp, Homo sapiens
gctgactgcaccagcgc

SEQ ID NO: 1500998 - DNA, 21 bp, Homo sapiens
gctgactgtactcctcccagg

SEQ ID NO: 1500999 - DNA, 13 bp, Homo sapiens
gctgactgtggcc

SEQ ID NO: 1501000 - DNA, 23 bp, Homo sapiens
gctgactgtggccccctccgtga

SEQ ID NO: 1501001 - DNA, 15 bp, Homo sapiens
gctgacttggcactt

SEQ ID NO: 1501002 - DNA, 22 bp, Homo sapiens
gctgagacaggagaatcacctg

SEQ ID NO: 1501003 - DNA, 21 bp, Homo sapiens
gctgagacctgggatttgaga

SEQ ID NO: 1501004 - DNA, 14 bp, Homo sapiens
gctgagactgcggg

SEQ ID NO: 1501005 - DNA, 17 bp, Homo sapiens
gctgagagacccaagga

SEQ ID NO: 1501006 - DNA, 22 bp, Homo sapiens
gctgagagacccaaggaggaaa

SEQ ID NO: 1501007 - DNA, 14 bp, Homo sapiens
gctgagagccagat

SEQ ID NO: 1501008 - DNA, 16 bp, Homo sapiens
gctgagagccagatgc

SEQ ID NO: 1501009 - DNA, 13 bp, Homo sapiens
gctgagagcccca

SEQ ID NO: 1501010 - DNA, 17 bp, Homo sapiens
gctgagagccccagctg

SEQ ID NO: 1501011 - DNA, 18 bp, Homo sapiens
gctgagagccccagctga

SEQ ID NO: 1501012 - DNA, 13 bp, Homo sapiens
gctccctcctgca

SEQ ID NO: 1501013 - DNA, 12 bp, Homo sapiens
gctccctcgccc

SEQ ID NO: 1501014 - DNA, 13 bp, Homo sapiens
gctccctcgccct

SEQ ID NO: 1501015 - DNA, 13 bp, Homo sapiens
gctccctcgctgt

SEQ ID NO: 1501016 - DNA, 14 bp, Homo sapiens
gctccctctctggt

SEQ ID NO: 1501017 - DNA, 17 bp, Homo sapiens
gctccctctctggtttc

SEQ ID NO: 1501018 - DNA, 12 bp, Homo sapiens
gctccctgcccc

SEQ ID NO: 1501019 - DNA, 20 bp, Homo sapiens
gctccctggaagctggaaga

SEQ ID NO: 1501020 - DNA, 16 bp, Homo sapiens
gctccctgtagctctg

SEQ ID NO: 1501021 - DNA, 16 bp, Homo sapiens
gctccctgtctgtgtc

SEQ ID NO: 1501022 - DNA, 17 bp, Homo sapiens
gctccctgtctgtgtcc

SEQ ID NO: 1501023 - DNA, 16 bp, Homo sapiens
gctccctgtggggcag

SEQ ID NO: 1501024 - DNA, 19 bp, Homo sapiens
gctccctgtggggcaggag

SEQ ID NO: 1501025 - DNA, 16 bp, Homo sapiens
gctcccttcctgccac

SEQ ID NO: 1501026 - DNA, 13 bp, Homo sapiens
gctccctttctct

SEQ ID NO: 1501027 - DNA, 20 bp, Homo sapiens
gctccgaaattccaaggccc

SEQ ID NO: 1501028 - DNA, 17 bp, Homo sapiens
gctccgctcccaccgcc

SEQ ID NO: 1501029 - DNA, 17 bp, Homo sapiens
gctccgctgcctggaac

SEQ ID NO: 1501030 - DNA, 23 bp, Homo sapiens
gctccgtccaggagcctgtgcct

SEQ ID NO: 1501031 - DNA, 12 bp, Homo sapiens
gctccgtctctg

SEQ ID NO: 1501032 - DNA, 16 bp, Homo sapiens
gctccgtctctgtcct

SEQ ID NO: 1501033 - DNA, 13 bp, Homo sapiens
gctccgtgcctcc

SEQ ID NO: 1501034 - DNA, 17 bp, Homo sapiens
gctccgtggactgcagt

SEQ ID NO: 1501035 - DNA, 16 bp, Homo sapiens
gctcctacctgtctgc

SEQ ID NO: 1501036 - DNA, 21 bp, Homo sapiens
gctcctacctgtctgctgcca

SEQ ID NO: 1501037 - DNA, 23 bp, Homo sapiens
gctcctacctgtctgctgccagc

SEQ ID NO: 1501038 - DNA, 23 bp, Homo sapiens
gctcctataaagggcccacacct

SEQ ID NO: 1501039 - DNA, 19 bp, Homo sapiens
gctcctcacccctgtaggg

SEQ ID NO: 1501040 - DNA, 22 bp, Homo sapiens
gctcctccagggccacgtgcca

SEQ ID NO: 1501041 - DNA, 23 bp, Homo sapiens
gctcctccagggccacgtgccag

SEQ ID NO: 1501042 - DNA, 19 bp, Homo sapiens
gctcctcccggtgcccaag

SEQ ID NO: 1501043 - DNA, 22 bp, Homo sapiens
gctcctccctgcctcagtggct

SEQ ID NO: 1501044 - DNA, 15 bp, Homo sapiens
gctcctccctggctg

SEQ ID NO: 1501045 - DNA, 14 bp, Homo sapiens
gctcctcctcctgg

SEQ ID NO: 1501046 - DNA, 21 bp, Homo sapiens
gctcctcctcttggagctgag

SEQ ID NO: 1501047 - DNA, 16 bp, Homo sapiens
gctcctctctttgtgg

SEQ ID NO: 1501048 - DNA, 20 bp, Homo sapiens
gctcctcttaccgtagcctc

SEQ ID NO: 1501049 - DNA, 22 bp, Homo sapiens
gctcctcttccatgctgtgcgc

SEQ ID NO: 1501050 - DNA, 19 bp, Homo sapiens
gctcctcttgattcctggt

SEQ ID NO: 1501051 - DNA, 22 bp, Homo sapiens
gctcctgaggggcatctgcccc

SEQ ID NO: 1501052 - DNA, 20 bp, Homo sapiens
gctcctgcacttacttgctt

SEQ ID NO: 1501053 - DNA, 12 bp, Homo sapiens
gctcctgccagg

SEQ ID NO: 1501054 - DNA, 15 bp, Homo sapiens
gctcctgccgcagag

SEQ ID NO: 1501055 - DNA, 19 bp, Homo sapiens
gctcctgccgcagagctgg

SEQ ID NO: 1501056 - DNA, 22 bp, Homo sapiens
gctcctgccgcagagctggccg

SEQ ID NO: 1501057 - DNA, 17 bp, Homo sapiens
gctcctgcttttctgtc

SEQ ID NO: 1501058 - DNA, 19 bp, Homo sapiens
gctcctgcttttctgtcct

SEQ ID NO: 1501059 - DNA, 23 bp, Homo sapiens
gctcctggaaaggctcagtctca

SEQ ID NO: 1501060 - DNA, 15 bp, Homo sapiens
gctcctggctgccag

SEQ ID NO: 1501061 - DNA, 16 bp, Homo sapiens
gctcctggctgccagg

SEQ ID NO: 1501062 - DNA, 19 bp, Homo sapiens
gctcctggctgccaggcgt

SEQ ID NO: 1501063 - DNA, 15 bp, Homo sapiens
gctcctggctgtgcc

SEQ ID NO: 1501064 - DNA, 19 bp, Homo sapiens
gctcctggctgtgcccagc

SEQ ID NO: 1501065 - DNA, 23 bp, Homo sapiens
gctcctggctgtgcccagcaggc

SEQ ID NO: 1501066 - DNA, 12 bp, Homo sapiens
gctcctgggccg

SEQ ID NO: 1501067 - DNA, 16 bp, Homo sapiens
gctcctgtctgccagc

SEQ ID NO: 1501068 - DNA, 15 bp, Homo sapiens
gctcctgtctggctc

SEQ ID NO: 1501069 - DNA, 19 bp, Homo sapiens
gctcctgtggcagctgccc

SEQ ID NO: 1501070 - DNA, 18 bp, Homo sapiens
gctcctgtggcaggaggc

SEQ ID NO: 1501071 - DNA, 15 bp, Homo sapiens
gctcctgtggcccca

SEQ ID NO: 1501072 - DNA, 16 bp, Homo sapiens
gctccttcactgttcc

SEQ ID NO: 1501073 - DNA, 17 bp, Homo sapiens
gctccttcactgttccc

SEQ ID NO: 1501074 - DNA, 23 bp, Homo sapiens
gctccttcactgttccctctggc

SEQ ID NO: 1501075 - DNA, 15 bp, Homo sapiens
gctccttcccctgca

SEQ ID NO: 1501076 - DNA, 23 bp, Homo sapiens
gctccttcccctgcacctggcct

SEQ ID NO: 1501077 - DNA, 19 bp, Homo sapiens
gctccttcctgtcttcctg

SEQ ID NO: 1501078 - DNA, 18 bp, Homo sapiens
gctccttggggcagggcc

SEQ ID NO: 1501079 - DNA, 19 bp, Homo sapiens
gctccttggggcagggcct

SEQ ID NO: 1501080 - DNA, 15 bp, Homo sapiens
gctcctttaccctct

SEQ ID NO: 1501081 - DNA, 17 bp, Homo sapiens
gctcctttaccctcttg

SEQ ID NO: 1501082 - DNA, 17 bp, Homo sapiens
gctcctttctccagcca

SEQ ID NO: 1501083 - DNA, 20 bp, Homo sapiens
gctcctttctccagccagca

SEQ ID NO: 1501084 - DNA, 14 bp, Homo sapiens
gctccttttgtccc

SEQ ID NO: 1501085 - DNA, 20 bp, Homo sapiens
gctccttttgtccccagggc

SEQ ID NO: 1501086 - DNA, 22 bp, Homo sapiens
gctccttttgtccccagggccc

SEQ ID NO: 1501087 - DNA, 15 bp, Homo sapiens
gctcgaatctctgtg

SEQ ID NO: 1501088 - DNA, 19 bp, Homo sapiens
gctcgaatctctgtgcctt

SEQ ID NO: 1501089 - DNA, 13 bp, Homo sapiens
gctcgccatgccg

SEQ ID NO: 1501090 - DNA, 15 bp, Homo sapiens
gctcgcccagacacc

SEQ ID NO: 1501091 - DNA, 12 bp, Homo sapiens
gctcgcccagca

SEQ ID NO: 1501092 - DNA, 16 bp, Homo sapiens
gctcgcccctgttttt

SEQ ID NO: 1501093 - DNA, 13 bp, Homo sapiens
gctcgcgggcagc

SEQ ID NO: 1501094 - DNA, 22 bp, Homo sapiens
gctcgcgggcagcgggccaggc

SEQ ID NO: 1501095 - DNA, 13 bp, Homo sapiens
gctcgctcaggtg

SEQ ID NO: 1501096 - DNA, 14 bp, Homo sapiens
gctcgctcaggtga

SEQ ID NO: 1501097 - DNA, 22 bp, Homo sapiens
gctcgctccctgtagctctgcc

SEQ ID NO: 1501098 - DNA, 17 bp, Homo sapiens
gctcgctggctttctct

SEQ ID NO: 1501099 - DNA, 15 bp, Homo sapiens
gctcggacccacccc

SEQ ID NO: 1501100 - DNA, 20 bp, Homo sapiens
gctcggacccaccccaactc

SEQ ID NO: 1501101 - DNA, 22 bp, Homo sapiens
gctcgggccgtaggggctcctg

SEQ ID NO: 1501102 - DNA, 16 bp, Homo sapiens
gctcggggggctctgc

SEQ ID NO: 1501103 - DNA, 17 bp, Homo sapiens
gctcggggggctctgcc

SEQ ID NO: 1501104 - DNA, 21 bp, Homo sapiens
gctcggggggctctgccttct

SEQ ID NO: 1501105 - DNA, 12 bp, Homo sapiens
gctcggtggacc

SEQ ID NO: 1501106 - DNA, 17 bp, Homo sapiens
gctcggtggacccaggg

SEQ ID NO: 1501107 - DNA, 13 bp, Homo sapiens
gctcgtggccttc

SEQ ID NO: 1501108 - DNA, 20 bp, Homo sapiens
gctggaggcccaggctggga

SEQ ID NO: 1501109 - DNA, 17 bp, Homo sapiens
gctggaggggtggggag

SEQ ID NO: 1501110 - DNA, 16 bp, Homo sapiens
gctggagtgcaggggc

SEQ ID NO: 1501111 - DNA, 14 bp, Homo sapiens
gctggagtgcagtg

SEQ ID NO: 1501112 - DNA, 15 bp, Homo sapiens
gctggagtgcagtga

SEQ ID NO: 1501113 - DNA, 16 bp, Homo sapiens
gctggatagacttggg

SEQ ID NO: 1501114 - DNA, 19 bp, Homo sapiens
gctggatagacttgggatg

SEQ ID NO: 1501115 - DNA, 20 bp, Homo sapiens
gctggatagacttgggatgg

SEQ ID NO: 1501116 - DNA, 20 bp, Homo sapiens
gctggatggcacctcaggct

SEQ ID NO: 1501117 - DNA, 18 bp, Homo sapiens
gctggatgtctgccaatt

SEQ ID NO: 1501118 - DNA, 21 bp, Homo sapiens
gctggatgtctgccaattttt

SEQ ID NO: 1501119 - DNA, 22 bp, Homo sapiens
gctggatgtctgccaatttttg

SEQ ID NO: 1501120 - DNA, 18 bp, Homo sapiens
gctggattaatgttttgt

SEQ ID NO: 1501121 - DNA, 16 bp, Homo sapiens
gctggattacaggcat

SEQ ID NO: 1501122 - DNA, 17 bp, Homo sapiens
gctggatttgatgagtt

SEQ ID NO: 1501123 - DNA, 19 bp, Homo sapiens
gctggcaacacagaggcag

SEQ ID NO: 1501124 - DNA, 21 bp, Homo sapiens
gctggcaacacagaggcagcc

SEQ ID NO: 1501125 - DNA, 14 bp, Homo sapiens
gctggcaaccagcc

SEQ ID NO: 1501126 - DNA, 14 bp, Homo sapiens
gctggcaagcaggg

SEQ ID NO: 1501127 - DNA, 16 bp, Homo sapiens
gctggcacccaccgtg

SEQ ID NO: 1501128 - DNA, 20 bp, Homo sapiens
gctggcaggattcttcccgc

SEQ ID NO: 1501129 - DNA, 12 bp, Homo sapiens
gctggcaggtgt

SEQ ID NO: 1501130 - DNA, 17 bp, Homo sapiens
gctggcagtcctggaag

SEQ ID NO: 1501131 - DNA, 16 bp, Homo sapiens
gctggccaaggtgtcc

SEQ ID NO: 1501132 - DNA, 19 bp, Homo sapiens
gctggccaaggtgtccagg

SEQ ID NO: 1501133 - DNA, 23 bp, Homo sapiens
gctggccacaaggaaaaggagga

SEQ ID NO: 1501134 - DNA, 23 bp, Homo sapiens
gctggccacctagaagtctccct

SEQ ID NO: 1501135 - DNA, 14 bp, Homo sapiens
gctggccagtccag

SEQ ID NO: 1501136 - DNA, 23 bp, Homo sapiens
gctggcccacccagtccatgctc

SEQ ID NO: 1501137 - DNA, 20 bp, Homo sapiens
gctggcccagccggcctctc

SEQ ID NO: 1501138 - DNA, 16 bp, Homo sapiens
gctggcccagggccca

SEQ ID NO: 1501139 - DNA, 17 bp, Homo sapiens
gctggcccagggcccag

SEQ ID NO: 1501140 - DNA, 18 bp, Homo sapiens
gctggcccagggcccaga

SEQ ID NO: 1501141 - DNA, 19 bp, Homo sapiens
gctggcccagggcccagag

SEQ ID NO: 1501142 - DNA, 20 bp, Homo sapiens
gctggcccagggcccagagc

SEQ ID NO: 1501143 - DNA, 21 bp, Homo sapiens
gctggcccagggcccagagcc

SEQ ID NO: 1501144 - DNA, 15 bp, Homo sapiens
gctggcccagggggc

SEQ ID NO: 1501145 - DNA, 18 bp, Homo sapiens
gctggcccagggggcctg

SEQ ID NO: 1501146 - DNA, 20 bp, Homo sapiens
gctggcccagggggcctgga

SEQ ID NO: 1501147 - DNA, 18 bp, Homo sapiens
gctggccccagccctgct

SEQ ID NO: 1501148 - DNA, 19 bp, Homo sapiens
gctggccccagccctgctg

SEQ ID NO: 1501149 - DNA, 15 bp, Homo sapiens
gctggccgagggtcc

SEQ ID NO: 1501150 - DNA, 19 bp, Homo sapiens
gctggccgagggtcctggc

SEQ ID NO: 1501151 - DNA, 17 bp, Homo sapiens
gctttgtgattccatgg

SEQ ID NO: 1501152 - DNA, 20 bp, Homo sapiens
gctttgtgcttggggctatt

SEQ ID NO: 1501153 - DNA, 15 bp, Homo sapiens
gctttgtgtgattga

SEQ ID NO: 1501154 - DNA, 16 bp, Homo sapiens
gctttgtgtgattgaa

SEQ ID NO: 1501155 - DNA, 14 bp, Homo sapiens
gctttgttttaata

SEQ ID NO: 1501156 - DNA, 14 bp, Homo sapiens
gcttttaaaaatgt

SEQ ID NO: 1501157 - DNA, 15 bp, Homo sapiens
gcttttaccatgccc

SEQ ID NO: 1501158 - DNA, 13 bp, Homo sapiens
gcttttacccttt

SEQ ID NO: 1501159 - DNA, 16 bp, Homo sapiens
gcttttatagaggcta

SEQ ID NO: 1501160 - DNA, 19 bp, Homo sapiens
gcttttatagaggctagct

SEQ ID NO: 1501161 - DNA, 12 bp, Homo sapiens
gcttttattgga

SEQ ID NO: 1501162 - DNA, 12 bp, Homo sapiens
gcttttcactgc

SEQ ID NO: 1501163 - DNA, 23 bp, Homo sapiens
gcttttcactgctggctgcctta

SEQ ID NO: 1501164 - DNA, 22 bp, Homo sapiens
gcttttcatggcccttcaaatt

SEQ ID NO: 1501165 - DNA, 21 bp, Homo sapiens
gcttttccaggatcctgcagg

SEQ ID NO: 1501166 - DNA, 23 bp, Homo sapiens
gcttttccaggatcctgcaggaa

SEQ ID NO: 1501167 - DNA, 22 bp, Homo sapiens
gcttttccccggtcccttgaga

SEQ ID NO: 1501168 - DNA, 16 bp, Homo sapiens
gcttttccctttgtga

SEQ ID NO: 1501169 - DNA, 17 bp, Homo sapiens
gcttttctgccctggct

SEQ ID NO: 1501170 - DNA, 18 bp, Homo sapiens
gcttttctgccctggctg

SEQ ID NO: 1501171 - DNA, 23 bp, Homo sapiens
gcttttctgtccctttgctcccg

SEQ ID NO: 1501172 - DNA, 15 bp, Homo sapiens
gcttttctgtcctgg

SEQ ID NO: 1501173 - DNA, 16 bp, Homo sapiens
gcttttctgtcctggg

SEQ ID NO: 1501174 - DNA, 17 bp, Homo sapiens
gcttttctgtcctgggc

SEQ ID NO: 1501175 - DNA, 18 bp, Homo sapiens
gcttttctgtcctgggca

SEQ ID NO: 1501176 - DNA, 16 bp, Homo sapiens
gcttttgaaaagttga

SEQ ID NO: 1501177 - DNA, 14 bp, Homo sapiens
gcttttgaattgca

SEQ ID NO: 1501178 - DNA, 15 bp, Homo sapiens
gcttttgccactttg

SEQ ID NO: 1501179 - DNA, 15 bp, Homo sapiens
gcttttgcccacaca

SEQ ID NO: 1501180 - DNA, 23 bp, Homo sapiens
gcttttgcctgcaagagaatctg

SEQ ID NO: 1501181 - DNA, 17 bp, Homo sapiens
gcttttgctttccctga

SEQ ID NO: 1501182 - DNA, 18 bp, Homo sapiens
gcttttggggagccagaa

SEQ ID NO: 1501183 - DNA, 22 bp, Homo sapiens
gcttttggttaatatgtctttt

SEQ ID NO: 1501184 - DNA, 22 bp, Homo sapiens
gcttttgtagatggcgatgtgt

SEQ ID NO: 1501185 - DNA, 18 bp, Homo sapiens
gcttttgttccaatgtca

SEQ ID NO: 1501186 - DNA, 14 bp, Homo sapiens
gcttttgttctaga

SEQ ID NO: 1501187 - DNA, 23 bp, Homo sapiens
gcttttgtttcctttttcagata

SEQ ID NO: 1501188 - DNA, 22 bp, Homo sapiens
gcttttgtttttttcctcatgt

SEQ ID NO: 1501189 - DNA, 17 bp, Homo sapiens
gctttttaatagcacta

SEQ ID NO: 1501190 - DNA, 19 bp, Homo sapiens
gctttttattcctcctgct

SEQ ID NO: 1501191 - DNA, 13 bp, Homo sapiens
gctttttctcaga

SEQ ID NO: 1501192 - DNA, 14 bp, Homo sapiens
gctttttctcagat

SEQ ID NO: 1501193 - DNA, 13 bp, Homo sapiens
gctttttctgcca

SEQ ID NO: 1501194 - DNA, 15 bp, Homo sapiens
gctttttggcacagt

SEQ ID NO: 1501195 - DNA, 16 bp, Homo sapiens
gctttttgttcagaat

SEQ ID NO: 1501196 - DNA, 17 bp, Homo sapiens
gcttttttgttttggct

SEQ ID NO: 1501197 - DNA, 21 bp, Homo sapiens
gctttttttgtgtgtatttgc

SEQ ID NO: 1501198 - DNA, 15 bp, Homo sapiens
gctttttttttctct

SEQ ID NO: 1501199 - DNA, 24 bp, Homo sapiens
gctttttttttctctttctctcct

SEQ ID NO: 1501200 - DNA, 16 bp, Homo sapiens
gcttttttttttccag

SEQ ID NO: 1501201 - DNA, 21 bp, Homo sapiens
gcttttttttttccagcaagt

SEQ ID NO: 1501202 - DNA, 20 bp, Homo sapiens
ggaaaaaaacataaaaagca

SEQ ID NO: 1501203 - DNA, 16 bp, Homo sapiens
ggaaaaaactctgaag

SEQ ID NO: 1501204 - DNA, 22 bp, Homo sapiens
ggaaaaaactctgaaggagagg

SEQ ID NO: 1501205 - DNA, 22 bp, Homo sapiens
ggaaaaaattgaaagaacttaa

SEQ ID NO: 1501206 - DNA, 13 bp, Homo sapiens
ggaaaaacacaag

SEQ ID NO: 1501207 - DNA, 19 bp, Homo sapiens
ggaaaaaccacccccaaat

SEQ ID NO: 1501208 - DNA, 17 bp, Homo sapiens
ggaaaaactttggaacc

SEQ ID NO: 1501209 - DNA, 23 bp, Homo sapiens
ggaaaaataacaactaacttgtt

SEQ ID NO: 1501210 - DNA, 17 bp, Homo sapiens
ggaaaaatgggagccag

SEQ ID NO: 1501211 - DNA, 12 bp, Homo sapiens
ggaaaacatttg

SEQ ID NO: 1501212 - DNA, 21 bp, Homo sapiens
ggaaaagaagttgcaagactc

SEQ ID NO: 1501213 - DNA, 18 bp, Homo sapiens
ggaaaagataaagaccag

SEQ ID NO: 1501214 - DNA, 22 bp, Homo sapiens
ggaaaagataaagaccagaaat

SEQ ID NO: 1501215 - DNA, 12 bp, Homo sapiens
ggaaaaggagga

SEQ ID NO: 1501216 - DNA, 14 bp, Homo sapiens
ggaaaaggcccctg

SEQ ID NO: 1501217 - DNA, 16 bp, Homo sapiens
ggaaaaggcccctgca

SEQ ID NO: 1501218 - DNA, 19 bp, Homo sapiens
ggaaaagggtcttcttggc

SEQ ID NO: 1501219 - DNA, 20 bp, Homo sapiens
ggaaaaggttgaataatata

SEQ ID NO: 1501220 - DNA, 14 bp, Homo sapiens
ggaagaaggcagtg

SEQ ID NO: 1501221 - DNA, 15 bp, Homo sapiens
ggaagaagggagaag

SEQ ID NO: 1501222 - DNA, 18 bp, Homo sapiens
ggaagaagggagaagaaa

SEQ ID NO: 1501223 - DNA, 13 bp, Homo sapiens
ggaagaatgaaag

SEQ ID NO: 1501224 - DNA, 19 bp, Homo sapiens
ggaagacacttcagatctg

SEQ ID NO: 1501225 - DNA, 19 bp, Homo sapiens
ggaagaccccacccaagct

SEQ ID NO: 1501226 - DNA, 21 bp, Homo sapiens
ggaagacttttggtagagaag

SEQ ID NO: 1501227 - DNA, 20 bp, Homo sapiens
ggaagagaagagggcccagc

SEQ ID NO: 1501228 - DNA, 16 bp, Homo sapiens
ggaagagacagcccag

SEQ ID NO: 1501229 - DNA, 17 bp, Homo sapiens
ggaagagacagcccagg

SEQ ID NO: 1501230 - DNA, 15 bp, Homo sapiens
ggaagagatgtttac

SEQ ID NO: 1501231 - DNA, 13 bp, Homo sapiens
ggaagagcagcct

SEQ ID NO: 1501232 - DNA, 16 bp, Homo sapiens
ggaagagcaggactcc

SEQ ID NO: 1501233 - DNA, 15 bp, Homo sapiens
ggaagagcaggcaca

SEQ ID NO: 1501234 - DNA, 20 bp, Homo sapiens
ggaagagcccagtctgttga

SEQ ID NO: 1501235 - DNA, 11 bp, Homo sapiens
ggaagagcccg

SEQ ID NO: 1501236 - DNA, 13 bp, Homo sapiens
ggaagagctcccc

SEQ ID NO: 1501237 - DNA, 16 bp, Homo sapiens
ggaagaggatgagcag

SEQ ID NO: 1501238 - DNA, 18 bp, Homo sapiens
ggaagaggatgagcagag

SEQ ID NO: 1501239 - DNA, 17 bp, Homo sapiens
ggaagataggctctgca

SEQ ID NO: 1501240 - DNA, 12 bp, Homo sapiens
ggaagatcctgc

SEQ ID NO: 1501241 - DNA, 21 bp, Homo sapiens
ggaagatcttgagagctgctg

SEQ ID NO: 1501242 - DNA, 22 bp, Homo sapiens
ggaagatggagacaccctctgg

SEQ ID NO: 1501243 - DNA, 18 bp, Homo sapiens
ggaagatttatgaacaga

SEQ ID NO: 1501244 - DNA, 17 bp, Homo sapiens
ggaagcaaagagtgaga

SEQ ID NO: 1501245 - DNA, 13 bp, Homo sapiens
ggaagcaccccat

SEQ ID NO: 1501246 - DNA, 15 bp, Homo sapiens
ggaagcaccccatgc

SEQ ID NO: 1501247 - DNA, 22 bp, Homo sapiens
ggaagcaccccatgccaaagct

SEQ ID NO: 1501248 - DNA, 12 bp, Homo sapiens
ggaagcagtgcc

SEQ ID NO: 1501249 - DNA, 17 bp, Homo sapiens
ggaagcatgtaggagaa

SEQ ID NO: 1501250 - DNA, 22 bp, Homo sapiens
ggaagccaaaatgtaggcttag

SEQ ID NO: 1501251 - DNA, 13 bp, Homo sapiens
ggaagccaaaggc

SEQ ID NO: 1501252 - DNA, 18 bp, Homo sapiens
ggaagccaggctgagtga

SEQ ID NO: 1501253 - DNA, 12 bp, Homo sapiens
ggaagccaggta

SEQ ID NO: 1501254 - DNA, 15 bp, Homo sapiens
ggaagccaggtacag

SEQ ID NO: 1501255 - DNA, 21 bp, Homo sapiens
ggaatgtggtagtacccaggg

SEQ ID NO: 1501256 - DNA, 22 bp, Homo sapiens
ggaattaagttatctttaaaat

SEQ ID NO: 1501257 - DNA, 17 bp, Homo sapiens
ggaattataaatatttt

SEQ ID NO: 1501258 - DNA, 18 bp, Homo sapiens
ggaattattttgaatgtc

SEQ ID NO: 1501259 - DNA, 17 bp, Homo sapiens
ggaattcagcaccctgg

SEQ ID NO: 1501260 - DNA, 14 bp, Homo sapiens
ggaattcagtgcct

SEQ ID NO: 1501261 - DNA, 15 bp, Homo sapiens
ggaattcagtgcctt

SEQ ID NO: 1501262 - DNA, 17 bp, Homo sapiens
ggaattgtcaaatgatg

SEQ ID NO: 1501263 - DNA, 15 bp, Homo sapiens
ggaatttaaaattaa

SEQ ID NO: 1501264 - DNA, 18 bp, Homo sapiens
ggaatttaaaattaagta

SEQ ID NO: 1501265 - DNA, 15 bp, Homo sapiens
ggaatttactttctt

SEQ ID NO: 1501266 - DNA, 14 bp, Homo sapiens
ggaatttcccagga

SEQ ID NO: 1501267 - DNA, 16 bp, Homo sapiens
ggaatttcccaggacc

SEQ ID NO: 1501268 - DNA, 18 bp, Homo sapiens
ggaatttcccaggaccct

SEQ ID NO: 1501269 - DNA, 18 bp, Homo sapiens
ggaatttcttaacttctt

SEQ ID NO: 1501270 - DNA, 21 bp, Homo sapiens
ggaatttgttcaagttttggg

SEQ ID NO: 1501271 - DNA, 22 bp, Homo sapiens
ggacaacttatttaaaaatatt

SEQ ID NO: 1501272 - DNA, 15 bp, Homo sapiens
ggacaagcagtccct

SEQ ID NO: 1501273 - DNA, 20 bp, Homo sapiens
ggacaagccaacttgtaaat

SEQ ID NO: 1501274 - DNA, 14 bp, Homo sapiens
ggacaagggaggca

SEQ ID NO: 1501275 - DNA, 16 bp, Homo sapiens
ggacaatcagtcccct

SEQ ID NO: 1501276 - DNA, 13 bp, Homo sapiens
ggacacacaaggt

SEQ ID NO: 1501277 - DNA, 20 bp, Homo sapiens
ggacacagcacaagggcaca

SEQ ID NO: 1501278 - DNA, 12 bp, Homo sapiens
ggacacagctct

SEQ ID NO: 1501279 - DNA, 21 bp, Homo sapiens
ggacacagctcttcattccat

SEQ ID NO: 1501280 - DNA, 14 bp, Homo sapiens
ggacacagttcctg

SEQ ID NO: 1501281 - DNA, 16 bp, Homo sapiens
ggacacagttcctggg

SEQ ID NO: 1501282 - DNA, 19 bp, Homo sapiens
ggacacagttcctgggaac

SEQ ID NO: 1501283 - DNA, 17 bp, Homo sapiens
ggacacatcccggcctc

SEQ ID NO: 1501284 - DNA, 12 bp, Homo sapiens
ggacaccagagc

SEQ ID NO: 1501285 - DNA, 13 bp, Homo sapiens
ggacaccagagct

SEQ ID NO: 1501286 - DNA, 13 bp, Homo sapiens
ggacaccaggagt

SEQ ID NO: 1501287 - DNA, 17 bp, Homo sapiens
ggacaccagtgaaagaa

SEQ ID NO: 1501288 - DNA, 15 bp, Homo sapiens
ggacaccctctgccg

SEQ ID NO: 1501289 - DNA, 12 bp, Homo sapiens
ggacaccgggca

SEQ ID NO: 1501290 - DNA, 12 bp, Homo sapiens
ggacacctcgcc

SEQ ID NO: 1501291 - DNA, 17 bp, Homo sapiens
ggacacctgggccgggc

SEQ ID NO: 1501292 - DNA, 16 bp, Homo sapiens
ggacacgagccacaag

SEQ ID NO: 1501293 - DNA, 17 bp, Homo sapiens
ggacactagggtcaggc

SEQ ID NO: 1501294 - DNA, 14 bp, Homo sapiens
ggacactcagacct

SEQ ID NO: 1501295 - DNA, 22 bp, Homo sapiens
ggacactcctcctcggaagagc

SEQ ID NO: 1501296 - DNA, 14 bp, Homo sapiens
ggacactgggcagc

SEQ ID NO: 1501297 - DNA, 18 bp, Homo sapiens
ggacactgggcagcaagg

SEQ ID NO: 1501298 - DNA, 18 bp, Homo sapiens
ggacacttaacagatgca

SEQ ID NO: 1501299 - DNA, 17 bp, Homo sapiens
ggacacttccctctgtt

SEQ ID NO: 1501300 - DNA, 18 bp, Homo sapiens
ggacacttccctctgttt

SEQ ID NO: 1501301 - DNA, 16 bp, Homo sapiens
ggacacttcctgccta

SEQ ID NO: 1501302 - DNA, 23 bp, Homo sapiens
ggacactttgaaatgtgtttctg

SEQ ID NO: 1501303 - DNA, 15 bp, Homo sapiens
ggacagaaggactgg

SEQ ID NO: 1501304 - DNA, 18 bp, Homo sapiens
ggacagaatgtgttcttt

SEQ ID NO: 1501305 - DNA, 19 bp, Homo sapiens
ggacagagacacctgcacc

SEQ ID NO: 1501306 - DNA, 21 bp, Homo sapiens
ggacagagacacctgcacctc

SEQ ID NO: 1501307 - DNA, 14 bp, Homo sapiens
ggacagagcttgaa

SEQ ID NO: 1501308 - DNA, 18 bp, Homo sapiens
ggacagaggccccagcct

SEQ ID NO: 1501309 - DNA, 14 bp, Homo sapiens
ggacagaggccggg

SEQ ID NO: 1501310 - DNA, 14 bp, Homo sapiens
ggacagagggcaca

SEQ ID NO: 1501311 - DNA, 15 bp, Homo sapiens
ggacagagggcacat

SEQ ID NO: 1501312 - DNA, 21 bp, Homo sapiens
ggacagcccagagcctggctg

SEQ ID NO: 1501313 - DNA, 14 bp, Homo sapiens
ggacagccccaccc

SEQ ID NO: 1501314 - DNA, 16 bp, Homo sapiens
ggacagccccaccctg

SEQ ID NO: 1501315 - DNA, 22 bp, Homo sapiens
ggacagcctgtggcggtgcctg

SEQ ID NO: 1501316 - DNA, 23 bp, Homo sapiens
ggacagcctgtggcggtgcctgg

SEQ ID NO: 1501317 - DNA, 12 bp, Homo sapiens
ggacagccttca

SEQ ID NO: 1501318 - DNA, 12 bp, Homo sapiens
ggacagctgccc

SEQ ID NO: 1501319 - DNA, 19 bp, Homo sapiens
ggacagctgcccagacaca

SEQ ID NO: 1501320 - DNA, 15 bp, Homo sapiens
ggacagctgctggga

SEQ ID NO: 1501321 - DNA, 22 bp, Homo sapiens
ggacagctgctgggacccacct

SEQ ID NO: 1501322 - DNA, 24 bp, Homo sapiens
ggacagctggctgggccttcacca

SEQ ID NO: 1501323 - DNA, 13 bp, Homo sapiens
ggacagcttcctc

SEQ ID NO: 1501324 - DNA, 14 bp, Homo sapiens
ggacagcttcctca

SEQ ID NO: 1501325 - DNA, 19 bp, Homo sapiens
ggacagcttgagccgggcc

SEQ ID NO: 1501326 - DNA, 23 bp, Homo sapiens
ggacagctttgctccgctcccac

SEQ ID NO: 1501327 - DNA, 18 bp, Homo sapiens
ggacaggaagctggcaga

SEQ ID NO: 1501328 - DNA, 17 bp, Homo sapiens
ggacaggaccctcagga

SEQ ID NO: 1501329 - DNA, 20 bp, Homo sapiens
ggacaggaggcggcccggcc

SEQ ID NO: 1501330 - DNA, 16 bp, Homo sapiens
ggacaggatgaggaca

SEQ ID NO: 1501331 - DNA, 17 bp, Homo sapiens
ggacaggatgaggacag

SEQ ID NO: 1501332 - DNA, 16 bp, Homo sapiens
ggacaggcagcctcct

SEQ ID NO: 1501333 - DNA, 12 bp, Homo sapiens
ggacaggcccag

SEQ ID NO: 1501334 - DNA, 22 bp, Homo sapiens
ggacaggcccagcgcggccagc

SEQ ID NO: 1501335 - DNA, 15 bp, Homo sapiens
ggacaggctgaagag

SEQ ID NO: 1501336 - DNA, 20 bp, Homo sapiens
ggacagggctggctcctctg

SEQ ID NO: 1501337 - DNA, 18 bp, Homo sapiens
ggacagtatcccacatcc

SEQ ID NO: 1501338 - DNA, 19 bp, Homo sapiens
ggacagtgcttcagcctga

SEQ ID NO: 1501339 - DNA, 21 bp, Homo sapiens
ggacagtgcttcagcctgagg

SEQ ID NO: 1501340 - DNA, 11 bp, Homo sapiens
ggacagtggtg

SEQ ID NO: 1501341 - DNA, 16 bp, Homo sapiens
ggacagtgtgggcgct

SEQ ID NO: 1501342 - DNA, 20 bp, Homo sapiens
ggactgaccaaagactgcag

SEQ ID NO: 1501343 - DNA, 22 bp, Homo sapiens
ggactgaccaaagactgcagaa

SEQ ID NO: 1501344 - DNA, 23 bp, Homo sapiens
ggactgaccaaagactgcagaac

SEQ ID NO: 1501345 - DNA, 23 bp, Homo sapiens
ggactgaccacaccaaccaggcc

SEQ ID NO: 1501346 - DNA, 12 bp, Homo sapiens
ggactgagccag

SEQ ID NO: 1501347 - DNA, 13 bp, Homo sapiens
ggactgagcctgg

SEQ ID NO: 1501348 - DNA, 13 bp, Homo sapiens
ggactgaggcctg

SEQ ID NO: 1501349 - DNA, 15 bp, Homo sapiens
ggactgagtgggaag

SEQ ID NO: 1501350 - DNA, 17 bp, Homo sapiens
ggactgagtgggaagcc

SEQ ID NO: 1501351 - DNA, 14 bp, Homo sapiens
ggactgatgtcatc

SEQ ID NO: 1501352 - DNA, 22 bp, Homo sapiens
ggactgcagtcggcatgccagg

SEQ ID NO: 1501353 - DNA, 16 bp, Homo sapiens
ggactgccaggctgtt

SEQ ID NO: 1501354 - DNA, 17 bp, Homo sapiens
ggactggaggcccctgg

SEQ ID NO: 1501355 - DNA, 21 bp, Homo sapiens
ggactggaggcccctggagcc

SEQ ID NO: 1501356 - DNA, 17 bp, Homo sapiens
ggactggagtccctgtg

SEQ ID NO: 1501357 - DNA, 15 bp, Homo sapiens
ggactggcagaagca

SEQ ID NO: 1501358 - DNA, 21 bp, Homo sapiens
ggactggccatttttctgggg

SEQ ID NO: 1501359 - DNA, 22 bp, Homo sapiens
ggactggcgagtccagagagga

SEQ ID NO: 1501360 - DNA, 23 bp, Homo sapiens
ggactggctagagtcctcactcc

SEQ ID NO: 1501361 - DNA, 17 bp, Homo sapiens
ggactgggtctgacctg

SEQ ID NO: 1501362 - DNA, 17 bp, Homo sapiens
ggactggtgccctcctc

SEQ ID NO: 1501363 - DNA, 22 bp, Homo sapiens
ggactggtgcgaccccccaccc

SEQ ID NO: 1501364 - DNA, 20 bp, Homo sapiens
ggagagggtctggagaagca

SEQ ID NO: 1501365 - DNA, 23 bp, Homo sapiens
ggagagggtctggagaagcagtg

SEQ ID NO: 1501366 - DNA, 21 bp, Homo sapiens
ggagaggttataggtcactcc

SEQ ID NO: 1501367 - DNA, 17 bp, Homo sapiens
ggagagtcacagaacaa

SEQ ID NO: 1501368 - DNA, 17 bp, Homo sapiens
ggagagtcccagagcag

SEQ ID NO: 1501369 - DNA, 15 bp, Homo sapiens
ggagagtggcaggtg

SEQ ID NO: 1501370 - DNA, 21 bp, Homo sapiens
ggagagtggcaggtgggctgc

SEQ ID NO: 1501371 - DNA, 21 bp, Homo sapiens
ggagagttcaagcctgtggga

SEQ ID NO: 1501372 - DNA, 21 bp, Homo sapiens
ggagataaaagcaattctgac

SEQ ID NO: 1501373 - DNA, 21 bp, Homo sapiens
ggagatagacgggttgaaaga

SEQ ID NO: 1501374 - DNA, 23 bp, Homo sapiens
ggagatagacgggttgaaagaca

SEQ ID NO: 1501375 - DNA, 22 bp, Homo sapiens
ggagatatctgagggaggaggc

SEQ ID NO: 1501376 - DNA, 22 bp, Homo sapiens
ggagatatttatggggggagaa

SEQ ID NO: 1501377 - DNA, 19 bp, Homo sapiens
ggagatcgcttttctcaga

SEQ ID NO: 1501378 - DNA, 22 bp, Homo sapiens
ggagatcgcttttctcagactc

SEQ ID NO: 1501379 - DNA, 13 bp, Homo sapiens
ggagatgaccagg

SEQ ID NO: 1501380 - DNA, 20 bp, Homo sapiens
ggagatggaagttgcagtga

SEQ ID NO: 1501381 - DNA, 15 bp, Homo sapiens
ggagatggtcagtgt

SEQ ID NO: 1501382 - DNA, 14 bp, Homo sapiens
ggagattcagactg

SEQ ID NO: 1501383 - DNA, 15 bp, Homo sapiens
ggagcaagacagaga

SEQ ID NO: 1501384 - DNA, 13 bp, Homo sapiens
ggagcacagccct

SEQ ID NO: 1501385 - DNA, 17 bp, Homo sapiens
ggagcacagccctggga

SEQ ID NO: 1501386 - DNA, 21 bp, Homo sapiens
ggagcacatactacctagaag

SEQ ID NO: 1501387 - DNA, 19 bp, Homo sapiens
ggagcacctgaaccccatg

SEQ ID NO: 1501388 - DNA, 13 bp, Homo sapiens
ggagcacgaggtc

SEQ ID NO: 1501389 - DNA, 15 bp, Homo sapiens
ggagcactggagtgc

SEQ ID NO: 1501390 - DNA, 15 bp, Homo sapiens
ggagcactggggtgg

SEQ ID NO: 1501391 - DNA, 23 bp, Homo sapiens
ggagcagaaaacccttgggccag

SEQ ID NO: 1501392 - DNA, 16 bp, Homo sapiens
ggagcagagctctccc

SEQ ID NO: 1501393 - DNA, 19 bp, Homo sapiens
ggagcagagggcaggggtg

SEQ ID NO: 1501394 - DNA, 21 bp, Homo sapiens
ggagcagagggcaggggtgct

SEQ ID NO: 1501395 - DNA, 16 bp, Homo sapiens
ggagcagatggacagc

SEQ ID NO: 1501396 - DNA, 12 bp, Homo sapiens
ggagcagcagcc

SEQ ID NO: 1501397 - DNA, 14 bp, Homo sapiens
ggagcagcagccag

SEQ ID NO: 1501398 - DNA, 18 bp, Homo sapiens
ggagcagcagccagcacc

SEQ ID NO: 1501399 - DNA, 19 bp, Homo sapiens
ggagcagcagccagcacca

SEQ ID NO: 1501400 - DNA, 18 bp, Homo sapiens
ggagcagccagagctgtg

SEQ ID NO: 1501401 - DNA, 19 bp, Homo sapiens
ggagcagccagagctgtgc

SEQ ID NO: 1501402 - DNA, 21 bp, Homo sapiens
ggagcagccagagctgtgcct

SEQ ID NO: 1501403 - DNA, 21 bp, Homo sapiens
ggagcagcggattgctctgga

SEQ ID NO: 1501404 - DNA, 14 bp, Homo sapiens
ggagcagctgagat

SEQ ID NO: 1501405 - DNA, 12 bp, Homo sapiens
ggagcagctgtg

SEQ ID NO: 1501406 - DNA, 18 bp, Homo sapiens
ggagcagcttccttctgg

SEQ ID NO: 1501407 - DNA, 22 bp, Homo sapiens
ggagcagcttccttctgggact

SEQ ID NO: 1501408 - DNA, 21 bp, Homo sapiens
ggagcagggaaggcctgactt

SEQ ID NO: 1501409 - DNA, 20 bp, Homo sapiens
ggagcaggttccccaagggc

SEQ ID NO: 1501410 - DNA, 13 bp, Homo sapiens
ggagcagtgtctt

SEQ ID NO: 1501411 - DNA, 18 bp, Homo sapiens
ggagcagtgtcttccata

SEQ ID NO: 1501412 - DNA, 18 bp, Homo sapiens
ggagcagttttcccctgg

SEQ ID NO: 1501413 - DNA, 19 bp, Homo sapiens
ggagcagttttcccctggc

SEQ ID NO: 1501414 - DNA, 24 bp, Homo sapiens
ggagcatatgattgctccagagca

SEQ ID NO: 1501415 - DNA, 20 bp, Homo sapiens
ggagcatctcttgaggccag

SEQ ID NO: 1501416 - DNA, 21 bp, Homo sapiens
ggagcatctcttgaggccagg

SEQ ID NO: 1501417 - DNA, 14 bp, Homo sapiens
ggagcatggacagt

SEQ ID NO: 1501418 - DNA, 23 bp, Homo sapiens
ggagcatttaatggcagctagtg

SEQ ID NO: 1501419 - DNA, 24 bp, Homo sapiens
ggagcatttaatggcagctagtgc

SEQ ID NO: 1501420 - DNA, 22 bp, Homo sapiens
ggagccaaaggcatccaggcca

SEQ ID NO: 1501421 - DNA, 22 bp, Homo sapiens
ggagccaaatgaccgagccctg

SEQ ID NO: 1501422 - DNA, 12 bp, Homo sapiens
ggagccagcagg

SEQ ID NO: 1501423 - DNA, 11 bp, Homo sapiens
ggagccagctg

SEQ ID NO: 1501424 - DNA, 12 bp, Homo sapiens
ggagccagctgc

SEQ ID NO: 1501425 - DNA, 16 bp, Homo sapiens
ggagccagctgctttt

SEQ ID NO: 1501426 - DNA, 15 bp, Homo sapiens
ggagccaggagacct

SEQ ID NO: 1501427 - DNA, 11 bp, Homo sapiens
ggagccagggc

SEQ ID NO: 1501428 - DNA, 14 bp, Homo sapiens
ggagcccacaacct

SEQ ID NO: 1501429 - DNA, 14 bp, Homo sapiens
ggagcccagccaga

SEQ ID NO: 1501430 - DNA, 12 bp, Homo sapiens
ggagcccagcct

SEQ ID NO: 1501431 - DNA, 13 bp, Homo sapiens
ggagcccagcctg

SEQ ID NO: 1501432 - DNA, 12 bp, Homo sapiens
ggagcccagtga

SEQ ID NO: 1501433 - DNA, 19 bp, Homo sapiens
ggagcccagtgaagcctct

SEQ ID NO: 1501434 - DNA, 20 bp, Homo sapiens
ggagcccagtgaagcctctg

SEQ ID NO: 1501435 - DNA, 12 bp, Homo sapiens
ggagccccaggg

SEQ ID NO: 1501436 - DNA, 13 bp, Homo sapiens
ggagccccagggt

SEQ ID NO: 1501437 - DNA, 14 bp, Homo sapiens
ggagccccagggtc

SEQ ID NO: 1501438 - DNA, 20 bp, Homo sapiens
ggagccccagggtcttccct

SEQ ID NO: 1501439 - DNA, 13 bp, Homo sapiens
ggagccccctctg

SEQ ID NO: 1501440 - DNA, 22 bp, Homo sapiens
ggagcccctcctcccccggctg

SEQ ID NO: 1501441 - DNA, 21 bp, Homo sapiens
ggagcccctcctctgagcagc

SEQ ID NO: 1501442 - DNA, 14 bp, Homo sapiens
ggagcccctgggtg

SEQ ID NO: 1501443 - DNA, 15 bp, Homo sapiens
ggagcccctgggtgg

SEQ ID NO: 1501444 - DNA, 21 bp, Homo sapiens
ggagcccctgggtgggtggtg

SEQ ID NO: 1501445 - DNA, 21 bp, Homo sapiens
ggagcccgaggcaccagtgtc

SEQ ID NO: 1501446 - DNA, 20 bp, Homo sapiens
ggagcccgatattctccctg

SEQ ID NO: 1501447 - DNA, 15 bp, Homo sapiens
ggagcccgtgcagta

SEQ ID NO: 1501448 - DNA, 20 bp, Homo sapiens
ggagccctgggcggagtccc

SEQ ID NO: 1501449 - DNA, 18 bp, Homo sapiens
ggagccgagggcgtcaga

SEQ ID NO: 1501450 - DNA, 14 bp, Homo sapiens
ggagccggcggcct

SEQ ID NO: 1501451 - DNA, 15 bp, Homo sapiens
ggagccgggccgcag

SEQ ID NO: 1501452 - DNA, 20 bp, Homo sapiens
ggagccgggcctcccaccgc

SEQ ID NO: 1501453 - DNA, 20 bp, Homo sapiens
ggagcctagcggagcccagc

SEQ ID NO: 1501454 - DNA, 23 bp, Homo sapiens
ggagcctagcggagcccagcctg

SEQ ID NO: 1501455 - DNA, 16 bp, Homo sapiens
ggagcctagctcctgc

SEQ ID NO: 1501456 - DNA, 19 bp, Homo sapiens
ggagcctcatccgaggcag

SEQ ID NO: 1501457 - DNA, 22 bp, Homo sapiens
ggagcctgccgcccccgcctgg

SEQ ID NO: 1501458 - DNA, 14 bp, Homo sapiens
ggagcctgctctcc

SEQ ID NO: 1501459 - DNA, 16 bp, Homo sapiens
ggagcctggcacagga

SEQ ID NO: 1501460 - DNA, 22 bp, Homo sapiens
ggagccttcctttctcctgccc

SEQ ID NO: 1501461 - DNA, 23 bp, Homo sapiens
ggagccttcctttctcctgcccc

SEQ ID NO: 1501462 - DNA, 15 bp, Homo sapiens
ggagctgaaaaatca

SEQ ID NO: 1501463 - DNA, 16 bp, Homo sapiens
ggagctgaaaaggatc

SEQ ID NO: 1501464 - DNA, 16 bp, Homo sapiens
ggagctgaaagggagc

SEQ ID NO: 1501465 - DNA, 20 bp, Homo sapiens
ggagctgaaagggagcccct

SEQ ID NO: 1501466 - DNA, 17 bp, Homo sapiens
ggagctgagatgagccc

SEQ ID NO: 1501467 - DNA, 18 bp, Homo sapiens
ggagctgagatgagcccc

SEQ ID NO: 1501468 - DNA, 18 bp, Homo sapiens
ggagctgagtcacctcct

SEQ ID NO: 1501469 - DNA, 21 bp, Homo sapiens
ggagctgagtcacctcctcca

SEQ ID NO: 1501470 - DNA, 12 bp, Homo sapiens
ggagctgccaca

SEQ ID NO: 1501471 - DNA, 18 bp, Homo sapiens
ggagctgccacagagaag

SEQ ID NO: 1501472 - DNA, 21 bp, Homo sapiens
ggagctgccgtgcctgtgtcc

SEQ ID NO: 1501473 - DNA, 17 bp, Homo sapiens
ggagctgcctgcagcac

SEQ ID NO: 1501474 - DNA, 23 bp, Homo sapiens
ggagctgcctgcttggcccggcc

SEQ ID NO: 1501475 - DNA, 17 bp, Homo sapiens
ggagctgccttggctca

SEQ ID NO: 1501476 - DNA, 18 bp, Homo sapiens
ggagctgccttggctcag

SEQ ID NO: 1501477 - DNA, 21 bp, Homo sapiens
ggagctgccttggctcagaca

SEQ ID NO: 1501478 - DNA, 19 bp, Homo sapiens
ggagctgcgcttccctgca

SEQ ID NO: 1501479 - DNA, 23 bp, Homo sapiens
ggagctgctggcttgcagtgcgc

SEQ ID NO: 1501480 - DNA, 12 bp, Homo sapiens
ggagctggaggg

SEQ ID NO: 1501481 - DNA, 13 bp, Homo sapiens
ggagctggagggg

SEQ ID NO: 1501482 - DNA, 12 bp, Homo sapiens
ggagctggccca

SEQ ID NO: 1501483 - DNA, 21 bp, Homo sapiens
ggagctggcctgtggcacagc

SEQ ID NO: 1501484 - DNA, 21 bp, Homo sapiens
ggagctgggagaccctcccca

SEQ ID NO: 1501485 - DNA, 23 bp, Homo sapiens
ggagctgggggaaggcaggagcc

SEQ ID NO: 1501486 - DNA, 23 bp, Homo sapiens
ggagctggttagaaatgcagaat

SEQ ID NO: 1501487 - DNA, 18 bp, Homo sapiens
ggagctgtcaccaaggaa

SEQ ID NO: 1501488 - DNA, 19 bp, Homo sapiens
ggagctgtcaccaaggaaa

SEQ ID NO: 1501489 - DNA, 19 bp, Homo sapiens
ggagcttcccacacctgcc

SEQ ID NO: 1501490 - DNA, 22 bp, Homo sapiens
ggagcttcccacacctgcctgc

SEQ ID NO: 1501491 - DNA, 13 bp, Homo sapiens
ggagcttccgctt

SEQ ID NO: 1501492 - DNA, 19 bp, Homo sapiens
ggagcttctcccagtgtga

SEQ ID NO: 1501493 - DNA, 14 bp, Homo sapiens
ggagcttgcagtga

SEQ ID NO: 1501494 - DNA, 20 bp, Homo sapiens
ggagctttcaaagaaggaat

SEQ ID NO: 1501495 - DNA, 14 bp, Homo sapiens
ggagctttctgtat

SEQ ID NO: 1501496 - DNA, 19 bp, Homo sapiens
ggagcttttaaaaatgttt

SEQ ID NO: 1501497 - DNA, 16 bp, Homo sapiens
ggaggaaaaaagaacc

SEQ ID NO: 1501498 - DNA, 17 bp, Homo sapiens
ggaggaaaaggcccctg

SEQ ID NO: 1501499 - DNA, 22 bp, Homo sapiens
ggaggaaacagttctcactggg

SEQ ID NO: 1501500 - DNA, 15 bp, Homo sapiens
ggaggaaagggcctg

SEQ ID NO: 1501501 - DNA, 24 bp, Homo sapiens
ggaggaaagggcctggccagtcct

SEQ ID NO: 1501502 - DNA, 23 bp, Homo sapiens
ggaggaaatttgaatgggtccat

SEQ ID NO: 1501503 - DNA, 21 bp, Homo sapiens
ggaggaaccacaatgtttctt

SEQ ID NO: 1501504 - DNA, 22 bp, Homo sapiens
ggaggaactgggtgactggagg

SEQ ID NO: 1501505 - DNA, 23 bp, Homo sapiens
ggaggaactgggtgactggaggc

SEQ ID NO: 1501506 - DNA, 20 bp, Homo sapiens
ggaggaagagccacctgcaa

SEQ ID NO: 1501507 - DNA, 17 bp, Homo sapiens
ggaggaagatggctccc

SEQ ID NO: 1501508 - DNA, 13 bp, Homo sapiens
ggaggaagcccac

SEQ ID NO: 1501509 - DNA, 14 bp, Homo sapiens
ggaggaaggcaaga

SEQ ID NO: 1501510 - DNA, 15 bp, Homo sapiens
ggaggaaggtgctga

SEQ ID NO: 1501511 - DNA, 21 bp, Homo sapiens
ggaggaagttctccagcttca

SEQ ID NO: 1501512 - DNA, 17 bp, Homo sapiens
ggaggaatagtgcttgc

SEQ ID NO: 1501513 - DNA, 21 bp, Homo sapiens
ggaggacacagcacaagggca

SEQ ID NO: 1501514 - DNA, 22 bp, Homo sapiens
ggaggacaggcgggaggaggtg

SEQ ID NO: 1501515 - DNA, 12 bp, Homo sapiens
ggaggacctggc

SEQ ID NO: 1501516 - DNA, 22 bp, Homo sapiens
ggaggagcatgcgcagaggcca

SEQ ID NO: 1501517 - DNA, 22 bp, Homo sapiens
ggaggagcctgtgcgtcccagc

SEQ ID NO: 1501518 - DNA, 20 bp, Homo sapiens
ggaggagccttgctgggcca

SEQ ID NO: 1501519 - DNA, 21 bp, Homo sapiens
ggaggagccttgctgggccag

SEQ ID NO: 1501520 - DNA, 17 bp, Homo sapiens
ggaggagcttgggggat

SEQ ID NO: 1501521 - DNA, 16 bp, Homo sapiens
ggaggaggaggagcct

SEQ ID NO: 1501522 - DNA, 15 bp, Homo sapiens
ggaggaggagggagg

SEQ ID NO: 1501523 - DNA, 14 bp, Homo sapiens
ggaggaggccacct

SEQ ID NO: 1501524 - DNA, 16 bp, Homo sapiens
ggaggaggccacctct

SEQ ID NO: 1501525 - DNA, 15 bp, Homo sapiens
ggaggagggaggccg

SEQ ID NO: 1501526 - DNA, 17 bp, Homo sapiens
ggaggagggatgctgct

SEQ ID NO: 1501527 - DNA, 20 bp, Homo sapiens
ggaggaggtggcagccctgt

SEQ ID NO: 1501528 - DNA, 23 bp, Homo sapiens
ggaggaggtgtctggggtgaggg

SEQ ID NO: 1501529 - DNA, 14 bp, Homo sapiens
ggaggatacagagg

SEQ ID NO: 1501530 - DNA, 19 bp, Homo sapiens
ggaggatcactggagccca

SEQ ID NO: 1501531 - DNA, 18 bp, Homo sapiens
ggaggatcagttttttgt

SEQ ID NO: 1501532 - DNA, 12 bp, Homo sapiens
ggaggatggaga

SEQ ID NO: 1501533 - DNA, 14 bp, Homo sapiens
ggaggatggagaga

SEQ ID NO: 1501534 - DNA, 20 bp, Homo sapiens
ggaggattgcttgagcccag

SEQ ID NO: 1501535 - DNA, 22 bp, Homo sapiens
ggaggatttcctacccccgtcc

SEQ ID NO: 1501536 - DNA, 20 bp, Homo sapiens
ggaggcaaagctggctcacc

SEQ ID NO: 1501537 - DNA, 16 bp, Homo sapiens
ggaggcaacactgctg

SEQ ID NO: 1501538 - DNA, 20 bp, Homo sapiens
ggaggcaagaaaaggacaaa

SEQ ID NO: 1501539 - DNA, 12 bp, Homo sapiens
ggaggcacactt

SEQ ID NO: 1501540 - DNA, 14 bp, Homo sapiens
ggaggcaccagctc

SEQ ID NO: 1501541 - DNA, 14 bp, Homo sapiens
ggaggcacctccag

SEQ ID NO: 1501542 - DNA, 13 bp, Homo sapiens
ggaggcacgcacc

SEQ ID NO: 1501543 - DNA, 18 bp, Homo sapiens
ggaggcacgcaccactgc

SEQ ID NO: 1501544 - DNA, 17 bp, Homo sapiens
ggaggcagccagggctt

SEQ ID NO: 1501545 - DNA, 16 bp, Homo sapiens
ggaggcagccgaggcc

SEQ ID NO: 1501546 - DNA, 22 bp, Homo sapiens
ggaggcagccgaggcctggcca

SEQ ID NO: 1501547 - DNA, 19 bp, Homo sapiens
ggaggcagggccttgccca

SEQ ID NO: 1501548 - DNA, 14 bp, Homo sapiens
ggaggcatctgcac

SEQ ID NO: 1501549 - DNA, 18 bp, Homo sapiens
ggaggccaaccagcccga

SEQ ID NO: 1501550 - DNA, 13 bp, Homo sapiens
ggaggccaaggca

SEQ ID NO: 1501551 - DNA, 22 bp, Homo sapiens
ggaggccaccgggacagacctg

SEQ ID NO: 1501552 - DNA, 13 bp, Homo sapiens
ggaggcccagttc

SEQ ID NO: 1501553 - DNA, 15 bp, Homo sapiens
ggaggcccctggagc

SEQ ID NO: 1501554 - DNA, 18 bp, Homo sapiens
ggaggcccctggagccag

SEQ ID NO: 1501555 - DNA, 19 bp, Homo sapiens
ggaggcccttgtcgtggga

SEQ ID NO: 1501556 - DNA, 15 bp, Homo sapiens
ggaggcctcaggtgc

SEQ ID NO: 1501557 - DNA, 17 bp, Homo sapiens
ggaggcctcaggtgctg

SEQ ID NO: 1501558 - DNA, 19 bp, Homo sapiens
ggaggcctcaggtgctgtc

SEQ ID NO: 1501559 - DNA, 14 bp, Homo sapiens
ggaggcctgatgct

SEQ ID NO: 1501560 - DNA, 19 bp, Homo sapiens
ggaggcctgatgctgcccc

SEQ ID NO: 1501561 - DNA, 19 bp, Homo sapiens
ggaggcctgcgaccctggg

SEQ ID NO: 1501562 - DNA, 21 bp, Homo sapiens
ggaggcctgcgaccctggggg

SEQ ID NO: 1501563 - DNA, 17 bp, Homo sapiens
ggaggccttccctggcc

SEQ ID NO: 1501564 - DNA, 20 bp, Homo sapiens
ggccaatgttgctgatggcc

SEQ ID NO: 1501565 - DNA, 21 bp, Homo sapiens
ggccacaaggaaaaggaggag

SEQ ID NO: 1501566 - DNA, 22 bp, Homo sapiens
ggccacaaggacgctggctact

SEQ ID NO: 1501567 - DNA, 22 bp, Homo sapiens
ggccacactattaccatgagaa

SEQ ID NO: 1501568 - DNA, 22 bp, Homo sapiens
ggccacagcccccttgccctcc

SEQ ID NO: 1501569 - DNA, 21 bp, Homo sapiens
ggccacagtgtcactggtcag

SEQ ID NO: 1501570 - DNA, 14 bp, Homo sapiens
ggccacattgctgg

SEQ ID NO: 1501571 - DNA, 17 bp, Homo sapiens
ggccacattgctggctg

SEQ ID NO: 1501572 - DNA, 14 bp, Homo sapiens
ggccacatttaata

SEQ ID NO: 1501573 - DNA, 16 bp, Homo sapiens
ggccaccaaagctgcc

SEQ ID NO: 1501574 - DNA, 17 bp, Homo sapiens
ggccaccaaagctgccc

SEQ ID NO: 1501575 - DNA, 19 bp, Homo sapiens
ggccaccacctttggctgg

SEQ ID NO: 1501576 - DNA, 16 bp, Homo sapiens
ggccacccactgaccc

SEQ ID NO: 1501577 - DNA, 19 bp, Homo sapiens
ggccaccccctatcctctg

SEQ ID NO: 1501578 - DNA, 24 bp, Homo sapiens
ggccacccgttctgctggcctgga

SEQ ID NO: 1501579 - DNA, 20 bp, Homo sapiens
ggccaccgcaggggactgtc

SEQ ID NO: 1501580 - DNA, 23 bp, Homo sapiens
ggccacctagaagtctccctgca

SEQ ID NO: 1501581 - DNA, 15 bp, Homo sapiens
ggccacctcccactc

SEQ ID NO: 1501582 - DNA, 19 bp, Homo sapiens
ggccacctcccactcctgc

SEQ ID NO: 1501583 - DNA, 21 bp, Homo sapiens
ggccacctcccactcctgctg

SEQ ID NO: 1501584 - DNA, 15 bp, Homo sapiens
ggccacctcctcccc

SEQ ID NO: 1501585 - DNA, 18 bp, Homo sapiens
ggccacctcctccccctg

SEQ ID NO: 1501586 - DNA, 16 bp, Homo sapiens
ggccacctgaggtggg

SEQ ID NO: 1501587 - DNA, 20 bp, Homo sapiens
ggccacctgaggtgggccca

SEQ ID NO: 1501588 - DNA, 23 bp, Homo sapiens
ggccacctgaggtgggcccagga

SEQ ID NO: 1501589 - DNA, 24 bp, Homo sapiens
ggccacgcactgggccacggagga

SEQ ID NO: 1501590 - DNA, 13 bp, Homo sapiens
ggccacgcagcca

SEQ ID NO: 1501591 - DNA, 18 bp, Homo sapiens
ggccacgcagccaggaca

SEQ ID NO: 1501592 - DNA, 19 bp, Homo sapiens
ggccacgcagccaggacac

SEQ ID NO: 1501593 - DNA, 14 bp, Homo sapiens
ggccacgctccagc

SEQ ID NO: 1501594 - DNA, 15 bp, Homo sapiens
ggccacggaggaggg

SEQ ID NO: 1501595 - DNA, 18 bp, Homo sapiens
ggccacgtgccaggcccg

SEQ ID NO: 1501596 - DNA, 18 bp, Homo sapiens
ggccactcaacagagagg

SEQ ID NO: 1501597 - DNA, 19 bp, Homo sapiens
ggccactcaacagagagga

SEQ ID NO: 1501598 - DNA, 12 bp, Homo sapiens
ggccactcctcc

SEQ ID NO: 1501599 - DNA, 12 bp, Homo sapiens
ggccactgggga

SEQ ID NO: 1501600 - DNA, 22 bp, Homo sapiens
ggccactgggtctcactcctga

SEQ ID NO: 1501601 - DNA, 11 bp, Homo sapiens
ggccactgtga

SEQ ID NO: 1501602 - DNA, 13 bp, Homo sapiens
ggccactgtggcc

SEQ ID NO: 1501603 - DNA, 14 bp, Homo sapiens
ggccactgtggcca

SEQ ID NO: 1501604 - DNA, 17 bp, Homo sapiens
ggccactgtggccagag

SEQ ID NO: 1501605 - DNA, 18 bp, Homo sapiens
ggccactgtggccagagc

SEQ ID NO: 1501606 - DNA, 17 bp, Homo sapiens
ggccactttcagagccc

SEQ ID NO: 1501607 - DNA, 21 bp, Homo sapiens
ggccactttcagagcccccag

SEQ ID NO: 1501608 - DNA, 13 bp, Homo sapiens
ggccagaaggagg

SEQ ID NO: 1501609 - DNA, 14 bp, Homo sapiens
ggccagaaggaggg

SEQ ID NO: 1501610 - DNA, 16 bp, Homo sapiens
ggccagaaggagggca

SEQ ID NO: 1501611 - DNA, 21 bp, Homo sapiens
ggccagaaggagggcagagcc

SEQ ID NO: 1501612 - DNA, 23 bp, Homo sapiens
ggccagaaggagggcagagccat

SEQ ID NO: 1501613 - DNA, 12 bp, Homo sapiens
ggccagaagtac

SEQ ID NO: 1501614 - DNA, 21 bp, Homo sapiens
ggccagacatggtgtctcaca

SEQ ID NO: 1501615 - DNA, 14 bp, Homo sapiens
ggccagaccacagc

SEQ ID NO: 1501616 - DNA, 13 bp, Homo sapiens
ggccagactggaa

SEQ ID NO: 1501617 - DNA, 23 bp, Homo sapiens
ggccagagaagataatgttcttt

SEQ ID NO: 1501618 - DNA, 15 bp, Homo sapiens
ggccagagagggccc

SEQ ID NO: 1501619 - DNA, 17 bp, Homo sapiens
ggccagagagggcccag

SEQ ID NO: 1501620 - DNA, 23 bp, Homo sapiens
ggccagagagggcccagctgtag

SEQ ID NO: 1501621 - DNA, 13 bp, Homo sapiens
ggccagagctgga

SEQ ID NO: 1501622 - DNA, 17 bp, Homo sapiens
ggccagagctggaaggc

SEQ ID NO: 1501623 - DNA, 18 bp, Homo sapiens
ggccagagctggaaggca

SEQ ID NO: 1501624 - DNA, 20 bp, Homo sapiens
ggccagagctggaaggcagg

SEQ ID NO: 1501625 - DNA, 23 bp, Homo sapiens
ggccagagctggaaggcagggca

SEQ ID NO: 1501626 - DNA, 16 bp, Homo sapiens
ggccagaggcccccag

SEQ ID NO: 1501627 - DNA, 21 bp, Homo sapiens
ggccagaggcccccagcccag

SEQ ID NO: 1501628 - DNA, 16 bp, Homo sapiens
ggccagagtggcctgg

SEQ ID NO: 1501629 - DNA, 20 bp, Homo sapiens
ggccagagtggcctggccag

SEQ ID NO: 1501630 - DNA, 17 bp, Homo sapiens
ggccagcaacgcttgta

SEQ ID NO: 1501631 - DNA, 21 bp, Homo sapiens
ggccagcactggaggggccca

SEQ ID NO: 1501632 - DNA, 14 bp, Homo sapiens
ggccagcaggctcc

SEQ ID NO: 1501633 - DNA, 20 bp, Homo sapiens
ggccagcaggctcctggctg

SEQ ID NO: 1501634 - DNA, 11 bp, Homo sapiens
ggccagcccag

SEQ ID NO: 1501635 - DNA, 14 bp, Homo sapiens
ggccagcccagcca

SEQ ID NO: 1501636 - DNA, 13 bp, Homo sapiens
ggccagccccacc

SEQ ID NO: 1501637 - DNA, 18 bp, Homo sapiens
ggccagccctgcagccca

SEQ ID NO: 1501638 - DNA, 19 bp, Homo sapiens
ggccagcgagtggtcaagg

SEQ ID NO: 1501639 - DNA, 20 bp, Homo sapiens
ggccagcgagtggtcaagga

SEQ ID NO: 1501640 - DNA, 18 bp, Homo sapiens
ggccagcgggcacagggc

SEQ ID NO: 1501641 - DNA, 13 bp, Homo sapiens
ggccagcgtccca

SEQ ID NO: 1501642 - DNA, 13 bp, Homo sapiens
ggccagcgtggct

SEQ ID NO: 1501643 - DNA, 13 bp, Homo sapiens
ggccagctctgga

SEQ ID NO: 1501644 - DNA, 16 bp, Homo sapiens
ggccaggacaggcccg

SEQ ID NO: 1501645 - DNA, 20 bp, Homo sapiens
ggccaggacgggccacacgt

SEQ ID NO: 1501646 - DNA, 13 bp, Homo sapiens
ggccaggagcagg

SEQ ID NO: 1501647 - DNA, 16 bp, Homo sapiens
ggccaggatggagggg

SEQ ID NO: 1501648 - DNA, 23 bp, Homo sapiens
ggccaggcaacgtgcgtgtctct

SEQ ID NO: 1501649 - DNA, 14 bp, Homo sapiens
ggccaggcacaggg

SEQ ID NO: 1501650 - DNA, 16 bp, Homo sapiens
ggccaggcacagggcc

SEQ ID NO: 1501651 - DNA, 18 bp, Homo sapiens
ggccaggcacagggcccg

SEQ ID NO: 1501652 - DNA, 19 bp, Homo sapiens
ggccaggcacagggcccgc

SEQ ID NO: 1501653 - DNA, 15 bp, Homo sapiens
ggccaggcagatctg

SEQ ID NO: 1501654 - DNA, 21 bp, Homo sapiens
ggccaggcagggagtgtctgc

SEQ ID NO: 1501655 - DNA, 15 bp, Homo sapiens
ggccaggccagggga

SEQ ID NO: 1501656 - DNA, 16 bp, Homo sapiens
ggccaggccaggggac

SEQ ID NO: 1501657 - DNA, 18 bp, Homo sapiens
ggccaggccctgggtctt

SEQ ID NO: 1501658 - DNA, 17 bp, Homo sapiens
ggccaggccgcgcccag

SEQ ID NO: 1501659 - DNA, 18 bp, Homo sapiens
ggccaggccgcgcccagc

SEQ ID NO: 1501660 - DNA, 21 bp, Homo sapiens
ggcccagggtgtttgcagctg

SEQ ID NO: 1501661 - DNA, 22 bp, Homo sapiens
ggcccagtacctagctggctct

SEQ ID NO: 1501662 - DNA, 17 bp, Homo sapiens
ggcccagtgccactgcc

SEQ ID NO: 1501663 - DNA, 19 bp, Homo sapiens
ggcccagtgccactgcccc

SEQ ID NO: 1501664 - DNA, 18 bp, Homo sapiens
ggcccatagcagccagtt

SEQ ID NO: 1501665 - DNA, 22 bp, Homo sapiens
ggcccatctcaggtgccactcc

SEQ ID NO: 1501666 - DNA, 21 bp, Homo sapiens
ggcccattcagagctatggtg

SEQ ID NO: 1501667 - DNA, 18 bp, Homo sapiens
ggccccaaccctgtcctc

SEQ ID NO: 1501668 - DNA, 21 bp, Homo sapiens
ggccccaccctgggccctggg

SEQ ID NO: 1501669 - DNA, 17 bp, Homo sapiens
ggccccaccggccaggc

SEQ ID NO: 1501670 - DNA, 23 bp, Homo sapiens
ggccccactcccttgctggcccc

SEQ ID NO: 1501671 - DNA, 13 bp, Homo sapiens
ggccccagaggcc

SEQ ID NO: 1501672 - DNA, 14 bp, Homo sapiens
ggccccagaggccc

SEQ ID NO: 1501673 - DNA, 16 bp, Homo sapiens
ggccccagaggccctg

SEQ ID NO: 1501674 - DNA, 20 bp, Homo sapiens
ggccccagatctgcctgggc

SEQ ID NO: 1501675 - DNA, 21 bp, Homo sapiens
ggccccagatctgcctgggcc

SEQ ID NO: 1501676 - DNA, 22 bp, Homo sapiens
ggccccagatctgcctgggcct

SEQ ID NO: 1501677 - DNA, 23 bp, Homo sapiens
ggccccagatctgcctgggcctg

SEQ ID NO: 1501678 - DNA, 15 bp, Homo sapiens
ggccccagcacagct

SEQ ID NO: 1501679 - DNA, 16 bp, Homo sapiens
ggccccagcactaaag

SEQ ID NO: 1501680 - DNA, 21 bp, Homo sapiens
ggccccagccctgctggggat

SEQ ID NO: 1501681 - DNA, 22 bp, Homo sapiens
ggccccaggggcagcaaggcct

SEQ ID NO: 1501682 - DNA, 23 bp, Homo sapiens
ggccccagtgcggttcctcatct

SEQ ID NO: 1501683 - DNA, 20 bp, Homo sapiens
ggcccttcagtctgctccac

SEQ ID NO: 1501684 - DNA, 14 bp, Homo sapiens
ggcccttcccctcc

SEQ ID NO: 1501685 - DNA, 17 bp, Homo sapiens
ggcccttcctctccact

SEQ ID NO: 1501686 - DNA, 19 bp, Homo sapiens
ggcccttcctctccactgc

SEQ ID NO: 1501687 - DNA, 22 bp, Homo sapiens
ggcccttcctctccactgcctt

SEQ ID NO: 1501688 - DNA, 23 bp, Homo sapiens
ggcccttcctctccactgccttc

SEQ ID NO: 1501689 - DNA, 16 bp, Homo sapiens
ggcccttcctctttgg

SEQ ID NO: 1501690 - DNA, 17 bp, Homo sapiens
ggcccttctgactgttt

SEQ ID NO: 1501691 - DNA, 21 bp, Homo sapiens
ggcccttctgactgtttattt

SEQ ID NO: 1501692 - DNA, 22 bp, Homo sapiens
ggcccttctgactgtttattta

SEQ ID NO: 1501693 - DNA, 18 bp, Homo sapiens
ggcccttggggcctggct

SEQ ID NO: 1501694 - DNA, 17 bp, Homo sapiens
ggcccttgtcctgccag

SEQ ID NO: 1501695 - DNA, 18 bp, Homo sapiens
ggcccttgtcctgccagc

SEQ ID NO: 1501696 - DNA, 19 bp, Homo sapiens
ggccctttccttccagatc

SEQ ID NO: 1501697 - DNA, 19 bp, Homo sapiens
ggccctttttcccttccct

SEQ ID NO: 1501698 - DNA, 14 bp, Homo sapiens
ggccgaagctctgg

SEQ ID NO: 1501699 - DNA, 21 bp, Homo sapiens
ggccgaatcccctccctgtca

SEQ ID NO: 1501700 - DNA, 15 bp, Homo sapiens
ggccgaccaggctgg

SEQ ID NO: 1501701 - DNA, 17 bp, Homo sapiens
ggccgaccaggctggac

SEQ ID NO: 1501702 - DNA, 20 bp, Homo sapiens
ggccgaggaccaccagcagg

SEQ ID NO: 1501703 - DNA, 14 bp, Homo sapiens
ggccgaggcccagc

SEQ ID NO: 1501704 - DNA, 22 bp, Homo sapiens
ggccgaggcgcgtttgtgcata

SEQ ID NO: 1501705 - DNA, 16 bp, Homo sapiens
ggccgagggtcctggc

SEQ ID NO: 1501706 - DNA, 15 bp, Homo sapiens
ggccgagtggctgcc

SEQ ID NO: 1501707 - DNA, 18 bp, Homo sapiens
ggccgcagctcttgccct

SEQ ID NO: 1501708 - DNA, 23 bp, Homo sapiens
ggccgcagctcttgcccttccct

SEQ ID NO: 1501709 - DNA, 17 bp, Homo sapiens
ggccgcattccctgagt

SEQ ID NO: 1501710 - DNA, 23 bp, Homo sapiens
ggccgccagcgtgtggagcagag

SEQ ID NO: 1501711 - DNA, 16 bp, Homo sapiens
ggccgccccctgcccc

SEQ ID NO: 1501712 - DNA, 16 bp, Homo sapiens
ggccgcccctgaggct

SEQ ID NO: 1501713 - DNA, 22 bp, Homo sapiens
ggccgcccgcacgtccgcgggt

SEQ ID NO: 1501714 - DNA, 15 bp, Homo sapiens
ggccgcccgctccct

SEQ ID NO: 1501715 - DNA, 17 bp, Homo sapiens
ggccgcccgggcccaga

SEQ ID NO: 1501716 - DNA, 18 bp, Homo sapiens
ggccgccgccaggactgt

SEQ ID NO: 1501717 - DNA, 22 bp, Homo sapiens
ggccgccgctgaccctgggcct

SEQ ID NO: 1501718 - DNA, 16 bp, Homo sapiens
ggccgccgtgacctat

SEQ ID NO: 1501719 - DNA, 17 bp, Homo sapiens
ggccgcctgcgggctgc

SEQ ID NO: 1501720 - DNA, 13 bp, Homo sapiens
ggccgcctggcag

SEQ ID NO: 1501721 - DNA, 15 bp, Homo sapiens
ggccgcgcccagcag

SEQ ID NO: 1501722 - DNA, 16 bp, Homo sapiens
ggccgctccaccagca

SEQ ID NO: 1501723 - DNA, 24 bp, Homo sapiens
ggccgctgctttgcgctggtggac

SEQ ID NO: 1501724 - DNA, 23 bp, Homo sapiens
ggccggaaggaatgtcagggcca

SEQ ID NO: 1501725 - DNA, 21 bp, Homo sapiens
ggccggagtaggagcactggg

SEQ ID NO: 1501726 - DNA, 14 bp, Homo sapiens
ggccggctgagtgg

SEQ ID NO: 1501727 - DNA, 16 bp, Homo sapiens
ggccggctgagtggca

SEQ ID NO: 1501728 - DNA, 12 bp, Homo sapiens
ggccgggcacag

SEQ ID NO: 1501729 - DNA, 14 bp, Homo sapiens
ggccgggcctgggg

SEQ ID NO: 1501730 - DNA, 16 bp, Homo sapiens
ggccgggctgctgctg

SEQ ID NO: 1501731 - DNA, 13 bp, Homo sapiens
ggccggggctgag

SEQ ID NO: 1501732 - DNA, 14 bp, Homo sapiens
ggccggggtccagg

SEQ ID NO: 1501733 - DNA, 14 bp, Homo sapiens
ggccggtgctgggt

SEQ ID NO: 1501734 - DNA, 19 bp, Homo sapiens
ggccggttaacatctttta

SEQ ID NO: 1501735 - DNA, 23 bp, Homo sapiens
ggccggtttcgaagttgatgcaa

SEQ ID NO: 1501736 - DNA, 18 bp, Homo sapiens
ggccgtcctcccgggccc

SEQ ID NO: 1501737 - DNA, 22 bp, Homo sapiens
ggccgtctcccttggcccagag

SEQ ID NO: 1501738 - DNA, 14 bp, Homo sapiens
ggccgtgcccttgc

SEQ ID NO: 1501739 - DNA, 17 bp, Homo sapiens
ggccgtggtccagctct

SEQ ID NO: 1501740 - DNA, 12 bp, Homo sapiens
ggccgtgtcccg

SEQ ID NO: 1501741 - DNA, 15 bp, Homo sapiens
ggccgttcagcctgt

SEQ ID NO: 1501742 - DNA, 16 bp, Homo sapiens
ggccgttccccttggc

SEQ ID NO: 1501743 - DNA, 20 bp, Homo sapiens
ggcctacagctttgatccct

SEQ ID NO: 1501744 - DNA, 16 bp, Homo sapiens
ggcctaccccgcagac

SEQ ID NO: 1501745 - DNA, 14 bp, Homo sapiens
ggcctagaccagca

SEQ ID NO: 1501746 - DNA, 23 bp, Homo sapiens
ggcctagatccacacacagagga

SEQ ID NO: 1501747 - DNA, 19 bp, Homo sapiens
ggcctagcgatctctcctg

SEQ ID NO: 1501748 - DNA, 13 bp, Homo sapiens
ggcctaggcacct

SEQ ID NO: 1501749 - DNA, 14 bp, Homo sapiens
ggcctaggcacctc

SEQ ID NO: 1501750 - DNA, 18 bp, Homo sapiens
ggcctcaaaggcccgctc

SEQ ID NO: 1501751 - DNA, 20 bp, Homo sapiens
ggcctcaagaacaaacactg

SEQ ID NO: 1501752 - DNA, 12 bp, Homo sapiens
ggcctcacccac

SEQ ID NO: 1501753 - DNA, 23 bp, Homo sapiens
ggcctcactggctggggcagagg

SEQ ID NO: 1501754 - DNA, 15 bp, Homo sapiens
ggcctcagctgcctc

SEQ ID NO: 1501755 - DNA, 17 bp, Homo sapiens
ggcctcagctgcctcac

SEQ ID NO: 1501756 - DNA, 17 bp, Homo sapiens
ggcctcaggctctgcac

SEQ ID NO: 1501757 - DNA, 13 bp, Homo sapiens
ggcctcagggcgc

SEQ ID NO: 1501758 - DNA, 14 bp, Homo sapiens
ggcctcagggcgct

SEQ ID NO: 1501759 - DNA, 16 bp, Homo sapiens
ggcctcagggcgctca

SEQ ID NO: 1501760 - DNA, 24 bp, Homo sapiens
ggcctcagggcgctcagacggcgg

SEQ ID NO: 1501761 - DNA, 13 bp, Homo sapiens
ggcctcaggtgct

SEQ ID NO: 1501762 - DNA, 17 bp, Homo sapiens
ggcctcagttcccagct

SEQ ID NO: 1501763 - DNA, 21 bp, Homo sapiens
ggcctcatccctcggaagccg

SEQ ID NO: 1501764 - DNA, 14 bp, Homo sapiens
ggcctcatgtggct

SEQ ID NO: 1501765 - DNA, 19 bp, Homo sapiens
ggcctcatgtggctggaag

SEQ ID NO: 1501766 - DNA, 16 bp, Homo sapiens
ggcctccaacgcccct

SEQ ID NO: 1501767 - DNA, 17 bp, Homo sapiens
ggcctccaacgcccctg

SEQ ID NO: 1501768 - DNA, 20 bp, Homo sapiens
ggcctccaacgcccctgtgg

SEQ ID NO: 1501769 - DNA, 22 bp, Homo sapiens
ggcctccactcccccacctgac

SEQ ID NO: 1501770 - DNA, 23 bp, Homo sapiens
ggcctccactcccccacctgaca

SEQ ID NO: 1501771 - DNA, 20 bp, Homo sapiens
ggcctccagaactcactggg

SEQ ID NO: 1501772 - DNA, 14 bp, Homo sapiens
ggcctccagaagct

SEQ ID NO: 1501773 - DNA, 22 bp, Homo sapiens
ggcctccagaagctgctccttt

SEQ ID NO: 1501774 - DNA, 16 bp, Homo sapiens
ggcctccagcctctcc

SEQ ID NO: 1501775 - DNA, 12 bp, Homo sapiens
ggcctccatgcc

SEQ ID NO: 1501776 - DNA, 22 bp, Homo sapiens
ggcctccattcctggagcccga

SEQ ID NO: 1501777 - DNA, 23 bp, Homo sapiens
ggcctccattcctggagcccgag

SEQ ID NO: 1501778 - DNA, 16 bp, Homo sapiens
ggcctccatttctgtc

SEQ ID NO: 1501779 - DNA, 13 bp, Homo sapiens
ggcctcccaaagt

SEQ ID NO: 1501780 - DNA, 14 bp, Homo sapiens
ggcctcccacccga

SEQ ID NO: 1501781 - DNA, 20 bp, Homo sapiens
ggcctcccacccgatgctgc

SEQ ID NO: 1501782 - DNA, 21 bp, Homo sapiens
ggcctcccacccgatgctgct

SEQ ID NO: 1501783 - DNA, 23 bp, Homo sapiens
ggcctcccacccgatgctgcttt

SEQ ID NO: 1501784 - DNA, 18 bp, Homo sapiens
ggcctcccccagccagga

SEQ ID NO: 1501785 - DNA, 15 bp, Homo sapiens
ggcctcccctgggca

SEQ ID NO: 1501786 - DNA, 17 bp, Homo sapiens
ggcctcccctgggcagg

SEQ ID NO: 1501787 - DNA, 21 bp, Homo sapiens
ggcctcccctgggcagggttc

SEQ ID NO: 1501788 - DNA, 15 bp, Homo sapiens
ggcctccctctctct

SEQ ID NO: 1501789 - DNA, 18 bp, Homo sapiens
ggcctccctgcagactcc

SEQ ID NO: 1501790 - DNA, 12 bp, Homo sapiens
ggcctccctgct

SEQ ID NO: 1501791 - DNA, 13 bp, Homo sapiens
ggcctccctgctg

SEQ ID NO: 1501792 - DNA, 10 bp, Homo sapiens
ggcctccctt

SEQ ID NO: 1501793 - DNA, 18 bp, Homo sapiens
ggcctccgaggctccccg

SEQ ID NO: 1501794 - DNA, 14 bp, Homo sapiens
ggcctccggcctcc

SEQ ID NO: 1501795 - DNA, 18 bp, Homo sapiens
ggcctcctcggagagcag

SEQ ID NO: 1501796 - DNA, 21 bp, Homo sapiens
ggcctcctcggagagcagcag

SEQ ID NO: 1501797 - DNA, 18 bp, Homo sapiens
ggcctcctctgtccaggg

SEQ ID NO: 1501798 - DNA, 23 bp, Homo sapiens
ggcctccttcttccacttctcca

SEQ ID NO: 1501799 - DNA, 14 bp, Homo sapiens
gctgggctgggcgc

SEQ ID NO: 1501800 - DNA, 20 bp, Homo sapiens
gctggggaaagggctggctg

SEQ ID NO: 1501801 - DNA, 22 bp, Homo sapiens
gctggggaaagggctggctgca

SEQ ID NO: 1501802 - DNA, 14 bp, Homo sapiens
gctggggaggagga

SEQ ID NO: 1501803 - DNA, 16 bp, Homo sapiens
gctggggaggaggaga

SEQ ID NO: 1501804 - DNA, 17 bp, Homo sapiens
gctggggaggaggagag

SEQ ID NO: 1501805 - DNA, 23 bp, Homo sapiens
gctggggatccccgcctggccag

SEQ ID NO: 1501806 - DNA, 19 bp, Homo sapiens
gctggggcagaggggcagc

SEQ ID NO: 1501807 - DNA, 22 bp, Homo sapiens
gctggggcagaggggcagccgc

SEQ ID NO: 1501808 - DNA, 13 bp, Homo sapiens
gctggggccacaa

SEQ ID NO: 1501809 - DNA, 18 bp, Homo sapiens
gctggggccgctggggtc

SEQ ID NO: 1501810 - DNA, 19 bp, Homo sapiens
gctggggcgtggggagggc

SEQ ID NO: 1501811 - DNA, 16 bp, Homo sapiens
gctggggctgctcccc

SEQ ID NO: 1501812 - DNA, 13 bp, Homo sapiens
gctgggggcagga

SEQ ID NO: 1501813 - DNA, 20 bp, Homo sapiens
gctgggggcaggagggccct

SEQ ID NO: 1501814 - DNA, 23 bp, Homo sapiens
gctgggggcaggagggccctacc

SEQ ID NO: 1501815 - DNA, 16 bp, Homo sapiens
gctggggggctgtcct

SEQ ID NO: 1501816 - DNA, 21 bp, Homo sapiens
gctggggtcctcctgtgctat

SEQ ID NO: 1501817 - DNA, 15 bp, Homo sapiens
gctgggtccttgggc

SEQ ID NO: 1501818 - DNA, 15 bp, Homo sapiens
gctgggtgccctctc

SEQ ID NO: 1501819 - DNA, 18 bp, Homo sapiens
gctgggtgccctctcagg

SEQ ID NO: 1501820 - DNA, 17 bp, Homo sapiens
gctgggtggtaccctct

SEQ ID NO: 1501821 - DNA, 16 bp, Homo sapiens
gctgggttcatttgtg

SEQ ID NO: 1501822 - DNA, 14 bp, Homo sapiens
gctgggttcccact

SEQ ID NO: 1501823 - DNA, 13 bp, Homo sapiens
gctggtaacagtt

SEQ ID NO: 1501824 - DNA, 18 bp, Homo sapiens
gctggtagagacccccag

SEQ ID NO: 1501825 - DNA, 21 bp, Homo sapiens
gctggtagagacccccaggcc

SEQ ID NO: 1501826 - DNA, 13 bp, Homo sapiens
gctggtagcagca

SEQ ID NO: 1501827 - DNA, 14 bp, Homo sapiens
gctggtatttctaa

SEQ ID NO: 1501828 - DNA, 19 bp, Homo sapiens
gctggtcactctgccctct

SEQ ID NO: 1501829 - DNA, 20 bp, Homo sapiens
gctggtcactctgccctctg

SEQ ID NO: 1501830 - DNA, 22 bp, Homo sapiens
gctggtcactctgccctctgct

SEQ ID NO: 1501831 - DNA, 20 bp, Homo sapiens
gctggtccctgccctcccct

SEQ ID NO: 1501832 - DNA, 15 bp, Homo sapiens
gctggtccgtgggac

SEQ ID NO: 1501833 - DNA, 12 bp, Homo sapiens
gctggtccttat

SEQ ID NO: 1501834 - DNA, 20 bp, Homo sapiens
gctggtctcaaactcctgac

SEQ ID NO: 1501835 - DNA, 18 bp, Homo sapiens
gctggtgaacactgtgac

SEQ ID NO: 1501836 - DNA, 24 bp, Homo sapiens
gctggtgaacactgtgaccaggct

SEQ ID NO: 1501837 - DNA, 13 bp, Homo sapiens
gctggtgcaaaga

SEQ ID NO: 1501838 - DNA, 15 bp, Homo sapiens
gctggtgcagggcct

SEQ ID NO: 1501839 - DNA, 22 bp, Homo sapiens
gctggtgccaaatagccccaga

SEQ ID NO: 1501840 - DNA, 12 bp, Homo sapiens
gctggtgcccca

SEQ ID NO: 1501841 - DNA, 15 bp, Homo sapiens
gctggtgccccacct

SEQ ID NO: 1501842 - DNA, 16 bp, Homo sapiens
gctggtgccccacctg

SEQ ID NO: 1501843 - DNA, 22 bp, Homo sapiens
gctggtgccccacctgcctggt

SEQ ID NO: 1501844 - DNA, 20 bp, Homo sapiens
gctggtggccctgtgcctgg

SEQ ID NO: 1501845 - DNA, 22 bp, Homo sapiens
gctggtggccctgtgcctgggc

SEQ ID NO: 1501846 - DNA, 15 bp, Homo sapiens
gctggtggccttggg

SEQ ID NO: 1501847 - DNA, 15 bp, Homo sapiens
gctggtgtagtcttt

SEQ ID NO: 1501848 - DNA, 15 bp, Homo sapiens
ggcctcggagcctca

SEQ ID NO: 1501849 - DNA, 15 bp, Homo sapiens
ggcctcggcctccca

SEQ ID NO: 1501850 - DNA, 19 bp, Homo sapiens
ggcctctcctgccctctgc

SEQ ID NO: 1501851 - DNA, 13 bp, Homo sapiens
ggcctctctatcc

SEQ ID NO: 1501852 - DNA, 14 bp, Homo sapiens
ggcctctctctgcc

SEQ ID NO: 1501853 - DNA, 15 bp, Homo sapiens
ggcctctctctgcct

SEQ ID NO: 1501854 - DNA, 16 bp, Homo sapiens
ggcctctctggcctcc

SEQ ID NO: 1501855 - DNA, 19 bp, Homo sapiens
ggcctctctggcctcccac

SEQ ID NO: 1501856 - DNA, 20 bp, Homo sapiens
ggcctctctggcctcccacc

SEQ ID NO: 1501857 - DNA, 21 bp, Homo sapiens
ggcctctctggcctcccaccc

SEQ ID NO: 1501858 - DNA, 23 bp, Homo sapiens
ggcctctgcaactgctcagctct

SEQ ID NO: 1501859 - DNA, 11 bp, Homo sapiens
ggcctctgcct

SEQ ID NO: 1501860 - DNA, 14 bp, Homo sapiens
ggcctctgcctgct

SEQ ID NO: 1501861 - DNA, 20 bp, Homo sapiens
ggcctctgcctgctggggat

SEQ ID NO: 1501862 - DNA, 15 bp, Homo sapiens
ggcctctgcctggga

SEQ ID NO: 1501863 - DNA, 21 bp, Homo sapiens
ggcctctgtaccgcccggcag

SEQ ID NO: 1501864 - DNA, 18 bp, Homo sapiens
ggcctcttcaaattagaa

SEQ ID NO: 1501865 - DNA, 18 bp, Homo sapiens
ggcctcttgagcagtggc

SEQ ID NO: 1501866 - DNA, 22 bp, Homo sapiens
ggcctcttgagcagtggctggt

SEQ ID NO: 1501867 - DNA, 23 bp, Homo sapiens
ggcctcttggctatttctgtgtc

SEQ ID NO: 1501868 - DNA, 16 bp, Homo sapiens
ggcctcttgtgctcac

SEQ ID NO: 1501869 - DNA, 19 bp, Homo sapiens
ggcctctttttttcttttc

SEQ ID NO: 1501870 - DNA, 17 bp, Homo sapiens
ggcctgaaagaggctga

SEQ ID NO: 1501871 - DNA, 23 bp, Homo sapiens
ggcctgaaagaggctgaggcctg

SEQ ID NO: 1501872 - DNA, 17 bp, Homo sapiens
ggcctgaactgaggaga

SEQ ID NO: 1501873 - DNA, 16 bp, Homo sapiens
ggcctgaagccagctg

SEQ ID NO: 1501874 - DNA, 17 bp, Homo sapiens
ggcctgaatcatgagcc

SEQ ID NO: 1501875 - DNA, 19 bp, Homo sapiens
ggcctgaatcatgagcctg

SEQ ID NO: 1501876 - DNA, 23 bp, Homo sapiens
ggcctgaatcatgagcctgctgg

SEQ ID NO: 1501877 - DNA, 17 bp, Homo sapiens
ggcctgacaccccctcc

SEQ ID NO: 1501878 - DNA, 15 bp, Homo sapiens
ggcctgaccaggggg

SEQ ID NO: 1501879 - DNA, 13 bp, Homo sapiens
ggcctgactgctc

SEQ ID NO: 1501880 - DNA, 14 bp, Homo sapiens
ggcctgagaatgag

SEQ ID NO: 1501881 - DNA, 15 bp, Homo sapiens
ggcctgagagtcagc

SEQ ID NO: 1501882 - DNA, 20 bp, Homo sapiens
ggcctgagatttcatctgct

SEQ ID NO: 1501883 - DNA, 15 bp, Homo sapiens
ggcctgagctggggc

SEQ ID NO: 1501884 - DNA, 18 bp, Homo sapiens
ggcctgaggatgagctgg

SEQ ID NO: 1501885 - DNA, 22 bp, Homo sapiens
ggcctgaggatgagctggaagg

SEQ ID NO: 1501886 - DNA, 15 bp, Homo sapiens
ggcctgatgctccct

SEQ ID NO: 1501887 - DNA, 20 bp, Homo sapiens
ggcctgatgctccctcccct

SEQ ID NO: 1501888 - DNA, 13 bp, Homo sapiens
ggcctgatgctgc

SEQ ID NO: 1501889 - DNA, 14 bp, Homo sapiens
ggcctgcacagtga

SEQ ID NO: 1501890 - DNA, 16 bp, Homo sapiens
ggcctgcaggggcaag

SEQ ID NO: 1501891 - DNA, 14 bp, Homo sapiens
ggcctgcatggaga

SEQ ID NO: 1501892 - DNA, 15 bp, Homo sapiens
ggcctgcatggagaa

SEQ ID NO: 1501893 - DNA, 18 bp, Homo sapiens
ggcctgcccagtcgaccc

SEQ ID NO: 1501894 - DNA, 21 bp, Homo sapiens
ggcctgccgggctgagggcct

SEQ ID NO: 1501895 - DNA, 19 bp, Homo sapiens
ggcctgcctccagggctgg

SEQ ID NO: 1501896 - DNA, 15 bp, Homo sapiens
ggcctgcctcccact

SEQ ID NO: 1501897 - DNA, 16 bp, Homo sapiens
ggcctgcgaccctggg

SEQ ID NO: 1501898 - DNA, 18 bp, Homo sapiens
ggcctgcgaccctggggg

SEQ ID NO: 1501899 - DNA, 23 bp, Homo sapiens
ggcctgcgaccctgggggcacag

SEQ ID NO: 1501900 - DNA, 18 bp, Homo sapiens
ggcctgcgccagtcctgc

SEQ ID NO: 1501901 - DNA, 20 bp, Homo sapiens
ggcctgctaaggctcctcct

SEQ ID NO: 1501902 - DNA, 21 bp, Homo sapiens
ggcctgctaaggctcctcctt

SEQ ID NO: 1501903 - DNA, 17 bp, Homo sapiens
ggcctgctcccagcagc

SEQ ID NO: 1501904 - DNA, 20 bp, Homo sapiens
ggcctgctgccagtgcagcc

SEQ ID NO: 1501905 - DNA, 21 bp, Homo sapiens
ggcctgctgccagtgcagcca

SEQ ID NO: 1501906 - DNA, 15 bp, Homo sapiens
ggcctgctggaggcc

SEQ ID NO: 1501907 - DNA, 12 bp, Homo sapiens
ggcctgctggga

SEQ ID NO: 1501908 - DNA, 21 bp, Homo sapiens
ggcctgctgggctctccacct

SEQ ID NO: 1501909 - DNA, 22 bp, Homo sapiens
ggcctgctgggctctccacctc

SEQ ID NO: 1501910 - DNA, 23 bp, Homo sapiens
ggcctgctgggctctccacctca

SEQ ID NO: 1501911 - DNA, 19 bp, Homo sapiens
ggcctgctgtgattccact

SEQ ID NO: 1501912 - DNA, 20 bp, Homo sapiens
ggcctgcttttccaggatcc

SEQ ID NO: 1501913 - DNA, 15 bp, Homo sapiens
ggcctggacctgcct

SEQ ID NO: 1501914 - DNA, 16 bp, Homo sapiens
ggcctggacctgcctc

SEQ ID NO: 1501915 - DNA, 21 bp, Homo sapiens
ggcctggacctgcctcctgcc

SEQ ID NO: 1501916 - DNA, 20 bp, Homo sapiens
ggcctggactgactgcagcc

SEQ ID NO: 1501917 - DNA, 18 bp, Homo sapiens
ggcctggactttcctgca

SEQ ID NO: 1501918 - DNA, 15 bp, Homo sapiens
ggcctggagatcctc

SEQ ID NO: 1501919 - DNA, 20 bp, Homo sapiens
ggcctggagcatggacagtg

SEQ ID NO: 1501920 - DNA, 10 bp, Homo sapiens
ggcctggagg

SEQ ID NO: 1501921 - DNA, 19 bp, Homo sapiens
ggcctggaggtggggttgg

SEQ ID NO: 1501922 - DNA, 19 bp, Homo sapiens
ggcctggattcatttcctg

SEQ ID NO: 1501923 - DNA, 15 bp, Homo sapiens
ggcctggcagccgtg

SEQ ID NO: 1501924 - DNA, 19 bp, Homo sapiens
ggcctggccaatgcggccc

SEQ ID NO: 1501925 - DNA, 14 bp, Homo sapiens
ggcctggccacctc

SEQ ID NO: 1501926 - DNA, 16 bp, Homo sapiens
ggcctggccacctctc

SEQ ID NO: 1501927 - DNA, 14 bp, Homo sapiens
ggcctggccaggag

SEQ ID NO: 1501928 - DNA, 19 bp, Homo sapiens
ggctagagtcctcactccc

SEQ ID NO: 1501929 - DNA, 20 bp, Homo sapiens
ggctagagtcctcactccca

SEQ ID NO: 1501930 - DNA, 20 bp, Homo sapiens
ggctagcttctgcttttctg

SEQ ID NO: 1501931 - DNA, 13 bp, Homo sapiens
ggctagtcagaga

SEQ ID NO: 1501932 - DNA, 19 bp, Homo sapiens
ggctagtggggtgaacagc

SEQ ID NO: 1501933 - DNA, 21 bp, Homo sapiens
ggctagtggggtgaacagctg

SEQ ID NO: 1501934 - DNA, 23 bp, Homo sapiens
ggctagtggggtgaacagctggt

SEQ ID NO: 1501935 - DNA, 18 bp, Homo sapiens
ggctagtgtgagtggcag

SEQ ID NO: 1501936 - DNA, 17 bp, Homo sapiens
ggctagttaaggtgtgc

SEQ ID NO: 1501937 - DNA, 20 bp, Homo sapiens
ggctatagctacaggaagca

SEQ ID NO: 1501938 - DNA, 21 bp, Homo sapiens
ggctatgaagggacagctgct

SEQ ID NO: 1501939 - DNA, 22 bp, Homo sapiens
ggctatttttgaagcaaagaag

SEQ ID NO: 1501940 - DNA, 12 bp, Homo sapiens
ggctcaaataaa

SEQ ID NO: 1501941 - DNA, 19 bp, Homo sapiens
ggctcaaatgatcctccca

SEQ ID NO: 1501942 - DNA, 21 bp, Homo sapiens
ggctcaagacaaggctggcaa

SEQ ID NO: 1501943 - DNA, 16 bp, Homo sapiens
ggctcaagtagaaaag

SEQ ID NO: 1501944 - DNA, 15 bp, Homo sapiens
ggctcacaaggccca

SEQ ID NO: 1501945 - DNA, 16 bp, Homo sapiens
ggctcacaaggcccag

SEQ ID NO: 1501946 - DNA, 12 bp, Homo sapiens
ggctcacactga

SEQ ID NO: 1501947 - DNA, 17 bp, Homo sapiens
ggctcacactgagaatg

SEQ ID NO: 1501948 - DNA, 15 bp, Homo sapiens
ggctcaccagctggg

SEQ ID NO: 1501949 - DNA, 20 bp, Homo sapiens
ggctcacgcctatgatccca

SEQ ID NO: 1501950 - DNA, 21 bp, Homo sapiens
ggctcacgcctatgatcccag

SEQ ID NO: 1501951 - DNA, 23 bp, Homo sapiens
ggctcacgcctatgatcccagca

SEQ ID NO: 1501952 - DNA, 12 bp, Homo sapiens
ggctcactactg

SEQ ID NO: 1501953 - DNA, 13 bp, Homo sapiens
ggctcactactga

SEQ ID NO: 1501954 - DNA, 21 bp, Homo sapiens
ggctcactgaaacctctgcct

SEQ ID NO: 1501955 - DNA, 19 bp, Homo sapiens
ggctcactgcaacctccgc

SEQ ID NO: 1501956 - DNA, 18 bp, Homo sapiens
ggctcactgccaggccag

SEQ ID NO: 1501957 - DNA, 21 bp, Homo sapiens
ggctcactgccaggccagcct

SEQ ID NO: 1501958 - DNA, 22 bp, Homo sapiens
ggctcactgccaggccagcctc

SEQ ID NO: 1501959 - DNA, 20 bp, Homo sapiens
ggctcactggcaggtgtggg

SEQ ID NO: 1501960 - DNA, 20 bp, Homo sapiens
ggctcacttttcatccttcc

SEQ ID NO: 1501961 - DNA, 21 bp, Homo sapiens
ggctcagatcggccacagggc

SEQ ID NO: 1501962 - DNA, 14 bp, Homo sapiens
ggctcagcccgctg

SEQ ID NO: 1501963 - DNA, 11 bp, Homo sapiens
ggctcagcctg

SEQ ID NO: 1501964 - DNA, 14 bp, Homo sapiens
ggctcaggcaagcc

SEQ ID NO: 1501965 - DNA, 19 bp, Homo sapiens
ggctcaggcaagcccctca

SEQ ID NO: 1501966 - DNA, 20 bp, Homo sapiens
ggctcaggcaagcccctcag

SEQ ID NO: 1501967 - DNA, 17 bp, Homo sapiens
ggctcaggcagacaaga

SEQ ID NO: 1501968 - DNA, 12 bp, Homo sapiens
ggctcagggctg

SEQ ID NO: 1501969 - DNA, 17 bp, Homo sapiens
ggctcagggctggagtg

SEQ ID NO: 1501970 - DNA, 17 bp, Homo sapiens
ggctcagtctcaggagc

SEQ ID NO: 1501971 - DNA, 20 bp, Homo sapiens
ggctcatagggaagacctgc

SEQ ID NO: 1501972 - DNA, 21 bp, Homo sapiens
ggctcatggcgtaatgggcct

SEQ ID NO: 1501973 - DNA, 13 bp, Homo sapiens
ggctccacacagc

SEQ ID NO: 1501974 - DNA, 14 bp, Homo sapiens
ggctccacacagca

SEQ ID NO: 1501975 - DNA, 20 bp, Homo sapiens
ggctccagcatccagcctgt

SEQ ID NO: 1501976 - DNA, 15 bp, Homo sapiens
ggctccagccatctc

SEQ ID NO: 1501977 - DNA, 18 bp, Homo sapiens
ggctccagccatctcatg

SEQ ID NO: 1501978 - DNA, 15 bp, Homo sapiens
ggctccaggcagaag

SEQ ID NO: 1501979 - DNA, 18 bp, Homo sapiens
ggctccagtttccccatg

SEQ ID NO: 1501980 - DNA, 20 bp, Homo sapiens
ggctccatatcatttgagtt

SEQ ID NO: 1501981 - DNA, 13 bp, Homo sapiens
ggctccatgcacc

SEQ ID NO: 1501982 - DNA, 16 bp, Homo sapiens
ggctccatgcacctcc

SEQ ID NO: 1501983 - DNA, 18 bp, Homo sapiens
ggctcccaatcagctttt

SEQ ID NO: 1501984 - DNA, 18 bp, Homo sapiens
ggctcccacaggcccttc

SEQ ID NO: 1501985 - DNA, 21 bp, Homo sapiens
ggctcccacaggcccttcctc

SEQ ID NO: 1501986 - DNA, 19 bp, Homo sapiens
ggctcccaccctcccctga

SEQ ID NO: 1501987 - DNA, 14 bp, Homo sapiens
ggctcccaggacac

SEQ ID NO: 1501988 - DNA, 23 bp, Homo sapiens
ggctcccaggggtctccctggct

SEQ ID NO: 1501989 - DNA, 15 bp, Homo sapiens
ggctcccatgtgagt

SEQ ID NO: 1501990 - DNA, 21 bp, Homo sapiens
ggctccccacgagtcacctgc

SEQ ID NO: 1501991 - DNA, 18 bp, Homo sapiens
ggctccccgcctccactc

SEQ ID NO: 1501992 - DNA, 15 bp, Homo sapiens
ggctcccggaattcc

SEQ ID NO: 1501993 - DNA, 15 bp, Homo sapiens
ggctccctcctccag

SEQ ID NO: 1501994 - DNA, 20 bp, Homo sapiens
ggctccctcctccaggcctg

SEQ ID NO: 1501995 - DNA, 17 bp, Homo sapiens
ggctccctctctggttt

SEQ ID NO: 1501996 - DNA, 20 bp, Homo sapiens
ggctccgaaattccaaggcc

SEQ ID NO: 1501997 - DNA, 14 bp, Homo sapiens
ggctccggcctctg

SEQ ID NO: 1501998 - DNA, 21 bp, Homo sapiens
ggctcctacctgtctgctgcc

SEQ ID NO: 1501999 - DNA, 20 bp, Homo sapiens
ggctcctatctgtgttttga

SEQ ID NO: 1502000 - DNA, 13 bp, Homo sapiens
ggctcctggaaag

SEQ ID NO: 1502001 - DNA, 14 bp, Homo sapiens
ggctctggccaccc

SEQ ID NO: 1502002 - DNA, 18 bp, Homo sapiens
ggctctggccaccctggc

SEQ ID NO: 1502003 - DNA, 19 bp, Homo sapiens
ggctctgggccgggcctgg

SEQ ID NO: 1502004 - DNA, 12 bp, Homo sapiens
ggctctgggcct

SEQ ID NO: 1502005 - DNA, 15 bp, Homo sapiens
ggctctgggctcagg

SEQ ID NO: 1502006 - DNA, 14 bp, Homo sapiens
ggctctgtgccttg

SEQ ID NO: 1502007 - DNA, 23 bp, Homo sapiens
ggctctgtgccttggtctctcct

SEQ ID NO: 1502008 - DNA, 23 bp, Homo sapiens
ggctctgttcggcctttgggtgt

SEQ ID NO: 1502009 - DNA, 19 bp, Homo sapiens
ggctctgtttgtgggactg

SEQ ID NO: 1502010 - DNA, 20 bp, Homo sapiens
ggctcttagcagcttccaga

SEQ ID NO: 1502011 - DNA, 20 bp, Homo sapiens
ggctcttatgtgtgcctttg

SEQ ID NO: 1502012 - DNA, 16 bp, Homo sapiens
ggctcttcctggacct

SEQ ID NO: 1502013 - DNA, 12 bp, Homo sapiens
ggctcttctcat

SEQ ID NO: 1502014 - DNA, 13 bp, Homo sapiens
ggctcttctcatt

SEQ ID NO: 1502015 - DNA, 15 bp, Homo sapiens
ggctcttctcctttc

SEQ ID NO: 1502016 - DNA, 23 bp, Homo sapiens
ggctcttctcctttcacaacctt

SEQ ID NO: 1502017 - DNA, 15 bp, Homo sapiens
ggctcttgactactt

SEQ ID NO: 1502018 - DNA, 12 bp, Homo sapiens
ggctctttcaga

SEQ ID NO: 1502019 - DNA, 13 bp, Homo sapiens
ggctctttcagag

SEQ ID NO: 1502020 - DNA, 24 bp, Homo sapiens
ggctgaaagaacatggacttgtat

SEQ ID NO: 1502021 - DNA, 20 bp, Homo sapiens
ggctgaaagaggccaatgcc

SEQ ID NO: 1502022 - DNA, 16 bp, Homo sapiens
ggctgaaattctcctg

SEQ ID NO: 1502023 - DNA, 21 bp, Homo sapiens
ggctgaaattctcctggaggt

SEQ ID NO: 1502024 - DNA, 16 bp, Homo sapiens
ggctgaaccctgtgct

SEQ ID NO: 1502025 - DNA, 20 bp, Homo sapiens
ggctgaaccctgtgctggtg

SEQ ID NO: 1502026 - DNA, 22 bp, Homo sapiens
ggctgaaccctgtgctggtgtc

SEQ ID NO: 1502027 - DNA, 11 bp, Homo sapiens
ggctgaagacg

SEQ ID NO: 1502028 - DNA, 16 bp, Homo sapiens
ggctgaagctggagca

SEQ ID NO: 1502029 - DNA, 18 bp, Homo sapiens
ggctgaagctggagcagc

SEQ ID NO: 1502030 - DNA, 19 bp, Homo sapiens
ggctgaagctggagcagcg

SEQ ID NO: 1502031 - DNA, 18 bp, Homo sapiens
ggctgaagtgttctctag

SEQ ID NO: 1502032 - DNA, 20 bp, Homo sapiens
ggctgacacctaccatgctg

SEQ ID NO: 1502033 - DNA, 22 bp, Homo sapiens
ggctgacacctaccatgctgct

SEQ ID NO: 1502034 - DNA, 14 bp, Homo sapiens
ggctgacatctgtg

SEQ ID NO: 1502035 - DNA, 22 bp, Homo sapiens
ggctgacatgaagctgttgtgt

SEQ ID NO: 1502036 - DNA, 19 bp, Homo sapiens
ggctgacatgctcacacat

SEQ ID NO: 1502037 - DNA, 17 bp, Homo sapiens
ggctgacccagcatctc

SEQ ID NO: 1502038 - DNA, 21 bp, Homo sapiens
ggctgacccagcatctcccag

SEQ ID NO: 1502039 - DNA, 12 bp, Homo sapiens
ggctgacccctc

SEQ ID NO: 1502040 - DNA, 15 bp, Homo sapiens
ggctgacccctctgg

SEQ ID NO: 1502041 - DNA, 23 bp, Homo sapiens
ggctgacctgcctctcacacaca

SEQ ID NO: 1502042 - DNA, 15 bp, Homo sapiens
ggctgacgtgtgagg

SEQ ID NO: 1502043 - DNA, 16 bp, Homo sapiens
ggctgacttttccaaa

SEQ ID NO: 1502044 - DNA, 21 bp, Homo sapiens
ggctgagactgcgggatggtc

SEQ ID NO: 1502045 - DNA, 17 bp, Homo sapiens
ggctgagagccccagct

SEQ ID NO: 1502046 - DNA, 18 bp, Homo sapiens
ggctgagagccccagctg

SEQ ID NO: 1502047 - DNA, 20 bp, Homo sapiens
ggctgagagccccagctgac

SEQ ID NO: 1502048 - DNA, 15 bp, Homo sapiens
ggctgagatatgaac

SEQ ID NO: 1502049 - DNA, 16 bp, Homo sapiens
ggctgagccatgagga

SEQ ID NO: 1502050 - DNA, 16 bp, Homo sapiens
ggctgagcccctaccc

SEQ ID NO: 1502051 - DNA, 14 bp, Homo sapiens
ggctgagccctggc

SEQ ID NO: 1502052 - DNA, 15 bp, Homo sapiens
ggctgagccctggca

SEQ ID NO: 1502053 - DNA, 15 bp, Homo sapiens
ggctgagctctctgt

SEQ ID NO: 1502054 - DNA, 16 bp, Homo sapiens
ggctgaggacgagacc

SEQ ID NO: 1502055 - DNA, 16 bp, Homo sapiens
ggctgaggcaggagaa

SEQ ID NO: 1502056 - DNA, 13 bp, Homo sapiens
ggctgaggccacc

SEQ ID NO: 1502057 - DNA, 16 bp, Homo sapiens
ggctgaggcctggact

SEQ ID NO: 1502058 - DNA, 15 bp, Homo sapiens
ggctgagggcctgct

SEQ ID NO: 1502059 - DNA, 17 bp, Homo sapiens
ggctgaggttcctctgc

SEQ ID NO: 1502060 - DNA, 20 bp, Homo sapiens
ggctgaggttcctctgcctg

SEQ ID NO: 1502061 - DNA, 23 bp, Homo sapiens
ggctgagtcatgatctccctgcc

SEQ ID NO: 1502062 - DNA, 19 bp, Homo sapiens
ggctgagtggcagcagccc

SEQ ID NO: 1502063 - DNA, 13 bp, Homo sapiens
ggctgagttctgg

SEQ ID NO: 1502064 - DNA, 17 bp, Homo sapiens
ggctgagttctggttca

SEQ ID NO: 1502065 - DNA, 14 bp, Homo sapiens
ggctgatctcaggg

SEQ ID NO: 1502066 - DNA, 22 bp, Homo sapiens
ggctgatctcagggaagcccag

SEQ ID NO: 1502067 - DNA, 22 bp, Homo sapiens
ggctgatgaagaagggggtggg

SEQ ID NO: 1502068 - DNA, 18 bp, Homo sapiens
ggctgatggaagatggtc

SEQ ID NO: 1502069 - DNA, 18 bp, Homo sapiens
ggctgatggaggaaaaag

SEQ ID NO: 1502070 - DNA, 17 bp, Homo sapiens
ggctgcttctctacaga

SEQ ID NO: 1502071 - DNA, 22 bp, Homo sapiens
ggctggacctatgtcctaagga

SEQ ID NO: 1502072 - DNA, 13 bp, Homo sapiens
ggctggactgagg

SEQ ID NO: 1502073 - DNA, 16 bp, Homo sapiens
ggctggactgaggcct

SEQ ID NO: 1502074 - DNA, 20 bp, Homo sapiens
ggctggacttctacctgccc

SEQ ID NO: 1502075 - DNA, 19 bp, Homo sapiens
ggctggagaaagagctgcc

SEQ ID NO: 1502076 - DNA, 14 bp, Homo sapiens
ggctggagctggcc

SEQ ID NO: 1502077 - DNA, 14 bp, Homo sapiens
ggctggaggagctg

SEQ ID NO: 1502078 - DNA, 16 bp, Homo sapiens
ggctggaggagctggc

SEQ ID NO: 1502079 - DNA, 17 bp, Homo sapiens
ggctggaggagctggcc

SEQ ID NO: 1502080 - DNA, 20 bp, Homo sapiens
ggctggaggagctggcctgt

SEQ ID NO: 1502081 - DNA, 22 bp, Homo sapiens
ggctggaggagctggcctgtgg

SEQ ID NO: 1502082 - DNA, 15 bp, Homo sapiens
ggctggaggcagggc

SEQ ID NO: 1502083 - DNA, 19 bp, Homo sapiens
ggctggaggcagggccttg

SEQ ID NO: 1502084 - DNA, 19 bp, Homo sapiens
ggctggaggcccaggctgg

SEQ ID NO: 1502085 - DNA, 21 bp, Homo sapiens
ggctggagtctcagagcacag

SEQ ID NO: 1502086 - DNA, 20 bp, Homo sapiens
ggctggagtgcagtggcgca

SEQ ID NO: 1502087 - DNA, 20 bp, Homo sapiens
ggctggagtgcagtggtgtg

SEQ ID NO: 1502088 - DNA, 19 bp, Homo sapiens
ggctggagtggagtggcgt

SEQ ID NO: 1502089 - DNA, 15 bp, Homo sapiens
ggctggcaagcaggg

SEQ ID NO: 1502090 - DNA, 17 bp, Homo sapiens
ggctggcaagcagggaa

SEQ ID NO: 1502091 - DNA, 21 bp, Homo sapiens
ggctggcaggcagttctagaa

SEQ ID NO: 1502092 - DNA, 14 bp, Homo sapiens
ggctggcaggtgtt

SEQ ID NO: 1502093 - DNA, 21 bp, Homo sapiens
ggctggcgcagccaaggccga

SEQ ID NO: 1502094 - DNA, 20 bp, Homo sapiens
ggctggcggctactcagcag

SEQ ID NO: 1502095 - DNA, 14 bp, Homo sapiens
ggctggctcctctg

SEQ ID NO: 1502096 - DNA, 15 bp, Homo sapiens
ggctggctgcagtga

SEQ ID NO: 1502097 - DNA, 23 bp, Homo sapiens
ggctggctggagtctcagagcac

SEQ ID NO: 1502098 - DNA, 21 bp, Homo sapiens
ggctgggaacatgacccagcc

SEQ ID NO: 1502099 - DNA, 14 bp, Homo sapiens
ggctgggcagagct

SEQ ID NO: 1502100 - DNA, 21 bp, Homo sapiens
ggctgggcagcacaaggcctt

SEQ ID NO: 1502101 - DNA, 14 bp, Homo sapiens
ggctgggccaggtc

SEQ ID NO: 1502102 - DNA, 18 bp, Homo sapiens
ggctgggccctctttccc

SEQ ID NO: 1502103 - DNA, 22 bp, Homo sapiens
ggctgggccctctttccctgcg

SEQ ID NO: 1502104 - DNA, 14 bp, Homo sapiens
ggctgggcctcctt

SEQ ID NO: 1502105 - DNA, 17 bp, Homo sapiens
ggctgggcctccttctt

SEQ ID NO: 1502106 - DNA, 12 bp, Homo sapiens
ggctggggcaga

SEQ ID NO: 1502107 - DNA, 15 bp, Homo sapiens
ggctggggccgctgg

SEQ ID NO: 1502108 - DNA, 16 bp, Homo sapiens
ggctggggctgctccc

SEQ ID NO: 1502109 - DNA, 19 bp, Homo sapiens
ggctggggctgctccccta

SEQ ID NO: 1502110 - DNA, 16 bp, Homo sapiens
ggctgggggcaggagg

SEQ ID NO: 1502111 - DNA, 18 bp, Homo sapiens
ggctggggtcctcctgtg

SEQ ID NO: 1502112 - DNA, 19 bp, Homo sapiens
ggctggggtcctcctgtgc

SEQ ID NO: 1502113 - DNA, 18 bp, Homo sapiens
ggctgggtccttgggcct

SEQ ID NO: 1502114 - DNA, 14 bp, Homo sapiens
ggctgggtgccctc

SEQ ID NO: 1502115 - DNA, 15 bp, Homo sapiens
ggctggtaagagaag

SEQ ID NO: 1502116 - DNA, 20 bp, Homo sapiens
ggctggtagaaaaaggggcc

SEQ ID NO: 1502117 - DNA, 13 bp, Homo sapiens
ggctggtagcagc

SEQ ID NO: 1502118 - DNA, 15 bp, Homo sapiens
ggctggtcactctgc

SEQ ID NO: 1502119 - DNA, 23 bp, Homo sapiens
ggctggtccagggctagtgactt

SEQ ID NO: 1502120 - DNA, 16 bp, Homo sapiens
ggctggtccttattta

SEQ ID NO: 1502121 - DNA, 13 bp, Homo sapiens
ggctggtggcctt

SEQ ID NO: 1502122 - DNA, 14 bp, Homo sapiens
ggctggtggccttg

SEQ ID NO: 1502123 - DNA, 22 bp, Homo sapiens
ggctggttcggatttggggtgg

SEQ ID NO: 1502124 - DNA, 23 bp, Homo sapiens
ggctggttcggatttggggtgga

SEQ ID NO: 1502125 - DNA, 13 bp, Homo sapiens
ggctggttttgta

SEQ ID NO: 1502126 - DNA, 14 bp, Homo sapiens
ggctgtaaggctct

SEQ ID NO: 1502127 - DNA, 17 bp, Homo sapiens
ggctgtagatcaggttt

SEQ ID NO: 1502128 - DNA, 18 bp, Homo sapiens
ggctgtagatggtgacct

SEQ ID NO: 1502129 - DNA, 23 bp, Homo sapiens
ggctgtagttgggcctaaataaa

SEQ ID NO: 1502130 - DNA, 16 bp, Homo sapiens
ggctgtattttctttt

SEQ ID NO: 1502131 - DNA, 13 bp, Homo sapiens
ggctgtcctgctc

SEQ ID NO: 1502132 - DNA, 13 bp, Homo sapiens
ggctgtcctgctg

SEQ ID NO: 1502133 - DNA, 17 bp, Homo sapiens
ggctgtcctgctgccct

SEQ ID NO: 1502134 - DNA, 21 bp, Homo sapiens
ggctgtcgggggctgtggatg

SEQ ID NO: 1502135 - DNA, 16 bp, Homo sapiens
ggctgtctgaccagag

SEQ ID NO: 1502136 - DNA, 19 bp, Homo sapiens
ggctgtgaatgccaaagcc

SEQ ID NO: 1502137 - DNA, 20 bp, Homo sapiens
ggctgtgaatgccaaagcca

SEQ ID NO: 1502138 - DNA, 16 bp, Homo sapiens
ggctgtgacacctggt

SEQ ID NO: 1502139 - DNA, 22 bp, Homo sapiens
ggctgtgactctgggcagggac

SEQ ID NO: 1502140 - DNA, 14 bp, Homo sapiens
ggctgtgagcagcc

SEQ ID NO: 1502141 - DNA, 18 bp, Homo sapiens
ggctgtgagcagcctcca

SEQ ID NO: 1502142 - DNA, 11 bp, Homo sapiens
ggctgtgagtg

SEQ ID NO: 1502143 - DNA, 17 bp, Homo sapiens
ggctgtgcccagcaggc

SEQ ID NO: 1502144 - DNA, 15 bp, Homo sapiens
ggctgtgcccctgat

SEQ ID NO: 1502145 - DNA, 23 bp, Homo sapiens
ggctgtgcccctgatgcagcctg

SEQ ID NO: 1502146 - DNA, 19 bp, Homo sapiens
ggctgtggaccgtggacag

SEQ ID NO: 1502147 - DNA, 22 bp, Homo sapiens
ggctgtggaccgtggacaggcc

SEQ ID NO: 1502148 - DNA, 23 bp, Homo sapiens
ggctgtggaccgtggacaggccc

SEQ ID NO: 1502149 - DNA, 14 bp, Homo sapiens
ggctgtggcacaga

SEQ ID NO: 1502150 - DNA, 21 bp, Homo sapiens
ggctgtggccgtctcctccct

SEQ ID NO: 1502151 - DNA, 16 bp, Homo sapiens
ggctgtgggactccag

SEQ ID NO: 1502152 - DNA, 13 bp, Homo sapiens
ggctgtgggtgtg

SEQ ID NO: 1502153 - DNA, 13 bp, Homo sapiens
ggctgttccagac

SEQ ID NO: 1502154 - DNA, 22 bp, Homo sapiens
ggctgttccagactcaggttcc

SEQ ID NO: 1502155 - DNA, 18 bp, Homo sapiens
ggctgttctagacacagt

SEQ ID NO: 1502156 - DNA, 14 bp, Homo sapiens
ggctgttctggaag

SEQ ID NO: 1502157 - DNA, 20 bp, Homo sapiens
ggctgttcttcaactcctgg

SEQ ID NO: 1502158 - DNA, 21 bp, Homo sapiens
ggctgttggacagctgcttgt

SEQ ID NO: 1502159 - DNA, 14 bp, Homo sapiens
ggctgtttgaggat

SEQ ID NO: 1502160 - DNA, 15 bp, Homo sapiens
ggcttagtatttctc

SEQ ID NO: 1502161 - DNA, 22 bp, Homo sapiens
ggcttagtatttctcaggaaga

SEQ ID NO: 1502162 - DNA, 21 bp, Homo sapiens
ggcttatcagggagttacagt

SEQ ID NO: 1502163 - DNA, 19 bp, Homo sapiens
ggcttatttctatgacaaa

SEQ ID NO: 1502164 - DNA, 18 bp, Homo sapiens
ggcttcaccagtctgtct

SEQ ID NO: 1502165 - DNA, 17 bp, Homo sapiens
ggcttcagcatatttat

SEQ ID NO: 1502166 - DNA, 20 bp, Homo sapiens
ggcttcagcatatttatagc

SEQ ID NO: 1502167 - DNA, 15 bp, Homo sapiens
ggcttcatgccagct

SEQ ID NO: 1502168 - DNA, 16 bp, Homo sapiens
ggcttcattctggaaa

SEQ ID NO: 1502169 - DNA, 19 bp, Homo sapiens
ggcttccagattttaaatt

SEQ ID NO: 1502170 - DNA, 17 bp, Homo sapiens
ggcttccaggctcttcc

SEQ ID NO: 1502171 - DNA, 18 bp, Homo sapiens
ggcttccaggctcttcct

SEQ ID NO: 1502172 - DNA, 19 bp, Homo sapiens
ggcttcccaggctgggctc

SEQ ID NO: 1502173 - DNA, 23 bp, Homo sapiens
ggcttccccactcccccgtttct

SEQ ID NO: 1502174 - DNA, 21 bp, Homo sapiens
ggcttcccgctcagccctccc

SEQ ID NO: 1502175 - DNA, 14 bp, Homo sapiens
ggcttccctggaag

SEQ ID NO: 1502176 - DNA, 11 bp, Homo sapiens
ggcttcccttc

SEQ ID NO: 1502177 - DNA, 13 bp, Homo sapiens
ggcttcccttctc

SEQ ID NO: 1502178 - DNA, 22 bp, Homo sapiens
ggcttcctccgtccacccaggc

SEQ ID NO: 1502179 - DNA, 17 bp, Homo sapiens
ggcttcctcttcttgtt

SEQ ID NO: 1502180 - DNA, 20 bp, Homo sapiens
ggcttcctggtgagaactga

SEQ ID NO: 1502181 - DNA, 14 bp, Homo sapiens
ggcttcctgtccac

SEQ ID NO: 1502182 - DNA, 18 bp, Homo sapiens
ggcttctccgccagcctc

SEQ ID NO: 1502183 - DNA, 23 bp, Homo sapiens
ggcttctccgccagcctcctctg

SEQ ID NO: 1502184 - DNA, 16 bp, Homo sapiens
ggcttctcctcctctg

SEQ ID NO: 1502185 - DNA, 15 bp, Homo sapiens
ggcttctcctgaccc

SEQ ID NO: 1502186 - DNA, 13 bp, Homo sapiens
gggaaatttttca

SEQ ID NO: 1502187 - DNA, 15 bp, Homo sapiens
gggaacactggcctg

SEQ ID NO: 1502188 - DNA, 14 bp, Homo sapiens
gggaacagacagga

SEQ ID NO: 1502189 - DNA, 15 bp, Homo sapiens
gggaacagacaggag

SEQ ID NO: 1502190 - DNA, 18 bp, Homo sapiens
gggaacagacaggagaaa

SEQ ID NO: 1502191 - DNA, 13 bp, Homo sapiens
gggaacagcccca

SEQ ID NO: 1502192 - DNA, 17 bp, Homo sapiens
gggaacagccccagggt

SEQ ID NO: 1502193 - DNA, 14 bp, Homo sapiens
gggaacatgccccc

SEQ ID NO: 1502194 - DNA, 20 bp, Homo sapiens
gggaacatgctggaaataaa

SEQ ID NO: 1502195 - DNA, 20 bp, Homo sapiens
gggaacccaagtccaagcat

SEQ ID NO: 1502196 - DNA, 15 bp, Homo sapiens
gggaaccccgcagcc

SEQ ID NO: 1502197 - DNA, 19 bp, Homo sapiens
gggaacctagtactctctg

SEQ ID NO: 1502198 - DNA, 20 bp, Homo sapiens
gggaacctagtactctctgc

SEQ ID NO: 1502199 - DNA, 13 bp, Homo sapiens
gggaacctgtgtc

SEQ ID NO: 1502200 - DNA, 14 bp, Homo sapiens
gggaacctgtgtcc

SEQ ID NO: 1502201 - DNA, 15 bp, Homo sapiens
gggaacctgtgtccg

SEQ ID NO: 1502202 - DNA, 17 bp, Homo sapiens
gggaacgtgactgcccc

SEQ ID NO: 1502203 - DNA, 16 bp, Homo sapiens
gggaagacagtggccc

SEQ ID NO: 1502204 - DNA, 16 bp, Homo sapiens
gggaagaccaaagttt

SEQ ID NO: 1502205 - DNA, 22 bp, Homo sapiens
gggaagaccagaattcccttga

SEQ ID NO: 1502206 - DNA, 14 bp, Homo sapiens
gggaagagaagaaa

SEQ ID NO: 1502207 - DNA, 23 bp, Homo sapiens
gggaagagaagagggcccagccc

SEQ ID NO: 1502208 - DNA, 18 bp, Homo sapiens
gggaagaggatgagcaga

SEQ ID NO: 1502209 - DNA, 21 bp, Homo sapiens
gggaagagggcagtacctggg

SEQ ID NO: 1502210 - DNA, 15 bp, Homo sapiens
gggaagaggggctgg

SEQ ID NO: 1502211 - DNA, 23 bp, Homo sapiens
gggaagcggaggttgcagggagc

SEQ ID NO: 1502212 - DNA, 20 bp, Homo sapiens
gggaagcttgagcctccccc

SEQ ID NO: 1502213 - DNA, 21 bp, Homo sapiens
gggaagcttgagcctccccca

SEQ ID NO: 1502214 - DNA, 20 bp, Homo sapiens
gggaaggagggttagggagg

SEQ ID NO: 1502215 - DNA, 13 bp, Homo sapiens
gggaaggccacct

SEQ ID NO: 1502216 - DNA, 15 bp, Homo sapiens
gggaaggcctgactt

SEQ ID NO: 1502217 - DNA, 16 bp, Homo sapiens
gggaagggagagcggg

SEQ ID NO: 1502218 - DNA, 22 bp, Homo sapiens
gggaagggccagtctgggctgc

SEQ ID NO: 1502219 - DNA, 14 bp, Homo sapiens
gggaaggggctgag

SEQ ID NO: 1502220 - DNA, 14 bp, Homo sapiens
gggaaggtggggcc

SEQ ID NO: 1502221 - DNA, 20 bp, Homo sapiens
gggaaggtggggccctgccc

SEQ ID NO: 1502222 - DNA, 21 bp, Homo sapiens
gggaaggtggggtcctggagc

SEQ ID NO: 1502223 - DNA, 14 bp, Homo sapiens
gggaagtaacagac

SEQ ID NO: 1502224 - DNA, 21 bp, Homo sapiens
gggaagtgaggcccaaggagc

SEQ ID NO: 1502225 - DNA, 13 bp, Homo sapiens
gggaagtggggag

SEQ ID NO: 1502226 - DNA, 18 bp, Homo sapiens
gggaagtggtccagaaac

SEQ ID NO: 1502227 - DNA, 17 bp, Homo sapiens
gggaagttaaagggaag

SEQ ID NO: 1502228 - DNA, 22 bp, Homo sapiens
gggaagttaaagggaagaaaac

SEQ ID NO: 1502229 - DNA, 22 bp, Homo sapiens
gggaagttgcattcctttgtct

SEQ ID NO: 1502230 - DNA, 21 bp, Homo sapiens
gggaatccaagcctccacagc

SEQ ID NO: 1502231 - DNA, 20 bp, Homo sapiens
gggaatggatggggagaatg

SEQ ID NO: 1502232 - DNA, 14 bp, Homo sapiens
gggaatgggagagg

SEQ ID NO: 1502233 - DNA, 21 bp, Homo sapiens
gggaatgtattattctgcagc

SEQ ID NO: 1502234 - DNA, 11 bp, Homo sapiens
gggaatgtgaa

SEQ ID NO: 1502235 - DNA, 15 bp, Homo sapiens
gggaatgttccctgc

SEQ ID NO: 1502236 - DNA, 16 bp, Homo sapiens
gggaatgttccctgca

SEQ ID NO: 1502237 - DNA, 21 bp, Homo sapiens
gggaatgttccctgcaccctg

SEQ ID NO: 1502238 - DNA, 17 bp, Homo sapiens
gggaattaaaaagaaga

SEQ ID NO: 1502239 - DNA, 15 bp, Homo sapiens
gggacaaagaggcct

SEQ ID NO: 1502240 - DNA, 13 bp, Homo sapiens
gggacaaggaagg

SEQ ID NO: 1502241 - DNA, 14 bp, Homo sapiens
gggagacagggtag

SEQ ID NO: 1502242 - DNA, 16 bp, Homo sapiens
gggagaccctccccac

SEQ ID NO: 1502243 - DNA, 23 bp, Homo sapiens
gggagactgtggtaggggcaggg

SEQ ID NO: 1502244 - DNA, 11 bp, Homo sapiens
gggagagaaaa

SEQ ID NO: 1502245 - DNA, 19 bp, Homo sapiens
gggagagagaaccaccact

SEQ ID NO: 1502246 - DNA, 18 bp, Homo sapiens
gggagagagaagcaggca

SEQ ID NO: 1502247 - DNA, 21 bp, Homo sapiens
gggagagagaagcaggcagat

SEQ ID NO: 1502248 - DNA, 14 bp, Homo sapiens
gggagagagagaga

SEQ ID NO: 1502249 - DNA, 22 bp, Homo sapiens
gggagagagagagagagaggac

SEQ ID NO: 1502250 - DNA, 14 bp, Homo sapiens
gggagagccagctc

SEQ ID NO: 1502251 - DNA, 12 bp, Homo sapiens
gggagagcccag

SEQ ID NO: 1502252 - DNA, 17 bp, Homo sapiens
gggagagggaggtcact

SEQ ID NO: 1502253 - DNA, 21 bp, Homo sapiens
gggagagggcctctgcctggg

SEQ ID NO: 1502254 - DNA, 19 bp, Homo sapiens
gggagaggtcaccagctgc

SEQ ID NO: 1502255 - DNA, 20 bp, Homo sapiens
gggagaggtcaccagctgct

SEQ ID NO: 1502256 - DNA, 14 bp, Homo sapiens
gggagatggggagg

SEQ ID NO: 1502257 - DNA, 14 bp, Homo sapiens
gggagcaagacaga

SEQ ID NO: 1502258 - DNA, 20 bp, Homo sapiens
gggagcacggactgtcagtt

SEQ ID NO: 1502259 - DNA, 23 bp, Homo sapiens
gggagcacttgcgtcctgcagag

SEQ ID NO: 1502260 - DNA, 23 bp, Homo sapiens
gggagcaggttccccaagggccc

SEQ ID NO: 1502261 - DNA, 19 bp, Homo sapiens
gggagcagtgtcttccata

SEQ ID NO: 1502262 - DNA, 21 bp, Homo sapiens
gggagcatttaatggcagcta

SEQ ID NO: 1502263 - DNA, 12 bp, Homo sapiens
gggagcccagaa

SEQ ID NO: 1502264 - DNA, 13 bp, Homo sapiens
gggagccccaggg

SEQ ID NO: 1502265 - DNA, 14 bp, Homo sapiens
gggagccccagggt

SEQ ID NO: 1502266 - DNA, 21 bp, Homo sapiens
gggagccccagggtcttccct

SEQ ID NO: 1502267 - DNA, 20 bp, Homo sapiens
gggagccggtaactgtcctg

SEQ ID NO: 1502268 - DNA, 17 bp, Homo sapiens
gggagcctagctcctgc

SEQ ID NO: 1502269 - DNA, 18 bp, Homo sapiens
gggagcctagctcctgcc

SEQ ID NO: 1502270 - DNA, 21 bp, Homo sapiens
gggagcctagctcctgccaca

SEQ ID NO: 1502271 - DNA, 23 bp, Homo sapiens
gggagctagaggccacctatgcc

SEQ ID NO: 1502272 - DNA, 23 bp, Homo sapiens
gggagctctggggacagcttcct

SEQ ID NO: 1502273 - DNA, 14 bp, Homo sapiens
gggagctgagctgg

SEQ ID NO: 1502274 - DNA, 12 bp, Homo sapiens
gggagctgccaa

SEQ ID NO: 1502275 - DNA, 13 bp, Homo sapiens
gggagctgggccc

SEQ ID NO: 1502276 - DNA, 19 bp, Homo sapiens
gggagctgggcccgacatg

SEQ ID NO: 1502277 - DNA, 13 bp, Homo sapiens
gggaggaaaaaag

SEQ ID NO: 1502278 - DNA, 12 bp, Homo sapiens
gggaggacaggc

SEQ ID NO: 1502279 - DNA, 23 bp, Homo sapiens
gggaggagcctgtgcgtcccagc

SEQ ID NO: 1502280 - DNA, 13 bp, Homo sapiens
gggaggagcttct

SEQ ID NO: 1502281 - DNA, 13 bp, Homo sapiens
gggaggatacaga

SEQ ID NO: 1502282 - DNA, 19 bp, Homo sapiens
gggaggatcactggagccc

SEQ ID NO: 1502283 - DNA, 18 bp, Homo sapiens
gggaggcaagaggggtgg

SEQ ID NO: 1502284 - DNA, 15 bp, Homo sapiens
gggaggcaccagctc

SEQ ID NO: 1502285 - DNA, 23 bp, Homo sapiens
gggaggcaccagctctgtggcct

SEQ ID NO: 1502286 - DNA, 14 bp, Homo sapiens
gggaggcagcagag

SEQ ID NO: 1502287 - DNA, 21 bp, Homo sapiens
gggaggcaggggtcctgcagg

SEQ ID NO: 1502288 - DNA, 16 bp, Homo sapiens
gggaggccaaggcagg

SEQ ID NO: 1502289 - DNA, 16 bp, Homo sapiens
gggaggccaggcgggc

SEQ ID NO: 1502290 - DNA, 15 bp, Homo sapiens
gggaggccgaggcgg

SEQ ID NO: 1502291 - DNA, 18 bp, Homo sapiens
gggaggccgaggtgggca

SEQ ID NO: 1502292 - DNA, 19 bp, Homo sapiens
gggaggccgaggtgggcag

SEQ ID NO: 1502293 - DNA, 15 bp, Homo sapiens
gggaggctgaggcag

SEQ ID NO: 1502294 - DNA, 16 bp, Homo sapiens
gggaggctgaggcagg

SEQ ID NO: 1502295 - DNA, 19 bp, Homo sapiens
gggaggctgaggcaggaga

SEQ ID NO: 1502296 - DNA, 18 bp, Homo sapiens
gggaggctgaggcggaag

SEQ ID NO: 1502297 - DNA, 13 bp, Homo sapiens
gggagggagctga

SEQ ID NO: 1502298 - DNA, 22 bp, Homo sapiens
gggagggatgaagggcgagtga

SEQ ID NO: 1502299 - DNA, 18 bp, Homo sapiens
gggagggcctgcagtgat

SEQ ID NO: 1502300 - DNA, 20 bp, Homo sapiens
ggtggaggttgcagtgagct

SEQ ID NO: 1502301 - DNA, 14 bp, Homo sapiens
ggtggagtcaggct

SEQ ID NO: 1502302 - DNA, 18 bp, Homo sapiens
ggtggataactagccaga

SEQ ID NO: 1502303 - DNA, 16 bp, Homo sapiens
ggtggatcacaaggtc

SEQ ID NO: 1502304 - DNA, 16 bp, Homo sapiens
ggtggatcacctgagg

SEQ ID NO: 1502305 - DNA, 16 bp, Homo sapiens
ggtggatgacagggca

SEQ ID NO: 1502306 - DNA, 23 bp, Homo sapiens
ggtggattctccctgggcctcag

SEQ ID NO: 1502307 - DNA, 17 bp, Homo sapiens
ggtggcacacgcctgta

SEQ ID NO: 1502308 - DNA, 13 bp, Homo sapiens
ggtggcacctcct

SEQ ID NO: 1502309 - DNA, 15 bp, Homo sapiens
ggtggcactgagccc

SEQ ID NO: 1502310 - DNA, 16 bp, Homo sapiens
ggtggcactgagcccc

SEQ ID NO: 1502311 - DNA, 20 bp, Homo sapiens
ggtggcactgagccccccca

SEQ ID NO: 1502312 - DNA, 14 bp, Homo sapiens
ggtggcaggtcact

SEQ ID NO: 1502313 - DNA, 16 bp, Homo sapiens
ggtggcatgaggaggt

SEQ ID NO: 1502314 - DNA, 23 bp, Homo sapiens
ggtggcatgtgcctatagtccca

SEQ ID NO: 1502315 - DNA, 12 bp, Homo sapiens
ggtggccacagt

SEQ ID NO: 1502316 - DNA, 21 bp, Homo sapiens
ggtggccactccagacccctg

SEQ ID NO: 1502317 - DNA, 14 bp, Homo sapiens
ggtggccaggcagg

SEQ ID NO: 1502318 - DNA, 16 bp, Homo sapiens
ggtggcccgacagcct

SEQ ID NO: 1502319 - DNA, 23 bp, Homo sapiens
ggtggccgcccctgaggcttcac

SEQ ID NO: 1502320 - DNA, 17 bp, Homo sapiens
ggtggcctctgcctggg

SEQ ID NO: 1502321 - DNA, 18 bp, Homo sapiens
ggtggcctggaggtgggc

SEQ ID NO: 1502322 - DNA, 17 bp, Homo sapiens
ggtggcctgttccctag

SEQ ID NO: 1502323 - DNA, 22 bp, Homo sapiens
ggtggcgctttctcctgtgccc

SEQ ID NO: 1502324 - DNA, 19 bp, Homo sapiens
ggtggcgggcacctatagt

SEQ ID NO: 1502325 - DNA, 14 bp, Homo sapiens
ggtggcggtggacc

SEQ ID NO: 1502326 - DNA, 22 bp, Homo sapiens
ggtggcgtctgcctaggagctg

SEQ ID NO: 1502327 - DNA, 15 bp, Homo sapiens
ggtggctagtcagag

SEQ ID NO: 1502328 - DNA, 19 bp, Homo sapiens
ggtggctccccctctgctt
